United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 192

SEQ ID NO: 7990933 - DNA, 22 bp, Homo sapiens
gtggcccaggttggagtgcagt

SEQ ID NO: 7990934 - DNA, 22 bp, Homo sapiens
gtggccccagggccctgtctgg

SEQ ID NO: 7990935 - DNA, 22 bp, Homo sapiens
gtggcccaggcttggcgctggc

SEQ ID NO: 7990936 - DNA, 22 bp, Homo sapiens
gtggcccaggctggagtgcagt

SEQ ID NO: 7990937 - DNA, 22 bp, Homo sapiens
gtggcccaggctggagtgcagt

SEQ ID NO: 7990938 - DNA, 22 bp, Homo sapiens
gtggcccaggcaccctgatgac

SEQ ID NO: 7990939 - DNA, 22 bp, Homo sapiens
gtggcatggagaaggaggcagt

SEQ ID NO: 7990940 - DNA, 22 bp, Homo sapiens
gtggcatgtgcctgtaatctca

SEQ ID NO: 7990941 - DNA, 22 bp, Homo sapiens
gtggcatggccctcattccagt

SEQ ID NO: 7990942 - DNA, 22 bp, Homo sapiens
gtggcatgacagtgaatgggca

SEQ ID NO: 7990943 - DNA, 22 bp, Homo sapiens
gtggcatctcagaggccaagaa

SEQ ID NO: 7990944 - DNA, 22 bp, Homo sapiens
gtggcatctcagaggccaagaa

SEQ ID NO: 7990945 - DNA, 22 bp, Homo sapiens
gtggcattgacagcttcagtgg

SEQ ID NO: 7990946 - DNA, 22 bp, Homo sapiens
gtggcattgacatgtaaacagt

SEQ ID NO: 7990947 - DNA, 22 bp, Homo sapiens
gtggcatcaagatttagattca

SEQ ID NO: 7990948 - DNA, 22 bp, Homo sapiens
gtggcattgacagcttcagtgg

SEQ ID NO: 7990949 - DNA, 22 bp, Homo sapiens
gtggcatttgaacaatcacata

SEQ ID NO: 7990950 - DNA, 22 bp, Homo sapiens
gtggcatttggaaagagcacta

SEQ ID NO: 7990951 - DNA, 22 bp, Homo sapiens
gtggccaaaaggaagaaggtta

SEQ ID NO: 7990952 - DNA, 22 bp, Homo sapiens
gtggccaagaggggactggata

SEQ ID NO: 7990953 - DNA, 22 bp, Homo sapiens
gtggccaaggcagagaaagagc

SEQ ID NO: 7990954 - DNA, 22 bp, Homo sapiens
gtggccaaggtgcagagcagct

SEQ ID NO: 7990955 - DNA, 22 bp, Homo sapiens
gtggccaaggtgcagagcagct

SEQ ID NO: 7990956 - DNA, 22 bp, Homo sapiens
gtggccaataggagcagctatc

SEQ ID NO: 7990957 - DNA, 22 bp, Homo sapiens
gtggccaatttccatctgtaag

SEQ ID NO: 7990958 - DNA, 22 bp, Homo sapiens
gtggcagtgtggagggaggagt

SEQ ID NO: 7990959 - DNA, 22 bp, Homo sapiens
gtggcagttctgtgtctcttgt

SEQ ID NO: 7990960 - DNA, 22 bp, Homo sapiens
gtggcagttgctgtggcaataa

SEQ ID NO: 7990961 - DNA, 22 bp, Homo sapiens
gtggcatcaagatttagattca

SEQ ID NO: 7990962 - DNA, 22 bp, Homo sapiens
gtggcatcgtctgaggtggggt

SEQ ID NO: 7990963 - DNA, 22 bp, Homo sapiens
gtggcatcagagctccctccag

SEQ ID NO: 7990964 - DNA, 22 bp, Homo sapiens
gtggcagtgccgtttggttcag

SEQ ID NO: 7990965 - DNA, 22 bp, Homo sapiens
gtggcagtgccgtttggttcag

SEQ ID NO: 7990966 - DNA, 22 bp, Homo sapiens
gtggcagtgtggagggaggagt

SEQ ID NO: 7990967 - DNA, 22 bp, Homo sapiens
gtggcagtgtgaggatcctgct

SEQ ID NO: 7990968 - DNA, 20 bp, Homo sapiens
gtggcagtggtggcagcagt

SEQ ID NO: 7990969 - DNA, 20 bp, Homo sapiens
gtggcagtggtggcagcagt

SEQ ID NO: 7990970 - DNA, 20 bp, Homo sapiens
gtggcagtggtggcagcagt

SEQ ID NO: 7990971 - DNA, 22 bp, Homo sapiens
gtggcagggtgctcatcatgca

SEQ ID NO: 7990972 - DNA, 22 bp, Homo sapiens
gtggcagggtgctcatcatgca

SEQ ID NO: 7990973 - DNA, 22 bp, Homo sapiens
gtggcagggtgctcatcatgca

SEQ ID NO: 7990974 - DNA, 22 bp, Homo sapiens
gtggcaggggtattccagctga

SEQ ID NO: 7990975 - DNA, 22 bp, Homo sapiens
gtggcagggtgctcatcatgca

SEQ ID NO: 7990976 - DNA, 22 bp, Homo sapiens
gtggcagggtgctcatcatgca

SEQ ID NO: 7990977 - DNA, 22 bp, Homo sapiens
gtggcaggggtattccagctga

SEQ ID NO: 7990978 - DNA, 22 bp, Homo sapiens
gtggcaggggcgggctgttccg

SEQ ID NO: 7990979 - DNA, 22 bp, Homo sapiens
gtggcaggggcgggctgttccg

SEQ ID NO: 7990980 - DNA, 22 bp, Homo sapiens
gtggcaggggtattccagctga

SEQ ID NO: 7990981 - DNA, 22 bp, Homo sapiens
gtggcaggggcgggctgttccg

SEQ ID NO: 7990982 - DNA, 22 bp, Homo sapiens
gtggcaggggcgggctgttccg

SEQ ID NO: 7990983 - DNA, 22 bp, Homo sapiens
gtggcaggggcgggctgttccg

SEQ ID NO: 7990984 - DNA, 22 bp, Homo sapiens
gtggcaggggtattccagctga

SEQ ID NO: 7990985 - DNA, 22 bp, Homo sapiens
gtggcaggggtattccagctga

SEQ ID NO: 7990986 - DNA, 22 bp, Homo sapiens
gtggcaggggtattccagctga

SEQ ID NO: 7990987 - DNA, 22 bp, Homo sapiens
gtggcaggggtattccagctga

SEQ ID NO: 7990988 - DNA, 22 bp, Homo sapiens
gtggcaggggtattccagctga

SEQ ID NO: 7990989 - DNA, 22 bp, Homo sapiens
gtggcagggcaatgctccctct

SEQ ID NO: 7990990 - DNA, 22 bp, Homo sapiens
gtggcagggctttgctgttctt

SEQ ID NO: 7990991 - DNA, 20 bp, Homo sapiens
gtggcaggcagtgaaggagc

SEQ ID NO: 7990992 - DNA, 22 bp, Homo sapiens
gtggcagggcaatgctccctct

SEQ ID NO: 7990993 - DNA, 22 bp, Homo sapiens
gtggcagggctttgctgttctt

SEQ ID NO: 7990994 - DNA, 22 bp, Homo sapiens
gtggcaggggcgggctgttccg

SEQ ID NO: 7990995 - DNA, 22 bp, Homo sapiens
gtggcagggctttgctgttctt

SEQ ID NO: 7990996 - DNA, 22 bp, Homo sapiens
gtggcagggctttgctgttctt

SEQ ID NO: 7990997 - DNA, 22 bp, Homo sapiens
gtggcagggctttgctgttctt

SEQ ID NO: 7990998 - DNA, 22 bp, Homo sapiens
gtggcagggctttgctgttctt

SEQ ID NO: 7990999 - DNA, 22 bp, Homo sapiens
gtggcagggcaatgctccctct

SEQ ID NO: 7991000 - DNA, 22 bp, Homo sapiens
gtggcagggagaagccattggg

SEQ ID NO: 7991001 - DNA, 22 bp, Homo sapiens
gtggcagggagaagccattggg

SEQ ID NO: 7991002 - DNA, 22 bp, Homo sapiens
gtggcagggcaatgctccctct

SEQ ID NO: 7991003 - DNA, 22 bp, Homo sapiens
gtggcagggcaatgctccctct

SEQ ID NO: 7991004 - DNA, 22 bp, Homo sapiens
gtggcagggcaatgctccctct

SEQ ID NO: 7991005 - DNA, 22 bp, Homo sapiens
gtggcagggcaatgctccctct

SEQ ID NO: 7991006 - DNA, 22 bp, Homo sapiens
gtggcagggagaagccattggg

SEQ ID NO: 7991007 - DNA, 20 bp, Homo sapiens
gtggcaggcagtgaaggagc

SEQ ID NO: 7991008 - DNA, 22 bp, Homo sapiens
gtggcagggagaagccattggg

SEQ ID NO: 7991009 - DNA, 22 bp, Homo sapiens
gtggcagggagaagccattggg

SEQ ID NO: 7991010 - DNA, 22 bp, Homo sapiens
gtggcagggagaagccattggg

SEQ ID NO: 7991011 - DNA, 22 bp, Homo sapiens
gtggcaggatcacggctcactg

SEQ ID NO: 7991012 - DNA, 22 bp, Homo sapiens
gtggcaggatcacggctcactg

SEQ ID NO: 7991013 - DNA, 22 bp, Homo sapiens
gtggcaggatcacggctcactg

SEQ ID NO: 7991014 - DNA, 20 bp, Homo sapiens
gtggcaggcagtgaaggagc

SEQ ID NO: 7991015 - DNA, 22 bp, Homo sapiens
gtggcaggatcacggctcactg

SEQ ID NO: 7991016 - DNA, 22 bp, Homo sapiens
gtggcaggatcacggctcactg

SEQ ID NO: 7991017 - DNA, 20 bp, Homo sapiens
gtggcaggcagtgaaggagc

SEQ ID NO: 7991018 - DNA, 20 bp, Homo sapiens
gtggcaggcagtgaaggagc

SEQ ID NO: 7991019 - DNA, 20 bp, Homo sapiens
gtggcaggcagtgaaggagc

SEQ ID NO: 7991020 - DNA, 20 bp, Homo sapiens
gtggcaggcagtgaaggagc

SEQ ID NO: 7991021 - DNA, 20 bp, Homo sapiens
gtggcaggcagtgaaggagc

SEQ ID NO: 7991022 - DNA, 20 bp, Homo sapiens
gtggcaggcagtgaaggagc

SEQ ID NO: 7991023 - DNA, 20 bp, Homo sapiens
gtggcaggcagtgaaggagc

SEQ ID NO: 7991024 - DNA, 22 bp, Homo sapiens
gtggcaggagactggaagatgg

SEQ ID NO: 7991025 - DNA, 22 bp, Homo sapiens
gtggcaggagactggaagatgg

SEQ ID NO: 7991026 - DNA, 22 bp, Homo sapiens
gtggcaggagagacacagccat

SEQ ID NO: 7991027 - DNA, 22 bp, Homo sapiens
gtggcagctgtgttgcagtttt

SEQ ID NO: 7991028 - DNA, 22 bp, Homo sapiens
gtggcagctgtgttgcagtttt

SEQ ID NO: 7991029 - DNA, 22 bp, Homo sapiens
gtggcagctgtgttgcagtttt

SEQ ID NO: 7991030 - DNA, 22 bp, Homo sapiens
gtggcaggagactggaagatgg

SEQ ID NO: 7991031 - DNA, 22 bp, Homo sapiens
gtggcagctgtgttgcagtttt

SEQ ID NO: 7991032 - DNA, 22 bp, Homo sapiens
gtggcagctggtatgcagacag

SEQ ID NO: 7991033 - DNA, 22 bp, Homo sapiens
gtggcagctctcttgatttccc

SEQ ID NO: 7991034 - DNA, 22 bp, Homo sapiens
gtggcagctggtatgcagacag

SEQ ID NO: 7991035 - DNA, 22 bp, Homo sapiens
gtggcagctgtgggacactggt

SEQ ID NO: 7991036 - DNA, 22 bp, Homo sapiens
gtggcagctggtatgcagacag

SEQ ID NO: 7991037 - DNA, 22 bp, Homo sapiens
gtggcagctgtgggacactggt

SEQ ID NO: 7991038 - DNA, 22 bp, Homo sapiens
gtggcaggagagacacagccat

SEQ ID NO: 7991039 - DNA, 22 bp, Homo sapiens
gtggcaggagagacacagccat

SEQ ID NO: 7991040 - DNA, 22 bp, Homo sapiens
gtggcaggagagacacagccat

SEQ ID NO: 7991041 - DNA, 22 bp, Homo sapiens
gtggcaggagagacacagccat

SEQ ID NO: 7991042 - DNA, 22 bp, Homo sapiens
gtggcaggagagacacagccat

SEQ ID NO: 7991043 - DNA, 22 bp, Homo sapiens
gtggcaggagagacacagccat

SEQ ID NO: 7991044 - DNA, 22 bp, Homo sapiens
gtggcaggagagacacagccat

SEQ ID NO: 7991045 - DNA, 22 bp, Homo sapiens
gtggcaggagggcatcacttgg

SEQ ID NO: 7991046 - DNA, 22 bp, Homo sapiens
gtggcaggagagacacagccat

SEQ ID NO: 7991047 - DNA, 22 bp, Homo sapiens
gtggcaggagtgggccttgaag

SEQ ID NO: 7991048 - DNA, 22 bp, Homo sapiens
gtggcaggagtgggccttgaag

SEQ ID NO: 7991049 - DNA, 22 bp, Homo sapiens
gtggcaggagtgggccttgaag

SEQ ID NO: 7991050 - DNA, 22 bp, Homo sapiens
gtggcaggatcacggctcactg

SEQ ID NO: 7991051 - DNA, 22 bp, Homo sapiens
gtggcaggagtgggccttgaag

SEQ ID NO: 7991052 - DNA, 22 bp, Homo sapiens
gtggcaggagtgggccttgaag

SEQ ID NO: 7991053 - DNA, 22 bp, Homo sapiens
gtggcaggatcacggctcactg

SEQ ID NO: 7991054 - DNA, 22 bp, Homo sapiens
gtggcaggatcacggctcactg

SEQ ID NO: 7991055 - DNA, 22 bp, Homo sapiens
gtggcaggagtgggccttgaag

SEQ ID NO: 7991056 - DNA, 22 bp, Homo sapiens
gtgggagaaattagctctagtt

SEQ ID NO: 7991057 - DNA, 22 bp, Homo sapiens
gtgggagaaattagctctagtt

SEQ ID NO: 7991058 - DNA, 22 bp, Homo sapiens
gtgggagaaattagctctagtt

SEQ ID NO: 7991059 - DNA, 22 bp, Homo sapiens
gtgggagaaattagctctagtt

SEQ ID NO: 7991060 - DNA, 22 bp, Homo sapiens
gtgggagaagatttggtcatct

SEQ ID NO: 7991061 - DNA, 22 bp, Homo sapiens
gtgggagaagatttggtcatct

SEQ ID NO: 7991062 - DNA, 22 bp, Homo sapiens
gtggcttcatcaactgtgctta

SEQ ID NO: 7991063 - DNA, 22 bp, Homo sapiens
gtggcttccaagactaagtcac

SEQ ID NO: 7991064 - DNA, 22 bp, Homo sapiens
gtggcttccatgtgcatctgac

SEQ ID NO: 7991065 - DNA, 22 bp, Homo sapiens
gtgggagaaattagctctagtt

SEQ ID NO: 7991066 - DNA, 22 bp, Homo sapiens
gtgggagcatggtcccagtgcc

SEQ ID NO: 7991067 - DNA, 22 bp, Homo sapiens
gtgggagcatggtcccagtgcc

SEQ ID NO: 7991068 - DNA, 22 bp, Homo sapiens
gtgggagagaccccgcttaggg

SEQ ID NO: 7991069 - DNA, 22 bp, Homo sapiens
gtgggagaagatttggtcatct

SEQ ID NO: 7991070 - DNA, 22 bp, Homo sapiens
gtgggagaagatttggtcatct

SEQ ID NO: 7991071 - DNA, 22 bp, Homo sapiens
gtgggagccctcagggaggtgc

SEQ ID NO: 7991072 - DNA, 22 bp, Homo sapiens
gtgggagccctcagggaggtgc

SEQ ID NO: 7991073 - DNA, 22 bp, Homo sapiens
gtgggagccctcagggaggtgc

SEQ ID NO: 7991074 - DNA, 22 bp, Homo sapiens
gtgggagccctcagggaggtgc

SEQ ID NO: 7991075 - DNA, 22 bp, Homo sapiens
gtgggagctttggcatcaggct

SEQ ID NO: 7991076 - DNA, 22 bp, Homo sapiens
gtgggagctttggcatcaggct

SEQ ID NO: 7991077 - DNA, 22 bp, Homo sapiens
gtgggagctttggcatcaggct

SEQ ID NO: 7991078 - DNA, 22 bp, Homo sapiens
gtgggagctttggcatcaggct

SEQ ID NO: 7991079 - DNA, 22 bp, Homo sapiens
gtgggagtggggaagcagagtg

SEQ ID NO: 7991080 - DNA, 22 bp, Homo sapiens
gtgggagtggggaagcagagtg

SEQ ID NO: 7991081 - DNA, 22 bp, Homo sapiens
gtgggatgcagtggtgagtggc

SEQ ID NO: 7991082 - DNA, 22 bp, Homo sapiens
gtgggagctgctacctccttcc

SEQ ID NO: 7991083 - DNA, 22 bp, Homo sapiens
gtgggagctgctacctccttcc

SEQ ID NO: 7991084 - DNA, 22 bp, Homo sapiens
gtgggagctgctacctccttcc

SEQ ID NO: 7991085 - DNA, 22 bp, Homo sapiens
gtgggagctttggcatcaggct

SEQ ID NO: 7991086 - DNA, 22 bp, Homo sapiens
gtgggagctttggcatcaggct

SEQ ID NO: 7991087 - DNA, 22 bp, Homo sapiens
gtgggagcttcatcaagcagtt

SEQ ID NO: 7991088 - DNA, 22 bp, Homo sapiens
gtgggagctgcggaggcctggg

SEQ ID NO: 7991089 - DNA, 22 bp, Homo sapiens
gtgggagctgcggaggcctggg

SEQ ID NO: 7991090 - DNA, 22 bp, Homo sapiens
gtgggagctgcggaggcctggg

SEQ ID NO: 7991091 - DNA, 22 bp, Homo sapiens
gtgggagctgcggaggcctggg

SEQ ID NO: 7991092 - DNA, 22 bp, Homo sapiens
gtgggagctgcggaggcctggg

SEQ ID NO: 7991093 - DNA, 22 bp, Homo sapiens
gtgggagctgcggaggcctggg

SEQ ID NO: 7991094 - DNA, 22 bp, Homo sapiens
gtgggagctgcggaggcctggg

SEQ ID NO: 7991095 - DNA, 22 bp, Homo sapiens
gtggctggtttcctgcatgcaa

SEQ ID NO: 7991096 - DNA, 22 bp, Homo sapiens
gtggctggtttcctgcatgcaa

SEQ ID NO: 7991097 - DNA, 22 bp, Homo sapiens
gtggctggtttcctgcatgcaa

SEQ ID NO: 7991098 - DNA, 22 bp, Homo sapiens
gtggctggtttcctgcatgcaa

SEQ ID NO: 7991099 - DNA, 22 bp, Homo sapiens
gtggctggtttcctgcatgcaa

SEQ ID NO: 7991100 - DNA, 22 bp, Homo sapiens
gtggctggtttcctgcatgcaa

SEQ ID NO: 7991101 - DNA, 22 bp, Homo sapiens
gtggctggtttcctgcatgcaa

SEQ ID NO: 7991102 - DNA, 22 bp, Homo sapiens
gtggctggtttcctgcatgcaa

SEQ ID NO: 7991103 - DNA, 22 bp, Homo sapiens
gtggcttcaccccagttgtctc

SEQ ID NO: 7991104 - DNA, 22 bp, Homo sapiens
gtggctgtatagccaagtcaga

SEQ ID NO: 7991105 - DNA, 22 bp, Homo sapiens
gtggctgttcttgccccatgct

SEQ ID NO: 7991106 - DNA, 22 bp, Homo sapiens
gtggctgttcttgccccatgct

SEQ ID NO: 7991107 - DNA, 22 bp, Homo sapiens
gtggctggtttcctgcatgcaa

SEQ ID NO: 7991108 - DNA, 22 bp, Homo sapiens
gtggctggtttcctgcatgcaa

SEQ ID NO: 7991109 - DNA, 22 bp, Homo sapiens
gtggctgctgtcctctctggtt

SEQ ID NO: 7991110 - DNA, 22 bp, Homo sapiens
gtggctggagtatgaggaaagg

SEQ ID NO: 7991111 - DNA, 22 bp, Homo sapiens
gtggctggagtatgaggaaagg

SEQ ID NO: 7991112 - DNA, 22 bp, Homo sapiens
gtggctgctgtcctctctggtt

SEQ ID NO: 7991113 - DNA, 22 bp, Homo sapiens
gtggctggccctggaccctaag

SEQ ID NO: 7991114 - DNA, 22 bp, Homo sapiens
gtggctggccctggaccctaag

SEQ ID NO: 7991115 - DNA, 22 bp, Homo sapiens
gtggctggagtatgaggaaagg

SEQ ID NO: 7991116 - DNA, 22 bp, Homo sapiens
gtggctggagtatgaggaaagg

SEQ ID NO: 7991117 - DNA, 22 bp, Homo sapiens
gtggctgggctccgagcggctt

SEQ ID NO: 7991118 - DNA, 22 bp, Homo sapiens
gtggctgggctccgagcggctt

SEQ ID NO: 7991119 - DNA, 22 bp, Homo sapiens
gtggctgggctccgagcggctt

SEQ ID NO: 7991120 - DNA, 22 bp, Homo sapiens
gtggctgggctccgagcggctt

SEQ ID NO: 7991121 - DNA, 22 bp, Homo sapiens
gtggctgggctccgagcggctt

SEQ ID NO: 7991122 - DNA, 22 bp, Homo sapiens
gtggctgggctccgagcggctt

SEQ ID NO: 7991123 - DNA, 22 bp, Homo sapiens
gtggctgggctccgagcggctt

SEQ ID NO: 7991124 - DNA, 22 bp, Homo sapiens
gtggctgctcgggctccggccc

SEQ ID NO: 7991125 - DNA, 22 bp, Homo sapiens
gtggctgctacagagctggagg

SEQ ID NO: 7991126 - DNA, 22 bp, Homo sapiens
gtggctgctaagtctccttcct

SEQ ID NO: 7991127 - DNA, 22 bp, Homo sapiens
gtggctgctaagtctccttcct

SEQ ID NO: 7991128 - DNA, 22 bp, Homo sapiens
gtggctgctaagtctccttcct

SEQ ID NO: 7991129 - DNA, 19 bp, Homo sapiens
gtggctgccgatcgcggct

SEQ ID NO: 7991130 - DNA, 22 bp, Homo sapiens
gtggctgctaagtctccttcct

SEQ ID NO: 7991131 - DNA, 22 bp, Homo sapiens
gtggctgctgtcctctctggtt

SEQ ID NO: 7991132 - DNA, 22 bp, Homo sapiens
gtggctgctgtcctctctggtt

SEQ ID NO: 7991133 - DNA, 22 bp, Homo sapiens
gtggctgctgtcctctctggtt

SEQ ID NO: 7991134 - DNA, 22 bp, Homo sapiens
gtggctgctggtactctgggaa

SEQ ID NO: 7991135 - DNA, 22 bp, Homo sapiens
gtggctgctggtactctgggaa

SEQ ID NO: 7991136 - DNA, 22 bp, Homo sapiens
gtggctgctggtactctgggaa

SEQ ID NO: 7991137 - DNA, 22 bp, Homo sapiens
gtggctgctcgggctccggccc

SEQ ID NO: 7991138 - DNA, 22 bp, Homo sapiens
gtggctgctcgggctccggccc

SEQ ID NO: 7991139 - DNA, 22 bp, Homo sapiens
gtggctgcatcggggtgaccag

SEQ ID NO: 7991140 - DNA, 22 bp, Homo sapiens
gtggctgcagtagtgtagggtc

SEQ ID NO: 7991141 - DNA, 22 bp, Homo sapiens
gtggctgcagcggctgtggaga

SEQ ID NO: 7991142 - DNA, 22 bp, Homo sapiens
gtggctgcagcggctgtggaga

SEQ ID NO: 7991143 - DNA, 22 bp, Homo sapiens
gtggctgcagcccagcggcacg

SEQ ID NO: 7991144 - DNA, 22 bp, Homo sapiens
gtggcctgccagcagatggcgc

SEQ ID NO: 7991145 - DNA, 22 bp, Homo sapiens
gtggcctgccagcagatggcgc

SEQ ID NO: 7991146 - DNA, 22 bp, Homo sapiens
gtggcctgcaggcaccttgggg

SEQ ID NO: 7991147 - DNA, 22 bp, Homo sapiens
gtggcctgcaggcaccttgggg

SEQ ID NO: 7991148 - DNA, 22 bp, Homo sapiens
gtggcctgcaggcaccttgggg

SEQ ID NO: 7991149 - DNA, 22 bp, Homo sapiens
gtggcctgatgccagccctgtg

SEQ ID NO: 7991150 - DNA, 22 bp, Homo sapiens
gtggcctgatgccagccctgtg

SEQ ID NO: 7991151 - DNA, 22 bp, Homo sapiens
gtggcctctgttggctcctagg

SEQ ID NO: 7991152 - DNA, 22 bp, Homo sapiens
gtggcctgagcttcagagttgg

SEQ ID NO: 7991153 - DNA, 21 bp, Homo sapiens
gtggcctgattatgaatgggt

SEQ ID NO: 7991154 - DNA, 22 bp, Homo sapiens
gtggcctgatgccagccctgtg

SEQ ID NO: 7991155 - DNA, 21 bp, Homo sapiens
gtggcctgattatgaatgggt

SEQ ID NO: 7991156 - DNA, 22 bp, Homo sapiens
gtggcctgatgccagccctgtg

SEQ ID NO: 7991157 - DNA, 22 bp, Homo sapiens
gtggcctgccgtgtggtatggg

SEQ ID NO: 7991158 - DNA, 19 bp, Homo sapiens
gtggcctgcgctgggtgcg

SEQ ID NO: 7991159 - DNA, 19 bp, Homo sapiens
gtggcctgcgctgggtgcg

SEQ ID NO: 7991160 - DNA, 22 bp, Homo sapiens
gtggcctggaaaggctggtctg

SEQ ID NO: 7991161 - DNA, 22 bp, Homo sapiens
gtggcctggatagactccatct

SEQ ID NO: 7991162 - DNA, 22 bp, Homo sapiens
gtggcctggatagactccatct

SEQ ID NO: 7991163 - DNA, 22 bp, Homo sapiens
gtggcctggaaaggctggtctg

SEQ ID NO: 7991164 - DNA, 22 bp, Homo sapiens
gtggcctggaaaggctggtctg

SEQ ID NO: 7991165 - DNA, 22 bp, Homo sapiens
gtggcctggaaaggctggtctg

SEQ ID NO: 7991166 - DNA, 20 bp, Homo sapiens
gtggcccttaaagagggaag

SEQ ID NO: 7991167 - DNA, 22 bp, Homo sapiens
gtggccctgtgaacagcgcagt

SEQ ID NO: 7991168 - DNA, 22 bp, Homo sapiens
gtggccctgtgaacagcgcagt

SEQ ID NO: 7991169 - DNA, 22 bp, Homo sapiens
gtggcccttggagttgtgacct

SEQ ID NO: 7991170 - DNA, 22 bp, Homo sapiens
gtggcccttggagttgtgacct

SEQ ID NO: 7991171 - DNA, 22 bp, Homo sapiens
gtggcccttgaagcagcttcat

SEQ ID NO: 7991172 - DNA, 22 bp, Homo sapiens
gtggcccttgaagcagcttcat

SEQ ID NO: 7991173 - DNA, 22 bp, Homo sapiens
gtggcccttgaagcagcttcat

SEQ ID NO: 7991174 - DNA, 21 bp, Homo sapiens
gtggccctggtgtggctgcac

SEQ ID NO: 7991175 - DNA, 22 bp, Homo sapiens
gtggccctggagttgtgacact

SEQ ID NO: 7991176 - DNA, 21 bp, Homo sapiens
gtggccctggtgtggctgcac

SEQ ID NO: 7991177 - DNA, 22 bp, Homo sapiens
gtggccctggagttgtgacact

SEQ ID NO: 7991178 - DNA, 22 bp, Homo sapiens
gtggccctgtcccaggcctcct

SEQ ID NO: 7991179 - DNA, 21 bp, Homo sapiens
gtggccctggtgtggctgcac

SEQ ID NO: 7991180 - DNA, 22 bp, Homo sapiens
gtggccctgtcccaggcctcct

SEQ ID NO: 7991181 - DNA, 22 bp, Homo sapiens
gtggccctgtgaacagcgcagt

SEQ ID NO: 7991182 - DNA, 22 bp, Homo sapiens
gtggccctgtgaacagcgcagt

SEQ ID NO: 7991183 - DNA, 23 bp, Homo sapiens
gtggcctccccggaatgcctcgc

SEQ ID NO: 7991184 - DNA, 22 bp, Homo sapiens
gtggcctcctccgtccgcctct

SEQ ID NO: 7991185 - DNA, 22 bp, Homo sapiens
gtggcctcctccgtccgcctct

SEQ ID NO: 7991186 - DNA, 22 bp, Homo sapiens
gtggccctttgttttgatacct

SEQ ID NO: 7991187 - DNA, 22 bp, Homo sapiens
gtggcctagaggtgcaaggaac

SEQ ID NO: 7991188 - DNA, 22 bp, Homo sapiens
gtggccgccaggtcctcgtcca

SEQ ID NO: 7991189 - DNA, 22 bp, Homo sapiens
gtggcctctgttggctcctagg

SEQ ID NO: 7991190 - DNA, 22 bp, Homo sapiens
gtggcctctgtgctcctgccta

SEQ ID NO: 7991191 - DNA, 20 bp, Homo sapiens
gtggcctctcacattctgag

SEQ ID NO: 7991192 - DNA, 22 bp, Homo sapiens
gtggctctccattgacatggaa

SEQ ID NO: 7991193 - DNA, 22 bp, Homo sapiens
gtggctctccattgacatggaa

SEQ ID NO: 7991194 - DNA, 22 bp, Homo sapiens
gtggctctccattgacatggaa

SEQ ID NO: 7991195 - DNA, 22 bp, Homo sapiens
gtggctctccattgacatggaa

SEQ ID NO: 7991196 - DNA, 22 bp, Homo sapiens
gtggctctccattgacatggaa

SEQ ID NO: 7991197 - DNA, 22 bp, Homo sapiens
gtggctctcgccagcctgcggg

SEQ ID NO: 7991198 - DNA, 22 bp, Homo sapiens
gtggctctctggtcccctgcca

SEQ ID NO: 7991199 - DNA, 22 bp, Homo sapiens
gtggctctgtaaaatgcctgca

SEQ ID NO: 7991200 - DNA, 22 bp, Homo sapiens
gtggctcttgcatggggtctct

SEQ ID NO: 7991201 - DNA, 22 bp, Homo sapiens
gtggctctgtaaaatgcctgca

SEQ ID NO: 7991202 - DNA, 22 bp, Homo sapiens
gtggctctggctttccaggcgg

SEQ ID NO: 7991203 - DNA, 21 bp, Homo sapiens
gtggctctgccaggactgaaa

SEQ ID NO: 7991204 - DNA, 22 bp, Homo sapiens
gtggctcttgcatggggtctct

SEQ ID NO: 7991205 - DNA, 22 bp, Homo sapiens
gtggctcttgcatggggtctct

SEQ ID NO: 7991206 - DNA, 22 bp, Homo sapiens
gtggctctttatgtgttattgg

SEQ ID NO: 7991207 - DNA, 22 bp, Homo sapiens
gtggctcttgcatggggtctct

SEQ ID NO: 7991208 - DNA, 22 bp, Homo sapiens
gtggctgacaaccactggagga

SEQ ID NO: 7991209 - DNA, 22 bp, Homo sapiens
gtggctgacaaccactggagga

SEQ ID NO: 7991210 - DNA, 22 bp, Homo sapiens
gtggctgagcagcagagagctg

SEQ ID NO: 7991211 - DNA, 22 bp, Homo sapiens
gtggctgagcagcagagagctg

SEQ ID NO: 7991212 - DNA, 22 bp, Homo sapiens
gtggctgcagagggcacagcat

SEQ ID NO: 7991213 - DNA, 22 bp, Homo sapiens
gtggctgcagagccagcaagct

SEQ ID NO: 7991214 - DNA, 17 bp, Homo sapiens
gtggctgcacacacatg

SEQ ID NO: 7991215 - DNA, 22 bp, Homo sapiens
gtggctgcagagccagcaagct

SEQ ID NO: 7991216 - DNA, 17 bp, Homo sapiens
gtggctgcacacacatg

SEQ ID NO: 7991217 - DNA, 22 bp, Homo sapiens
gtggctctaggtgagcatggag

SEQ ID NO: 7991218 - DNA, 22 bp, Homo sapiens
gtggctctaggtgagcatggag

SEQ ID NO: 7991219 - DNA, 22 bp, Homo sapiens
gtggctctaggtgagcatggag

SEQ ID NO: 7991220 - DNA, 22 bp, Homo sapiens
gtggctctaggtgagcatggag

SEQ ID NO: 7991221 - DNA, 22 bp, Homo sapiens
gtggctccgcaggctccattct

SEQ ID NO: 7991222 - DNA, 22 bp, Homo sapiens
gtggctccgcaggctccattct

SEQ ID NO: 7991223 - DNA, 19 bp, Homo sapiens
gtggctcatgtagtgggcc

SEQ ID NO: 7991224 - DNA, 22 bp, Homo sapiens
gtggctccttttcaggaggctg

SEQ ID NO: 7991225 - DNA, 22 bp, Homo sapiens
gtggctccttttcaggaggctg

SEQ ID NO: 7991226 - DNA, 22 bp, Homo sapiens
gtggctccgcaggctccattct

SEQ ID NO: 7991227 - DNA, 22 bp, Homo sapiens
gtggctccttttcaggaggctg

SEQ ID NO: 7991228 - DNA, 22 bp, Homo sapiens
gtggctcatctttgggaagtaa

SEQ ID NO: 7991229 - DNA, 19 bp, Homo sapiens
gtggctcatgtagtgggcc

SEQ ID NO: 7991230 - DNA, 22 bp, Homo sapiens
gtggctcagttaacttccatgt

SEQ ID NO: 7991231 - DNA, 22 bp, Homo sapiens
gtggctcatctttgggaagtaa

SEQ ID NO: 7991232 - DNA, 22 bp, Homo sapiens
gtggctcatctttgggaagtaa

SEQ ID NO: 7991233 - DNA, 22 bp, Homo sapiens
gtggctcagcggagctctgcac

SEQ ID NO: 7991234 - DNA, 22 bp, Homo sapiens
gtggctcagcggagctctgcac

SEQ ID NO: 7991235 - DNA, 22 bp, Homo sapiens
gtggctcagcggagctctgcac

SEQ ID NO: 7991236 - DNA, 22 bp, Homo sapiens
gtggctcagcggagctctgcac

SEQ ID NO: 7991237 - DNA, 22 bp, Homo sapiens
gtggctcagttaacttccatgt

SEQ ID NO: 7991238 - DNA, 22 bp, Homo sapiens
gtggctcagttaacttccatgt

SEQ ID NO: 7991239 - DNA, 22 bp, Homo sapiens
gtggcctggcgagctggcgcgg

SEQ ID NO: 7991240 - DNA, 22 bp, Homo sapiens
gtggcctggctggcaccacctc

SEQ ID NO: 7991241 - DNA, 22 bp, Homo sapiens
gtggcctggcgagctggcgcgg

SEQ ID NO: 7991242 - DNA, 22 bp, Homo sapiens
gtggcctggggtttgttctgag

SEQ ID NO: 7991243 - DNA, 22 bp, Homo sapiens
gtggctcagcggagctctgcac

SEQ ID NO: 7991244 - DNA, 22 bp, Homo sapiens
gtggcctggatgagcttcgaca

SEQ ID NO: 7991245 - DNA, 22 bp, Homo sapiens
gtggcctggcgagctggcgcgg

SEQ ID NO: 7991246 - DNA, 22 bp, Homo sapiens
gtggcctggatagactccatct

SEQ ID NO: 7991247 - DNA, 22 bp, Homo sapiens
gtggcctggcgagctggcgcgg

SEQ ID NO: 7991248 - DNA, 22 bp, Homo sapiens
gtggcctggcgagctggcgcgg

SEQ ID NO: 7991249 - DNA, 22 bp, Homo sapiens
gtggcctggcgagctggcgcgg

SEQ ID NO: 7991250 - DNA, 22 bp, Homo sapiens
gtggcctggcgagctggcgcgg

SEQ ID NO: 7991251 - DNA, 22 bp, Homo sapiens
gtggaggaaaagaagttgggtg

SEQ ID NO: 7991252 - DNA, 22 bp, Homo sapiens
gtggagctggcccaagaagctg

SEQ ID NO: 7991253 - DNA, 22 bp, Homo sapiens
gtggaggaaaagaagttgggtg

SEQ ID NO: 7991254 - DNA, 22 bp, Homo sapiens
gtggagccctggtagggacccc

SEQ ID NO: 7991255 - DNA, 22 bp, Homo sapiens
gtggagctggacccaggcctct

SEQ ID NO: 7991256 - DNA, 19 bp, Homo sapiens
gtggagctaagaaaaggaa

SEQ ID NO: 7991257 - DNA, 22 bp, Homo sapiens
gtggaggacaaaagaagccttt

SEQ ID NO: 7991258 - DNA, 22 bp, Homo sapiens
gtggaggacaaaagaagccttt

SEQ ID NO: 7991259 - DNA, 22 bp, Homo sapiens
gtggaggaaaagaagttgggtg

SEQ ID NO: 7991260 - DNA, 22 bp, Homo sapiens
gtggaggaagggattcagacca

SEQ ID NO: 7991261 - DNA, 22 bp, Homo sapiens
gtggaggacaaaagaagccttt

SEQ ID NO: 7991262 - DNA, 22 bp, Homo sapiens
gtggaggaagggattcagacca

SEQ ID NO: 7991263 - DNA, 22 bp, Homo sapiens
gtggagaggaacccagctctgt

SEQ ID NO: 7991264 - DNA, 22 bp, Homo sapiens
gtggagaggaacccagctctgt

SEQ ID NO: 7991265 - DNA, 22 bp, Homo sapiens
gtggagaggaacccagctctgt

SEQ ID NO: 7991266 - DNA, 22 bp, Homo sapiens
gtggagaggaacccagctctgt

SEQ ID NO: 7991267 - DNA, 22 bp, Homo sapiens
gtggagccctggtagggacccc

SEQ ID NO: 7991268 - DNA, 22 bp, Homo sapiens
gtggagccctgccttgctcatg

SEQ ID NO: 7991269 - DNA, 22 bp, Homo sapiens
gtggagagcaaataattggaat

SEQ ID NO: 7991270 - DNA, 23 bp, Homo sapiens
gtggagagattagtaattcaccc

SEQ ID NO: 7991271 - DNA, 22 bp, Homo sapiens
gtggagagagtgacagcatctt

SEQ ID NO: 7991272 - DNA, 22 bp, Homo sapiens
gtggagagagtgacagcatctt

SEQ ID NO: 7991273 - DNA, 22 bp, Homo sapiens
gtggagagagtgacagcatctt

SEQ ID NO: 7991274 - DNA, 22 bp, Homo sapiens
gtggagagagtgacagcatctt

SEQ ID NO: 7991275 - DNA, 22 bp, Homo sapiens
gtggagagagataagcctggtc

SEQ ID NO: 7991276 - DNA, 22 bp, Homo sapiens
gtggagagagataagcctggtc

SEQ ID NO: 7991277 - DNA, 22 bp, Homo sapiens
gtggagagagataagcctggtc

SEQ ID NO: 7991278 - DNA, 22 bp, Homo sapiens
gtggagagagataagcctggtc

SEQ ID NO: 7991279 - DNA, 22 bp, Homo sapiens
gtggagagagataagcctggtc

SEQ ID NO: 7991280 - DNA, 22 bp, Homo sapiens
gtggagagagataagcctggtc

SEQ ID NO: 7991281 - DNA, 22 bp, Homo sapiens
gtggacttgctgtcctggactt

SEQ ID NO: 7991282 - DNA, 22 bp, Homo sapiens
gtggacatgcatacatatgttt

SEQ ID NO: 7991283 - DNA, 22 bp, Homo sapiens
gtggacagcttctaggtgccag

SEQ ID NO: 7991284 - DNA, 22 bp, Homo sapiens
gtggacagcttctaggtgccag

SEQ ID NO: 7991285 - DNA, 22 bp, Homo sapiens
gtggacagcttctaggtgccag

SEQ ID NO: 7991286 - DNA, 22 bp, Homo sapiens
gtggacagcttctaggtgccag

SEQ ID NO: 7991287 - DNA, 22 bp, Homo sapiens
gtggacagcttctaggtgccag

SEQ ID NO: 7991288 - DNA, 22 bp, Homo sapiens
gtggacagcttctaggtgccag

SEQ ID NO: 7991289 - DNA, 22 bp, Homo sapiens
gtggaattgctggataatatca

SEQ ID NO: 7991290 - DNA, 22 bp, Homo sapiens
gtggacagagactaaatgttgt

SEQ ID NO: 7991291 - DNA, 22 bp, Homo sapiens
gtggacactggcagcagctcag

SEQ ID NO: 7991292 - DNA, 22 bp, Homo sapiens
gtggacagagactaaatgttgt

SEQ ID NO: 7991293 - DNA, 22 bp, Homo sapiens
gtggacagacataatcctaatt

SEQ ID NO: 7991294 - DNA, 22 bp, Homo sapiens
gtggacagagctagaaaatgtg

SEQ ID NO: 7991295 - DNA, 22 bp, Homo sapiens
gtggatgagataactgtagaag

SEQ ID NO: 7991296 - DNA, 20 bp, Homo sapiens
gtggatgatcagtgtagtgg

SEQ ID NO: 7991297 - DNA, 22 bp, Homo sapiens
gtggatctactgtatgggatag

SEQ ID NO: 7991298 - DNA, 22 bp, Homo sapiens
gtggagtggtgatggataggtt

SEQ ID NO: 7991299 - DNA, 22 bp, Homo sapiens
gtggagtggtgatggataggtt

SEQ ID NO: 7991300 - DNA, 22 bp, Homo sapiens
gtggatgattgactctgtagac

SEQ ID NO: 7991301 - DNA, 22 bp, Homo sapiens
gtggatgcttaggcagcctggg

SEQ ID NO: 7991302 - DNA, 18 bp, Homo sapiens
gtggatgcattgggaggg

SEQ ID NO: 7991303 - DNA, 22 bp, Homo sapiens
gtggatgcttaggcagcctggg

SEQ ID NO: 7991304 - DNA, 22 bp, Homo sapiens
gtggatggacatgggcaagagg

SEQ ID NO: 7991305 - DNA, 22 bp, Homo sapiens
gtggatggacatgggcaagagg

SEQ ID NO: 7991306 - DNA, 22 bp, Homo sapiens
gtggatgcttaggcagcctggg

SEQ ID NO: 7991307 - DNA, 22 bp, Homo sapiens
gtggagtgcaacggttggagtt

SEQ ID NO: 7991308 - DNA, 17 bp, Homo sapiens
gtggaggtgctctggta

SEQ ID NO: 7991309 - DNA, 17 bp, Homo sapiens
gtggaggtgctctggta

SEQ ID NO: 7991310 - DNA, 22 bp, Homo sapiens
gtggagtgcaacggttggagtt

SEQ ID NO: 7991311 - DNA, 22 bp, Homo sapiens
gtggagtggcctggccctgaga

SEQ ID NO: 7991312 - DNA, 22 bp, Homo sapiens
gtggagtggcctggccctgaga

SEQ ID NO: 7991313 - DNA, 22 bp, Homo sapiens
gtggaggtcccgggcaggagca

SEQ ID NO: 7991314 - DNA, 22 bp, Homo sapiens
gtggagggtttgcaatgtgcag

SEQ ID NO: 7991315 - DNA, 22 bp, Homo sapiens
gtggaggtcccgggcaggagca

SEQ ID NO: 7991316 - DNA, 22 bp, Homo sapiens
gtggaggtcccgggcaggagca

SEQ ID NO: 7991317 - DNA, 22 bp, Homo sapiens
gtggaggtcccgggcaggagca

SEQ ID NO: 7991318 - DNA, 22 bp, Homo sapiens
gtggagggtgattgccggctgt

SEQ ID NO: 7991319 - DNA, 22 bp, Homo sapiens
gtggagggtgattgccggctgt

SEQ ID NO: 7991320 - DNA, 22 bp, Homo sapiens
gtggagggtgattgccggctgt

SEQ ID NO: 7991321 - DNA, 22 bp, Homo sapiens
gtggagggtgattgccggctgt

SEQ ID NO: 7991322 - DNA, 18 bp, Homo sapiens
gtggagggttctcagaat

SEQ ID NO: 7991323 - DNA, 18 bp, Homo sapiens
gtggagggttctcagaat

SEQ ID NO: 7991324 - DNA, 22 bp, Homo sapiens
gtggagggtttgcaatgtgcag

SEQ ID NO: 7991325 - DNA, 22 bp, Homo sapiens
gtggagggtttgcaatgtgcag

SEQ ID NO: 7991326 - DNA, 22 bp, Homo sapiens
gtggagggtttgcaatgtgcag

SEQ ID NO: 7991327 - DNA, 22 bp, Homo sapiens
gtggagggtttgcaatgtgcag

SEQ ID NO: 7991328 - DNA, 22 bp, Homo sapiens
gtggagggtgagctcatgtttg

SEQ ID NO: 7991329 - DNA, 22 bp, Homo sapiens
gtggagggaatgaatcttctct

SEQ ID NO: 7991330 - DNA, 22 bp, Homo sapiens
gtggagggaatgaatcttctct

SEQ ID NO: 7991331 - DNA, 22 bp, Homo sapiens
gtggaggacaaaagaagccttt

SEQ ID NO: 7991332 - DNA, 22 bp, Homo sapiens
gtggaggagaggcgccttgcgg

SEQ ID NO: 7991333 - DNA, 22 bp, Homo sapiens
gtggaggagaggcgccttgcgg

SEQ ID NO: 7991334 - DNA, 22 bp, Homo sapiens
gtggaggcagtgacacagtagc

SEQ ID NO: 7991335 - DNA, 22 bp, Homo sapiens
gtggaggcagtgacacagtagc

SEQ ID NO: 7991336 - DNA, 22 bp, Homo sapiens
gtggaggcagtgacacagtagc

SEQ ID NO: 7991337 - DNA, 22 bp, Homo sapiens
gtggattacaagacagttgaga

SEQ ID NO: 7991338 - DNA, 22 bp, Homo sapiens
gtggattacaagacagttgaga

SEQ ID NO: 7991339 - DNA, 22 bp, Homo sapiens
gtggattacaagacagttgaga

SEQ ID NO: 7991340 - DNA, 22 bp, Homo sapiens
gtggatggctagttgagaaggg

SEQ ID NO: 7991341 - DNA, 22 bp, Homo sapiens
gtggatggctagttgagaaggg

SEQ ID NO: 7991342 - DNA, 22 bp, Homo sapiens
gtggatggctagttgagaaggg

SEQ ID NO: 7991343 - DNA, 22 bp, Homo sapiens
gtggatggtggtccagtatcat

SEQ ID NO: 7991344 - DNA, 22 bp, Homo sapiens
gtggatggtggtccagtatcat

SEQ ID NO: 7991345 - DNA, 22 bp, Homo sapiens
gtggatggtggtccagtatcat

SEQ ID NO: 7991346 - DNA, 22 bp, Homo sapiens
gtggatggctagttgagaaggg

SEQ ID NO: 7991347 - DNA, 23 bp, Homo sapiens
gtggattccacaggagctgcccc

SEQ ID NO: 7991348 - DNA, 22 bp, Homo sapiens
gtggcaagtgttccaagaggcg

SEQ ID NO: 7991349 - DNA, 22 bp, Homo sapiens
gtggcaaggagcatgaaaagtc

SEQ ID NO: 7991350 - DNA, 22 bp, Homo sapiens
gtggatggattgaggcagtggg

SEQ ID NO: 7991351 - DNA, 22 bp, Homo sapiens
gtggatggattgaggcagtggg

SEQ ID NO: 7991352 - DNA, 22 bp, Homo sapiens
gtggatggattgaggcagtggg

SEQ ID NO: 7991353 - DNA, 22 bp, Homo sapiens
gtggatggattgaggcagtggg

SEQ ID NO: 7991354 - DNA, 22 bp, Homo sapiens
gtggatggattttgaggaatgg

SEQ ID NO: 7991355 - DNA, 22 bp, Homo sapiens
gtggatggattttgaggaatgg

SEQ ID NO: 7991356 - DNA, 22 bp, Homo sapiens
gtggatggccctgcacacaggt

SEQ ID NO: 7991357 - DNA, 22 bp, Homo sapiens
gtggatggccctgcacacaggt

SEQ ID NO: 7991358 - DNA, 22 bp, Homo sapiens
gtggatggccctgcacacaggt

SEQ ID NO: 7991359 - DNA, 22 bp, Homo sapiens
gtggatggccctgcacacaggt

SEQ ID NO: 7991360 - DNA, 22 bp, Homo sapiens
gtggatggagctggaagccatt

SEQ ID NO: 7991361 - DNA, 22 bp, Homo sapiens
gtggatggagctggaagccatt

SEQ ID NO: 7991362 - DNA, 22 bp, Homo sapiens
gtggatggagctggaagccatt

SEQ ID NO: 7991363 - DNA, 22 bp, Homo sapiens
gtggatggagctggaagccatt

SEQ ID NO: 7991364 - DNA, 22 bp, Homo sapiens
gtggatggagcagtgacccagg

SEQ ID NO: 7991365 - DNA, 22 bp, Homo sapiens
gtggatggagcagtgacccagg

SEQ ID NO: 7991366 - DNA, 22 bp, Homo sapiens
gtggatggagctggaagccatt

SEQ ID NO: 7991367 - DNA, 22 bp, Homo sapiens
gtggatggagctggaagccatt

SEQ ID NO: 7991368 - DNA, 22 bp, Homo sapiens
gtggatggattgaggcagtggg

SEQ ID NO: 7991369 - DNA, 22 bp, Homo sapiens
gtggatggagctggaagccatt

SEQ ID NO: 7991370 - DNA, 22 bp, Homo sapiens
gtggatggattgaggcagtggg

SEQ ID NO: 7991371 - DNA, 22 bp, Homo sapiens
gtggcactcacctgtagtttca

SEQ ID NO: 7991372 - DNA, 22 bp, Homo sapiens
gtggcacattggtagggtctgt

SEQ ID NO: 7991373 - DNA, 22 bp, Homo sapiens
gtggcactaaatacagcatttc

SEQ ID NO: 7991374 - DNA, 22 bp, Homo sapiens
gtggcagagccaggctttgaac

SEQ ID NO: 7991375 - DNA, 22 bp, Homo sapiens
gtggcagagccgtgcaggtagg

SEQ ID NO: 7991376 - DNA, 22 bp, Homo sapiens
gtggcagagccgtgcaggtagg

SEQ ID NO: 7991377 - DNA, 22 bp, Homo sapiens
gtggcacagtgggagagcccca

SEQ ID NO: 7991378 - DNA, 22 bp, Homo sapiens
gtggcacagtgggagagcccca

SEQ ID NO: 7991379 - DNA, 22 bp, Homo sapiens
gtggcacagtctgaaattttga

SEQ ID NO: 7991380 - DNA, 22 bp, Homo sapiens
gtggcacagtgggagagcccca

SEQ ID NO: 7991381 - DNA, 22 bp, Homo sapiens
gtggcacataggatcctgtggc

SEQ ID NO: 7991382 - DNA, 22 bp, Homo sapiens
gtggcacattggtagggtctgt

SEQ ID NO: 7991383 - DNA, 22 bp, Homo sapiens
gtggcacacaggagagagctca

SEQ ID NO: 7991384 - DNA, 22 bp, Homo sapiens
gtggcacacaggagagagctca

SEQ ID NO: 7991385 - DNA, 22 bp, Homo sapiens
gtggcacacaggagagagctca

SEQ ID NO: 7991386 - DNA, 22 bp, Homo sapiens
gtggcacaaggcttacacagca

SEQ ID NO: 7991387 - DNA, 22 bp, Homo sapiens
gtggcacaaggcttacacagca

SEQ ID NO: 7991388 - DNA, 22 bp, Homo sapiens
gtggcaagtgttccaagaggcg

SEQ ID NO: 7991389 - DNA, 22 bp, Homo sapiens
gtggcacagccaagcctcactc

SEQ ID NO: 7991390 - DNA, 22 bp, Homo sapiens
gtggcacagggtgtggcacaca

SEQ ID NO: 7991391 - DNA, 22 bp, Homo sapiens
gtggcacagggtgtggcacaca

SEQ ID NO: 7991392 - DNA, 22 bp, Homo sapiens
gtggcacagggttgttggtcat

SEQ ID NO: 7991393 - DNA, 22 bp, Homo sapiens
gtggcacagggttgttggtcat

SEQ ID NO: 7991394 - DNA, 22 bp, Homo sapiens
gtggcacagagatggggcatga

SEQ ID NO: 7991395 - DNA, 22 bp, Homo sapiens
gtggcacagagatggggcatga

SEQ ID NO: 7991396 - DNA, 22 bp, Homo sapiens
gtggcacagagatggggcatga

SEQ ID NO: 7991397 - DNA, 22 bp, Homo sapiens
gtggcacagagatggggcatga

SEQ ID NO: 7991398 - DNA, 22 bp, Homo sapiens
gtggcagagggtgagctggact

SEQ ID NO: 7991399 - DNA, 22 bp, Homo sapiens
gtggcagagggtgagctggact

SEQ ID NO: 7991400 - DNA, 22 bp, Homo sapiens
gtggcagagggtgagctggact

SEQ ID NO: 7991401 - DNA, 22 bp, Homo sapiens
gtggcagagggtgagctggact

SEQ ID NO: 7991402 - DNA, 22 bp, Homo sapiens
gtggcagagggtgagctggact

SEQ ID NO: 7991403 - DNA, 22 bp, Homo sapiens
gtggcagagccttgcggctttg

SEQ ID NO: 7991404 - DNA, 22 bp, Homo sapiens
gtggcagaggctctgggaccag

SEQ ID NO: 7991405 - DNA, 22 bp, Homo sapiens
gtggcagattgctcaccatggt

SEQ ID NO: 7991406 - DNA, 22 bp, Homo sapiens
gtggcagattgctcaccatggt

SEQ ID NO: 7991407 - DNA, 22 bp, Homo sapiens
gtggcagattgctcaccatggt

SEQ ID NO: 7991408 - DNA, 22 bp, Homo sapiens
gtggcagattgctcaccatggt

SEQ ID NO: 7991409 - DNA, 22 bp, Homo sapiens
gtggcagcaaaatcctgcattc

SEQ ID NO: 7991410 - DNA, 22 bp, Homo sapiens
gtggcagcaaaatcctgcattc

SEQ ID NO: 7991411 - DNA, 22 bp, Homo sapiens
gtggcagattgctcaccatggt

SEQ ID NO: 7991412 - DNA, 22 bp, Homo sapiens
gtggcagattgctcaccatggt

SEQ ID NO: 7991413 - DNA, 22 bp, Homo sapiens
gtggcagcaaaatcctgcattc

SEQ ID NO: 7991414 - DNA, 22 bp, Homo sapiens
gtggcagagtgcggttctgacc

SEQ ID NO: 7991415 - DNA, 22 bp, Homo sapiens
gtggcagaggttcctcagtgtg

SEQ ID NO: 7991416 - DNA, 22 bp, Homo sapiens
gtggcagagtgcggttctgacc

SEQ ID NO: 7991417 - DNA, 22 bp, Homo sapiens
gtggcagagtgcggttctgacc

SEQ ID NO: 7991418 - DNA, 22 bp, Homo sapiens
gtggcagagttgctgactagaa

SEQ ID NO: 7991419 - DNA, 22 bp, Homo sapiens
gtggcagcaaatgcctggacta

SEQ ID NO: 7991420 - DNA, 22 bp, Homo sapiens
gtggcagcaaaatcctgcattc

SEQ ID NO: 7991421 - DNA, 22 bp, Homo sapiens
gtggcagcaaatgcctggacta

SEQ ID NO: 7991422 - DNA, 22 bp, Homo sapiens
gtggcagcaaaatcctgcattc

SEQ ID NO: 7991423 - DNA, 22 bp, Homo sapiens
gtggcagcagaggggtggtatg

SEQ ID NO: 7991424 - DNA, 22 bp, Homo sapiens
gtggcagcaaatgcctggacta

SEQ ID NO: 7991425 - DNA, 22 bp, Homo sapiens
gtggcagcagaggggtggtatg

SEQ ID NO: 7991426 - DNA, 22 bp, Homo sapiens
gtggcagcaaatgcctggacta

SEQ ID NO: 7991427 - DNA, 22 bp, Homo sapiens
gtggcagccatgagaatataac

SEQ ID NO: 7991428 - DNA, 16 bp, Homo sapiens
gtggcagccccttctc

SEQ ID NO: 7991429 - DNA, 22 bp, Homo sapiens
gtggcagcatggcttttagctg

SEQ ID NO: 7991430 - DNA, 22 bp, Homo sapiens
gtggcagcaggtactcacgcac

SEQ ID NO: 7991431 - DNA, 22 bp, Homo sapiens
gtggcagcaggtactcacgcac

SEQ ID NO: 7991432 - DNA, 22 bp, Homo sapiens
gtggcagcagaggggtggtatg

SEQ ID NO: 7991433 - DNA, 19 bp, Homo sapiens
gtggcagcagatttggtgt

SEQ ID NO: 7991434 - DNA, 19 bp, Homo sapiens
gtggcagcagatttggtgt

SEQ ID NO: 7991435 - DNA, 19 bp, Homo sapiens
gtggcagcagatttggtgt

SEQ ID NO: 7991436 - DNA, 18 bp, Homo sapiens
gtggcagcctttggcttt

SEQ ID NO: 7991437 - DNA, 22 bp, Homo sapiens
gtggcagcggcccaggccgtct

SEQ ID NO: 7991438 - DNA, 16 bp, Homo sapiens
gtggcagccccttctc

SEQ ID NO: 7991439 - DNA, 22 bp, Homo sapiens
gtggcagccgcaggccctgtgt

SEQ ID NO: 7991440 - DNA, 22 bp, Homo sapiens
gtggcagccgcaggccctgtgt

SEQ ID NO: 7991441 - DNA, 22 bp, Homo sapiens
gtggcagccgcaggccctgtgt

SEQ ID NO: 7991442 - DNA, 22 bp, Homo sapiens
gtggcagcggcccaggccgtct

SEQ ID NO: 7991443 - DNA, 22 bp, Homo sapiens
gtggcagcggtgtgcaaggagg

SEQ ID NO: 7991444 - DNA, 22 bp, Homo sapiens
gtggcagcggtgtgcaaggagg

SEQ ID NO: 7991445 - DNA, 22 bp, Homo sapiens
gtggcagctacatttaatgcaa

SEQ ID NO: 7991446 - DNA, 22 bp, Homo sapiens
gtggcagcggtgtgcaaggagg

SEQ ID NO: 7991447 - DNA, 22 bp, Homo sapiens
gtggcagctacatttaatgcaa

SEQ ID NO: 7991448 - DNA, 22 bp, Homo sapiens
gtggcagctctcttgatttccc

SEQ ID NO: 7991449 - DNA, 22 bp, Homo sapiens
gtggcagctcatgttgttttaa

SEQ ID NO: 7991450 - DNA, 22 bp, Homo sapiens
gtggcagctcatgttgttttaa

SEQ ID NO: 7991451 - DNA, 22 bp, Homo sapiens
gtgcgtgaggcccctgagcgaa

SEQ ID NO: 7991452 - DNA, 22 bp, Homo sapiens
gtgcgtcctgggggctgggtcg

SEQ ID NO: 7991453 - DNA, 22 bp, Homo sapiens
gtgcgggcctgggggtttctct

SEQ ID NO: 7991454 - DNA, 22 bp, Homo sapiens
gtgcgggggttcccagcagccg

SEQ ID NO: 7991455 - DNA, 22 bp, Homo sapiens
gtgcgggcctgggggtttctct

SEQ ID NO: 7991456 - DNA, 22 bp, Homo sapiens
gtgcgggggttcccagcagccg

SEQ ID NO: 7991457 - DNA, 22 bp, Homo sapiens
gtgctacagactgagtacactt

SEQ ID NO: 7991458 - DNA, 22 bp, Homo sapiens
gtgctacagactgagtacactt

SEQ ID NO: 7991459 - DNA, 22 bp, Homo sapiens
gtgcgtgtgcctatcaataaag

SEQ ID NO: 7991460 - DNA, 22 bp, Homo sapiens
gtgctaaagggttatgaacaag

SEQ ID NO: 7991461 - DNA, 22 bp, Homo sapiens
gtgctaaatattgtgtttgtct

SEQ ID NO: 7991462 - DNA, 20 bp, Homo sapiens
gtgctaagtactgtgaaggg

SEQ ID NO: 7991463 - DNA, 23 bp, Homo sapiens
gtgcgccaggacaacctgacgga

SEQ ID NO: 7991464 - DNA, 23 bp, Homo sapiens
gtgcgccaggacaacctgacgga

SEQ ID NO: 7991465 - DNA, 22 bp, Homo sapiens
gtgcggatcggtgtcctccaaa

SEQ ID NO: 7991466 - DNA, 21 bp, Homo sapiens
gtgcggatgccgtcattgtca

SEQ ID NO: 7991467 - DNA, 22 bp, Homo sapiens
gtgcgggcctgggggtttctct

SEQ ID NO: 7991468 - DNA, 22 bp, Homo sapiens
gtgcgggcctgggggtttctct

SEQ ID NO: 7991469 - DNA, 22 bp, Homo sapiens
gtgccttccccggtggtctgtt

SEQ ID NO: 7991470 - DNA, 22 bp, Homo sapiens
gtgcctttgtgtctaaaacagc

SEQ ID NO: 7991471 - DNA, 22 bp, Homo sapiens
gtgcctttgagaagtttctctg

SEQ ID NO: 7991472 - DNA, 22 bp, Homo sapiens
gtgcctttgtgtctaaaacagc

SEQ ID NO: 7991473 - DNA, 22 bp, Homo sapiens
gtgccttttcttcatagttact

SEQ ID NO: 7991474 - DNA, 20 bp, Homo sapiens
gtgcctggagaagaggctgt

SEQ ID NO: 7991475 - DNA, 20 bp, Homo sapiens
gtgcctggagaagaggctgt

SEQ ID NO: 7991476 - DNA, 20 bp, Homo sapiens
gtgcctggagaagaggctgt

SEQ ID NO: 7991477 - DNA, 20 bp, Homo sapiens
gtgcctggagaagaggctgt

SEQ ID NO: 7991478 - DNA, 20 bp, Homo sapiens
gtgcctggagaagaggctgt

SEQ ID NO: 7991479 - DNA, 20 bp, Homo sapiens
gtgcctggagaagaggctgt

SEQ ID NO: 7991480 - DNA, 20 bp, Homo sapiens
gtgcctggagaagaggctgt

SEQ ID NO: 7991481 - DNA, 20 bp, Homo sapiens
gtgcctggagaagaggctgt

SEQ ID NO: 7991482 - DNA, 20 bp, Homo sapiens
gtgcctggagaagaggctgt

SEQ ID NO: 7991483 - DNA, 22 bp, Homo sapiens
gtgcctggcacacagaaggcaa

SEQ ID NO: 7991484 - DNA, 22 bp, Homo sapiens
gtgcctggcacacagaaggcaa

SEQ ID NO: 7991485 - DNA, 22 bp, Homo sapiens
gtgcctggcagggtcagctgct

SEQ ID NO: 7991486 - DNA, 22 bp, Homo sapiens
gtgcctggcatgcgccggtgct

SEQ ID NO: 7991487 - DNA, 22 bp, Homo sapiens
gtgcctggcatgcgccggtgct

SEQ ID NO: 7991488 - DNA, 22 bp, Homo sapiens
gtgcctgggacacagcagatac

SEQ ID NO: 7991489 - DNA, 22 bp, Homo sapiens
gtgcctgtttgtagactggaca

SEQ ID NO: 7991490 - DNA, 22 bp, Homo sapiens
gtgcctggcagggtcagctgct

SEQ ID NO: 7991491 - DNA, 22 bp, Homo sapiens
gtgcctggcagggtcagctgct

SEQ ID NO: 7991492 - DNA, 22 bp, Homo sapiens
gtgcctggcagggtcagctgct

SEQ ID NO: 7991493 - DNA, 22 bp, Homo sapiens
gtgcctggcagggtcagctgct

SEQ ID NO: 7991494 - DNA, 22 bp, Homo sapiens
gtgcctggcagggtcagctgct

SEQ ID NO: 7991495 - DNA, 22 bp, Homo sapiens
gtgcctggcacacagaaggcaa

SEQ ID NO: 7991496 - DNA, 22 bp, Homo sapiens
gtgcctggcagggtcagctgct

SEQ ID NO: 7991497 - DNA, 22 bp, Homo sapiens
gtgcctggcagggtcagctgct

SEQ ID NO: 7991498 - DNA, 22 bp, Homo sapiens
gtgcctggcagggtcagctgct

SEQ ID NO: 7991499 - DNA, 22 bp, Homo sapiens
gtgcctggcagggtcagctgct

SEQ ID NO: 7991500 - DNA, 22 bp, Homo sapiens
gtggaaatagtttggttataga

SEQ ID NO: 7991501 - DNA, 22 bp, Homo sapiens
gtggaaattttaggatcatctt

SEQ ID NO: 7991502 - DNA, 22 bp, Homo sapiens
gtggaaattttaggatcatctt

SEQ ID NO: 7991503 - DNA, 22 bp, Homo sapiens
gtggaaatgcccccaaatagtg

SEQ ID NO: 7991504 - DNA, 22 bp, Homo sapiens
gtggaaatgcccccaaatagtg

SEQ ID NO: 7991505 - DNA, 22 bp, Homo sapiens
gtgctttttcaatcagaaggga

SEQ ID NO: 7991506 - DNA, 22 bp, Homo sapiens
gtggaaggaagagatggcccca

SEQ ID NO: 7991507 - DNA, 22 bp, Homo sapiens
gtggaaggaagagatggcccca

SEQ ID NO: 7991508 - DNA, 22 bp, Homo sapiens
gtggaagctgatgggagacagg

SEQ ID NO: 7991509 - DNA, 22 bp, Homo sapiens
gtggaagcaaccctggcaggag

SEQ ID NO: 7991510 - DNA, 22 bp, Homo sapiens
gtggaagaggcaagatagctct

SEQ ID NO: 7991511 - DNA, 22 bp, Homo sapiens
gtggaagcaaccctggcaggag

SEQ ID NO: 7991512 - DNA, 22 bp, Homo sapiens
gtggaagaggcaagatagctct

SEQ ID NO: 7991513 - DNA, 22 bp, Homo sapiens
gtggaacattcaaagtggagag

SEQ ID NO: 7991514 - DNA, 22 bp, Homo sapiens
gtggaacagggagcctggaatg

SEQ ID NO: 7991515 - DNA, 22 bp, Homo sapiens
gtggaacaatatcgaagagagg

SEQ ID NO: 7991516 - DNA, 22 bp, Homo sapiens
gtggaacagaactgtttattga

SEQ ID NO: 7991517 - DNA, 22 bp, Homo sapiens
gtggaagggtcacagcccctac

SEQ ID NO: 7991518 - DNA, 22 bp, Homo sapiens
gtggaaggtaatgcagcttact

SEQ ID NO: 7991519 - DNA, 22 bp, Homo sapiens
gtggaaggtgaaggagcagcga

SEQ ID NO: 7991520 - DNA, 22 bp, Homo sapiens
gtggaaggtgaaggagcagcga

SEQ ID NO: 7991521 - DNA, 22 bp, Homo sapiens
gtggaaggtgaaggagcagcga

SEQ ID NO: 7991522 - DNA, 22 bp, Homo sapiens
gtggaaggtgaaggagcagcga

SEQ ID NO: 7991523 - DNA, 22 bp, Homo sapiens
gtggaaggtgaaggagcagcga

SEQ ID NO: 7991524 - DNA, 22 bp, Homo sapiens
gtggaaggaagagatggcccca

SEQ ID NO: 7991525 - DNA, 22 bp, Homo sapiens
gtggaaggaagagatggcccca

SEQ ID NO: 7991526 - DNA, 22 bp, Homo sapiens
gtggaaggaattaacagactag

SEQ ID NO: 7991527 - DNA, 22 bp, Homo sapiens
gtggaaggaattaacagactag

SEQ ID NO: 7991528 - DNA, 22 bp, Homo sapiens
gtggaagggactgcctagagga

SEQ ID NO: 7991529 - DNA, 22 bp, Homo sapiens
gtggaagggactgcctagagga

SEQ ID NO: 7991530 - DNA, 20 bp, Homo sapiens
gtggaatgcactctgtgctg

SEQ ID NO: 7991531 - DNA, 22 bp, Homo sapiens
gtggaatggccatgggatcctt

SEQ ID NO: 7991532 - DNA, 22 bp, Homo sapiens
gtggaattaattcagttaatgc

SEQ ID NO: 7991533 - DNA, 22 bp, Homo sapiens
gtggaagtagatttgagaaggt

SEQ ID NO: 7991534 - DNA, 22 bp, Homo sapiens
gtggaagtagatttgagaaggt

SEQ ID NO: 7991535 - DNA, 22 bp, Homo sapiens
gtggaaggtgctagaacaagga

SEQ ID NO: 7991536 - DNA, 22 bp, Homo sapiens
gtggaaggtgctagaacaagga

SEQ ID NO: 7991537 - DNA, 22 bp, Homo sapiens
gtggaaggtgaaggagcagcga

SEQ ID NO: 7991538 - DNA, 22 bp, Homo sapiens
gtggaaggtgaaggagcagcga

SEQ ID NO: 7991539 - DNA, 22 bp, Homo sapiens
gtggaaggtgaaggagcagcga

SEQ ID NO: 7991540 - DNA, 22 bp, Homo sapiens
gtgacagagtgagaccctgtct

SEQ ID NO: 7991541 - DNA, 22 bp, Homo sapiens
gtgacagagctgggatttgaag

SEQ ID NO: 7991542 - DNA, 22 bp, Homo sapiens
gtgacagagttttagatctcat

SEQ ID NO: 7991543 - DNA, 22 bp, Homo sapiens
gtgacagatttgctgcgcatgg

SEQ ID NO: 7991544 - DNA, 22 bp, Homo sapiens
gtgacaggcccagtgggatgca

SEQ ID NO: 7991545 - DNA, 22 bp, Homo sapiens
gtgacaggcccagtgggatgca

SEQ ID NO: 7991546 - DNA, 22 bp, Homo sapiens
gtgacaggccactgcggctctg

SEQ ID NO: 7991547 - DNA, 22 bp, Homo sapiens
gtgacaggcccagtgggatgca

SEQ ID NO: 7991548 - DNA, 22 bp, Homo sapiens
gtgacaggcccagtgggatgca

SEQ ID NO: 7991549 - DNA, 22 bp, Homo sapiens
gtgacaggccactgcggctctg

SEQ ID NO: 7991550 - DNA, 22 bp, Homo sapiens
gtgacagggggcttggtttcta

SEQ ID NO: 7991551 - DNA, 22 bp, Homo sapiens
gtgacaggatagtcagctttgt

SEQ ID NO: 7991552 - DNA, 22 bp, Homo sapiens
gtgacaggcatggggtcatgca

SEQ ID NO: 7991553 - DNA, 22 bp, Homo sapiens
gtgacaggcatggggtcatgca

SEQ ID NO: 7991554 - DNA, 22 bp, Homo sapiens
gtgacaggcatggggtcatgca

SEQ ID NO: 7991555 - DNA, 22 bp, Homo sapiens
gtgacaggccactgcggctctg

SEQ ID NO: 7991556 - DNA, 22 bp, Homo sapiens
gtgacaggcatggggtcatgca

SEQ ID NO: 7991557 - DNA, 20 bp, Homo sapiens
gtgaagggagtcaggtgtgc

SEQ ID NO: 7991558 - DNA, 20 bp, Homo sapiens
gtgaagggagtcaggtgtgc

SEQ ID NO: 7991559 - DNA, 22 bp, Homo sapiens
gtgaatttctgactaaaagtgc

SEQ ID NO: 7991560 - DNA, 22 bp, Homo sapiens
gtgaaggctgtgtgaaagttct

SEQ ID NO: 7991561 - DNA, 22 bp, Homo sapiens
gtgaaggctacaagagatcaag

SEQ ID NO: 7991562 - DNA, 22 bp, Homo sapiens
gtgaaggccagtagggtcctgg

SEQ ID NO: 7991563 - DNA, 22 bp, Homo sapiens
gtgaaggcttgacgtcatcagg

SEQ ID NO: 7991564 - DNA, 22 bp, Homo sapiens
gtgaaggctacaagagatcaag

SEQ ID NO: 7991565 - DNA, 22 bp, Homo sapiens
gtgaaggctacaagagatcaag

SEQ ID NO: 7991566 - DNA, 20 bp, Homo sapiens
gtgaaggctaagcacagagg

SEQ ID NO: 7991567 - DNA, 22 bp, Homo sapiens
gtgaaggctaattaaacaagtt

SEQ ID NO: 7991568 - DNA, 22 bp, Homo sapiens
gtgaaggcaatgataagagtga

SEQ ID NO: 7991569 - DNA, 22 bp, Homo sapiens
gtgaaggattggagggcatctt

SEQ ID NO: 7991570 - DNA, 22 bp, Homo sapiens
gtctggggtactttcatctgat

SEQ ID NO: 7991571 - DNA, 20 bp, Homo sapiens
gtgaaggctaagcacagagg

SEQ ID NO: 7991572 - DNA, 22 bp, Homo sapiens
gtgaaggcagccatcgacagtt

SEQ ID NO: 7991573 - DNA, 22 bp, Homo sapiens
gtgaaggcagccatcgacagtt

SEQ ID NO: 7991574 - DNA, 22 bp, Homo sapiens
gtgaaggccagtagggtcctgg

SEQ ID NO: 7991575 - DNA, 22 bp, Homo sapiens
gtgacagaaacagggctagaat

SEQ ID NO: 7991576 - DNA, 22 bp, Homo sapiens
gtgacaaggaaagacagactgt

SEQ ID NO: 7991577 - DNA, 22 bp, Homo sapiens
gtgacaaatgcaaattgggctg

SEQ ID NO: 7991578 - DNA, 22 bp, Homo sapiens
gtgacaaatgcaaattgggctg

SEQ ID NO: 7991579 - DNA, 22 bp, Homo sapiens
gtgacaaatgcaaattgggctg

SEQ ID NO: 7991580 - DNA, 22 bp, Homo sapiens
gtgacaaaggtcaagcttttga

SEQ ID NO: 7991581 - DNA, 22 bp, Homo sapiens
gtgacaaaggtcaagcttttga

SEQ ID NO: 7991582 - DNA, 22 bp, Homo sapiens
gtgacaaaaacactgattattt

SEQ ID NO: 7991583 - DNA, 22 bp, Homo sapiens
gtgacaaaaacactgattattt

SEQ ID NO: 7991584 - DNA, 22 bp, Homo sapiens
gtgacagtgacagctagatagt

SEQ ID NO: 7991585 - DNA, 22 bp, Homo sapiens
gtgacagtggtcacttgtagtt

SEQ ID NO: 7991586 - DNA, 22 bp, Homo sapiens
gtgacatggtttgccgtccctg

SEQ ID NO: 7991587 - DNA, 22 bp, Homo sapiens
gtgacatccgctgacatcgcca

SEQ ID NO: 7991588 - DNA, 22 bp, Homo sapiens
gtgacatatgcacacctttatt

SEQ ID NO: 7991589 - DNA, 22 bp, Homo sapiens
gtgacagtcaaagacatgactt

SEQ ID NO: 7991590 - DNA, 22 bp, Homo sapiens
gtgacaggtatactcaccattg

SEQ ID NO: 7991591 - DNA, 22 bp, Homo sapiens
gtgacagggggcttggtttcta

SEQ ID NO: 7991592 - DNA, 22 bp, Homo sapiens
gtgacatttattagatgcttac

SEQ ID NO: 7991593 - DNA, 22 bp, Homo sapiens
gtgacatttacgaatcttatcc

SEQ ID NO: 7991594 - DNA, 22 bp, Homo sapiens
gtgacatgttatggactggcta

SEQ ID NO: 7991595 - DNA, 22 bp, Homo sapiens
gtgacattgctaggaacagatt

SEQ ID NO: 7991596 - DNA, 22 bp, Homo sapiens
gtgaccagtgatgctgaggagt

SEQ ID NO: 7991597 - DNA, 22 bp, Homo sapiens
gtgaccagtgatgctgaggagt

SEQ ID NO: 7991598 - DNA, 22 bp, Homo sapiens
gtgaccagcccatagagaggcg

SEQ ID NO: 7991599 - DNA, 20 bp, Homo sapiens
gtgaccagaagacagtgggt

SEQ ID NO: 7991600 - DNA, 22 bp, Homo sapiens
gtgaccagccagtgctgtctgt

SEQ ID NO: 7991601 - DNA, 22 bp, Homo sapiens
gtgaccacttcaaattctagat

SEQ ID NO: 7991602 - DNA, 22 bp, Homo sapiens
gtgacattttttaagcccttgt

SEQ ID NO: 7991603 - DNA, 20 bp, Homo sapiens
gtgaccagaagacagtgggt

SEQ ID NO: 7991604 - DNA, 22 bp, Homo sapiens
gtgacatttcgtgacgtgagaa

SEQ ID NO: 7991605 - DNA, 22 bp, Homo sapiens
gtgacatttcccatcagtatcc

SEQ ID NO: 7991606 - DNA, 22 bp, Homo sapiens
gtgacatttcgtgacgtgagaa

SEQ ID NO: 7991607 - DNA, 22 bp, Homo sapiens
gtgacatttttactgatgagag

SEQ ID NO: 7991608 - DNA, 22 bp, Homo sapiens
gtgaccaatattatgctaatta

SEQ ID NO: 7991609 - DNA, 22 bp, Homo sapiens
gtgcctggaactgggtaggctg

SEQ ID NO: 7991610 - DNA, 22 bp, Homo sapiens
gtgcctggaactgggtaggctg

SEQ ID NO: 7991611 - DNA, 22 bp, Homo sapiens
gtgcctggaactgggtaggctg

SEQ ID NO: 7991612 - DNA, 22 bp, Homo sapiens
gtgcctggaactgggtaggctg

SEQ ID NO: 7991613 - DNA, 22 bp, Homo sapiens
gtgcctggaactgggtaggctg

SEQ ID NO: 7991614 - DNA, 22 bp, Homo sapiens
gtgcctggaactgggtaggctg

SEQ ID NO: 7991615 - DNA, 22 bp, Homo sapiens
gtgcctggaatgcgcctcggcg

SEQ ID NO: 7991616 - DNA, 22 bp, Homo sapiens
gtgcctggaatgcgcctcggcg

SEQ ID NO: 7991617 - DNA, 22 bp, Homo sapiens
gtgcctggaatgcgcctcggcg

SEQ ID NO: 7991618 - DNA, 22 bp, Homo sapiens
gtgcctggaatgcgcctcggcg

SEQ ID NO: 7991619 - DNA, 22 bp, Homo sapiens
gtgcctggaatgcgcctcggcg

SEQ ID NO: 7991620 - DNA, 22 bp, Homo sapiens
gtgcctggaccctctttccgga

SEQ ID NO: 7991621 - DNA, 22 bp, Homo sapiens
gtgcctggaatgcgcctcggcg

SEQ ID NO: 7991622 - DNA, 22 bp, Homo sapiens
gtgcctgcagcaatccatggca

SEQ ID NO: 7991623 - DNA, 22 bp, Homo sapiens
gtgcctgcagcaatccatggca

SEQ ID NO: 7991624 - DNA, 22 bp, Homo sapiens
gtgcctgagccagctgcagctc

SEQ ID NO: 7991625 - DNA, 22 bp, Homo sapiens
gtgcctgagccagctgcagctc

SEQ ID NO: 7991626 - DNA, 22 bp, Homo sapiens
gtgcctgcaggtgccggcttca

SEQ ID NO: 7991627 - DNA, 22 bp, Homo sapiens
gtgcctgccccactcctcagca

SEQ ID NO: 7991628 - DNA, 22 bp, Homo sapiens
gtgcctgctacctgacttgttt

SEQ ID NO: 7991629 - DNA, 22 bp, Homo sapiens
gtgcctgctgcagagtcgctgt

SEQ ID NO: 7991630 - DNA, 22 bp, Homo sapiens
gtgcctgctgcagagtcgctgt

SEQ ID NO: 7991631 - DNA, 22 bp, Homo sapiens
gtgcctgctgcagctgagcagt

SEQ ID NO: 7991632 - DNA, 22 bp, Homo sapiens
gtgcctgctgcagctgagcagt

SEQ ID NO: 7991633 - DNA, 22 bp, Homo sapiens
gtgcctgctgcagctgagcagt

SEQ ID NO: 7991634 - DNA, 22 bp, Homo sapiens
gtatgtgctgagctttccccgc

SEQ ID NO: 7991635 - DNA, 22 bp, Homo sapiens
gtatgtgcaattcactgtgaga

SEQ ID NO: 7991636 - DNA, 22 bp, Homo sapiens
gtatgtgaggttggtttccagg

SEQ ID NO: 7991637 - DNA, 22 bp, Homo sapiens
gtatgtcttagggttcagtaac

SEQ ID NO: 7991638 - DNA, 22 bp, Homo sapiens
gtatgtgaggttggtttccagg

SEQ ID NO: 7991639 - DNA, 22 bp, Homo sapiens
gtatgtgaggttggtttccagg

SEQ ID NO: 7991640 - DNA, 22 bp, Homo sapiens
gtatgtcaaaatctgcatgata

SEQ ID NO: 7991641 - DNA, 22 bp, Homo sapiens
gtatgtcaaaatctgcatgata

SEQ ID NO: 7991642 - DNA, 22 bp, Homo sapiens
gtattacaaataaatgttactg

SEQ ID NO: 7991643 - DNA, 22 bp, Homo sapiens
gtattacatttagtaattaggc

SEQ ID NO: 7991644 - DNA, 22 bp, Homo sapiens
gtattacatttagtaattaggc

SEQ ID NO: 7991645 - DNA, 22 bp, Homo sapiens
gtcagaggggcagctgccaggc

SEQ ID NO: 7991646 - DNA, 18 bp, Homo sapiens
gtcagaggatggggaaat

SEQ ID NO: 7991647 - DNA, 18 bp, Homo sapiens
gtcagaggatggggaaat

SEQ ID NO: 7991648 - DNA, 22 bp, Homo sapiens
gtcagctgcagtgggcacagcc

SEQ ID NO: 7991649 - DNA, 22 bp, Homo sapiens
gtcagctgcagtgggcacagcc

SEQ ID NO: 7991650 - DNA, 22 bp, Homo sapiens
gtcagctgcacaggtgggagct

SEQ ID NO: 7991651 - DNA, 22 bp, Homo sapiens
gtcagctctcttatccatgagg

SEQ ID NO: 7991652 - DNA, 22 bp, Homo sapiens
gtcagctgcacaggtgggagct

SEQ ID NO: 7991653 - DNA, 22 bp, Homo sapiens
gtcagctcagcaggtgggagtg

SEQ ID NO: 7991654 - DNA, 22 bp, Homo sapiens
gtcagctactgcagggaacttt

SEQ ID NO: 7991655 - DNA, 22 bp, Homo sapiens
gtcagctcctagcaccccccaa

SEQ ID NO: 7991656 - DNA, 22 bp, Homo sapiens
gtcagaggggcagctgccaggc

SEQ ID NO: 7991657 - DNA, 22 bp, Homo sapiens
gtcagaggggcagctgccaggc

SEQ ID NO: 7991658 - DNA, 22 bp, Homo sapiens
gtcaggaaaacccgggttgact

SEQ ID NO: 7991659 - DNA, 22 bp, Homo sapiens
gtcaggaaaacccgggttgact

SEQ ID NO: 7991660 - DNA, 22 bp, Homo sapiens
gtcaggaaaaattgataatttt

SEQ ID NO: 7991661 - DNA, 21 bp, Homo sapiens
gtcagctgtgtgtgaggaccc

SEQ ID NO: 7991662 - DNA, 22 bp, Homo sapiens
gtcaggaaaaattgataatttt

SEQ ID NO: 7991663 - DNA, 23 bp, Homo sapiens
gtcagcttgaccagtggagagtc

SEQ ID NO: 7991664 - DNA, 22 bp, Homo sapiens
gtcagctgtctccccagagtgg

SEQ ID NO: 7991665 - DNA, 22 bp, Homo sapiens
gtcagctgtctccccagagtgg

SEQ ID NO: 7991666 - DNA, 21 bp, Homo sapiens
gtcagctgtgtgtgaggaccc

SEQ ID NO: 7991667 - DNA, 21 bp, Homo sapiens
gtcagctgtgtgtgaggaccc

SEQ ID NO: 7991668 - DNA, 22 bp, Homo sapiens
gtcagctgggcatctgcagatg

SEQ ID NO: 7991669 - DNA, 22 bp, Homo sapiens
gtcagctgggcatctgcagatg

SEQ ID NO: 7991670 - DNA, 19 bp, Homo sapiens
gtcaggcacgtgagagcat

SEQ ID NO: 7991671 - DNA, 19 bp, Homo sapiens
gtcaggcacgtgagagcat

SEQ ID NO: 7991672 - DNA, 19 bp, Homo sapiens
gtcaggcacgtgagagcat

SEQ ID NO: 7991673 - DNA, 22 bp, Homo sapiens
gtcaggattataatccccatgg

SEQ ID NO: 7991674 - DNA, 19 bp, Homo sapiens
gtcaggcacgtgagagcat

SEQ ID NO: 7991675 - DNA, 19 bp, Homo sapiens
gtcaggcacgtgagagcat

SEQ ID NO: 7991676 - DNA, 22 bp, Homo sapiens
gtcaggcatttaggatgagttc

SEQ ID NO: 7991677 - DNA, 22 bp, Homo sapiens
gtcaggcagcctggagattcag

SEQ ID NO: 7991678 - DNA, 18 bp, Homo sapiens
gtcaggcatgaatctggg

SEQ ID NO: 7991679 - DNA, 22 bp, Homo sapiens
gtcaggcagcctggagattcag

SEQ ID NO: 7991680 - DNA, 22 bp, Homo sapiens
gtcaggcagcctggagattcag

SEQ ID NO: 7991681 - DNA, 18 bp, Homo sapiens
gtcaggcatgaatctggg

SEQ ID NO: 7991682 - DNA, 22 bp, Homo sapiens
gtcaggcagtggaaattaaaaa

SEQ ID NO: 7991683 - DNA, 22 bp, Homo sapiens
gtcaggccctggcagccgtgac

SEQ ID NO: 7991684 - DNA, 22 bp, Homo sapiens
gtcaggccctggcagccgtgac

SEQ ID NO: 7991685 - DNA, 21 bp, Homo sapiens
gtcaggcccatagcagtgcct

SEQ ID NO: 7991686 - DNA, 22 bp, Homo sapiens
gtcaggccaatactctccagca

SEQ ID NO: 7991687 - DNA, 22 bp, Homo sapiens
gtcaggccctggcagccgtgac

SEQ ID NO: 7991688 - DNA, 22 bp, Homo sapiens
gtcaggccctggcagccgtgac

SEQ ID NO: 7991689 - DNA, 22 bp, Homo sapiens
gtcaggccctggcagccgtgac

SEQ ID NO: 7991690 - DNA, 21 bp, Homo sapiens
gtcaggcccatagcagtgcct

SEQ ID NO: 7991691 - DNA, 21 bp, Homo sapiens
gtcaggcccatagcagtgcct

SEQ ID NO: 7991692 - DNA, 22 bp, Homo sapiens
gtcaggactctgacccgtcccg

SEQ ID NO: 7991693 - DNA, 22 bp, Homo sapiens
gtcaggactctgacccgtcccg

SEQ ID NO: 7991694 - DNA, 22 bp, Homo sapiens
gtcaggactctgacccgtcccg

SEQ ID NO: 7991695 - DNA, 22 bp, Homo sapiens
gtcaggactctgacccgtcccg

SEQ ID NO: 7991696 - DNA, 22 bp, Homo sapiens
gtcaggacaggctctggactga

SEQ ID NO: 7991697 - DNA, 22 bp, Homo sapiens
gtcaggacattttaccatcctg

SEQ ID NO: 7991698 - DNA, 22 bp, Homo sapiens
gtcaggaagcaaggttgggcat

SEQ ID NO: 7991699 - DNA, 19 bp, Homo sapiens
gtcaggaagtactttccgg

SEQ ID NO: 7991700 - DNA, 19 bp, Homo sapiens
gtcaggaagtactttccgg

SEQ ID NO: 7991701 - DNA, 22 bp, Homo sapiens
gtcaggaagtggcattggagaa

SEQ ID NO: 7991702 - DNA, 22 bp, Homo sapiens
gtcaggaagtggcattggagaa

SEQ ID NO: 7991703 - DNA, 22 bp, Homo sapiens
gtcaggacaaggtggtctccag

SEQ ID NO: 7991704 - DNA, 22 bp, Homo sapiens
gtcaggacaaggtggtctccag

SEQ ID NO: 7991705 - DNA, 22 bp, Homo sapiens
gtcaggacaaggtggtctccag

SEQ ID NO: 7991706 - DNA, 22 bp, Homo sapiens
gtcaggagagatcaggacagca

SEQ ID NO: 7991707 - DNA, 22 bp, Homo sapiens
gtcaggagagacctgttctcct

SEQ ID NO: 7991708 - DNA, 22 bp, Homo sapiens
gtcaggagagacctgttctcct

SEQ ID NO: 7991709 - DNA, 22 bp, Homo sapiens
gtcaggagagatcaggacagca

SEQ ID NO: 7991710 - DNA, 22 bp, Homo sapiens
gtcaggagatagggcaagcttc

SEQ ID NO: 7991711 - DNA, 22 bp, Homo sapiens
gtcaggagatagggcaagcttc

SEQ ID NO: 7991712 - DNA, 21 bp, Homo sapiens
gtcaggagccgtcttacattc

SEQ ID NO: 7991713 - DNA, 22 bp, Homo sapiens
gtcaggatgggcagccaaacta

SEQ ID NO: 7991714 - DNA, 21 bp, Homo sapiens
gtcaggagccgtcttacattc

SEQ ID NO: 7991715 - DNA, 22 bp, Homo sapiens
gtcccagggcaaggctgtttct

SEQ ID NO: 7991716 - DNA, 22 bp, Homo sapiens
gtcccagggcaaggctgtttct

SEQ ID NO: 7991717 - DNA, 22 bp, Homo sapiens
gtcccagggcaaggctgtttct

SEQ ID NO: 7991718 - DNA, 22 bp, Homo sapiens
gtcccagggatgcagacatgag

SEQ ID NO: 7991719 - DNA, 22 bp, Homo sapiens
gtcccagggatgcagacatgag

SEQ ID NO: 7991720 - DNA, 22 bp, Homo sapiens
gtcccagggatgcagacatgag

SEQ ID NO: 7991721 - DNA, 22 bp, Homo sapiens
gtcccagggatgcagacatgag

SEQ ID NO: 7991722 - DNA, 22 bp, Homo sapiens
gtcccagggaggttcagggctt

SEQ ID NO: 7991723 - DNA, 22 bp, Homo sapiens
gtcccagggaggttcagggctt

SEQ ID NO: 7991724 - DNA, 22 bp, Homo sapiens
gtcccagggaggttcagggctt

SEQ ID NO: 7991725 - DNA, 22 bp, Homo sapiens
gtcccagggaggttcagggctt

SEQ ID NO: 7991726 - DNA, 22 bp, Homo sapiens
gtcccagggatgcagacatgag

SEQ ID NO: 7991727 - DNA, 22 bp, Homo sapiens
gtcccagggatgcagacatgag

SEQ ID NO: 7991728 - DNA, 22 bp, Homo sapiens
gtcccagggatgcagacatgag

SEQ ID NO: 7991729 - DNA, 22 bp, Homo sapiens
gtcccaggtcccagcacatctg

SEQ ID NO: 7991730 - DNA, 22 bp, Homo sapiens
gtcccagggccaccatatatag

SEQ ID NO: 7991731 - DNA, 22 bp, Homo sapiens
gtcccagggccaccatatatag

SEQ ID NO: 7991732 - DNA, 22 bp, Homo sapiens
gtcccaggtcccagcacatctg

SEQ ID NO: 7991733 - DNA, 22 bp, Homo sapiens
gtcccaggtcccagcacatctg

SEQ ID NO: 7991734 - DNA, 22 bp, Homo sapiens
gtcccaggtgcccagtgggcag

SEQ ID NO: 7991735 - DNA, 22 bp, Homo sapiens
gtcccaggtgcccagtgggcag

SEQ ID NO: 7991736 - DNA, 22 bp, Homo sapiens
gtcccaggtgcccagtgggcag

SEQ ID NO: 7991737 - DNA, 22 bp, Homo sapiens
gtcccaggtgcccagtgggcag

SEQ ID NO: 7991738 - DNA, 22 bp, Homo sapiens
gtcccaggtgggctccacctct

SEQ ID NO: 7991739 - DNA, 22 bp, Homo sapiens
gtcccagttcctcctgtcagca

SEQ ID NO: 7991740 - DNA, 22 bp, Homo sapiens
gtcccagttcctcctgtcagca

SEQ ID NO: 7991741 - DNA, 22 bp, Homo sapiens
gtcccaggtgggctccacctct

SEQ ID NO: 7991742 - DNA, 22 bp, Homo sapiens
gtcccaggtgggctccacctct

SEQ ID NO: 7991743 - DNA, 22 bp, Homo sapiens
gtcccataagtagtgcaacttg

SEQ ID NO: 7991744 - DNA, 22 bp, Homo sapiens
gtcccataagtagtgcaacttg

SEQ ID NO: 7991745 - DNA, 22 bp, Homo sapiens
gtcccataagtagtgcaacttg

SEQ ID NO: 7991746 - DNA, 22 bp, Homo sapiens
gtcccataagtagtgcaacttg

SEQ ID NO: 7991747 - DNA, 22 bp, Homo sapiens
gtccttaaccacttgtgtttat

SEQ ID NO: 7991748 - DNA, 22 bp, Homo sapiens
gtccttaaccacttgtgtttat

SEQ ID NO: 7991749 - DNA, 22 bp, Homo sapiens
gtccttaatctgattggtgcag

SEQ ID NO: 7991750 - DNA, 22 bp, Homo sapiens
gtccttagttacttttcatgtc

SEQ ID NO: 7991751 - DNA, 22 bp, Homo sapiens
gtccttaaatgctgctgcagga

SEQ ID NO: 7991752 - DNA, 22 bp, Homo sapiens
gtccttaacaaacggggaaaag

SEQ ID NO: 7991753 - DNA, 22 bp, Homo sapiens
gtccttaaagagagcatcattc

SEQ ID NO: 7991754 - DNA, 22 bp, Homo sapiens
gtccttcaagagtcccctactg

SEQ ID NO: 7991755 - DNA, 22 bp, Homo sapiens
gtccttcaaaggcacgcagtta

SEQ ID NO: 7991756 - DNA, 22 bp, Homo sapiens
gtccttcaaaggcacgcagtta

SEQ ID NO: 7991757 - DNA, 22 bp, Homo sapiens
gtcctgtgtgagtgcaccacct

SEQ ID NO: 7991758 - DNA, 22 bp, Homo sapiens
gtcctgtgtgagtgcaccacct

SEQ ID NO: 7991759 - DNA, 22 bp, Homo sapiens
gtcctgtgtgttgccggctgaa

SEQ ID NO: 7991760 - DNA, 22 bp, Homo sapiens
gtcctgttggtgaatggctctt

SEQ ID NO: 7991761 - DNA, 22 bp, Homo sapiens
gtcctgtgtaagtacttgctca

SEQ ID NO: 7991762 - DNA, 22 bp, Homo sapiens
gtcctgtgtcccagagaaagag

SEQ ID NO: 7991763 - DNA, 22 bp, Homo sapiens
gtcctgtgtgacttcccaaatg

SEQ ID NO: 7991764 - DNA, 22 bp, Homo sapiens
gtcctgtgtaagtacttgctca

SEQ ID NO: 7991765 - DNA, 22 bp, Homo sapiens
gtcctggtagggctctgtgtct

SEQ ID NO: 7991766 - DNA, 22 bp, Homo sapiens
gtcctgtgtaagccaggacaat

SEQ ID NO: 7991767 - DNA, 22 bp, Homo sapiens
gtcctggtagctggcttggtca

SEQ ID NO: 7991768 - DNA, 22 bp, Homo sapiens
gtcctggtagggctctgtgtct

SEQ ID NO: 7991769 - DNA, 22 bp, Homo sapiens
gtcctgggtccccgcaggtcag

SEQ ID NO: 7991770 - DNA, 22 bp, Homo sapiens
gtcctgggtccccgcaggtcag

SEQ ID NO: 7991771 - DNA, 22 bp, Homo sapiens
gtcctggtagctggcttggtca

SEQ ID NO: 7991772 - DNA, 22 bp, Homo sapiens
gtcctgggtccccgcaggtcag

SEQ ID NO: 7991773 - DNA, 22 bp, Homo sapiens
gtccagtgtgtttatcttggat

SEQ ID NO: 7991774 - DNA, 22 bp, Homo sapiens
gtccagtgtcttctacataaca

SEQ ID NO: 7991775 - DNA, 22 bp, Homo sapiens
gtccagtggtcaattatctgga

SEQ ID NO: 7991776 - DNA, 20 bp, Homo sapiens
gtccagtgggccttcatttc

SEQ ID NO: 7991777 - DNA, 20 bp, Homo sapiens
gtccagtgggccttcatttc

SEQ ID NO: 7991778 - DNA, 22 bp, Homo sapiens
gtccagttgtatgtccagtgtc

SEQ ID NO: 7991779 - DNA, 22 bp, Homo sapiens
gtccagtttcagggtctgcgct

SEQ ID NO: 7991780 - DNA, 22 bp, Homo sapiens
gtccatacaggcagtggctctg

SEQ ID NO: 7991781 - DNA, 22 bp, Homo sapiens
gtccatacaggcagtggctctg

SEQ ID NO: 7991782 - DNA, 22 bp, Homo sapiens
gtccatacagtggcacacatct

SEQ ID NO: 7991783 - DNA, 22 bp, Homo sapiens
gtccatccacgcccacacactc

SEQ ID NO: 7991784 - DNA, 22 bp, Homo sapiens
gtccatccacctctcgtctacc

SEQ ID NO: 7991785 - DNA, 22 bp, Homo sapiens
gtccatccagggtcaccatgac

SEQ ID NO: 7991786 - DNA, 18 bp, Homo sapiens
gtccatccaggcagtgtc

SEQ ID NO: 7991787 - DNA, 22 bp, Homo sapiens
gtccatccagaggccaccatgg

SEQ ID NO: 7991788 - DNA, 22 bp, Homo sapiens
gtccatccgtggtagcatggat

SEQ ID NO: 7991789 - DNA, 22 bp, Homo sapiens
gtccatccgtggtagcatggat

SEQ ID NO: 7991790 - DNA, 22 bp, Homo sapiens
gtccatccggccacctccagcc

SEQ ID NO: 7991791 - DNA, 22 bp, Homo sapiens
gtccatccggccacctccagcc

SEQ ID NO: 7991792 - DNA, 22 bp, Homo sapiens
gtccatccctcgagttagggtg

SEQ ID NO: 7991793 - DNA, 22 bp, Homo sapiens
gtccatccctatctgcattgct

SEQ ID NO: 7991794 - DNA, 22 bp, Homo sapiens
gtccatccatgttgtattatgt

SEQ ID NO: 7991795 - DNA, 22 bp, Homo sapiens
gtccatccattgaatataatag

SEQ ID NO: 7991796 - DNA, 22 bp, Homo sapiens
gtccagtcactgtcaatgttcc

SEQ ID NO: 7991797 - DNA, 22 bp, Homo sapiens
gtccagtcactgtcaatgttcc

SEQ ID NO: 7991798 - DNA, 22 bp, Homo sapiens
gtccagtctctttccaagccca

SEQ ID NO: 7991799 - DNA, 22 bp, Homo sapiens
gtccagtgacaagtagctggcc

SEQ ID NO: 7991800 - DNA, 22 bp, Homo sapiens
gtccagtgcttatagaatcagt

SEQ ID NO: 7991801 - DNA, 22 bp, Homo sapiens
gtccagggggcttaagcaaact

SEQ ID NO: 7991802 - DNA, 22 bp, Homo sapiens
gtccagggctaaatcaggttcc

SEQ ID NO: 7991803 - DNA, 22 bp, Homo sapiens
gtccaggtctggaccctgagcc

SEQ ID NO: 7991804 - DNA, 22 bp, Homo sapiens
gtccagggggcttaagcaaact

SEQ ID NO: 7991805 - DNA, 22 bp, Homo sapiens
gtccagggccccgagcaccagg

SEQ ID NO: 7991806 - DNA, 22 bp, Homo sapiens
gtccagggctaaatcaggttcc

SEQ ID NO: 7991807 - DNA, 22 bp, Homo sapiens
gtccagggccccgagcaccagg

SEQ ID NO: 7991808 - DNA, 22 bp, Homo sapiens
gtcccagggaggttcagggctt

SEQ ID NO: 7991809 - DNA, 22 bp, Homo sapiens
gtcccagggaagaaggcagcac

SEQ ID NO: 7991810 - DNA, 22 bp, Homo sapiens
gtcccagggaagaaggcagcac

SEQ ID NO: 7991811 - DNA, 22 bp, Homo sapiens
gtcccagggaagaaggcagcac

SEQ ID NO: 7991812 - DNA, 22 bp, Homo sapiens
gtcccactgggcaactagaaaa

SEQ ID NO: 7991813 - DNA, 22 bp, Homo sapiens
gtcccagaaacatattgctggt

SEQ ID NO: 7991814 - DNA, 22 bp, Homo sapiens
gtccattttattcagagacttt

SEQ ID NO: 7991815 - DNA, 22 bp, Homo sapiens
gtccattttattcagagacttt

SEQ ID NO: 7991816 - DNA, 22 bp, Homo sapiens
gtcccacaccttgaggggtctt

SEQ ID NO: 7991817 - DNA, 22 bp, Homo sapiens
gtcccacaggaactcggtggag

SEQ ID NO: 7991818 - DNA, 18 bp, Homo sapiens
gtccatggcctccaccca

SEQ ID NO: 7991819 - DNA, 22 bp, Homo sapiens
gtccattgttctatggctcaaa

SEQ ID NO: 7991820 - DNA, 22 bp, Homo sapiens
gtccatgcttaaataccttaaa

SEQ ID NO: 7991821 - DNA, 22 bp, Homo sapiens
gtccatctttgatgaaaactta

SEQ ID NO: 7991822 - DNA, 22 bp, Homo sapiens
gtccatcttcttggtgtagcat

SEQ ID NO: 7991823 - DNA, 22 bp, Homo sapiens
gtccatcttcttggtgtagcat

SEQ ID NO: 7991824 - DNA, 22 bp, Homo sapiens
gtccatcttattacagagcttt

SEQ ID NO: 7991825 - DNA, 22 bp, Homo sapiens
gtccatcttattacagagcttt

SEQ ID NO: 7991826 - DNA, 22 bp, Homo sapiens
gtccatctgtcacttatagtcg

SEQ ID NO: 7991827 - DNA, 22 bp, Homo sapiens
gtccatctccaccatctgggag

SEQ ID NO: 7991828 - DNA, 22 bp, Homo sapiens
gtccatctagaatttatttcta

SEQ ID NO: 7991829 - DNA, 22 bp, Homo sapiens
gtccatctaagtatccagcctg

SEQ ID NO: 7991830 - DNA, 22 bp, Homo sapiens
gtccatctagaatttatttcta

SEQ ID NO: 7991831 - DNA, 22 bp, Homo sapiens
gtccatctgtaggagggacaca

SEQ ID NO: 7991832 - DNA, 22 bp, Homo sapiens
gtccatctgtcacttatagtcg

SEQ ID NO: 7991833 - DNA, 22 bp, Homo sapiens
gtccatctgtaggagggacaca

SEQ ID NO: 7991834 - DNA, 22 bp, Homo sapiens
gtccatctcttattgatcctaa

SEQ ID NO: 7991835 - DNA, 22 bp, Homo sapiens
gtcggccacgcaggtgcggtag

SEQ ID NO: 7991836 - DNA, 22 bp, Homo sapiens
gtcggccacgcaggtgcggtag

SEQ ID NO: 7991837 - DNA, 22 bp, Homo sapiens
gtcgcagcaccggagcatcgac

SEQ ID NO: 7991838 - DNA, 22 bp, Homo sapiens
gtcctttttgtaaaatattcat

SEQ ID NO: 7991839 - DNA, 22 bp, Homo sapiens
gtcctttgaaggcaaaaggaga

SEQ ID NO: 7991840 - DNA, 22 bp, Homo sapiens
gtcctttcttaaattcctgctt

SEQ ID NO: 7991841 - DNA, 22 bp, Homo sapiens
gtcctttcttaaattcctgctt

SEQ ID NO: 7991842 - DNA, 22 bp, Homo sapiens
gtccttgtattccaagatacaa

SEQ ID NO: 7991843 - DNA, 22 bp, Homo sapiens
gtccttgggatagaaagatgaa

SEQ ID NO: 7991844 - DNA, 22 bp, Homo sapiens
gtccttgggatagaaagatgaa

SEQ ID NO: 7991845 - DNA, 22 bp, Homo sapiens
gtccttggcattctgagtcttg

SEQ ID NO: 7991846 - DNA, 22 bp, Homo sapiens
gtccttggctgggcttgcctcg

SEQ ID NO: 7991847 - DNA, 22 bp, Homo sapiens
gtccttggaggtgtggaatctg

SEQ ID NO: 7991848 - DNA, 22 bp, Homo sapiens
gtccttggaggtgtggaatctg

SEQ ID NO: 7991849 - DNA, 22 bp, Homo sapiens
gtccttggagtcaggcaaggct

SEQ ID NO: 7991850 - DNA, 22 bp, Homo sapiens
gtccttggaggtgtggaatctg

SEQ ID NO: 7991851 - DNA, 22 bp, Homo sapiens
gtccttggagctcccctctgta

SEQ ID NO: 7991852 - DNA, 22 bp, Homo sapiens
gtccttggagctcccctctgta

SEQ ID NO: 7991853 - DNA, 22 bp, Homo sapiens
gtccttgcttgagacaggcagt

SEQ ID NO: 7991854 - DNA, 22 bp, Homo sapiens
gtccttgctttggagcaggcta

SEQ ID NO: 7991855 - DNA, 22 bp, Homo sapiens
gtccttcttttcatccctggtt

SEQ ID NO: 7991856 - DNA, 22 bp, Homo sapiens
gtccttctcaaatcctgtgttt

SEQ ID NO: 7991857 - DNA, 22 bp, Homo sapiens
gtccttcttttcatccctggtt

SEQ ID NO: 7991858 - DNA, 22 bp, Homo sapiens
gtccttgcttgagacaggcagt

SEQ ID NO: 7991859 - DNA, 22 bp, Homo sapiens
gtccttgagtaagtcatggtgg

SEQ ID NO: 7991860 - DNA, 22 bp, Homo sapiens
gtccttccccagccagctctgg

SEQ ID NO: 7991861 - DNA, 22 bp, Homo sapiens
gtccttccccagccagctctgg

SEQ ID NO: 7991862 - DNA, 22 bp, Homo sapiens
gtccttcatttcctgatctcta

SEQ ID NO: 7991863 - DNA, 22 bp, Homo sapiens
gtccttctcaaatcctgtgttt

SEQ ID NO: 7991864 - DNA, 22 bp, Homo sapiens
gtccttcctgcagggatggatg

SEQ ID NO: 7991865 - DNA, 22 bp, Homo sapiens
gtccttcctgcagggatggatg

SEQ ID NO: 7991866 - DNA, 22 bp, Homo sapiens
gtccttcctgcagggatggatg

SEQ ID NO: 7991867 - DNA, 22 bp, Homo sapiens
gtccttccccagccagctctgg

SEQ ID NO: 7991868 - DNA, 22 bp, Homo sapiens
gtccttccccagccagctctgg

SEQ ID NO: 7991869 - DNA, 22 bp, Homo sapiens
gtccttcagctttatctgaaca

SEQ ID NO: 7991870 - DNA, 22 bp, Homo sapiens
gtccttcaaggtccttggtgtg

SEQ ID NO: 7991871 - DNA, 22 bp, Homo sapiens
gtccttcagggagtcaaacact

SEQ ID NO: 7991872 - DNA, 22 bp, Homo sapiens
gtccttcatttcctgatctcta

SEQ ID NO: 7991873 - DNA, 22 bp, Homo sapiens
gtccttcatggagttacagcct

SEQ ID NO: 7991874 - DNA, 22 bp, Homo sapiens
gtccttcaaggtccttggtgtg

SEQ ID NO: 7991875 - DNA, 22 bp, Homo sapiens
gtccttcaagtaacctgggacc

SEQ ID NO: 7991876 - DNA, 21 bp, Homo sapiens
gtccttcagcaagttagtggc

SEQ ID NO: 7991877 - DNA, 22 bp, Homo sapiens
gtccttcagcacctccctcggc

SEQ ID NO: 7991878 - DNA, 22 bp, Homo sapiens
gtctctgagctctgagctggct

SEQ ID NO: 7991879 - DNA, 22 bp, Homo sapiens
gtctctgagctctgagctggct

SEQ ID NO: 7991880 - DNA, 22 bp, Homo sapiens
gtctctgagctctgagctggct

SEQ ID NO: 7991881 - DNA, 22 bp, Homo sapiens
gtctctgagctctgagctggct

SEQ ID NO: 7991882 - DNA, 19 bp, Homo sapiens
gtctctggatttcaggtcc

SEQ ID NO: 7991883 - DNA, 19 bp, Homo sapiens
gtctctggatttcaggtcc

SEQ ID NO: 7991884 - DNA, 19 bp, Homo sapiens
gtctctggatttcaggtcc

SEQ ID NO: 7991885 - DNA, 22 bp, Homo sapiens
gtctctgctctagagtctgtga

SEQ ID NO: 7991886 - DNA, 22 bp, Homo sapiens
gtctcttttatggtgagttgat

SEQ ID NO: 7991887 - DNA, 22 bp, Homo sapiens
gtctcttttatggtgagttgat

SEQ ID NO: 7991888 - DNA, 22 bp, Homo sapiens
gtctcttttatggtgagttgat

SEQ ID NO: 7991889 - DNA, 22 bp, Homo sapiens
gtctgaaaatgccctacgattg

SEQ ID NO: 7991890 - DNA, 22 bp, Homo sapiens
gtctgaaaatgccctacgattg

SEQ ID NO: 7991891 - DNA, 22 bp, Homo sapiens
gtctgaaaatatgattttgcct

SEQ ID NO: 7991892 - DNA, 22 bp, Homo sapiens
gtctgaagccagtggtagtccg

SEQ ID NO: 7991893 - DNA, 22 bp, Homo sapiens
gtctgaaacgcattgttatcga

SEQ ID NO: 7991894 - DNA, 22 bp, Homo sapiens
gtctgaatacgtacttgtgaag

SEQ ID NO: 7991895 - DNA, 22 bp, Homo sapiens
gtctgaatgatgagtgggactc

SEQ ID NO: 7991896 - DNA, 22 bp, Homo sapiens
gtctgacacctagagtccagga

SEQ ID NO: 7991897 - DNA, 22 bp, Homo sapiens
gtctgaatacgtacttgtgaag

SEQ ID NO: 7991898 - DNA, 22 bp, Homo sapiens
gtctgaatgatgagtgggactc

SEQ ID NO: 7991899 - DNA, 22 bp, Homo sapiens
gtctgaattctgtgtaactcta

SEQ ID NO: 7991900 - DNA, 22 bp, Homo sapiens
gtctgagactgggcacatacct

SEQ ID NO: 7991901 - DNA, 22 bp, Homo sapiens
gtctgagaatcttgcatatcat

SEQ ID NO: 7991902 - DNA, 22 bp, Homo sapiens
gtctgagacccactcccagaga

SEQ ID NO: 7991903 - DNA, 22 bp, Homo sapiens
gtctgagactgggcacatacct

SEQ ID NO: 7991904 - DNA, 22 bp, Homo sapiens
gtctgagacccactcccagaga

SEQ ID NO: 7991905 - DNA, 22 bp, Homo sapiens
gtctgagaatcttgcatatcat

SEQ ID NO: 7991906 - DNA, 22 bp, Homo sapiens
gtctgagaactactgaggataa

SEQ ID NO: 7991907 - DNA, 22 bp, Homo sapiens
gtctgagaaagaattctgggga

SEQ ID NO: 7991908 - DNA, 22 bp, Homo sapiens
gtctgaggcgaggcctgagaac

SEQ ID NO: 7991909 - DNA, 22 bp, Homo sapiens
gtctgaggcgaggcctgagaac

SEQ ID NO: 7991910 - DNA, 22 bp, Homo sapiens
gtctgaggcgaggcctgagaac

SEQ ID NO: 7991911 - DNA, 22 bp, Homo sapiens
gtctgagggacagagtcctggc

SEQ ID NO: 7991912 - DNA, 22 bp, Homo sapiens
gtctgagggacagagtcctggc

SEQ ID NO: 7991913 - DNA, 22 bp, Homo sapiens
gtctgagggacagagtcctggc

SEQ ID NO: 7991914 - DNA, 22 bp, Homo sapiens
gtctgagggacagagtcctggc

SEQ ID NO: 7991915 - DNA, 22 bp, Homo sapiens
gtctgagggacagagtcctggc

SEQ ID NO: 7991916 - DNA, 22 bp, Homo sapiens
gtctgagggacagagtcctggc

SEQ ID NO: 7991917 - DNA, 22 bp, Homo sapiens
gtctgaggggtttcccaggaca

SEQ ID NO: 7991918 - DNA, 22 bp, Homo sapiens
gtctgaggggtttcccaggaca

SEQ ID NO: 7991919 - DNA, 22 bp, Homo sapiens
gtctgaggggtttcccaggaca

SEQ ID NO: 7991920 - DNA, 22 bp, Homo sapiens
gtctgagggtcatgggtctcac

SEQ ID NO: 7991921 - DNA, 22 bp, Homo sapiens
gtctgagggtcatgggtctcac

SEQ ID NO: 7991922 - DNA, 22 bp, Homo sapiens
gtctgagggagaaggatctggg

SEQ ID NO: 7991923 - DNA, 22 bp, Homo sapiens
gtctgagggagaaggatctggg

SEQ ID NO: 7991924 - DNA, 22 bp, Homo sapiens
gtctgagggagaaggatctggg

SEQ ID NO: 7991925 - DNA, 22 bp, Homo sapiens
gtctgaggggtttcccaggaca

SEQ ID NO: 7991926 - DNA, 22 bp, Homo sapiens
gtctgagaggaggcagcctcgg

SEQ ID NO: 7991927 - DNA, 22 bp, Homo sapiens
gtctgagaggagccaagtattg

SEQ ID NO: 7991928 - DNA, 22 bp, Homo sapiens
gtctgagcaccctggcctgtca

SEQ ID NO: 7991929 - DNA, 22 bp, Homo sapiens
gtctgagcaccctggcctgtca

SEQ ID NO: 7991930 - DNA, 22 bp, Homo sapiens
gtctgagcaccctggcctgtca

SEQ ID NO: 7991931 - DNA, 22 bp, Homo sapiens
gtctgaggaagatgcaggggga

SEQ ID NO: 7991932 - DNA, 22 bp, Homo sapiens
gtctgaggaagatgcaggggga

SEQ ID NO: 7991933 - DNA, 20 bp, Homo sapiens
gtctgaggagcagtgggaaa

SEQ ID NO: 7991934 - DNA, 20 bp, Homo sapiens
gtctgaggagcagtgggaaa

SEQ ID NO: 7991935 - DNA, 20 bp, Homo sapiens
gtctgaggagcagtgggaaa

SEQ ID NO: 7991936 - DNA, 22 bp, Homo sapiens
gtctgaggcctgaggccctggg

SEQ ID NO: 7991937 - DNA, 22 bp, Homo sapiens
gtctgaggcctgaggccctggg

SEQ ID NO: 7991938 - DNA, 22 bp, Homo sapiens
gtctgggcaagggagatggcgc

SEQ ID NO: 7991939 - DNA, 22 bp, Homo sapiens
gtctgggcacctggcctgggaa

SEQ ID NO: 7991940 - DNA, 22 bp, Homo sapiens
gtctgggcacctggcctgggaa

SEQ ID NO: 7991941 - DNA, 22 bp, Homo sapiens
gtctgggcacctggcctgggaa

SEQ ID NO: 7991942 - DNA, 22 bp, Homo sapiens
gtctgggcacctggcctgggaa

SEQ ID NO: 7991943 - DNA, 22 bp, Homo sapiens
gtctgggccaggcgagccgagg

SEQ ID NO: 7991944 - DNA, 22 bp, Homo sapiens
gtctgggccaggcgagccgagg

SEQ ID NO: 7991945 - DNA, 22 bp, Homo sapiens
gtctgggcatcagactgcgggc

SEQ ID NO: 7991946 - DNA, 22 bp, Homo sapiens
gtctgggcatcagactgcgggc

SEQ ID NO: 7991947 - DNA, 22 bp, Homo sapiens
gtctgggcaggaatctgcattc

SEQ ID NO: 7991948 - DNA, 22 bp, Homo sapiens
gtctgggcaggaatctgcattc

SEQ ID NO: 7991949 - DNA, 22 bp, Homo sapiens
gtctgggcagcagcatttctta

SEQ ID NO: 7991950 - DNA, 22 bp, Homo sapiens
gtctggctttatatttgctatt

SEQ ID NO: 7991951 - DNA, 22 bp, Homo sapiens
gtctggctttatatttgctatt

SEQ ID NO: 7991952 - DNA, 22 bp, Homo sapiens
gtctggctttatatttgctatt

SEQ ID NO: 7991953 - DNA, 22 bp, Homo sapiens
gtctggctttgctcagatgctg

SEQ ID NO: 7991954 - DNA, 22 bp, Homo sapiens
gtctggctttcatggctctgca

SEQ ID NO: 7991955 - DNA, 22 bp, Homo sapiens
gtctggcttttgccctgtgttt

SEQ ID NO: 7991956 - DNA, 22 bp, Homo sapiens
gtctgggcaagggagatggcgc

SEQ ID NO: 7991957 - DNA, 22 bp, Homo sapiens
gtctgggcaagggagatggcgc

SEQ ID NO: 7991958 - DNA, 22 bp, Homo sapiens
gtctgggcaagggagatggcgc

SEQ ID NO: 7991959 - DNA, 22 bp, Homo sapiens
gtctggggaagtcagggcatca

SEQ ID NO: 7991960 - DNA, 22 bp, Homo sapiens
gtctggggaagtcagggcatca

SEQ ID NO: 7991961 - DNA, 17 bp, Homo sapiens
gtctgggctttagagac

SEQ ID NO: 7991962 - DNA, 22 bp, Homo sapiens
gtctggggcagcaaggcgcgcg

SEQ ID NO: 7991963 - DNA, 22 bp, Homo sapiens
gtctggggaagtcagggcatca

SEQ ID NO: 7991964 - DNA, 22 bp, Homo sapiens
gtctggggcagcaaggcgcgcg

SEQ ID NO: 7991965 - DNA, 22 bp, Homo sapiens
gtctgggctcctggcaggcagc

SEQ ID NO: 7991966 - DNA, 22 bp, Homo sapiens
gtctgggcttagggacatggca

SEQ ID NO: 7991967 - DNA, 22 bp, Homo sapiens
gtctgggcttagggacatggca

SEQ ID NO: 7991968 - DNA, 22 bp, Homo sapiens
gtctgggcttagggacatggca

SEQ ID NO: 7991969 - DNA, 22 bp, Homo sapiens
gtctgggcttcagagttagaga

SEQ ID NO: 7991970 - DNA, 22 bp, Homo sapiens
gtctgggctcccagggtcggcg

SEQ ID NO: 7991971 - DNA, 22 bp, Homo sapiens
gtctgggctcccagggtcggcg

SEQ ID NO: 7991972 - DNA, 22 bp, Homo sapiens
gtctgggctcccagggtcggcg

SEQ ID NO: 7991973 - DNA, 22 bp, Homo sapiens
gtctgggctcccagggtcggcg

SEQ ID NO: 7991974 - DNA, 22 bp, Homo sapiens
gtctgggctcctggcaggcagc

SEQ ID NO: 7991975 - DNA, 22 bp, Homo sapiens
gtctgggctcctggcaggcagc

SEQ ID NO: 7991976 - DNA, 22 bp, Homo sapiens
gtctgggctcctggcaggcagc

SEQ ID NO: 7991977 - DNA, 22 bp, Homo sapiens
gtctgggctcctggcaggcagc

SEQ ID NO: 7991978 - DNA, 22 bp, Homo sapiens
gtctggctcgctctcgcccgtc

SEQ ID NO: 7991979 - DNA, 22 bp, Homo sapiens
gtctggctccgaggagtggcag

SEQ ID NO: 7991980 - DNA, 22 bp, Homo sapiens
gtctggctcccactcttacaaa

SEQ ID NO: 7991981 - DNA, 22 bp, Homo sapiens
gtctggctccgaggagtggcag

SEQ ID NO: 7991982 - DNA, 22 bp, Homo sapiens
gtctggctccgaggagtggcag

SEQ ID NO: 7991983 - DNA, 22 bp, Homo sapiens
gtctggctgttcctgcctgtga

SEQ ID NO: 7991984 - DNA, 20 bp, Homo sapiens
gtctggcttcgtgattctgg

SEQ ID NO: 7991985 - DNA, 20 bp, Homo sapiens
gtctggcttcgtgattctgg

SEQ ID NO: 7991986 - DNA, 22 bp, Homo sapiens
gtctggctgtccagcttatcta

SEQ ID NO: 7991987 - DNA, 22 bp, Homo sapiens
gtctggctgtccagcttatcta

SEQ ID NO: 7991988 - DNA, 22 bp, Homo sapiens
gtctggctgttcctgcctgtga

SEQ ID NO: 7991989 - DNA, 22 bp, Homo sapiens
gtctggctgtccagcttatcta

SEQ ID NO: 7991990 - DNA, 22 bp, Homo sapiens
gtctggctgataaaatgctctt

SEQ ID NO: 7991991 - DNA, 22 bp, Homo sapiens
gtctggctcccactcttacaaa

SEQ ID NO: 7991992 - DNA, 22 bp, Homo sapiens
gtctggctccaggatctcatga

SEQ ID NO: 7991993 - DNA, 22 bp, Homo sapiens
gtctggctaggcacgccgtgtt

SEQ ID NO: 7991994 - DNA, 22 bp, Homo sapiens
gtctggctaggcacgccgtgtt

SEQ ID NO: 7991995 - DNA, 22 bp, Homo sapiens
gtctggctaattttggtaattt

SEQ ID NO: 7991996 - DNA, 22 bp, Homo sapiens
gtctggcctgccagctctggtg

SEQ ID NO: 7991997 - DNA, 22 bp, Homo sapiens
gtctggccatttgcccattgtg

SEQ ID NO: 7991998 - DNA, 22 bp, Homo sapiens
gtctggcattcttcctggagaa

SEQ ID NO: 7991999 - DNA, 22 bp, Homo sapiens
gtctggcagatcgagcagccca

SEQ ID NO: 7992000 - DNA, 22 bp, Homo sapiens
gtctggcatatgcaaagtgcat

SEQ ID NO: 7992001 - DNA, 22 bp, Homo sapiens
gtctggcatatgcaaagtgcat

SEQ ID NO: 7992002 - DNA, 22 bp, Homo sapiens
gtctggcacataagaggagctc

SEQ ID NO: 7992003 - DNA, 22 bp, Homo sapiens
gtctgcacggggaggatgggct

SEQ ID NO: 7992004 - DNA, 22 bp, Homo sapiens
gtctgcacgtgccagggagggg

SEQ ID NO: 7992005 - DNA, 22 bp, Homo sapiens
gtctgcactgtggagtactgtg

SEQ ID NO: 7992006 - DNA, 22 bp, Homo sapiens
gtctgcactgtggagtactgtg

SEQ ID NO: 7992007 - DNA, 22 bp, Homo sapiens
gtctgcagagggaaggcttcag

SEQ ID NO: 7992008 - DNA, 21 bp, Homo sapiens
gtctgcagaccccttcattgc

SEQ ID NO: 7992009 - DNA, 21 bp, Homo sapiens
gtctgatgcttgatgcagttg

SEQ ID NO: 7992010 - DNA, 22 bp, Homo sapiens
gtctgaggtcattagctctctt

SEQ ID NO: 7992011 - DNA, 22 bp, Homo sapiens
gtctgaggtcattagctctctt

SEQ ID NO: 7992012 - DNA, 21 bp, Homo sapiens
gtctgatgcttgatgcagttg

SEQ ID NO: 7992013 - DNA, 22 bp, Homo sapiens
gtctgaggtcattagctctctt

SEQ ID NO: 7992014 - DNA, 22 bp, Homo sapiens
gtctgaggtcattagctctctt

SEQ ID NO: 7992015 - DNA, 22 bp, Homo sapiens
gtctgagggttgtgctggagga

SEQ ID NO: 7992016 - DNA, 22 bp, Homo sapiens
gtctgagggtcatgggtctcac

SEQ ID NO: 7992017 - DNA, 22 bp, Homo sapiens
gtctgagggtcatgggtctcac

SEQ ID NO: 7992018 - DNA, 22 bp, Homo sapiens
gtctgagggttgtgctggagga

SEQ ID NO: 7992019 - DNA, 22 bp, Homo sapiens
gtctgagggttgtgctggagga

SEQ ID NO: 7992020 - DNA, 22 bp, Homo sapiens
gtctgagggttgtgctggagga

SEQ ID NO: 7992021 - DNA, 22 bp, Homo sapiens
gtctggcacataagaggagctc

SEQ ID NO: 7992022 - DNA, 22 bp, Homo sapiens
gtctgcccagaagacatcccct

SEQ ID NO: 7992023 - DNA, 21 bp, Homo sapiens
gtctggatgcccttctcttgg

SEQ ID NO: 7992024 - DNA, 22 bp, Homo sapiens
gtctgccagcaccataaattag

SEQ ID NO: 7992025 - DNA, 22 bp, Homo sapiens
gtctgccatgtggagaaagcca

SEQ ID NO: 7992026 - DNA, 22 bp, Homo sapiens
gtctgcagcctccacctcctgg

SEQ ID NO: 7992027 - DNA, 20 bp, Homo sapiens
gtctgcagtaagagggaata

SEQ ID NO: 7992028 - DNA, 22 bp, Homo sapiens
gtctgcagacaacttagaagca

SEQ ID NO: 7992029 - DNA, 21 bp, Homo sapiens
gtctgcagaccccttcattgc

SEQ ID NO: 7992030 - DNA, 22 bp, Homo sapiens
gtctgcagcctccacctcctgg

SEQ ID NO: 7992031 - DNA, 22 bp, Homo sapiens
gtctgcagcctccacctcctgg

SEQ ID NO: 7992032 - DNA, 22 bp, Homo sapiens
gtctgcagcacatagattagaa

SEQ ID NO: 7992033 - DNA, 22 bp, Homo sapiens
gtctgcagcacatagattagaa

SEQ ID NO: 7992034 - DNA, 22 bp, Homo sapiens
gtctgcattggagacaagagtc

SEQ ID NO: 7992035 - DNA, 22 bp, Homo sapiens
gtctgcattggagacaagagtc

SEQ ID NO: 7992036 - DNA, 22 bp, Homo sapiens
gtctgcattgaccctactagtc

SEQ ID NO: 7992037 - DNA, 18 bp, Homo sapiens
gtctgccaacaactatca

SEQ ID NO: 7992038 - DNA, 22 bp, Homo sapiens
gtctgcatacaggacatgcaca

SEQ ID NO: 7992039 - DNA, 22 bp, Homo sapiens
gtctgcatacaggacatgcaca

SEQ ID NO: 7992040 - DNA, 22 bp, Homo sapiens
gtctgcatattagatttgtttt

SEQ ID NO: 7992041 - DNA, 22 bp, Homo sapiens
gtctgcattgaccctactagtc

SEQ ID NO: 7992042 - DNA, 22 bp, Homo sapiens
gtctgcattgaccctactagtc

SEQ ID NO: 7992043 - DNA, 22 bp, Homo sapiens
ggtggcagttacaggggcaaat

SEQ ID NO: 7992044 - DNA, 22 bp, Homo sapiens
ggtggcataagaacactaaaga

SEQ ID NO: 7992045 - DNA, 22 bp, Homo sapiens
ggtggcatacaacatagaggct

SEQ ID NO: 7992046 - DNA, 22 bp, Homo sapiens
ggtggcataagaacactaaaga

SEQ ID NO: 7992047 - DNA, 22 bp, Homo sapiens
ggtggcaggctggcattggcaa

SEQ ID NO: 7992048 - DNA, 22 bp, Homo sapiens
ggtggcagttacaggggcaaat

SEQ ID NO: 7992049 - DNA, 22 bp, Homo sapiens
ggtggcagttacaggggcaaat

SEQ ID NO: 7992050 - DNA, 22 bp, Homo sapiens
ggtggcagttacaggggcaaat

SEQ ID NO: 7992051 - DNA, 22 bp, Homo sapiens
ggtggcatctctttccagattt

SEQ ID NO: 7992052 - DNA, 22 bp, Homo sapiens
ggtggcatggcaaagaaatagc

SEQ ID NO: 7992053 - DNA, 22 bp, Homo sapiens
ggtggcatggcaaagaaatagc

SEQ ID NO: 7992054 - DNA, 22 bp, Homo sapiens
ggtggcatggcagttgatgtaa

SEQ ID NO: 7992055 - DNA, 22 bp, Homo sapiens
ggtggcattcagaagagctggc

SEQ ID NO: 7992056 - DNA, 22 bp, Homo sapiens
ggtggcatctcagttcatgggc

SEQ ID NO: 7992057 - DNA, 22 bp, Homo sapiens
ggtggcatcacagtactggggg

SEQ ID NO: 7992058 - DNA, 22 bp, Homo sapiens
ggtggcatacatttctgtcttg

SEQ ID NO: 7992059 - DNA, 22 bp, Homo sapiens
ggtggccataggaccagcctgg

SEQ ID NO: 7992060 - DNA, 22 bp, Homo sapiens
ggtggccataggaccagcctgg

SEQ ID NO: 7992061 - DNA, 22 bp, Homo sapiens
ggtggccataggaccagcctgg

SEQ ID NO: 7992062 - DNA, 22 bp, Homo sapiens
ggtggccataggaccagcctgg

SEQ ID NO: 7992063 - DNA, 22 bp, Homo sapiens
ggtggccaggccagctctggcc

SEQ ID NO: 7992064 - DNA, 22 bp, Homo sapiens
ggtggccaggccagctctggcc

SEQ ID NO: 7992065 - DNA, 22 bp, Homo sapiens
ggtggcattgatccctcccagc

SEQ ID NO: 7992066 - DNA, 22 bp, Homo sapiens
ggtggcattcagtaagtatata

SEQ ID NO: 7992067 - DNA, 22 bp, Homo sapiens
ggtggcattcagaagagctggc

SEQ ID NO: 7992068 - DNA, 22 bp, Homo sapiens
ggtggcattcagaagagctggc

SEQ ID NO: 7992069 - DNA, 22 bp, Homo sapiens
ggtggcattcagtaagtatata

SEQ ID NO: 7992070 - DNA, 22 bp, Homo sapiens
ggtggcattcagaagagctggc

SEQ ID NO: 7992071 - DNA, 22 bp, Homo sapiens
ggtggcattcagaagagctggc

SEQ ID NO: 7992072 - DNA, 22 bp, Homo sapiens
ggtggcatttaaattaattaag

SEQ ID NO: 7992073 - DNA, 22 bp, Homo sapiens
ggtggcatttaaattaattaag

SEQ ID NO: 7992074 - DNA, 22 bp, Homo sapiens
ggtggccaggagacatttgtca

SEQ ID NO: 7992075 - DNA, 22 bp, Homo sapiens
ggtggccaggagacatttgtca

SEQ ID NO: 7992076 - DNA, 22 bp, Homo sapiens
ggtggccaggccagctctggcc

SEQ ID NO: 7992077 - DNA, 22 bp, Homo sapiens
ggtggccaggccagctctggcc

SEQ ID NO: 7992078 - DNA, 22 bp, Homo sapiens
ggtggcaggccctgagcatccc

SEQ ID NO: 7992079 - DNA, 22 bp, Homo sapiens
ggtggcaggccctgagcatccc

SEQ ID NO: 7992080 - DNA, 22 bp, Homo sapiens
ggtggcaggccctgagcatccc

SEQ ID NO: 7992081 - DNA, 22 bp, Homo sapiens
ggtggcaggccctgagcatccc

SEQ ID NO: 7992082 - DNA, 22 bp, Homo sapiens
ggtggcaggccctgagcatccc

SEQ ID NO: 7992083 - DNA, 22 bp, Homo sapiens
ggtggcaggccctgagcatccc

SEQ ID NO: 7992084 - DNA, 22 bp, Homo sapiens
ggtggcaggccctgagcatccc

SEQ ID NO: 7992085 - DNA, 22 bp, Homo sapiens
ggtggcaggccctgagcatccc

SEQ ID NO: 7992086 - DNA, 22 bp, Homo sapiens
ggtggcaggctggcattggcaa

SEQ ID NO: 7992087 - DNA, 22 bp, Homo sapiens
ggtggcaggctggcattggcaa

SEQ ID NO: 7992088 - DNA, 22 bp, Homo sapiens
ggtggcaggctggcattggcaa

SEQ ID NO: 7992089 - DNA, 22 bp, Homo sapiens
ggtggcaggctggcattggcaa

SEQ ID NO: 7992090 - DNA, 22 bp, Homo sapiens
ggtggcaggctggcattggcaa

SEQ ID NO: 7992091 - DNA, 22 bp, Homo sapiens
ggtggcaggctggcattggcaa

SEQ ID NO: 7992092 - DNA, 22 bp, Homo sapiens
ggtggcaggctggcattggcaa

SEQ ID NO: 7992093 - DNA, 22 bp, Homo sapiens
ggtggcaggctggcattggcaa

SEQ ID NO: 7992094 - DNA, 22 bp, Homo sapiens
ggtggcagcgtctatctgacat

SEQ ID NO: 7992095 - DNA, 19 bp, Homo sapiens
ggtggcaggaataaaggtc

SEQ ID NO: 7992096 - DNA, 23 bp, Homo sapiens
ggtggcaggagtggatgctgagc

SEQ ID NO: 7992097 - DNA, 19 bp, Homo sapiens
ggtggcaggaataaaggtc

SEQ ID NO: 7992098 - DNA, 19 bp, Homo sapiens
ggtggcaggaataaaggtc

SEQ ID NO: 7992099 - DNA, 22 bp, Homo sapiens
ggtggcagcatggtcccagtgt

SEQ ID NO: 7992100 - DNA, 22 bp, Homo sapiens
ggtggcagcgtctatctgacat

SEQ ID NO: 7992101 - DNA, 22 bp, Homo sapiens
ggtggcagcgtctatctgacat

SEQ ID NO: 7992102 - DNA, 22 bp, Homo sapiens
ggtggcagcgtctatctgacat

SEQ ID NO: 7992103 - DNA, 22 bp, Homo sapiens
ggtggcagcgtctatctgacat

SEQ ID NO: 7992104 - DNA, 22 bp, Homo sapiens
ggtggcagcatggtcccagtgt

SEQ ID NO: 7992105 - DNA, 22 bp, Homo sapiens
ggtggcagcatggtcccagtgt

SEQ ID NO: 7992106 - DNA, 23 bp, Homo sapiens
ggtggcaggagtggatgctgagc

SEQ ID NO: 7992107 - DNA, 23 bp, Homo sapiens
ggtggcaggagtggatgctgagc

SEQ ID NO: 7992108 - DNA, 23 bp, Homo sapiens
ggtggcaggagtggatgctgagc

SEQ ID NO: 7992109 - DNA, 23 bp, Homo sapiens
ggtggcaggagtggatgctgagc

SEQ ID NO: 7992110 - DNA, 23 bp, Homo sapiens
ggtggcaggagtggatgctgagc

SEQ ID NO: 7992111 - DNA, 23 bp, Homo sapiens
ggtggcaggagtggatgctgagc

SEQ ID NO: 7992112 - DNA, 23 bp, Homo sapiens
ggtggcaggagtggatgctgagc

SEQ ID NO: 7992113 - DNA, 19 bp, Homo sapiens
ggtggcaggaataaaggtc

SEQ ID NO: 7992114 - DNA, 22 bp, Homo sapiens
ggtggcaggccctgagcatccc

SEQ ID NO: 7992115 - DNA, 23 bp, Homo sapiens
ggtggcaggagtggatgctgagc

SEQ ID NO: 7992116 - DNA, 22 bp, Homo sapiens
ggtgtcatccaacaggacaggg

SEQ ID NO: 7992117 - DNA, 22 bp, Homo sapiens
ggtgtccactcagcccgtcctg

SEQ ID NO: 7992118 - DNA, 22 bp, Homo sapiens
ggtgtccacattccctggcagg

SEQ ID NO: 7992119 - DNA, 22 bp, Homo sapiens
ggtgtccactcagcccgtcctg

SEQ ID NO: 7992120 - DNA, 21 bp, Homo sapiens
ggtgtccagaggagtccccag

SEQ ID NO: 7992121 - DNA, 22 bp, Homo sapiens
ggtgtccattggcctaacctag

SEQ ID NO: 7992122 - DNA, 22 bp, Homo sapiens
ggtgtccattggcctaacctag

SEQ ID NO: 7992123 - DNA, 21 bp, Homo sapiens
ggtgtccagaggagtccccag

SEQ ID NO: 7992124 - DNA, 22 bp, Homo sapiens
ggtgtccatcaggctgtgcttc

SEQ ID NO: 7992125 - DNA, 22 bp, Homo sapiens
ggtgtccatcaggctgtgcttc

SEQ ID NO: 7992126 - DNA, 22 bp, Homo sapiens
ggtgtcccaggccagctgtgtg

SEQ ID NO: 7992127 - DNA, 22 bp, Homo sapiens
ggtgtccgcgctgtagaaggtc

SEQ ID NO: 7992128 - DNA, 19 bp, Homo sapiens
ggtgtcaggcctctctcct

SEQ ID NO: 7992129 - DNA, 20 bp, Homo sapiens
ggtgtcagggccatgcctgg

SEQ ID NO: 7992130 - DNA, 20 bp, Homo sapiens
ggtgtcagggccatgcctgg

SEQ ID NO: 7992131 - DNA, 22 bp, Homo sapiens
ggtgtcagcctgggagcctagc

SEQ ID NO: 7992132 - DNA, 22 bp, Homo sapiens
ggtgtcaggaaaatctcagtgt

SEQ ID NO: 7992133 - DNA, 16 bp, Homo sapiens
ggtgtcagatgtccag

SEQ ID NO: 7992134 - DNA, 22 bp, Homo sapiens
ggtgtcagatacataggaagta

SEQ ID NO: 7992135 - DNA, 22 bp, Homo sapiens
ggtgtcagttgctcatcagagt

SEQ ID NO: 7992136 - DNA, 22 bp, Homo sapiens
ggtgtcagtgagagcacagtac

SEQ ID NO: 7992137 - DNA, 22 bp, Homo sapiens
ggtgtcagttgctcatcagagt

SEQ ID NO: 7992138 - DNA, 22 bp, Homo sapiens
ggtgtcagtgaaggtagagttt

SEQ ID NO: 7992139 - DNA, 22 bp, Homo sapiens
ggtgtcagtgagagcacagtac

SEQ ID NO: 7992140 - DNA, 22 bp, Homo sapiens
ggtggttcacgcctataatccc

SEQ ID NO: 7992141 - DNA, 23 bp, Homo sapiens
ggtggtggtgagtcacgggctca

SEQ ID NO: 7992142 - DNA, 23 bp, Homo sapiens
ggtggtggtgagtcacgggctca

SEQ ID NO: 7992143 - DNA, 23 bp, Homo sapiens
ggtggtggtgagtcacgggctca

SEQ ID NO: 7992144 - DNA, 23 bp, Homo sapiens
ggtggtggtgagtcacgggctca

SEQ ID NO: 7992145 - DNA, 23 bp, Homo sapiens
ggtggtggtgagtcacgggctca

SEQ ID NO: 7992146 - DNA, 22 bp, Homo sapiens
ggtggtggtcccgacttgggag

SEQ ID NO: 7992147 - DNA, 22 bp, Homo sapiens
ggtggccatggtcaggtagcgg

SEQ ID NO: 7992148 - DNA, 22 bp, Homo sapiens
ggtggccattctaccgccttct

SEQ ID NO: 7992149 - DNA, 22 bp, Homo sapiens
ggtggccattctaccgccttct

SEQ ID NO: 7992150 - DNA, 22 bp, Homo sapiens
ggtggccattctaccgccttct

SEQ ID NO: 7992151 - DNA, 22 bp, Homo sapiens
ggtggccatggtcaggtagcgg

SEQ ID NO: 7992152 - DNA, 22 bp, Homo sapiens
ggtggccatggtcaggtagcgg

SEQ ID NO: 7992153 - DNA, 22 bp, Homo sapiens
ggtggtggtcccgacttgggag

SEQ ID NO: 7992154 - DNA, 22 bp, Homo sapiens
ggtggtggtcccgacttgggag

SEQ ID NO: 7992155 - DNA, 22 bp, Homo sapiens
ggtggccctaaccgcagcctcc

SEQ ID NO: 7992156 - DNA, 22 bp, Homo sapiens
ggtgtcaatgctcccaccttgg

SEQ ID NO: 7992157 - DNA, 22 bp, Homo sapiens
ggtgtcaaaataccatttcagg

SEQ ID NO: 7992158 - DNA, 22 bp, Homo sapiens
ggtgtcaaattattgagtttca

SEQ ID NO: 7992159 - DNA, 22 bp, Homo sapiens
ggtgtcagactttgcatatcct

SEQ ID NO: 7992160 - DNA, 22 bp, Homo sapiens
ggtgtcagactttgcatatcct

SEQ ID NO: 7992161 - DNA, 22 bp, Homo sapiens
ggtgtcagaagtgggatattac

SEQ ID NO: 7992162 - DNA, 22 bp, Homo sapiens
ggtgtagctctgtgtcccactg

SEQ ID NO: 7992163 - DNA, 22 bp, Homo sapiens
ggtgtagctctgtgtcccactg

SEQ ID NO: 7992164 - DNA, 22 bp, Homo sapiens
ggtgtagctctgtgtcccactg

SEQ ID NO: 7992165 - DNA, 22 bp, Homo sapiens
ggtgtagataatgatgctctcc

SEQ ID NO: 7992166 - DNA, 22 bp, Homo sapiens
ggtgtagaaaagggaagggttt

SEQ ID NO: 7992167 - DNA, 22 bp, Homo sapiens
ggtggttgcataggccagcagc

SEQ ID NO: 7992168 - DNA, 22 bp, Homo sapiens
ggtggttcacgcctataatccc

SEQ ID NO: 7992169 - DNA, 22 bp, Homo sapiens
gggtggggttcaggaatcttca

SEQ ID NO: 7992170 - DNA, 22 bp, Homo sapiens
gggtggggttcaggaatcttca

SEQ ID NO: 7992171 - DNA, 22 bp, Homo sapiens
gggtggggttcaggaatcttca

SEQ ID NO: 7992172 - DNA, 22 bp, Homo sapiens
gggtggggttcaggaatcttca

SEQ ID NO: 7992173 - DNA, 22 bp, Homo sapiens
gggtggggtgtatcggatccta

SEQ ID NO: 7992174 - DNA, 22 bp, Homo sapiens
gggtggggtgtatcggatccta

SEQ ID NO: 7992175 - DNA, 22 bp, Homo sapiens
gggtggggtgtatcggatccta

SEQ ID NO: 7992176 - DNA, 22 bp, Homo sapiens
gggtggggtgtatcggatccta

SEQ ID NO: 7992177 - DNA, 22 bp, Homo sapiens
gggtggggtgtatcggatccta

SEQ ID NO: 7992178 - DNA, 22 bp, Homo sapiens
gggtggggtgtatcggatccta

SEQ ID NO: 7992179 - DNA, 22 bp, Homo sapiens
gggtggggtgtatcggatccta

SEQ ID NO: 7992180 - DNA, 22 bp, Homo sapiens
gggtggggcccaggaaatctat

SEQ ID NO: 7992181 - DNA, 22 bp, Homo sapiens
gggtggggcccaggaaatctat

SEQ ID NO: 7992182 - DNA, 22 bp, Homo sapiens
gggtggggcccaggaaatctat

SEQ ID NO: 7992183 - DNA, 22 bp, Homo sapiens
gggtggggcccaggaaatctat

SEQ ID NO: 7992184 - DNA, 22 bp, Homo sapiens
gggtgggcctgtctggccatgt

SEQ ID NO: 7992185 - DNA, 22 bp, Homo sapiens
gggtggggccaggcaatttgca

SEQ ID NO: 7992186 - DNA, 22 bp, Homo sapiens
gggtgggcctgtctggccatgt

SEQ ID NO: 7992187 - DNA, 22 bp, Homo sapiens
gggtggggccaggcaatttgca

SEQ ID NO: 7992188 - DNA, 22 bp, Homo sapiens
gggtggggccaggcaatttgca

SEQ ID NO: 7992189 - DNA, 22 bp, Homo sapiens
ggtgaggggagagtgaaagaaa

SEQ ID NO: 7992190 - DNA, 22 bp, Homo sapiens
ggtgaggggcacctctgcccgg

SEQ ID NO: 7992191 - DNA, 22 bp, Homo sapiens
ggtgaggggcacctctgcccgg

SEQ ID NO: 7992192 - DNA, 22 bp, Homo sapiens
ggtgaggggagagtgaaagaaa

SEQ ID NO: 7992193 - DNA, 22 bp, Homo sapiens
ggtgaggggagagtgaaagaaa

SEQ ID NO: 7992194 - DNA, 22 bp, Homo sapiens
ggtgaggggagagtgaaagaaa

SEQ ID NO: 7992195 - DNA, 22 bp, Homo sapiens
ggtgaggggcgcctctgcccgg

SEQ ID NO: 7992196 - DNA, 22 bp, Homo sapiens
ggtgaggggcgcctctgcccag

SEQ ID NO: 7992197 - DNA, 22 bp, Homo sapiens
ggtgaggggcgcctctgcccag

SEQ ID NO: 7992198 - DNA, 22 bp, Homo sapiens
ggtgaggggcgcctctgcccag

SEQ ID NO: 7992199 - DNA, 22 bp, Homo sapiens
ggtgaggggcacctctgcccgg

SEQ ID NO: 7992200 - DNA, 22 bp, Homo sapiens
ggtgagggtaaatataggcaaa

SEQ ID NO: 7992201 - DNA, 22 bp, Homo sapiens
ggtgagggtaaatataggcaaa

SEQ ID NO: 7992202 - DNA, 22 bp, Homo sapiens
ggtgagggtaaatataggcaaa

SEQ ID NO: 7992203 - DNA, 22 bp, Homo sapiens
ggtgagggtaaatataggcaaa

SEQ ID NO: 7992204 - DNA, 22 bp, Homo sapiens
ggtgagggtaaatataggcaaa

SEQ ID NO: 7992205 - DNA, 22 bp, Homo sapiens
ggtgagggtaaatataggcaaa

SEQ ID NO: 7992206 - DNA, 22 bp, Homo sapiens
ggtgaggggctcctctgcccgg

SEQ ID NO: 7992207 - DNA, 22 bp, Homo sapiens
ggtgaggggctcctctgcccgg

SEQ ID NO: 7992208 - DNA, 22 bp, Homo sapiens
ggtgagggtaaactaaaacatc

SEQ ID NO: 7992209 - DNA, 22 bp, Homo sapiens
ggtgaggggcgcctctgcccgg

SEQ ID NO: 7992210 - DNA, 22 bp, Homo sapiens
ggtgaggggctcctctgcccgg

SEQ ID NO: 7992211 - DNA, 22 bp, Homo sapiens
ggtgaggggcgcctctgcccgg

SEQ ID NO: 7992212 - DNA, 22 bp, Homo sapiens
ggtgcaaaagtaatcacagttt

SEQ ID NO: 7992213 - DNA, 22 bp, Homo sapiens
ggtgcaggaaaattacctggag

SEQ ID NO: 7992214 - DNA, 22 bp, Homo sapiens
ggtgcaggaatctgcaattgaa

SEQ ID NO: 7992215 - DNA, 22 bp, Homo sapiens
ggtgcaggaatctgcaattgaa

SEQ ID NO: 7992216 - DNA, 22 bp, Homo sapiens
ggtgcaggaatctgcaattgaa

SEQ ID NO: 7992217 - DNA, 22 bp, Homo sapiens
ggtgcaggaatctgcaattgaa

SEQ ID NO: 7992218 - DNA, 22 bp, Homo sapiens
ggtgcaggaatctgcaattgaa

SEQ ID NO: 7992219 - DNA, 22 bp, Homo sapiens
ggtgcaggacgaagtgggggtt

SEQ ID NO: 7992220 - DNA, 22 bp, Homo sapiens
ggtgcaggacgaagtgggggtt

SEQ ID NO: 7992221 - DNA, 22 bp, Homo sapiens
ggtgcaggacgaagtgggggtt

SEQ ID NO: 7992222 - DNA, 22 bp, Homo sapiens
ggtgcaggacgaagtgggggtt

SEQ ID NO: 7992223 - DNA, 22 bp, Homo sapiens
ggtgcaggacgaagtgggggtt

SEQ ID NO: 7992224 - DNA, 22 bp, Homo sapiens
ggtgcaggacgaagtgggggtt

SEQ ID NO: 7992225 - DNA, 22 bp, Homo sapiens
ggtgcaggagcggggtgctcgg

SEQ ID NO: 7992226 - DNA, 22 bp, Homo sapiens
ggtgcaggagcggggtgctcgg

SEQ ID NO: 7992227 - DNA, 22 bp, Homo sapiens
ggtgagtgtcaatggttagagt

SEQ ID NO: 7992228 - DNA, 22 bp, Homo sapiens
ggtgagtgcctggcctggccac

SEQ ID NO: 7992229 - DNA, 22 bp, Homo sapiens
ggtgatgaaaagtgcctttatc

SEQ ID NO: 7992230 - DNA, 22 bp, Homo sapiens
ggtgatgtttgagttgagacag

SEQ ID NO: 7992231 - DNA, 22 bp, Homo sapiens
ggtgattctgtgaggggctgac

SEQ ID NO: 7992232 - DNA, 22 bp, Homo sapiens
ggtgagtttcatggttgtttac

SEQ ID NO: 7992233 - DNA, 22 bp, Homo sapiens
ggtggcagaggtgcatcagccc

SEQ ID NO: 7992234 - DNA, 22 bp, Homo sapiens
ggtggcagcatggtcccagtgt

SEQ ID NO: 7992235 - DNA, 22 bp, Homo sapiens
ggtggcagcatggtcccagtgt

SEQ ID NO: 7992236 - DNA, 22 bp, Homo sapiens
ggtggcagaggtgcatcagccc

SEQ ID NO: 7992237 - DNA, 22 bp, Homo sapiens
ggtggcagaggtgcatcagccc

SEQ ID NO: 7992238 - DNA, 22 bp, Homo sapiens
ggtggcagaggtgcatcagccc

SEQ ID NO: 7992239 - DNA, 22 bp, Homo sapiens
ggtggcagaggtgcatcagccc

SEQ ID NO: 7992240 - DNA, 22 bp, Homo sapiens
ggtggcagaggtgcatcagccc

SEQ ID NO: 7992241 - DNA, 22 bp, Homo sapiens
ggtggcagaggtgcatcagccc

SEQ ID NO: 7992242 - DNA, 22 bp, Homo sapiens
ggtggcagagaggaggtagttt

SEQ ID NO: 7992243 - DNA, 22 bp, Homo sapiens
ggtggcagagaggaggtagttt

SEQ ID NO: 7992244 - DNA, 22 bp, Homo sapiens
ggtggcagagaggaggtagttt

SEQ ID NO: 7992245 - DNA, 22 bp, Homo sapiens
ggtggcagaggtgcatcagccc

SEQ ID NO: 7992246 - DNA, 22 bp, Homo sapiens
ggtggcagagaggaggtagttt

SEQ ID NO: 7992247 - DNA, 22 bp, Homo sapiens
ggtgcaggcggtggggcaagta

SEQ ID NO: 7992248 - DNA, 22 bp, Homo sapiens
ggtgcaggcggtggggcaagta

SEQ ID NO: 7992249 - DNA, 22 bp, Homo sapiens
ggtgcaggcggtggggcaagta

SEQ ID NO: 7992250 - DNA, 22 bp, Homo sapiens
ggtgcaggcggtggggcaagta

SEQ ID NO: 7992251 - DNA, 22 bp, Homo sapiens
ggtgcaggcggtggggcaagta

SEQ ID NO: 7992252 - DNA, 22 bp, Homo sapiens
ggtgcaggcggtggggcaagta

SEQ ID NO: 7992253 - DNA, 22 bp, Homo sapiens
ggtgcaggcggtggggcaagta

SEQ ID NO: 7992254 - DNA, 22 bp, Homo sapiens
ggtgcaggcggtggggcaagta

SEQ ID NO: 7992255 - DNA, 22 bp, Homo sapiens
ggtgcaggcggtggggcaagta

SEQ ID NO: 7992256 - DNA, 22 bp, Homo sapiens
ggtgcaggcggtggggcaagta

SEQ ID NO: 7992257 - DNA, 22 bp, Homo sapiens
ggtggcagagaggaggtagttt

SEQ ID NO: 7992258 - DNA, 22 bp, Homo sapiens
ggtggcagagaggaggtagttt

SEQ ID NO: 7992259 - DNA, 22 bp, Homo sapiens
ggtgcaggagcggggtgctcgg

SEQ ID NO: 7992260 - DNA, 22 bp, Homo sapiens
ggtgcaggcggtggggcaagta

SEQ ID NO: 7992261 - DNA, 22 bp, Homo sapiens
ggtgcaggcggtggggcaagta

SEQ ID NO: 7992262 - DNA, 22 bp, Homo sapiens
ggtgcaggagcggggtgctcgg

SEQ ID NO: 7992263 - DNA, 22 bp, Homo sapiens
ggtgcaggagcggggtgctcgg

SEQ ID NO: 7992264 - DNA, 22 bp, Homo sapiens
ggtgcaggagcggggtgctcgg

SEQ ID NO: 7992265 - DNA, 22 bp, Homo sapiens
ggtgcaggagcggggtgctcgg

SEQ ID NO: 7992266 - DNA, 22 bp, Homo sapiens
ggtgcaggagcggggtgctcgg

SEQ ID NO: 7992267 - DNA, 22 bp, Homo sapiens
ggtgcaggagcggggtgctcgg

SEQ ID NO: 7992268 - DNA, 20 bp, Homo sapiens
gtatataaccatagtgacta

SEQ ID NO: 7992269 - DNA, 20 bp, Homo sapiens
gtatataaccatagtgacta

SEQ ID NO: 7992270 - DNA, 20 bp, Homo sapiens
gtatataaccatagtgacta

SEQ ID NO: 7992271 - DNA, 22 bp, Homo sapiens
gtatagttccaagcatattttg

SEQ ID NO: 7992272 - DNA, 22 bp, Homo sapiens
gtatagaaacccagaaagatag

SEQ ID NO: 7992273 - DNA, 22 bp, Homo sapiens
gtatatatcggcactattttaa

SEQ ID NO: 7992274 - DNA, 22 bp, Homo sapiens
gtatatatcggcactattttaa

SEQ ID NO: 7992275 - DNA, 22 bp, Homo sapiens
gtatataaggtaaagcgattgt

SEQ ID NO: 7992276 - DNA, 22 bp, Homo sapiens
gtatataaggtaaagcgattgt

SEQ ID NO: 7992277 - DNA, 22 bp, Homo sapiens
gtatataaggtaaagcgattgt

SEQ ID NO: 7992278 - DNA, 20 bp, Homo sapiens
gtatataaccatagtgacta

SEQ ID NO: 7992279 - DNA, 22 bp, Homo sapiens
gtatatatgtgtgaacatgtat

SEQ ID NO: 7992280 - DNA, 22 bp, Homo sapiens
gtatatatgtgtgaacatgtat

SEQ ID NO: 7992281 - DNA, 22 bp, Homo sapiens
gtatatatcggcactattttaa

SEQ ID NO: 7992282 - DNA, 22 bp, Homo sapiens
gtatatatgtgtgaacatgtat

SEQ ID NO: 7992283 - DNA, 22 bp, Homo sapiens
gtatatatgtgtgaacatgtat

SEQ ID NO: 7992284 - DNA, 22 bp, Homo sapiens
gtatatatcggcactattttaa

SEQ ID NO: 7992285 - DNA, 22 bp, Homo sapiens
gtatatgagctctatgtaatgg

SEQ ID NO: 7992286 - DNA, 22 bp, Homo sapiens
gtatggaagtataagttttgaa

SEQ ID NO: 7992287 - DNA, 22 bp, Homo sapiens
gtatatcttcagaaattatagg

SEQ ID NO: 7992288 - DNA, 22 bp, Homo sapiens
gtatatcttcagaaattatagg

SEQ ID NO: 7992289 - DNA, 18 bp, Homo sapiens
gtatatctgcacatatac

SEQ ID NO: 7992290 - DNA, 22 bp, Homo sapiens
gtatatatgtgtgaacatgtat

SEQ ID NO: 7992291 - DNA, 22 bp, Homo sapiens
gtatatatgtgtgaacatgtat

SEQ ID NO: 7992292 - DNA, 22 bp, Homo sapiens
gtatatatgtgtgaacatgtat

SEQ ID NO: 7992293 - DNA, 22 bp, Homo sapiens
gtatatattggataaaccagag

SEQ ID NO: 7992294 - DNA, 22 bp, Homo sapiens
gtatatattggataaaccagag

SEQ ID NO: 7992295 - DNA, 22 bp, Homo sapiens
gtatatctcttacatacacaca

SEQ ID NO: 7992296 - DNA, 22 bp, Homo sapiens
gtacatattataaaatacagct

SEQ ID NO: 7992297 - DNA, 22 bp, Homo sapiens
gtacatattataaaatacagct

SEQ ID NO: 7992298 - DNA, 22 bp, Homo sapiens
gtacatattataaaatacagct

SEQ ID NO: 7992299 - DNA, 22 bp, Homo sapiens
gtacatattaaaggtctataaa

SEQ ID NO: 7992300 - DNA, 22 bp, Homo sapiens
gtacatattataaaatacagct

SEQ ID NO: 7992301 - DNA, 22 bp, Homo sapiens
gtacatattataaaatacagct

SEQ ID NO: 7992302 - DNA, 22 bp, Homo sapiens
gtacatctgtcttgttctgttg

SEQ ID NO: 7992303 - DNA, 22 bp, Homo sapiens
gtacatctttaaattgttcagt

SEQ ID NO: 7992304 - DNA, 22 bp, Homo sapiens
gtacatctttaaattgttcagt

SEQ ID NO: 7992305 - DNA, 22 bp, Homo sapiens
gtacatgtatgagatatgtgta

SEQ ID NO: 7992306 - DNA, 22 bp, Homo sapiens
gtacatgtgcacaatgtgcagg

SEQ ID NO: 7992307 - DNA, 22 bp, Homo sapiens
gtacatgttggttgtttccagt

SEQ ID NO: 7992308 - DNA, 22 bp, Homo sapiens
gtacatgtgcacaacatgcatg

SEQ ID NO: 7992309 - DNA, 22 bp, Homo sapiens
gtacatgtcaaaaaatgcataa

SEQ ID NO: 7992310 - DNA, 22 bp, Homo sapiens
gtacatttactgatgaaaagta

SEQ ID NO: 7992311 - DNA, 22 bp, Homo sapiens
gtacatttaggattcattgaaa

SEQ ID NO: 7992312 - DNA, 22 bp, Homo sapiens
gtacatttaggattcattgaaa

SEQ ID NO: 7992313 - DNA, 22 bp, Homo sapiens
gtatacatagatgatgaacaag

SEQ ID NO: 7992314 - DNA, 22 bp, Homo sapiens
gtatacatgtggtaaaatgcac

SEQ ID NO: 7992315 - DNA, 22 bp, Homo sapiens
gtacatttactgatgaaaagta

SEQ ID NO: 7992316 - DNA, 22 bp, Homo sapiens
gtacattctgtggacttggaca

SEQ ID NO: 7992317 - DNA, 22 bp, Homo sapiens
gtacattcagcttagcacttct

SEQ ID NO: 7992318 - DNA, 19 bp, Homo sapiens
gtacagtggtaagctatga

SEQ ID NO: 7992319 - DNA, 22 bp, Homo sapiens
gtacagtggaggtctgtgttca

SEQ ID NO: 7992320 - DNA, 22 bp, Homo sapiens
gtacagtgggtgtagggaccag

SEQ ID NO: 7992321 - DNA, 22 bp, Homo sapiens
gtacagtgtgactttggagtga

SEQ ID NO: 7992322 - DNA, 19 bp, Homo sapiens
gtacagtggtaagctatga

SEQ ID NO: 7992323 - DNA, 22 bp, Homo sapiens
gtacagttttcagtgttcactg

SEQ ID NO: 7992324 - DNA, 22 bp, Homo sapiens
gtacagttttcagtgttcactg

SEQ ID NO: 7992325 - DNA, 22 bp, Homo sapiens
gtacagtagtaaaagtgaatga

SEQ ID NO: 7992326 - DNA, 22 bp, Homo sapiens
gtacagtagtaaaagtgaatga

SEQ ID NO: 7992327 - DNA, 22 bp, Homo sapiens
gtacagtgccagacttctaggt

SEQ ID NO: 7992328 - DNA, 22 bp, Homo sapiens
gtacagtagagccaggttcagt

SEQ ID NO: 7992329 - DNA, 22 bp, Homo sapiens
gtacagtacttcagaaccagcc

SEQ ID NO: 7992330 - DNA, 22 bp, Homo sapiens
gtacagtaatcccgttcttctg

SEQ ID NO: 7992331 - DNA, 22 bp, Homo sapiens
gtacatatggcacatgctattt

SEQ ID NO: 7992332 - DNA, 22 bp, Homo sapiens
gtacatatggcacatgctattt

SEQ ID NO: 7992333 - DNA, 22 bp, Homo sapiens
gtacatatggcacatgctattt

SEQ ID NO: 7992334 - DNA, 22 bp, Homo sapiens
gtacatatggcacatgctattt

SEQ ID NO: 7992335 - DNA, 22 bp, Homo sapiens
gtacatatcctttacgttttgt

SEQ ID NO: 7992336 - DNA, 22 bp, Homo sapiens
gtacatattaaaggtctataaa

SEQ ID NO: 7992337 - DNA, 22 bp, Homo sapiens
gtacatattacagacaaagctt

SEQ ID NO: 7992338 - DNA, 22 bp, Homo sapiens
gtacatattacagacaaagctt

SEQ ID NO: 7992339 - DNA, 22 bp, Homo sapiens
gtacataagaaattactacaga

SEQ ID NO: 7992340 - DNA, 22 bp, Homo sapiens
gtacataattttcagccagttt

SEQ ID NO: 7992341 - DNA, 22 bp, Homo sapiens
gtacataagaaattactacaga

SEQ ID NO: 7992342 - DNA, 22 bp, Homo sapiens
gtacataagaaattactacaga

SEQ ID NO: 7992343 - DNA, 22 bp, Homo sapiens
gtacataagaaattactacaga

SEQ ID NO: 7992344 - DNA, 22 bp, Homo sapiens
gtacataaaggaggctctttgc

SEQ ID NO: 7992345 - DNA, 22 bp, Homo sapiens
gtacataaaggaggctctttgc

SEQ ID NO: 7992346 - DNA, 22 bp, Homo sapiens
gtacataaaatactgccatgta

SEQ ID NO: 7992347 - DNA, 22 bp, Homo sapiens
gtacataaaatactgccatgta

SEQ ID NO: 7992348 - DNA, 22 bp, Homo sapiens
gtacataaaatactgccatgta

SEQ ID NO: 7992349 - DNA, 22 bp, Homo sapiens
gtaaatataaatgctagctgcc

SEQ ID NO: 7992350 - DNA, 22 bp, Homo sapiens
gtaaatataaatgctagctgcc

SEQ ID NO: 7992351 - DNA, 22 bp, Homo sapiens
gtaaataactggtaattggggt

SEQ ID NO: 7992352 - DNA, 22 bp, Homo sapiens
gtaaatataaatgctagctgcc

SEQ ID NO: 7992353 - DNA, 22 bp, Homo sapiens
gtaaataactggtaattggggt

SEQ ID NO: 7992354 - DNA, 22 bp, Homo sapiens
gtaaataactggtaattggggt

SEQ ID NO: 7992355 - DNA, 22 bp, Homo sapiens
gtaaataactggtaattggggt

SEQ ID NO: 7992356 - DNA, 22 bp, Homo sapiens
gtaaataactggtaattggggt

SEQ ID NO: 7992357 - DNA, 22 bp, Homo sapiens
gtaaataactggtaattggggt

SEQ ID NO: 7992358 - DNA, 22 bp, Homo sapiens
gtaaataactggtaattggggt

SEQ ID NO: 7992359 - DNA, 22 bp, Homo sapiens
gtaaataactggtaattggggt

SEQ ID NO: 7992360 - DNA, 22 bp, Homo sapiens
gtacacaaagtgagacttgata

SEQ ID NO: 7992361 - DNA, 18 bp, Homo sapiens
gtacacaaagtcaaagta

SEQ ID NO: 7992362 - DNA, 18 bp, Homo sapiens
gtacacaaagtcaaagta

SEQ ID NO: 7992363 - DNA, 22 bp, Homo sapiens
gtaaatattccctcggttccta

SEQ ID NO: 7992364 - DNA, 22 bp, Homo sapiens
gtaaatattaaaggctgctaga

SEQ ID NO: 7992365 - DNA, 22 bp, Homo sapiens
gtaaatattaaaggctgctaga

SEQ ID NO: 7992366 - DNA, 22 bp, Homo sapiens
gtaaatataaatgctagctgcc

SEQ ID NO: 7992367 - DNA, 22 bp, Homo sapiens
gtaaatataaatgctagctgcc

SEQ ID NO: 7992368 - DNA, 22 bp, Homo sapiens
gtaaatataaatgctagctgcc

SEQ ID NO: 7992369 - DNA, 22 bp, Homo sapiens
gtaaatattaaaggctgctaga

SEQ ID NO: 7992370 - DNA, 22 bp, Homo sapiens
gtaaatattaaaggctgctaga

SEQ ID NO: 7992371 - DNA, 21 bp, Homo sapiens
gtacacacaggtggatgggct

SEQ ID NO: 7992372 - DNA, 22 bp, Homo sapiens
gtacacttgtcttgaacagcct

SEQ ID NO: 7992373 - DNA, 22 bp, Homo sapiens
gtacacacaatctctggtcagt

SEQ ID NO: 7992374 - DNA, 22 bp, Homo sapiens
gtacacaaataataaagttaca

SEQ ID NO: 7992375 - DNA, 22 bp, Homo sapiens
gtacacaaataataaagttaca

SEQ ID NO: 7992376 - DNA, 22 bp, Homo sapiens
gtacagagaaggttacatatga

SEQ ID NO: 7992377 - DNA, 22 bp, Homo sapiens
gtacagaaggagctttggattc

SEQ ID NO: 7992378 - DNA, 22 bp, Homo sapiens
gtacagaaggatttctagtagt

SEQ ID NO: 7992379 - DNA, 22 bp, Homo sapiens
gtacaggcagcaaacaccataa

SEQ ID NO: 7992380 - DNA, 22 bp, Homo sapiens
gtacaggcagcaaacaccataa

SEQ ID NO: 7992381 - DNA, 22 bp, Homo sapiens
gtacaggccaccactgaatttt

SEQ ID NO: 7992382 - DNA, 22 bp, Homo sapiens
gtacaggccaccactgaatttt

SEQ ID NO: 7992383 - DNA, 22 bp, Homo sapiens
gtacagggcccctcagcagggc

SEQ ID NO: 7992384 - DNA, 22 bp, Homo sapiens
gtacaggaaggagggagtttca

SEQ ID NO: 7992385 - DNA, 22 bp, Homo sapiens
gtacagctaagaatttcatctt

SEQ ID NO: 7992386 - DNA, 22 bp, Homo sapiens
gtacaggacatagacagagtag

SEQ ID NO: 7992387 - DNA, 22 bp, Homo sapiens
gtacaggaccgcggccccctgg

SEQ ID NO: 7992388 - DNA, 22 bp, Homo sapiens
gtacagattaataatatactga

SEQ ID NO: 7992389 - DNA, 22 bp, Homo sapiens
gtacagaggttgctggaggctc

SEQ ID NO: 7992390 - DNA, 22 bp, Homo sapiens
gtacagattaataatatactga

SEQ ID NO: 7992391 - DNA, 22 bp, Homo sapiens
gtacagcatttgaaattactgg

SEQ ID NO: 7992392 - DNA, 22 bp, Homo sapiens
gtacaggaaggagggagtttca

SEQ ID NO: 7992393 - DNA, 22 bp, Homo sapiens
gtacagcatttgaaattactgg

SEQ ID NO: 7992394 - DNA, 22 bp, Homo sapiens
gtacagcacagagcatcgcaca

SEQ ID NO: 7992395 - DNA, 22 bp, Homo sapiens
gtacagcatttgaaattactgg

SEQ ID NO: 7992396 - DNA, 23 bp, Homo sapiens
gtaaaatacgcagtgcagtgtga

SEQ ID NO: 7992397 - DNA, 23 bp, Homo sapiens
gtaaaatacgcagtgcagtgtga

SEQ ID NO: 7992398 - DNA, 22 bp, Homo sapiens
ggtgtcctcatgattttctaga

SEQ ID NO: 7992399 - DNA, 22 bp, Homo sapiens
gtaaacatgctgtgtactcagc

SEQ ID NO: 7992400 - DNA, 22 bp, Homo sapiens
gtaaaatagaataacgtggcta

SEQ ID NO: 7992401 - DNA, 22 bp, Homo sapiens
gtaaacatgctgtgtactcagc

SEQ ID NO: 7992402 - DNA, 22 bp, Homo sapiens
gtaaaatagaataacgtggcta

SEQ ID NO: 7992403 - DNA, 22 bp, Homo sapiens
gtaaacattactgtgctgtata

SEQ ID NO: 7992404 - DNA, 22 bp, Homo sapiens
gtaaacattactgtgctgtata

SEQ ID NO: 7992405 - DNA, 22 bp, Homo sapiens
gtaaacattttcatctgtgccc

SEQ ID NO: 7992406 - DNA, 22 bp, Homo sapiens
gtaaaccaatgaaatgtgtgca

SEQ ID NO: 7992407 - DNA, 22 bp, Homo sapiens
gtaaactatgggctttggagga

SEQ ID NO: 7992408 - DNA, 22 bp, Homo sapiens
gtaaacattttcatctgtgccc

SEQ ID NO: 7992409 - DNA, 22 bp, Homo sapiens
gtaaacattttcatctgtgccc

SEQ ID NO: 7992410 - DNA, 20 bp, Homo sapiens
gtaaagcattcttggcatac

SEQ ID NO: 7992411 - DNA, 22 bp, Homo sapiens
gtaaagctctcatttaatatca

SEQ ID NO: 7992412 - DNA, 22 bp, Homo sapiens
gtaaagctggagaggtctttta

SEQ ID NO: 7992413 - DNA, 22 bp, Homo sapiens
gtaaagctgtttctccaccgtc

SEQ ID NO: 7992414 - DNA, 22 bp, Homo sapiens
gtaaaggctctgataagtactg

SEQ ID NO: 7992415 - DNA, 22 bp, Homo sapiens
gtaaagtacatacatgaactca

SEQ ID NO: 7992416 - DNA, 22 bp, Homo sapiens
gtaaagtacatacatgaactca

SEQ ID NO: 7992417 - DNA, 22 bp, Homo sapiens
gtaaagtctggctgaaacatgc

SEQ ID NO: 7992418 - DNA, 22 bp, Homo sapiens
gtaaagtcctacatatgtcagg

SEQ ID NO: 7992419 - DNA, 22 bp, Homo sapiens
gtaaagtacaagcctcattaca

SEQ ID NO: 7992420 - DNA, 22 bp, Homo sapiens
gtaaagtacaagcctcattaca

SEQ ID NO: 7992421 - DNA, 22 bp, Homo sapiens
gtaaagttctactagaatcaac

SEQ ID NO: 7992422 - DNA, 22 bp, Homo sapiens
gtaaagatgagcggtaatacaa

SEQ ID NO: 7992423 - DNA, 22 bp, Homo sapiens
gtaaagaagtttttgaatgcat

SEQ ID NO: 7992424 - DNA, 22 bp, Homo sapiens
gtaaagcaaaatgtagagattg

SEQ ID NO: 7992425 - DNA, 22 bp, Homo sapiens
gtaaagcaaaatgtagagattg

SEQ ID NO: 7992426 - DNA, 22 bp, Homo sapiens
gtaaagaagtttttgaatgcat

SEQ ID NO: 7992427 - DNA, 22 bp, Homo sapiens
gtaaagaagtttttgaatgcat

SEQ ID NO: 7992428 - DNA, 22 bp, Homo sapiens
gtaaagaaggcaacctggttat

SEQ ID NO: 7992429 - DNA, 22 bp, Homo sapiens
gtaaagaaggcaacctggttat

SEQ ID NO: 7992430 - DNA, 22 bp, Homo sapiens
gtaaactcagagaatacttctt

SEQ ID NO: 7992431 - DNA, 22 bp, Homo sapiens
gtaaactgattgttggagttac

SEQ ID NO: 7992432 - DNA, 21 bp, Homo sapiens
gtgtgagtagcatgtgtctca

SEQ ID NO: 7992433 - DNA, 21 bp, Homo sapiens
gtgtgagtagcatgtgtctca

SEQ ID NO: 7992434 - DNA, 22 bp, Homo sapiens
gtgtgagtgaaagtagtttgat

SEQ ID NO: 7992435 - DNA, 22 bp, Homo sapiens
gtgtgagggacagagaaagggg

SEQ ID NO: 7992436 - DNA, 21 bp, Homo sapiens
gtgtgagtagcatgtgtctca

SEQ ID NO: 7992437 - DNA, 22 bp, Homo sapiens
gtgtgagggacagagaaagggg

SEQ ID NO: 7992438 - DNA, 22 bp, Homo sapiens
gtgtgagctccctctcctcctg

SEQ ID NO: 7992439 - DNA, 22 bp, Homo sapiens
gtgtgcaactttcattaatatt

SEQ ID NO: 7992440 - DNA, 22 bp, Homo sapiens
gtgtgcaactttcattaatatt

SEQ ID NO: 7992441 - DNA, 22 bp, Homo sapiens
gtgtgcaagggcatgtacattg

SEQ ID NO: 7992442 - DNA, 22 bp, Homo sapiens
gtgtgagtgaaagtagtttgat

SEQ ID NO: 7992443 - DNA, 22 bp, Homo sapiens
gtgtgagtgaaagtagtttgat

SEQ ID NO: 7992444 - DNA, 21 bp, Homo sapiens
gtgtgagtagcatgtgtctca

SEQ ID NO: 7992445 - DNA, 22 bp, Homo sapiens
gtgtgcagaacagggagtgggt

SEQ ID NO: 7992446 - DNA, 22 bp, Homo sapiens
gtgtgcagaacagggagtgggt

SEQ ID NO: 7992447 - DNA, 22 bp, Homo sapiens
gtgtgcagaacagggagtgggt

SEQ ID NO: 7992448 - DNA, 22 bp, Homo sapiens
gtgtgcacagtatactagggtt

SEQ ID NO: 7992449 - DNA, 22 bp, Homo sapiens
gtgtgcagaggcaggaggtgct

SEQ ID NO: 7992450 - DNA, 22 bp, Homo sapiens
gtgtgcagaggcaggaggtgct

SEQ ID NO: 7992451 - DNA, 22 bp, Homo sapiens
gtgtgcagaagacacaagacat

SEQ ID NO: 7992452 - DNA, 22 bp, Homo sapiens
gtgtgcagaagacacaagacat

SEQ ID NO: 7992453 - DNA, 22 bp, Homo sapiens
gtgtgcagaagacacaagacat

SEQ ID NO: 7992454 - DNA, 22 bp, Homo sapiens
gtgtgcagaacagggagtgggt

SEQ ID NO: 7992455 - DNA, 22 bp, Homo sapiens
gtgtgcagaacagggagtgggt

SEQ ID NO: 7992456 - DNA, 22 bp, Homo sapiens
gtgtgcagaacagggagtgggt

SEQ ID NO: 7992457 - DNA, 22 bp, Homo sapiens
gtgtgcagatgtgatgctgggc

SEQ ID NO: 7992458 - DNA, 22 bp, Homo sapiens
gtgtgcagatgtgatgctgggc

SEQ ID NO: 7992459 - DNA, 22 bp, Homo sapiens
gtgtgcagaggcaggaggtgct

SEQ ID NO: 7992460 - DNA, 22 bp, Homo sapiens
gtgtgcagaggcaggaggtgct

SEQ ID NO: 7992461 - DNA, 22 bp, Homo sapiens
gtgtgcagcagagacaggactc

SEQ ID NO: 7992462 - DNA, 22 bp, Homo sapiens
gtgtgcagcagagacaggactc

SEQ ID NO: 7992463 - DNA, 22 bp, Homo sapiens
gtgtgcagcagagacaggactc

SEQ ID NO: 7992464 - DNA, 22 bp, Homo sapiens
gtgtgcagcagagacaggactc

SEQ ID NO: 7992465 - DNA, 22 bp, Homo sapiens
gtgtgcagggggccagcgcagc

SEQ ID NO: 7992466 - DNA, 22 bp, Homo sapiens
gtgtgcagggggccagcgcagc

SEQ ID NO: 7992467 - DNA, 22 bp, Homo sapiens
gtgtgcagggggccagcgcagc

SEQ ID NO: 7992468 - DNA, 22 bp, Homo sapiens
gtgtgcaggggcttggtggagc

SEQ ID NO: 7992469 - DNA, 22 bp, Homo sapiens
gtgtgcagggggccagcgcagc

SEQ ID NO: 7992470 - DNA, 22 bp, Homo sapiens
gtgtgcaggggcttggtggagc

SEQ ID NO: 7992471 - DNA, 22 bp, Homo sapiens
gtgtgcagggctgcctgtgccg

SEQ ID NO: 7992472 - DNA, 22 bp, Homo sapiens
gtgtgcagggctgcctgtgccg

SEQ ID NO: 7992473 - DNA, 22 bp, Homo sapiens
gtgtgcagggggccagcgcagc

SEQ ID NO: 7992474 - DNA, 22 bp, Homo sapiens
gtgtgcaggggcttggtggagc

SEQ ID NO: 7992475 - DNA, 22 bp, Homo sapiens
gtgtgcaggtgtcagtgcagct

SEQ ID NO: 7992476 - DNA, 22 bp, Homo sapiens
gtgtgcaggtgtcagtgcagct

SEQ ID NO: 7992477 - DNA, 22 bp, Homo sapiens
gtgtgcaggtgtcagtgcagct

SEQ ID NO: 7992478 - DNA, 22 bp, Homo sapiens
gtgtgcagggggccagcgcagc

SEQ ID NO: 7992479 - DNA, 22 bp, Homo sapiens
gtgtgcaggtgtcagtgcagct

SEQ ID NO: 7992480 - DNA, 22 bp, Homo sapiens
gtgtgcaggtgtcagtgcagct

SEQ ID NO: 7992481 - DNA, 22 bp, Homo sapiens
gtgtgcagggctgcctgtgccg

SEQ ID NO: 7992482 - DNA, 22 bp, Homo sapiens
gtgtgcagggatgagtgcaggt

SEQ ID NO: 7992483 - DNA, 22 bp, Homo sapiens
gtgtgcagggctgcctgtgccg

SEQ ID NO: 7992484 - DNA, 22 bp, Homo sapiens
gtgtgcagggatgagtgcaggt

SEQ ID NO: 7992485 - DNA, 22 bp, Homo sapiens
gtgtgcagggatgagtgcaggt

SEQ ID NO: 7992486 - DNA, 22 bp, Homo sapiens
gtgtgcagggatgagtgcaggt

SEQ ID NO: 7992487 - DNA, 22 bp, Homo sapiens
gtgtgcagggatgagtgcaggt

SEQ ID NO: 7992488 - DNA, 22 bp, Homo sapiens
gtgtgcaggcttgaggattagg

SEQ ID NO: 7992489 - DNA, 22 bp, Homo sapiens
gtgtgcaggcttgaggattagg

SEQ ID NO: 7992490 - DNA, 22 bp, Homo sapiens
gtgtgcaggccacaggccaggg

SEQ ID NO: 7992491 - DNA, 22 bp, Homo sapiens
gtgtgcagcagagacaggactc

SEQ ID NO: 7992492 - DNA, 22 bp, Homo sapiens
gtgtgcagcagagacaggactc

SEQ ID NO: 7992493 - DNA, 22 bp, Homo sapiens
gtgtgcaggccacaggccaggg

SEQ ID NO: 7992494 - DNA, 22 bp, Homo sapiens
gtgtgcaggccacaggccaggg

SEQ ID NO: 7992495 - DNA, 22 bp, Homo sapiens
gtgtgcaggccacaggccaggg

SEQ ID NO: 7992496 - DNA, 22 bp, Homo sapiens
gtgtgtcagagctcagagaagt

SEQ ID NO: 7992497 - DNA, 22 bp, Homo sapiens
gtgtgtatgtagaactatgtat

SEQ ID NO: 7992498 - DNA, 22 bp, Homo sapiens
gtgtgtcagagctcagagaagt

SEQ ID NO: 7992499 - DNA, 22 bp, Homo sapiens
gtgtgtcaggtactgtgctagg

SEQ ID NO: 7992500 - DNA, 22 bp, Homo sapiens
gtgtgtagatgtgagaggactg

SEQ ID NO: 7992501 - DNA, 22 bp, Homo sapiens
gtgtgtacaaatttcatgtaaa

SEQ ID NO: 7992502 - DNA, 22 bp, Homo sapiens
gtgtggtggccctccttcaggc

SEQ ID NO: 7992503 - DNA, 22 bp, Homo sapiens
gtgtggtgaggccccttaggct

SEQ ID NO: 7992504 - DNA, 22 bp, Homo sapiens
gtgtggtcgaagttctcccgga

SEQ ID NO: 7992505 - DNA, 22 bp, Homo sapiens
gtgtggggtcttctcttggcct

SEQ ID NO: 7992506 - DNA, 22 bp, Homo sapiens
gtgtggggtcttctcttggcct

SEQ ID NO: 7992507 - DNA, 22 bp, Homo sapiens
gtgtggtcgaagttctcccgga

SEQ ID NO: 7992508 - DNA, 22 bp, Homo sapiens
gtgtggtcgaagttctcccgga

SEQ ID NO: 7992509 - DNA, 22 bp, Homo sapiens
gtgtggggctcagtgggaatgt

SEQ ID NO: 7992510 - DNA, 22 bp, Homo sapiens
gtgtggggctcagtgggaatgt

SEQ ID NO: 7992511 - DNA, 22 bp, Homo sapiens
gtgtggggctcagtgggaatgt

SEQ ID NO: 7992512 - DNA, 22 bp, Homo sapiens
gtgtggggctcagtgggaatgt

SEQ ID NO: 7992513 - DNA, 22 bp, Homo sapiens
gtgtgggggcagctctgatatg

SEQ ID NO: 7992514 - DNA, 22 bp, Homo sapiens
gtgtgggggcagctctgatatg

SEQ ID NO: 7992515 - DNA, 22 bp, Homo sapiens
gtgtgcagtctgctaggcaggg

SEQ ID NO: 7992516 - DNA, 22 bp, Homo sapiens
gtgtgcagtctgctaggcaggg

SEQ ID NO: 7992517 - DNA, 22 bp, Homo sapiens
gtgtgggaggaaggtgaacaga

SEQ ID NO: 7992518 - DNA, 22 bp, Homo sapiens
gtgtgggacgggtgagtggcca

SEQ ID NO: 7992519 - DNA, 22 bp, Homo sapiens
gtgtgggcagggccgtgctccc

SEQ ID NO: 7992520 - DNA, 22 bp, Homo sapiens
gtgtgggaggaaggtgaacaga

SEQ ID NO: 7992521 - DNA, 22 bp, Homo sapiens
gtgtgggcagggccgtgctccc

SEQ ID NO: 7992522 - DNA, 22 bp, Homo sapiens
gtgtgggctatgtgcgtgggca

SEQ ID NO: 7992523 - DNA, 22 bp, Homo sapiens
gtgtgggctgcagaggcacagc

SEQ ID NO: 7992524 - DNA, 22 bp, Homo sapiens
gtgtgggctatgtgcgtgggca

SEQ ID NO: 7992525 - DNA, 22 bp, Homo sapiens
gtgtggggccaggatcagggct

SEQ ID NO: 7992526 - DNA, 22 bp, Homo sapiens
gtgtggggccaggatcagggct

SEQ ID NO: 7992527 - DNA, 22 bp, Homo sapiens
gtgtggggccaggatcagggct

SEQ ID NO: 7992528 - DNA, 22 bp, Homo sapiens
gtgtggggaggagagagccctt

SEQ ID NO: 7992529 - DNA, 22 bp, Homo sapiens
gtgtggggaggagagagccctt

SEQ ID NO: 7992530 - DNA, 22 bp, Homo sapiens
gtgtggggccaggatcagggct

SEQ ID NO: 7992531 - DNA, 22 bp, Homo sapiens
gtgtggggaggagagagccctt

SEQ ID NO: 7992532 - DNA, 22 bp, Homo sapiens
gtgtggggaggagagagccctt

SEQ ID NO: 7992533 - DNA, 22 bp, Homo sapiens
gtgtggggaggagagagccctt

SEQ ID NO: 7992534 - DNA, 22 bp, Homo sapiens
gtgtggggagctgcagccacat

SEQ ID NO: 7992535 - DNA, 22 bp, Homo sapiens
gtgtggggagctgcagccacat

SEQ ID NO: 7992536 - DNA, 22 bp, Homo sapiens
gtgtggggagctgcagccacat

SEQ ID NO: 7992537 - DNA, 22 bp, Homo sapiens
gtgtggggagctgcagccacat

SEQ ID NO: 7992538 - DNA, 22 bp, Homo sapiens
gtgtccagagaaactcacagct

SEQ ID NO: 7992539 - DNA, 22 bp, Homo sapiens
gtgtccacggctgagaatgatt

SEQ ID NO: 7992540 - DNA, 22 bp, Homo sapiens
gtgtccactccatgcccatcct

SEQ ID NO: 7992541 - DNA, 23 bp, Homo sapiens
gtgtcattactgtaattattgtg

SEQ ID NO: 7992542 - DNA, 22 bp, Homo sapiens
gtgtcatgtagaaattgatgaa

SEQ ID NO: 7992543 - DNA, 22 bp, Homo sapiens
gtgtcatgcacactcagtgttg

SEQ ID NO: 7992544 - DNA, 22 bp, Homo sapiens
gtgtcagtgtatgttaaacttt

SEQ ID NO: 7992545 - DNA, 22 bp, Homo sapiens
gtgtcatgcacactcagtgttg

SEQ ID NO: 7992546 - DNA, 22 bp, Homo sapiens
gtgtcatgtagaaattgatgaa

SEQ ID NO: 7992547 - DNA, 22 bp, Homo sapiens
gtgtcatggggtttgttataca

SEQ ID NO: 7992548 - DNA, 22 bp, Homo sapiens
gtgtcatggaaaattgcaatgg

SEQ ID NO: 7992549 - DNA, 22 bp, Homo sapiens
gtgtcaggcagtcagcatggag

SEQ ID NO: 7992550 - DNA, 19 bp, Homo sapiens
gtgtcaggatgtgcagggg

SEQ ID NO: 7992551 - DNA, 19 bp, Homo sapiens
gtgtcaggatgtgcagggg

SEQ ID NO: 7992552 - DNA, 20 bp, Homo sapiens
gtgtcagtaaatattatgtg

SEQ ID NO: 7992553 - DNA, 22 bp, Homo sapiens
gtgtcaggggcagccaggaaat

SEQ ID NO: 7992554 - DNA, 19 bp, Homo sapiens
gtgtcaggatgtgcagggg

SEQ ID NO: 7992555 - DNA, 22 bp, Homo sapiens
gtgtcaggagaattagggcttt

SEQ ID NO: 7992556 - DNA, 22 bp, Homo sapiens
gtgtcactggaatactgtctgt

SEQ ID NO: 7992557 - DNA, 22 bp, Homo sapiens
gtgtcagatagtacaccaaggg

SEQ ID NO: 7992558 - DNA, 22 bp, Homo sapiens
gtgtcagatgtccagggcagca

SEQ ID NO: 7992559 - DNA, 22 bp, Homo sapiens
gtgtcccaaagattagaaatca

SEQ ID NO: 7992560 - DNA, 22 bp, Homo sapiens
gtgtccatctctgtatgctgct

SEQ ID NO: 7992561 - DNA, 22 bp, Homo sapiens
gtgtccagttttttctctgctg

SEQ ID NO: 7992562 - DNA, 22 bp, Homo sapiens
gtgtccagttttttctctgctg

SEQ ID NO: 7992563 - DNA, 22 bp, Homo sapiens
gtgtcccagcagcacattggct

SEQ ID NO: 7992564 - DNA, 22 bp, Homo sapiens
gtgtcccactctggaggtgaag

SEQ ID NO: 7992565 - DNA, 22 bp, Homo sapiens
gtgtcccaatgttcaggacggc

SEQ ID NO: 7992566 - DNA, 22 bp, Homo sapiens
gtgtcccaatgttcaggacggc

SEQ ID NO: 7992567 - DNA, 22 bp, Homo sapiens
gtgtcccaatctacttttccct

SEQ ID NO: 7992568 - DNA, 22 bp, Homo sapiens
gtgtcccaaagattagaaatca

SEQ ID NO: 7992569 - DNA, 22 bp, Homo sapiens
gtgtcccaaagattagaaatca

SEQ ID NO: 7992570 - DNA, 22 bp, Homo sapiens
gtgtccagggggtatcccagct

SEQ ID NO: 7992571 - DNA, 22 bp, Homo sapiens
gtgtccagggccgtgttgtctt

SEQ ID NO: 7992572 - DNA, 22 bp, Homo sapiens
gtgtccagggctggaagtgagg

SEQ ID NO: 7992573 - DNA, 22 bp, Homo sapiens
gtgtccagggggtatcccagct

SEQ ID NO: 7992574 - DNA, 22 bp, Homo sapiens
gtgtccagggggtatcccagct

SEQ ID NO: 7992575 - DNA, 22 bp, Homo sapiens
gtgtccagtcatagcccagggc

SEQ ID NO: 7992576 - DNA, 22 bp, Homo sapiens
gtgtccagtcatagcccagggc

SEQ ID NO: 7992577 - DNA, 17 bp, Homo sapiens
gtgtccaggccgatggc

SEQ ID NO: 7992578 - DNA, 17 bp, Homo sapiens
gtgtccaggccgatggc

SEQ ID NO: 7992579 - DNA, 22 bp, Homo sapiens
gtgtccagggctggaagtgagg

SEQ ID NO: 7992580 - DNA, 22 bp, Homo sapiens
gtgtccagagaactgtgggagc

SEQ ID NO: 7992581 - DNA, 22 bp, Homo sapiens
gtgtccagagaactgtgggagc

SEQ ID NO: 7992582 - DNA, 22 bp, Homo sapiens
gtgtccagagaaactcacagct

SEQ ID NO: 7992583 - DNA, 22 bp, Homo sapiens
gtgtccagatgaggagacgatg

SEQ ID NO: 7992584 - DNA, 22 bp, Homo sapiens
gtgtccagagccgggctgaatg

SEQ ID NO: 7992585 - DNA, 22 bp, Homo sapiens
gtgtccagatgaggagacgatg

SEQ ID NO: 7992586 - DNA, 22 bp, Homo sapiens
gtgtccagcctgcacagggtgc

SEQ ID NO: 7992587 - DNA, 22 bp, Homo sapiens
gtgtccagcgtggaatgagggt

SEQ ID NO: 7992588 - DNA, 22 bp, Homo sapiens
gtgtccagcctgcacagggtgc

SEQ ID NO: 7992589 - DNA, 22 bp, Homo sapiens
gtgtctctaggacctggtacta

SEQ ID NO: 7992590 - DNA, 22 bp, Homo sapiens
gtgtctgagtttggaaagtcca

SEQ ID NO: 7992591 - DNA, 22 bp, Homo sapiens
gtgtctcttcctttcaagtggg

SEQ ID NO: 7992592 - DNA, 22 bp, Homo sapiens
gtgtgagccatgatgtgtccag

SEQ ID NO: 7992593 - DNA, 22 bp, Homo sapiens
gtgtctgcaagatagccaagtc

SEQ ID NO: 7992594 - DNA, 22 bp, Homo sapiens
gtgtctctaggacctggtacta

SEQ ID NO: 7992595 - DNA, 22 bp, Homo sapiens
gtgtctctatctatgcctgaag

SEQ ID NO: 7992596 - DNA, 22 bp, Homo sapiens
gtgtccttttgagggtccacag

SEQ ID NO: 7992597 - DNA, 22 bp, Homo sapiens
gtgtcgtgcttgccatgggtac

SEQ ID NO: 7992598 - DNA, 22 bp, Homo sapiens
gtgtcctgggctggtagagctg

SEQ ID NO: 7992599 - DNA, 22 bp, Homo sapiens
gtgtcctgggggacttcaggtt

SEQ ID NO: 7992600 - DNA, 22 bp, Homo sapiens
gtgtcctgggggacttcaggtt

SEQ ID NO: 7992601 - DNA, 22 bp, Homo sapiens
gtgtcctgggtctctgattctt

SEQ ID NO: 7992602 - DNA, 22 bp, Homo sapiens
gtgtcctgtttccctgtctata

SEQ ID NO: 7992603 - DNA, 22 bp, Homo sapiens
gtgtcctgtttccctgtctata

SEQ ID NO: 7992604 - DNA, 22 bp, Homo sapiens
gtgtcctggttccttgtggctg

SEQ ID NO: 7992605 - DNA, 18 bp, Homo sapiens
gtgtcctttgcaagaaac

SEQ ID NO: 7992606 - DNA, 22 bp, Homo sapiens
gtgtccttgcagtttgaagaaa

SEQ ID NO: 7992607 - DNA, 22 bp, Homo sapiens
gtgtcctgatcaattgagctgg

SEQ ID NO: 7992608 - DNA, 22 bp, Homo sapiens
gtgtcctgcattggctctgccc

SEQ ID NO: 7992609 - DNA, 22 bp, Homo sapiens
gtgtcctgcattggctctgccc

SEQ ID NO: 7992610 - DNA, 22 bp, Homo sapiens
gtgtcctgccaccctgggcttt

SEQ ID NO: 7992611 - DNA, 22 bp, Homo sapiens
gtgtcctgcattggctctgccc

SEQ ID NO: 7992612 - DNA, 18 bp, Homo sapiens
gtgtcctggctgcggcgc

SEQ ID NO: 7992613 - DNA, 18 bp, Homo sapiens
gtgtcctggctgcggcgc

SEQ ID NO: 7992614 - DNA, 22 bp, Homo sapiens
gtgtcctgggcattaggcttag

SEQ ID NO: 7992615 - DNA, 22 bp, Homo sapiens
gtgtcctgccaccctgggcttt

SEQ ID NO: 7992616 - DNA, 22 bp, Homo sapiens
gtgtcctgccaccctgggcttt

SEQ ID NO: 7992617 - DNA, 22 bp, Homo sapiens
gtgtcctgagtgaggcctggcc

SEQ ID NO: 7992618 - DNA, 22 bp, Homo sapiens
gtgtcctgagtgaggcctggcc

SEQ ID NO: 7992619 - DNA, 22 bp, Homo sapiens
gtgtcccaggagaggagacaat

SEQ ID NO: 7992620 - DNA, 22 bp, Homo sapiens
gtgtcctgagtgaggcctggcc

SEQ ID NO: 7992621 - DNA, 22 bp, Homo sapiens
gtgtcctcttattgctcttggc

SEQ ID NO: 7992622 - DNA, 22 bp, Homo sapiens
gtgtcccagccccacaggcctg

SEQ ID NO: 7992623 - DNA, 22 bp, Homo sapiens
gtgtcccaggcctctggaatta

SEQ ID NO: 7992624 - DNA, 22 bp, Homo sapiens
gtgtcccaggagaggagacaat

SEQ ID NO: 7992625 - DNA, 22 bp, Homo sapiens
gtgtcccagccccacaggcctg

SEQ ID NO: 7992626 - DNA, 22 bp, Homo sapiens
gttctctctcttgcctgggtgg

SEQ ID NO: 7992627 - DNA, 22 bp, Homo sapiens
gttctctcagcgatagtgatgg

SEQ ID NO: 7992628 - DNA, 22 bp, Homo sapiens
gttctctcagcgatagtgatgg

SEQ ID NO: 7992629 - DNA, 22 bp, Homo sapiens
gttctctctcttgcctgggtgg

SEQ ID NO: 7992630 - DNA, 22 bp, Homo sapiens
gttctctctgcttccaagatgg

SEQ ID NO: 7992631 - DNA, 22 bp, Homo sapiens
gttctctgcgctcccggcccgg

SEQ ID NO: 7992632 - DNA, 22 bp, Homo sapiens
gttctctggaaactatgattca

SEQ ID NO: 7992633 - DNA, 22 bp, Homo sapiens
gttctctggagtccctgggccc

SEQ ID NO: 7992634 - DNA, 22 bp, Homo sapiens
gttctctgagtcctggcaaaat

SEQ ID NO: 7992635 - DNA, 22 bp, Homo sapiens
gttctctgccggcacctacccg

SEQ ID NO: 7992636 - DNA, 22 bp, Homo sapiens
gttctctgccacttaccagcta

SEQ ID NO: 7992637 - DNA, 22 bp, Homo sapiens
gttctgacttctctgcatctgc

SEQ ID NO: 7992638 - DNA, 22 bp, Homo sapiens
gttctgagtcctcctttgaagg

SEQ ID NO: 7992639 - DNA, 22 bp, Homo sapiens
gttctctatcattagtgaattt

SEQ ID NO: 7992640 - DNA, 22 bp, Homo sapiens
gttctctcaaactttgtgtttg

SEQ ID NO: 7992641 - DNA, 22 bp, Homo sapiens
gttctccttgtggctgcagcag

SEQ ID NO: 7992642 - DNA, 22 bp, Homo sapiens
gttctctcagcctttgttatta

SEQ ID NO: 7992643 - DNA, 22 bp, Homo sapiens
gttctctcagcctttgttatta

SEQ ID NO: 7992644 - DNA, 22 bp, Homo sapiens
gttctctcaaactttgtgtttg

SEQ ID NO: 7992645 - DNA, 22 bp, Homo sapiens
gttctcctggctcccaccctgc

SEQ ID NO: 7992646 - DNA, 22 bp, Homo sapiens
gttctcctcttgtcccaggctg

SEQ ID NO: 7992647 - DNA, 22 bp, Homo sapiens
gttctcctcttgtcccaggctg

SEQ ID NO: 7992648 - DNA, 22 bp, Homo sapiens
gttctccttgtggctgcagcag

SEQ ID NO: 7992649 - DNA, 22 bp, Homo sapiens
gttctcctggctcccaccctgc

SEQ ID NO: 7992650 - DNA, 22 bp, Homo sapiens
gttctccttgtggctgcagcag

SEQ ID NO: 7992651 - DNA, 22 bp, Homo sapiens
gttctccttgtggctgcagcag

SEQ ID NO: 7992652 - DNA, 22 bp, Homo sapiens
gttctccctgtcccctgagctt

SEQ ID NO: 7992653 - DNA, 22 bp, Homo sapiens
gttctccattcagcttcctgtg

SEQ ID NO: 7992654 - DNA, 22 bp, Homo sapiens
gttctcctcttagctgtgccac

SEQ ID NO: 7992655 - DNA, 22 bp, Homo sapiens
gttctcctcttagctgtgccac

SEQ ID NO: 7992656 - DNA, 22 bp, Homo sapiens
gttctccactgcagagtctctc

SEQ ID NO: 7992657 - DNA, 22 bp, Homo sapiens
gttctccaggggctgttcatct

SEQ ID NO: 7992658 - DNA, 22 bp, Homo sapiens
gttctccaggggctgttcatct

SEQ ID NO: 7992659 - DNA, 22 bp, Homo sapiens
gttctcatagtggaaaataggt

SEQ ID NO: 7992660 - DNA, 22 bp, Homo sapiens
gttctccactgcagagtctctc

SEQ ID NO: 7992661 - DNA, 22 bp, Homo sapiens
gttctccactgcagagtctctc

SEQ ID NO: 7992662 - DNA, 22 bp, Homo sapiens
gttctccactgcagagtctctc

SEQ ID NO: 7992663 - DNA, 22 bp, Homo sapiens
gttctcagtggggagcagggtt

SEQ ID NO: 7992664 - DNA, 21 bp, Homo sapiens
gttctattttgcaaacttctg

SEQ ID NO: 7992665 - DNA, 21 bp, Homo sapiens
gttctattttgcaaacttctg

SEQ ID NO: 7992666 - DNA, 21 bp, Homo sapiens
gttctattttgcaaacttctg

SEQ ID NO: 7992667 - DNA, 22 bp, Homo sapiens
gttctcactagtgctttgagag

SEQ ID NO: 7992668 - DNA, 20 bp, Homo sapiens
gttctcactgatctgcaggg

SEQ ID NO: 7992669 - DNA, 22 bp, Homo sapiens
gttctcagggataacttccccc

SEQ ID NO: 7992670 - DNA, 22 bp, Homo sapiens
gttctcagtgatctgtgattcg

SEQ ID NO: 7992671 - DNA, 22 bp, Homo sapiens
gttctcagggataacttccccc

SEQ ID NO: 7992672 - DNA, 22 bp, Homo sapiens
gttctcagtgatctgtgattcg

SEQ ID NO: 7992673 - DNA, 22 bp, Homo sapiens
gttctattccccttatctgtga

SEQ ID NO: 7992674 - DNA, 22 bp, Homo sapiens
gttctattcattgctccacgag

SEQ ID NO: 7992675 - DNA, 22 bp, Homo sapiens
gttctattctccagttacatat

SEQ ID NO: 7992676 - DNA, 22 bp, Homo sapiens
gttctattccccttatctgtga

SEQ ID NO: 7992677 - DNA, 22 bp, Homo sapiens
gttctagatgactgagcagctg

SEQ ID NO: 7992678 - DNA, 16 bp, Homo sapiens
gttctattttcgtcct

SEQ ID NO: 7992679 - DNA, 22 bp, Homo sapiens
gttctatttcagtaagcaggca

SEQ ID NO: 7992680 - DNA, 22 bp, Homo sapiens
gttctatttcagtaagcaggca

SEQ ID NO: 7992681 - DNA, 22 bp, Homo sapiens
gttctatttcagtaagcaggca

SEQ ID NO: 7992682 - DNA, 22 bp, Homo sapiens
gttctattctccagttacatat

SEQ ID NO: 7992683 - DNA, 22 bp, Homo sapiens
gttctattctccagttacatat

SEQ ID NO: 7992684 - DNA, 22 bp, Homo sapiens
gttgtcttagtcagaaatatgc

SEQ ID NO: 7992685 - DNA, 22 bp, Homo sapiens
gttgtctgtgtcagttagcgtc

SEQ ID NO: 7992686 - DNA, 22 bp, Homo sapiens
gttgtccttcttatttgtagtg

SEQ ID NO: 7992687 - DNA, 21 bp, Homo sapiens
gttgtccagctggtttgggcc

SEQ ID NO: 7992688 - DNA, 22 bp, Homo sapiens
gttgtcccttcaggtttcactg

SEQ ID NO: 7992689 - DNA, 22 bp, Homo sapiens
gttgtgaatagtgccgcaataa

SEQ ID NO: 7992690 - DNA, 22 bp, Homo sapiens
gttgtgaatagtgccgcaataa

SEQ ID NO: 7992691 - DNA, 22 bp, Homo sapiens
gttgtgaatagtgccgcaataa

SEQ ID NO: 7992692 - DNA, 22 bp, Homo sapiens
gttgttaatccaactcagcttg

SEQ ID NO: 7992693 - DNA, 21 bp, Homo sapiens
gttgtggttggggctgcagct

SEQ ID NO: 7992694 - DNA, 22 bp, Homo sapiens
gttgttttaaaatactccagaa

SEQ ID NO: 7992695 - DNA, 22 bp, Homo sapiens
gttgttttataattgattgcaa

SEQ ID NO: 7992696 - DNA, 22 bp, Homo sapiens
gttgttttataattgattgcaa

SEQ ID NO: 7992697 - DNA, 22 bp, Homo sapiens
gttgttttataattgattgcaa

SEQ ID NO: 7992698 - DNA, 22 bp, Homo sapiens
gttgttttataggctcatgcct

SEQ ID NO: 7992699 - DNA, 22 bp, Homo sapiens
gttgttttataggctcatgcct

SEQ ID NO: 7992700 - DNA, 22 bp, Homo sapiens
gttgttttataggctcatgcct

SEQ ID NO: 7992701 - DNA, 22 bp, Homo sapiens
gttgttttcacaaacccatgat

SEQ ID NO: 7992702 - DNA, 22 bp, Homo sapiens
gttgttttcagcagtttatgac

SEQ ID NO: 7992703 - DNA, 22 bp, Homo sapiens
gttgttttcacaaacccatgat

SEQ ID NO: 7992704 - DNA, 22 bp, Homo sapiens
gttgttttcacaaacccatgat

SEQ ID NO: 7992705 - DNA, 22 bp, Homo sapiens
gttgttttataggctcatgcct

SEQ ID NO: 7992706 - DNA, 22 bp, Homo sapiens
gttgttttattgtgagtcccat

SEQ ID NO: 7992707 - DNA, 22 bp, Homo sapiens
gttgttttattgtgagtcccat

SEQ ID NO: 7992708 - DNA, 22 bp, Homo sapiens
gttgtttataaaaatatctagc

SEQ ID NO: 7992709 - DNA, 22 bp, Homo sapiens
gttgtttataaaaatatctagc

SEQ ID NO: 7992710 - DNA, 22 bp, Homo sapiens
gttgttttaaaatactccagaa

SEQ ID NO: 7992711 - DNA, 22 bp, Homo sapiens
gttgttttaaaatactccagaa

SEQ ID NO: 7992712 - DNA, 22 bp, Homo sapiens
gttgttttaaaatactccagaa

SEQ ID NO: 7992713 - DNA, 22 bp, Homo sapiens
gttgttctccctaacaattact

SEQ ID NO: 7992714 - DNA, 22 bp, Homo sapiens
gttgtacatatgaggataagtt

SEQ ID NO: 7992715 - DNA, 22 bp, Homo sapiens
gttgtacatatgaggataagtt

SEQ ID NO: 7992716 - DNA, 22 bp, Homo sapiens
gttgtacattctatgggtttgg

SEQ ID NO: 7992717 - DNA, 22 bp, Homo sapiens
gttgtacatgttggggtacctt

SEQ ID NO: 7992718 - DNA, 22 bp, Homo sapiens
gttgtacatgcgtctgcaagga

SEQ ID NO: 7992719 - DNA, 22 bp, Homo sapiens
gttgtactacctctcgtattag

SEQ ID NO: 7992720 - DNA, 22 bp, Homo sapiens
gttgtactctgaccattcagac

SEQ ID NO: 7992721 - DNA, 22 bp, Homo sapiens
gttgtacattctatgggttttg

SEQ ID NO: 7992722 - DNA, 22 bp, Homo sapiens
gttgtactttgactagttgact

SEQ ID NO: 7992723 - DNA, 22 bp, Homo sapiens
gttgtatagagggcatgaatct

SEQ ID NO: 7992724 - DNA, 22 bp, Homo sapiens
gttgtattcttcaatatcagag

SEQ ID NO: 7992725 - DNA, 22 bp, Homo sapiens
gttgtattcttcaatatcagag

SEQ ID NO: 7992726 - DNA, 22 bp, Homo sapiens
gttgtattcttcaatatcagag

SEQ ID NO: 7992727 - DNA, 22 bp, Homo sapiens
gttgtcatcaccgttgttatca

SEQ ID NO: 7992728 - DNA, 22 bp, Homo sapiens
gttgtcaggtaaaacagtatgg

SEQ ID NO: 7992729 - DNA, 22 bp, Homo sapiens
gttgtatttgcctgaatgcagt

SEQ ID NO: 7992730 - DNA, 22 bp, Homo sapiens
gttgtacaggcagggaaactga

SEQ ID NO: 7992731 - DNA, 22 bp, Homo sapiens
gttgtacaggcagggaaactga

SEQ ID NO: 7992732 - DNA, 22 bp, Homo sapiens
gttgtacagcattccatatagg

SEQ ID NO: 7992733 - DNA, 22 bp, Homo sapiens
gttgtacaggactgcccagtgt

SEQ ID NO: 7992734 - DNA, 22 bp, Homo sapiens
gttctgcagggatccagctggg

SEQ ID NO: 7992735 - DNA, 22 bp, Homo sapiens
gttctgcagggatccagctggg

SEQ ID NO: 7992736 - DNA, 22 bp, Homo sapiens
gttctgcagggatccagctggg

SEQ ID NO: 7992737 - DNA, 22 bp, Homo sapiens
gttctgcagacttggaaggtgg

SEQ ID NO: 7992738 - DNA, 22 bp, Homo sapiens
gttctgctcctgtggcaatcta

SEQ ID NO: 7992739 - DNA, 22 bp, Homo sapiens
gttctgcagacttggaaggtgg

SEQ ID NO: 7992740 - DNA, 22 bp, Homo sapiens
gttctgagtcctcctttgaagg

SEQ ID NO: 7992741 - DNA, 22 bp, Homo sapiens
gttctgagtggcccaagccctg

SEQ ID NO: 7992742 - DNA, 22 bp, Homo sapiens
gttctgcacatcacacaggtgc

SEQ ID NO: 7992743 - DNA, 22 bp, Homo sapiens
gttctgagtcctcctttgaagg

SEQ ID NO: 7992744 - DNA, 22 bp, Homo sapiens
gttctgagtcctcctttgaagg

SEQ ID NO: 7992745 - DNA, 22 bp, Homo sapiens
gttctgagtcctcctttgaagg

SEQ ID NO: 7992746 - DNA, 22 bp, Homo sapiens
gttcaagaccagcctggccaac

SEQ ID NO: 7992747 - DNA, 22 bp, Homo sapiens
gttcaagaccagcctggccaac

SEQ ID NO: 7992748 - DNA, 22 bp, Homo sapiens
gttcaagaccagcctggccaac

SEQ ID NO: 7992749 - DNA, 22 bp, Homo sapiens
gttcaagaccagcctggccaac

SEQ ID NO: 7992750 - DNA, 22 bp, Homo sapiens
gttcaagaccagcctggccaac

SEQ ID NO: 7992751 - DNA, 22 bp, Homo sapiens
gttcaagaccagcctggccaac

SEQ ID NO: 7992752 - DNA, 22 bp, Homo sapiens
gttcaaatctcaggacttcaga

SEQ ID NO: 7992753 - DNA, 21 bp, Homo sapiens
gttcaaatgggtagattcaca

SEQ ID NO: 7992754 - DNA, 22 bp, Homo sapiens
gttcaaattctatgaaatatgt

SEQ ID NO: 7992755 - DNA, 22 bp, Homo sapiens
gttcaaatggctgcagttacca

SEQ ID NO: 7992756 - DNA, 21 bp, Homo sapiens
gttcaaatgggtagattcaca

SEQ ID NO: 7992757 - DNA, 22 bp, Homo sapiens
gttcaaattctatgaaatatgt

SEQ ID NO: 7992758 - DNA, 22 bp, Homo sapiens
gttcaaggaagggaggaaagcc

SEQ ID NO: 7992759 - DNA, 22 bp, Homo sapiens
gttcaagaccagcctggccaac

SEQ ID NO: 7992760 - DNA, 22 bp, Homo sapiens
gttcaaggaagggaggaaagcc

SEQ ID NO: 7992761 - DNA, 18 bp, Homo sapiens
gttcaaggtcaagagaga

SEQ ID NO: 7992762 - DNA, 22 bp, Homo sapiens
gttctaataggagaaaagacag

SEQ ID NO: 7992763 - DNA, 22 bp, Homo sapiens
gttctaagggcttgaaatgtat

SEQ ID NO: 7992764 - DNA, 22 bp, Homo sapiens
gttctaagggcttgaaatgtat

SEQ ID NO: 7992765 - DNA, 22 bp, Homo sapiens
gttcaagtctggggctgccagt

SEQ ID NO: 7992766 - DNA, 22 bp, Homo sapiens
gttcaaggttttacagagtgta

SEQ ID NO: 7992767 - DNA, 22 bp, Homo sapiens
gttcaaggttttacagagtgta

SEQ ID NO: 7992768 - DNA, 22 bp, Homo sapiens
gttctacagttcctattactta

SEQ ID NO: 7992769 - DNA, 22 bp, Homo sapiens
gttctacagttcctattactta

SEQ ID NO: 7992770 - DNA, 22 bp, Homo sapiens
gttctaatttggggctccttag

SEQ ID NO: 7992771 - DNA, 22 bp, Homo sapiens
gttctaatattttaaaagccaa

SEQ ID NO: 7992772 - DNA, 18 bp, Homo sapiens
gttctagaaattaggtac

SEQ ID NO: 7992773 - DNA, 22 bp, Homo sapiens
gttctactttctgtgtctttga

SEQ ID NO: 7992774 - DNA, 22 bp, Homo sapiens
gttctacatgacactcaacatt

SEQ ID NO: 7992775 - DNA, 21 bp, Homo sapiens
gttctacagttttagaattcc

SEQ ID NO: 7992776 - DNA, 22 bp, Homo sapiens
gttctacatgacactcaacatt

SEQ ID NO: 7992777 - DNA, 22 bp, Homo sapiens
gttctacatgacactcaacatt

SEQ ID NO: 7992778 - DNA, 22 bp, Homo sapiens
gttctaggagccaagaatatag

SEQ ID NO: 7992779 - DNA, 22 bp, Homo sapiens
gttctagatgactgagcagctg

SEQ ID NO: 7992780 - DNA, 22 bp, Homo sapiens
gttctagacaccagggattcag

SEQ ID NO: 7992781 - DNA, 22 bp, Homo sapiens
gttctagactttatcttaaaac

SEQ ID NO: 7992782 - DNA, 22 bp, Homo sapiens
gttctagataaaactgcatgaa

SEQ ID NO: 7992783 - DNA, 22 bp, Homo sapiens
gttctaggctaggggagtaaga

SEQ ID NO: 7992784 - DNA, 22 bp, Homo sapiens
gttctaggttagaaggacagat

SEQ ID NO: 7992785 - DNA, 22 bp, Homo sapiens
gttctattactccctgcttctt

SEQ ID NO: 7992786 - DNA, 22 bp, Homo sapiens
gttctattcattgctccacgag

SEQ ID NO: 7992787 - DNA, 22 bp, Homo sapiens
gttctattactccctgcttctt

SEQ ID NO: 7992788 - DNA, 22 bp, Homo sapiens
gttattttcattggctcagact

SEQ ID NO: 7992789 - DNA, 22 bp, Homo sapiens
gttattttcattggctcagact

SEQ ID NO: 7992790 - DNA, 22 bp, Homo sapiens
gttattttatctctgagaggtt

SEQ ID NO: 7992791 - DNA, 22 bp, Homo sapiens
gttattttcattggctcagact

SEQ ID NO: 7992792 - DNA, 22 bp, Homo sapiens
gttattttcattggctcagact

SEQ ID NO: 7992793 - DNA, 22 bp, Homo sapiens
gttattttcattggctcagact

SEQ ID NO: 7992794 - DNA, 22 bp, Homo sapiens
gttattttcattggctcagact

SEQ ID NO: 7992795 - DNA, 19 bp, Homo sapiens
gttcaaacactgattcagc

SEQ ID NO: 7992796 - DNA, 22 bp, Homo sapiens
gttcaaaattcaaatggtatac

SEQ ID NO: 7992797 - DNA, 22 bp, Homo sapiens
gttattttcattggctcagact

SEQ ID NO: 7992798 - DNA, 22 bp, Homo sapiens
gttattttatctctgagaggtt

SEQ ID NO: 7992799 - DNA, 22 bp, Homo sapiens
gttattttatctctgagaggtt

SEQ ID NO: 7992800 - DNA, 21 bp, Homo sapiens
gttattttaagtgagctttgc

SEQ ID NO: 7992801 - DNA, 22 bp, Homo sapiens
gttattttatctctgagaggtt

SEQ ID NO: 7992802 - DNA, 21 bp, Homo sapiens
gttattttaagtgagctttgc

SEQ ID NO: 7992803 - DNA, 21 bp, Homo sapiens
gttattttaagtgagctttgc

SEQ ID NO: 7992804 - DNA, 22 bp, Homo sapiens
gttattttatctctgagaggtt

SEQ ID NO: 7992805 - DNA, 22 bp, Homo sapiens
gttattttatctctgagaggtt

SEQ ID NO: 7992806 - DNA, 22 bp, Homo sapiens
gttattttatctctgagaggtt

SEQ ID NO: 7992807 - DNA, 22 bp, Homo sapiens
gttattttcattggctcagact

SEQ ID NO: 7992808 - DNA, 22 bp, Homo sapiens
gttattttcattggctcagact

SEQ ID NO: 7992809 - DNA, 22 bp, Homo sapiens
gttattttaacttctcagtaat

SEQ ID NO: 7992810 - DNA, 22 bp, Homo sapiens
gttattttaacttctcagtaat

SEQ ID NO: 7992811 - DNA, 22 bp, Homo sapiens
gtgtgtcctcagtagtggcatg

SEQ ID NO: 7992812 - DNA, 22 bp, Homo sapiens
gtgtgtcctcagtagtggcatg

SEQ ID NO: 7992813 - DNA, 22 bp, Homo sapiens
gttattttaacttctcagtaat

SEQ ID NO: 7992814 - DNA, 22 bp, Homo sapiens
gttattttaacttctcagtaat

SEQ ID NO: 7992815 - DNA, 21 bp, Homo sapiens
gttattttaagtgagctttgc

SEQ ID NO: 7992816 - DNA, 21 bp, Homo sapiens
gttattttaagtgagctttgc

SEQ ID NO: 7992817 - DNA, 21 bp, Homo sapiens
gttattttaagtgagctttgc

SEQ ID NO: 7992818 - DNA, 21 bp, Homo sapiens
gttattttaagtgagctttgc

SEQ ID NO: 7992819 - DNA, 22 bp, Homo sapiens
gttattttaacttctcagtaat

SEQ ID NO: 7992820 - DNA, 21 bp, Homo sapiens
gttattttaagtgagctttgc

SEQ ID NO: 7992821 - DNA, 22 bp, Homo sapiens
gttattttaacttctcagtaat

SEQ ID NO: 7992822 - DNA, 21 bp, Homo sapiens
gttattttaagtgagctttgc

SEQ ID NO: 7992823 - DNA, 22 bp, Homo sapiens
gtgtgtccctcctctcctgagt

SEQ ID NO: 7992824 - DNA, 22 bp, Homo sapiens
gtgtgtcccttggaacctcagc

SEQ ID NO: 7992825 - DNA, 22 bp, Homo sapiens
gtgtgtccctacaacagcttca

SEQ ID NO: 7992826 - DNA, 23 bp, Homo sapiens
gtgtgtccattcgcactcttagg

SEQ ID NO: 7992827 - DNA, 22 bp, Homo sapiens
gtgtgtccaggcgggagtcaag

SEQ ID NO: 7992828 - DNA, 22 bp, Homo sapiens
gtgtgtccaaggccacaatagc

SEQ ID NO: 7992829 - DNA, 22 bp, Homo sapiens
gtgtgtccacacatacatacat

SEQ ID NO: 7992830 - DNA, 22 bp, Homo sapiens
gtgtgtccaaggcacggatgac

SEQ ID NO: 7992831 - DNA, 20 bp, Homo sapiens
gtgggcagagcaccacctgg

SEQ ID NO: 7992832 - DNA, 20 bp, Homo sapiens
gtgggcagagcaccacctgg

SEQ ID NO: 7992833 - DNA, 22 bp, Homo sapiens
gtgggcagaggagagaacatta

SEQ ID NO: 7992834 - DNA, 22 bp, Homo sapiens
gtgggcagaggagagaacatta

SEQ ID NO: 7992835 - DNA, 22 bp, Homo sapiens
gtgggcagagcaagggaactca

SEQ ID NO: 7992836 - DNA, 22 bp, Homo sapiens
gtgggcagagcaagggaactca

SEQ ID NO: 7992837 - DNA, 22 bp, Homo sapiens
gtgggcagagcaagggaactca

SEQ ID NO: 7992838 - DNA, 22 bp, Homo sapiens
gtgggcagagcaagggaactca

SEQ ID NO: 7992839 - DNA, 22 bp, Homo sapiens
gtgggcagaattgaatctttaa

SEQ ID NO: 7992840 - DNA, 22 bp, Homo sapiens
gtgggcagacagtgctttgcag

SEQ ID NO: 7992841 - DNA, 22 bp, Homo sapiens
gtgggcagaacatttgtaggct

SEQ ID NO: 7992842 - DNA, 22 bp, Homo sapiens
gtgggcaaggtccctgccagct

SEQ ID NO: 7992843 - DNA, 22 bp, Homo sapiens
gtgggcagaacatttgtaggct

SEQ ID NO: 7992844 - DNA, 22 bp, Homo sapiens
gtgggcagacatgatagaagga

SEQ ID NO: 7992845 - DNA, 22 bp, Homo sapiens
gtgggcagacatgatagaagga

SEQ ID NO: 7992846 - DNA, 22 bp, Homo sapiens
gtgggcagacatgatagaagga

SEQ ID NO: 7992847 - DNA, 22 bp, Homo sapiens
gtgggcagacatgatagaagga

SEQ ID NO: 7992848 - DNA, 22 bp, Homo sapiens
gtgggcagacatgatagaagga

SEQ ID NO: 7992849 - DNA, 22 bp, Homo sapiens
gtgggcagacagtgctttgcag

SEQ ID NO: 7992850 - DNA, 22 bp, Homo sapiens
gtgggcagacagtgctttgcag

SEQ ID NO: 7992851 - DNA, 22 bp, Homo sapiens
gtgggcagacagtgctttgcag

SEQ ID NO: 7992852 - DNA, 22 bp, Homo sapiens
gtgggcagcaccagggaagtgt

SEQ ID NO: 7992853 - DNA, 22 bp, Homo sapiens
gtgggcagcaccagggaagtgt

SEQ ID NO: 7992854 - DNA, 22 bp, Homo sapiens
gtgggcagcaccagggaagtgt

SEQ ID NO: 7992855 - DNA, 20 bp, Homo sapiens
gtgggcagcaggcatactgg

SEQ ID NO: 7992856 - DNA, 22 bp, Homo sapiens
gtgggcagcaccagggaagtgt

SEQ ID NO: 7992857 - DNA, 22 bp, Homo sapiens
gtgggcagcaccagggaagtgt

SEQ ID NO: 7992858 - DNA, 22 bp, Homo sapiens
gtgggcagcaccagggaagtgt

SEQ ID NO: 7992859 - DNA, 22 bp, Homo sapiens
gtgggcagcaccagggaagtgt

SEQ ID NO: 7992860 - DNA, 22 bp, Homo sapiens
gtgggcagccccttcaaggcca

SEQ ID NO: 7992861 - DNA, 22 bp, Homo sapiens
gtgggcagccccttcaaggcca

SEQ ID NO: 7992862 - DNA, 22 bp, Homo sapiens
gtgggcagcaccagggaagtgt

SEQ ID NO: 7992863 - DNA, 20 bp, Homo sapiens
gtgggcagcaggcatactgg

SEQ ID NO: 7992864 - DNA, 20 bp, Homo sapiens
gtgggcagcaggcatactgg

SEQ ID NO: 7992865 - DNA, 20 bp, Homo sapiens
gtgggcagcaggcatactgg

SEQ ID NO: 7992866 - DNA, 20 bp, Homo sapiens
gtgggcagatgtgtgcatgg

SEQ ID NO: 7992867 - DNA, 22 bp, Homo sapiens
gtgggcagaggagagaacatta

SEQ ID NO: 7992868 - DNA, 22 bp, Homo sapiens
gtgggcagaggagagaacatta

SEQ ID NO: 7992869 - DNA, 22 bp, Homo sapiens
gtgggcagattaatttctcaat

SEQ ID NO: 7992870 - DNA, 22 bp, Homo sapiens
gtgggcagattatagatgatgc

SEQ ID NO: 7992871 - DNA, 22 bp, Homo sapiens
gtgggcagattatagatgatgc

SEQ ID NO: 7992872 - DNA, 22 bp, Homo sapiens
gtgggcagcaccagggaagtgt

SEQ ID NO: 7992873 - DNA, 22 bp, Homo sapiens
gtgggcagattatagatgatgc

SEQ ID NO: 7992874 - DNA, 22 bp, Homo sapiens
gtgggcagattatagatgatgc

SEQ ID NO: 7992875 - DNA, 22 bp, Homo sapiens
gtgggcagattatagatgatgc

SEQ ID NO: 7992876 - DNA, 22 bp, Homo sapiens
gtgggcagcctgtccggagacc

SEQ ID NO: 7992877 - DNA, 22 bp, Homo sapiens
gtgggcagcctcctttattttc

SEQ ID NO: 7992878 - DNA, 22 bp, Homo sapiens
gtgggcagccccttcaaggcca

SEQ ID NO: 7992879 - DNA, 22 bp, Homo sapiens
gtgggcagccccttcaaggcca

SEQ ID NO: 7992880 - DNA, 22 bp, Homo sapiens
gtgggcagcctgtccggagacc

SEQ ID NO: 7992881 - DNA, 22 bp, Homo sapiens
gtgggcaggaggccctgccctg

SEQ ID NO: 7992882 - DNA, 22 bp, Homo sapiens
gtgggcaggaggccctgccctg

SEQ ID NO: 7992883 - DNA, 22 bp, Homo sapiens
gtgggcagcctgtccggagacc

SEQ ID NO: 7992884 - DNA, 22 bp, Homo sapiens
gtgggcagcctgtccggagacc

SEQ ID NO: 7992885 - DNA, 22 bp, Homo sapiens
gtgggcagcctgtccggagacc

SEQ ID NO: 7992886 - DNA, 22 bp, Homo sapiens
gtgggcagcctgtccggagacc

SEQ ID NO: 7992887 - DNA, 22 bp, Homo sapiens
gtgggcagcctgtccggagacc

SEQ ID NO: 7992888 - DNA, 22 bp, Homo sapiens
gtgggcagttcaattctgggag

SEQ ID NO: 7992889 - DNA, 22 bp, Homo sapiens
gtgggcagtgtgtcagtatctt

SEQ ID NO: 7992890 - DNA, 22 bp, Homo sapiens
gtgggcagtggtttgcgcggtc

SEQ ID NO: 7992891 - DNA, 22 bp, Homo sapiens
gtgggcagtggtttgcgcggtc

SEQ ID NO: 7992892 - DNA, 22 bp, Homo sapiens
gtgggcagtgtgtcagtatctt

SEQ ID NO: 7992893 - DNA, 22 bp, Homo sapiens
gtgggcagtggtttgcgcggtc

SEQ ID NO: 7992894 - DNA, 22 bp, Homo sapiens
gtgggcagtggtttgcgcggtc

SEQ ID NO: 7992895 - DNA, 22 bp, Homo sapiens
gtgggcagtggtttgcgcggtc

SEQ ID NO: 7992896 - DNA, 22 bp, Homo sapiens
gtgggccacatcccagggctct

SEQ ID NO: 7992897 - DNA, 22 bp, Homo sapiens
gtgggccacatcccagggctct

SEQ ID NO: 7992898 - DNA, 22 bp, Homo sapiens
gtgggccacatcccagggctct

SEQ ID NO: 7992899 - DNA, 22 bp, Homo sapiens
gtgggccactgggaggcaaggg

SEQ ID NO: 7992900 - DNA, 22 bp, Homo sapiens
gtgggccactgggaggcaaggg

SEQ ID NO: 7992901 - DNA, 22 bp, Homo sapiens
gtgggccactgggaggcaaggg

SEQ ID NO: 7992902 - DNA, 22 bp, Homo sapiens
gtgggcagttggtgattctcgt

SEQ ID NO: 7992903 - DNA, 22 bp, Homo sapiens
gtgggcagttggtgattctcgt

SEQ ID NO: 7992904 - DNA, 22 bp, Homo sapiens
gtgggcagttggtgattctcgt

SEQ ID NO: 7992905 - DNA, 22 bp, Homo sapiens
gtgggccactgggaggcaaggg

SEQ ID NO: 7992906 - DNA, 19 bp, Homo sapiens
gtgggccaggcagaaggct

SEQ ID NO: 7992907 - DNA, 22 bp, Homo sapiens
gtgggccaggccggagtgcaga

SEQ ID NO: 7992908 - DNA, 22 bp, Homo sapiens
gtgggccaggcgtctaggccct

SEQ ID NO: 7992909 - DNA, 22 bp, Homo sapiens
gtgggccaggccggagtgcaga

SEQ ID NO: 7992910 - DNA, 22 bp, Homo sapiens
gtgggccaggccggagtgcaga

SEQ ID NO: 7992911 - DNA, 22 bp, Homo sapiens
gtgggggacccaggtgctgtcc

SEQ ID NO: 7992912 - DNA, 22 bp, Homo sapiens
gtgggggagatgcttaggtccg

SEQ ID NO: 7992913 - DNA, 22 bp, Homo sapiens
gtgggggatgctgagttggaaa

SEQ ID NO: 7992914 - DNA, 22 bp, Homo sapiens
gtgggggatgctgagttggaaa

SEQ ID NO: 7992915 - DNA, 22 bp, Homo sapiens
gtgggggatgctgagttggaaa

SEQ ID NO: 7992916 - DNA, 22 bp, Homo sapiens
gtgggggacccaggtgctgtcc

SEQ ID NO: 7992917 - DNA, 22 bp, Homo sapiens
gtgggggatgctgagttggaaa

SEQ ID NO: 7992918 - DNA, 22 bp, Homo sapiens
gtgggggatgctgagttggaaa

SEQ ID NO: 7992919 - DNA, 22 bp, Homo sapiens
gtgggggacccaggtgctgtcc

SEQ ID NO: 7992920 - DNA, 22 bp, Homo sapiens
gtgggggacccaggtgctgtcc

SEQ ID NO: 7992921 - DNA, 22 bp, Homo sapiens
gtgggggacccaggtgctgtcc

SEQ ID NO: 7992922 - DNA, 22 bp, Homo sapiens
gtggggcttcctggggcaagtt

SEQ ID NO: 7992923 - DNA, 22 bp, Homo sapiens
gtggggcttcctggggcaagtt

SEQ ID NO: 7992924 - DNA, 22 bp, Homo sapiens
gtgggggctggaaatcttgcca

SEQ ID NO: 7992925 - DNA, 22 bp, Homo sapiens
gtgggggcagtgggcttcgagc

SEQ ID NO: 7992926 - DNA, 22 bp, Homo sapiens
gtgggggcagtgggcttcgagc

SEQ ID NO: 7992927 - DNA, 22 bp, Homo sapiens
gtgggggcagtgggcttcgagc

SEQ ID NO: 7992928 - DNA, 22 bp, Homo sapiens
gtgggggcaggcagtgctagga

SEQ ID NO: 7992929 - DNA, 22 bp, Homo sapiens
gtgggggcaggcagtgctagga

SEQ ID NO: 7992930 - DNA, 22 bp, Homo sapiens
gtgggggctggaaatcttgcca

SEQ ID NO: 7992931 - DNA, 22 bp, Homo sapiens
gtgggggctggaaatcttgcca

SEQ ID NO: 7992932 - DNA, 22 bp, Homo sapiens
gtgggggctggaaatcttgcca

SEQ ID NO: 7992933 - DNA, 22 bp, Homo sapiens
gtgggggcaggcagtgctagga

SEQ ID NO: 7992934 - DNA, 22 bp, Homo sapiens
gtgggggcaggcagtgctagga

SEQ ID NO: 7992935 - DNA, 22 bp, Homo sapiens
gtgggggcaggcagtgctagga

SEQ ID NO: 7992936 - DNA, 22 bp, Homo sapiens
gtgggggcaggcagtgctagga

SEQ ID NO: 7992937 - DNA, 22 bp, Homo sapiens
gtgggggcaggcagtgctagga

SEQ ID NO: 7992938 - DNA, 22 bp, Homo sapiens
gtggggaggcctaagcaagttg

SEQ ID NO: 7992939 - DNA, 22 bp, Homo sapiens
gtggggaggcctaagcaagttg

SEQ ID NO: 7992940 - DNA, 22 bp, Homo sapiens
gtggggaggcctaagcaagttg

SEQ ID NO: 7992941 - DNA, 22 bp, Homo sapiens
gtggggaggcctaagcaagttg

SEQ ID NO: 7992942 - DNA, 22 bp, Homo sapiens
gtggggaggcctaagcaagttg

SEQ ID NO: 7992943 - DNA, 22 bp, Homo sapiens
gtggggaggcctaagcaagttg

SEQ ID NO: 7992944 - DNA, 22 bp, Homo sapiens
gtggggaggcctaagcaagttg

SEQ ID NO: 7992945 - DNA, 22 bp, Homo sapiens
gtggggaggcctaagcaagttg

SEQ ID NO: 7992946 - DNA, 22 bp, Homo sapiens
gtggggaggcctaagcaagttg

SEQ ID NO: 7992947 - DNA, 22 bp, Homo sapiens
gtggggaggcattcttctccct

SEQ ID NO: 7992948 - DNA, 22 bp, Homo sapiens
gtggggaggcattcttctccct

SEQ ID NO: 7992949 - DNA, 22 bp, Homo sapiens
gtggggaggcattcttctccct

SEQ ID NO: 7992950 - DNA, 22 bp, Homo sapiens
gtggggaggcattcttctccct

SEQ ID NO: 7992951 - DNA, 22 bp, Homo sapiens
gtggggaggcattcttctccct

SEQ ID NO: 7992952 - DNA, 22 bp, Homo sapiens
gtggggaggcctaagcaagttg

SEQ ID NO: 7992953 - DNA, 22 bp, Homo sapiens
gtggggaggcattcttctccct

SEQ ID NO: 7992954 - DNA, 22 bp, Homo sapiens
gtggggaggcctaagcaagttg

SEQ ID NO: 7992955 - DNA, 22 bp, Homo sapiens
gtggggaggcctaagcaagttg

SEQ ID NO: 7992956 - DNA, 22 bp, Homo sapiens
gtggggaggcattcttctccct

SEQ ID NO: 7992957 - DNA, 22 bp, Homo sapiens
gtggggaggcattcttctccct

SEQ ID NO: 7992958 - DNA, 22 bp, Homo sapiens
gtggggaggcattcttctccct

SEQ ID NO: 7992959 - DNA, 22 bp, Homo sapiens
gtggggagcagccttagcccct

SEQ ID NO: 7992960 - DNA, 22 bp, Homo sapiens
gtggggagcagccttagcccct

SEQ ID NO: 7992961 - DNA, 22 bp, Homo sapiens
gtggggagcagccttagcccct

SEQ ID NO: 7992962 - DNA, 22 bp, Homo sapiens
gtggggagcagccttagcccct

SEQ ID NO: 7992963 - DNA, 22 bp, Homo sapiens
gtggggagcagccttagcccct

SEQ ID NO: 7992964 - DNA, 22 bp, Homo sapiens
gtggggagcagccttagcccct

SEQ ID NO: 7992965 - DNA, 22 bp, Homo sapiens
gtggggagcagccttagcccct

SEQ ID NO: 7992966 - DNA, 22 bp, Homo sapiens
gtggggagcagccttagcccct

SEQ ID NO: 7992967 - DNA, 22 bp, Homo sapiens
gtggggaaaggagtggggctca

SEQ ID NO: 7992968 - DNA, 22 bp, Homo sapiens
gtggggaaaggagtggggctca

SEQ ID NO: 7992969 - DNA, 22 bp, Homo sapiens
gtggggaaaggagtggggctca

SEQ ID NO: 7992970 - DNA, 22 bp, Homo sapiens
gtggggaaaggagtggggctca

SEQ ID NO: 7992971 - DNA, 22 bp, Homo sapiens
gtggggacgggatggctcactg

SEQ ID NO: 7992972 - DNA, 22 bp, Homo sapiens
gtgggctgaggggacaccaagg

SEQ ID NO: 7992973 - DNA, 22 bp, Homo sapiens
gtgggctgaggggacaccaagg

SEQ ID NO: 7992974 - DNA, 22 bp, Homo sapiens
gtgggctgaggggacaccaagg

SEQ ID NO: 7992975 - DNA, 22 bp, Homo sapiens
gtgggctcaggcctctgtgggg

SEQ ID NO: 7992976 - DNA, 22 bp, Homo sapiens
gtgggctcccctggcatgtcca

SEQ ID NO: 7992977 - DNA, 22 bp, Homo sapiens
gtgggctgcatgtttactattc

SEQ ID NO: 7992978 - DNA, 22 bp, Homo sapiens
gtgggctgcccttgaggtcagc

SEQ ID NO: 7992979 - DNA, 22 bp, Homo sapiens
gtgggctgcccttgaggtcagc

SEQ ID NO: 7992980 - DNA, 22 bp, Homo sapiens
gtgggctgcatgtttactattc

SEQ ID NO: 7992981 - DNA, 22 bp, Homo sapiens
gtgggctgcccttgaggtcagc

SEQ ID NO: 7992982 - DNA, 22 bp, Homo sapiens
gtgggccttgcagggtgcaggg

SEQ ID NO: 7992983 - DNA, 22 bp, Homo sapiens
gtgggccttgcagggtgcaggg

SEQ ID NO: 7992984 - DNA, 22 bp, Homo sapiens
gtgggcctttcaggcgatctgg

SEQ ID NO: 7992985 - DNA, 22 bp, Homo sapiens
gtgggctcaggcctctgtgggg

SEQ ID NO: 7992986 - DNA, 22 bp, Homo sapiens
gtgggctcccctggcatgtcca

SEQ ID NO: 7992987 - DNA, 22 bp, Homo sapiens
gtgggccagttcctcacaggta

SEQ ID NO: 7992988 - DNA, 22 bp, Homo sapiens
gtgggcctcccctttacgagcc

SEQ ID NO: 7992989 - DNA, 22 bp, Homo sapiens
gtgggcctcccctttacgagcc

SEQ ID NO: 7992990 - DNA, 22 bp, Homo sapiens
gtgggccaggcgtctaggccct

SEQ ID NO: 7992991 - DNA, 22 bp, Homo sapiens
gtgggccaggcgtctaggccct

SEQ ID NO: 7992992 - DNA, 22 bp, Homo sapiens
gtgggcctcttgagggtggcta

SEQ ID NO: 7992993 - DNA, 22 bp, Homo sapiens
gtgggcctgatgctgccatgag

SEQ ID NO: 7992994 - DNA, 22 bp, Homo sapiens
gtgggcctgatgctgccatgag

SEQ ID NO: 7992995 - DNA, 22 bp, Homo sapiens
gtgggcctgatgctgccatgag

SEQ ID NO: 7992996 - DNA, 22 bp, Homo sapiens
gtgggcctcttgagggtggcta

SEQ ID NO: 7992997 - DNA, 22 bp, Homo sapiens
gtgggccttgcagggtgcaggg

SEQ ID NO: 7992998 - DNA, 22 bp, Homo sapiens
gtgggccttgcagggtgcaggg

SEQ ID NO: 7992999 - DNA, 22 bp, Homo sapiens
gtgggccttcaaccctgtctgg

SEQ ID NO: 7993000 - DNA, 22 bp, Homo sapiens
gtgggctgcccttgaggtcagc

SEQ ID NO: 7993001 - DNA, 22 bp, Homo sapiens
gtgggctgcccttgaggtcagc

SEQ ID NO: 7993002 - DNA, 22 bp, Homo sapiens
gtgggctgcttcctccttccac

SEQ ID NO: 7993003 - DNA, 22 bp, Homo sapiens
gtgggctgcccttgaggtcagc

SEQ ID NO: 7993004 - DNA, 22 bp, Homo sapiens
gtgggctggaccctcctgctcc

SEQ ID NO: 7993005 - DNA, 22 bp, Homo sapiens
gtgggctggaccctcctgctcc

SEQ ID NO: 7993006 - DNA, 22 bp, Homo sapiens
gtgggctggaccctcctgctcc

SEQ ID NO: 7993007 - DNA, 22 bp, Homo sapiens
gtgggctgcttcctccttccac

SEQ ID NO: 7993008 - DNA, 22 bp, Homo sapiens
gtgggctggaccctcctgctcc

SEQ ID NO: 7993009 - DNA, 22 bp, Homo sapiens
gtgggctgcttcctccttccac

SEQ ID NO: 7993010 - DNA, 22 bp, Homo sapiens
gtgggctgcttcctccttccac

SEQ ID NO: 7993011 - DNA, 22 bp, Homo sapiens
gtgggctgcttcctccttccac

SEQ ID NO: 7993012 - DNA, 22 bp, Homo sapiens
gtgggctgcttcctccttccac

SEQ ID NO: 7993013 - DNA, 22 bp, Homo sapiens
gtgggctggatttgcttgcaga

SEQ ID NO: 7993014 - DNA, 22 bp, Homo sapiens
gtgggctggatttgcttgcaga

SEQ ID NO: 7993015 - DNA, 22 bp, Homo sapiens
gtgggctggatttgcttgcaga

SEQ ID NO: 7993016 - DNA, 22 bp, Homo sapiens
gtgggctggaccctcctgctcc

SEQ ID NO: 7993017 - DNA, 22 bp, Homo sapiens
gtgggctggaccctcctgctcc

SEQ ID NO: 7993018 - DNA, 22 bp, Homo sapiens
gtgggctggagcaatgatttca

SEQ ID NO: 7993019 - DNA, 22 bp, Homo sapiens
gtgggctggagcaatgatttca

SEQ ID NO: 7993020 - DNA, 22 bp, Homo sapiens
gtgggctgttgttccctgttct

SEQ ID NO: 7993021 - DNA, 22 bp, Homo sapiens
gtgggcttctgttagggaggct

SEQ ID NO: 7993022 - DNA, 22 bp, Homo sapiens
gtgggctttggcctctttctcc

SEQ ID NO: 7993023 - DNA, 22 bp, Homo sapiens
gtgggcttctgttagggaggct

SEQ ID NO: 7993024 - DNA, 22 bp, Homo sapiens
gtgggcttctgttagggaggct

SEQ ID NO: 7993025 - DNA, 22 bp, Homo sapiens
gtggggggacgttggtcacttt

SEQ ID NO: 7993026 - DNA, 22 bp, Homo sapiens
gtgggggctggctcgtcctgtg

SEQ ID NO: 7993027 - DNA, 22 bp, Homo sapiens
gtggggggacgttggtcacttt

SEQ ID NO: 7993028 - DNA, 22 bp, Homo sapiens
gtggggggacgttggtcacttt

SEQ ID NO: 7993029 - DNA, 22 bp, Homo sapiens
gtgggggctggctcgtcctgtg

SEQ ID NO: 7993030 - DNA, 22 bp, Homo sapiens
gtgggggctggctcgtcctgtg

SEQ ID NO: 7993031 - DNA, 22 bp, Homo sapiens
gtgggggctggctcgtcctgtg

SEQ ID NO: 7993032 - DNA, 22 bp, Homo sapiens
gtgggggctggctcgtcctgtg

SEQ ID NO: 7993033 - DNA, 22 bp, Homo sapiens
gtggggggagctgcaagctgga

SEQ ID NO: 7993034 - DNA, 22 bp, Homo sapiens
gtggggggagctgcaagctgga

SEQ ID NO: 7993035 - DNA, 22 bp, Homo sapiens
gtggggggagctgcaagctgga

SEQ ID NO: 7993036 - DNA, 22 bp, Homo sapiens
gtggggggacgttggtcacttt

SEQ ID NO: 7993037 - DNA, 22 bp, Homo sapiens
gtggggggagctgcaagctgga

SEQ ID NO: 7993038 - DNA, 22 bp, Homo sapiens
gtggggggacgttggtcacttt

SEQ ID NO: 7993039 - DNA, 22 bp, Homo sapiens
gtggggggagctgcaagctgga

SEQ ID NO: 7993040 - DNA, 22 bp, Homo sapiens
gtgggggtggaaaggcaagttg

SEQ ID NO: 7993041 - DNA, 22 bp, Homo sapiens
gtgggggtggaaaggcaagttg

SEQ ID NO: 7993042 - DNA, 22 bp, Homo sapiens
gtgggggtggaaaggcaagttg

SEQ ID NO: 7993043 - DNA, 22 bp, Homo sapiens
gtgggggtggaaaggcaagttg

SEQ ID NO: 7993044 - DNA, 22 bp, Homo sapiens
gtgggggtggaaaggcaagttg

SEQ ID NO: 7993045 - DNA, 22 bp, Homo sapiens
gtgggggtggaaaggcaagttg

SEQ ID NO: 7993046 - DNA, 22 bp, Homo sapiens
gtgggggtttcattaagacaat

SEQ ID NO: 7993047 - DNA, 22 bp, Homo sapiens
gtggggtagatctttctcagga

SEQ ID NO: 7993048 - DNA, 22 bp, Homo sapiens
gtggggtagatctttctcagga

SEQ ID NO: 7993049 - DNA, 22 bp, Homo sapiens
gtgggggtttcattaagacaat

SEQ ID NO: 7993050 - DNA, 22 bp, Homo sapiens
gtggggtagatctttctcagga

SEQ ID NO: 7993051 - DNA, 18 bp, Homo sapiens
gtggggtgttgtgaggat

SEQ ID NO: 7993052 - DNA, 18 bp, Homo sapiens
gtggggtgttgtgaggat

SEQ ID NO: 7993053 - DNA, 18 bp, Homo sapiens
gtggggtgttgtgaggat

SEQ ID NO: 7993054 - DNA, 18 bp, Homo sapiens
gtggggtgttgtgaggat

SEQ ID NO: 7993055 - DNA, 22 bp, Homo sapiens
gtggggtgtccagcagcgagct

SEQ ID NO: 7993056 - DNA, 22 bp, Homo sapiens
gtggggtgtccagcagcgagct

SEQ ID NO: 7993057 - DNA, 22 bp, Homo sapiens
gtggggtgtccagcagcgagct

SEQ ID NO: 7993058 - DNA, 22 bp, Homo sapiens
gtggggtgtccagcagcgagct

SEQ ID NO: 7993059 - DNA, 18 bp, Homo sapiens
gtggggtgttgtgaggat

SEQ ID NO: 7993060 - DNA, 18 bp, Homo sapiens
gtggggtgttgtgaggat

SEQ ID NO: 7993061 - DNA, 22 bp, Homo sapiens
gtggggtgtccagcagcgagct

SEQ ID NO: 7993062 - DNA, 22 bp, Homo sapiens
gtggggtctgtcctcttctggg

SEQ ID NO: 7993063 - DNA, 22 bp, Homo sapiens
gtggggtgcagcagtactgtgt

SEQ ID NO: 7993064 - DNA, 22 bp, Homo sapiens
gtggggtgcagcagtactgtgt

SEQ ID NO: 7993065 - DNA, 22 bp, Homo sapiens
gtggggtctgtcctcttctggg

SEQ ID NO: 7993066 - DNA, 22 bp, Homo sapiens
gtggggtctgtcctcttctggg

SEQ ID NO: 7993067 - DNA, 22 bp, Homo sapiens
gtggggtctctctgtacctccc

SEQ ID NO: 7993068 - DNA, 22 bp, Homo sapiens
gtggggtctctctgtacctccc

SEQ ID NO: 7993069 - DNA, 22 bp, Homo sapiens
gtggggtagatctttctcagga

SEQ ID NO: 7993070 - DNA, 22 bp, Homo sapiens
gtggggtctctctgtacctccc

SEQ ID NO: 7993071 - DNA, 22 bp, Homo sapiens
gtggggtgggctgagttaggcc

SEQ ID NO: 7993072 - DNA, 22 bp, Homo sapiens
gtggggtgtccagcagcgagct

SEQ ID NO: 7993073 - DNA, 22 bp, Homo sapiens
gtggggtgggctgagttaggcc

SEQ ID NO: 7993074 - DNA, 22 bp, Homo sapiens
gtggggtgggctgagttaggcc

SEQ ID NO: 7993075 - DNA, 22 bp, Homo sapiens
gtggtcaggggctgaggtgccc

SEQ ID NO: 7993076 - DNA, 22 bp, Homo sapiens
gtggtcaggggctgaggtgccc

SEQ ID NO: 7993077 - DNA, 22 bp, Homo sapiens
gtggtcaggcagtgggagagaa

SEQ ID NO: 7993078 - DNA, 22 bp, Homo sapiens
gtggtcagggagcagagccatg

SEQ ID NO: 7993079 - DNA, 22 bp, Homo sapiens
gtggtcaggcagtgggagagaa

SEQ ID NO: 7993080 - DNA, 22 bp, Homo sapiens
gtggtcaggcagtgggagagaa

SEQ ID NO: 7993081 - DNA, 22 bp, Homo sapiens
gtggtcagcagcagtgggagtg

SEQ ID NO: 7993082 - DNA, 22 bp, Homo sapiens
gtggtcagccccggtgagccct

SEQ ID NO: 7993083 - DNA, 22 bp, Homo sapiens
gtggtcagttaggcaatcatgt

SEQ ID NO: 7993084 - DNA, 22 bp, Homo sapiens
gtggtcagttaggcaatcatgt

SEQ ID NO: 7993085 - DNA, 22 bp, Homo sapiens
gtggtcagttaaggttgaaacg

SEQ ID NO: 7993086 - DNA, 22 bp, Homo sapiens
gtggtcaggggctgtggctatg

SEQ ID NO: 7993087 - DNA, 22 bp, Homo sapiens
gtggtcaggggctgaggtgccc

SEQ ID NO: 7993088 - DNA, 22 bp, Homo sapiens
gtggtcaggttatcagatcata

SEQ ID NO: 7993089 - DNA, 22 bp, Homo sapiens
gtggtcaggttatcagatcata

SEQ ID NO: 7993090 - DNA, 22 bp, Homo sapiens
gtggtcagcagcagtgggagtg

SEQ ID NO: 7993091 - DNA, 22 bp, Homo sapiens
gtggtcagagatgacagtgggt

SEQ ID NO: 7993092 - DNA, 22 bp, Homo sapiens
gtggtcagcagcagtgggagtg

SEQ ID NO: 7993093 - DNA, 22 bp, Homo sapiens
gtggtcagaatggagcccagga

SEQ ID NO: 7993094 - DNA, 22 bp, Homo sapiens
gtggtcagaatggagcccagga

SEQ ID NO: 7993095 - DNA, 22 bp, Homo sapiens
gtggtcagaatggagcccagga

SEQ ID NO: 7993096 - DNA, 22 bp, Homo sapiens
gtggtcagagatgacagtgggt

SEQ ID NO: 7993097 - DNA, 22 bp, Homo sapiens
gtggtcagaaatctcagtggca

SEQ ID NO: 7993098 - DNA, 22 bp, Homo sapiens
gtggtcagaaatctcagtggca

SEQ ID NO: 7993099 - DNA, 22 bp, Homo sapiens
gtggtcagaatggagcccagga

SEQ ID NO: 7993100 - DNA, 22 bp, Homo sapiens
gtggtcagaaatctcagtggca

SEQ ID NO: 7993101 - DNA, 22 bp, Homo sapiens
gtggtcaccatgaatgtgggtt

SEQ ID NO: 7993102 - DNA, 20 bp, Homo sapiens
gtggtcacacctgagtgggt

SEQ ID NO: 7993103 - DNA, 22 bp, Homo sapiens
gtgggtggaggcgtcgagggca

SEQ ID NO: 7993104 - DNA, 22 bp, Homo sapiens
gtgggtgatgtactggaggcca

SEQ ID NO: 7993105 - DNA, 22 bp, Homo sapiens
gtgggtgcggggagccgaggcg

SEQ ID NO: 7993106 - DNA, 22 bp, Homo sapiens
gtgggtgcggggagccgaggcg

SEQ ID NO: 7993107 - DNA, 22 bp, Homo sapiens
gtgggtggacggtgcttttgtt

SEQ ID NO: 7993108 - DNA, 22 bp, Homo sapiens
gtgggtgctgtcaggcagggaa

SEQ ID NO: 7993109 - DNA, 22 bp, Homo sapiens
gtgggtgatgtactggaggcca

SEQ ID NO: 7993110 - DNA, 22 bp, Homo sapiens
gtgggtgatgtactggaggcca

SEQ ID NO: 7993111 - DNA, 22 bp, Homo sapiens
gtgggtctggctttgagggtca

SEQ ID NO: 7993112 - DNA, 18 bp, Homo sapiens
gtggggtgttgtgaggat

SEQ ID NO: 7993113 - DNA, 22 bp, Homo sapiens
gtgggtggaggcgtcgagggca

SEQ ID NO: 7993114 - DNA, 22 bp, Homo sapiens
gtgggtggaggcgtcgagggca

SEQ ID NO: 7993115 - DNA, 22 bp, Homo sapiens
gtgggtggaggcgtcgagggca

SEQ ID NO: 7993116 - DNA, 22 bp, Homo sapiens
gtgggtggagactgggtgcaag

SEQ ID NO: 7993117 - DNA, 22 bp, Homo sapiens
gtgggtggagactgggtgcaag

SEQ ID NO: 7993118 - DNA, 22 bp, Homo sapiens
gtgggtggaggcgtcgagggca

SEQ ID NO: 7993119 - DNA, 22 bp, Homo sapiens
gtgggtggagactgggtgcaag

SEQ ID NO: 7993120 - DNA, 22 bp, Homo sapiens
gtgggtggagactgggtgcaag

SEQ ID NO: 7993121 - DNA, 22 bp, Homo sapiens
gtgggtggagactgggtgcaag

SEQ ID NO: 7993122 - DNA, 22 bp, Homo sapiens
gtgggtggagactgggtgcaag

SEQ ID NO: 7993123 - DNA, 22 bp, Homo sapiens
gtgggtggagactgggtgcaag

SEQ ID NO: 7993124 - DNA, 22 bp, Homo sapiens
gtgggtggagactgggtgcaag

SEQ ID NO: 7993125 - DNA, 22 bp, Homo sapiens
gtgggtggagactgggtgcaag

SEQ ID NO: 7993126 - DNA, 22 bp, Homo sapiens
gtgggtggacggtgcttttgtt

SEQ ID NO: 7993127 - DNA, 22 bp, Homo sapiens
gtgggtggagactgggtgcaag

SEQ ID NO: 7993128 - DNA, 22 bp, Homo sapiens
gtgggtggagactgggtgcaag

SEQ ID NO: 7993129 - DNA, 22 bp, Homo sapiens
gtgtaagtatctttgtatcttt

SEQ ID NO: 7993130 - DNA, 22 bp, Homo sapiens
gtgtaagtatctttgtatcttt

SEQ ID NO: 7993131 - DNA, 22 bp, Homo sapiens
gtgtaagtatctttgtatcttt

SEQ ID NO: 7993132 - DNA, 22 bp, Homo sapiens
gtgtaattgaaattgagaacca

SEQ ID NO: 7993133 - DNA, 22 bp, Homo sapiens
gtgtaattatataaagatctac

SEQ ID NO: 7993134 - DNA, 22 bp, Homo sapiens
gtgtaattagtagtaaattcaa

SEQ ID NO: 7993135 - DNA, 22 bp, Homo sapiens
gtgtaagtatctttgtatcttt

SEQ ID NO: 7993136 - DNA, 22 bp, Homo sapiens
gtgtaatttctaggtaatttga

SEQ ID NO: 7993137 - DNA, 22 bp, Homo sapiens
gtgtaattttgtggtcctgtac

SEQ ID NO: 7993138 - DNA, 22 bp, Homo sapiens
gtgtacaaaatgtctccatgga

SEQ ID NO: 7993139 - DNA, 22 bp, Homo sapiens
gtgtacaaaatgtctccatgga

SEQ ID NO: 7993140 - DNA, 22 bp, Homo sapiens
gtgtacaaaatgtctccatgga

SEQ ID NO: 7993141 - DNA, 22 bp, Homo sapiens
gtgtacacacatcgtttgtcat

SEQ ID NO: 7993142 - DNA, 17 bp, Homo sapiens
gtgtacaagcagaaggc

SEQ ID NO: 7993143 - DNA, 17 bp, Homo sapiens
gtgtacaagcagaaggc

SEQ ID NO: 7993144 - DNA, 22 bp, Homo sapiens
gtgtacacttccttcacacggt

SEQ ID NO: 7993145 - DNA, 22 bp, Homo sapiens
gtgtacacatcattcacatata

SEQ ID NO: 7993146 - DNA, 22 bp, Homo sapiens
gtgtacacatacacatattgaa

SEQ ID NO: 7993147 - DNA, 22 bp, Homo sapiens
gtgtcacaggcccagctcttca

SEQ ID NO: 7993148 - DNA, 22 bp, Homo sapiens
gtgtcacaagagcccaggaaac

SEQ ID NO: 7993149 - DNA, 22 bp, Homo sapiens
gtgtcaatgaggtttatttttg

SEQ ID NO: 7993150 - DNA, 22 bp, Homo sapiens
gtgtcaataaatagcggtgtgg

SEQ ID NO: 7993151 - DNA, 22 bp, Homo sapiens
gtgtcaataaatagcggtgtgg

SEQ ID NO: 7993152 - DNA, 22 bp, Homo sapiens
gtgtacaggatgactgtactta

SEQ ID NO: 7993153 - DNA, 19 bp, Homo sapiens
gtgtacacttggccatggt

SEQ ID NO: 7993154 - DNA, 22 bp, Homo sapiens
gtgtacacttgaactgacggtt

SEQ ID NO: 7993155 - DNA, 19 bp, Homo sapiens
gtgtacagctcagtgaatt

SEQ ID NO: 7993156 - DNA, 22 bp, Homo sapiens
gtggtttgttttattcctggaa

SEQ ID NO: 7993157 - DNA, 22 bp, Homo sapiens
gtggttttctccaacccagaac

SEQ ID NO: 7993158 - DNA, 22 bp, Homo sapiens
gtggttttattcgttcctctgt

SEQ ID NO: 7993159 - DNA, 22 bp, Homo sapiens
gtgtaaaaacatactatttcta

SEQ ID NO: 7993160 - DNA, 22 bp, Homo sapiens
gtgtaaaaacatactatttcta

SEQ ID NO: 7993161 - DNA, 22 bp, Homo sapiens
gtggttttggaggccactgttt

SEQ ID NO: 7993162 - DNA, 22 bp, Homo sapiens
gtggttttgccattacaagtaa

SEQ ID NO: 7993163 - DNA, 22 bp, Homo sapiens
gtgtaaatcagcttgtgtaata

SEQ ID NO: 7993164 - DNA, 22 bp, Homo sapiens
gtgtaaatcagcttgtgtaata

SEQ ID NO: 7993165 - DNA, 22 bp, Homo sapiens
gtgtaaaaacatactatttcta

SEQ ID NO: 7993166 - DNA, 22 bp, Homo sapiens
gtgtaacttttattcatgctct

SEQ ID NO: 7993167 - DNA, 22 bp, Homo sapiens
gtgtaacttgctggaaaaacta

SEQ ID NO: 7993168 - DNA, 17 bp, Homo sapiens
gtgtaactatgagccat

SEQ ID NO: 7993169 - DNA, 22 bp, Homo sapiens
gtgtaaatttgtacttgtaaat

SEQ ID NO: 7993170 - DNA, 22 bp, Homo sapiens
gtgtaaatgccccattcattga

SEQ ID NO: 7993171 - DNA, 21 bp, Homo sapiens
gtggttctagagaaacagaat

SEQ ID NO: 7993172 - DNA, 22 bp, Homo sapiens
gtggtttgtgcatagctcctat

SEQ ID NO: 7993173 - DNA, 22 bp, Homo sapiens
gtggtgtttgagctgccaggga

SEQ ID NO: 7993174 - DNA, 22 bp, Homo sapiens
gtggtgtttgccagttaataac

SEQ ID NO: 7993175 - DNA, 22 bp, Homo sapiens
gtggtgtttgagctgccaggga

SEQ ID NO: 7993176 - DNA, 22 bp, Homo sapiens
gtggtgttcccacgcctgctag

SEQ ID NO: 7993177 - DNA, 22 bp, Homo sapiens
gtggtgtttttggggcagagga

SEQ ID NO: 7993178 - DNA, 22 bp, Homo sapiens
gtggtgcaggccagcaggggcg

SEQ ID NO: 7993179 - DNA, 22 bp, Homo sapiens
gtggtgcaggccagcaggggcg

SEQ ID NO: 7993180 - DNA, 22 bp, Homo sapiens
gtggtgcaggccagcaggggcg

SEQ ID NO: 7993181 - DNA, 22 bp, Homo sapiens
gtggtgagttcaggctggggtg

SEQ ID NO: 7993182 - DNA, 22 bp, Homo sapiens
gtggtgcaggaagcatctggct

SEQ ID NO: 7993183 - DNA, 22 bp, Homo sapiens
gtggtgcaggaagcatctggct

SEQ ID NO: 7993184 - DNA, 22 bp, Homo sapiens
gtggtgtggctggcagagttta

SEQ ID NO: 7993185 - DNA, 22 bp, Homo sapiens
gtggtggatgtctgtaatctca

SEQ ID NO: 7993186 - DNA, 22 bp, Homo sapiens
gtggtgcaggtgtcactgcaga

SEQ ID NO: 7993187 - DNA, 22 bp, Homo sapiens
gtggtgcaggtgtcactgcaga

SEQ ID NO: 7993188 - DNA, 22 bp, Homo sapiens
gtggtgcaggtgtcactgcaga

SEQ ID NO: 7993189 - DNA, 22 bp, Homo sapiens
gtggtgcatccttgagtaagct

SEQ ID NO: 7993190 - DNA, 22 bp, Homo sapiens
gtggtgcatccttgagtaagct

SEQ ID NO: 7993191 - DNA, 22 bp, Homo sapiens
gtggtccatcatgcagagctcc

SEQ ID NO: 7993192 - DNA, 22 bp, Homo sapiens
gtggtccccagagctgtgtaca

SEQ ID NO: 7993193 - DNA, 22 bp, Homo sapiens
gtggtccatcatgcagagctcc

SEQ ID NO: 7993194 - DNA, 22 bp, Homo sapiens
gtggtcctcataattcagtgag

SEQ ID NO: 7993195 - DNA, 22 bp, Homo sapiens
gtggtcctcataattcagtgag

SEQ ID NO: 7993196 - DNA, 22 bp, Homo sapiens
gtggtcccttctggccctggtc

SEQ ID NO: 7993197 - DNA, 22 bp, Homo sapiens
gtggtcccttctggccctggtc

SEQ ID NO: 7993198 - DNA, 22 bp, Homo sapiens
gtggtccccagagctgtgtaca

SEQ ID NO: 7993199 - DNA, 22 bp, Homo sapiens
gtggtcccttctggccctggtc

SEQ ID NO: 7993200 - DNA, 22 bp, Homo sapiens
gtggtcctgcacccgcttggcc

SEQ ID NO: 7993201 - DNA, 22 bp, Homo sapiens
gtggtcctgccagccaggtcca

SEQ ID NO: 7993202 - DNA, 22 bp, Homo sapiens
gtggtcctgcacccgcttggcc

SEQ ID NO: 7993203 - DNA, 22 bp, Homo sapiens
gtggtctggggtcaggcctgag

SEQ ID NO: 7993204 - DNA, 22 bp, Homo sapiens
gtggtctttaaatttgtgcctg

SEQ ID NO: 7993205 - DNA, 22 bp, Homo sapiens
gtggtcctggcaaccatggtga

SEQ ID NO: 7993206 - DNA, 22 bp, Homo sapiens
gtggtcctggcaaccatggtga

SEQ ID NO: 7993207 - DNA, 22 bp, Homo sapiens
gtggtccttacaggaggcttac

SEQ ID NO: 7993208 - DNA, 22 bp, Homo sapiens
gtggtcctgtcctgacggcttc

SEQ ID NO: 7993209 - DNA, 22 bp, Homo sapiens
gtggtcctggcaaccatggtga

SEQ ID NO: 7993210 - DNA, 22 bp, Homo sapiens
gtggtgagttcaggctggggtg

SEQ ID NO: 7993211 - DNA, 22 bp, Homo sapiens
gtggtgagttcaggctggggtg

SEQ ID NO: 7993212 - DNA, 22 bp, Homo sapiens
gtggtgagattgctggatcaaa

SEQ ID NO: 7993213 - DNA, 22 bp, Homo sapiens
gtggtgagattgctggatcaaa

SEQ ID NO: 7993214 - DNA, 22 bp, Homo sapiens
gtggtgaagccccatctctgct

SEQ ID NO: 7993215 - DNA, 22 bp, Homo sapiens
gtggtgaagccccatctctgct

SEQ ID NO: 7993216 - DNA, 18 bp, Homo sapiens
gtggtctttctgtcttct

SEQ ID NO: 7993217 - DNA, 22 bp, Homo sapiens
gtggtgaagcattgagaagtca

SEQ ID NO: 7993218 - DNA, 22 bp, Homo sapiens
gtttttctaggaccatgtgatt

SEQ ID NO: 7993219 - DNA, 22 bp, Homo sapiens
gtttttctaggaccatgtgatt

SEQ ID NO: 7993220 - DNA, 22 bp, Homo sapiens
gtttttctaggaccatgtgatt

SEQ ID NO: 7993221 - DNA, 22 bp, Homo sapiens
gtttttctaggaccatgtgatt

SEQ ID NO: 7993222 - DNA, 20 bp, Homo sapiens
gtttttctctcttgccacta

SEQ ID NO: 7993223 - DNA, 22 bp, Homo sapiens
gtttttctaggaccatgtgatt

SEQ ID NO: 7993224 - DNA, 22 bp, Homo sapiens
gtttttctagaaatctcctcct

SEQ ID NO: 7993225 - DNA, 22 bp, Homo sapiens
gtttttctagaaatctcctcct

SEQ ID NO: 7993226 - DNA, 22 bp, Homo sapiens
gtttttctagactgggagtttg

SEQ ID NO: 7993227 - DNA, 22 bp, Homo sapiens
gtttttctagactgggagtttg

SEQ ID NO: 7993228 - DNA, 22 bp, Homo sapiens
gtttttctagactgggagtttg

SEQ ID NO: 7993229 - DNA, 22 bp, Homo sapiens
gtttttctagactgggagtttg

SEQ ID NO: 7993230 - DNA, 22 bp, Homo sapiens
gtttttctagactgggagtttg

SEQ ID NO: 7993231 - DNA, 22 bp, Homo sapiens
gtttttctaggaccatgtgatt

SEQ ID NO: 7993232 - DNA, 22 bp, Homo sapiens
gtttttctgtgagcggtaaagg

SEQ ID NO: 7993233 - DNA, 22 bp, Homo sapiens
gtttttctgtgagcggtaaagg

SEQ ID NO: 7993234 - DNA, 22 bp, Homo sapiens
gtttttctgtgagcggtaaagg

SEQ ID NO: 7993235 - DNA, 20 bp, Homo sapiens
gtttttcttgggcgagctat

SEQ ID NO: 7993236 - DNA, 20 bp, Homo sapiens
gtttttcttgggcgagctat

SEQ ID NO: 7993237 - DNA, 20 bp, Homo sapiens
gtttttcttgggcgagctat

SEQ ID NO: 7993238 - DNA, 22 bp, Homo sapiens
gtttttctctgaaatagttgac

SEQ ID NO: 7993239 - DNA, 22 bp, Homo sapiens
gtttttctctgaaatagttgac

SEQ ID NO: 7993240 - DNA, 22 bp, Homo sapiens
gtttttctctgaaatagttgac

SEQ ID NO: 7993241 - DNA, 20 bp, Homo sapiens
gtttttctctcttgccacta

SEQ ID NO: 7993242 - DNA, 20 bp, Homo sapiens
gtttttctctcttgccacta

SEQ ID NO: 7993243 - DNA, 22 bp, Homo sapiens
gttttttcatgagtagttatct

SEQ ID NO: 7993244 - DNA, 22 bp, Homo sapiens
gttttttcatgagtagttatct

SEQ ID NO: 7993245 - DNA, 22 bp, Homo sapiens
gtttttgtcgagttccttgacc

SEQ ID NO: 7993246 - DNA, 22 bp, Homo sapiens
gttttttcatgagtagttatct

SEQ ID NO: 7993247 - DNA, 22 bp, Homo sapiens
gttttttcatgagtagttatct

SEQ ID NO: 7993248 - DNA, 22 bp, Homo sapiens
gtttttctttgtgtgaagacaa

SEQ ID NO: 7993249 - DNA, 22 bp, Homo sapiens
gtttttctttgtgtgaagacaa

SEQ ID NO: 7993250 - DNA, 22 bp, Homo sapiens
gtttttctttgtgtgaagacaa

SEQ ID NO: 7993251 - DNA, 22 bp, Homo sapiens
gtttttctttgtgtgaagacaa

SEQ ID NO: 7993252 - DNA, 22 bp, Homo sapiens
gtttttctttgtgtgaagacaa

SEQ ID NO: 7993253 - DNA, 22 bp, Homo sapiens
gtttttctttgtgtgaagacaa

SEQ ID NO: 7993254 - DNA, 22 bp, Homo sapiens
taaaacactcagcacctagcaa

SEQ ID NO: 7993255 - DNA, 22 bp, Homo sapiens
taaaacacctgtagtgtctgcc

SEQ ID NO: 7993256 - DNA, 22 bp, Homo sapiens
taaaacacataaactctctatt

SEQ ID NO: 7993257 - DNA, 22 bp, Homo sapiens
taaaacacctgtagtgtctgcc

SEQ ID NO: 7993258 - DNA, 22 bp, Homo sapiens
gttttttcatgagtagttatct

SEQ ID NO: 7993259 - DNA, 22 bp, Homo sapiens
gttttttgggtgtatatcttct

SEQ ID NO: 7993260 - DNA, 22 bp, Homo sapiens
taaaacacataaactctctatt

SEQ ID NO: 7993261 - DNA, 22 bp, Homo sapiens
taaaaaacattactctgtcctg

SEQ ID NO: 7993262 - DNA, 22 bp, Homo sapiens
taaaaaacattactctgtcctg

SEQ ID NO: 7993263 - DNA, 22 bp, Homo sapiens
gttttttgggtgtatatcttct

SEQ ID NO: 7993264 - DNA, 22 bp, Homo sapiens
gttttttgggtgtatatcttct

SEQ ID NO: 7993265 - DNA, 22 bp, Homo sapiens
gtttaataatgttgaattacta

SEQ ID NO: 7993266 - DNA, 22 bp, Homo sapiens
gtttaataatgttgaattacta

SEQ ID NO: 7993267 - DNA, 22 bp, Homo sapiens
gtttaataatgttgaattacta

SEQ ID NO: 7993268 - DNA, 22 bp, Homo sapiens
gtttaaccaagagcattgtgca

SEQ ID NO: 7993269 - DNA, 22 bp, Homo sapiens
gtttaaccaagagcattgtgca

SEQ ID NO: 7993270 - DNA, 22 bp, Homo sapiens
gtttaagaaaattcatgttgtt

SEQ ID NO: 7993271 - DNA, 22 bp, Homo sapiens
gtttaaccattgcatatccata

SEQ ID NO: 7993272 - DNA, 22 bp, Homo sapiens
gtttaagaaaattcatgttgtt

SEQ ID NO: 7993273 - DNA, 22 bp, Homo sapiens
gtttaagtttcagaagctaaga

SEQ ID NO: 7993274 - DNA, 22 bp, Homo sapiens
gtttaagagggtttcattccca

SEQ ID NO: 7993275 - DNA, 22 bp, Homo sapiens
gtttaagagggtttcattccca

SEQ ID NO: 7993276 - DNA, 22 bp, Homo sapiens
gtttaagaaaattcatgttgtt

SEQ ID NO: 7993277 - DNA, 22 bp, Homo sapiens
gtttttcctgctgacttgggtc

SEQ ID NO: 7993278 - DNA, 22 bp, Homo sapiens
gtttttccttgctgaggacccg

SEQ ID NO: 7993279 - DNA, 19 bp, Homo sapiens
gtttttcccagacgaggca

SEQ ID NO: 7993280 - DNA, 22 bp, Homo sapiens
gtttttcctgctgacttgggtc

SEQ ID NO: 7993281 - DNA, 21 bp, Homo sapiens
gtttttcagccctgaggtgag

SEQ ID NO: 7993282 - DNA, 19 bp, Homo sapiens
gtttttcccagacgaggca

SEQ ID NO: 7993283 - DNA, 19 bp, Homo sapiens
gtttttcccagacgaggca

SEQ ID NO: 7993284 - DNA, 22 bp, Homo sapiens
gtttttccttgctgaggacccg

SEQ ID NO: 7993285 - DNA, 22 bp, Homo sapiens
gtttttccttgctgaggacccg

SEQ ID NO: 7993286 - DNA, 22 bp, Homo sapiens
gtttttctaagtagcgatattt

SEQ ID NO: 7993287 - DNA, 22 bp, Homo sapiens
gtttttctaagtagcgatattt

SEQ ID NO: 7993288 - DNA, 22 bp, Homo sapiens
gtttttctagaaatctcctcct

SEQ ID NO: 7993289 - DNA, 22 bp, Homo sapiens
gtttttctagaaatctcctcct

SEQ ID NO: 7993290 - DNA, 22 bp, Homo sapiens
gtttttctagaaatctcctcct

SEQ ID NO: 7993291 - DNA, 22 bp, Homo sapiens
gtttaaataattaggggcctgt

SEQ ID NO: 7993292 - DNA, 22 bp, Homo sapiens
gtttaaataattaggggcctgt

SEQ ID NO: 7993293 - DNA, 22 bp, Homo sapiens
gtttaaataattaggggcctgt

SEQ ID NO: 7993294 - DNA, 22 bp, Homo sapiens
gtttaaataattaggggcctgt

SEQ ID NO: 7993295 - DNA, 22 bp, Homo sapiens
gtttaaataattaggggcctgt

SEQ ID NO: 7993296 - DNA, 22 bp, Homo sapiens
gttgtttttgttctctatagct

SEQ ID NO: 7993297 - DNA, 22 bp, Homo sapiens
gttgtttttgttctctatagct

SEQ ID NO: 7993298 - DNA, 22 bp, Homo sapiens
gttgtttttgttctctatagct

SEQ ID NO: 7993299 - DNA, 22 bp, Homo sapiens
gttgtttttgttctctatagct

SEQ ID NO: 7993300 - DNA, 22 bp, Homo sapiens
gttgtttttgttctctatagct

SEQ ID NO: 7993301 - DNA, 22 bp, Homo sapiens
gtttaaagtcttggaaggagga

SEQ ID NO: 7993302 - DNA, 22 bp, Homo sapiens
gttgtttttgttctctatagct

SEQ ID NO: 7993303 - DNA, 22 bp, Homo sapiens
gttgttttgcaggatccttaca

SEQ ID NO: 7993304 - DNA, 22 bp, Homo sapiens
gttgttttgcaggatccttaca

SEQ ID NO: 7993305 - DNA, 22 bp, Homo sapiens
gttgttttgcaggatccttaca

SEQ ID NO: 7993306 - DNA, 22 bp, Homo sapiens
gttgttttgcaggatccttaca

SEQ ID NO: 7993307 - DNA, 22 bp, Homo sapiens
gttgttttcagcagtttatgac

SEQ ID NO: 7993308 - DNA, 22 bp, Homo sapiens
gttgttttgcaggatccttaca

SEQ ID NO: 7993309 - DNA, 22 bp, Homo sapiens
gttgttttgcaggatccttaca

SEQ ID NO: 7993310 - DNA, 22 bp, Homo sapiens
gttgttttgctgtctgtcttag

SEQ ID NO: 7993311 - DNA, 22 bp, Homo sapiens
gttgttttgctgtctgtcttag

SEQ ID NO: 7993312 - DNA, 19 bp, Homo sapiens
gttgtttttcttattatgg

SEQ ID NO: 7993313 - DNA, 22 bp, Homo sapiens
gttgtttttgaacggtggtggc

SEQ ID NO: 7993314 - DNA, 22 bp, Homo sapiens
gttgtttttgaacggtggtggc

SEQ ID NO: 7993315 - DNA, 22 bp, Homo sapiens
gttgtttttgttctctatagct

SEQ ID NO: 7993316 - DNA, 22 bp, Homo sapiens
gttgttttgctgtctgtcttag

SEQ ID NO: 7993317 - DNA, 19 bp, Homo sapiens
gttgtttttcttattatgg

SEQ ID NO: 7993318 - DNA, 19 bp, Homo sapiens
gttgtttttcttattatgg

SEQ ID NO: 7993319 - DNA, 19 bp, Homo sapiens
gttgtttttcttattatgg

SEQ ID NO: 7993320 - DNA, 19 bp, Homo sapiens
gttgtttttcttattatgg

SEQ ID NO: 7993321 - DNA, 22 bp, Homo sapiens
taaagctagaaggtgctgtaca

SEQ ID NO: 7993322 - DNA, 21 bp, Homo sapiens
taaagctagaaccttagcttt

SEQ ID NO: 7993323 - DNA, 22 bp, Homo sapiens
taaagcagtatgatggaaggat

SEQ ID NO: 7993324 - DNA, 22 bp, Homo sapiens
taaagcagtatgatggaaggat

SEQ ID NO: 7993325 - DNA, 22 bp, Homo sapiens
taaagcagtctgtgtatgtgaa

SEQ ID NO: 7993326 - DNA, 22 bp, Homo sapiens
taaagcagtctgtgtatgtgaa

SEQ ID NO: 7993327 - DNA, 22 bp, Homo sapiens
taaagctattatagttatgttt

SEQ ID NO: 7993328 - DNA, 22 bp, Homo sapiens
taaagctctagtgttttggata

SEQ ID NO: 7993329 - DNA, 21 bp, Homo sapiens
taaagctcgttcaggaaagtc

SEQ ID NO: 7993330 - DNA, 22 bp, Homo sapiens
taaagctatgcttaatttatca

SEQ ID NO: 7993331 - DNA, 22 bp, Homo sapiens
taaagctagaattgttccagca

SEQ ID NO: 7993332 - DNA, 22 bp, Homo sapiens
taaagctgttcagtgcagaaag

SEQ ID NO: 7993333 - DNA, 22 bp, Homo sapiens
taaagctgttcagtgcagaaag

SEQ ID NO: 7993334 - DNA, 22 bp, Homo sapiens
taaagctgttagagtagtaaga

SEQ ID NO: 7993335 - DNA, 22 bp, Homo sapiens
taaagctgttagagtagtaaga

SEQ ID NO: 7993336 - DNA, 22 bp, Homo sapiens
taaagctgcaggctcagaaaac

SEQ ID NO: 7993337 - DNA, 22 bp, Homo sapiens
taaagctgcaggctcagaaaac

SEQ ID NO: 7993338 - DNA, 22 bp, Homo sapiens
taaagctgaaatgattatgaca

SEQ ID NO: 7993339 - DNA, 22 bp, Homo sapiens
taaagctgaaatgattatgaca

SEQ ID NO: 7993340 - DNA, 22 bp, Homo sapiens
taaagctgcaggctcagaaaac

SEQ ID NO: 7993341 - DNA, 22 bp, Homo sapiens
taaagcttgtattgcaatattt

SEQ ID NO: 7993342 - DNA, 22 bp, Homo sapiens
taaagcttgtattgcaatattt

SEQ ID NO: 7993343 - DNA, 22 bp, Homo sapiens
taaaggaacagaggactcattt

SEQ ID NO: 7993344 - DNA, 22 bp, Homo sapiens
taaaggaacagaggactcattt

SEQ ID NO: 7993345 - DNA, 22 bp, Homo sapiens
taaaggaacagaggactcattt

SEQ ID NO: 7993346 - DNA, 22 bp, Homo sapiens
taaaggaactgctgctatggaa

SEQ ID NO: 7993347 - DNA, 22 bp, Homo sapiens
taaaggaactgctgctatggaa

SEQ ID NO: 7993348 - DNA, 22 bp, Homo sapiens
taaaactagtggttgggactaa

SEQ ID NO: 7993349 - DNA, 22 bp, Homo sapiens
taaaactgaatacatactgagg

SEQ ID NO: 7993350 - DNA, 22 bp, Homo sapiens
taaaactagtggttgggactaa

SEQ ID NO: 7993351 - DNA, 22 bp, Homo sapiens
taaaactagaccgtgagtctaa

SEQ ID NO: 7993352 - DNA, 22 bp, Homo sapiens
taaaactagaccgtgagtctaa

SEQ ID NO: 7993353 - DNA, 22 bp, Homo sapiens
taaaactagaccgtgagtctaa

SEQ ID NO: 7993354 - DNA, 22 bp, Homo sapiens
taaagcaggtgctcagtgacca

SEQ ID NO: 7993355 - DNA, 22 bp, Homo sapiens
taaagcaggtgctcagtgacca

SEQ ID NO: 7993356 - DNA, 22 bp, Homo sapiens
taaagcaggccacatatgtgat

SEQ ID NO: 7993357 - DNA, 22 bp, Homo sapiens
taaagcagcgtgggtggggcag

SEQ ID NO: 7993358 - DNA, 22 bp, Homo sapiens
taaagcaggcatctctctcctc

SEQ ID NO: 7993359 - DNA, 22 bp, Homo sapiens
taaagcaggcatctctctcctc

SEQ ID NO: 7993360 - DNA, 22 bp, Homo sapiens
taaagcaggccacatatgtgat

SEQ ID NO: 7993361 - DNA, 22 bp, Homo sapiens
taaaaccaggtcttgggattta

SEQ ID NO: 7993362 - DNA, 22 bp, Homo sapiens
taaaaccaggtcttgggattta

SEQ ID NO: 7993363 - DNA, 22 bp, Homo sapiens
taaaaccataaggctggaagga

SEQ ID NO: 7993364 - DNA, 22 bp, Homo sapiens
taaaacagcagggcagagaagt

SEQ ID NO: 7993365 - DNA, 22 bp, Homo sapiens
taaaacagcagggcagagaagt

SEQ ID NO: 7993366 - DNA, 22 bp, Homo sapiens
taaaacagcagggcagagaagt

SEQ ID NO: 7993367 - DNA, 22 bp, Homo sapiens
taaaacagcagggcagagaagt

SEQ ID NO: 7993368 - DNA, 22 bp, Homo sapiens
taaaacagcagggcagagaagt

SEQ ID NO: 7993369 - DNA, 22 bp, Homo sapiens
taaaaccataaggctggaagga

SEQ ID NO: 7993370 - DNA, 22 bp, Homo sapiens
taaaaccataaggctggaagga

SEQ ID NO: 7993371 - DNA, 22 bp, Homo sapiens
taaaaccattcctgctttcatg

SEQ ID NO: 7993372 - DNA, 19 bp, Homo sapiens
taaaacgtgcatggcagca

SEQ ID NO: 7993373 - DNA, 22 bp, Homo sapiens
taaaaccattcctgctttcatg

SEQ ID NO: 7993374 - DNA, 19 bp, Homo sapiens
taaaacgtgcatggcagca

SEQ ID NO: 7993375 - DNA, 22 bp, Homo sapiens
taaaaccattcctgctttcatg

SEQ ID NO: 7993376 - DNA, 22 bp, Homo sapiens
taaaggcaaactctccaaggat

SEQ ID NO: 7993377 - DNA, 22 bp, Homo sapiens
taaaggattttgtataatataa

SEQ ID NO: 7993378 - DNA, 22 bp, Homo sapiens
taaaggcacggagttgttatgg

SEQ ID NO: 7993379 - DNA, 22 bp, Homo sapiens
taaaggcagccactgagctcaa

SEQ ID NO: 7993380 - DNA, 22 bp, Homo sapiens
taaaggcactgcgtccctcaaa

SEQ ID NO: 7993381 - DNA, 22 bp, Homo sapiens
taaaggcaattcagcaagccac

SEQ ID NO: 7993382 - DNA, 22 bp, Homo sapiens
taaaggcaaatgtgtgtttgtg

SEQ ID NO: 7993383 - DNA, 22 bp, Homo sapiens
taaaggcaattcagcaagccac

SEQ ID NO: 7993384 - DNA, 18 bp, Homo sapiens
taaaggaagtgggagagg

SEQ ID NO: 7993385 - DNA, 22 bp, Homo sapiens
taaaggaatcagttttagagat

SEQ ID NO: 7993386 - DNA, 22 bp, Homo sapiens
taaaggaatcagttttagagat

SEQ ID NO: 7993387 - DNA, 22 bp, Homo sapiens
taaaggaatcagttttagagat

SEQ ID NO: 7993388 - DNA, 22 bp, Homo sapiens
taaaggaatcagttttagagat

SEQ ID NO: 7993389 - DNA, 19 bp, Homo sapiens
taaaggaagaagggaggat

SEQ ID NO: 7993390 - DNA, 22 bp, Homo sapiens
taaaggaactgctgctatggaa

SEQ ID NO: 7993391 - DNA, 22 bp, Homo sapiens
taaaggaagaattctctgtgat

SEQ ID NO: 7993392 - DNA, 22 bp, Homo sapiens
taaaggaagaattctctgtgat

SEQ ID NO: 7993393 - DNA, 22 bp, Homo sapiens
taaaggaagaattctctgtgat

SEQ ID NO: 7993394 - DNA, 19 bp, Homo sapiens
taaaggaagaggaagggaa

SEQ ID NO: 7993395 - DNA, 22 bp, Homo sapiens
taaaggaagaattctctgtgat

SEQ ID NO: 7993396 - DNA, 18 bp, Homo sapiens
taaaggaagtgggagagg

SEQ ID NO: 7993397 - DNA, 18 bp, Homo sapiens
taaaggaagtgggagagg

SEQ ID NO: 7993398 - DNA, 22 bp, Homo sapiens
taaaggctttattttccagtca

SEQ ID NO: 7993399 - DNA, 21 bp, Homo sapiens
taaaggctttagaatggcaaa

SEQ ID NO: 7993400 - DNA, 22 bp, Homo sapiens
taaaggctcgtattgttgtgtg

SEQ ID NO: 7993401 - DNA, 22 bp, Homo sapiens
taaaggcttctgcagggactga

SEQ ID NO: 7993402 - DNA, 20 bp, Homo sapiens
taaaggctgtgaggtggccc

SEQ ID NO: 7993403 - DNA, 22 bp, Homo sapiens
taaaggcttcggagtgcacact

SEQ ID NO: 7993404 - DNA, 22 bp, Homo sapiens
taaaggcttttacaggagtgca

SEQ ID NO: 7993405 - DNA, 22 bp, Homo sapiens
taaatactttacaggatgtctc

SEQ ID NO: 7993406 - DNA, 22 bp, Homo sapiens
taaatactttacaggatgtctc

SEQ ID NO: 7993407 - DNA, 22 bp, Homo sapiens
taaatacttttactccactgat

SEQ ID NO: 7993408 - DNA, 22 bp, Homo sapiens
taaaggcagccactgagctcaa

SEQ ID NO: 7993409 - DNA, 22 bp, Homo sapiens
taaaggcactgcgtccctcaaa

SEQ ID NO: 7993410 - DNA, 22 bp, Homo sapiens
taaaggcagtaattcctgagtt

SEQ ID NO: 7993411 - DNA, 22 bp, Homo sapiens
taaaggcagtaattcctgagtt

SEQ ID NO: 7993412 - DNA, 22 bp, Homo sapiens
taaaggcagcctaggaagtgtt

SEQ ID NO: 7993413 - DNA, 22 bp, Homo sapiens
taaaggcagcctaggaagtgtt

SEQ ID NO: 7993414 - DNA, 22 bp, Homo sapiens
taaaggcagtaattcctgagtt

SEQ ID NO: 7993415 - DNA, 22 bp, Homo sapiens
taaaggcagtaattcctgagtt

SEQ ID NO: 7993416 - DNA, 22 bp, Homo sapiens
taaaggcagttctgattaggtc

SEQ ID NO: 7993417 - DNA, 22 bp, Homo sapiens
taaaggcatgcaggtgaatgta

SEQ ID NO: 7993418 - DNA, 22 bp, Homo sapiens
taaaggcagttggagttgagga

SEQ ID NO: 7993419 - DNA, 22 bp, Homo sapiens
taaaggccagggcctgagtgct

SEQ ID NO: 7993420 - DNA, 22 bp, Homo sapiens
taaaggccagggcctgagtgct

SEQ ID NO: 7993421 - DNA, 22 bp, Homo sapiens
taaaggccatgatggaggatca

SEQ ID NO: 7993422 - DNA, 22 bp, Homo sapiens
taaaggcctagtaagttgagac

SEQ ID NO: 7993423 - DNA, 22 bp, Homo sapiens
taaaggctcactggcttggggt

SEQ ID NO: 7993424 - DNA, 22 bp, Homo sapiens
taaaggctcagggaaccagatc

SEQ ID NO: 7993425 - DNA, 22 bp, Homo sapiens
taaatgagatttgttcttttgt

SEQ ID NO: 7993426 - DNA, 22 bp, Homo sapiens
taaatgagatgtacataactca

SEQ ID NO: 7993427 - DNA, 22 bp, Homo sapiens
taaatgagatgtacataactca

SEQ ID NO: 7993428 - DNA, 22 bp, Homo sapiens
taaatgagatgtacataactca

SEQ ID NO: 7993429 - DNA, 22 bp, Homo sapiens
taaatgacattcttaagtcttg

SEQ ID NO: 7993430 - DNA, 22 bp, Homo sapiens
taaatgacattcttaagtcttg

SEQ ID NO: 7993431 - DNA, 22 bp, Homo sapiens
taaatgaagctcatgggccaca

SEQ ID NO: 7993432 - DNA, 22 bp, Homo sapiens
taaatgaagctcatgggccaca

SEQ ID NO: 7993433 - DNA, 22 bp, Homo sapiens
taaatgaagaaatggagattgt

SEQ ID NO: 7993434 - DNA, 22 bp, Homo sapiens
taaatgaagaaatggagattgt

SEQ ID NO: 7993435 - DNA, 22 bp, Homo sapiens
taaatgaagaaatggagattgt

SEQ ID NO: 7993436 - DNA, 22 bp, Homo sapiens
taaatgacaacacctgcttttg

SEQ ID NO: 7993437 - DNA, 22 bp, Homo sapiens
taaatgacattcttaagtcttg

SEQ ID NO: 7993438 - DNA, 22 bp, Homo sapiens
taaatgaagctcatgggccaca

SEQ ID NO: 7993439 - DNA, 22 bp, Homo sapiens
taaatgaagctcatgggccaca

SEQ ID NO: 7993440 - DNA, 22 bp, Homo sapiens
taacactaagaatctaaattta

SEQ ID NO: 7993441 - DNA, 22 bp, Homo sapiens
taacactatccagatatgataa

SEQ ID NO: 7993442 - DNA, 22 bp, Homo sapiens
taacactgaaaatgatgcatgt

SEQ ID NO: 7993443 - DNA, 22 bp, Homo sapiens
taaatgagtaatatagctgttt

SEQ ID NO: 7993444 - DNA, 22 bp, Homo sapiens
taaatgagtaatatagctgttt

SEQ ID NO: 7993445 - DNA, 22 bp, Homo sapiens
taaatgagtaatatagctgttt

SEQ ID NO: 7993446 - DNA, 22 bp, Homo sapiens
taaatgagggctgacatgattg

SEQ ID NO: 7993447 - DNA, 22 bp, Homo sapiens
taaatgagggctgacatgattg

SEQ ID NO: 7993448 - DNA, 22 bp, Homo sapiens
taaatgagggctgacatgattg

SEQ ID NO: 7993449 - DNA, 22 bp, Homo sapiens
taacactggcttttgctgaggc

SEQ ID NO: 7993450 - DNA, 22 bp, Homo sapiens
taacactggagagttggttgtg

SEQ ID NO: 7993451 - DNA, 22 bp, Homo sapiens
taacactggttatccctgtgca

SEQ ID NO: 7993452 - DNA, 22 bp, Homo sapiens
taacactggtatttcatttagt

SEQ ID NO: 7993453 - DNA, 22 bp, Homo sapiens
taacactggtatttcatttagt

SEQ ID NO: 7993454 - DNA, 22 bp, Homo sapiens
taacactgcttcattttggaga

SEQ ID NO: 7993455 - DNA, 22 bp, Homo sapiens
taacactggagagttggttgtg

SEQ ID NO: 7993456 - DNA, 22 bp, Homo sapiens
taacactgccatgctggagtca

SEQ ID NO: 7993457 - DNA, 22 bp, Homo sapiens
taacactgatttgttctcaggg

SEQ ID NO: 7993458 - DNA, 22 bp, Homo sapiens
taacactgatttgttctcaggg

SEQ ID NO: 7993459 - DNA, 22 bp, Homo sapiens
taacactgatttgttctcaggg

SEQ ID NO: 7993460 - DNA, 22 bp, Homo sapiens
taacactgaaaatgatgcatgt

SEQ ID NO: 7993461 - DNA, 22 bp, Homo sapiens
taacactgaaaatgatgcatgt

SEQ ID NO: 7993462 - DNA, 22 bp, Homo sapiens
taaatacttttactccactgat

SEQ ID NO: 7993463 - DNA, 22 bp, Homo sapiens
taaatagaatctaaactgctca

SEQ ID NO: 7993464 - DNA, 22 bp, Homo sapiens
taaatagaatctaaactgctca

SEQ ID NO: 7993465 - DNA, 22 bp, Homo sapiens
taaatcacccatctcctaatct

SEQ ID NO: 7993466 - DNA, 22 bp, Homo sapiens
taaatcacccatctcctaatct

SEQ ID NO: 7993467 - DNA, 22 bp, Homo sapiens
taaatcactgtactttattcct

SEQ ID NO: 7993468 - DNA, 22 bp, Homo sapiens
taaatcactgtactttattcct

SEQ ID NO: 7993469 - DNA, 22 bp, Homo sapiens
taaatcactgtactttattcct

SEQ ID NO: 7993470 - DNA, 22 bp, Homo sapiens
taaatcactgttcattccacac

SEQ ID NO: 7993471 - DNA, 22 bp, Homo sapiens
taaatcactcctaataatcagt

SEQ ID NO: 7993472 - DNA, 22 bp, Homo sapiens
taaatcactcctaataatcagt

SEQ ID NO: 7993473 - DNA, 22 bp, Homo sapiens
taaatcactcttctctcaccac

SEQ ID NO: 7993474 - DNA, 22 bp, Homo sapiens
taaatcactcttctctcaccac

SEQ ID NO: 7993475 - DNA, 22 bp, Homo sapiens
taaatcagggagtcatctgcga

SEQ ID NO: 7993476 - DNA, 22 bp, Homo sapiens
taaatcagggagtcatctgcga

SEQ ID NO: 7993477 - DNA, 22 bp, Homo sapiens
taaatcagggagtcatctgcga

SEQ ID NO: 7993478 - DNA, 22 bp, Homo sapiens
taaatcagtaaggcatattctc

SEQ ID NO: 7993479 - DNA, 22 bp, Homo sapiens
taaatcactgttcattccacac

SEQ ID NO: 7993480 - DNA, 22 bp, Homo sapiens
taaatcagtttctcttattggt

SEQ ID NO: 7993481 - DNA, 22 bp, Homo sapiens
taaatccagcttctaatttaga

SEQ ID NO: 7993482 - DNA, 22 bp, Homo sapiens
taaatccagcttctaatttaga

SEQ ID NO: 7993483 - DNA, 22 bp, Homo sapiens
taaatcagggagtcatctgcga

SEQ ID NO: 7993484 - DNA, 22 bp, Homo sapiens
taaatcagtaaggcatattctc

SEQ ID NO: 7993485 - DNA, 22 bp, Homo sapiens
taaatcagtttctcttattggt

SEQ ID NO: 7993486 - DNA, 22 bp, Homo sapiens
taaatcttctacatcatcataa

SEQ ID NO: 7993487 - DNA, 22 bp, Homo sapiens
taaatcttgtggcaatgcttct

SEQ ID NO: 7993488 - DNA, 22 bp, Homo sapiens
taaatcttgtggcaatgcttct

SEQ ID NO: 7993489 - DNA, 22 bp, Homo sapiens
taaatcttctacatcatcataa

SEQ ID NO: 7993490 - DNA, 22 bp, Homo sapiens
taaatgaagaaatggagattgt

SEQ ID NO: 7993491 - DNA, 22 bp, Homo sapiens
taaatgaaagggtttaatttat

SEQ ID NO: 7993492 - DNA, 22 bp, Homo sapiens
taaatgaaagggtttaatttat

SEQ ID NO: 7993493 - DNA, 22 bp, Homo sapiens
taaatgaaagggtttaatttat

SEQ ID NO: 7993494 - DNA, 22 bp, Homo sapiens
taaatgaaagggtttaatttat

SEQ ID NO: 7993495 - DNA, 22 bp, Homo sapiens
taaatgaaagggtttaatttat

SEQ ID NO: 7993496 - DNA, 22 bp, Homo sapiens
taaatccttatcttctttgaat

SEQ ID NO: 7993497 - DNA, 22 bp, Homo sapiens
taaatccttatcttctttgaat

SEQ ID NO: 7993498 - DNA, 22 bp, Homo sapiens
taaatccttatcttctttgaat

SEQ ID NO: 7993499 - DNA, 22 bp, Homo sapiens
taaatctcactgggtatattgg

SEQ ID NO: 7993500 - DNA, 22 bp, Homo sapiens
taaatctcaataaagtctgtgg

SEQ ID NO: 7993501 - DNA, 22 bp, Homo sapiens
taaatctcagcctttctgctta

SEQ ID NO: 7993502 - DNA, 22 bp, Homo sapiens
taaatctcagcctttctgctta

SEQ ID NO: 7993503 - DNA, 22 bp, Homo sapiens
taaatctcactgggtatattgg

SEQ ID NO: 7993504 - DNA, 21 bp, Homo sapiens
taaatctctgtattcttcagt

SEQ ID NO: 7993505 - DNA, 21 bp, Homo sapiens
taaatctctgtattcttcagt

SEQ ID NO: 7993506 - DNA, 22 bp, Homo sapiens
taaatctctgctcctcttgggt

SEQ ID NO: 7993507 - DNA, 18 bp, Homo sapiens
taaatctctctttagtca

SEQ ID NO: 7993508 - DNA, 18 bp, Homo sapiens
taaatctctctttagtca

SEQ ID NO: 7993509 - DNA, 22 bp, Homo sapiens
taaatctcctgtttttcatcta

SEQ ID NO: 7993510 - DNA, 22 bp, Homo sapiens
taaatctcagggaatatattga

SEQ ID NO: 7993511 - DNA, 22 bp, Homo sapiens
taacagagtgaaaatcagcaca

SEQ ID NO: 7993512 - DNA, 22 bp, Homo sapiens
taacagcaaccacagtgctggt

SEQ ID NO: 7993513 - DNA, 22 bp, Homo sapiens
taacagcaaccacagtgctggt

SEQ ID NO: 7993514 - DNA, 22 bp, Homo sapiens
taacagcactggcaggcactgt

SEQ ID NO: 7993515 - DNA, 22 bp, Homo sapiens
taacagcactggcaggcactgt

SEQ ID NO: 7993516 - DNA, 22 bp, Homo sapiens
taacagcaaccacagtgctggt

SEQ ID NO: 7993517 - DNA, 22 bp, Homo sapiens
taacagcactggcaggcactgt

SEQ ID NO: 7993518 - DNA, 22 bp, Homo sapiens
taacagaatttgctaaactccg

SEQ ID NO: 7993519 - DNA, 22 bp, Homo sapiens
taacagaatttgctaaactccg

SEQ ID NO: 7993520 - DNA, 22 bp, Homo sapiens
taacagaatttgctaaactccg

SEQ ID NO: 7993521 - DNA, 22 bp, Homo sapiens
taacagagatagaaatgtaaag

SEQ ID NO: 7993522 - DNA, 22 bp, Homo sapiens
taacagaggtagaattcaaggt

SEQ ID NO: 7993523 - DNA, 22 bp, Homo sapiens
taagaaatttagttatagaatg

SEQ ID NO: 7993524 - DNA, 22 bp, Homo sapiens
taagaaatttagttatagaatg

SEQ ID NO: 7993525 - DNA, 22 bp, Homo sapiens
taagaaatttagttatagaatg

SEQ ID NO: 7993526 - DNA, 22 bp, Homo sapiens
taagaaatttagttatagaatg

SEQ ID NO: 7993527 - DNA, 22 bp, Homo sapiens
taagaaatttagttatagaatg

SEQ ID NO: 7993528 - DNA, 22 bp, Homo sapiens
taacagcagtcctcttctcatg

SEQ ID NO: 7993529 - DNA, 22 bp, Homo sapiens
taacagcagggttacaggcatt

SEQ ID NO: 7993530 - DNA, 22 bp, Homo sapiens
taacagcagggttacaggcatt

SEQ ID NO: 7993531 - DNA, 22 bp, Homo sapiens
taacagcagggttacaggcatt

SEQ ID NO: 7993532 - DNA, 22 bp, Homo sapiens
taacagcagggttacaggcatt

SEQ ID NO: 7993533 - DNA, 22 bp, Homo sapiens
taacagaatcctgttattgcca

SEQ ID NO: 7993534 - DNA, 22 bp, Homo sapiens
taacagaatcctgttattgcca

SEQ ID NO: 7993535 - DNA, 22 bp, Homo sapiens
taacagaatcctgttattgcca

SEQ ID NO: 7993536 - DNA, 22 bp, Homo sapiens
taacagaatagcagaaacagaa

SEQ ID NO: 7993537 - DNA, 22 bp, Homo sapiens
taacagaatagcagaaacagaa

SEQ ID NO: 7993538 - DNA, 22 bp, Homo sapiens
taacagaatagcagaaacagaa

SEQ ID NO: 7993539 - DNA, 22 bp, Homo sapiens
taacagaatagcagaaacagaa

SEQ ID NO: 7993540 - DNA, 22 bp, Homo sapiens
taacagaatagcagaaacagaa

SEQ ID NO: 7993541 - DNA, 22 bp, Homo sapiens
taacagaatagcagaaacagaa

SEQ ID NO: 7993542 - DNA, 22 bp, Homo sapiens
taacactgtgtctgccatatcc

SEQ ID NO: 7993543 - DNA, 22 bp, Homo sapiens
taacactgtggtgttctttgtc

SEQ ID NO: 7993544 - DNA, 22 bp, Homo sapiens
taacactgtgcccagagtccca

SEQ ID NO: 7993545 - DNA, 22 bp, Homo sapiens
taacactgtggtgttctttgtc

SEQ ID NO: 7993546 - DNA, 22 bp, Homo sapiens
taacactgtccaaagaattcca

SEQ ID NO: 7993547 - DNA, 22 bp, Homo sapiens
taacactgtccaaagaattcca

SEQ ID NO: 7993548 - DNA, 22 bp, Homo sapiens
taacactgtgcccagagtccca

SEQ ID NO: 7993549 - DNA, 22 bp, Homo sapiens
taacactgtccaaagaattcca

SEQ ID NO: 7993550 - DNA, 22 bp, Homo sapiens
taacactgtccaaagaattcca

SEQ ID NO: 7993551 - DNA, 22 bp, Homo sapiens
taacactgtaaacctagatgtt

SEQ ID NO: 7993552 - DNA, 22 bp, Homo sapiens
taacactgtaaacctagatgtt

SEQ ID NO: 7993553 - DNA, 22 bp, Homo sapiens
taacactgtaaacctagatgtt

SEQ ID NO: 7993554 - DNA, 22 bp, Homo sapiens
taacactgtaaacctagatgtt

SEQ ID NO: 7993555 - DNA, 20 bp, Homo sapiens
taagaacaagactaggaagc

SEQ ID NO: 7993556 - DNA, 20 bp, Homo sapiens
taagaacaagactaggaagc

SEQ ID NO: 7993557 - DNA, 22 bp, Homo sapiens
ggagaaggaatattggagtagg

SEQ ID NO: 7993558 - DNA, 22 bp, Homo sapiens
ggagaaggaatattggagtagg

SEQ ID NO: 7993559 - DNA, 22 bp, Homo sapiens
ggagaaggaatattggagtagg

SEQ ID NO: 7993560 - DNA, 22 bp, Homo sapiens
ggagaaggaatattggagtagg

SEQ ID NO: 7993561 - DNA, 22 bp, Homo sapiens
ggagaaggaatattggagtagg

SEQ ID NO: 7993562 - DNA, 22 bp, Homo sapiens
ggagaaggaatattggagtagg

SEQ ID NO: 7993563 - DNA, 22 bp, Homo sapiens
ggagaaggaatattggagtagg

SEQ ID NO: 7993564 - DNA, 22 bp, Homo sapiens
ggagaaggaatattggagtagg

SEQ ID NO: 7993565 - DNA, 22 bp, Homo sapiens
ggagaaggaatattggagtagg

SEQ ID NO: 7993566 - DNA, 22 bp, Homo sapiens
ggagaaggaagaaagctactat

SEQ ID NO: 7993567 - DNA, 22 bp, Homo sapiens
ggagaaggaagaaagctactat

SEQ ID NO: 7993568 - DNA, 22 bp, Homo sapiens
ggagaaggaagaaagctactat

SEQ ID NO: 7993569 - DNA, 22 bp, Homo sapiens
ggagaaggaagaaagctactat

SEQ ID NO: 7993570 - DNA, 22 bp, Homo sapiens
ggagaaggaagaaagctactat

SEQ ID NO: 7993571 - DNA, 22 bp, Homo sapiens
ggagaaggaagaaagctactat

SEQ ID NO: 7993572 - DNA, 21 bp, Homo sapiens
ggagaaggacaatgttgagta

SEQ ID NO: 7993573 - DNA, 21 bp, Homo sapiens
ggagaaggacaatgttgagta

SEQ ID NO: 7993574 - DNA, 21 bp, Homo sapiens
ggagaaggacaatgttgagta

SEQ ID NO: 7993575 - DNA, 21 bp, Homo sapiens
ggagaaggacaatgttgagta

SEQ ID NO: 7993576 - DNA, 21 bp, Homo sapiens
ggagaaggacaatgttgagta

SEQ ID NO: 7993577 - DNA, 21 bp, Homo sapiens
ggagaaggacaatgttgagta

SEQ ID NO: 7993578 - DNA, 22 bp, Homo sapiens
ggagaaggcacacccacctctg

SEQ ID NO: 7993579 - DNA, 22 bp, Homo sapiens
ggagaaggcacacccacctctg

SEQ ID NO: 7993580 - DNA, 22 bp, Homo sapiens
ggagaaggcacacccacctctg

SEQ ID NO: 7993581 - DNA, 22 bp, Homo sapiens
ggagaaggcacacccacctctg

SEQ ID NO: 7993582 - DNA, 22 bp, Homo sapiens
ggagaaggtggctcagcaaagg

SEQ ID NO: 7993583 - DNA, 22 bp, Homo sapiens
ggagaaggtggctcagcaaagg

SEQ ID NO: 7993584 - DNA, 22 bp, Homo sapiens
ggagaaggaatattggagtagg

SEQ ID NO: 7993585 - DNA, 22 bp, Homo sapiens
ggagaaggaatattggagtagg

SEQ ID NO: 7993586 - DNA, 21 bp, Homo sapiens
ggagaaggacaatgttgagta

SEQ ID NO: 7993587 - DNA, 21 bp, Homo sapiens
ggagaaggacaatgttgagta

SEQ ID NO: 7993588 - DNA, 21 bp, Homo sapiens
ggagaaggacaatgttgagta

SEQ ID NO: 7993589 - DNA, 21 bp, Homo sapiens
ggagaaggacaatgttgagta

SEQ ID NO: 7993590 - DNA, 22 bp, Homo sapiens
ggagaggcttggcccagcctgg

SEQ ID NO: 7993591 - DNA, 22 bp, Homo sapiens
ggagaggcttggcccagcctgg

SEQ ID NO: 7993592 - DNA, 22 bp, Homo sapiens
ggagacagggttgaaccacgca

SEQ ID NO: 7993593 - DNA, 22 bp, Homo sapiens
ggagacagggttgaaccacgca

SEQ ID NO: 7993594 - DNA, 17 bp, Homo sapiens
ggagacagggtctttaa

SEQ ID NO: 7993595 - DNA, 17 bp, Homo sapiens
ggagacagggtctttaa

SEQ ID NO: 7993596 - DNA, 17 bp, Homo sapiens
ggagacagggtctttaa

SEQ ID NO: 7993597 - DNA, 17 bp, Homo sapiens
ggagacagggtctttaa

SEQ ID NO: 7993598 - DNA, 22 bp, Homo sapiens
ggagacactggaaagtattaca

SEQ ID NO: 7993599 - DNA, 22 bp, Homo sapiens
ggagacagcaggaagaaatatc

SEQ ID NO: 7993600 - DNA, 22 bp, Homo sapiens
ggagacagcaggaagaaatatc

SEQ ID NO: 7993601 - DNA, 22 bp, Homo sapiens
ggagacagcaggaagaaatatc

SEQ ID NO: 7993602 - DNA, 22 bp, Homo sapiens
ggagacagcaggaagaaatatc

SEQ ID NO: 7993603 - DNA, 17 bp, Homo sapiens
ggagacagggtctttaa

SEQ ID NO: 7993604 - DNA, 22 bp, Homo sapiens
ggagaaggtggctcagcaaagg

SEQ ID NO: 7993605 - DNA, 22 bp, Homo sapiens
ggagaagtttaagacctttgat

SEQ ID NO: 7993606 - DNA, 22 bp, Homo sapiens
ggagaaggtggctcagcaaagg

SEQ ID NO: 7993607 - DNA, 22 bp, Homo sapiens
ggagaaggtggctcagcaaagg

SEQ ID NO: 7993608 - DNA, 22 bp, Homo sapiens
ggagaaggtggctcagcaaagg

SEQ ID NO: 7993609 - DNA, 22 bp, Homo sapiens
ggagaaggtggctcagcaaagg

SEQ ID NO: 7993610 - DNA, 22 bp, Homo sapiens
ggagaatgattctttgctcact

SEQ ID NO: 7993611 - DNA, 22 bp, Homo sapiens
ggagaatggccatcttttcaga

SEQ ID NO: 7993612 - DNA, 18 bp, Homo sapiens
ggaagtaggaagaggaag

SEQ ID NO: 7993613 - DNA, 18 bp, Homo sapiens
ggaagtaggaagaggaag

SEQ ID NO: 7993614 - DNA, 22 bp, Homo sapiens
ggaagtagaagtaatgaaatca

SEQ ID NO: 7993615 - DNA, 22 bp, Homo sapiens
ggaagtagaagtaatgaaatca

SEQ ID NO: 7993616 - DNA, 22 bp, Homo sapiens
ggaagtagaagtaatgaaatca

SEQ ID NO: 7993617 - DNA, 23 bp, Homo sapiens
ggaagtcagcggagaggtggctg

SEQ ID NO: 7993618 - DNA, 23 bp, Homo sapiens
ggaagtcagcggagaggtggctg

SEQ ID NO: 7993619 - DNA, 22 bp, Homo sapiens
ggaagtattcaatcctgccaca

SEQ ID NO: 7993620 - DNA, 22 bp, Homo sapiens
ggaagtagaggtcattctgaat

SEQ ID NO: 7993621 - DNA, 18 bp, Homo sapiens
ggaagtaggaagaggaag

SEQ ID NO: 7993622 - DNA, 18 bp, Homo sapiens
ggaaggtgctggagtgca

SEQ ID NO: 7993623 - DNA, 18 bp, Homo sapiens
ggaaggtgctggagtgca

SEQ ID NO: 7993624 - DNA, 18 bp, Homo sapiens
ggaaggtgctggagtgca

SEQ ID NO: 7993625 - DNA, 18 bp, Homo sapiens
ggaaggtgctggagtgca

SEQ ID NO: 7993626 - DNA, 18 bp, Homo sapiens
ggaaggtgctggagtgca

SEQ ID NO: 7993627 - DNA, 18 bp, Homo sapiens
ggaaggtgctggagtgca

SEQ ID NO: 7993628 - DNA, 22 bp, Homo sapiens
ggaaggtttttctcctggtggg

SEQ ID NO: 7993629 - DNA, 18 bp, Homo sapiens
ggaaggttatgccaggtc

SEQ ID NO: 7993630 - DNA, 22 bp, Homo sapiens
ggaaggtttttctcctggtggg

SEQ ID NO: 7993631 - DNA, 22 bp, Homo sapiens
ggaagtgaggaaatattttgtt

SEQ ID NO: 7993632 - DNA, 22 bp, Homo sapiens
ggaagtgaggaattaggtttat

SEQ ID NO: 7993633 - DNA, 22 bp, Homo sapiens
ggaagtggtagagccatgagtg

SEQ ID NO: 7993634 - DNA, 22 bp, Homo sapiens
ggaagtgtagtccgaagttgcg

SEQ ID NO: 7993635 - DNA, 22 bp, Homo sapiens
ggaagtggtagagccatgagtg

SEQ ID NO: 7993636 - DNA, 22 bp, Homo sapiens
ggaagtggtagagccatgagtg

SEQ ID NO: 7993637 - DNA, 22 bp, Homo sapiens
ggaagtgtgcaatattgggctg

SEQ ID NO: 7993638 - DNA, 22 bp, Homo sapiens
ggaagtgtttccttgggcagca

SEQ ID NO: 7993639 - DNA, 22 bp, Homo sapiens
ggaagtgtttccttgggcagca

SEQ ID NO: 7993640 - DNA, 22 bp, Homo sapiens
ggaagtgtttgtgcagatggcc

SEQ ID NO: 7993641 - DNA, 22 bp, Homo sapiens
ggaagtgtttccttgggcagca

SEQ ID NO: 7993642 - DNA, 22 bp, Homo sapiens
ggaagttgtatgatcggggaat

SEQ ID NO: 7993643 - DNA, 22 bp, Homo sapiens
ggaagttgtatgatcggggaat

SEQ ID NO: 7993644 - DNA, 22 bp, Homo sapiens
ggaataaaaattgtttactgta

SEQ ID NO: 7993645 - DNA, 22 bp, Homo sapiens
ggaataaagaatctggttcccc

SEQ ID NO: 7993646 - DNA, 22 bp, Homo sapiens
ggaataaaaattgtttactgta

SEQ ID NO: 7993647 - DNA, 22 bp, Homo sapiens
ggaagtttgtagatgtttctta

SEQ ID NO: 7993648 - DNA, 22 bp, Homo sapiens
ggaagtttgagcatctgtttcc

SEQ ID NO: 7993649 - DNA, 22 bp, Homo sapiens
ggaatacaaatctttgttctct

SEQ ID NO: 7993650 - DNA, 22 bp, Homo sapiens
ggaatactttgttgtcttccaa

SEQ ID NO: 7993651 - DNA, 22 bp, Homo sapiens
ggaatagtttatgtagctgaat

SEQ ID NO: 7993652 - DNA, 22 bp, Homo sapiens
ggaatatagccagtaacagtca

SEQ ID NO: 7993653 - DNA, 22 bp, Homo sapiens
ggaatatagccagtaacagtca

SEQ ID NO: 7993654 - DNA, 22 bp, Homo sapiens
ggaatagggagagaatcgtttg

SEQ ID NO: 7993655 - DNA, 22 bp, Homo sapiens
ggaataggatttacctctgtaa

SEQ ID NO: 7993656 - DNA, 22 bp, Homo sapiens
ggaataggatttacctctgtaa

SEQ ID NO: 7993657 - DNA, 22 bp, Homo sapiens
ggagaaggaagaaagctactat

SEQ ID NO: 7993658 - DNA, 22 bp, Homo sapiens
ggagaaggaagaaagctactat

SEQ ID NO: 7993659 - DNA, 22 bp, Homo sapiens
ggagaaggaagaaagctactat

SEQ ID NO: 7993660 - DNA, 22 bp, Homo sapiens
ggagaaggaagaaagctactat

SEQ ID NO: 7993661 - DNA, 19 bp, Homo sapiens
ggagaagcccaggaatcct

SEQ ID NO: 7993662 - DNA, 22 bp, Homo sapiens
ggagaagccacacattgggtgt

SEQ ID NO: 7993663 - DNA, 19 bp, Homo sapiens
ggagaagcatctagaaata

SEQ ID NO: 7993664 - DNA, 22 bp, Homo sapiens
ggagaagcaggtgctttgggtc

SEQ ID NO: 7993665 - DNA, 22 bp, Homo sapiens
ggaatatagccagtaacagtca

SEQ ID NO: 7993666 - DNA, 22 bp, Homo sapiens
ggagaagcaggtgctttgggtc

SEQ ID NO: 7993667 - DNA, 22 bp, Homo sapiens
ggagaagcaggtgctttgggtc

SEQ ID NO: 7993668 - DNA, 22 bp, Homo sapiens
ggaatcagaattactgaatgga

SEQ ID NO: 7993669 - DNA, 22 bp, Homo sapiens
ggaatcagaattactgaatgga

SEQ ID NO: 7993670 - DNA, 22 bp, Homo sapiens
ggagctaggcaaagctcacgga

SEQ ID NO: 7993671 - DNA, 22 bp, Homo sapiens
ggagctagtagtttcatgagtt

SEQ ID NO: 7993672 - DNA, 22 bp, Homo sapiens
ggagctaggcaaagctcacgga

SEQ ID NO: 7993673 - DNA, 22 bp, Homo sapiens
ggagctagcctgtctctgttta

SEQ ID NO: 7993674 - DNA, 22 bp, Homo sapiens
ggagctagcctgtctctgttta

SEQ ID NO: 7993675 - DNA, 22 bp, Homo sapiens
ggagcgtgcagcatgagctcat

SEQ ID NO: 7993676 - DNA, 20 bp, Homo sapiens
ggagctagagctgaaagact

SEQ ID NO: 7993677 - DNA, 22 bp, Homo sapiens
ggagcgtgcactccaggccctt

SEQ ID NO: 7993678 - DNA, 22 bp, Homo sapiens
ggagcggtcagctggccacacg

SEQ ID NO: 7993679 - DNA, 22 bp, Homo sapiens
ggagcggcagatggagtgggag

SEQ ID NO: 7993680 - DNA, 22 bp, Homo sapiens
ggagcggcagatggagtgggag

SEQ ID NO: 7993681 - DNA, 22 bp, Homo sapiens
ggagcggagggagggccactgt

SEQ ID NO: 7993682 - DNA, 22 bp, Homo sapiens
ggagccttgggcgctctcccat

SEQ ID NO: 7993683 - DNA, 22 bp, Homo sapiens
ggagcgagcccgatagcgctgg

SEQ ID NO: 7993684 - DNA, 22 bp, Homo sapiens
ggagccttactagaatgtgagc

SEQ ID NO: 7993685 - DNA, 22 bp, Homo sapiens
ggagccttagacatctgatcct

SEQ ID NO: 7993686 - DNA, 22 bp, Homo sapiens
ggagcctgtgggatgagatgtg

SEQ ID NO: 7993687 - DNA, 22 bp, Homo sapiens
ggagcctgtgggatgagatgtg

SEQ ID NO: 7993688 - DNA, 22 bp, Homo sapiens
ggagcctgttagttgagtgctc

SEQ ID NO: 7993689 - DNA, 22 bp, Homo sapiens
ggagcctgttagttgagtgctc

SEQ ID NO: 7993690 - DNA, 22 bp, Homo sapiens
ggagcctgttagttgagtgctc

SEQ ID NO: 7993691 - DNA, 22 bp, Homo sapiens
ggagcctgtgcccaagcccaga

SEQ ID NO: 7993692 - DNA, 22 bp, Homo sapiens
ggagcctgtggccgtcacgact

SEQ ID NO: 7993693 - DNA, 22 bp, Homo sapiens
ggagcctgtggccgtcacgact

SEQ ID NO: 7993694 - DNA, 22 bp, Homo sapiens
ggagcctgtggccgtcacgact

SEQ ID NO: 7993695 - DNA, 22 bp, Homo sapiens
ggagcctgtggccgtcacgact

SEQ ID NO: 7993696 - DNA, 22 bp, Homo sapiens
ggagatgccttgtttcaggaac

SEQ ID NO: 7993697 - DNA, 20 bp, Homo sapiens
ggagatgcctctcagtccat

SEQ ID NO: 7993698 - DNA, 22 bp, Homo sapiens
ggagatgctatgtagtttggtt

SEQ ID NO: 7993699 - DNA, 22 bp, Homo sapiens
ggagatgcgactcgcggggctg

SEQ ID NO: 7993700 - DNA, 22 bp, Homo sapiens
ggagatgctatgtagtttggtt

SEQ ID NO: 7993701 - DNA, 22 bp, Homo sapiens
ggagatgctatgtagtttggtt

SEQ ID NO: 7993702 - DNA, 23 bp, Homo sapiens
ggagatgcttaagagtggttgag

SEQ ID NO: 7993703 - DNA, 22 bp, Homo sapiens
ggagatgccagaattgcaaatt

SEQ ID NO: 7993704 - DNA, 20 bp, Homo sapiens
ggagatgcagcccaggtgcc

SEQ ID NO: 7993705 - DNA, 20 bp, Homo sapiens
ggagatgcagcccaggtgcc

SEQ ID NO: 7993706 - DNA, 22 bp, Homo sapiens
ggagatgacacaatttatttat

SEQ ID NO: 7993707 - DNA, 22 bp, Homo sapiens
ggagcctggttactagagcctg

SEQ ID NO: 7993708 - DNA, 22 bp, Homo sapiens
ggagcctggttactagagcctg

SEQ ID NO: 7993709 - DNA, 22 bp, Homo sapiens
ggagcctggttactagagcctg

SEQ ID NO: 7993710 - DNA, 22 bp, Homo sapiens
ggagcctggttactagagcctg

SEQ ID NO: 7993711 - DNA, 22 bp, Homo sapiens
ggagcctggttactagagcctg

SEQ ID NO: 7993712 - DNA, 22 bp, Homo sapiens
ggagcctgtgcccaagcccaga

SEQ ID NO: 7993713 - DNA, 22 bp, Homo sapiens
ggagcctggtcaggttggctcc

SEQ ID NO: 7993714 - DNA, 22 bp, Homo sapiens
ggagcctggtcaggttggctcc

SEQ ID NO: 7993715 - DNA, 22 bp, Homo sapiens
ggagatggaatagattctgact

SEQ ID NO: 7993716 - DNA, 22 bp, Homo sapiens
ggagatggaatagattctgact

SEQ ID NO: 7993717 - DNA, 22 bp, Homo sapiens
ggagatggaatagattctgact

SEQ ID NO: 7993718 - DNA, 22 bp, Homo sapiens
ggagatgctttccagtggggat

SEQ ID NO: 7993719 - DNA, 22 bp, Homo sapiens
ggagatgctttccagtggggat

SEQ ID NO: 7993720 - DNA, 22 bp, Homo sapiens
ggagatgctttccagtggggat

SEQ ID NO: 7993721 - DNA, 22 bp, Homo sapiens
ggagatgctttccagtggggat

SEQ ID NO: 7993722 - DNA, 23 bp, Homo sapiens
ggagatgcttaagagtggttgag

SEQ ID NO: 7993723 - DNA, 17 bp, Homo sapiens
ggagatctggcagaggg

SEQ ID NO: 7993724 - DNA, 22 bp, Homo sapiens
ggagaggtgagaggtacaagtt

SEQ ID NO: 7993725 - DNA, 22 bp, Homo sapiens
ggagaggtgtattcagtgggtc

SEQ ID NO: 7993726 - DNA, 22 bp, Homo sapiens
ggagaggtgtattcagtgggtc

SEQ ID NO: 7993727 - DNA, 22 bp, Homo sapiens
ggagaggtgagaggtacaagtt

SEQ ID NO: 7993728 - DNA, 22 bp, Homo sapiens
ggagaggtgtattcagtgggtc

SEQ ID NO: 7993729 - DNA, 22 bp, Homo sapiens
ggagaggtgcaggtcagtggca

SEQ ID NO: 7993730 - DNA, 22 bp, Homo sapiens
ggagaggtgcaggtcagtggca

SEQ ID NO: 7993731 - DNA, 22 bp, Homo sapiens
ggagagggtgtggaaagttatc

SEQ ID NO: 7993732 - DNA, 22 bp, Homo sapiens
ggagagggtgtggaaagttatc

SEQ ID NO: 7993733 - DNA, 22 bp, Homo sapiens
ggagagggtaggggtcctgccc

SEQ ID NO: 7993734 - DNA, 22 bp, Homo sapiens
ggagagggtaggggtcctgccc

SEQ ID NO: 7993735 - DNA, 22 bp, Homo sapiens
ggagagggtaggggtcctgccc

SEQ ID NO: 7993736 - DNA, 22 bp, Homo sapiens
ggagagggtaggggtcctgccc

SEQ ID NO: 7993737 - DNA, 22 bp, Homo sapiens
ggagagggtaggggtcctgccc

SEQ ID NO: 7993738 - DNA, 22 bp, Homo sapiens
ggagagggtaggggtcctgccc

SEQ ID NO: 7993739 - DNA, 23 bp, Homo sapiens
ggagaggggtgtgggcatcttta

SEQ ID NO: 7993740 - DNA, 23 bp, Homo sapiens
ggagaggggtgtgggcatcttta

SEQ ID NO: 7993741 - DNA, 23 bp, Homo sapiens
ggagaggggtgtgggcatcttta

SEQ ID NO: 7993742 - DNA, 23 bp, Homo sapiens
ggagaggggtgtgggcatcttta

SEQ ID NO: 7993743 - DNA, 23 bp, Homo sapiens
ggagaggggtgtgggcatcttta

SEQ ID NO: 7993744 - DNA, 22 bp, Homo sapiens
ggagagggggctccctgcttgg

SEQ ID NO: 7993745 - DNA, 22 bp, Homo sapiens
ggagagggggctccctgcttgg

SEQ ID NO: 7993746 - DNA, 22 bp, Homo sapiens
ggagagggggctccctgcttgg

SEQ ID NO: 7993747 - DNA, 23 bp, Homo sapiens
ggagaggggtgtgggcatcttta

SEQ ID NO: 7993748 - DNA, 23 bp, Homo sapiens
ggagaggggtgtgggcatcttta

SEQ ID NO: 7993749 - DNA, 22 bp, Homo sapiens
ggagagggtaggggtcctgccc

SEQ ID NO: 7993750 - DNA, 22 bp, Homo sapiens
ggagaggcttggcccagcctgg

SEQ ID NO: 7993751 - DNA, 22 bp, Homo sapiens
ggagaggcttggcccagcctgg

SEQ ID NO: 7993752 - DNA, 22 bp, Homo sapiens
ggagaggggaacttgttgcttg

SEQ ID NO: 7993753 - DNA, 22 bp, Homo sapiens
ggagaggcttggcccagcctgg

SEQ ID NO: 7993754 - DNA, 22 bp, Homo sapiens
ggagaggcttggcccagcctgg

SEQ ID NO: 7993755 - DNA, 22 bp, Homo sapiens
ggagaggggaacttgttgcttg

SEQ ID NO: 7993756 - DNA, 22 bp, Homo sapiens
ggagaggggaacttgttgcttg

SEQ ID NO: 7993757 - DNA, 22 bp, Homo sapiens
ggagaggggaacttgttgcttg

SEQ ID NO: 7993758 - DNA, 22 bp, Homo sapiens
ggagaggggaacttgttgcttg

SEQ ID NO: 7993759 - DNA, 22 bp, Homo sapiens
ggagaggggaacttgttgcttg

SEQ ID NO: 7993760 - DNA, 22 bp, Homo sapiens
ggagaggggcaagtttatctag

SEQ ID NO: 7993761 - DNA, 22 bp, Homo sapiens
ggagaggggcaagtttatctag

SEQ ID NO: 7993762 - DNA, 22 bp, Homo sapiens
ggagaggggcaagtttatctag

SEQ ID NO: 7993763 - DNA, 22 bp, Homo sapiens
ggagaggggcaagtttatctag

SEQ ID NO: 7993764 - DNA, 22 bp, Homo sapiens
ggagagggggctccctgcttgg

SEQ ID NO: 7993765 - DNA, 22 bp, Homo sapiens
ggagagggggctccctgcttgg

SEQ ID NO: 7993766 - DNA, 22 bp, Homo sapiens
ggagagggggctccctgcttgg

SEQ ID NO: 7993767 - DNA, 22 bp, Homo sapiens
ggaggaagcacacggcttgtat

SEQ ID NO: 7993768 - DNA, 22 bp, Homo sapiens
ggaggaaatgaaaggagggttt

SEQ ID NO: 7993769 - DNA, 22 bp, Homo sapiens
ggaggaagcacacggcttgtat

SEQ ID NO: 7993770 - DNA, 22 bp, Homo sapiens
ggaggaagcacacggcttgtat

SEQ ID NO: 7993771 - DNA, 22 bp, Homo sapiens
ggaggaagcacacggcttgtat

SEQ ID NO: 7993772 - DNA, 22 bp, Homo sapiens
ggaggaagcacacggcttgtat

SEQ ID NO: 7993773 - DNA, 22 bp, Homo sapiens
ggaggaagcacacggcttgtat

SEQ ID NO: 7993774 - DNA, 22 bp, Homo sapiens
ggaggaaatccttagtaaggca

SEQ ID NO: 7993775 - DNA, 22 bp, Homo sapiens
ggaggaaatgaaaggagggttt

SEQ ID NO: 7993776 - DNA, 22 bp, Homo sapiens
ggaggaaatgaaaggagggttt

SEQ ID NO: 7993777 - DNA, 22 bp, Homo sapiens
ggaggaagaggttgttctctca

SEQ ID NO: 7993778 - DNA, 22 bp, Homo sapiens
ggaggaagaggttgttctctca

SEQ ID NO: 7993779 - DNA, 22 bp, Homo sapiens
ggaggaagggcccaggctttat

SEQ ID NO: 7993780 - DNA, 22 bp, Homo sapiens
ggaggaagggcccaggctttat

SEQ ID NO: 7993781 - DNA, 22 bp, Homo sapiens
ggaggaagggcccaggctttat

SEQ ID NO: 7993782 - DNA, 22 bp, Homo sapiens
ggaggaagggcccaggctttat

SEQ ID NO: 7993783 - DNA, 22 bp, Homo sapiens
ggaggaagggtagcataatgta

SEQ ID NO: 7993784 - DNA, 22 bp, Homo sapiens
ggaggaagtgcagttctactac

SEQ ID NO: 7993785 - DNA, 22 bp, Homo sapiens
ggaggaagggtagcataatgta

SEQ ID NO: 7993786 - DNA, 22 bp, Homo sapiens
ggaggaagggtagcataatgta

SEQ ID NO: 7993787 - DNA, 22 bp, Homo sapiens
ggaggaagggtagcataatgta

SEQ ID NO: 7993788 - DNA, 22 bp, Homo sapiens
ggaggaagccctcggtgcccca

SEQ ID NO: 7993789 - DNA, 22 bp, Homo sapiens
ggaggaagccctcggtgcccca

SEQ ID NO: 7993790 - DNA, 22 bp, Homo sapiens
ggaggaagccctcggtgcccca

SEQ ID NO: 7993791 - DNA, 22 bp, Homo sapiens
ggaggaagccctcggtgcccca

SEQ ID NO: 7993792 - DNA, 22 bp, Homo sapiens
ggaggaagccctcggtgcccca

SEQ ID NO: 7993793 - DNA, 22 bp, Homo sapiens
ggaggacactggctctgccttc

SEQ ID NO: 7993794 - DNA, 22 bp, Homo sapiens
ggaggacactggctctgccttc

SEQ ID NO: 7993795 - DNA, 22 bp, Homo sapiens
ggaggacactggctctgccttc

SEQ ID NO: 7993796 - DNA, 22 bp, Homo sapiens
ggaggaagtgcagttctactac

SEQ ID NO: 7993797 - DNA, 22 bp, Homo sapiens
ggaggaagtgcagttctactac

SEQ ID NO: 7993798 - DNA, 22 bp, Homo sapiens
ggaggaagtgcagttctactac

SEQ ID NO: 7993799 - DNA, 22 bp, Homo sapiens
ggaggacactggctctgccttc

SEQ ID NO: 7993800 - DNA, 22 bp, Homo sapiens
ggaggaagtgcagttctactac

SEQ ID NO: 7993801 - DNA, 22 bp, Homo sapiens
ggaggaagtgcagttctactac

SEQ ID NO: 7993802 - DNA, 22 bp, Homo sapiens
ggaggacaggggctgcagcaca

SEQ ID NO: 7993803 - DNA, 22 bp, Homo sapiens
ggaggacaggggctgcagcaca

SEQ ID NO: 7993804 - DNA, 22 bp, Homo sapiens
ggaggacaggggctgcagcaca

SEQ ID NO: 7993805 - DNA, 22 bp, Homo sapiens
ggaggagcatgagagggtagtg

SEQ ID NO: 7993806 - DNA, 22 bp, Homo sapiens
ggaggagcatgagagggtagtg

SEQ ID NO: 7993807 - DNA, 22 bp, Homo sapiens
ggaggagcatgagagggtagtg

SEQ ID NO: 7993808 - DNA, 22 bp, Homo sapiens
ggaggacggcatgctgggacgt

SEQ ID NO: 7993809 - DNA, 22 bp, Homo sapiens
ggaggagcatgagagggtagtg

SEQ ID NO: 7993810 - DNA, 22 bp, Homo sapiens
ggaggagcatgagagggtagtg

SEQ ID NO: 7993811 - DNA, 22 bp, Homo sapiens
ggaggagcatgagagggtagtg

SEQ ID NO: 7993812 - DNA, 22 bp, Homo sapiens
ggaggagctgctgtgggggccc

SEQ ID NO: 7993813 - DNA, 22 bp, Homo sapiens
ggaggagctgctgtgggggccc

SEQ ID NO: 7993814 - DNA, 22 bp, Homo sapiens
ggaggagcccactcaaagggga

SEQ ID NO: 7993815 - DNA, 22 bp, Homo sapiens
ggaggagcccactcaaagggga

SEQ ID NO: 7993816 - DNA, 22 bp, Homo sapiens
ggagctgaaccccatcgtgctg

SEQ ID NO: 7993817 - DNA, 22 bp, Homo sapiens
ggagctgaaggggtgggctcag

SEQ ID NO: 7993818 - DNA, 22 bp, Homo sapiens
ggagctgagacccagtggctga

SEQ ID NO: 7993819 - DNA, 22 bp, Homo sapiens
ggagctgagacccagtggctga

SEQ ID NO: 7993820 - DNA, 22 bp, Homo sapiens
ggagctgagacccagtggctga

SEQ ID NO: 7993821 - DNA, 22 bp, Homo sapiens
ggagctgagacccagtggctga

SEQ ID NO: 7993822 - DNA, 22 bp, Homo sapiens
ggagctctcctgatgtgaagat

SEQ ID NO: 7993823 - DNA, 22 bp, Homo sapiens
ggagctctgtgtctctcctgcc

SEQ ID NO: 7993824 - DNA, 22 bp, Homo sapiens
ggagctctctcagggggtccaa

SEQ ID NO: 7993825 - DNA, 22 bp, Homo sapiens
ggagctctgtgtctctcctgcc

SEQ ID NO: 7993826 - DNA, 22 bp, Homo sapiens
ggagctgaaccccatcgtgctg

SEQ ID NO: 7993827 - DNA, 22 bp, Homo sapiens
ggagctcataacaaggtagcca

SEQ ID NO: 7993828 - DNA, 22 bp, Homo sapiens
ggagctcctggcagtgacagag

SEQ ID NO: 7993829 - DNA, 22 bp, Homo sapiens
ggagctcctggcagtgacagag

SEQ ID NO: 7993830 - DNA, 22 bp, Homo sapiens
ggagctcagaagtgagtgagtt

SEQ ID NO: 7993831 - DNA, 22 bp, Homo sapiens
ggagctcagaagtgagtgagtt

SEQ ID NO: 7993832 - DNA, 22 bp, Homo sapiens
ggagctcagtggggggactgtg

SEQ ID NO: 7993833 - DNA, 22 bp, Homo sapiens
ggagctcaggcccagcaaggcc

SEQ ID NO: 7993834 - DNA, 22 bp, Homo sapiens
ggagctcagtggggggactgtg

SEQ ID NO: 7993835 - DNA, 22 bp, Homo sapiens
ggagctgaggtaacagtgagtg

SEQ ID NO: 7993836 - DNA, 22 bp, Homo sapiens
ggagctgaggtaacagtgagtg

SEQ ID NO: 7993837 - DNA, 22 bp, Homo sapiens
ggagctgagtgggtttattgat

SEQ ID NO: 7993838 - DNA, 22 bp, Homo sapiens
ggagctgatgacgtcaccatgg

SEQ ID NO: 7993839 - DNA, 22 bp, Homo sapiens
ggagctgagtgggtttattgat

SEQ ID NO: 7993840 - DNA, 22 bp, Homo sapiens
ggagctgagttcttcagccggg

SEQ ID NO: 7993841 - DNA, 22 bp, Homo sapiens
ggagctgagttcttcagccggg

SEQ ID NO: 7993842 - DNA, 22 bp, Homo sapiens
ggagctgaggaatagctttgat

SEQ ID NO: 7993843 - DNA, 22 bp, Homo sapiens
ggagctgaggaatagctttgat

SEQ ID NO: 7993844 - DNA, 22 bp, Homo sapiens
ggagctgagcagcgatggcgga

SEQ ID NO: 7993845 - DNA, 22 bp, Homo sapiens
ggagctgagagtagtccctttt

SEQ ID NO: 7993846 - DNA, 22 bp, Homo sapiens
ggagctgagagtagtccctttt

SEQ ID NO: 7993847 - DNA, 22 bp, Homo sapiens
ggagctgaggctgaggcctcac

SEQ ID NO: 7993848 - DNA, 22 bp, Homo sapiens
ggagctgaggctgaggcctcac

SEQ ID NO: 7993849 - DNA, 22 bp, Homo sapiens
ggagctgaggacactacatttt

SEQ ID NO: 7993850 - DNA, 22 bp, Homo sapiens
ggagctgaggacactacatttt

SEQ ID NO: 7993851 - DNA, 22 bp, Homo sapiens
ggaggaaatccttagtaaggca

SEQ ID NO: 7993852 - DNA, 22 bp, Homo sapiens
ggaggaaaggctccctccctct

SEQ ID NO: 7993853 - DNA, 22 bp, Homo sapiens
ggaggaaaggctccctccctct

SEQ ID NO: 7993854 - DNA, 22 bp, Homo sapiens
ggagctgcacgctctgaagcct

SEQ ID NO: 7993855 - DNA, 22 bp, Homo sapiens
ggagctgcacgctctgaagcct

SEQ ID NO: 7993856 - DNA, 22 bp, Homo sapiens
ggagctgcaagtgttgagagct

SEQ ID NO: 7993857 - DNA, 22 bp, Homo sapiens
ggagctgcaagtgttgagagct

SEQ ID NO: 7993858 - DNA, 22 bp, Homo sapiens
ggagctgcaagtgttgagagct

SEQ ID NO: 7993859 - DNA, 22 bp, Homo sapiens
ggagctgatggtagaagaatga

SEQ ID NO: 7993860 - DNA, 22 bp, Homo sapiens
ggagctgatggtagaagaatga

SEQ ID NO: 7993861 - DNA, 22 bp, Homo sapiens
ggaggccaaggcgggcggatca

SEQ ID NO: 7993862 - DNA, 22 bp, Homo sapiens
ggaggcagaatagagtgtgggt

SEQ ID NO: 7993863 - DNA, 22 bp, Homo sapiens
ggaggcagaatagagtgtgggt

SEQ ID NO: 7993864 - DNA, 22 bp, Homo sapiens
ggaggcagaatagagtgtgggt

SEQ ID NO: 7993865 - DNA, 22 bp, Homo sapiens
ggaggcagaatagagtgtgggt

SEQ ID NO: 7993866 - DNA, 22 bp, Homo sapiens
ggaggcagaatagagtgtgggt

SEQ ID NO: 7993867 - DNA, 22 bp, Homo sapiens
ggaggcagaatagagtgtgggt

SEQ ID NO: 7993868 - DNA, 22 bp, Homo sapiens
ggaggcagaatagagtgtgggt

SEQ ID NO: 7993869 - DNA, 22 bp, Homo sapiens
ggaggaggcggcagaagttcct

SEQ ID NO: 7993870 - DNA, 22 bp, Homo sapiens
ggaggaggcggcagaagttcct

SEQ ID NO: 7993871 - DNA, 22 bp, Homo sapiens
ggaggcagaatagagtgtgggt

SEQ ID NO: 7993872 - DNA, 22 bp, Homo sapiens
ggaggaggcaagtaccagatgc

SEQ ID NO: 7993873 - DNA, 22 bp, Homo sapiens
ggaggaggcaagtaccagatgc

SEQ ID NO: 7993874 - DNA, 22 bp, Homo sapiens
ggaggaggcaagtaccagatgc

SEQ ID NO: 7993875 - DNA, 22 bp, Homo sapiens
ggaggaggcaagtaccagatgc

SEQ ID NO: 7993876 - DNA, 22 bp, Homo sapiens
ggaggaggcaagtaccagatgc

SEQ ID NO: 7993877 - DNA, 22 bp, Homo sapiens
ggaggagctgctgtgggggccc

SEQ ID NO: 7993878 - DNA, 22 bp, Homo sapiens
ggaggaggcaagtaccagatgc

SEQ ID NO: 7993879 - DNA, 22 bp, Homo sapiens
ggaggagctgctgtgggggccc

SEQ ID NO: 7993880 - DNA, 22 bp, Homo sapiens
ggaggaggcggcagaagttcct

SEQ ID NO: 7993881 - DNA, 22 bp, Homo sapiens
ggaggaggcggcagaagttcct

SEQ ID NO: 7993882 - DNA, 22 bp, Homo sapiens
ggaggaggcaagtaccagatgc

SEQ ID NO: 7993883 - DNA, 22 bp, Homo sapiens
ggaggaggcaagtaccagatgc

SEQ ID NO: 7993884 - DNA, 22 bp, Homo sapiens
ggaggaggcaagtaccagatgc

SEQ ID NO: 7993885 - DNA, 22 bp, Homo sapiens
ggaggccagcctgaggctgagg

SEQ ID NO: 7993886 - DNA, 22 bp, Homo sapiens
ggaggccagcctgaggctgagg

SEQ ID NO: 7993887 - DNA, 22 bp, Homo sapiens
ggaggccagcctgaggctgagg

SEQ ID NO: 7993888 - DNA, 22 bp, Homo sapiens
ggaggccagcctgaggctgagg

SEQ ID NO: 7993889 - DNA, 22 bp, Homo sapiens
ggaggccagcctgaggctgagg

SEQ ID NO: 7993890 - DNA, 22 bp, Homo sapiens
ggaggccacggtttagcaccga

SEQ ID NO: 7993891 - DNA, 22 bp, Homo sapiens
ggaggccacggtttagcaccga

SEQ ID NO: 7993892 - DNA, 22 bp, Homo sapiens
ggaggccagaatctgtgttgga

SEQ ID NO: 7993893 - DNA, 22 bp, Homo sapiens
ggaggccacctgacctgctgtt

SEQ ID NO: 7993894 - DNA, 22 bp, Homo sapiens
ggaggccacctgacctgctgtt

SEQ ID NO: 7993895 - DNA, 22 bp, Homo sapiens
ggaggccacggtttagcaccga

SEQ ID NO: 7993896 - DNA, 22 bp, Homo sapiens
ggaggccacggtttagcaccga

SEQ ID NO: 7993897 - DNA, 22 bp, Homo sapiens
ggaggccacctgacctgctgtt

SEQ ID NO: 7993898 - DNA, 22 bp, Homo sapiens
ggaggccaccatggagtcactt

SEQ ID NO: 7993899 - DNA, 22 bp, Homo sapiens
ggaggccaattttctaactgca

SEQ ID NO: 7993900 - DNA, 22 bp, Homo sapiens
ggaggccaattttctaactgca

SEQ ID NO: 7993901 - DNA, 22 bp, Homo sapiens
ggaggccaccatggagtcactt

SEQ ID NO: 7993902 - DNA, 22 bp, Homo sapiens
ggaggccaagtcactgacctgg

SEQ ID NO: 7993903 - DNA, 22 bp, Homo sapiens
ggaggccaagtcactgacctgg

SEQ ID NO: 7993904 - DNA, 22 bp, Homo sapiens
ggaggccaaggtgggcggatca

SEQ ID NO: 7993905 - DNA, 22 bp, Homo sapiens
ggaggccaaggtgggcggatca

SEQ ID NO: 7993906 - DNA, 22 bp, Homo sapiens
ggaggccaaggcgggcggatca

SEQ ID NO: 7993907 - DNA, 22 bp, Homo sapiens
ggaggccaggtgggagtcatct

SEQ ID NO: 7993908 - DNA, 22 bp, Homo sapiens
ggaggccagggtgggtggatcg

SEQ ID NO: 7993909 - DNA, 22 bp, Homo sapiens
ggaggccagggtgggtggatcg

SEQ ID NO: 7993910 - DNA, 22 bp, Homo sapiens
ggaggccaggtgggagtcatct

SEQ ID NO: 7993911 - DNA, 22 bp, Homo sapiens
ggaggccagtcctggccgggct

SEQ ID NO: 7993912 - DNA, 22 bp, Homo sapiens
ggaggccaggtgggagtcatct

SEQ ID NO: 7993913 - DNA, 22 bp, Homo sapiens
ggaggccaggtgggagtcatct

SEQ ID NO: 7993914 - DNA, 22 bp, Homo sapiens
ggaggccagggacccagtcagc

SEQ ID NO: 7993915 - DNA, 22 bp, Homo sapiens
ggaggccagggacccagtcagc

SEQ ID NO: 7993916 - DNA, 22 bp, Homo sapiens
ggaggccagggacccagtcagc

SEQ ID NO: 7993917 - DNA, 22 bp, Homo sapiens
ggaggccagggacccagtcagc

SEQ ID NO: 7993918 - DNA, 22 bp, Homo sapiens
ggaggccagggacccagtcagc

SEQ ID NO: 7993919 - DNA, 22 bp, Homo sapiens
ggaggccagggacccagtcagc

SEQ ID NO: 7993920 - DNA, 15 bp, Homo sapiens
ggaggccaggctgtg

SEQ ID NO: 7993921 - DNA, 22 bp, Homo sapiens
ggaggccagcctgaggctgagg

SEQ ID NO: 7993922 - DNA, 22 bp, Homo sapiens
ggaggccagcctgaggctgagg

SEQ ID NO: 7993923 - DNA, 22 bp, Homo sapiens
ggaggccagcctgaggctgagg

SEQ ID NO: 7993924 - DNA, 22 bp, Homo sapiens
ggaggccaggaagagccgccct

SEQ ID NO: 7993925 - DNA, 22 bp, Homo sapiens
ggaggccagcctgaggctgagg

SEQ ID NO: 7993926 - DNA, 22 bp, Homo sapiens
ggaggccaggaaggctcggaga

SEQ ID NO: 7993927 - DNA, 22 bp, Homo sapiens
ggaggccaggaaggctcggaga

SEQ ID NO: 7993928 - DNA, 22 bp, Homo sapiens
ggaggccaggatgggaactcaa

SEQ ID NO: 7993929 - DNA, 22 bp, Homo sapiens
ggaggccaggaaggctcggaga

SEQ ID NO: 7993930 - DNA, 22 bp, Homo sapiens
ggaggccaggaagagccgccct

SEQ ID NO: 7993931 - DNA, 22 bp, Homo sapiens
ggaggccatcagggagggcatt

SEQ ID NO: 7993932 - DNA, 22 bp, Homo sapiens
ggaggccatcagggagggcatt

SEQ ID NO: 7993933 - DNA, 22 bp, Homo sapiens
ggaggccatcagggagggcatt

SEQ ID NO: 7993934 - DNA, 22 bp, Homo sapiens
ggaggccatcagggagggcatt

SEQ ID NO: 7993935 - DNA, 22 bp, Homo sapiens
ggaggccatcagggagggcatt

SEQ ID NO: 7993936 - DNA, 22 bp, Homo sapiens
ggaggccatcagggagggcatt

SEQ ID NO: 7993937 - DNA, 22 bp, Homo sapiens
ggaggccatcagggagggcatt

SEQ ID NO: 7993938 - DNA, 22 bp, Homo sapiens
ggaggccatcagggagggcatt

SEQ ID NO: 7993939 - DNA, 22 bp, Homo sapiens
ggaggccagtcctggccgggct

SEQ ID NO: 7993940 - DNA, 22 bp, Homo sapiens
ggaggccatagtttgggagtca

SEQ ID NO: 7993941 - DNA, 22 bp, Homo sapiens
ggaggccatagtttgggagtca

SEQ ID NO: 7993942 - DNA, 22 bp, Homo sapiens
ggaggccatagtttgggagtca

SEQ ID NO: 7993943 - DNA, 22 bp, Homo sapiens
ggaggccatgaggctctaggtg

SEQ ID NO: 7993944 - DNA, 22 bp, Homo sapiens
ggaggccatgaggctctaggtg

SEQ ID NO: 7993945 - DNA, 22 bp, Homo sapiens
ggaggccatgaggctctaggtg

SEQ ID NO: 7993946 - DNA, 22 bp, Homo sapiens
ggaggccatctggctggaggct

SEQ ID NO: 7993947 - DNA, 22 bp, Homo sapiens
ggaggccatctggctggaggct

SEQ ID NO: 7993948 - DNA, 22 bp, Homo sapiens
ggaggccatgaggctctaggtg

SEQ ID NO: 7993949 - DNA, 22 bp, Homo sapiens
ggaggccatctggctggaggct

SEQ ID NO: 7993950 - DNA, 22 bp, Homo sapiens
ggaggccatcagggagggcatt

SEQ ID NO: 7993951 - DNA, 22 bp, Homo sapiens
ggaggccatctggctggaggct

SEQ ID NO: 7993952 - DNA, 22 bp, Homo sapiens
ggaggccatctggctggaggct

SEQ ID NO: 7993953 - DNA, 22 bp, Homo sapiens
ggaggccatcagggagggcatt

SEQ ID NO: 7993954 - DNA, 22 bp, Homo sapiens
ggaggccatctggctggaggct

SEQ ID NO: 7993955 - DNA, 22 bp, Homo sapiens
ggaggccatctggctggaggct

SEQ ID NO: 7993956 - DNA, 22 bp, Homo sapiens
gcttcatttctctctgtagacc

SEQ ID NO: 7993957 - DNA, 22 bp, Homo sapiens
gcttcatttgagaacctctgtg

SEQ ID NO: 7993958 - DNA, 22 bp, Homo sapiens
gcttcatttgagaacctctgtg

SEQ ID NO: 7993959 - DNA, 22 bp, Homo sapiens
gcttcctgggacaggctatgtg

SEQ ID NO: 7993960 - DNA, 22 bp, Homo sapiens
gcttcctgggacaggctatgtg

SEQ ID NO: 7993961 - DNA, 22 bp, Homo sapiens
gcttcctgggacaggctatgtg

SEQ ID NO: 7993962 - DNA, 22 bp, Homo sapiens
gcttcctggagggagagagctg

SEQ ID NO: 7993963 - DNA, 22 bp, Homo sapiens
gcttcctggagggagagagctg

SEQ ID NO: 7993964 - DNA, 22 bp, Homo sapiens
gcttcctggagggagagagctg

SEQ ID NO: 7993965 - DNA, 22 bp, Homo sapiens
gcttcctggagggagagagctg

SEQ ID NO: 7993966 - DNA, 22 bp, Homo sapiens
gcttcatagcattcattgcctg

SEQ ID NO: 7993967 - DNA, 22 bp, Homo sapiens
gcttcatacaatggtatatgca

SEQ ID NO: 7993968 - DNA, 22 bp, Homo sapiens
gcttcaggaggtcggtctcctt

SEQ ID NO: 7993969 - DNA, 22 bp, Homo sapiens
gcttcagcccatcccagtacat

SEQ ID NO: 7993970 - DNA, 22 bp, Homo sapiens
gcttcacagaatcaatagttgg

SEQ ID NO: 7993971 - DNA, 22 bp, Homo sapiens
gcttcacaggcaagttaagcct

SEQ ID NO: 7993972 - DNA, 22 bp, Homo sapiens
gcttcagaaatatcatcattat

SEQ ID NO: 7993973 - DNA, 22 bp, Homo sapiens
gcttcagaagttgggctctgac

SEQ ID NO: 7993974 - DNA, 22 bp, Homo sapiens
gcttcagaagttgggctctgac

SEQ ID NO: 7993975 - DNA, 22 bp, Homo sapiens
gcttcagaagttgggctctgac

SEQ ID NO: 7993976 - DNA, 20 bp, Homo sapiens
gcttcagaacctgggtgctg

SEQ ID NO: 7993977 - DNA, 22 bp, Homo sapiens
gcttcagaaatgaacactgtct

SEQ ID NO: 7993978 - DNA, 20 bp, Homo sapiens
gcttcagaacctgggtgctg

SEQ ID NO: 7993979 - DNA, 22 bp, Homo sapiens
gcttattttcaccttctctcag

SEQ ID NO: 7993980 - DNA, 22 bp, Homo sapiens
gcttattttcaccttctctcag

SEQ ID NO: 7993981 - DNA, 22 bp, Homo sapiens
gcttcaaactgagcttcaagtg

SEQ ID NO: 7993982 - DNA, 22 bp, Homo sapiens
gcttcaaagattcacagtttca

SEQ ID NO: 7993983 - DNA, 22 bp, Homo sapiens
gcttcacactaaaaatgttaaa

SEQ ID NO: 7993984 - DNA, 22 bp, Homo sapiens
gcttcacactaaaaatgttaaa

SEQ ID NO: 7993985 - DNA, 22 bp, Homo sapiens
gcttcacaacttcttaattctt

SEQ ID NO: 7993986 - DNA, 22 bp, Homo sapiens
gcttcagattcttttcatgtct

SEQ ID NO: 7993987 - DNA, 22 bp, Homo sapiens
gcttcagattcttttcatgtct

SEQ ID NO: 7993988 - DNA, 21 bp, Homo sapiens
gcttcagcaaggcttgctggt

SEQ ID NO: 7993989 - DNA, 22 bp, Homo sapiens
gcttcagatttatgtatcattg

SEQ ID NO: 7993990 - DNA, 22 bp, Homo sapiens
gcttcagattcctcttctgtaa

SEQ ID NO: 7993991 - DNA, 22 bp, Homo sapiens
gcttcagactgtgcttctgttg

SEQ ID NO: 7993992 - DNA, 22 bp, Homo sapiens
gcttcagactggagcagaggaa

SEQ ID NO: 7993993 - DNA, 22 bp, Homo sapiens
gcttcagacctgaaaggaaaaa

SEQ ID NO: 7993994 - DNA, 22 bp, Homo sapiens
gcttccttccttacattggtgg

SEQ ID NO: 7993995 - DNA, 22 bp, Homo sapiens
gcttccttccttacattggtgg

SEQ ID NO: 7993996 - DNA, 22 bp, Homo sapiens
gcttccttccttacattggtgg

SEQ ID NO: 7993997 - DNA, 22 bp, Homo sapiens
gcttcggggtccaagcgcgtgt

SEQ ID NO: 7993998 - DNA, 22 bp, Homo sapiens
gcttccttggtcctggtctaag

SEQ ID NO: 7993999 - DNA, 22 bp, Homo sapiens
gcttccttggtcctggtctaag

SEQ ID NO: 7994000 - DNA, 22 bp, Homo sapiens
gcttccttggtcctggtctaag

SEQ ID NO: 7994001 - DNA, 22 bp, Homo sapiens
gcttccttgggaaaattagatg

SEQ ID NO: 7994002 - DNA, 22 bp, Homo sapiens
gcttccttgggaaaattagatg

SEQ ID NO: 7994003 - DNA, 22 bp, Homo sapiens
gcttcctgtccctcagccatga

SEQ ID NO: 7994004 - DNA, 22 bp, Homo sapiens
gcttcctgtccaggccccacat

SEQ ID NO: 7994005 - DNA, 22 bp, Homo sapiens
gcttcctgtatcctcctgtacc

SEQ ID NO: 7994006 - DNA, 22 bp, Homo sapiens
gcttcctgtatcctcctgtacc

SEQ ID NO: 7994007 - DNA, 22 bp, Homo sapiens
gcttcctgtaggcaggtccaag

SEQ ID NO: 7994008 - DNA, 23 bp, Homo sapiens
gcttctagtcaatttcaccagga

SEQ ID NO: 7994009 - DNA, 22 bp, Homo sapiens
gcttctcaattctcaccctcca

SEQ ID NO: 7994010 - DNA, 20 bp, Homo sapiens
gcttctcagggcttctctga

SEQ ID NO: 7994011 - DNA, 22 bp, Homo sapiens
gcttctgagttcttgcttaata

SEQ ID NO: 7994012 - DNA, 22 bp, Homo sapiens
gcttctgagttcttgcttaata

SEQ ID NO: 7994013 - DNA, 22 bp, Homo sapiens
gcttctgatgtcagacttctgg

SEQ ID NO: 7994014 - DNA, 22 bp, Homo sapiens
gcttctacccacgagatgcaaa

SEQ ID NO: 7994015 - DNA, 22 bp, Homo sapiens
gcttctagggaaggcagtcaca

SEQ ID NO: 7994016 - DNA, 22 bp, Homo sapiens
gcttcggggtccaagcgcgtgt

SEQ ID NO: 7994017 - DNA, 22 bp, Homo sapiens
gcttctgcagagccgtcctgag

SEQ ID NO: 7994018 - DNA, 23 bp, Homo sapiens
gcttctgccatttgctagctgtg

SEQ ID NO: 7994019 - DNA, 23 bp, Homo sapiens
gcttctgccatttgctagctgtg

SEQ ID NO: 7994020 - DNA, 22 bp, Homo sapiens
gcttctgcgcacgcttcttccc

SEQ ID NO: 7994021 - DNA, 22 bp, Homo sapiens
gcttctgcgcacgcttcttccc

SEQ ID NO: 7994022 - DNA, 22 bp, Homo sapiens
gcttctgcgcctagcctcaggt

SEQ ID NO: 7994023 - DNA, 22 bp, Homo sapiens
gcttctgcctcttccactttgc

SEQ ID NO: 7994024 - DNA, 22 bp, Homo sapiens
gcttctggaagcatatgcaaga

SEQ ID NO: 7994025 - DNA, 22 bp, Homo sapiens
gcttctggaagcatatgcaaga

SEQ ID NO: 7994026 - DNA, 23 bp, Homo sapiens
gcttctgccatttgctagctgtg

SEQ ID NO: 7994027 - DNA, 22 bp, Homo sapiens
gcttaatgagcagagaatctac

SEQ ID NO: 7994028 - DNA, 22 bp, Homo sapiens
gctgggctggaaggccaaggca

SEQ ID NO: 7994029 - DNA, 22 bp, Homo sapiens
gcttaaggaattggagagtctg

SEQ ID NO: 7994030 - DNA, 22 bp, Homo sapiens
gctgggctggaaggccaaggca

SEQ ID NO: 7994031 - DNA, 22 bp, Homo sapiens
gctgggctgcgtcggggaagcc

SEQ ID NO: 7994032 - DNA, 22 bp, Homo sapiens
gctgggctgcgtcggggaagcc

SEQ ID NO: 7994033 - DNA, 22 bp, Homo sapiens
gcttacaagatcgtgctccagt

SEQ ID NO: 7994034 - DNA, 22 bp, Homo sapiens
gcttacaaacaacagaaattaa

SEQ ID NO: 7994035 - DNA, 22 bp, Homo sapiens
gcttaattctggctcagtttcc

SEQ ID NO: 7994036 - DNA, 22 bp, Homo sapiens
gcttacaaacaacagaaattaa

SEQ ID NO: 7994037 - DNA, 22 bp, Homo sapiens
gcttaattctggctcagtttcc

SEQ ID NO: 7994038 - DNA, 22 bp, Homo sapiens
gctgggctgcgtcggggaagcc

SEQ ID NO: 7994039 - DNA, 22 bp, Homo sapiens
gctgggctgcgtcggggaagcc

SEQ ID NO: 7994040 - DNA, 22 bp, Homo sapiens
gctgggctgcgtcggggaagcc

SEQ ID NO: 7994041 - DNA, 22 bp, Homo sapiens
gctgggctgcgtcggggaagcc

SEQ ID NO: 7994042 - DNA, 22 bp, Homo sapiens
gctgggctgcccaacctctgac

SEQ ID NO: 7994043 - DNA, 22 bp, Homo sapiens
gctgggctgcccaacctctgac

SEQ ID NO: 7994044 - DNA, 22 bp, Homo sapiens
gctgggctgcccaacctctgac

SEQ ID NO: 7994045 - DNA, 22 bp, Homo sapiens
gctgggctgcccaacctctgac

SEQ ID NO: 7994046 - DNA, 22 bp, Homo sapiens
gctgggctgagctagacttggc

SEQ ID NO: 7994047 - DNA, 22 bp, Homo sapiens
gctgggctgagctagacttggc

SEQ ID NO: 7994048 - DNA, 22 bp, Homo sapiens
gctgggctgagctagacttggc

SEQ ID NO: 7994049 - DNA, 22 bp, Homo sapiens
gctgggctgagctagacttggc

SEQ ID NO: 7994050 - DNA, 22 bp, Homo sapiens
gctgggctgcccaacctctgac

SEQ ID NO: 7994051 - DNA, 22 bp, Homo sapiens
gctgggctgcccaacctctgac

SEQ ID NO: 7994052 - DNA, 22 bp, Homo sapiens
gcttagagcagctcacaacatg

SEQ ID NO: 7994053 - DNA, 22 bp, Homo sapiens
gcttagaagttcctataaaatg

SEQ ID NO: 7994054 - DNA, 22 bp, Homo sapiens
gcttagaagttcctataaaatg

SEQ ID NO: 7994055 - DNA, 22 bp, Homo sapiens
gcttagaagttcctataaaatg

SEQ ID NO: 7994056 - DNA, 22 bp, Homo sapiens
gcttagaagtacacatgccttt

SEQ ID NO: 7994057 - DNA, 20 bp, Homo sapiens
gcttagcaggcatagtagct

SEQ ID NO: 7994058 - DNA, 22 bp, Homo sapiens
gcttagcctggactggtgagca

SEQ ID NO: 7994059 - DNA, 22 bp, Homo sapiens
gcttagcagtcacacattgttc

SEQ ID NO: 7994060 - DNA, 22 bp, Homo sapiens
gcttacaatcatttcagtttag

SEQ ID NO: 7994061 - DNA, 22 bp, Homo sapiens
gcttacaggtgaggcagcaaga

SEQ ID NO: 7994062 - DNA, 22 bp, Homo sapiens
gcttacaggtgaggcagcaaga

SEQ ID NO: 7994063 - DNA, 22 bp, Homo sapiens
gcttagaaagtgattgatacat

SEQ ID NO: 7994064 - DNA, 22 bp, Homo sapiens
gcttagaacatgtggattgcaa

SEQ ID NO: 7994065 - DNA, 22 bp, Homo sapiens
gcttagaagtacacatgccttt

SEQ ID NO: 7994066 - DNA, 22 bp, Homo sapiens
gcttagaagattgaccctggtt

SEQ ID NO: 7994067 - DNA, 21 bp, Homo sapiens
gcttatagaaacatcaccaga

SEQ ID NO: 7994068 - DNA, 22 bp, Homo sapiens
gcttattttcaccttctctcag

SEQ ID NO: 7994069 - DNA, 22 bp, Homo sapiens
gcttattttcaccttctctcag

SEQ ID NO: 7994070 - DNA, 22 bp, Homo sapiens
gcttattttatcctattcacta

SEQ ID NO: 7994071 - DNA, 22 bp, Homo sapiens
gcttagtcaattataaataggc

SEQ ID NO: 7994072 - DNA, 22 bp, Homo sapiens
gcttaggaaaatggtggagttg

SEQ ID NO: 7994073 - DNA, 22 bp, Homo sapiens
gcttaggagtttcaggctctca

SEQ ID NO: 7994074 - DNA, 22 bp, Homo sapiens
gcttagcctggactggtgagca

SEQ ID NO: 7994075 - DNA, 22 bp, Homo sapiens
gcttagccttgcctgccttgtc

SEQ ID NO: 7994076 - DNA, 22 bp, Homo sapiens
gcttagtccccaagagagacca

SEQ ID NO: 7994077 - DNA, 22 bp, Homo sapiens
gcttagtcaattataaataggc

SEQ ID NO: 7994078 - DNA, 22 bp, Homo sapiens
gcttagtcctagtgtactaaat

SEQ ID NO: 7994079 - DNA, 22 bp, Homo sapiens
gcttagtgaaacaacctttggc

SEQ ID NO: 7994080 - DNA, 22 bp, Homo sapiens
gctgggctgagaagttaagcaa

SEQ ID NO: 7994081 - DNA, 22 bp, Homo sapiens
gctgggctgagctagacttggc

SEQ ID NO: 7994082 - DNA, 22 bp, Homo sapiens
gctgggctgagctagacttggc

SEQ ID NO: 7994083 - DNA, 22 bp, Homo sapiens
gctgggctgagctagacttggc

SEQ ID NO: 7994084 - DNA, 22 bp, Homo sapiens
gctgggctgagaagttaagcaa

SEQ ID NO: 7994085 - DNA, 22 bp, Homo sapiens
gctgggctctttacccctgtac

SEQ ID NO: 7994086 - DNA, 22 bp, Homo sapiens
gctgggctgagaagttaagcaa

SEQ ID NO: 7994087 - DNA, 22 bp, Homo sapiens
gctgggctgagaagttaagcaa

SEQ ID NO: 7994088 - DNA, 22 bp, Homo sapiens
gctgggctctttacccctgtac

SEQ ID NO: 7994089 - DNA, 22 bp, Homo sapiens
gctgggctcttatcacctgtac

SEQ ID NO: 7994090 - DNA, 22 bp, Homo sapiens
gctgggctctttacccctgtac

SEQ ID NO: 7994091 - DNA, 22 bp, Homo sapiens
gctgggctctttacccctgtac

SEQ ID NO: 7994092 - DNA, 22 bp, Homo sapiens
gctgggctcttatcacctgtac

SEQ ID NO: 7994093 - DNA, 22 bp, Homo sapiens
gctgggctcttatcacctgtac

SEQ ID NO: 7994094 - DNA, 22 bp, Homo sapiens
gctgggctcttatcacctgtac

SEQ ID NO: 7994095 - DNA, 22 bp, Homo sapiens
gctgggctctgtcatgccttcc

SEQ ID NO: 7994096 - DNA, 22 bp, Homo sapiens
gctgggctctgtcatgccttcc

SEQ ID NO: 7994097 - DNA, 22 bp, Homo sapiens
gctgggctctgtcatgccttcc

SEQ ID NO: 7994098 - DNA, 22 bp, Homo sapiens
gctgggctcgttcccacacgcg

SEQ ID NO: 7994099 - DNA, 22 bp, Homo sapiens
gctgggctctgtcatgccttcc

SEQ ID NO: 7994100 - DNA, 22 bp, Homo sapiens
gctgggctctgtcatgccttcc

SEQ ID NO: 7994101 - DNA, 22 bp, Homo sapiens
gctgggctcgttcccacacgcg

SEQ ID NO: 7994102 - DNA, 22 bp, Homo sapiens
gctgggctcgttcccacacgcg

SEQ ID NO: 7994103 - DNA, 22 bp, Homo sapiens
gctgggctcgttcccacacgcg

SEQ ID NO: 7994104 - DNA, 21 bp, Homo sapiens
gctgggctccagtctgccgct

SEQ ID NO: 7994105 - DNA, 21 bp, Homo sapiens
gctgggctccagtctgccgct

SEQ ID NO: 7994106 - DNA, 21 bp, Homo sapiens
gctgggctccagtctgccgct

SEQ ID NO: 7994107 - DNA, 21 bp, Homo sapiens
gctgggctccagtctgccgct

SEQ ID NO: 7994108 - DNA, 21 bp, Homo sapiens
gctgggctccagtctgccgct

SEQ ID NO: 7994109 - DNA, 22 bp, Homo sapiens
gctgggcatgtgaccaacagaa

SEQ ID NO: 7994110 - DNA, 22 bp, Homo sapiens
gctgggcatgtgaccaacagaa

SEQ ID NO: 7994111 - DNA, 22 bp, Homo sapiens
gctgggcatgtgaccaacagaa

SEQ ID NO: 7994112 - DNA, 22 bp, Homo sapiens
gctgggccagactttcaatgtc

SEQ ID NO: 7994113 - DNA, 22 bp, Homo sapiens
gctgggccagactttcaatgtc

SEQ ID NO: 7994114 - DNA, 22 bp, Homo sapiens
gctgggccagactttcaatgtc

SEQ ID NO: 7994115 - DNA, 22 bp, Homo sapiens
gctgggccagagcagcagcact

SEQ ID NO: 7994116 - DNA, 22 bp, Homo sapiens
gctgggccagagcagcagcact

SEQ ID NO: 7994117 - DNA, 22 bp, Homo sapiens
gctgggccagagcagcagcact

SEQ ID NO: 7994118 - DNA, 22 bp, Homo sapiens
gctgggctcagacctagtgaac

SEQ ID NO: 7994119 - DNA, 22 bp, Homo sapiens
gctgggctcagacctagtgaac

SEQ ID NO: 7994120 - DNA, 22 bp, Homo sapiens
gctgggctcagacctagtgaac

SEQ ID NO: 7994121 - DNA, 22 bp, Homo sapiens
gctgggccagagcagcagcact

SEQ ID NO: 7994122 - DNA, 22 bp, Homo sapiens
gctgggccagagcagcagcact

SEQ ID NO: 7994123 - DNA, 22 bp, Homo sapiens
gctgggccagagcagcagcact

SEQ ID NO: 7994124 - DNA, 22 bp, Homo sapiens
gctgggctccaccctcaactgt

SEQ ID NO: 7994125 - DNA, 22 bp, Homo sapiens
gctgggctccaccctcaactgt

SEQ ID NO: 7994126 - DNA, 22 bp, Homo sapiens
gctgggctccaccctcaactgt

SEQ ID NO: 7994127 - DNA, 22 bp, Homo sapiens
gctgggctccaccctcaactgt

SEQ ID NO: 7994128 - DNA, 22 bp, Homo sapiens
gctgggctcatttgtgtgtctg

SEQ ID NO: 7994129 - DNA, 22 bp, Homo sapiens
gctgggctcatttgtgtgtctg

SEQ ID NO: 7994130 - DNA, 22 bp, Homo sapiens
gctgggctcatttgtgtgtctg

SEQ ID NO: 7994131 - DNA, 22 bp, Homo sapiens
gctgggctcatttgtgtgtctg

SEQ ID NO: 7994132 - DNA, 22 bp, Homo sapiens
gctgggctcatttgtgtgtctg

SEQ ID NO: 7994133 - DNA, 22 bp, Homo sapiens
gctgggctcatttgtgtgtctg

SEQ ID NO: 7994134 - DNA, 22 bp, Homo sapiens
gctgggctccaggccagggtga

SEQ ID NO: 7994135 - DNA, 22 bp, Homo sapiens
gctgggctccaggccagggtga

SEQ ID NO: 7994136 - DNA, 22 bp, Homo sapiens
gctgggctccaggccagggtga

SEQ ID NO: 7994137 - DNA, 22 bp, Homo sapiens
gctgggctccaggccagggtga

SEQ ID NO: 7994138 - DNA, 22 bp, Homo sapiens
gctgggctccaggccagggtga

SEQ ID NO: 7994139 - DNA, 22 bp, Homo sapiens
gctgggctccaggccagggtga

SEQ ID NO: 7994140 - DNA, 22 bp, Homo sapiens
gctgggctccaccctcaactgt

SEQ ID NO: 7994141 - DNA, 22 bp, Homo sapiens
gctgggctccaccctcaactgt

SEQ ID NO: 7994142 - DNA, 22 bp, Homo sapiens
gctgggctccaccctcaactgt

SEQ ID NO: 7994143 - DNA, 22 bp, Homo sapiens
ggaaggtgaggtaaggtcttgt

SEQ ID NO: 7994144 - DNA, 22 bp, Homo sapiens
ggaaggtgaggtaaggtcttgt

SEQ ID NO: 7994145 - DNA, 19 bp, Homo sapiens
ggaaggtgacagtggtgaa

SEQ ID NO: 7994146 - DNA, 22 bp, Homo sapiens
ggaaggtcgagctgcatctggc

SEQ ID NO: 7994147 - DNA, 22 bp, Homo sapiens
ggaaggtcgagctgcatctggc

SEQ ID NO: 7994148 - DNA, 19 bp, Homo sapiens
ggaaggtgacagtggtgaa

SEQ ID NO: 7994149 - DNA, 19 bp, Homo sapiens
ggaaggtgacagtggtgaa

SEQ ID NO: 7994150 - DNA, 19 bp, Homo sapiens
ggaaggtgacagtggtgaa

SEQ ID NO: 7994151 - DNA, 22 bp, Homo sapiens
ggaaggtgctccctggacagag

SEQ ID NO: 7994152 - DNA, 22 bp, Homo sapiens
ggaaggtgctccctggacagag

SEQ ID NO: 7994153 - DNA, 22 bp, Homo sapiens
ggaaggtgctccctggacagag

SEQ ID NO: 7994154 - DNA, 18 bp, Homo sapiens
ggaaggtgatgtgaaaag

SEQ ID NO: 7994155 - DNA, 18 bp, Homo sapiens
ggaaggtgatgtgaaaag

SEQ ID NO: 7994156 - DNA, 18 bp, Homo sapiens
ggaaggtgatgtgaaaag

SEQ ID NO: 7994157 - DNA, 22 bp, Homo sapiens
ggaaggtgctccctggacagag

SEQ ID NO: 7994158 - DNA, 22 bp, Homo sapiens
ggaaggtgctccctggacagag

SEQ ID NO: 7994159 - DNA, 22 bp, Homo sapiens
ggaaggtgctccctggacagag

SEQ ID NO: 7994160 - DNA, 22 bp, Homo sapiens
ggaaggggtgtcgcccatggat

SEQ ID NO: 7994161 - DNA, 22 bp, Homo sapiens
ggaaggggtgtcgcccatggat

SEQ ID NO: 7994162 - DNA, 22 bp, Homo sapiens
ggaaggggtgtcgcccatggat

SEQ ID NO: 7994163 - DNA, 22 bp, Homo sapiens
ggaaggggttaggggtccctga

SEQ ID NO: 7994164 - DNA, 22 bp, Homo sapiens
ggaaggggttaggggtccctga

SEQ ID NO: 7994165 - DNA, 22 bp, Homo sapiens
ggaaggggttaggggtccctga

SEQ ID NO: 7994166 - DNA, 22 bp, Homo sapiens
ggaagggtttaagcaggagagt

SEQ ID NO: 7994167 - DNA, 22 bp, Homo sapiens
ggaagggtttggaaagccgaga

SEQ ID NO: 7994168 - DNA, 22 bp, Homo sapiens
ggaaggtcacagatgagggaag

SEQ ID NO: 7994169 - DNA, 22 bp, Homo sapiens
ggaagggtttaagcaggagagt

SEQ ID NO: 7994170 - DNA, 22 bp, Homo sapiens
ggaaggggttaggggtccctga

SEQ ID NO: 7994171 - DNA, 22 bp, Homo sapiens
ggaaggggtgggtgagcctcag

SEQ ID NO: 7994172 - DNA, 22 bp, Homo sapiens
ggaaggggtgggtgagcctcag

SEQ ID NO: 7994173 - DNA, 22 bp, Homo sapiens
ggaaggggtgggtgagcctcag

SEQ ID NO: 7994174 - DNA, 22 bp, Homo sapiens
ggaaggggtgggtgagcctcag

SEQ ID NO: 7994175 - DNA, 22 bp, Homo sapiens
ggaaggggtgggtgagcctcag

SEQ ID NO: 7994176 - DNA, 22 bp, Homo sapiens
ggaagggcaaaagagatgaact

SEQ ID NO: 7994177 - DNA, 22 bp, Homo sapiens
ggaagggcaaaagagatgaact

SEQ ID NO: 7994178 - DNA, 22 bp, Homo sapiens
ggaagggcaaaagagatgaact

SEQ ID NO: 7994179 - DNA, 21 bp, Homo sapiens
ggaaggggtcctcccaacagt

SEQ ID NO: 7994180 - DNA, 22 bp, Homo sapiens
ggaagggcaataaaatctcagg

SEQ ID NO: 7994181 - DNA, 22 bp, Homo sapiens
ggaagaaatgctcttctatgcg

SEQ ID NO: 7994182 - DNA, 22 bp, Homo sapiens
ggaagaaatgctcttctatgcg

SEQ ID NO: 7994183 - DNA, 22 bp, Homo sapiens
ggaagaaatgctcttctatgcg

SEQ ID NO: 7994184 - DNA, 22 bp, Homo sapiens
ggaagaaatctggttaagagat

SEQ ID NO: 7994185 - DNA, 22 bp, Homo sapiens
ggaagaaatctggttaagagat

SEQ ID NO: 7994186 - DNA, 22 bp, Homo sapiens
ggaagggagtagttggaatgca

SEQ ID NO: 7994187 - DNA, 22 bp, Homo sapiens
ggaagggagtagttggaatgca

SEQ ID NO: 7994188 - DNA, 22 bp, Homo sapiens
ggaagggagtagttggaatgca

SEQ ID NO: 7994189 - DNA, 22 bp, Homo sapiens
ggaagaaatgctcttctatgcg

SEQ ID NO: 7994190 - DNA, 22 bp, Homo sapiens
ggaagaaatgctcttctatgcg

SEQ ID NO: 7994191 - DNA, 22 bp, Homo sapiens
ggaagggagtagttggaatgca

SEQ ID NO: 7994192 - DNA, 22 bp, Homo sapiens
ggaagggagtagttggaatgca

SEQ ID NO: 7994193 - DNA, 22 bp, Homo sapiens
ggaagaaaatgggcaacaggtg

SEQ ID NO: 7994194 - DNA, 22 bp, Homo sapiens
ggaagaaaatgggcaacaggtg

SEQ ID NO: 7994195 - DNA, 22 bp, Homo sapiens
ggaagaaaatgggcaacaggtg

SEQ ID NO: 7994196 - DNA, 22 bp, Homo sapiens
ggaagaaagacatttattttga

SEQ ID NO: 7994197 - DNA, 22 bp, Homo sapiens
ggaagaaagcacacaaacttga

SEQ ID NO: 7994198 - DNA, 22 bp, Homo sapiens
ggaagaaagacatttattttga

SEQ ID NO: 7994199 - DNA, 22 bp, Homo sapiens
ggaagaaagacatttattttga

SEQ ID NO: 7994200 - DNA, 22 bp, Homo sapiens
ggaagaaagacatttattttga

SEQ ID NO: 7994201 - DNA, 22 bp, Homo sapiens
ggaagaaagcacacaaacttga

SEQ ID NO: 7994202 - DNA, 22 bp, Homo sapiens
ggaagaaagcacacaaacttga

SEQ ID NO: 7994203 - DNA, 22 bp, Homo sapiens
ggaagaaaggtggacaacaggt

SEQ ID NO: 7994204 - DNA, 22 bp, Homo sapiens
ggaagaaaggtggacaacaggt

SEQ ID NO: 7994205 - DNA, 22 bp, Homo sapiens
ggaagaaaggtggacaacaggt

SEQ ID NO: 7994206 - DNA, 22 bp, Homo sapiens
ggaagaaaggtggacaacaggt

SEQ ID NO: 7994207 - DNA, 22 bp, Homo sapiens
ggaagaaaggtggacaacaggt

SEQ ID NO: 7994208 - DNA, 22 bp, Homo sapiens
ggaagaaaggtggacaacaggt

SEQ ID NO: 7994209 - DNA, 22 bp, Homo sapiens
ggaagaaaggtggacaacaggt

SEQ ID NO: 7994210 - DNA, 22 bp, Homo sapiens
ggaagaaaggtggacaacaggt

SEQ ID NO: 7994211 - DNA, 22 bp, Homo sapiens
ggaagaaatctggttaagagat

SEQ ID NO: 7994212 - DNA, 22 bp, Homo sapiens
ggaagaaatctggttaagagat

SEQ ID NO: 7994213 - DNA, 22 bp, Homo sapiens
ggaagaaatctggttaagagat

SEQ ID NO: 7994214 - DNA, 22 bp, Homo sapiens
ggaagaaagtagaaaaccgtgg

SEQ ID NO: 7994215 - DNA, 22 bp, Homo sapiens
ggaagaaagtagaaaaccgtgg

SEQ ID NO: 7994216 - DNA, 22 bp, Homo sapiens
ggaagaaagtagaaaaccgtgg

SEQ ID NO: 7994217 - DNA, 18 bp, Homo sapiens
ggaagaaaaggaactcag

SEQ ID NO: 7994218 - DNA, 22 bp, Homo sapiens
ggaagaaaagcttccagcgcct

SEQ ID NO: 7994219 - DNA, 18 bp, Homo sapiens
ggaagaaaaggaactcag

SEQ ID NO: 7994220 - DNA, 17 bp, Homo sapiens
ggaagaaaaggatcatc

SEQ ID NO: 7994221 - DNA, 17 bp, Homo sapiens
ggaagaaaaggatcatc

SEQ ID NO: 7994222 - DNA, 17 bp, Homo sapiens
ggaagaaaaggatcatc

SEQ ID NO: 7994223 - DNA, 17 bp, Homo sapiens
ggaagaaaaggatcatc

SEQ ID NO: 7994224 - DNA, 17 bp, Homo sapiens
ggaagaaaaggatcatc

SEQ ID NO: 7994225 - DNA, 22 bp, Homo sapiens
ggaactgggttagggtctcttc

SEQ ID NO: 7994226 - DNA, 22 bp, Homo sapiens
ggaacttatactgccagattct

SEQ ID NO: 7994227 - DNA, 22 bp, Homo sapiens
ggaacttgaaaatcaaggtggt

SEQ ID NO: 7994228 - DNA, 22 bp, Homo sapiens
ggaacttgcaacctctggtcac

SEQ ID NO: 7994229 - DNA, 22 bp, Homo sapiens
ggaactttttaacaagctgctg

SEQ ID NO: 7994230 - DNA, 21 bp, Homo sapiens
ggaactttcatgaatctagca

SEQ ID NO: 7994231 - DNA, 22 bp, Homo sapiens
ggaactttaggatcctggctca

SEQ ID NO: 7994232 - DNA, 19 bp, Homo sapiens
ggaacttggcctttaccca

SEQ ID NO: 7994233 - DNA, 22 bp, Homo sapiens
ggaactgaatgtctcggtataa

SEQ ID NO: 7994234 - DNA, 22 bp, Homo sapiens
ggaactgagaagcagctatgcc

SEQ ID NO: 7994235 - DNA, 22 bp, Homo sapiens
ggaactggagaatgccctcttt

SEQ ID NO: 7994236 - DNA, 22 bp, Homo sapiens
ggaactggagaatgccctcttt

SEQ ID NO: 7994237 - DNA, 22 bp, Homo sapiens
ggaactgattaagtcatgagaa

SEQ ID NO: 7994238 - DNA, 20 bp, Homo sapiens
ggaaacatttttatttccat

SEQ ID NO: 7994239 - DNA, 22 bp, Homo sapiens
ggaaacatgcctgctggacagt

SEQ ID NO: 7994240 - DNA, 22 bp, Homo sapiens
ggaaacatattctgatgtgcat

SEQ ID NO: 7994241 - DNA, 22 bp, Homo sapiens
ggaaacatgcctgctggacagt

SEQ ID NO: 7994242 - DNA, 22 bp, Homo sapiens
ggaaacatgcctgctggacagt

SEQ ID NO: 7994243 - DNA, 19 bp, Homo sapiens
ggaaacaggggccagagga

SEQ ID NO: 7994244 - DNA, 19 bp, Homo sapiens
ggaaacaggggccagagga

SEQ ID NO: 7994245 - DNA, 22 bp, Homo sapiens
ggaaacagcaaattatggcaat

SEQ ID NO: 7994246 - DNA, 22 bp, Homo sapiens
ggaaacagagggcacctgagcc

SEQ ID NO: 7994247 - DNA, 19 bp, Homo sapiens
ggaaacaggggccagagga

SEQ ID NO: 7994248 - DNA, 22 bp, Homo sapiens
ggaaacagctctttggggctgt

SEQ ID NO: 7994249 - DNA, 22 bp, Homo sapiens
ggaaaccaggactgcaccgtct

SEQ ID NO: 7994250 - DNA, 18 bp, Homo sapiens
ggaaaccacagggttctg

SEQ ID NO: 7994251 - DNA, 22 bp, Homo sapiens
ggaaactgagtgacactccctc

SEQ ID NO: 7994252 - DNA, 22 bp, Homo sapiens
ggaaactgagtgacactccctc

SEQ ID NO: 7994253 - DNA, 22 bp, Homo sapiens
ggaaactaaatcaagctggctt

SEQ ID NO: 7994254 - DNA, 22 bp, Homo sapiens
ggaaactaaatcaagctggctt

SEQ ID NO: 7994255 - DNA, 22 bp, Homo sapiens
ggaaactaaagaggtgtttttg

SEQ ID NO: 7994256 - DNA, 22 bp, Homo sapiens
ggaaacttggcataattttaag

SEQ ID NO: 7994257 - DNA, 22 bp, Homo sapiens
ggaaagaaagtgtgaacaactt

SEQ ID NO: 7994258 - DNA, 22 bp, Homo sapiens
ggaaactgtagtttgctgacat

SEQ ID NO: 7994259 - DNA, 22 bp, Homo sapiens
ggaaactgcttacactagaggg

SEQ ID NO: 7994260 - DNA, 22 bp, Homo sapiens
ggaaactgcttacactagaggg

SEQ ID NO: 7994261 - DNA, 22 bp, Homo sapiens
ggaaactgcttacactagaggg

SEQ ID NO: 7994262 - DNA, 22 bp, Homo sapiens
ggaaacacatgatcagacatct

SEQ ID NO: 7994263 - DNA, 22 bp, Homo sapiens
ggaaacacacccagagaagcag

SEQ ID NO: 7994264 - DNA, 22 bp, Homo sapiens
ggaaaacaagagaatgatgttt

SEQ ID NO: 7994265 - DNA, 22 bp, Homo sapiens
ggaaaacagcgattggtatcat

SEQ ID NO: 7994266 - DNA, 20 bp, Homo sapiens
ggaaaaatgcatgctcaaga

SEQ ID NO: 7994267 - DNA, 22 bp, Homo sapiens
gcttctggtgaggcctcaggaa

SEQ ID NO: 7994268 - DNA, 20 bp, Homo sapiens
ggaaaaatgcatgctcaaga

SEQ ID NO: 7994269 - DNA, 22 bp, Homo sapiens
ggaaaacaagagaatgatgttt

SEQ ID NO: 7994270 - DNA, 22 bp, Homo sapiens
gcttctggggttctggcatgct

SEQ ID NO: 7994271 - DNA, 22 bp, Homo sapiens
gcttctgggcacctgaacagga

SEQ ID NO: 7994272 - DNA, 22 bp, Homo sapiens
gcttctggggttctggcatgct

SEQ ID NO: 7994273 - DNA, 17 bp, Homo sapiens
gcttctggagcttctgt

SEQ ID NO: 7994274 - DNA, 17 bp, Homo sapiens
gcttctggagcttctgt

SEQ ID NO: 7994275 - DNA, 22 bp, Homo sapiens
gcttctggaagctgcttctgcc

SEQ ID NO: 7994276 - DNA, 22 bp, Homo sapiens
gcttctggaggagctgggctga

SEQ ID NO: 7994277 - DNA, 22 bp, Homo sapiens
gcttctggaggagctgggctga

SEQ ID NO: 7994278 - DNA, 23 bp, Homo sapiens
ggaaagagaggagttgtgcatag

SEQ ID NO: 7994279 - DNA, 22 bp, Homo sapiens
ggaaagagaagttgggaggaat

SEQ ID NO: 7994280 - DNA, 22 bp, Homo sapiens
ggaaagagcccagcagtgcttg

SEQ ID NO: 7994281 - DNA, 22 bp, Homo sapiens
ggaaagagcccagcagtgcttg

SEQ ID NO: 7994282 - DNA, 22 bp, Homo sapiens
ggaaagagaagttgggaggaat

SEQ ID NO: 7994283 - DNA, 22 bp, Homo sapiens
ggaaagagaagttgggaggaat

SEQ ID NO: 7994284 - DNA, 22 bp, Homo sapiens
ggaaagagaagttgggaggaat

SEQ ID NO: 7994285 - DNA, 22 bp, Homo sapiens
ggaaagagaagttgggaggaat

SEQ ID NO: 7994286 - DNA, 22 bp, Homo sapiens
ggaaagaatcaagtgatcctgt

SEQ ID NO: 7994287 - DNA, 22 bp, Homo sapiens
ggaaagaatcaagtgatcctgt

SEQ ID NO: 7994288 - DNA, 22 bp, Homo sapiens
ggaaagaaccctggatggctgg

SEQ ID NO: 7994289 - DNA, 22 bp, Homo sapiens
ggaaagaaccctggatggctgg

SEQ ID NO: 7994290 - DNA, 22 bp, Homo sapiens
ggaaagaaagtgtgaacaactt

SEQ ID NO: 7994291 - DNA, 22 bp, Homo sapiens
ggaaagaaagtgtgaacaactt

SEQ ID NO: 7994292 - DNA, 21 bp, Homo sapiens
ggaaagaaggcaaggctcagg

SEQ ID NO: 7994293 - DNA, 22 bp, Homo sapiens
ggaaagaaccctggatggctgg

SEQ ID NO: 7994294 - DNA, 22 bp, Homo sapiens
ggaaagaatagagactttatca

SEQ ID NO: 7994295 - DNA, 22 bp, Homo sapiens
ggaaagaatagagactttatca

SEQ ID NO: 7994296 - DNA, 22 bp, Homo sapiens
ggaaagaatagagactttatca

SEQ ID NO: 7994297 - DNA, 22 bp, Homo sapiens
ggaaagaatagagactttatca

SEQ ID NO: 7994298 - DNA, 21 bp, Homo sapiens
ggaaagaaggcaaggctcagg

SEQ ID NO: 7994299 - DNA, 21 bp, Homo sapiens
ggaaagaaggcaaggctcagg

SEQ ID NO: 7994300 - DNA, 21 bp, Homo sapiens
ggaaagaaggcaaggctcagg

SEQ ID NO: 7994301 - DNA, 21 bp, Homo sapiens
ggaaagaaggcaaggctcagg

SEQ ID NO: 7994302 - DNA, 21 bp, Homo sapiens
ggaaagaaggcaaggctcagg

SEQ ID NO: 7994303 - DNA, 22 bp, Homo sapiens
ggaaagagctaaaagggtgaga

SEQ ID NO: 7994304 - DNA, 22 bp, Homo sapiens
ggaaagagctaaaagggtgaga

SEQ ID NO: 7994305 - DNA, 22 bp, Homo sapiens
ggaaagagctaaaagggtgaga

SEQ ID NO: 7994306 - DNA, 22 bp, Homo sapiens
ggaaagaggatagtgggtaggt

SEQ ID NO: 7994307 - DNA, 22 bp, Homo sapiens
ggaaagaggatagtgggtaggt

SEQ ID NO: 7994308 - DNA, 22 bp, Homo sapiens
ggaaagaggatagtgggtaggt

SEQ ID NO: 7994309 - DNA, 22 bp, Homo sapiens
ggaaagatttgtcacatgaatg

SEQ ID NO: 7994310 - DNA, 22 bp, Homo sapiens
ggaaagaggatagtgggtaggt

SEQ ID NO: 7994311 - DNA, 22 bp, Homo sapiens
ggaaagagggacccagcttggt

SEQ ID NO: 7994312 - DNA, 22 bp, Homo sapiens
ggaactcctgctccaagcagct

SEQ ID NO: 7994313 - DNA, 22 bp, Homo sapiens
ggaactcctgctccaagcagct

SEQ ID NO: 7994314 - DNA, 22 bp, Homo sapiens
ggaactcagtatcagactccag

SEQ ID NO: 7994315 - DNA, 22 bp, Homo sapiens
ggaactcctgctccaagcagct

SEQ ID NO: 7994316 - DNA, 22 bp, Homo sapiens
ggaactcctgctccaagcagct

SEQ ID NO: 7994317 - DNA, 22 bp, Homo sapiens
ggaactgaatgtctcggtataa

SEQ ID NO: 7994318 - DNA, 22 bp, Homo sapiens
ggaactgaatgtctcggtataa

SEQ ID NO: 7994319 - DNA, 22 bp, Homo sapiens
ggaaagcatccaggtgccccca

SEQ ID NO: 7994320 - DNA, 22 bp, Homo sapiens
ggaaagatttgtcacatgaatg

SEQ ID NO: 7994321 - DNA, 22 bp, Homo sapiens
ggaaagccaggtgctctggtgt

SEQ ID NO: 7994322 - DNA, 22 bp, Homo sapiens
ggaaagcatccaggtgccccca

SEQ ID NO: 7994323 - DNA, 22 bp, Homo sapiens
ggaacctttgtgctccactggg

SEQ ID NO: 7994324 - DNA, 22 bp, Homo sapiens
ggaacctttgtgaagggagagg

SEQ ID NO: 7994325 - DNA, 22 bp, Homo sapiens
ggaacctttctccaggttgtag

SEQ ID NO: 7994326 - DNA, 19 bp, Homo sapiens
ggaaccttggagcttcggc

SEQ ID NO: 7994327 - DNA, 22 bp, Homo sapiens
ggaaagctcagatcttgttgga

SEQ ID NO: 7994328 - DNA, 22 bp, Homo sapiens
ggaactattgctctagcaatag

SEQ ID NO: 7994329 - DNA, 22 bp, Homo sapiens
ggagggtggcagcgtcctgggc

SEQ ID NO: 7994330 - DNA, 22 bp, Homo sapiens
ggagggtggcagcgtcctgggc

SEQ ID NO: 7994331 - DNA, 22 bp, Homo sapiens
ggagggtggcagcgtcctgggc

SEQ ID NO: 7994332 - DNA, 22 bp, Homo sapiens
ggagggtggcagcgtcctgggc

SEQ ID NO: 7994333 - DNA, 22 bp, Homo sapiens
ggagggtggcagcgtcctgggc

SEQ ID NO: 7994334 - DNA, 20 bp, Homo sapiens
ggagggtggaagaaagcaag

SEQ ID NO: 7994335 - DNA, 22 bp, Homo sapiens
ggagggtggcagcgtcctgggc

SEQ ID NO: 7994336 - DNA, 20 bp, Homo sapiens
ggagggtggaagaaagcaag

SEQ ID NO: 7994337 - DNA, 20 bp, Homo sapiens
ggagggtggaagaaagcaag

SEQ ID NO: 7994338 - DNA, 20 bp, Homo sapiens
ggagggtggaagaaagcaag

SEQ ID NO: 7994339 - DNA, 20 bp, Homo sapiens
ggagggtggaagaaagcaag

SEQ ID NO: 7994340 - DNA, 22 bp, Homo sapiens
ggaggtagcctcaaaagcagct

SEQ ID NO: 7994341 - DNA, 22 bp, Homo sapiens
ggaggtagtctgagtcataggc

SEQ ID NO: 7994342 - DNA, 22 bp, Homo sapiens
ggaggtagtctgagtcataggc

SEQ ID NO: 7994343 - DNA, 22 bp, Homo sapiens
ggagggttgggacaccagggtc

SEQ ID NO: 7994344 - DNA, 22 bp, Homo sapiens
ggagggttagcaaaggcacaga

SEQ ID NO: 7994345 - DNA, 22 bp, Homo sapiens
ggagggtgggtcattcttacat

SEQ ID NO: 7994346 - DNA, 22 bp, Homo sapiens
ggaggtcaaatggagggctggg

SEQ ID NO: 7994347 - DNA, 22 bp, Homo sapiens
ggaggtcaaatggagggctggg

SEQ ID NO: 7994348 - DNA, 22 bp, Homo sapiens
ggaggtcaaatggagggctggg

SEQ ID NO: 7994349 - DNA, 20 bp, Homo sapiens
ggaggtcaaatgatgagaag

SEQ ID NO: 7994350 - DNA, 20 bp, Homo sapiens
ggaggtcaaatgatgagaag

SEQ ID NO: 7994351 - DNA, 22 bp, Homo sapiens
ggaggtatttgtcaatctgttt

SEQ ID NO: 7994352 - DNA, 22 bp, Homo sapiens
ggaggtatgatagctgtgtcct

SEQ ID NO: 7994353 - DNA, 22 bp, Homo sapiens
ggaggtcccaggcctggcagca

SEQ ID NO: 7994354 - DNA, 22 bp, Homo sapiens
ggaggtcccaggcctggcagca

SEQ ID NO: 7994355 - DNA, 22 bp, Homo sapiens
ggaggtggaggttgcagtgagc

SEQ ID NO: 7994356 - DNA, 22 bp, Homo sapiens
ggaggtcccaggcctggcagca

SEQ ID NO: 7994357 - DNA, 22 bp, Homo sapiens
ggaggtcatagctgtgcaggta

SEQ ID NO: 7994358 - DNA, 22 bp, Homo sapiens
ggaggtcatagctgtgcaggta

SEQ ID NO: 7994359 - DNA, 22 bp, Homo sapiens
ggaggtcataagtgtatagatg

SEQ ID NO: 7994360 - DNA, 22 bp, Homo sapiens
ggaggtcatagctgtgcaggta

SEQ ID NO: 7994361 - DNA, 22 bp, Homo sapiens
ggaggtcaaatggagggctggg

SEQ ID NO: 7994362 - DNA, 22 bp, Homo sapiens
ggaggtggcagagggacattct

SEQ ID NO: 7994363 - DNA, 22 bp, Homo sapiens
ggaggtggcagagggacattct

SEQ ID NO: 7994364 - DNA, 22 bp, Homo sapiens
ggaggtggcagagggacattct

SEQ ID NO: 7994365 - DNA, 22 bp, Homo sapiens
ggaggtggcagagggacattct

SEQ ID NO: 7994366 - DNA, 22 bp, Homo sapiens
ggaggtggcagagggacattct

SEQ ID NO: 7994367 - DNA, 22 bp, Homo sapiens
ggaggtggcagagggacattct

SEQ ID NO: 7994368 - DNA, 22 bp, Homo sapiens
ggaggtggcagagggacattct

SEQ ID NO: 7994369 - DNA, 22 bp, Homo sapiens
ggaggtggaggttgcagtgagc

SEQ ID NO: 7994370 - DNA, 22 bp, Homo sapiens
ggaggtggaggttgcagtgagc

SEQ ID NO: 7994371 - DNA, 22 bp, Homo sapiens
ggaggtggaggttgcagtgagc

SEQ ID NO: 7994372 - DNA, 22 bp, Homo sapiens
ggaggtggaggttgcagtgagc

SEQ ID NO: 7994373 - DNA, 22 bp, Homo sapiens
ggaggtggaggttgcagtgagc

SEQ ID NO: 7994374 - DNA, 22 bp, Homo sapiens
ggaggtgggattaggacctaaa

SEQ ID NO: 7994375 - DNA, 22 bp, Homo sapiens
ggaggtgggattaggacctaaa

SEQ ID NO: 7994376 - DNA, 22 bp, Homo sapiens
ggaggtgggattaggacctaaa

SEQ ID NO: 7994377 - DNA, 22 bp, Homo sapiens
ggaggtgggattaggacctaaa

SEQ ID NO: 7994378 - DNA, 22 bp, Homo sapiens
ggaggtgggattaggacctaaa

SEQ ID NO: 7994379 - DNA, 22 bp, Homo sapiens
ggaggtgggattaggacctaaa

SEQ ID NO: 7994380 - DNA, 22 bp, Homo sapiens
ggaggtgggattaggacctaaa

SEQ ID NO: 7994381 - DNA, 22 bp, Homo sapiens
ggaggtgggattaggacctaaa

SEQ ID NO: 7994382 - DNA, 22 bp, Homo sapiens
ggaggtgggagcctccagtggt

SEQ ID NO: 7994383 - DNA, 22 bp, Homo sapiens
ggaggtgggagtttagttcttg

SEQ ID NO: 7994384 - DNA, 22 bp, Homo sapiens
ggaggtgggagcctccagtggt

SEQ ID NO: 7994385 - DNA, 22 bp, Homo sapiens
ggaggtgggagcctccagtggt

SEQ ID NO: 7994386 - DNA, 22 bp, Homo sapiens
ggaggtgggagcctccagtggt

SEQ ID NO: 7994387 - DNA, 22 bp, Homo sapiens
ggaggtgggagcctccagtggt

SEQ ID NO: 7994388 - DNA, 22 bp, Homo sapiens
ggaggtgggagcctccagtggt

SEQ ID NO: 7994389 - DNA, 22 bp, Homo sapiens
ggaggtgggagcctccagtggt

SEQ ID NO: 7994390 - DNA, 22 bp, Homo sapiens
ggaggtgggagcctccagtggt

SEQ ID NO: 7994391 - DNA, 22 bp, Homo sapiens
ggaggtgggagacataggcggc

SEQ ID NO: 7994392 - DNA, 22 bp, Homo sapiens
ggaggtgggagacataggcggc

SEQ ID NO: 7994393 - DNA, 22 bp, Homo sapiens
ggaggtgggagacataggcggc

SEQ ID NO: 7994394 - DNA, 22 bp, Homo sapiens
ggaggtgggagacataggcggc

SEQ ID NO: 7994395 - DNA, 22 bp, Homo sapiens
ggaggtgggagacataggcggc

SEQ ID NO: 7994396 - DNA, 22 bp, Homo sapiens
ggaggtgggagacataggcggc

SEQ ID NO: 7994397 - DNA, 22 bp, Homo sapiens
ggaggtgggagacataggcggc

SEQ ID NO: 7994398 - DNA, 22 bp, Homo sapiens
ggaggtggcctgaaaatgtggc

SEQ ID NO: 7994399 - DNA, 22 bp, Homo sapiens
ggaggtggcagagggacattct

SEQ ID NO: 7994400 - DNA, 22 bp, Homo sapiens
ggaggtggcagggaacataatt

SEQ ID NO: 7994401 - DNA, 22 bp, Homo sapiens
ggaggtggcctgaaaatgtggc

SEQ ID NO: 7994402 - DNA, 22 bp, Homo sapiens
ggaggtggcctgaaaatgtggc

SEQ ID NO: 7994403 - DNA, 22 bp, Homo sapiens
ggaggtggcctgaaaatgtggc

SEQ ID NO: 7994404 - DNA, 22 bp, Homo sapiens
ggaggtggcctgaaaatgtggc

SEQ ID NO: 7994405 - DNA, 22 bp, Homo sapiens
ggaggtgggctaaggactctct

SEQ ID NO: 7994406 - DNA, 22 bp, Homo sapiens
ggaggtgggctaaggactctct

SEQ ID NO: 7994407 - DNA, 22 bp, Homo sapiens
ggaggtgggctaaggactctct

SEQ ID NO: 7994408 - DNA, 22 bp, Homo sapiens
ggaggtgggctaaggactctct

SEQ ID NO: 7994409 - DNA, 22 bp, Homo sapiens
ggaggtgggctaaggactctct

SEQ ID NO: 7994410 - DNA, 22 bp, Homo sapiens
ggaggtgggctaaggactctct

SEQ ID NO: 7994411 - DNA, 22 bp, Homo sapiens
ggaggtgggctaaggactctct

SEQ ID NO: 7994412 - DNA, 22 bp, Homo sapiens
ggaggtgggctaaggactctct

SEQ ID NO: 7994413 - DNA, 22 bp, Homo sapiens
ggaggtggtggcagtgacaatt

SEQ ID NO: 7994414 - DNA, 22 bp, Homo sapiens
ggaggtggtggcagtgacaatt

SEQ ID NO: 7994415 - DNA, 22 bp, Homo sapiens
ggaggtggtggcagtgacaatt

SEQ ID NO: 7994416 - DNA, 22 bp, Homo sapiens
ggaggtgggctaaggactctct

SEQ ID NO: 7994417 - DNA, 22 bp, Homo sapiens
ggagtagctgcattccgagcac

SEQ ID NO: 7994418 - DNA, 22 bp, Homo sapiens
ggagtaggagtagaactcatca

SEQ ID NO: 7994419 - DNA, 22 bp, Homo sapiens
ggaggttctctctttgcagagc

SEQ ID NO: 7994420 - DNA, 22 bp, Homo sapiens
ggagtaaggctcagaggaaatg

SEQ ID NO: 7994421 - DNA, 22 bp, Homo sapiens
ggaggtggtttgatttctatat

SEQ ID NO: 7994422 - DNA, 22 bp, Homo sapiens
ggaggtggtggcagtgacaatt

SEQ ID NO: 7994423 - DNA, 22 bp, Homo sapiens
ggagggggaattcagccccagc

SEQ ID NO: 7994424 - DNA, 22 bp, Homo sapiens
ggagggggaattcagccccagc

SEQ ID NO: 7994425 - DNA, 22 bp, Homo sapiens
ggagggggaattcagccccagc

SEQ ID NO: 7994426 - DNA, 22 bp, Homo sapiens
ggagggggaattcagccccagc

SEQ ID NO: 7994427 - DNA, 22 bp, Homo sapiens
ggagggggaagaagctaaagac

SEQ ID NO: 7994428 - DNA, 22 bp, Homo sapiens
ggagggggaagaagctaaagac

SEQ ID NO: 7994429 - DNA, 22 bp, Homo sapiens
ggagggggaagaagctaaagac

SEQ ID NO: 7994430 - DNA, 22 bp, Homo sapiens
ggagggggaagaagctaaagac

SEQ ID NO: 7994431 - DNA, 22 bp, Homo sapiens
ggaggggagtctcccaaagccg

SEQ ID NO: 7994432 - DNA, 22 bp, Homo sapiens
ggaggggctcctgttcgccccc

SEQ ID NO: 7994433 - DNA, 22 bp, Homo sapiens
ggagggggaaactttggctgcc

SEQ ID NO: 7994434 - DNA, 22 bp, Homo sapiens
ggagggggaaactttggctgcc

SEQ ID NO: 7994435 - DNA, 22 bp, Homo sapiens
ggagggggaaactttggctgcc

SEQ ID NO: 7994436 - DNA, 22 bp, Homo sapiens
ggagggggaaactttggctgcc

SEQ ID NO: 7994437 - DNA, 22 bp, Homo sapiens
ggaggggctcctgttcgccccc

SEQ ID NO: 7994438 - DNA, 22 bp, Homo sapiens
ggagggggaaactttggctgcc

SEQ ID NO: 7994439 - DNA, 22 bp, Homo sapiens
ggaggggaggtccagctgatct

SEQ ID NO: 7994440 - DNA, 22 bp, Homo sapiens
ggaggggaggtccagctgatct

SEQ ID NO: 7994441 - DNA, 22 bp, Homo sapiens
ggaggggaggtccagctgatct

SEQ ID NO: 7994442 - DNA, 22 bp, Homo sapiens
ggaggggaggtccagctgatct

SEQ ID NO: 7994443 - DNA, 22 bp, Homo sapiens
ggaggggaggtccagctgatct

SEQ ID NO: 7994444 - DNA, 22 bp, Homo sapiens
ggaggggagtctcccaaagccg

SEQ ID NO: 7994445 - DNA, 22 bp, Homo sapiens
ggaggggagtctcccaaagccg

SEQ ID NO: 7994446 - DNA, 22 bp, Homo sapiens
ggaggggagtctcccaaagccg

SEQ ID NO: 7994447 - DNA, 22 bp, Homo sapiens
ggaggggagtctcccaaagccg

SEQ ID NO: 7994448 - DNA, 22 bp, Homo sapiens
ggaggggagtctcccaaagccg

SEQ ID NO: 7994449 - DNA, 22 bp, Homo sapiens
ggaggggaggattaatgacaaa

SEQ ID NO: 7994450 - DNA, 22 bp, Homo sapiens
ggaggggaggattaatgacaaa

SEQ ID NO: 7994451 - DNA, 22 bp, Homo sapiens
ggaggggaggattaatgacaaa

SEQ ID NO: 7994452 - DNA, 22 bp, Homo sapiens
ggaggggaggattaatgacaaa

SEQ ID NO: 7994453 - DNA, 22 bp, Homo sapiens
ggaggggaggattaatgacaaa

SEQ ID NO: 7994454 - DNA, 22 bp, Homo sapiens
ggaggggagatgtttgggctca

SEQ ID NO: 7994455 - DNA, 22 bp, Homo sapiens
ggaggggaggattaatgacaaa

SEQ ID NO: 7994456 - DNA, 22 bp, Homo sapiens
ggaggggagatgtttgggctca

SEQ ID NO: 7994457 - DNA, 22 bp, Homo sapiens
ggaggggagatgtttgggctca

SEQ ID NO: 7994458 - DNA, 22 bp, Homo sapiens
ggaggggagatgtttgggctca

SEQ ID NO: 7994459 - DNA, 22 bp, Homo sapiens
ggaggggagatgtttgggctca

SEQ ID NO: 7994460 - DNA, 22 bp, Homo sapiens
ggagggggactgacactgattt

SEQ ID NO: 7994461 - DNA, 22 bp, Homo sapiens
ggagggggactgacactgattt

SEQ ID NO: 7994462 - DNA, 22 bp, Homo sapiens
ggagggggactgacactgattt

SEQ ID NO: 7994463 - DNA, 22 bp, Homo sapiens
ggaggggtctctagcgaggaga

SEQ ID NO: 7994464 - DNA, 22 bp, Homo sapiens
ggaggggtctctagcgaggaga

SEQ ID NO: 7994465 - DNA, 22 bp, Homo sapiens
ggaggggtctctagcgaggaga

SEQ ID NO: 7994466 - DNA, 22 bp, Homo sapiens
ggaggggtctctagcgaggaga

SEQ ID NO: 7994467 - DNA, 22 bp, Homo sapiens
ggaggggtctctagcgaggaga

SEQ ID NO: 7994468 - DNA, 22 bp, Homo sapiens
ggaggggtctctagcgaggaga

SEQ ID NO: 7994469 - DNA, 22 bp, Homo sapiens
ggaggggtctctagcgaggaga

SEQ ID NO: 7994470 - DNA, 22 bp, Homo sapiens
ggaggggtgctcagctgtcacg

SEQ ID NO: 7994471 - DNA, 22 bp, Homo sapiens
ggaggggtgctcagctgtcacg

SEQ ID NO: 7994472 - DNA, 22 bp, Homo sapiens
ggaggggtggaaggagtgcctg

SEQ ID NO: 7994473 - DNA, 22 bp, Homo sapiens
ggaggggtggaaggagtgcctg

SEQ ID NO: 7994474 - DNA, 22 bp, Homo sapiens
ggaggggtgagaatggctgcct

SEQ ID NO: 7994475 - DNA, 22 bp, Homo sapiens
ggaggggtgagaatggctgcct

SEQ ID NO: 7994476 - DNA, 22 bp, Homo sapiens
ggaggggtgagaatggctgcct

SEQ ID NO: 7994477 - DNA, 22 bp, Homo sapiens
ggaggggtgagaatggctgcct

SEQ ID NO: 7994478 - DNA, 22 bp, Homo sapiens
ggaggggtgagaatggctgcct

SEQ ID NO: 7994479 - DNA, 22 bp, Homo sapiens
ggagggtccatcttgtgaaaag

SEQ ID NO: 7994480 - DNA, 22 bp, Homo sapiens
ggagggtccccagcagcatgaa

SEQ ID NO: 7994481 - DNA, 22 bp, Homo sapiens
ggagggtctaagggagaactga

SEQ ID NO: 7994482 - DNA, 22 bp, Homo sapiens
ggagggtgcagaccctttgcaa

SEQ ID NO: 7994483 - DNA, 22 bp, Homo sapiens
ggagggtctaagggagaactga

SEQ ID NO: 7994484 - DNA, 22 bp, Homo sapiens
ggagggtgcattttaccctgtg

SEQ ID NO: 7994485 - DNA, 22 bp, Homo sapiens
ggagggtgcattttaccctgtg

SEQ ID NO: 7994486 - DNA, 22 bp, Homo sapiens
ggagggtgcattttaccctgtg

SEQ ID NO: 7994487 - DNA, 22 bp, Homo sapiens
ggagggtgcttaagttgtgttt

SEQ ID NO: 7994488 - DNA, 22 bp, Homo sapiens
ggagggtgcttaagttgtgttt

SEQ ID NO: 7994489 - DNA, 22 bp, Homo sapiens
ggagggtgcttaagttgtgttt

SEQ ID NO: 7994490 - DNA, 22 bp, Homo sapiens
ggagggtccactgtgaggcaga

SEQ ID NO: 7994491 - DNA, 22 bp, Homo sapiens
ggagggtccactgtgaggcaga

SEQ ID NO: 7994492 - DNA, 22 bp, Homo sapiens
ggagggtccactgtgaggcaga

SEQ ID NO: 7994493 - DNA, 22 bp, Homo sapiens
ggaggggtggtcgcgaagagca

SEQ ID NO: 7994494 - DNA, 22 bp, Homo sapiens
ggagggtccactgtgaggcaga

SEQ ID NO: 7994495 - DNA, 22 bp, Homo sapiens
ggaggggtggaaggagtgcctg

SEQ ID NO: 7994496 - DNA, 22 bp, Homo sapiens
ggaggggtggaaggagtgcctg

SEQ ID NO: 7994497 - DNA, 22 bp, Homo sapiens
ggaggggtggtcacctggcagg

SEQ ID NO: 7994498 - DNA, 22 bp, Homo sapiens
ggaggggtggtcacctggcagg

SEQ ID NO: 7994499 - DNA, 22 bp, Homo sapiens
ggaggggtggtcacctggcagg

SEQ ID NO: 7994500 - DNA, 22 bp, Homo sapiens
ggagggctgtagaggagacctg

SEQ ID NO: 7994501 - DNA, 23 bp, Homo sapiens
ggagggcttcatcagacccccag

SEQ ID NO: 7994502 - DNA, 18 bp, Homo sapiens
ggagggctttggggactg

SEQ ID NO: 7994503 - DNA, 18 bp, Homo sapiens
ggagggctttggggactg

SEQ ID NO: 7994504 - DNA, 22 bp, Homo sapiens
ggaggggaactaatcccgtgac

SEQ ID NO: 7994505 - DNA, 22 bp, Homo sapiens
ggaggggaactaatcccgtgac

SEQ ID NO: 7994506 - DNA, 22 bp, Homo sapiens
ggaggggaactaatcccgtgac

SEQ ID NO: 7994507 - DNA, 22 bp, Homo sapiens
ggagggctgtagaggagacctg

SEQ ID NO: 7994508 - DNA, 22 bp, Homo sapiens
ggagggctgtagaggagacctg

SEQ ID NO: 7994509 - DNA, 22 bp, Homo sapiens
ggagggctgtagaggagacctg

SEQ ID NO: 7994510 - DNA, 22 bp, Homo sapiens
ggagggctgccaggtggagcgg

SEQ ID NO: 7994511 - DNA, 22 bp, Homo sapiens
ggagggctgccaggtggagcgg

SEQ ID NO: 7994512 - DNA, 22 bp, Homo sapiens
ggagggctgccaggtggagcgg

SEQ ID NO: 7994513 - DNA, 22 bp, Homo sapiens
ggagggctgccaggtggagcgg

SEQ ID NO: 7994514 - DNA, 22 bp, Homo sapiens
ggagggctgccaggtggagcgg

SEQ ID NO: 7994515 - DNA, 22 bp, Homo sapiens
ggagggctgccaggtggagcgg

SEQ ID NO: 7994516 - DNA, 22 bp, Homo sapiens
ggagggctccctgggagtggat

SEQ ID NO: 7994517 - DNA, 22 bp, Homo sapiens
ggagggctccctgggagtggat

SEQ ID NO: 7994518 - DNA, 22 bp, Homo sapiens
ggagggccctgggtgcagctct

SEQ ID NO: 7994519 - DNA, 22 bp, Homo sapiens
ggagggctcaattgactcctga

SEQ ID NO: 7994520 - DNA, 22 bp, Homo sapiens
ggagggctcaattgactcctga

SEQ ID NO: 7994521 - DNA, 22 bp, Homo sapiens
ggagggctccctgggagtggat

SEQ ID NO: 7994522 - DNA, 22 bp, Homo sapiens
ggagggctcaattgactcctga

SEQ ID NO: 7994523 - DNA, 22 bp, Homo sapiens
ggagggctgagactggggtctg

SEQ ID NO: 7994524 - DNA, 22 bp, Homo sapiens
ggagggctcgtcatccaccact

SEQ ID NO: 7994525 - DNA, 22 bp, Homo sapiens
ggagggctcgtcatccaccact

SEQ ID NO: 7994526 - DNA, 22 bp, Homo sapiens
ggagggctccctgggagtggat

SEQ ID NO: 7994527 - DNA, 22 bp, Homo sapiens
ggagggctccctgggagtggat

SEQ ID NO: 7994528 - DNA, 22 bp, Homo sapiens
ggagggctcgtcatccaccact

SEQ ID NO: 7994529 - DNA, 22 bp, Homo sapiens
ggagggctgccaggtggagcgg

SEQ ID NO: 7994530 - DNA, 22 bp, Homo sapiens
ggagggctgagactggggtctg

SEQ ID NO: 7994531 - DNA, 22 bp, Homo sapiens
ggagggcccctccagtgggcag

SEQ ID NO: 7994532 - DNA, 22 bp, Homo sapiens
ggagggcccctccagtgggcag

SEQ ID NO: 7994533 - DNA, 22 bp, Homo sapiens
ggagggcccctccagtgggcag

SEQ ID NO: 7994534 - DNA, 22 bp, Homo sapiens
ggagggccatcttgggtgtgat

SEQ ID NO: 7994535 - DNA, 22 bp, Homo sapiens
ggagggcccctccagtgggcag

SEQ ID NO: 7994536 - DNA, 22 bp, Homo sapiens
ggagggcatcaatcaggcctgg

SEQ ID NO: 7994537 - DNA, 22 bp, Homo sapiens
ggagggcatcaatcaggcctgg

SEQ ID NO: 7994538 - DNA, 21 bp, Homo sapiens
ggagggcagcccagactggct

SEQ ID NO: 7994539 - DNA, 21 bp, Homo sapiens
ggagggcagcccagactggct

SEQ ID NO: 7994540 - DNA, 21 bp, Homo sapiens
ggagggcagcccagactggct

SEQ ID NO: 7994541 - DNA, 21 bp, Homo sapiens
ggagggcagcccagactggct

SEQ ID NO: 7994542 - DNA, 21 bp, Homo sapiens
ggagggcagcccagactggct

SEQ ID NO: 7994543 - DNA, 22 bp, Homo sapiens
ggagggcatcaatcaggcctgg

SEQ ID NO: 7994544 - DNA, 22 bp, Homo sapiens
ggagggcatcaatcaggcctgg

SEQ ID NO: 7994545 - DNA, 22 bp, Homo sapiens
ggagggcatcaatcaggcctgg

SEQ ID NO: 7994546 - DNA, 21 bp, Homo sapiens
ggagggcagcccagactggct

SEQ ID NO: 7994547 - DNA, 20 bp, Homo sapiens
ggagggcagctgagagttgg

SEQ ID NO: 7994548 - DNA, 20 bp, Homo sapiens
ggagggcagctgagagttgg

SEQ ID NO: 7994549 - DNA, 20 bp, Homo sapiens
ggagggcagctgagagttgg

SEQ ID NO: 7994550 - DNA, 20 bp, Homo sapiens
ggagggcagctgagagttgg

SEQ ID NO: 7994551 - DNA, 22 bp, Homo sapiens
ggagggaatgtctagcattctt

SEQ ID NO: 7994552 - DNA, 22 bp, Homo sapiens
ggagggaatgtctagcattctt

SEQ ID NO: 7994553 - DNA, 22 bp, Homo sapiens
ggagggaagtgagttctcagct

SEQ ID NO: 7994554 - DNA, 22 bp, Homo sapiens
ggaggcttgatgatcttggata

SEQ ID NO: 7994555 - DNA, 22 bp, Homo sapiens
ggagggacccactctagaggtg

SEQ ID NO: 7994556 - DNA, 22 bp, Homo sapiens
ggagggacccactctagaggtg

SEQ ID NO: 7994557 - DNA, 22 bp, Homo sapiens
ggagggacccactctagaggtg

SEQ ID NO: 7994558 - DNA, 22 bp, Homo sapiens
ggagggacccactctagaggtg

SEQ ID NO: 7994559 - DNA, 22 bp, Homo sapiens
ggagggacccactctagaggtg

SEQ ID NO: 7994560 - DNA, 22 bp, Homo sapiens
ggagggcacaggaccagaaatc

SEQ ID NO: 7994561 - DNA, 22 bp, Homo sapiens
ggagggcagagtcccctgctga

SEQ ID NO: 7994562 - DNA, 22 bp, Homo sapiens
ggagggcagagtcccctgctga

SEQ ID NO: 7994563 - DNA, 22 bp, Homo sapiens
ggagggcacaggaccagaaatc

SEQ ID NO: 7994564 - DNA, 22 bp, Homo sapiens
ggagggagagtgaccctaccaa

SEQ ID NO: 7994565 - DNA, 22 bp, Homo sapiens
ggagggagagtgaccctaccaa

SEQ ID NO: 7994566 - DNA, 22 bp, Homo sapiens
ggagggagcagagaacccaacc

SEQ ID NO: 7994567 - DNA, 22 bp, Homo sapiens
ggagggagagtgaccctaccaa

SEQ ID NO: 7994568 - DNA, 22 bp, Homo sapiens
ggagggacccactgcggtgacc

SEQ ID NO: 7994569 - DNA, 22 bp, Homo sapiens
ggagggacccactgcggtgacc

SEQ ID NO: 7994570 - DNA, 22 bp, Homo sapiens
ggagggacccactgcggtgacc

SEQ ID NO: 7994571 - DNA, 22 bp, Homo sapiens
ggagggagagtgaccctaccaa

SEQ ID NO: 7994572 - DNA, 22 bp, Homo sapiens
ggagggagagtgaccctaccaa

SEQ ID NO: 7994573 - DNA, 22 bp, Homo sapiens
ggagggagagtgaccctaccaa

SEQ ID NO: 7994574 - DNA, 22 bp, Homo sapiens
ggaggcctagccagctccagtt

SEQ ID NO: 7994575 - DNA, 22 bp, Homo sapiens
ggaggcctagccagctccagtt

SEQ ID NO: 7994576 - DNA, 22 bp, Homo sapiens
ggaggcctagaaaagtggttct

SEQ ID NO: 7994577 - DNA, 22 bp, Homo sapiens
ggaggcctagccagctccagtt

SEQ ID NO: 7994578 - DNA, 22 bp, Homo sapiens
ggaggcctagccagctccagtt

SEQ ID NO: 7994579 - DNA, 22 bp, Homo sapiens
ggaggcccagagaggtgaagtg

SEQ ID NO: 7994580 - DNA, 22 bp, Homo sapiens
ggaggcctagaaaagtggttct

SEQ ID NO: 7994581 - DNA, 22 bp, Homo sapiens
ggaggcccagaaggaagcccag

SEQ ID NO: 7994582 - DNA, 22 bp, Homo sapiens
ggaggcccagaaggaagcccag

SEQ ID NO: 7994583 - DNA, 22 bp, Homo sapiens
ggaggccatgggcagaatcttt

SEQ ID NO: 7994584 - DNA, 22 bp, Homo sapiens
ggaggccatgaggctctaggtg

SEQ ID NO: 7994585 - DNA, 22 bp, Homo sapiens
ggaggccatgggcagaatcttt

SEQ ID NO: 7994586 - DNA, 22 bp, Homo sapiens
ggaggcctcctgggggaggttc

SEQ ID NO: 7994587 - DNA, 22 bp, Homo sapiens
ggaggcctcctgggggaggttc

SEQ ID NO: 7994588 - DNA, 22 bp, Homo sapiens
ggaggcctcagtaccttgcttt

SEQ ID NO: 7994589 - DNA, 22 bp, Homo sapiens
ggaggcctcagtaccttgcttt

SEQ ID NO: 7994590 - DNA, 22 bp, Homo sapiens
ggaggcctagccagctccagtt

SEQ ID NO: 7994591 - DNA, 22 bp, Homo sapiens
ggaggccttgaggccaggagct

SEQ ID NO: 7994592 - DNA, 22 bp, Homo sapiens
ggaggccttgaggccaggagct

SEQ ID NO: 7994593 - DNA, 22 bp, Homo sapiens
ggaggcctggacttcctgatgg

SEQ ID NO: 7994594 - DNA, 22 bp, Homo sapiens
ggaggcctggacttcctgatgg

SEQ ID NO: 7994595 - DNA, 22 bp, Homo sapiens
ggaggcggaggttgcagtgagc

SEQ ID NO: 7994596 - DNA, 22 bp, Homo sapiens
ggaggcggaggttgcagtgagc

SEQ ID NO: 7994597 - DNA, 22 bp, Homo sapiens
ggaggcggaggttgcagtgagc

SEQ ID NO: 7994598 - DNA, 22 bp, Homo sapiens
ggaggcggaggttgcagtgagc

SEQ ID NO: 7994599 - DNA, 22 bp, Homo sapiens
ggaggctcagtgaggaaatgga

SEQ ID NO: 7994600 - DNA, 22 bp, Homo sapiens
ggaggctcagtgaggaaatgga

SEQ ID NO: 7994601 - DNA, 22 bp, Homo sapiens
ggaggctcagactccatcctca

SEQ ID NO: 7994602 - DNA, 23 bp, Homo sapiens
ggaggctcaagtatcacgggcag

SEQ ID NO: 7994603 - DNA, 23 bp, Homo sapiens
ggaggctcaagtatcacgggcag

SEQ ID NO: 7994604 - DNA, 23 bp, Homo sapiens
ggaggctcaagtatcacgggcag

SEQ ID NO: 7994605 - DNA, 23 bp, Homo sapiens
ggaggctcaagtatcacgggcag

SEQ ID NO: 7994606 - DNA, 22 bp, Homo sapiens
ggaggctcagactccatcctca

SEQ ID NO: 7994607 - DNA, 22 bp, Homo sapiens
ggaggctcccacgcagctcaca

SEQ ID NO: 7994608 - DNA, 22 bp, Homo sapiens
ggaggctccatgagctcctgca

SEQ ID NO: 7994609 - DNA, 22 bp, Homo sapiens
ggaggctccatgagctcctgca

SEQ ID NO: 7994610 - DNA, 22 bp, Homo sapiens
ggaggctccactgctcttcctg

SEQ ID NO: 7994611 - DNA, 22 bp, Homo sapiens
ggaggctccatgagctcctgca

SEQ ID NO: 7994612 - DNA, 22 bp, Homo sapiens
ggaggctccatgagctcctgca

SEQ ID NO: 7994613 - DNA, 22 bp, Homo sapiens
ggaggctccatgagctcctgca

SEQ ID NO: 7994614 - DNA, 22 bp, Homo sapiens
ggaggcggggaaggcatcccat

SEQ ID NO: 7994615 - DNA, 22 bp, Homo sapiens
ggaggcggggaaggcatcccat

SEQ ID NO: 7994616 - DNA, 22 bp, Homo sapiens
ggaggcggaggttgcagtgagt

SEQ ID NO: 7994617 - DNA, 22 bp, Homo sapiens
ggaggcggaggttgcagtgagt

SEQ ID NO: 7994618 - DNA, 22 bp, Homo sapiens
ggaggcggaggttgcagtgagc

SEQ ID NO: 7994619 - DNA, 22 bp, Homo sapiens
ggaggcggaggttgcagtgagc

SEQ ID NO: 7994620 - DNA, 22 bp, Homo sapiens
ggaggcggaggttgcagtgagt

SEQ ID NO: 7994621 - DNA, 22 bp, Homo sapiens
ggaggcggaggttgcagtgagt

SEQ ID NO: 7994622 - DNA, 22 bp, Homo sapiens
ggaggcggaggttgcagtgagt

SEQ ID NO: 7994623 - DNA, 22 bp, Homo sapiens
ggaggcggaggttgcagtgagt

SEQ ID NO: 7994624 - DNA, 22 bp, Homo sapiens
ggaggctcttgagaggggagta

SEQ ID NO: 7994625 - DNA, 22 bp, Homo sapiens
ggaggctcttgagaggggagta

SEQ ID NO: 7994626 - DNA, 18 bp, Homo sapiens
ggaggctctgtggtttcc

SEQ ID NO: 7994627 - DNA, 18 bp, Homo sapiens
ggaggctctgtggtttcc

SEQ ID NO: 7994628 - DNA, 22 bp, Homo sapiens
ggaggctcttatttgttcaaca

SEQ ID NO: 7994629 - DNA, 22 bp, Homo sapiens
ggaggctgagaagtccaagatc

SEQ ID NO: 7994630 - DNA, 22 bp, Homo sapiens
ggaggctcttgagaggggagta

SEQ ID NO: 7994631 - DNA, 22 bp, Homo sapiens
ggaggctcttgagaggggagta

SEQ ID NO: 7994632 - DNA, 22 bp, Homo sapiens
ggaggctgagaagtccaagatc

SEQ ID NO: 7994633 - DNA, 22 bp, Homo sapiens
ggaggctgagaagtccaagatc

SEQ ID NO: 7994634 - DNA, 22 bp, Homo sapiens
ggaggctgagaagtccaagatc

SEQ ID NO: 7994635 - DNA, 22 bp, Homo sapiens
ggaggctgagaagtccaagatc

SEQ ID NO: 7994636 - DNA, 22 bp, Homo sapiens
ggaggctcccacgcagctcaca

SEQ ID NO: 7994637 - DNA, 22 bp, Homo sapiens
ggaggctcccacgcagctcaca

SEQ ID NO: 7994638 - DNA, 22 bp, Homo sapiens
ggaggctcccacgcagctcaca

SEQ ID NO: 7994639 - DNA, 22 bp, Homo sapiens
ggaggctcctaagctgacttga

SEQ ID NO: 7994640 - DNA, 22 bp, Homo sapiens
ggaggctcccacgcagctcaca

SEQ ID NO: 7994641 - DNA, 22 bp, Homo sapiens
ggaggctcgctggtcgcacagc

SEQ ID NO: 7994642 - DNA, 22 bp, Homo sapiens
ggaggctcctaagctgacttga

SEQ ID NO: 7994643 - DNA, 22 bp, Homo sapiens
ggaggctcgctggtcgcacagc

SEQ ID NO: 7994644 - DNA, 22 bp, Homo sapiens
ggaggctctaaactttccttgg

SEQ ID NO: 7994645 - DNA, 22 bp, Homo sapiens
ggaggctcgctggtcgcacagc

SEQ ID NO: 7994646 - DNA, 22 bp, Homo sapiens
ggaggctctcctggccttgtct

SEQ ID NO: 7994647 - DNA, 22 bp, Homo sapiens
ggaggctctgaccatttaccca

SEQ ID NO: 7994648 - DNA, 22 bp, Homo sapiens
ggaggctctgccatctgtcaca

SEQ ID NO: 7994649 - DNA, 22 bp, Homo sapiens
ggaggctctaaactttccttgg

SEQ ID NO: 7994650 - DNA, 22 bp, Homo sapiens
ggaggctctcctggccttgtct

SEQ ID NO: 7994651 - DNA, 22 bp, Homo sapiens
ggaggctctgccatctgtcaca

SEQ ID NO: 7994652 - DNA, 22 bp, Homo sapiens
ggaggctctgccatctgtcaca

SEQ ID NO: 7994653 - DNA, 22 bp, Homo sapiens
ggaggctctgcttatgaaaggc

SEQ ID NO: 7994654 - DNA, 22 bp, Homo sapiens
ggaggctctgcttatgaaaggc

SEQ ID NO: 7994655 - DNA, 22 bp, Homo sapiens
ggaggctctgctccgtgtgttc

SEQ ID NO: 7994656 - DNA, 22 bp, Homo sapiens
ggaggctgagaggtcgcagtgg

SEQ ID NO: 7994657 - DNA, 22 bp, Homo sapiens
ggaggctgagaggtcgcagtgg

SEQ ID NO: 7994658 - DNA, 22 bp, Homo sapiens
ggaggctgagaggtcgcagtgg

SEQ ID NO: 7994659 - DNA, 22 bp, Homo sapiens
ggaggctgaggcaggcggatca

SEQ ID NO: 7994660 - DNA, 22 bp, Homo sapiens
ggaggctgaggcaggcggatca

SEQ ID NO: 7994661 - DNA, 22 bp, Homo sapiens
ggaggctgaggcccctcacagg

SEQ ID NO: 7994662 - DNA, 22 bp, Homo sapiens
ggaggctgaggcccctcacagg

SEQ ID NO: 7994663 - DNA, 22 bp, Homo sapiens
ggaggctgaggcccctcacagg

SEQ ID NO: 7994664 - DNA, 22 bp, Homo sapiens
ggaggctgaggcaggcggatca

SEQ ID NO: 7994665 - DNA, 22 bp, Homo sapiens
ggaggctgctgcctcacgtggg

SEQ ID NO: 7994666 - DNA, 22 bp, Homo sapiens
ggaggctgctgcctcacgtggg

SEQ ID NO: 7994667 - DNA, 22 bp, Homo sapiens
ggaggctgctgcctcacgtggg

SEQ ID NO: 7994668 - DNA, 22 bp, Homo sapiens
ggaggctgaggcccctcacagg

SEQ ID NO: 7994669 - DNA, 22 bp, Homo sapiens
ggaggctgaggcccctcacagg

SEQ ID NO: 7994670 - DNA, 22 bp, Homo sapiens
ggaggctgctgcctcacgtggg

SEQ ID NO: 7994671 - DNA, 22 bp, Homo sapiens
ggaggctgctgcctcacgtggg

SEQ ID NO: 7994672 - DNA, 22 bp, Homo sapiens
ggaggctgctgcctcacgtggg

SEQ ID NO: 7994673 - DNA, 19 bp, Homo sapiens
ggaggcttcttggggtcgg

SEQ ID NO: 7994674 - DNA, 22 bp, Homo sapiens
ggaggcttcctggctcttgatt

SEQ ID NO: 7994675 - DNA, 22 bp, Homo sapiens
ggcaggcattagagattcccag

SEQ ID NO: 7994676 - DNA, 22 bp, Homo sapiens
ggcaggcattgcaacatgtaca

SEQ ID NO: 7994677 - DNA, 22 bp, Homo sapiens
ggcaggcctgagaggcagggct

SEQ ID NO: 7994678 - DNA, 22 bp, Homo sapiens
ggcaggcctgagaggcagggct

SEQ ID NO: 7994679 - DNA, 22 bp, Homo sapiens
ggcaggcctgagaggcagggct

SEQ ID NO: 7994680 - DNA, 22 bp, Homo sapiens
ggcaggcaggagcgtgcttggg

SEQ ID NO: 7994681 - DNA, 22 bp, Homo sapiens
ggcaggcaggagcgtgcttggg

SEQ ID NO: 7994682 - DNA, 22 bp, Homo sapiens
ggcaggcagcctccatccacag

SEQ ID NO: 7994683 - DNA, 22 bp, Homo sapiens
ggcaggcagcctccatccacag

SEQ ID NO: 7994684 - DNA, 22 bp, Homo sapiens
ggcaggcagcctccatccacag

SEQ ID NO: 7994685 - DNA, 22 bp, Homo sapiens
ggcaggcagatggctgcaccaa

SEQ ID NO: 7994686 - DNA, 22 bp, Homo sapiens
ggcaggctagcactgatgtcct

SEQ ID NO: 7994687 - DNA, 22 bp, Homo sapiens
ggcaggctcagcagccaaggag

SEQ ID NO: 7994688 - DNA, 22 bp, Homo sapiens
ggcaggctagcactgatgtcct

SEQ ID NO: 7994689 - DNA, 22 bp, Homo sapiens
ggcaggctagcactgatgtcct

SEQ ID NO: 7994690 - DNA, 22 bp, Homo sapiens
ggcaggcgtggtggcctcagaa

SEQ ID NO: 7994691 - DNA, 22 bp, Homo sapiens
ggcaggcgtggtggcctcagaa

SEQ ID NO: 7994692 - DNA, 22 bp, Homo sapiens
ggcaggcctgagaggcagggct

SEQ ID NO: 7994693 - DNA, 22 bp, Homo sapiens
ggcaggctcagcagccaaggag

SEQ ID NO: 7994694 - DNA, 22 bp, Homo sapiens
ggcaggctcagcagccaaggag

SEQ ID NO: 7994695 - DNA, 22 bp, Homo sapiens
ggcaggctccaagcatcctatg

SEQ ID NO: 7994696 - DNA, 22 bp, Homo sapiens
ggcaggctccaagcatcctatg

SEQ ID NO: 7994697 - DNA, 22 bp, Homo sapiens
ggcaggctcagcagccaaggag

SEQ ID NO: 7994698 - DNA, 22 bp, Homo sapiens
ggcaggctccagagccctctcc

SEQ ID NO: 7994699 - DNA, 22 bp, Homo sapiens
ggcaggctccagagccctctcc

SEQ ID NO: 7994700 - DNA, 22 bp, Homo sapiens
ggcaggctccaagcatcctatg

SEQ ID NO: 7994701 - DNA, 22 bp, Homo sapiens
ggcaggctccgtgttccattcc

SEQ ID NO: 7994702 - DNA, 22 bp, Homo sapiens
ggcaggctccagagccctctcc

SEQ ID NO: 7994703 - DNA, 22 bp, Homo sapiens
ggcaggctccagagccctctcc

SEQ ID NO: 7994704 - DNA, 22 bp, Homo sapiens
ggcaggctcttggccttatgag

SEQ ID NO: 7994705 - DNA, 22 bp, Homo sapiens
ggcaggctcttggccttatgag

SEQ ID NO: 7994706 - DNA, 18 bp, Homo sapiens
ggcaggctctctgggtca

SEQ ID NO: 7994707 - DNA, 18 bp, Homo sapiens
ggcaggctctctgggtca

SEQ ID NO: 7994708 - DNA, 18 bp, Homo sapiens
ggcaggctctctgggtca

SEQ ID NO: 7994709 - DNA, 22 bp, Homo sapiens
ggcaggctgcttgggtcatgtc

SEQ ID NO: 7994710 - DNA, 22 bp, Homo sapiens
ggcaggctgcttgggtcatgtc

SEQ ID NO: 7994711 - DNA, 22 bp, Homo sapiens
ggcaggctgcttgggtcatgtc

SEQ ID NO: 7994712 - DNA, 22 bp, Homo sapiens
ggcaggctgcttgggtcatgtc

SEQ ID NO: 7994713 - DNA, 22 bp, Homo sapiens
ggcaggctgcttgggtcatgtc

SEQ ID NO: 7994714 - DNA, 22 bp, Homo sapiens
ggcaggtgagttcattatctgc

SEQ ID NO: 7994715 - DNA, 22 bp, Homo sapiens
ggcaggtgaggcatgtgcctgg

SEQ ID NO: 7994716 - DNA, 22 bp, Homo sapiens
ggcaggctgggtgtcatggagt

SEQ ID NO: 7994717 - DNA, 22 bp, Homo sapiens
ggcaggtgaggcatgtgcctgg

SEQ ID NO: 7994718 - DNA, 22 bp, Homo sapiens
ggcaggtgaggcatgtgcctgg

SEQ ID NO: 7994719 - DNA, 22 bp, Homo sapiens
ggcaggtgaggcatgtgcctgg

SEQ ID NO: 7994720 - DNA, 22 bp, Homo sapiens
ggcaggctgggagtcatcagag

SEQ ID NO: 7994721 - DNA, 22 bp, Homo sapiens
ggcaggtgaggcatgtgcctgg

SEQ ID NO: 7994722 - DNA, 22 bp, Homo sapiens
ggcaggctgggtgtcatggagt

SEQ ID NO: 7994723 - DNA, 22 bp, Homo sapiens
ggcaggctgcttgggtcatgtc

SEQ ID NO: 7994724 - DNA, 22 bp, Homo sapiens
ggcaggctgcttgggtcatgtc

SEQ ID NO: 7994725 - DNA, 22 bp, Homo sapiens
ggcaggctgcttgggtcatgtc

SEQ ID NO: 7994726 - DNA, 22 bp, Homo sapiens
ggcaggctgcttgggtcatgtc

SEQ ID NO: 7994727 - DNA, 19 bp, Homo sapiens
ggcaggctggatagagagg

SEQ ID NO: 7994728 - DNA, 22 bp, Homo sapiens
ggcaggctggctttgttccagg

SEQ ID NO: 7994729 - DNA, 22 bp, Homo sapiens
ggcaggctgggagtcatcagag

SEQ ID NO: 7994730 - DNA, 22 bp, Homo sapiens
ggcaggctgggagtcatcagag

SEQ ID NO: 7994731 - DNA, 22 bp, Homo sapiens
ggcaggctgggagtcatcagag

SEQ ID NO: 7994732 - DNA, 22 bp, Homo sapiens
ggcaggctgggagtcatcagag

SEQ ID NO: 7994733 - DNA, 22 bp, Homo sapiens
ggcaggctgggagtcatcagag

SEQ ID NO: 7994734 - DNA, 22 bp, Homo sapiens
ggcaggtgctaagagaggtaaa

SEQ ID NO: 7994735 - DNA, 22 bp, Homo sapiens
ggcaggtgctaagagaggtaaa

SEQ ID NO: 7994736 - DNA, 22 bp, Homo sapiens
ggcaggtgctaagagaggtaaa

SEQ ID NO: 7994737 - DNA, 17 bp, Homo sapiens
ggcaggtgcggggccgc

SEQ ID NO: 7994738 - DNA, 17 bp, Homo sapiens
ggcaggtgcggggccgc

SEQ ID NO: 7994739 - DNA, 17 bp, Homo sapiens
ggcaggtgcggggccgc

SEQ ID NO: 7994740 - DNA, 17 bp, Homo sapiens
ggcaggtgcggggccgc

SEQ ID NO: 7994741 - DNA, 17 bp, Homo sapiens
ggcaggtgcggggccgc

SEQ ID NO: 7994742 - DNA, 22 bp, Homo sapiens
ggcaggtgcgcatgttgcatta

SEQ ID NO: 7994743 - DNA, 22 bp, Homo sapiens
ggcaggtgcgcatgttgcatta

SEQ ID NO: 7994744 - DNA, 22 bp, Homo sapiens
ggcaggtgctaagagaggtaaa

SEQ ID NO: 7994745 - DNA, 22 bp, Homo sapiens
ggcaggtgctaagagaggtaaa

SEQ ID NO: 7994746 - DNA, 22 bp, Homo sapiens
ggcaggtgctaagagaggtaaa

SEQ ID NO: 7994747 - DNA, 22 bp, Homo sapiens
ggcaggtgctaagagaggtaaa

SEQ ID NO: 7994748 - DNA, 22 bp, Homo sapiens
ggcaggtgctaagagaggtaaa

SEQ ID NO: 7994749 - DNA, 22 bp, Homo sapiens
ggcaggtgctaagagaggtaaa

SEQ ID NO: 7994750 - DNA, 20 bp, Homo sapiens
ggcaggtgctcgcttggtct

SEQ ID NO: 7994751 - DNA, 22 bp, Homo sapiens
ggcaggtgctctgtgggcctgg

SEQ ID NO: 7994752 - DNA, 20 bp, Homo sapiens
ggcaggtgctcgcttggtct

SEQ ID NO: 7994753 - DNA, 20 bp, Homo sapiens
ggcaggtgctcgcttggtct

SEQ ID NO: 7994754 - DNA, 20 bp, Homo sapiens
ggcaggtgctcgcttggtct

SEQ ID NO: 7994755 - DNA, 22 bp, Homo sapiens
ggcagctgggttggccagaaac

SEQ ID NO: 7994756 - DNA, 22 bp, Homo sapiens
ggcagctgggtgcctaataatg

SEQ ID NO: 7994757 - DNA, 22 bp, Homo sapiens
ggcagctgggtgcctaataatg

SEQ ID NO: 7994758 - DNA, 22 bp, Homo sapiens
ggcagctgggttggccagaaac

SEQ ID NO: 7994759 - DNA, 22 bp, Homo sapiens
ggcagctgggtcacaccgatct

SEQ ID NO: 7994760 - DNA, 22 bp, Homo sapiens
ggcagctgggtcacaccgatct

SEQ ID NO: 7994761 - DNA, 22 bp, Homo sapiens
ggcagctgggtcacaccgatct

SEQ ID NO: 7994762 - DNA, 22 bp, Homo sapiens
ggcagctgggtgcctaataatg

SEQ ID NO: 7994763 - DNA, 22 bp, Homo sapiens
ggcagctgggtgcctaataatg

SEQ ID NO: 7994764 - DNA, 22 bp, Homo sapiens
ggcagctgggttggccagaaac

SEQ ID NO: 7994765 - DNA, 22 bp, Homo sapiens
ggcagctgggttggccagaaac

SEQ ID NO: 7994766 - DNA, 22 bp, Homo sapiens
ggcagctgggttggccagaaac

SEQ ID NO: 7994767 - DNA, 22 bp, Homo sapiens
ggcagctgggttggccagaaac

SEQ ID NO: 7994768 - DNA, 22 bp, Homo sapiens
ggcagctgggttggccagaaac

SEQ ID NO: 7994769 - DNA, 22 bp, Homo sapiens
ggcagctggttctttccattaa

SEQ ID NO: 7994770 - DNA, 23 bp, Homo sapiens
ggcagctgggcagcactcatggg

SEQ ID NO: 7994771 - DNA, 23 bp, Homo sapiens
ggcagctgggcagcactcatggg

SEQ ID NO: 7994772 - DNA, 23 bp, Homo sapiens
ggcagctgggcagcactcatggg

SEQ ID NO: 7994773 - DNA, 23 bp, Homo sapiens
ggcagctgggcagcactcatggg

SEQ ID NO: 7994774 - DNA, 22 bp, Homo sapiens
ggcagctggggcagtgccctgt

SEQ ID NO: 7994775 - DNA, 22 bp, Homo sapiens
ggcagctggggcagtgccctgt

SEQ ID NO: 7994776 - DNA, 23 bp, Homo sapiens
ggcagctgggcagcactcatggg

SEQ ID NO: 7994777 - DNA, 22 bp, Homo sapiens
ggcagctggggcagtgccctgt

SEQ ID NO: 7994778 - DNA, 22 bp, Homo sapiens
ggcagctggggcagtgccctgt

SEQ ID NO: 7994779 - DNA, 22 bp, Homo sapiens
ggcagctggggcagtgccctgt

SEQ ID NO: 7994780 - DNA, 22 bp, Homo sapiens
ggcagctggggcagtgccctgt

SEQ ID NO: 7994781 - DNA, 22 bp, Homo sapiens
ggcagctggggcagtgccctgt

SEQ ID NO: 7994782 - DNA, 22 bp, Homo sapiens
ggcagctggggcagtgccctgt

SEQ ID NO: 7994783 - DNA, 22 bp, Homo sapiens
ggcagctgggtcacaccgatct

SEQ ID NO: 7994784 - DNA, 22 bp, Homo sapiens
ggcagctggggcagtgccctgt

SEQ ID NO: 7994785 - DNA, 22 bp, Homo sapiens
ggcagctgtaagatgagtgaat

SEQ ID NO: 7994786 - DNA, 22 bp, Homo sapiens
ggcagctgtaagatgagtgaat

SEQ ID NO: 7994787 - DNA, 22 bp, Homo sapiens
ggcagctgtaagatgagtgaat

SEQ ID NO: 7994788 - DNA, 22 bp, Homo sapiens
ggcagctgtaagatgagtgaat

SEQ ID NO: 7994789 - DNA, 22 bp, Homo sapiens
ggcagctgtaagatgagtgaat

SEQ ID NO: 7994790 - DNA, 22 bp, Homo sapiens
ggcagctggttctttccattaa

SEQ ID NO: 7994791 - DNA, 22 bp, Homo sapiens
ggcagctggttctttccattaa

SEQ ID NO: 7994792 - DNA, 22 bp, Homo sapiens
ggcagctggttctttccattaa

SEQ ID NO: 7994793 - DNA, 22 bp, Homo sapiens
ggcagctggttctttccattaa

SEQ ID NO: 7994794 - DNA, 22 bp, Homo sapiens
ggcagctggttctttccattaa

SEQ ID NO: 7994795 - DNA, 22 bp, Homo sapiens
ggcagctgtctcattcacacct

SEQ ID NO: 7994796 - DNA, 22 bp, Homo sapiens
ggcagctgtaagatgagtgaat

SEQ ID NO: 7994797 - DNA, 22 bp, Homo sapiens
ggcagctgtaagatgagtgaat

SEQ ID NO: 7994798 - DNA, 22 bp, Homo sapiens
ggcagctgtaagatgagtgaat

SEQ ID NO: 7994799 - DNA, 22 bp, Homo sapiens
ggcagctgtctcattcacacct

SEQ ID NO: 7994800 - DNA, 22 bp, Homo sapiens
ggcagctgtaagatgagtgaat

SEQ ID NO: 7994801 - DNA, 22 bp, Homo sapiens
ggcagctgtctcattcacacct

SEQ ID NO: 7994802 - DNA, 22 bp, Homo sapiens
ggcagctgtctcattcacacct

SEQ ID NO: 7994803 - DNA, 22 bp, Homo sapiens
ggcagctgtctcattcacacct

SEQ ID NO: 7994804 - DNA, 22 bp, Homo sapiens
ggcagctgtctcattcacacct

SEQ ID NO: 7994805 - DNA, 22 bp, Homo sapiens
ggcagctgtctcattcacacct

SEQ ID NO: 7994806 - DNA, 22 bp, Homo sapiens
ggcaggcagatggctgcaccaa

SEQ ID NO: 7994807 - DNA, 22 bp, Homo sapiens
ggcaggcagatggctgcaccaa

SEQ ID NO: 7994808 - DNA, 22 bp, Homo sapiens
ggcagctgtgaagtgcctcaca

SEQ ID NO: 7994809 - DNA, 22 bp, Homo sapiens
ggcagctgtgaagtgcctcaca

SEQ ID NO: 7994810 - DNA, 22 bp, Homo sapiens
ggcagctgtgaagtgcctcaca

SEQ ID NO: 7994811 - DNA, 22 bp, Homo sapiens
ggcagctgtctctgagttagca

SEQ ID NO: 7994812 - DNA, 22 bp, Homo sapiens
ggcagctgtctctgagttagca

SEQ ID NO: 7994813 - DNA, 22 bp, Homo sapiens
ggcagctgtctctgagttagca

SEQ ID NO: 7994814 - DNA, 22 bp, Homo sapiens
ggcagctgtctctgagttagca

SEQ ID NO: 7994815 - DNA, 22 bp, Homo sapiens
ggcagctgtctctgagttagca

SEQ ID NO: 7994816 - DNA, 22 bp, Homo sapiens
ggcagctgtctctgagttagca

SEQ ID NO: 7994817 - DNA, 22 bp, Homo sapiens
ggcagctgtctctgagttagca

SEQ ID NO: 7994818 - DNA, 22 bp, Homo sapiens
ggcagctgtctctgagttagca

SEQ ID NO: 7994819 - DNA, 22 bp, Homo sapiens
ggcagctgtgaagtgcctcaca

SEQ ID NO: 7994820 - DNA, 22 bp, Homo sapiens
ggcagctgtgaagtgcctcaca

SEQ ID NO: 7994821 - DNA, 22 bp, Homo sapiens
ggcagctgtgaagtgcctcaca

SEQ ID NO: 7994822 - DNA, 22 bp, Homo sapiens
ggcagctgtgaagtgcctcaca

SEQ ID NO: 7994823 - DNA, 22 bp, Homo sapiens
ggcagaggaagctggaagtggg

SEQ ID NO: 7994824 - DNA, 22 bp, Homo sapiens
ggcagaggaagctggaagtggg

SEQ ID NO: 7994825 - DNA, 22 bp, Homo sapiens
ggcagaggaagctggaagtggg

SEQ ID NO: 7994826 - DNA, 22 bp, Homo sapiens
ggcagaggaagctggaagtggg

SEQ ID NO: 7994827 - DNA, 22 bp, Homo sapiens
ggcagaggaagctggaagtggg

SEQ ID NO: 7994828 - DNA, 22 bp, Homo sapiens
ggcagaggaagctggaagtggg

SEQ ID NO: 7994829 - DNA, 22 bp, Homo sapiens
ggcagctctgatgatgctctgg

SEQ ID NO: 7994830 - DNA, 22 bp, Homo sapiens
ggcagctctgatgatgctctgg

SEQ ID NO: 7994831 - DNA, 22 bp, Homo sapiens
ggcagctcgtcaggctgcggcg

SEQ ID NO: 7994832 - DNA, 22 bp, Homo sapiens
ggcagaggaagctggaagtggg

SEQ ID NO: 7994833 - DNA, 20 bp, Homo sapiens
ggcagctctagtcgaggccc

SEQ ID NO: 7994834 - DNA, 22 bp, Homo sapiens
ggcagaggaagctggaagtggg

SEQ ID NO: 7994835 - DNA, 22 bp, Homo sapiens
ggcagaggaagctggaagtggg

SEQ ID NO: 7994836 - DNA, 22 bp, Homo sapiens
ggcagaggaagctggaagtggg

SEQ ID NO: 7994837 - DNA, 22 bp, Homo sapiens
ggcagaggaagctggaagtggg

SEQ ID NO: 7994838 - DNA, 22 bp, Homo sapiens
ggcagaggaagctggaagtggg

SEQ ID NO: 7994839 - DNA, 22 bp, Homo sapiens
ggcagaggaagctggaagtggg

SEQ ID NO: 7994840 - DNA, 22 bp, Homo sapiens
ggcagaggaagctggaagtggg

SEQ ID NO: 7994841 - DNA, 22 bp, Homo sapiens
ggcagaggaagctggaagtggg

SEQ ID NO: 7994842 - DNA, 22 bp, Homo sapiens
ggcagaggaagctggaagtggg

SEQ ID NO: 7994843 - DNA, 22 bp, Homo sapiens
ggcagaggaagctggaagtggg

SEQ ID NO: 7994844 - DNA, 22 bp, Homo sapiens
ggcagaggaagctggaagtggg

SEQ ID NO: 7994845 - DNA, 22 bp, Homo sapiens
ggcagaggaagctggaagtggg

SEQ ID NO: 7994846 - DNA, 22 bp, Homo sapiens
ggcagaggaagctggaagtggg

SEQ ID NO: 7994847 - DNA, 22 bp, Homo sapiens
ggcagaggaagctggaagtggg

SEQ ID NO: 7994848 - DNA, 22 bp, Homo sapiens
ggcagaggaagctggaagtggg

SEQ ID NO: 7994849 - DNA, 22 bp, Homo sapiens
ggcagaggaagctggaagtggg

SEQ ID NO: 7994850 - DNA, 22 bp, Homo sapiens
ggcagctggcctcctcgcccac

SEQ ID NO: 7994851 - DNA, 22 bp, Homo sapiens
ggcagctggcctcctcgcccac

SEQ ID NO: 7994852 - DNA, 22 bp, Homo sapiens
ggcagctggcctcctcgcccac

SEQ ID NO: 7994853 - DNA, 23 bp, Homo sapiens
ggcagctgggcagcactcatggg

SEQ ID NO: 7994854 - DNA, 23 bp, Homo sapiens
ggcagctgggcagcactcatggg

SEQ ID NO: 7994855 - DNA, 23 bp, Homo sapiens
ggcagctgggcagcactcatggg

SEQ ID NO: 7994856 - DNA, 23 bp, Homo sapiens
ggcagctgggcagcactcatggg

SEQ ID NO: 7994857 - DNA, 23 bp, Homo sapiens
ggcagctgggcagcactcatggg

SEQ ID NO: 7994858 - DNA, 22 bp, Homo sapiens
ggcagctggcctcctcgcccac

SEQ ID NO: 7994859 - DNA, 22 bp, Homo sapiens
ggcagctgctgcattacgttgt

SEQ ID NO: 7994860 - DNA, 22 bp, Homo sapiens
ggcagctgctgcattacgttgt

SEQ ID NO: 7994861 - DNA, 22 bp, Homo sapiens
ggcagctgctgcattacgttgt

SEQ ID NO: 7994862 - DNA, 22 bp, Homo sapiens
ggcagctgctgcattacgttgt

SEQ ID NO: 7994863 - DNA, 19 bp, Homo sapiens
ggcagctggacgctgttca

SEQ ID NO: 7994864 - DNA, 19 bp, Homo sapiens
ggcagctggacgctgttca

SEQ ID NO: 7994865 - DNA, 19 bp, Homo sapiens
ggcagctggacgctgttca

SEQ ID NO: 7994866 - DNA, 22 bp, Homo sapiens
ggcagctggcctcctcgcccac

SEQ ID NO: 7994867 - DNA, 22 bp, Homo sapiens
ggcagctggcctcctcgcccac

SEQ ID NO: 7994868 - DNA, 19 bp, Homo sapiens
ggcagctggacgctgttca

SEQ ID NO: 7994869 - DNA, 19 bp, Homo sapiens
ggcagctggacgctgttca

SEQ ID NO: 7994870 - DNA, 22 bp, Homo sapiens
ggcagctctgctccacatgagt

SEQ ID NO: 7994871 - DNA, 22 bp, Homo sapiens
ggcagctctgctccttggctcc

SEQ ID NO: 7994872 - DNA, 22 bp, Homo sapiens
ggcagctctgctccacatgagt

SEQ ID NO: 7994873 - DNA, 22 bp, Homo sapiens
ggcagctctgctccttggctcc

SEQ ID NO: 7994874 - DNA, 22 bp, Homo sapiens
ggcagctctgctaattgagcct

SEQ ID NO: 7994875 - DNA, 22 bp, Homo sapiens
ggcagctctgctccacatgagt

SEQ ID NO: 7994876 - DNA, 22 bp, Homo sapiens
ggcagctctgctaattgagcct

SEQ ID NO: 7994877 - DNA, 17 bp, Homo sapiens
ggcagctgccacttttt

SEQ ID NO: 7994878 - DNA, 22 bp, Homo sapiens
ggcagctgcacgttgtcccgtc

SEQ ID NO: 7994879 - DNA, 17 bp, Homo sapiens
ggcagctgccacttttt

SEQ ID NO: 7994880 - DNA, 22 bp, Homo sapiens
ggcagctctgtgtctgggaagc

SEQ ID NO: 7994881 - DNA, 22 bp, Homo sapiens
ggcagctgcaaatctgctctgt

SEQ ID NO: 7994882 - DNA, 22 bp, Homo sapiens
ggcagctgcaaatctgctctgt

SEQ ID NO: 7994883 - DNA, 22 bp, Homo sapiens
ggcagctgcacgttgtcccgtc

SEQ ID NO: 7994884 - DNA, 22 bp, Homo sapiens
ggcagctgcacgttgtcccgtc

SEQ ID NO: 7994885 - DNA, 22 bp, Homo sapiens
ggcacagcacagagcacatgta

SEQ ID NO: 7994886 - DNA, 22 bp, Homo sapiens
ggcacagcacagagcacatgta

SEQ ID NO: 7994887 - DNA, 22 bp, Homo sapiens
ggcacagcacagagcacatgta

SEQ ID NO: 7994888 - DNA, 22 bp, Homo sapiens
ggcacagcacagagcacatgta

SEQ ID NO: 7994889 - DNA, 22 bp, Homo sapiens
ggcacagcaagaagggaaatga

SEQ ID NO: 7994890 - DNA, 22 bp, Homo sapiens
ggcacagcacagagcacatgta

SEQ ID NO: 7994891 - DNA, 22 bp, Homo sapiens
ggcacagcaagaagggaaatga

SEQ ID NO: 7994892 - DNA, 22 bp, Homo sapiens
ggcacagcacagagcacatgta

SEQ ID NO: 7994893 - DNA, 22 bp, Homo sapiens
ggcacagcacagtggacccagg

SEQ ID NO: 7994894 - DNA, 22 bp, Homo sapiens
ggcacagcacagtggacccagg

SEQ ID NO: 7994895 - DNA, 22 bp, Homo sapiens
ggcacagcacagtggacccagg

SEQ ID NO: 7994896 - DNA, 22 bp, Homo sapiens
ggcacagcacagtggacccagg

SEQ ID NO: 7994897 - DNA, 22 bp, Homo sapiens
ggcacagcacagagcacatgta

SEQ ID NO: 7994898 - DNA, 22 bp, Homo sapiens
ggcacagcacagagcacatgta

SEQ ID NO: 7994899 - DNA, 22 bp, Homo sapiens
ggcacagcacagagcacatgta

SEQ ID NO: 7994900 - DNA, 22 bp, Homo sapiens
ggcacagcacagtggacccagg

SEQ ID NO: 7994901 - DNA, 22 bp, Homo sapiens
ggcacagcacagtggacccagg

SEQ ID NO: 7994902 - DNA, 22 bp, Homo sapiens
ggcacagcacagtggacccagg

SEQ ID NO: 7994903 - DNA, 22 bp, Homo sapiens
ggcagacacaaaaacataaggt

SEQ ID NO: 7994904 - DNA, 22 bp, Homo sapiens
ggcagacacaaaaacataaggt

SEQ ID NO: 7994905 - DNA, 22 bp, Homo sapiens
ggcagacacaaaaacataaggt

SEQ ID NO: 7994906 - DNA, 22 bp, Homo sapiens
ggcagacacaaaaacataaggt

SEQ ID NO: 7994907 - DNA, 22 bp, Homo sapiens
ggcagacaatctgtctgttagg

SEQ ID NO: 7994908 - DNA, 22 bp, Homo sapiens
ggcacagcactgtaggcctggg

SEQ ID NO: 7994909 - DNA, 22 bp, Homo sapiens
ggcacagcactgtaggcctggg

SEQ ID NO: 7994910 - DNA, 22 bp, Homo sapiens
ggcacagcactgtaggcctggg

SEQ ID NO: 7994911 - DNA, 22 bp, Homo sapiens
ggcacagcactgtaggcctggg

SEQ ID NO: 7994912 - DNA, 22 bp, Homo sapiens
ggcacagcaccttttcacattg

SEQ ID NO: 7994913 - DNA, 22 bp, Homo sapiens
ggcacagcaccttttcacattg

SEQ ID NO: 7994914 - DNA, 22 bp, Homo sapiens
ggcacagcaccttttcacattg

SEQ ID NO: 7994915 - DNA, 22 bp, Homo sapiens
ggcacagcactgtaggcctggg

SEQ ID NO: 7994916 - DNA, 22 bp, Homo sapiens
ggcacagcactgtaggcctggg

SEQ ID NO: 7994917 - DNA, 22 bp, Homo sapiens
ggcacagagttggcagagctgc

SEQ ID NO: 7994918 - DNA, 22 bp, Homo sapiens
ggcacagagttggcagagctgc

SEQ ID NO: 7994919 - DNA, 22 bp, Homo sapiens
ggcacagagttggcagagctgc

SEQ ID NO: 7994920 - DNA, 22 bp, Homo sapiens
ggcacagagttggcagagctgc

SEQ ID NO: 7994921 - DNA, 23 bp, Homo sapiens
ggcacagatgctgagcatgtgca

SEQ ID NO: 7994922 - DNA, 23 bp, Homo sapiens
ggcacagatgctgagcatgtgca

SEQ ID NO: 7994923 - DNA, 23 bp, Homo sapiens
ggcacagatgctgagcatgtgca

SEQ ID NO: 7994924 - DNA, 22 bp, Homo sapiens
ggcacagatagatcaagtgtct

SEQ ID NO: 7994925 - DNA, 22 bp, Homo sapiens
ggcacagatagatcaagtgtct

SEQ ID NO: 7994926 - DNA, 22 bp, Homo sapiens
ggcacagatagatcaagtgtct

SEQ ID NO: 7994927 - DNA, 22 bp, Homo sapiens
ggcacagaggttgcctccagat

SEQ ID NO: 7994928 - DNA, 22 bp, Homo sapiens
ggcacagagttggcagagctgc

SEQ ID NO: 7994929 - DNA, 22 bp, Homo sapiens
ggcacagagctttgtcccagtt

SEQ ID NO: 7994930 - DNA, 22 bp, Homo sapiens
ggcacagagctttgtcccagtt

SEQ ID NO: 7994931 - DNA, 22 bp, Homo sapiens
ggcacagagctccagccttggc

SEQ ID NO: 7994932 - DNA, 22 bp, Homo sapiens
ggcacagagctccagccttggc

SEQ ID NO: 7994933 - DNA, 22 bp, Homo sapiens
ggcacagagctccagccttggc

SEQ ID NO: 7994934 - DNA, 22 bp, Homo sapiens
ggcacagagctccagccttggc

SEQ ID NO: 7994935 - DNA, 22 bp, Homo sapiens
ggcagacctctccagccccaca

SEQ ID NO: 7994936 - DNA, 22 bp, Homo sapiens
ggcagacctctccagccccaca

SEQ ID NO: 7994937 - DNA, 22 bp, Homo sapiens
ggcagacctctccagccccaca

SEQ ID NO: 7994938 - DNA, 22 bp, Homo sapiens
ggcagacctctccagccccaca

SEQ ID NO: 7994939 - DNA, 22 bp, Homo sapiens
ggcagacactcaaaagctggga

SEQ ID NO: 7994940 - DNA, 22 bp, Homo sapiens
ggcagacactcaaaagctggga

SEQ ID NO: 7994941 - DNA, 22 bp, Homo sapiens
ggcagacactcaaaagctggga

SEQ ID NO: 7994942 - DNA, 22 bp, Homo sapiens
ggcagacacctttatgtctaat

SEQ ID NO: 7994943 - DNA, 22 bp, Homo sapiens
ggcagacacctttatgtctaat

SEQ ID NO: 7994944 - DNA, 22 bp, Homo sapiens
ggcagacactcaaaagctggga

SEQ ID NO: 7994945 - DNA, 22 bp, Homo sapiens
ggcagacacctttatgtctaat

SEQ ID NO: 7994946 - DNA, 22 bp, Homo sapiens
ggcagacacaaaaacataaggt

SEQ ID NO: 7994947 - DNA, 19 bp, Homo sapiens
ggcagacacagttgacatg

SEQ ID NO: 7994948 - DNA, 19 bp, Homo sapiens
ggcagacacagttgacatg

SEQ ID NO: 7994949 - DNA, 19 bp, Homo sapiens
ggcagacacagttgacatg

SEQ ID NO: 7994950 - DNA, 22 bp, Homo sapiens
ggcagagaatctggctgtttac

SEQ ID NO: 7994951 - DNA, 22 bp, Homo sapiens
ggcagagaatctggctgtttac

SEQ ID NO: 7994952 - DNA, 21 bp, Homo sapiens
ggcagagaagctggaagttgg

SEQ ID NO: 7994953 - DNA, 21 bp, Homo sapiens
ggcagagaagctggaagttgg

SEQ ID NO: 7994954 - DNA, 21 bp, Homo sapiens
ggcagagaagctggaagttgg

SEQ ID NO: 7994955 - DNA, 22 bp, Homo sapiens
ggcagactttttctctgaaggg

SEQ ID NO: 7994956 - DNA, 21 bp, Homo sapiens
ggcagagaagctggaagttgg

SEQ ID NO: 7994957 - DNA, 22 bp, Homo sapiens
ggcagactgtaataggagaatt

SEQ ID NO: 7994958 - DNA, 22 bp, Homo sapiens
ggcagactgtaataggagaatt

SEQ ID NO: 7994959 - DNA, 20 bp, Homo sapiens
ggcagacctgctgagagccc

SEQ ID NO: 7994960 - DNA, 22 bp, Homo sapiens
ggcagagactgggttggcagag

SEQ ID NO: 7994961 - DNA, 22 bp, Homo sapiens
ggcagagactgggttggcagag

SEQ ID NO: 7994962 - DNA, 23 bp, Homo sapiens
ggcagagagcatggctggggccc

SEQ ID NO: 7994963 - DNA, 23 bp, Homo sapiens
ggcagagagcatggctggggccc

SEQ ID NO: 7994964 - DNA, 23 bp, Homo sapiens
ggcagagagcatggctggggccc

SEQ ID NO: 7994965 - DNA, 22 bp, Homo sapiens
ggcagagactgggttggcagag

SEQ ID NO: 7994966 - DNA, 22 bp, Homo sapiens
ggcagagactgggttggcagag

SEQ ID NO: 7994967 - DNA, 22 bp, Homo sapiens
ggcagagactgggttggcagag

SEQ ID NO: 7994968 - DNA, 22 bp, Homo sapiens
ggcagagacaccgaatgactct

SEQ ID NO: 7994969 - DNA, 22 bp, Homo sapiens
ggcagagacaccgaatgactct

SEQ ID NO: 7994970 - DNA, 22 bp, Homo sapiens
ggcagagacaccgaatgactct

SEQ ID NO: 7994971 - DNA, 22 bp, Homo sapiens
ggcagagacaccgaatgactct

SEQ ID NO: 7994972 - DNA, 22 bp, Homo sapiens
ggcagagacaccgaatgactct

SEQ ID NO: 7994973 - DNA, 22 bp, Homo sapiens
ggcagagaatctggctgtttac

SEQ ID NO: 7994974 - DNA, 23 bp, Homo sapiens
ggcagagagcatggctggggccc

SEQ ID NO: 7994975 - DNA, 23 bp, Homo sapiens
ggcagagagcatggctggggccc

SEQ ID NO: 7994976 - DNA, 23 bp, Homo sapiens
ggcagagagcatggctggggccc

SEQ ID NO: 7994977 - DNA, 23 bp, Homo sapiens
ggcagagagcatggctggggccc

SEQ ID NO: 7994978 - DNA, 23 bp, Homo sapiens
ggcagagagcatggctggggccc

SEQ ID NO: 7994979 - DNA, 22 bp, Homo sapiens
ggcagagagttctccacctctc

SEQ ID NO: 7994980 - DNA, 23 bp, Homo sapiens
ggcagagagcatggctggggccc

SEQ ID NO: 7994981 - DNA, 22 bp, Homo sapiens
ggcagaggaagctggaagtggg

SEQ ID NO: 7994982 - DNA, 22 bp, Homo sapiens
ggcagaggaagctggaagtggg

SEQ ID NO: 7994983 - DNA, 22 bp, Homo sapiens
ggcagagcttgttccttctgtt

SEQ ID NO: 7994984 - DNA, 22 bp, Homo sapiens
ggcagagcttgttccttctgtt

SEQ ID NO: 7994985 - DNA, 22 bp, Homo sapiens
ggcagagcttgttccttctgtt

SEQ ID NO: 7994986 - DNA, 22 bp, Homo sapiens
ggcagagcttgcagtgagccga

SEQ ID NO: 7994987 - DNA, 22 bp, Homo sapiens
ggcagagcttgttccttctgtt

SEQ ID NO: 7994988 - DNA, 22 bp, Homo sapiens
ggcagagcttgttccttctgtt

SEQ ID NO: 7994989 - DNA, 22 bp, Homo sapiens
ggcaaggccaggcctccaagac

SEQ ID NO: 7994990 - DNA, 22 bp, Homo sapiens
ggcaaggcctgcagctcagtgt

SEQ ID NO: 7994991 - DNA, 22 bp, Homo sapiens
ggagttgattttggatatatta

SEQ ID NO: 7994992 - DNA, 22 bp, Homo sapiens
ggagttgattttggatatatta

SEQ ID NO: 7994993 - DNA, 22 bp, Homo sapiens
ggagttgattttggatatatta

SEQ ID NO: 7994994 - DNA, 22 bp, Homo sapiens
ggagttgattttggatatatta

SEQ ID NO: 7994995 - DNA, 22 bp, Homo sapiens
ggagttccagaccagactggcc

SEQ ID NO: 7994996 - DNA, 22 bp, Homo sapiens
ggagttcaggaatgaaaatgtt

SEQ ID NO: 7994997 - DNA, 22 bp, Homo sapiens
ggagttcaggaatgaaaatgtt

SEQ ID NO: 7994998 - DNA, 22 bp, Homo sapiens
ggagttcaggaatgaaaatgtt

SEQ ID NO: 7994999 - DNA, 17 bp, Homo sapiens
ggagttctgcagtcagg

SEQ ID NO: 7995000 - DNA, 17 bp, Homo sapiens
ggagttctgcagtcagg

SEQ ID NO: 7995001 - DNA, 22 bp, Homo sapiens
ggagttgatcagagtaggaggt

SEQ ID NO: 7995002 - DNA, 22 bp, Homo sapiens
ggagttgacggccgacacccag

SEQ ID NO: 7995003 - DNA, 22 bp, Homo sapiens
ggagttgattttggatatatta

SEQ ID NO: 7995004 - DNA, 22 bp, Homo sapiens
ggagtggtgtcactgagaggaa

SEQ ID NO: 7995005 - DNA, 22 bp, Homo sapiens
ggagtggtgtcactgagaggaa

SEQ ID NO: 7995006 - DNA, 22 bp, Homo sapiens
ggagtggtgtcactgagaggaa

SEQ ID NO: 7995007 - DNA, 22 bp, Homo sapiens
ggagtggtgtcactgagaggaa

SEQ ID NO: 7995008 - DNA, 22 bp, Homo sapiens
ggagttcaccaaggttatgcag

SEQ ID NO: 7995009 - DNA, 22 bp, Homo sapiens
ggagttcaaatcttttggatct

SEQ ID NO: 7995010 - DNA, 22 bp, Homo sapiens
ggagttcacgatgttggccagg

SEQ ID NO: 7995011 - DNA, 22 bp, Homo sapiens
ggagttcactgtgcaggctctg

SEQ ID NO: 7995012 - DNA, 22 bp, Homo sapiens
ggagttcaggaaaggagccaga

SEQ ID NO: 7995013 - DNA, 22 bp, Homo sapiens
ggagtgtgggatggagctcagg

SEQ ID NO: 7995014 - DNA, 22 bp, Homo sapiens
ggagtgtgggatggagctcagg

SEQ ID NO: 7995015 - DNA, 22 bp, Homo sapiens
ggcaagggacggccgtgagaca

SEQ ID NO: 7995016 - DNA, 22 bp, Homo sapiens
ggcaagggacggccgtgagaca

SEQ ID NO: 7995017 - DNA, 22 bp, Homo sapiens
ggcaagggacggccgtgagaca

SEQ ID NO: 7995018 - DNA, 22 bp, Homo sapiens
ggcacacaaaggcagcatttga

SEQ ID NO: 7995019 - DNA, 22 bp, Homo sapiens
ggcaagggacggccgtgagaca

SEQ ID NO: 7995020 - DNA, 22 bp, Homo sapiens
ggcacacagatggagcactagc

SEQ ID NO: 7995021 - DNA, 22 bp, Homo sapiens
ggcaaggcctgcagctcagtgt

SEQ ID NO: 7995022 - DNA, 22 bp, Homo sapiens
ggcaagggacggccgtgagaca

SEQ ID NO: 7995023 - DNA, 22 bp, Homo sapiens
ggcaaggccttgcccagcattc

SEQ ID NO: 7995024 - DNA, 22 bp, Homo sapiens
ggcacacagatggagcactagc

SEQ ID NO: 7995025 - DNA, 22 bp, Homo sapiens
ggcacacagatggagcactagc

SEQ ID NO: 7995026 - DNA, 22 bp, Homo sapiens
ggcacacagcttggcaggagat

SEQ ID NO: 7995027 - DNA, 22 bp, Homo sapiens
ggcacacagcttggcaggagat

SEQ ID NO: 7995028 - DNA, 22 bp, Homo sapiens
ggcacagacttttgcttgcgtt

SEQ ID NO: 7995029 - DNA, 22 bp, Homo sapiens
ggcacagacttttgcttgcgtt

SEQ ID NO: 7995030 - DNA, 22 bp, Homo sapiens
ggcacagagcccagcttcctag

SEQ ID NO: 7995031 - DNA, 22 bp, Homo sapiens
ggcacagagcaggccactaatc

SEQ ID NO: 7995032 - DNA, 22 bp, Homo sapiens
ggcacacagcttggcaggagat

SEQ ID NO: 7995033 - DNA, 22 bp, Homo sapiens
ggcacacatagatctgcactgg

SEQ ID NO: 7995034 - DNA, 22 bp, Homo sapiens
ggcacacatagatctgcactgg

SEQ ID NO: 7995035 - DNA, 22 bp, Homo sapiens
ggcacacatagatctgcactgg

SEQ ID NO: 7995036 - DNA, 22 bp, Homo sapiens
ggcacacatggtggttggtgaa

SEQ ID NO: 7995037 - DNA, 22 bp, Homo sapiens
ggcacacatagatctgcactgg

SEQ ID NO: 7995038 - DNA, 22 bp, Homo sapiens
ggagtgctttgaagccttcatt

SEQ ID NO: 7995039 - DNA, 22 bp, Homo sapiens
ggagtgctgggccgctgccaac

SEQ ID NO: 7995040 - DNA, 22 bp, Homo sapiens
ggagtgctgggccgctgccaac

SEQ ID NO: 7995041 - DNA, 22 bp, Homo sapiens
ggagtgctttgaagccttcatt

SEQ ID NO: 7995042 - DNA, 22 bp, Homo sapiens
ggagtggcactctgaggcgggg

SEQ ID NO: 7995043 - DNA, 22 bp, Homo sapiens
ggagtggcactctgaggcgggg

SEQ ID NO: 7995044 - DNA, 22 bp, Homo sapiens
ggagtggcactctgaggcgggg

SEQ ID NO: 7995045 - DNA, 22 bp, Homo sapiens
ggagtggcactctgaggcgggg

SEQ ID NO: 7995046 - DNA, 22 bp, Homo sapiens
ggagtggcactctgaggcgggg

SEQ ID NO: 7995047 - DNA, 22 bp, Homo sapiens
ggagtggcactctgaggcgggg

SEQ ID NO: 7995048 - DNA, 22 bp, Homo sapiens
ggagtggcactctgaggcgggg

SEQ ID NO: 7995049 - DNA, 22 bp, Homo sapiens
ggagtggcagagagggtatact

SEQ ID NO: 7995050 - DNA, 22 bp, Homo sapiens
ggagtggcagctaggctgtcag

SEQ ID NO: 7995051 - DNA, 22 bp, Homo sapiens
ggagtggcagctaggctgtcag

SEQ ID NO: 7995052 - DNA, 22 bp, Homo sapiens
ggagtggcagctaggctgtcag

SEQ ID NO: 7995053 - DNA, 22 bp, Homo sapiens
ggagtggcagcgaggatcagat

SEQ ID NO: 7995054 - DNA, 22 bp, Homo sapiens
ggagtggcagcgaggatcagat

SEQ ID NO: 7995055 - DNA, 22 bp, Homo sapiens
ggagtggcagcgaggatcagat

SEQ ID NO: 7995056 - DNA, 22 bp, Homo sapiens
ggagtggcagcgaggatcagat

SEQ ID NO: 7995057 - DNA, 22 bp, Homo sapiens
ggagtggcagcgaggatcagat

SEQ ID NO: 7995058 - DNA, 22 bp, Homo sapiens
ggagtggcagcgaggatcagat

SEQ ID NO: 7995059 - DNA, 22 bp, Homo sapiens
ggagtggcagcgaggatcagat

SEQ ID NO: 7995060 - DNA, 22 bp, Homo sapiens
ggagtggcagcgaggatcagat

SEQ ID NO: 7995061 - DNA, 22 bp, Homo sapiens
ggagtggcagcgaggatcagat

SEQ ID NO: 7995062 - DNA, 22 bp, Homo sapiens
ggagtggcagcgaggatcagat

SEQ ID NO: 7995063 - DNA, 22 bp, Homo sapiens
ggagtggcctctcctgtgcagg

SEQ ID NO: 7995064 - DNA, 22 bp, Homo sapiens
ggagtggcctctcctgtgcagg

SEQ ID NO: 7995065 - DNA, 22 bp, Homo sapiens
ggagtggcctctcctgtgcagg

SEQ ID NO: 7995066 - DNA, 22 bp, Homo sapiens
ggagtggcctctcctgtgcagg

SEQ ID NO: 7995067 - DNA, 22 bp, Homo sapiens
ggagtggcctctcctgtgcagg

SEQ ID NO: 7995068 - DNA, 22 bp, Homo sapiens
ggagtggccacgactgggagat

SEQ ID NO: 7995069 - DNA, 22 bp, Homo sapiens
ggagtggctatttgtgctggtt

SEQ ID NO: 7995070 - DNA, 22 bp, Homo sapiens
ggagtggctatttgtgctggtt

SEQ ID NO: 7995071 - DNA, 22 bp, Homo sapiens
ggagtggcctctcctgtgcagg

SEQ ID NO: 7995072 - DNA, 22 bp, Homo sapiens
ggagtggccacgactgggagat

SEQ ID NO: 7995073 - DNA, 22 bp, Homo sapiens
ggagtggccacgactgggagat

SEQ ID NO: 7995074 - DNA, 22 bp, Homo sapiens
ggagtggccacgactgggagat

SEQ ID NO: 7995075 - DNA, 22 bp, Homo sapiens
ggagtggccacgactgggagat

SEQ ID NO: 7995076 - DNA, 22 bp, Homo sapiens
ggagtggcaggccacagtgctg

SEQ ID NO: 7995077 - DNA, 22 bp, Homo sapiens
ggagtggcaggccacagtgctg

SEQ ID NO: 7995078 - DNA, 22 bp, Homo sapiens
ggagtggcaggccacagtgctg

SEQ ID NO: 7995079 - DNA, 19 bp, Homo sapiens
ggagtgggtagttagtggt

SEQ ID NO: 7995080 - DNA, 22 bp, Homo sapiens
ggagtggtggtcaggccatggc

SEQ ID NO: 7995081 - DNA, 22 bp, Homo sapiens
ggagtggtggtcaggccatggc

SEQ ID NO: 7995082 - DNA, 22 bp, Homo sapiens
ggagtggtggtcaggccatggc

SEQ ID NO: 7995083 - DNA, 19 bp, Homo sapiens
ggagtgggtagttagtggt

SEQ ID NO: 7995084 - DNA, 22 bp, Homo sapiens
ggagtgggcagcactgccctgt

SEQ ID NO: 7995085 - DNA, 22 bp, Homo sapiens
ggagtgggcagcactgccctgt

SEQ ID NO: 7995086 - DNA, 22 bp, Homo sapiens
ggagtgggcagcactgccctgt

SEQ ID NO: 7995087 - DNA, 22 bp, Homo sapiens
ggagtgggcagcactgccctgt

SEQ ID NO: 7995088 - DNA, 22 bp, Homo sapiens
ggagtgggcagcactgccctgt

SEQ ID NO: 7995089 - DNA, 22 bp, Homo sapiens
ggagtgggcagcactgccctgt

SEQ ID NO: 7995090 - DNA, 22 bp, Homo sapiens
ggagtgggaacaatgacatggt

SEQ ID NO: 7995091 - DNA, 22 bp, Homo sapiens
ggagtgggaacaatgacatggt

SEQ ID NO: 7995092 - DNA, 22 bp, Homo sapiens
ggagtgggaacaatgacatggt

SEQ ID NO: 7995093 - DNA, 22 bp, Homo sapiens
ggagtgggaacaatgacatggt

SEQ ID NO: 7995094 - DNA, 22 bp, Homo sapiens
ggagtgggaacaatgacatggt

SEQ ID NO: 7995095 - DNA, 22 bp, Homo sapiens
ggagtgggaacaatgacatggt

SEQ ID NO: 7995096 - DNA, 22 bp, Homo sapiens
ggagtgggaacaatgacatggt

SEQ ID NO: 7995097 - DNA, 22 bp, Homo sapiens
ggagtggctgtttctgccccca

SEQ ID NO: 7995098 - DNA, 22 bp, Homo sapiens
ggagtggctgtttctgccccca

SEQ ID NO: 7995099 - DNA, 22 bp, Homo sapiens
ggagtggctgtttctgccccca

SEQ ID NO: 7995100 - DNA, 23 bp, Homo sapiens
ggctcctggattcaaatcctgcc

SEQ ID NO: 7995101 - DNA, 22 bp, Homo sapiens
ggctcctggaaagccctcgctc

SEQ ID NO: 7995102 - DNA, 22 bp, Homo sapiens
ggctcctggaggcaccactggt

SEQ ID NO: 7995103 - DNA, 23 bp, Homo sapiens
ggctcctggattcaaatcctgcc

SEQ ID NO: 7995104 - DNA, 23 bp, Homo sapiens
ggctcctggattcaaatcctgcc

SEQ ID NO: 7995105 - DNA, 22 bp, Homo sapiens
ggctcctggcatctggtgggta

SEQ ID NO: 7995106 - DNA, 22 bp, Homo sapiens
ggctcctggcatctggtgggta

SEQ ID NO: 7995107 - DNA, 22 bp, Homo sapiens
ggctcctgggatgggactgagc

SEQ ID NO: 7995108 - DNA, 22 bp, Homo sapiens
ggctcctgggcagctgctccct

SEQ ID NO: 7995109 - DNA, 22 bp, Homo sapiens
ggctcctgggatgggactgagc

SEQ ID NO: 7995110 - DNA, 22 bp, Homo sapiens
ggctcctgggatgggactgagc

SEQ ID NO: 7995111 - DNA, 22 bp, Homo sapiens
ggctcctgggagaagttttatt

SEQ ID NO: 7995112 - DNA, 22 bp, Homo sapiens
ggctcctgggagatagaggtca

SEQ ID NO: 7995113 - DNA, 22 bp, Homo sapiens
ggctcctgggagatagaggtca

SEQ ID NO: 7995114 - DNA, 22 bp, Homo sapiens
ggctcctgggcagctgctccct

SEQ ID NO: 7995115 - DNA, 22 bp, Homo sapiens
ggctcctgggcagctgctccct

SEQ ID NO: 7995116 - DNA, 22 bp, Homo sapiens
ggctcctgggcagctgctccct

SEQ ID NO: 7995117 - DNA, 22 bp, Homo sapiens
ggctcctgggcagctgctccct

SEQ ID NO: 7995118 - DNA, 22 bp, Homo sapiens
ggctcctgggcagctgctccct

SEQ ID NO: 7995119 - DNA, 22 bp, Homo sapiens
ggctcctgggcagctgctccct

SEQ ID NO: 7995120 - DNA, 22 bp, Homo sapiens
ggctctagagactctagagaaa

SEQ ID NO: 7995121 - DNA, 22 bp, Homo sapiens
ggctctagagactctagagaaa

SEQ ID NO: 7995122 - DNA, 22 bp, Homo sapiens
ggctctccactatggatgagaa

SEQ ID NO: 7995123 - DNA, 22 bp, Homo sapiens
ggctctcagggaaaggcctccc

SEQ ID NO: 7995124 - DNA, 22 bp, Homo sapiens
ggctctaggcggagtcccgcga

SEQ ID NO: 7995125 - DNA, 20 bp, Homo sapiens
ggctccttctttcatggccc

SEQ ID NO: 7995126 - DNA, 22 bp, Homo sapiens
ggctccttgagaggcctagcag

SEQ ID NO: 7995127 - DNA, 22 bp, Homo sapiens
ggctccttcaagcctgtcactg

SEQ ID NO: 7995128 - DNA, 22 bp, Homo sapiens
ggctccttcaagcctgtcactg

SEQ ID NO: 7995129 - DNA, 22 bp, Homo sapiens
ggctcgagcagctgtgtaggat

SEQ ID NO: 7995130 - DNA, 23 bp, Homo sapiens
ggctccttgcccatccagcagcc

SEQ ID NO: 7995131 - DNA, 23 bp, Homo sapiens
ggctccttgcccatccagcagcc

SEQ ID NO: 7995132 - DNA, 22 bp, Homo sapiens
ggctccttgccaccagctctgc

SEQ ID NO: 7995133 - DNA, 22 bp, Homo sapiens
ggctccttgccaccagctctgc

SEQ ID NO: 7995134 - DNA, 22 bp, Homo sapiens
ggctccttgccaccagctctgc

SEQ ID NO: 7995135 - DNA, 22 bp, Homo sapiens
ggctccttatctctcctatgcc

SEQ ID NO: 7995136 - DNA, 22 bp, Homo sapiens
ggctcctgttttaaaaggtgaa

SEQ ID NO: 7995137 - DNA, 22 bp, Homo sapiens
ggctcctgttttaaaaggtgaa

SEQ ID NO: 7995138 - DNA, 22 bp, Homo sapiens
ggctcctgttttaaaaggtgaa

SEQ ID NO: 7995139 - DNA, 22 bp, Homo sapiens
ggctccttcaaagcacctggct

SEQ ID NO: 7995140 - DNA, 22 bp, Homo sapiens
ggctccttcaagcctgtcactg

SEQ ID NO: 7995141 - DNA, 22 bp, Homo sapiens
ggctccttcaaagcacctggct

SEQ ID NO: 7995142 - DNA, 22 bp, Homo sapiens
ggctccttatctctcctatgcc

SEQ ID NO: 7995143 - DNA, 22 bp, Homo sapiens
ggctccttatctctcctatgcc

SEQ ID NO: 7995144 - DNA, 22 bp, Homo sapiens
ggctccttcaaagcacctggct

SEQ ID NO: 7995145 - DNA, 22 bp, Homo sapiens
ggctcctggggaggtgagcttg

SEQ ID NO: 7995146 - DNA, 22 bp, Homo sapiens
ggctcctggggaggtgagcttg

SEQ ID NO: 7995147 - DNA, 19 bp, Homo sapiens
ggctcctggggctcagccc

SEQ ID NO: 7995148 - DNA, 22 bp, Homo sapiens
ggctcctggggaggtgagcttg

SEQ ID NO: 7995149 - DNA, 19 bp, Homo sapiens
ggctcctggggctcagccc

SEQ ID NO: 7995150 - DNA, 22 bp, Homo sapiens
ggctcctgttatttaatgagga

SEQ ID NO: 7995151 - DNA, 22 bp, Homo sapiens
ggctgagttgagaggattactt

SEQ ID NO: 7995152 - DNA, 22 bp, Homo sapiens
ggctgagttgagaggattactt

SEQ ID NO: 7995153 - DNA, 22 bp, Homo sapiens
ggctgagttgagaggattactt

SEQ ID NO: 7995154 - DNA, 22 bp, Homo sapiens
ggctctccactatggatgagaa

SEQ ID NO: 7995155 - DNA, 22 bp, Homo sapiens
ggctctccactatggatgagaa

SEQ ID NO: 7995156 - DNA, 22 bp, Homo sapiens
ggctgagttgagaggattactt

SEQ ID NO: 7995157 - DNA, 22 bp, Homo sapiens
ggctctcggcggaccctgggaa

SEQ ID NO: 7995158 - DNA, 19 bp, Homo sapiens
ggctctcccttgagagagc

SEQ ID NO: 7995159 - DNA, 22 bp, Homo sapiens
ggctgcaaataacaactagctt

SEQ ID NO: 7995160 - DNA, 22 bp, Homo sapiens
ggctgcaagcatgcacagatac

SEQ ID NO: 7995161 - DNA, 22 bp, Homo sapiens
ggctgcagaagtacttccggat

SEQ ID NO: 7995162 - DNA, 22 bp, Homo sapiens
ggctgatgagcttagctagaga

SEQ ID NO: 7995163 - DNA, 22 bp, Homo sapiens
ggctgatgagcttagctagaga

SEQ ID NO: 7995164 - DNA, 19 bp, Homo sapiens
ggctgatgtagacagtgtc

SEQ ID NO: 7995165 - DNA, 22 bp, Homo sapiens
ggctgatgggcatgagctgtca

SEQ ID NO: 7995166 - DNA, 22 bp, Homo sapiens
ggctgcagagctggtgccctgg

SEQ ID NO: 7995167 - DNA, 22 bp, Homo sapiens
ggctgcagagctggtgccctgg

SEQ ID NO: 7995168 - DNA, 22 bp, Homo sapiens
ggctgcagaggcccccagtggg

SEQ ID NO: 7995169 - DNA, 22 bp, Homo sapiens
ggctgcagaggcccccagtggg

SEQ ID NO: 7995170 - DNA, 22 bp, Homo sapiens
ggctgcagagctgggtgggcct

SEQ ID NO: 7995171 - DNA, 22 bp, Homo sapiens
ggctgcagagctggtgccctgg

SEQ ID NO: 7995172 - DNA, 22 bp, Homo sapiens
ggctgcagaggcccccagtggg

SEQ ID NO: 7995173 - DNA, 22 bp, Homo sapiens
ggctgcagaggcccccagtggg

SEQ ID NO: 7995174 - DNA, 22 bp, Homo sapiens
ggctgcagaggcccccagtggg

SEQ ID NO: 7995175 - DNA, 22 bp, Homo sapiens
ggctgcagaggcgatctgaggt

SEQ ID NO: 7995176 - DNA, 22 bp, Homo sapiens
ggctgcagaggcgatctgaggt

SEQ ID NO: 7995177 - DNA, 22 bp, Homo sapiens
ggctgcagaggcccccagtggg

SEQ ID NO: 7995178 - DNA, 22 bp, Homo sapiens
ggctgcaggaacgacggagggg

SEQ ID NO: 7995179 - DNA, 22 bp, Homo sapiens
ggctgcaggaacgacggagggg

SEQ ID NO: 7995180 - DNA, 22 bp, Homo sapiens
ggctgcagaggcgatctgaggt

SEQ ID NO: 7995181 - DNA, 22 bp, Homo sapiens
ggctgcagaggcgatctgaggt

SEQ ID NO: 7995182 - DNA, 22 bp, Homo sapiens
ggctgcagaggcgatctgaggt

SEQ ID NO: 7995183 - DNA, 19 bp, Homo sapiens
ggctgcagagccccggcgc

SEQ ID NO: 7995184 - DNA, 19 bp, Homo sapiens
ggctgcagagccccggcgc

SEQ ID NO: 7995185 - DNA, 19 bp, Homo sapiens
ggctgcagagccccggcgc

SEQ ID NO: 7995186 - DNA, 19 bp, Homo sapiens
ggctgcagagccccggcgc

SEQ ID NO: 7995187 - DNA, 22 bp, Homo sapiens
ggctgcagagctgggtgggcct

SEQ ID NO: 7995188 - DNA, 22 bp, Homo sapiens
ggctgcagagctgggtgggcct

SEQ ID NO: 7995189 - DNA, 22 bp, Homo sapiens
ggctgcagagctgggtgggcct

SEQ ID NO: 7995190 - DNA, 22 bp, Homo sapiens
ggctgcagagctggtgccctgg

SEQ ID NO: 7995191 - DNA, 22 bp, Homo sapiens
ggctgcagagctggtgccctgg

SEQ ID NO: 7995192 - DNA, 22 bp, Homo sapiens
ggctgcagagctggtgccctgg

SEQ ID NO: 7995193 - DNA, 22 bp, Homo sapiens
ggctgcagagctgggtgggcct

SEQ ID NO: 7995194 - DNA, 22 bp, Homo sapiens
ggctgctctgccttccagctgg

SEQ ID NO: 7995195 - DNA, 22 bp, Homo sapiens
ggctgctctccatcccaggcct

SEQ ID NO: 7995196 - DNA, 22 bp, Homo sapiens
ggctgctctccatcccaggcct

SEQ ID NO: 7995197 - DNA, 22 bp, Homo sapiens
ggctgctcggcagctcctgagc

SEQ ID NO: 7995198 - DNA, 22 bp, Homo sapiens
ggctgctctgccttccagctgg

SEQ ID NO: 7995199 - DNA, 19 bp, Homo sapiens
ggctgccttctgctcatct

SEQ ID NO: 7995200 - DNA, 19 bp, Homo sapiens
ggctgccttctgctcatct

SEQ ID NO: 7995201 - DNA, 19 bp, Homo sapiens
ggctgccttctgctcatct

SEQ ID NO: 7995202 - DNA, 19 bp, Homo sapiens
ggctgccttctgctcatct

SEQ ID NO: 7995203 - DNA, 22 bp, Homo sapiens
ggctgccttccctgagccccgg

SEQ ID NO: 7995204 - DNA, 22 bp, Homo sapiens
ggctgccttccctgagccccgg

SEQ ID NO: 7995205 - DNA, 22 bp, Homo sapiens
ggctgccttccctgagccccgg

SEQ ID NO: 7995206 - DNA, 22 bp, Homo sapiens
ggctgccttgaccctggctccg

SEQ ID NO: 7995207 - DNA, 19 bp, Homo sapiens
ggctgccttctgctcatct

SEQ ID NO: 7995208 - DNA, 22 bp, Homo sapiens
ggctgctcggagcctcctgtga

SEQ ID NO: 7995209 - DNA, 22 bp, Homo sapiens
ggctgctcggagcctcctgtga

SEQ ID NO: 7995210 - DNA, 22 bp, Homo sapiens
ggctgccttgaccctggctccg

SEQ ID NO: 7995211 - DNA, 22 bp, Homo sapiens
ggctgctcggcagctcctgagc

SEQ ID NO: 7995212 - DNA, 22 bp, Homo sapiens
ggctgctcggcagctcctgagc

SEQ ID NO: 7995213 - DNA, 22 bp, Homo sapiens
ggctggctacattggaggaagg

SEQ ID NO: 7995214 - DNA, 22 bp, Homo sapiens
ggctggctatctgtggttgcct

SEQ ID NO: 7995215 - DNA, 22 bp, Homo sapiens
ggctggctacattggaggaagg

SEQ ID NO: 7995216 - DNA, 22 bp, Homo sapiens
ggctggctacattggaggaagg

SEQ ID NO: 7995217 - DNA, 22 bp, Homo sapiens
ggctggcgggtgggtgaaagac

SEQ ID NO: 7995218 - DNA, 22 bp, Homo sapiens
ggctggctacattggaggaagg

SEQ ID NO: 7995219 - DNA, 22 bp, Homo sapiens
ggctggcgggtgggtgaaagac

SEQ ID NO: 7995220 - DNA, 22 bp, Homo sapiens
ggctggctacattggaggaagg

SEQ ID NO: 7995221 - DNA, 22 bp, Homo sapiens
ggctggctacattggaggaagg

SEQ ID NO: 7995222 - DNA, 22 bp, Homo sapiens
ggctggcctgtgtggccgccac

SEQ ID NO: 7995223 - DNA, 22 bp, Homo sapiens
ggctggcctgtgtggccgccac

SEQ ID NO: 7995224 - DNA, 22 bp, Homo sapiens
ggctggcctgtgtggccgccac

SEQ ID NO: 7995225 - DNA, 22 bp, Homo sapiens
ggctggcctctacagggaggca

SEQ ID NO: 7995226 - DNA, 22 bp, Homo sapiens
ggctggcctctacagggaggca

SEQ ID NO: 7995227 - DNA, 22 bp, Homo sapiens
ggctggcctctacagggaggca

SEQ ID NO: 7995228 - DNA, 22 bp, Homo sapiens
ggctggcctctacagggaggca

SEQ ID NO: 7995229 - DNA, 23 bp, Homo sapiens
ggctgctcttttcatgctgtttc

SEQ ID NO: 7995230 - DNA, 22 bp, Homo sapiens
ggctgctgaacaagggaaccct

SEQ ID NO: 7995231 - DNA, 22 bp, Homo sapiens
ggctgctgaacaagggaaccct

SEQ ID NO: 7995232 - DNA, 23 bp, Homo sapiens
ggctggcccggggctgctcctga

SEQ ID NO: 7995233 - DNA, 23 bp, Homo sapiens
ggctggcccggggctgctcctga

SEQ ID NO: 7995234 - DNA, 23 bp, Homo sapiens
ggctggcccggggctgctcctga

SEQ ID NO: 7995235 - DNA, 22 bp, Homo sapiens
ggctggcctcagggtcctcgct

SEQ ID NO: 7995236 - DNA, 22 bp, Homo sapiens
ggctggcctcagggtcctcgct

SEQ ID NO: 7995237 - DNA, 22 bp, Homo sapiens
ggctggcctcagggtcctcgct

SEQ ID NO: 7995238 - DNA, 22 bp, Homo sapiens
ggctggcctcagggtcctcgct

SEQ ID NO: 7995239 - DNA, 22 bp, Homo sapiens
ggctgcctgtgcccaggcacac

SEQ ID NO: 7995240 - DNA, 22 bp, Homo sapiens
ggctgcctgtgcccaggcacac

SEQ ID NO: 7995241 - DNA, 22 bp, Homo sapiens
ggctgcctgtgcccaggcacac

SEQ ID NO: 7995242 - DNA, 22 bp, Homo sapiens
ggctgcctgtgcccaggcacac

SEQ ID NO: 7995243 - DNA, 22 bp, Homo sapiens
ggctgcctggtttcttgtaagg

SEQ ID NO: 7995244 - DNA, 22 bp, Homo sapiens
ggctgcctggtttagtgctgac

SEQ ID NO: 7995245 - DNA, 22 bp, Homo sapiens
ggctgcctggtttagtgctgac

SEQ ID NO: 7995246 - DNA, 22 bp, Homo sapiens
ggctgcctggtttagtgctgac

SEQ ID NO: 7995247 - DNA, 22 bp, Homo sapiens
ggctgcctgggagccctcctct

SEQ ID NO: 7995248 - DNA, 21 bp, Homo sapiens
ggctgcctgggaagaagaaga

SEQ ID NO: 7995249 - DNA, 21 bp, Homo sapiens
ggctgcctgggaagaagaaga

SEQ ID NO: 7995250 - DNA, 21 bp, Homo sapiens
ggctgcctgggaagaagaaga

SEQ ID NO: 7995251 - DNA, 21 bp, Homo sapiens
ggctgcctgggaagaagaaga

SEQ ID NO: 7995252 - DNA, 22 bp, Homo sapiens
ggctgcctggtttagtgctgac

SEQ ID NO: 7995253 - DNA, 22 bp, Homo sapiens
ggctgcctggtttagtgctgac

SEQ ID NO: 7995254 - DNA, 22 bp, Homo sapiens
ggctgcctgggagccctcctct

SEQ ID NO: 7995255 - DNA, 22 bp, Homo sapiens
ggctgcctgggagccctcctct

SEQ ID NO: 7995256 - DNA, 22 bp, Homo sapiens
ggctgcctgggagccctcctct

SEQ ID NO: 7995257 - DNA, 22 bp, Homo sapiens
ggctgccttcatagaccatggg

SEQ ID NO: 7995258 - DNA, 22 bp, Homo sapiens
ggctgccttcatagaccatggg

SEQ ID NO: 7995259 - DNA, 22 bp, Homo sapiens
ggctgccttcatagaccatggg

SEQ ID NO: 7995260 - DNA, 22 bp, Homo sapiens
ggctgccttcatagaccatggg

SEQ ID NO: 7995261 - DNA, 22 bp, Homo sapiens
ggctgccttcatagaccatggg

SEQ ID NO: 7995262 - DNA, 22 bp, Homo sapiens
ggctgccttcatagaccatggg

SEQ ID NO: 7995263 - DNA, 22 bp, Homo sapiens
ggctgccttcagactccagctt

SEQ ID NO: 7995264 - DNA, 22 bp, Homo sapiens
ggctgccttcagactccagctt

SEQ ID NO: 7995265 - DNA, 22 bp, Homo sapiens
ggctgcctgtgcccaggcacac

SEQ ID NO: 7995266 - DNA, 22 bp, Homo sapiens
ggctgcctgtgcccaggcacac

SEQ ID NO: 7995267 - DNA, 18 bp, Homo sapiens
ggctgcctgttcctgaag

SEQ ID NO: 7995268 - DNA, 22 bp, Homo sapiens
ggctgccttcagactccagctt

SEQ ID NO: 7995269 - DNA, 22 bp, Homo sapiens
ggctgccttcagactccagctt

SEQ ID NO: 7995270 - DNA, 22 bp, Homo sapiens
ggctgcctgttgagtatgtccc

SEQ ID NO: 7995271 - DNA, 22 bp, Homo sapiens
ggctgcctgttgagtatgtccc

SEQ ID NO: 7995272 - DNA, 22 bp, Homo sapiens
ggctgcaggcagaggctgtctg

SEQ ID NO: 7995273 - DNA, 22 bp, Homo sapiens
ggctgcaggcagaggctgtctg

SEQ ID NO: 7995274 - DNA, 22 bp, Homo sapiens
ggctgcaggatgcccagccgtg

SEQ ID NO: 7995275 - DNA, 22 bp, Homo sapiens
ggctgcaggcagaggctgtctg

SEQ ID NO: 7995276 - DNA, 22 bp, Homo sapiens
ggctgcaggcagaggctgtctg

SEQ ID NO: 7995277 - DNA, 22 bp, Homo sapiens
ggctgcaggcagaggctgtctg

SEQ ID NO: 7995278 - DNA, 22 bp, Homo sapiens
ggctgcaggcagaggctgtctg

SEQ ID NO: 7995279 - DNA, 22 bp, Homo sapiens
ggctgcaggcagggtatccact

SEQ ID NO: 7995280 - DNA, 19 bp, Homo sapiens
ggctgcctggagcgagggc

SEQ ID NO: 7995281 - DNA, 19 bp, Homo sapiens
ggctgcctggagcgagggc

SEQ ID NO: 7995282 - DNA, 19 bp, Homo sapiens
ggctgcctggagcgagggc

SEQ ID NO: 7995283 - DNA, 22 bp, Homo sapiens
ggctgcaggaacgacggagggg

SEQ ID NO: 7995284 - DNA, 22 bp, Homo sapiens
ggctgcaggaacgacggagggg

SEQ ID NO: 7995285 - DNA, 22 bp, Homo sapiens
ggctgcaggaacgacggagggg

SEQ ID NO: 7995286 - DNA, 22 bp, Homo sapiens
ggctgcaggaacgacggagggg

SEQ ID NO: 7995287 - DNA, 22 bp, Homo sapiens
ggctgcaggaacgacggagggg

SEQ ID NO: 7995288 - DNA, 22 bp, Homo sapiens
ggctgcaggaacgacggagggg

SEQ ID NO: 7995289 - DNA, 22 bp, Homo sapiens
ggctgcagaggcgatctgaggt

SEQ ID NO: 7995290 - DNA, 20 bp, Homo sapiens
ggctgcaggactcattggct

SEQ ID NO: 7995291 - DNA, 22 bp, Homo sapiens
ggctgcaggatgcccagccgtg

SEQ ID NO: 7995292 - DNA, 22 bp, Homo sapiens
ggctgcaggatgcccagccgtg

SEQ ID NO: 7995293 - DNA, 22 bp, Homo sapiens
ggctgcaggatgcccagccgtg

SEQ ID NO: 7995294 - DNA, 20 bp, Homo sapiens
ggctgcaggactcattggct

SEQ ID NO: 7995295 - DNA, 22 bp, Homo sapiens
ggctgcaggatgcccagccgtg

SEQ ID NO: 7995296 - DNA, 22 bp, Homo sapiens
ggctgcaggatgcccagccgtg

SEQ ID NO: 7995297 - DNA, 20 bp, Homo sapiens
ggctgcaggactcattggct

SEQ ID NO: 7995298 - DNA, 22 bp, Homo sapiens
gggaagagaccgtaccctggcc

SEQ ID NO: 7995299 - DNA, 22 bp, Homo sapiens
gggaagagaccgtaccctggcc

SEQ ID NO: 7995300 - DNA, 22 bp, Homo sapiens
gggaagagaccgtaccctggcc

SEQ ID NO: 7995301 - DNA, 22 bp, Homo sapiens
gggaagagaggaggtggtttcg

SEQ ID NO: 7995302 - DNA, 22 bp, Homo sapiens
gggaagagaggaggtggtttcg

SEQ ID NO: 7995303 - DNA, 22 bp, Homo sapiens
gggaagagaccgtaccctggcc

SEQ ID NO: 7995304 - DNA, 22 bp, Homo sapiens
gggaagacttagtcggttcaat

SEQ ID NO: 7995305 - DNA, 22 bp, Homo sapiens
gggaagagaccgtaccctggcc

SEQ ID NO: 7995306 - DNA, 22 bp, Homo sapiens
gggaagacttagtcggttcaat

SEQ ID NO: 7995307 - DNA, 22 bp, Homo sapiens
gggaagaagacatggtgaaggc

SEQ ID NO: 7995308 - DNA, 21 bp, Homo sapiens
gggaagactgtcaggattcct

SEQ ID NO: 7995309 - DNA, 22 bp, Homo sapiens
gggaagaagacatggtgaaggc

SEQ ID NO: 7995310 - DNA, 18 bp, Homo sapiens
gggaagaggatctggccc

SEQ ID NO: 7995311 - DNA, 18 bp, Homo sapiens
gggaagaggatctggccc

SEQ ID NO: 7995312 - DNA, 18 bp, Homo sapiens
gggaagaggatctggccc

SEQ ID NO: 7995313 - DNA, 22 bp, Homo sapiens
gggaagagatttccacatcatt

SEQ ID NO: 7995314 - DNA, 22 bp, Homo sapiens
gggaagagatttccacatcatt

SEQ ID NO: 7995315 - DNA, 22 bp, Homo sapiens
gggaagagatttccacatcatt

SEQ ID NO: 7995316 - DNA, 22 bp, Homo sapiens
gggaagagatttccacatcatt

SEQ ID NO: 7995317 - DNA, 23 bp, Homo sapiens
gggaccaggcccttcctggtttg

SEQ ID NO: 7995318 - DNA, 23 bp, Homo sapiens
gggaccaggcccttcctggtttg

SEQ ID NO: 7995319 - DNA, 22 bp, Homo sapiens
gggaccaggtcagggctctgac

SEQ ID NO: 7995320 - DNA, 22 bp, Homo sapiens
gggaccaggtcagggctctgac

SEQ ID NO: 7995321 - DNA, 22 bp, Homo sapiens
gggaccaggtcagggctctgac

SEQ ID NO: 7995322 - DNA, 22 bp, Homo sapiens
gggaccaggtcagggctctgac

SEQ ID NO: 7995323 - DNA, 18 bp, Homo sapiens
gggaagaggatctggccc

SEQ ID NO: 7995324 - DNA, 18 bp, Homo sapiens
gggaagaggatctggccc

SEQ ID NO: 7995325 - DNA, 23 bp, Homo sapiens
gggaccaggcccttcctggtttg

SEQ ID NO: 7995326 - DNA, 18 bp, Homo sapiens
gggaagaggatctggccc

SEQ ID NO: 7995327 - DNA, 23 bp, Homo sapiens
gggaccaggcccttcctggtttg

SEQ ID NO: 7995328 - DNA, 22 bp, Homo sapiens
gggaacagcatatctgaagggt

SEQ ID NO: 7995329 - DNA, 22 bp, Homo sapiens
gggaacagcatatctgaagggt

SEQ ID NO: 7995330 - DNA, 22 bp, Homo sapiens
gggaacagcctcaccagccctg

SEQ ID NO: 7995331 - DNA, 22 bp, Homo sapiens
gggaacagcatatctgaagggt

SEQ ID NO: 7995332 - DNA, 22 bp, Homo sapiens
gggaacagcctcaccagccctg

SEQ ID NO: 7995333 - DNA, 22 bp, Homo sapiens
gggaacagcttgggctctgcca

SEQ ID NO: 7995334 - DNA, 22 bp, Homo sapiens
gggaacagcttgggctctgcca

SEQ ID NO: 7995335 - DNA, 22 bp, Homo sapiens
gggaacagcttgggctctgcca

SEQ ID NO: 7995336 - DNA, 22 bp, Homo sapiens
gggaacagaggagggtgttgct

SEQ ID NO: 7995337 - DNA, 22 bp, Homo sapiens
gggaacagagtgccagactgac

SEQ ID NO: 7995338 - DNA, 22 bp, Homo sapiens
gggaacagagtgccagactgac

SEQ ID NO: 7995339 - DNA, 22 bp, Homo sapiens
gggaacagagtgccagactgac

SEQ ID NO: 7995340 - DNA, 22 bp, Homo sapiens
gggaacagaggagggtgttgct

SEQ ID NO: 7995341 - DNA, 22 bp, Homo sapiens
gggaacagagtgccagactgac

SEQ ID NO: 7995342 - DNA, 22 bp, Homo sapiens
gggaacagcatatctgaagggt

SEQ ID NO: 7995343 - DNA, 22 bp, Homo sapiens
gggaaccacccctctgccctga

SEQ ID NO: 7995344 - DNA, 22 bp, Homo sapiens
gggaaccacccctctgccctga

SEQ ID NO: 7995345 - DNA, 22 bp, Homo sapiens
gggaaccacccctctgccctga

SEQ ID NO: 7995346 - DNA, 22 bp, Homo sapiens
gggaaccagccgcttccgcctc

SEQ ID NO: 7995347 - DNA, 22 bp, Homo sapiens
gggaacagggcctgagctgggg

SEQ ID NO: 7995348 - DNA, 22 bp, Homo sapiens
gggaacagggcctgagctgggg

SEQ ID NO: 7995349 - DNA, 22 bp, Homo sapiens
gggaacagggcctgagctgggg

SEQ ID NO: 7995350 - DNA, 22 bp, Homo sapiens
gggaacagggcctgagctgggg

SEQ ID NO: 7995351 - DNA, 22 bp, Homo sapiens
gggaacttatgatatgacttta

SEQ ID NO: 7995352 - DNA, 22 bp, Homo sapiens
gggaacttcagaaagtcgctgc

SEQ ID NO: 7995353 - DNA, 22 bp, Homo sapiens
gggaacttgccccagaggaatt

SEQ ID NO: 7995354 - DNA, 22 bp, Homo sapiens
gggaagaagacatggtgaaggc

SEQ ID NO: 7995355 - DNA, 22 bp, Homo sapiens
gggaactgtttaacaggggttt

SEQ ID NO: 7995356 - DNA, 22 bp, Homo sapiens
gggaactgtttaacaggggttt

SEQ ID NO: 7995357 - DNA, 22 bp, Homo sapiens
gggaactattttaagcacttga

SEQ ID NO: 7995358 - DNA, 22 bp, Homo sapiens
gggaactgtgtggtgctctgat

SEQ ID NO: 7995359 - DNA, 22 bp, Homo sapiens
gggaactattttaagcacttga

SEQ ID NO: 7995360 - DNA, 22 bp, Homo sapiens
gggaacctgccccaggcctctg

SEQ ID NO: 7995361 - DNA, 19 bp, Homo sapiens
ggcttcgaggctggggaag

SEQ ID NO: 7995362 - DNA, 22 bp, Homo sapiens
ggcttcctttcactaccctcag

SEQ ID NO: 7995363 - DNA, 22 bp, Homo sapiens
ggcttctcagcacactgtccac

SEQ ID NO: 7995364 - DNA, 22 bp, Homo sapiens
ggctttgggattcagcatgaga

SEQ ID NO: 7995365 - DNA, 18 bp, Homo sapiens
ggctttggctcttaccgc

SEQ ID NO: 7995366 - DNA, 22 bp, Homo sapiens
ggctttgggccctcaagtctcc

SEQ ID NO: 7995367 - DNA, 18 bp, Homo sapiens
ggctttggctcttaccgc

SEQ ID NO: 7995368 - DNA, 22 bp, Homo sapiens
ggctttgggggtgtccaagaaa

SEQ ID NO: 7995369 - DNA, 22 bp, Homo sapiens
ggcttcctggggcctcctgcaa

SEQ ID NO: 7995370 - DNA, 22 bp, Homo sapiens
ggcttcctggggcctcctgcaa

SEQ ID NO: 7995371 - DNA, 22 bp, Homo sapiens
ggcttcctaatactccctacac

SEQ ID NO: 7995372 - DNA, 22 bp, Homo sapiens
ggcttcctatcccatctgagtg

SEQ ID NO: 7995373 - DNA, 22 bp, Homo sapiens
ggcttccctttccgagaggaga

SEQ ID NO: 7995374 - DNA, 22 bp, Homo sapiens
ggcttcctccttcctgctgtca

SEQ ID NO: 7995375 - DNA, 22 bp, Homo sapiens
ggcttcctggagaaggtctgag

SEQ ID NO: 7995376 - DNA, 22 bp, Homo sapiens
ggcttcctggagaaggtctgag

SEQ ID NO: 7995377 - DNA, 22 bp, Homo sapiens
ggctttggtagacacagattga

SEQ ID NO: 7995378 - DNA, 22 bp, Homo sapiens
ggctttggggtgtgcagagatg

SEQ ID NO: 7995379 - DNA, 22 bp, Homo sapiens
ggctttggggtgtgcagagatg

SEQ ID NO: 7995380 - DNA, 22 bp, Homo sapiens
gggaaaggatcagtgggaggct

SEQ ID NO: 7995381 - DNA, 22 bp, Homo sapiens
gggaaaggatcagtgggaggct

SEQ ID NO: 7995382 - DNA, 22 bp, Homo sapiens
gggaaaggatcagtgggaggct

SEQ ID NO: 7995383 - DNA, 22 bp, Homo sapiens
gggaaaggatcagtgggaggct

SEQ ID NO: 7995384 - DNA, 22 bp, Homo sapiens
gggaaaggatttacagtttgat

SEQ ID NO: 7995385 - DNA, 22 bp, Homo sapiens
gggaaaggatttacagtttgat

SEQ ID NO: 7995386 - DNA, 22 bp, Homo sapiens
gggaaatctcgtcctctattta

SEQ ID NO: 7995387 - DNA, 23 bp, Homo sapiens
gggaaatcaaaagatatttcttc

SEQ ID NO: 7995388 - DNA, 23 bp, Homo sapiens
gggaaatcaaaagatatttcttc

SEQ ID NO: 7995389 - DNA, 21 bp, Homo sapiens
gggaaattaggattgctcatc

SEQ ID NO: 7995390 - DNA, 22 bp, Homo sapiens
gggaaatctcgtcctctattta

SEQ ID NO: 7995391 - DNA, 22 bp, Homo sapiens
gggaaatctcgtcctctattta

SEQ ID NO: 7995392 - DNA, 22 bp, Homo sapiens
gggaaatctcgtcctctattta

SEQ ID NO: 7995393 - DNA, 22 bp, Homo sapiens
gggaaatctcgtcctctattta

SEQ ID NO: 7995394 - DNA, 22 bp, Homo sapiens
ggctggctggcttagcagagga

SEQ ID NO: 7995395 - DNA, 22 bp, Homo sapiens
ggctggctggcttagcagagga

SEQ ID NO: 7995396 - DNA, 22 bp, Homo sapiens
ggctggctggcttagcagagga

SEQ ID NO: 7995397 - DNA, 22 bp, Homo sapiens
ggctggctggcttagcagagga

SEQ ID NO: 7995398 - DNA, 22 bp, Homo sapiens
ggctggctgtgccctgtactct

SEQ ID NO: 7995399 - DNA, 22 bp, Homo sapiens
ggctggctgtgccctgtactct

SEQ ID NO: 7995400 - DNA, 22 bp, Homo sapiens
ggctggctgtgccctgtactct

SEQ ID NO: 7995401 - DNA, 22 bp, Homo sapiens
ggctggctgtgccctgtactct

SEQ ID NO: 7995402 - DNA, 22 bp, Homo sapiens
ggctggctggctggtagacaag

SEQ ID NO: 7995403 - DNA, 22 bp, Homo sapiens
ggctggctggctggtagacaag

SEQ ID NO: 7995404 - DNA, 22 bp, Homo sapiens
ggctggctggctggtagacaag

SEQ ID NO: 7995405 - DNA, 22 bp, Homo sapiens
ggctggctggctggtagacaag

SEQ ID NO: 7995406 - DNA, 22 bp, Homo sapiens
ggctggctggctggtagacaag

SEQ ID NO: 7995407 - DNA, 22 bp, Homo sapiens
ggctggctggctggtagacaag

SEQ ID NO: 7995408 - DNA, 22 bp, Homo sapiens
ggctggctggcttagcagagga

SEQ ID NO: 7995409 - DNA, 22 bp, Homo sapiens
ggctggctggcttagcagagga

SEQ ID NO: 7995410 - DNA, 22 bp, Homo sapiens
ggctggcttgccaagctcaggg

SEQ ID NO: 7995411 - DNA, 22 bp, Homo sapiens
ggctggcttgccaagctcaggg

SEQ ID NO: 7995412 - DNA, 22 bp, Homo sapiens
ggctggcttgccaagctcaggg

SEQ ID NO: 7995413 - DNA, 22 bp, Homo sapiens
ggctggcttgccaagctcaggg

SEQ ID NO: 7995414 - DNA, 22 bp, Homo sapiens
ggctggctgtgccctgtactct

SEQ ID NO: 7995415 - DNA, 22 bp, Homo sapiens
ggctggcttgccaagctcaggg

SEQ ID NO: 7995416 - DNA, 22 bp, Homo sapiens
ggctggcttgccaagctcaggg

SEQ ID NO: 7995417 - DNA, 22 bp, Homo sapiens
ggctggcttgccaagctcaggg

SEQ ID NO: 7995418 - DNA, 22 bp, Homo sapiens
ggctggctgtgccctgtactct

SEQ ID NO: 7995419 - DNA, 22 bp, Homo sapiens
ggctgtggtggcatccctgagc

SEQ ID NO: 7995420 - DNA, 22 bp, Homo sapiens
ggctgtggtggcatccctgagc

SEQ ID NO: 7995421 - DNA, 19 bp, Homo sapiens
ggctgtggtggtgccttgc

SEQ ID NO: 7995422 - DNA, 22 bp, Homo sapiens
ggctggcttgccaagctcaggg

SEQ ID NO: 7995423 - DNA, 22 bp, Homo sapiens
ggctggcttgccaagctcaggg

SEQ ID NO: 7995424 - DNA, 22 bp, Homo sapiens
ggctggctccacctaggtagct

SEQ ID NO: 7995425 - DNA, 22 bp, Homo sapiens
ggctggctccacctaggtagct

SEQ ID NO: 7995426 - DNA, 22 bp, Homo sapiens
ggctggctcatgcaaagggtga

SEQ ID NO: 7995427 - DNA, 22 bp, Homo sapiens
ggctggctccacctaggtagct

SEQ ID NO: 7995428 - DNA, 22 bp, Homo sapiens
ggctggctcttaccgacagcgt

SEQ ID NO: 7995429 - DNA, 22 bp, Homo sapiens
ggctggctccacctaggtagct

SEQ ID NO: 7995430 - DNA, 22 bp, Homo sapiens
ggctggctatctgtggttgcct

SEQ ID NO: 7995431 - DNA, 22 bp, Homo sapiens
ggctggctatctgtggttgcct

SEQ ID NO: 7995432 - DNA, 22 bp, Homo sapiens
ggctggctatctgtggttgcct

SEQ ID NO: 7995433 - DNA, 22 bp, Homo sapiens
ggctggctcagggcttgagaga

SEQ ID NO: 7995434 - DNA, 22 bp, Homo sapiens
ggctggctcagggcttgagaga

SEQ ID NO: 7995435 - DNA, 22 bp, Homo sapiens
ggctggctcagggcttgagaga

SEQ ID NO: 7995436 - DNA, 22 bp, Homo sapiens
ggctggctgataaagggttgag

SEQ ID NO: 7995437 - DNA, 22 bp, Homo sapiens
ggctggctgataaagggttgag

SEQ ID NO: 7995438 - DNA, 22 bp, Homo sapiens
ggctggctgataaagggttgag

SEQ ID NO: 7995439 - DNA, 22 bp, Homo sapiens
ggctggctgataaagggttgag

SEQ ID NO: 7995440 - DNA, 22 bp, Homo sapiens
ggctggctgataaagggttgag

SEQ ID NO: 7995441 - DNA, 22 bp, Homo sapiens
ggctggctgataaagggttgag

SEQ ID NO: 7995442 - DNA, 22 bp, Homo sapiens
ggctggctcttaccgacagcgt

SEQ ID NO: 7995443 - DNA, 22 bp, Homo sapiens
ggctggctcttaccgacagcgt

SEQ ID NO: 7995444 - DNA, 22 bp, Homo sapiens
ggctggctcttaccgacagcgt

SEQ ID NO: 7995445 - DNA, 22 bp, Homo sapiens
ggctggctcttaccgacagcgt

SEQ ID NO: 7995446 - DNA, 22 bp, Homo sapiens
ggctggctcttaccgacagcgt

SEQ ID NO: 7995447 - DNA, 22 bp, Homo sapiens
ggctggctgcatgccccctcct

SEQ ID NO: 7995448 - DNA, 22 bp, Homo sapiens
ggctggctgataaagggttgag

SEQ ID NO: 7995449 - DNA, 22 bp, Homo sapiens
ggctggctgcatgccccctcct

SEQ ID NO: 7995450 - DNA, 22 bp, Homo sapiens
ggctggctgcatgccccctcct

SEQ ID NO: 7995451 - DNA, 22 bp, Homo sapiens
ggctggctggatgaatggatta

SEQ ID NO: 7995452 - DNA, 22 bp, Homo sapiens
ggctggctggatgaatggatta

SEQ ID NO: 7995453 - DNA, 22 bp, Homo sapiens
ggctggctggatgaatggatta

SEQ ID NO: 7995454 - DNA, 22 bp, Homo sapiens
ggcttcccagtccctgctctca

SEQ ID NO: 7995455 - DNA, 22 bp, Homo sapiens
ggcttcccagtccctgctctca

SEQ ID NO: 7995456 - DNA, 22 bp, Homo sapiens
ggcttcccaggcggtccccaca

SEQ ID NO: 7995457 - DNA, 22 bp, Homo sapiens
ggcttcccagcagagggcgcac

SEQ ID NO: 7995458 - DNA, 22 bp, Homo sapiens
ggcttcccaaggagccaggatg

SEQ ID NO: 7995459 - DNA, 17 bp, Homo sapiens
ggcttccaggtggctct

SEQ ID NO: 7995460 - DNA, 17 bp, Homo sapiens
ggcttccaggtggctct

SEQ ID NO: 7995461 - DNA, 17 bp, Homo sapiens
ggcttccaggtggctct

SEQ ID NO: 7995462 - DNA, 22 bp, Homo sapiens
ggcttccagtgatgcctctttg

SEQ ID NO: 7995463 - DNA, 22 bp, Homo sapiens
ggcttccagtgatgcctctttg

SEQ ID NO: 7995464 - DNA, 22 bp, Homo sapiens
ggcttccagctgggccttggag

SEQ ID NO: 7995465 - DNA, 22 bp, Homo sapiens
ggcttccagctgggccttggag

SEQ ID NO: 7995466 - DNA, 22 bp, Homo sapiens
ggcttccaaggtcctctccacc

SEQ ID NO: 7995467 - DNA, 22 bp, Homo sapiens
ggcttccagctgggccttggag

SEQ ID NO: 7995468 - DNA, 20 bp, Homo sapiens
ggcttccccgccatcttccg

SEQ ID NO: 7995469 - DNA, 22 bp, Homo sapiens
ggcttccccacagtcctgagct

SEQ ID NO: 7995470 - DNA, 22 bp, Homo sapiens
ggcttcccctccagtgctctgt

SEQ ID NO: 7995471 - DNA, 22 bp, Homo sapiens
ggcttcccagtccctgctctca

SEQ ID NO: 7995472 - DNA, 22 bp, Homo sapiens
ggcttccccacaaagcacacaa

SEQ ID NO: 7995473 - DNA, 22 bp, Homo sapiens
ggcttccctaaacctttccact

SEQ ID NO: 7995474 - DNA, 22 bp, Homo sapiens
ggcttccctaaacctttccact

SEQ ID NO: 7995475 - DNA, 18 bp, Homo sapiens
ggcttccctactcacttc

SEQ ID NO: 7995476 - DNA, 22 bp, Homo sapiens
ggcttccctgcctcacttattc

SEQ ID NO: 7995477 - DNA, 22 bp, Homo sapiens
ggcttccctgtttgctgtgcct

SEQ ID NO: 7995478 - DNA, 22 bp, Homo sapiens
ggcttccctgtttgctgtgcct

SEQ ID NO: 7995479 - DNA, 19 bp, Homo sapiens
ggcttcagtttagcaggct

SEQ ID NO: 7995480 - DNA, 22 bp, Homo sapiens
ggcttccaaggtcctctccacc

SEQ ID NO: 7995481 - DNA, 22 bp, Homo sapiens
ggcttccaaggtcctctccacc

SEQ ID NO: 7995482 - DNA, 22 bp, Homo sapiens
ggcttcatttctgtccttgatt

SEQ ID NO: 7995483 - DNA, 22 bp, Homo sapiens
ggcttcagtggccagagatgat

SEQ ID NO: 7995484 - DNA, 22 bp, Homo sapiens
ggcttcagtgagctgagctcac

SEQ ID NO: 7995485 - DNA, 22 bp, Homo sapiens
ggcttcagtgagctgagctcac

SEQ ID NO: 7995486 - DNA, 22 bp, Homo sapiens
ggcttcaggggtctgtctgcac

SEQ ID NO: 7995487 - DNA, 23 bp, Homo sapiens
ggcttcagtgagagtccctgctg

SEQ ID NO: 7995488 - DNA, 23 bp, Homo sapiens
ggcttcagtgagagtccctgctg

SEQ ID NO: 7995489 - DNA, 22 bp, Homo sapiens
ggcttcagtgactggtgccctc

SEQ ID NO: 7995490 - DNA, 22 bp, Homo sapiens
ggctgtgtccccacctgagcag

SEQ ID NO: 7995491 - DNA, 19 bp, Homo sapiens
ggctgtggtggtgccttgc

SEQ ID NO: 7995492 - DNA, 22 bp, Homo sapiens
ggctgtgtccccacctgagcag

SEQ ID NO: 7995493 - DNA, 22 bp, Homo sapiens
ggctgtgtcctgtatgattatt

SEQ ID NO: 7995494 - DNA, 22 bp, Homo sapiens
ggctgtgtggccgtgggctcta

SEQ ID NO: 7995495 - DNA, 22 bp, Homo sapiens
ggctgtgtggccgtgggctcta

SEQ ID NO: 7995496 - DNA, 22 bp, Homo sapiens
ggctgtgttccaagtgtcagga

SEQ ID NO: 7995497 - DNA, 21 bp, Homo sapiens
ggctgtgttcagggcatgcgg

SEQ ID NO: 7995498 - DNA, 22 bp, Homo sapiens
ggcaggtgctctgtgggcctgg

SEQ ID NO: 7995499 - DNA, 22 bp, Homo sapiens
ggcaggtgctctgtgggcctgg

SEQ ID NO: 7995500 - DNA, 22 bp, Homo sapiens
ggcaggtgctctgtgggcctgg

SEQ ID NO: 7995501 - DNA, 22 bp, Homo sapiens
ggcaggtgctctgtgggcctgg

SEQ ID NO: 7995502 - DNA, 22 bp, Homo sapiens
ggcaggtgctctgtgggcctgg

SEQ ID NO: 7995503 - DNA, 22 bp, Homo sapiens
ggcaggtgctgggagcatctca

SEQ ID NO: 7995504 - DNA, 22 bp, Homo sapiens
ggcaggtgctgggagcatctca

SEQ ID NO: 7995505 - DNA, 22 bp, Homo sapiens
ggcaggtgctgggagcatctca

SEQ ID NO: 7995506 - DNA, 22 bp, Homo sapiens
ggcaggtgctgggagcatctca

SEQ ID NO: 7995507 - DNA, 22 bp, Homo sapiens
ggcaggtgctgggagcatctca

SEQ ID NO: 7995508 - DNA, 22 bp, Homo sapiens
ggcaggtgctgggagcatctca

SEQ ID NO: 7995509 - DNA, 22 bp, Homo sapiens
ggcaggtgcttgtcgaaggcct

SEQ ID NO: 7995510 - DNA, 22 bp, Homo sapiens
ggcaggtgcttgtcgaaggcct

SEQ ID NO: 7995511 - DNA, 22 bp, Homo sapiens
ggcaggtgcttgtcgaaggcct

SEQ ID NO: 7995512 - DNA, 22 bp, Homo sapiens
ggcaggtgcttgtcgaaggcct

SEQ ID NO: 7995513 - DNA, 22 bp, Homo sapiens
ggcaggtgcttgtcgaaggcct

SEQ ID NO: 7995514 - DNA, 22 bp, Homo sapiens
ggcaggtggaagttggcagagc

SEQ ID NO: 7995515 - DNA, 22 bp, Homo sapiens
ggcaggtggaagttggcagagc

SEQ ID NO: 7995516 - DNA, 22 bp, Homo sapiens
ggcaggtggaagttggcagagc

SEQ ID NO: 7995517 - DNA, 22 bp, Homo sapiens
ggcaggtggaaggtctccattc

SEQ ID NO: 7995518 - DNA, 22 bp, Homo sapiens
ggccagagaagtcagacccttg

SEQ ID NO: 7995519 - DNA, 22 bp, Homo sapiens
ggccagagaagtcagacccttg

SEQ ID NO: 7995520 - DNA, 22 bp, Homo sapiens
ggccagagaagtcagacccttg

SEQ ID NO: 7995521 - DNA, 22 bp, Homo sapiens
ggccagagaagtcagacccttg

SEQ ID NO: 7995522 - DNA, 22 bp, Homo sapiens
ggccagagaatatgccttacgt

SEQ ID NO: 7995523 - DNA, 22 bp, Homo sapiens
ggccagagaatatgccttacgt

SEQ ID NO: 7995524 - DNA, 22 bp, Homo sapiens
ggccagaagttggaaaagagcc

SEQ ID NO: 7995525 - DNA, 22 bp, Homo sapiens
ggccagaagttggaaaagagcc

SEQ ID NO: 7995526 - DNA, 22 bp, Homo sapiens
ggccagaagttggaaaagagcc

SEQ ID NO: 7995527 - DNA, 22 bp, Homo sapiens
ggccagaagttggaaaagagcc

SEQ ID NO: 7995528 - DNA, 22 bp, Homo sapiens
ggccagaagttggaaaagagcc

SEQ ID NO: 7995529 - DNA, 22 bp, Homo sapiens
ggccagaagttggaaaagagcc

SEQ ID NO: 7995530 - DNA, 22 bp, Homo sapiens
ggccagacatatcgctcccaaa

SEQ ID NO: 7995531 - DNA, 22 bp, Homo sapiens
ggccagaagttggaaaagagcc

SEQ ID NO: 7995532 - DNA, 22 bp, Homo sapiens
ggccacctgggttcgactgggc

SEQ ID NO: 7995533 - DNA, 22 bp, Homo sapiens
ggccaccttcctgtggtctctg

SEQ ID NO: 7995534 - DNA, 20 bp, Homo sapiens
ggccacctgcttcagacccc

SEQ ID NO: 7995535 - DNA, 22 bp, Homo sapiens
ggccagaggccatcctcctgct

SEQ ID NO: 7995536 - DNA, 22 bp, Homo sapiens
ggccagaggccatcctcctgct

SEQ ID NO: 7995537 - DNA, 22 bp, Homo sapiens
ggccagaggccacagctgtgtc

SEQ ID NO: 7995538 - DNA, 22 bp, Homo sapiens
ggccagaggccacagctgtgtc

SEQ ID NO: 7995539 - DNA, 22 bp, Homo sapiens
ggccagaggccacagctgtgtc

SEQ ID NO: 7995540 - DNA, 22 bp, Homo sapiens
ggccagaggccacagctgtgtc

SEQ ID NO: 7995541 - DNA, 22 bp, Homo sapiens
ggccagaggccacagctgtgtc

SEQ ID NO: 7995542 - DNA, 22 bp, Homo sapiens
ggccagaggccacagctgtgtc

SEQ ID NO: 7995543 - DNA, 22 bp, Homo sapiens
ggccagaggacctctcatagcc

SEQ ID NO: 7995544 - DNA, 22 bp, Homo sapiens
ggccagaggacctctcatagcc

SEQ ID NO: 7995545 - DNA, 22 bp, Homo sapiens
ggccagagagcagccaggattc

SEQ ID NO: 7995546 - DNA, 22 bp, Homo sapiens
ggccagagagcagccaggattc

SEQ ID NO: 7995547 - DNA, 22 bp, Homo sapiens
ggccagagagcagccaggattc

SEQ ID NO: 7995548 - DNA, 22 bp, Homo sapiens
ggccagagagcagccaggattc

SEQ ID NO: 7995549 - DNA, 22 bp, Homo sapiens
ggccagagagcagccaggattc

SEQ ID NO: 7995550 - DNA, 22 bp, Homo sapiens
ggccagagagcagccaggattc

SEQ ID NO: 7995551 - DNA, 22 bp, Homo sapiens
ggccagagctgacctatcaatg

SEQ ID NO: 7995552 - DNA, 22 bp, Homo sapiens
ggccagagagccgctgttagga

SEQ ID NO: 7995553 - DNA, 22 bp, Homo sapiens
ggccagagctcaaacagtcgca

SEQ ID NO: 7995554 - DNA, 22 bp, Homo sapiens
ggccagagctcaaacagtcgca

SEQ ID NO: 7995555 - DNA, 22 bp, Homo sapiens
ggccagagagccgctgttagga

SEQ ID NO: 7995556 - DNA, 18 bp, Homo sapiens
ggccagagggagggtccc

SEQ ID NO: 7995557 - DNA, 18 bp, Homo sapiens
ggccagagggagggtccc

SEQ ID NO: 7995558 - DNA, 18 bp, Homo sapiens
ggccagagggagggtccc

SEQ ID NO: 7995559 - DNA, 22 bp, Homo sapiens
ggccagaggtggtacatagctt

SEQ ID NO: 7995560 - DNA, 22 bp, Homo sapiens
ggccagaggtggtacatagctt

SEQ ID NO: 7995561 - DNA, 22 bp, Homo sapiens
ggccagaggtgtcctcagttct

SEQ ID NO: 7995562 - DNA, 22 bp, Homo sapiens
ggccatgggaagaggtggagag

SEQ ID NO: 7995563 - DNA, 22 bp, Homo sapiens
ggccatgggaagaggtggagag

SEQ ID NO: 7995564 - DNA, 22 bp, Homo sapiens
ggccatgggaagaggtggagag

SEQ ID NO: 7995565 - DNA, 22 bp, Homo sapiens
ggccatgggaagaggtggagag

SEQ ID NO: 7995566 - DNA, 18 bp, Homo sapiens
ggccagagggagggtccc

SEQ ID NO: 7995567 - DNA, 18 bp, Homo sapiens
ggccagagggagggtccc

SEQ ID NO: 7995568 - DNA, 18 bp, Homo sapiens
ggccagagggagggtccc

SEQ ID NO: 7995569 - DNA, 22 bp, Homo sapiens
ggccagagggagggcacaaatc

SEQ ID NO: 7995570 - DNA, 22 bp, Homo sapiens
ggccagagggagggcacaaatc

SEQ ID NO: 7995571 - DNA, 22 bp, Homo sapiens
ggccagagggagggcacaaatc

SEQ ID NO: 7995572 - DNA, 18 bp, Homo sapiens
ggccagagggagggtccc

SEQ ID NO: 7995573 - DNA, 17 bp, Homo sapiens
ggccagaggcggggctg

SEQ ID NO: 7995574 - DNA, 17 bp, Homo sapiens
ggccagaggcggggctg

SEQ ID NO: 7995575 - DNA, 17 bp, Homo sapiens
ggccagaggcggggctg

SEQ ID NO: 7995576 - DNA, 17 bp, Homo sapiens
ggccagaggcggggctg

SEQ ID NO: 7995577 - DNA, 20 bp, Homo sapiens
ggccatgggttgcctgaggt

SEQ ID NO: 7995578 - DNA, 20 bp, Homo sapiens
ggccatgggttgcctgaggt

SEQ ID NO: 7995579 - DNA, 20 bp, Homo sapiens
ggccatgggttgcctgaggt

SEQ ID NO: 7995580 - DNA, 20 bp, Homo sapiens
ggccatgggttgcctgaggt

SEQ ID NO: 7995581 - DNA, 22 bp, Homo sapiens
ggccatggggacagagggtgaa

SEQ ID NO: 7995582 - DNA, 20 bp, Homo sapiens
ggccatgggttgcctgaggt

SEQ ID NO: 7995583 - DNA, 22 bp, Homo sapiens
ggccatggtcatgggtgagctt

SEQ ID NO: 7995584 - DNA, 22 bp, Homo sapiens
ggccatggtcatgggtgagctt

SEQ ID NO: 7995585 - DNA, 22 bp, Homo sapiens
ggccatggtcatgggtgagctt

SEQ ID NO: 7995586 - DNA, 22 bp, Homo sapiens
ggccatggtcatgggtgagctt

SEQ ID NO: 7995587 - DNA, 22 bp, Homo sapiens
ggccatggtgaggtcttctcag

SEQ ID NO: 7995588 - DNA, 22 bp, Homo sapiens
ggccatggtgaggtcttctcag

SEQ ID NO: 7995589 - DNA, 20 bp, Homo sapiens
ggccatgggttgcctgaggt

SEQ ID NO: 7995590 - DNA, 22 bp, Homo sapiens
ggccatggtggtttgagcacct

SEQ ID NO: 7995591 - DNA, 22 bp, Homo sapiens
ggccatggtggtttgagcacct

SEQ ID NO: 7995592 - DNA, 22 bp, Homo sapiens
ggccatggttggggaagacatg

SEQ ID NO: 7995593 - DNA, 22 bp, Homo sapiens
ggccatggtggtttgagcacct

SEQ ID NO: 7995594 - DNA, 17 bp, Homo sapiens
ggccatggtgcaaggtt

SEQ ID NO: 7995595 - DNA, 17 bp, Homo sapiens
ggccatggtgcaaggtt

SEQ ID NO: 7995596 - DNA, 22 bp, Homo sapiens
ggccatggtgaggtcttctcag

SEQ ID NO: 7995597 - DNA, 17 bp, Homo sapiens
ggccatggtgcaaggtt

SEQ ID NO: 7995598 - DNA, 17 bp, Homo sapiens
ggccatggtgcaaggtt

SEQ ID NO: 7995599 - DNA, 22 bp, Homo sapiens
ggccatgtttggcagaaggatt

SEQ ID NO: 7995600 - DNA, 22 bp, Homo sapiens
ggccatggttggggaagacatg

SEQ ID NO: 7995601 - DNA, 22 bp, Homo sapiens
ggccatggttggggaagacatg

SEQ ID NO: 7995602 - DNA, 22 bp, Homo sapiens
ggcccaaaccaagtacctcaaa

SEQ ID NO: 7995603 - DNA, 22 bp, Homo sapiens
ggcccacttgaaatggagctca

SEQ ID NO: 7995604 - DNA, 22 bp, Homo sapiens
ggcccacttgaaatggagctca

SEQ ID NO: 7995605 - DNA, 22 bp, Homo sapiens
ggcccagaaaaaggcttagaat

SEQ ID NO: 7995606 - DNA, 22 bp, Homo sapiens
ggcccagaaaaaggcttagaat

SEQ ID NO: 7995607 - DNA, 22 bp, Homo sapiens
ggcccagaaaaaggcttagaat

SEQ ID NO: 7995608 - DNA, 22 bp, Homo sapiens
ggcccagaagccagaagcctcc

SEQ ID NO: 7995609 - DNA, 22 bp, Homo sapiens
ggcccacatggaagcatcgagg

SEQ ID NO: 7995610 - DNA, 22 bp, Homo sapiens
ggcccagccggcgagtctcgcg

SEQ ID NO: 7995611 - DNA, 22 bp, Homo sapiens
ggcccagccggcgagtctcgcg

SEQ ID NO: 7995612 - DNA, 22 bp, Homo sapiens
ggcccagccggcgagtctcgcg

SEQ ID NO: 7995613 - DNA, 22 bp, Homo sapiens
ggcccagcccgagtcagccttc

SEQ ID NO: 7995614 - DNA, 22 bp, Homo sapiens
ggcccagcccgagtcagccttc

SEQ ID NO: 7995615 - DNA, 22 bp, Homo sapiens
ggcccagccggcgagtctcgcg

SEQ ID NO: 7995616 - DNA, 22 bp, Homo sapiens
ggcccagccggcgagtctcgcg

SEQ ID NO: 7995617 - DNA, 22 bp, Homo sapiens
ggcccaaggtgccaaggcctcc

SEQ ID NO: 7995618 - DNA, 22 bp, Homo sapiens
ggcccaaggcccaggtcgagct

SEQ ID NO: 7995619 - DNA, 22 bp, Homo sapiens
ggcccaaatctccacttgttgc

SEQ ID NO: 7995620 - DNA, 22 bp, Homo sapiens
ggcccaaaccagctgggcagga

SEQ ID NO: 7995621 - DNA, 22 bp, Homo sapiens
ggcccaaacgggtccagtgaaa

SEQ ID NO: 7995622 - DNA, 22 bp, Homo sapiens
ggcccaaaggagtcttggacca

SEQ ID NO: 7995623 - DNA, 22 bp, Homo sapiens
ggcccaaagggctctgtgggct

SEQ ID NO: 7995624 - DNA, 22 bp, Homo sapiens
ggcccacactgacagctgagct

SEQ ID NO: 7995625 - DNA, 22 bp, Homo sapiens
ggcccacactgacagctgagct

SEQ ID NO: 7995626 - DNA, 22 bp, Homo sapiens
ggcccacactgacagctgagct

SEQ ID NO: 7995627 - DNA, 19 bp, Homo sapiens
ggcccaagtactgagtgcc

SEQ ID NO: 7995628 - DNA, 19 bp, Homo sapiens
ggcccaagtactgagtgcc

SEQ ID NO: 7995629 - DNA, 19 bp, Homo sapiens
ggcccaagtactgagtgcc

SEQ ID NO: 7995630 - DNA, 22 bp, Homo sapiens
ggcccctcagcatctgagtcag

SEQ ID NO: 7995631 - DNA, 22 bp, Homo sapiens
ggcccctcagcatctgagtcag

SEQ ID NO: 7995632 - DNA, 22 bp, Homo sapiens
ggcccctcagcatctgagtcag

SEQ ID NO: 7995633 - DNA, 17 bp, Homo sapiens
ggcccctatctcccttc

SEQ ID NO: 7995634 - DNA, 22 bp, Homo sapiens
ggcccctcagcatctgagtcag

SEQ ID NO: 7995635 - DNA, 22 bp, Homo sapiens
ggcccctcttgtggcacatacg

SEQ ID NO: 7995636 - DNA, 19 bp, Homo sapiens
ggcccctctcacaggagtt

SEQ ID NO: 7995637 - DNA, 19 bp, Homo sapiens
ggcccctctcacaggagtt

SEQ ID NO: 7995638 - DNA, 19 bp, Homo sapiens
ggcccctctcacaggagtt

SEQ ID NO: 7995639 - DNA, 22 bp, Homo sapiens
ggcccctgcggactgcctagag

SEQ ID NO: 7995640 - DNA, 22 bp, Homo sapiens
ggcccctcttgtggcacatacg

SEQ ID NO: 7995641 - DNA, 22 bp, Homo sapiens
ggcccctcttgtggcacatacg

SEQ ID NO: 7995642 - DNA, 22 bp, Homo sapiens
ggcccctgcggactgcctagag

SEQ ID NO: 7995643 - DNA, 22 bp, Homo sapiens
ggcccctgcggactgcctagag

SEQ ID NO: 7995644 - DNA, 22 bp, Homo sapiens
ggcccctgcggactgcctagag

SEQ ID NO: 7995645 - DNA, 22 bp, Homo sapiens
ggccccagttcactcctggccg

SEQ ID NO: 7995646 - DNA, 22 bp, Homo sapiens
ggccccagttcactcctggccg

SEQ ID NO: 7995647 - DNA, 22 bp, Homo sapiens
ggccccagttcactcctggccg

SEQ ID NO: 7995648 - DNA, 22 bp, Homo sapiens
ggccccagttcactcctggccg

SEQ ID NO: 7995649 - DNA, 22 bp, Homo sapiens
ggccccagttcactcctggccg

SEQ ID NO: 7995650 - DNA, 22 bp, Homo sapiens
ggccccaggtctgaacacgctg

SEQ ID NO: 7995651 - DNA, 22 bp, Homo sapiens
ggccccaggtctgaacacgctg

SEQ ID NO: 7995652 - DNA, 21 bp, Homo sapiens
ggccccgcagacccagcacgt

SEQ ID NO: 7995653 - DNA, 22 bp, Homo sapiens
ggcccctaacatctctcaccaa

SEQ ID NO: 7995654 - DNA, 22 bp, Homo sapiens
ggcccctaacatctctcaccaa

SEQ ID NO: 7995655 - DNA, 22 bp, Homo sapiens
ggccccagttcactcctggccg

SEQ ID NO: 7995656 - DNA, 22 bp, Homo sapiens
ggccccagttcactcctggccg

SEQ ID NO: 7995657 - DNA, 22 bp, Homo sapiens
ggcccccagggtgggtgtagac

SEQ ID NO: 7995658 - DNA, 22 bp, Homo sapiens
ggcccagcgaggccacctacag

SEQ ID NO: 7995659 - DNA, 22 bp, Homo sapiens
ggcccagcgaggccacctacag

SEQ ID NO: 7995660 - DNA, 22 bp, Homo sapiens
ggccccacgggggagtcctagt

SEQ ID NO: 7995661 - DNA, 22 bp, Homo sapiens
ggccccagattctgggctgggt

SEQ ID NO: 7995662 - DNA, 22 bp, Homo sapiens
ggccccagattctgggctgggt

SEQ ID NO: 7995663 - DNA, 22 bp, Homo sapiens
ggccccagattctgggctgggt

SEQ ID NO: 7995664 - DNA, 22 bp, Homo sapiens
ggccccagattctgggctgggt

SEQ ID NO: 7995665 - DNA, 22 bp, Homo sapiens
ggccccagattctgggctgggt

SEQ ID NO: 7995666 - DNA, 22 bp, Homo sapiens
ggccccagattctgggctgggt

SEQ ID NO: 7995667 - DNA, 22 bp, Homo sapiens
ggccccagcagaccctcctctg

SEQ ID NO: 7995668 - DNA, 22 bp, Homo sapiens
ggccccagcagaccctcctctg

SEQ ID NO: 7995669 - DNA, 22 bp, Homo sapiens
ggccccaggtagaagatataga

SEQ ID NO: 7995670 - DNA, 22 bp, Homo sapiens
ggcccagccttggggtttcttt

SEQ ID NO: 7995671 - DNA, 22 bp, Homo sapiens
ggcccagccttggggtttcttt

SEQ ID NO: 7995672 - DNA, 22 bp, Homo sapiens
ggcccagcgaggccacctacag

SEQ ID NO: 7995673 - DNA, 22 bp, Homo sapiens
ggcccagcgaggccacctacag

SEQ ID NO: 7995674 - DNA, 22 bp, Homo sapiens
ggcccagccttggggtttcttt

SEQ ID NO: 7995675 - DNA, 22 bp, Homo sapiens
ggcccagcctggcaacaatgac

SEQ ID NO: 7995676 - DNA, 22 bp, Homo sapiens
ggcccagcctggcaacaatgac

SEQ ID NO: 7995677 - DNA, 22 bp, Homo sapiens
ggcccagcctggcaacaatgac

SEQ ID NO: 7995678 - DNA, 22 bp, Homo sapiens
ggcccagccttggggtttcttt

SEQ ID NO: 7995679 - DNA, 22 bp, Homo sapiens
ggcccagcctcagacatgccct

SEQ ID NO: 7995680 - DNA, 22 bp, Homo sapiens
ggcccagcctcagacatgccct

SEQ ID NO: 7995681 - DNA, 22 bp, Homo sapiens
ggcccagcctcagacatgccct

SEQ ID NO: 7995682 - DNA, 22 bp, Homo sapiens
ggcccagcctcagacatgccct

SEQ ID NO: 7995683 - DNA, 22 bp, Homo sapiens
ggcccagcctcagacatgccct

SEQ ID NO: 7995684 - DNA, 22 bp, Homo sapiens
ggcccagcctcagacatgccct

SEQ ID NO: 7995685 - DNA, 22 bp, Homo sapiens
ggcccagcctggcaacaatgac

SEQ ID NO: 7995686 - DNA, 22 bp, Homo sapiens
ggccctcttttatccatcataa

SEQ ID NO: 7995687 - DNA, 22 bp, Homo sapiens
ggccctcttgatatccagcggc

SEQ ID NO: 7995688 - DNA, 22 bp, Homo sapiens
ggccctctttagacagagtagg

SEQ ID NO: 7995689 - DNA, 22 bp, Homo sapiens
ggccctcttgatatccagcggc

SEQ ID NO: 7995690 - DNA, 22 bp, Homo sapiens
ggccctctgtggctgccatgga

SEQ ID NO: 7995691 - DNA, 22 bp, Homo sapiens
ggccctctgtggctgccatgga

SEQ ID NO: 7995692 - DNA, 22 bp, Homo sapiens
ggccctcttttggtttggatgt

SEQ ID NO: 7995693 - DNA, 22 bp, Homo sapiens
ggccctctggcttccgcatggg

SEQ ID NO: 7995694 - DNA, 22 bp, Homo sapiens
ggccctctggtgagtatcacat

SEQ ID NO: 7995695 - DNA, 22 bp, Homo sapiens
ggccctctgtggctgccatgga

SEQ ID NO: 7995696 - DNA, 22 bp, Homo sapiens
ggccctctggtgagtatcacat

SEQ ID NO: 7995697 - DNA, 22 bp, Homo sapiens
ggccctctgtggctgccatgga

SEQ ID NO: 7995698 - DNA, 22 bp, Homo sapiens
ggccctctgtggctgccatgga

SEQ ID NO: 7995699 - DNA, 22 bp, Homo sapiens
ggccctctgtggctgccatgga

SEQ ID NO: 7995700 - DNA, 22 bp, Homo sapiens
ggccctctggcttccgcatggg

SEQ ID NO: 7995701 - DNA, 22 bp, Homo sapiens
ggccctctgctctgagatgaag

SEQ ID NO: 7995702 - DNA, 22 bp, Homo sapiens
ggccctctgctcacttcctatt

SEQ ID NO: 7995703 - DNA, 22 bp, Homo sapiens
ggccctctggcttccgcatggg

SEQ ID NO: 7995704 - DNA, 22 bp, Homo sapiens
ggccctctggcttccgcatggg

SEQ ID NO: 7995705 - DNA, 22 bp, Homo sapiens
ggccctctgctcacttcctatt

SEQ ID NO: 7995706 - DNA, 22 bp, Homo sapiens
ggccctctgcctgtgctggcga

SEQ ID NO: 7995707 - DNA, 22 bp, Homo sapiens
ggccctctgctcacttcctatt

SEQ ID NO: 7995708 - DNA, 22 bp, Homo sapiens
ggccctctgcctgtgctggcga

SEQ ID NO: 7995709 - DNA, 22 bp, Homo sapiens
ggccctctgcctgtgctggcga

SEQ ID NO: 7995710 - DNA, 22 bp, Homo sapiens
ggccctctgcctgtgctggcga

SEQ ID NO: 7995711 - DNA, 22 bp, Homo sapiens
ggccctctgagtagctgcaaac

SEQ ID NO: 7995712 - DNA, 22 bp, Homo sapiens
ggccctctgatccaactggtat

SEQ ID NO: 7995713 - DNA, 22 bp, Homo sapiens
ggccctctgatacagaagaatg

SEQ ID NO: 7995714 - DNA, 22 bp, Homo sapiens
ggccctctgagtagctgcaaac

SEQ ID NO: 7995715 - DNA, 22 bp, Homo sapiens
ggccctctctacatgttagacg

SEQ ID NO: 7995716 - DNA, 22 bp, Homo sapiens
ggccctctccaactctgttcca

SEQ ID NO: 7995717 - DNA, 22 bp, Homo sapiens
ggccctctccaactctgttcca

SEQ ID NO: 7995718 - DNA, 22 bp, Homo sapiens
ggccctctccaactctgttcca

SEQ ID NO: 7995719 - DNA, 22 bp, Homo sapiens
ggccctccctgagccaggtggg

SEQ ID NO: 7995720 - DNA, 22 bp, Homo sapiens
ggcccctgtaaaatgtacatgt

SEQ ID NO: 7995721 - DNA, 22 bp, Homo sapiens
ggcccctggcaccaggctgatt

SEQ ID NO: 7995722 - DNA, 22 bp, Homo sapiens
ggccctgcaaggtacccaggcc

SEQ ID NO: 7995723 - DNA, 22 bp, Homo sapiens
ggccctgcgattaggtggcagg

SEQ ID NO: 7995724 - DNA, 22 bp, Homo sapiens
ggcctggctggttcagtaccct

SEQ ID NO: 7995725 - DNA, 22 bp, Homo sapiens
ggccctgcgattaggtggcagg

SEQ ID NO: 7995726 - DNA, 22 bp, Homo sapiens
ggccctgcgattaggtggcagg

SEQ ID NO: 7995727 - DNA, 22 bp, Homo sapiens
ggccctgcgattaggtggcagg

SEQ ID NO: 7995728 - DNA, 22 bp, Homo sapiens
ggccctgagcacagctcctctc

SEQ ID NO: 7995729 - DNA, 22 bp, Homo sapiens
ggccctgcaaggtacccaggcc

SEQ ID NO: 7995730 - DNA, 22 bp, Homo sapiens
ggccctgcaaggtacccaggcc

SEQ ID NO: 7995731 - DNA, 23 bp, Homo sapiens
ggcctgtgttttgtctgaagtac

SEQ ID NO: 7995732 - DNA, 22 bp, Homo sapiens
ggcctgggcctttgtgttttga

SEQ ID NO: 7995733 - DNA, 22 bp, Homo sapiens
ggcctgggcccactgtcaagag

SEQ ID NO: 7995734 - DNA, 22 bp, Homo sapiens
ggcctgggcccactgtcaagag

SEQ ID NO: 7995735 - DNA, 22 bp, Homo sapiens
ggcctgggcccactgtcaagag

SEQ ID NO: 7995736 - DNA, 22 bp, Homo sapiens
ggcctgggcccactgtcaagag

SEQ ID NO: 7995737 - DNA, 22 bp, Homo sapiens
ggcctgggcccactgtcaagag

SEQ ID NO: 7995738 - DNA, 22 bp, Homo sapiens
ggcctggctggttcagtaccct

SEQ ID NO: 7995739 - DNA, 22 bp, Homo sapiens
ggcctggctggttcagtaccct

SEQ ID NO: 7995740 - DNA, 22 bp, Homo sapiens
ggcctggctggttcagtaccct

SEQ ID NO: 7995741 - DNA, 22 bp, Homo sapiens
ggccttgcagccacagaacaca

SEQ ID NO: 7995742 - DNA, 22 bp, Homo sapiens
ggccttgcggaacgctcaggcg

SEQ ID NO: 7995743 - DNA, 22 bp, Homo sapiens
ggccttgcctcaatagctccac

SEQ ID NO: 7995744 - DNA, 23 bp, Homo sapiens
ggccttgcagtaaaccaaatgac

SEQ ID NO: 7995745 - DNA, 22 bp, Homo sapiens
ggccttgccaaggagcccttaa

SEQ ID NO: 7995746 - DNA, 22 bp, Homo sapiens
ggccttctgcctttcagcaatg

SEQ ID NO: 7995747 - DNA, 22 bp, Homo sapiens
ggccttgagagccagtgcaggc

SEQ ID NO: 7995748 - DNA, 22 bp, Homo sapiens
ggccttgatcctccagagcact

SEQ ID NO: 7995749 - DNA, 22 bp, Homo sapiens
ggccttggagtcctccactgga

SEQ ID NO: 7995750 - DNA, 22 bp, Homo sapiens
ggccttggagtcctccactgga

SEQ ID NO: 7995751 - DNA, 20 bp, Homo sapiens
ggccttggaatagcacagct

SEQ ID NO: 7995752 - DNA, 20 bp, Homo sapiens
ggccttggaatagcacagct

SEQ ID NO: 7995753 - DNA, 20 bp, Homo sapiens
ggccttggaatagcacagct

SEQ ID NO: 7995754 - DNA, 19 bp, Homo sapiens
ggccttgctctgtggcagc

SEQ ID NO: 7995755 - DNA, 19 bp, Homo sapiens
ggccttgctctgtggcagc

SEQ ID NO: 7995756 - DNA, 19 bp, Homo sapiens
ggccttgctctgtggcagc

SEQ ID NO: 7995757 - DNA, 20 bp, Homo sapiens
ggccttgctctgtgaccccc

SEQ ID NO: 7995758 - DNA, 15 bp, Homo sapiens
ggccttgctatttcc

SEQ ID NO: 7995759 - DNA, 22 bp, Homo sapiens
ggccttgcttgggttatatgcc

SEQ ID NO: 7995760 - DNA, 22 bp, Homo sapiens
ggccttggaaagatacccagct

SEQ ID NO: 7995761 - DNA, 22 bp, Homo sapiens
ggccttgcttctgggcatggtt

SEQ ID NO: 7995762 - DNA, 22 bp, Homo sapiens
ggccttgcttctgggcatggtt

SEQ ID NO: 7995763 - DNA, 20 bp, Homo sapiens
ggccttgcttctccggcttc

SEQ ID NO: 7995764 - DNA, 22 bp, Homo sapiens
ggccttgctgcttccagaaggt

SEQ ID NO: 7995765 - DNA, 22 bp, Homo sapiens
ggccttgctgcttccagaaggt

SEQ ID NO: 7995766 - DNA, 22 bp, Homo sapiens
ggccttcacgtgacctggcgtg

SEQ ID NO: 7995767 - DNA, 22 bp, Homo sapiens
ggccttcacgtgacctggcgtg

SEQ ID NO: 7995768 - DNA, 22 bp, Homo sapiens
ggccttaggttccctgcctcca

SEQ ID NO: 7995769 - DNA, 18 bp, Homo sapiens
ggccttagtatgtgcctt

SEQ ID NO: 7995770 - DNA, 22 bp, Homo sapiens
ggccttagtgaggtcctgatgc

SEQ ID NO: 7995771 - DNA, 20 bp, Homo sapiens
ggccttagggagggctgtaa

SEQ ID NO: 7995772 - DNA, 22 bp, Homo sapiens
ggccttaggctcaacaggcaga

SEQ ID NO: 7995773 - DNA, 22 bp, Homo sapiens
ggccttagctgtctttcctttg

SEQ ID NO: 7995774 - DNA, 22 bp, Homo sapiens
ggccttagcggtcatagcaaag

SEQ ID NO: 7995775 - DNA, 22 bp, Homo sapiens
ggccttagagaccacctagtct

SEQ ID NO: 7995776 - DNA, 22 bp, Homo sapiens
ggccttccagggaagacagggc

SEQ ID NO: 7995777 - DNA, 22 bp, Homo sapiens
ggccttccagggaagacagggc

SEQ ID NO: 7995778 - DNA, 22 bp, Homo sapiens
ggccttccatctgcctctgttt

SEQ ID NO: 7995779 - DNA, 21 bp, Homo sapiens
ggccttcccctgcagtctccg

SEQ ID NO: 7995780 - DNA, 22 bp, Homo sapiens
ggccttccatctgcctctgttt

SEQ ID NO: 7995781 - DNA, 22 bp, Homo sapiens
ggccttccatctgcctctgttt

SEQ ID NO: 7995782 - DNA, 22 bp, Homo sapiens
ggccttccatctgcctctgttt

SEQ ID NO: 7995783 - DNA, 22 bp, Homo sapiens
ggccttcctggcggctcagggt

SEQ ID NO: 7995784 - DNA, 22 bp, Homo sapiens
ggccttcctgttgtgtccaccg

SEQ ID NO: 7995785 - DNA, 22 bp, Homo sapiens
ggccttcctgttgtgtccaccg

SEQ ID NO: 7995786 - DNA, 22 bp, Homo sapiens
ggccttcctgttgtgtccaccg

SEQ ID NO: 7995787 - DNA, 22 bp, Homo sapiens
ggccttccttcccagcctactg

SEQ ID NO: 7995788 - DNA, 22 bp, Homo sapiens
ggccttccttcccagcctactg

SEQ ID NO: 7995789 - DNA, 22 bp, Homo sapiens
ggccttccttcccagcctactg

SEQ ID NO: 7995790 - DNA, 22 bp, Homo sapiens
ggccttcctggcggctcagggt

SEQ ID NO: 7995791 - DNA, 22 bp, Homo sapiens
ggccttcctggcggctcagggt

SEQ ID NO: 7995792 - DNA, 22 bp, Homo sapiens
ggccttcctgctgctccgggcc

SEQ ID NO: 7995793 - DNA, 22 bp, Homo sapiens
ggccttcctgctgctccgggcc

SEQ ID NO: 7995794 - DNA, 21 bp, Homo sapiens
ggccttcccctgcagtctccg

SEQ ID NO: 7995795 - DNA, 21 bp, Homo sapiens
ggccttcccctgcagtctccg

SEQ ID NO: 7995796 - DNA, 21 bp, Homo sapiens
ggccttcccctgcagtctccg

SEQ ID NO: 7995797 - DNA, 22 bp, Homo sapiens
ggccttcctgctgctccgggcc

SEQ ID NO: 7995798 - DNA, 22 bp, Homo sapiens
ggccttcctgctgctccgggcc

SEQ ID NO: 7995799 - DNA, 21 bp, Homo sapiens
ggccttcccctgcagtctccg

SEQ ID NO: 7995800 - DNA, 22 bp, Homo sapiens
ggctcaggactgcagcgtagag

SEQ ID NO: 7995801 - DNA, 22 bp, Homo sapiens
ggctcaggatgagccttctcat

SEQ ID NO: 7995802 - DNA, 22 bp, Homo sapiens
ggctcaggatgagccttctcat

SEQ ID NO: 7995803 - DNA, 22 bp, Homo sapiens
ggctcaggatgagccttctcat

SEQ ID NO: 7995804 - DNA, 22 bp, Homo sapiens
ggctcaggccagaccacgactc

SEQ ID NO: 7995805 - DNA, 22 bp, Homo sapiens
ggctcaggccagaccacgactc

SEQ ID NO: 7995806 - DNA, 22 bp, Homo sapiens
ggctcaggccagaccacgactc

SEQ ID NO: 7995807 - DNA, 22 bp, Homo sapiens
ggctcaggccagaccacgactc

SEQ ID NO: 7995808 - DNA, 22 bp, Homo sapiens
ggctcagcttggtgcgcagaaa

SEQ ID NO: 7995809 - DNA, 22 bp, Homo sapiens
ggctcagcttatctgggcaggc

SEQ ID NO: 7995810 - DNA, 22 bp, Homo sapiens
ggctcagcttggtgcgcagaaa

SEQ ID NO: 7995811 - DNA, 22 bp, Homo sapiens
ggctcagcttatctgggcaggc

SEQ ID NO: 7995812 - DNA, 22 bp, Homo sapiens
ggctcagcttggtgcgcagaaa

SEQ ID NO: 7995813 - DNA, 22 bp, Homo sapiens
ggctcagcttggtgcgcagaaa

SEQ ID NO: 7995814 - DNA, 22 bp, Homo sapiens
ggctcaggacacagtggtttag

SEQ ID NO: 7995815 - DNA, 22 bp, Homo sapiens
ggctcaggacacagtggtttag

SEQ ID NO: 7995816 - DNA, 22 bp, Homo sapiens
ggctcagcttggtgcgcagaaa

SEQ ID NO: 7995817 - DNA, 22 bp, Homo sapiens
ggctcaggacctgggattgcca

SEQ ID NO: 7995818 - DNA, 22 bp, Homo sapiens
ggctcaggacctgggattgcca

SEQ ID NO: 7995819 - DNA, 22 bp, Homo sapiens
ggctcaggacctgggattgcca

SEQ ID NO: 7995820 - DNA, 22 bp, Homo sapiens
ggctcaggacacagtggtttag

SEQ ID NO: 7995821 - DNA, 22 bp, Homo sapiens
ggctcaggacctgggattgcca

SEQ ID NO: 7995822 - DNA, 22 bp, Homo sapiens
ggctcaggactgcagcgtagag

SEQ ID NO: 7995823 - DNA, 22 bp, Homo sapiens
ggctcaggactgcagcgtagag

SEQ ID NO: 7995824 - DNA, 22 bp, Homo sapiens
ggctcaggacctgggattgcca

SEQ ID NO: 7995825 - DNA, 22 bp, Homo sapiens
ggctcaggactgcagcgtagag

SEQ ID NO: 7995826 - DNA, 20 bp, Homo sapiens
ggccttggcctctttgcagc

SEQ ID NO: 7995827 - DNA, 21 bp, Homo sapiens
ggccttggcgggggccgaatt

SEQ ID NO: 7995828 - DNA, 22 bp, Homo sapiens
ggccttggatccaagctgcggc

SEQ ID NO: 7995829 - DNA, 22 bp, Homo sapiens
ggccttggatccaagctgcggc

SEQ ID NO: 7995830 - DNA, 22 bp, Homo sapiens
ggccttggattttaccctaaag

SEQ ID NO: 7995831 - DNA, 22 bp, Homo sapiens
ggccttgggaggagggtcagaa

SEQ ID NO: 7995832 - DNA, 22 bp, Homo sapiens
ggccttgggaggagggtcagaa

SEQ ID NO: 7995833 - DNA, 22 bp, Homo sapiens
ggccttgggaggagggtcagaa

SEQ ID NO: 7995834 - DNA, 22 bp, Homo sapiens
ggccttggctcctgcagggagt

SEQ ID NO: 7995835 - DNA, 22 bp, Homo sapiens
ggccttggctcctgcagggagt

SEQ ID NO: 7995836 - DNA, 22 bp, Homo sapiens
ggctcagcacagggctggcatc

SEQ ID NO: 7995837 - DNA, 18 bp, Homo sapiens
ggctcagcaggctctctc

SEQ ID NO: 7995838 - DNA, 22 bp, Homo sapiens
ggccttgggatgtggctgcagc

SEQ ID NO: 7995839 - DNA, 18 bp, Homo sapiens
ggctcagcaggctctctc

SEQ ID NO: 7995840 - DNA, 22 bp, Homo sapiens
ggctcagccccgtaacacagca

SEQ ID NO: 7995841 - DNA, 18 bp, Homo sapiens
ggctcagcaggctctctc

SEQ ID NO: 7995842 - DNA, 22 bp, Homo sapiens
ggctcagcttatctgggcaggc

SEQ ID NO: 7995843 - DNA, 22 bp, Homo sapiens
ggctcagcttatctgggcaggc

SEQ ID NO: 7995844 - DNA, 22 bp, Homo sapiens
ggctcagcgcgctgggagggag

SEQ ID NO: 7995845 - DNA, 22 bp, Homo sapiens
ggctcagcttatctgggcaggc

SEQ ID NO: 7995846 - DNA, 22 bp, Homo sapiens
ggctcagctggatggttctact

SEQ ID NO: 7995847 - DNA, 22 bp, Homo sapiens
ggctcaggtttaaagtgcttta

SEQ ID NO: 7995848 - DNA, 22 bp, Homo sapiens
ggctcaggtttaaagtgcttta

SEQ ID NO: 7995849 - DNA, 22 bp, Homo sapiens
ggctcaggtttaaagtgcttta

SEQ ID NO: 7995850 - DNA, 22 bp, Homo sapiens
ggctcaggtttaaagtgcttta

SEQ ID NO: 7995851 - DNA, 22 bp, Homo sapiens
ggctcaggtttccttcccagct

SEQ ID NO: 7995852 - DNA, 22 bp, Homo sapiens
ggctcaggccagaccacgactc

SEQ ID NO: 7995853 - DNA, 22 bp, Homo sapiens
ggctcaggccagaccacgactc

SEQ ID NO: 7995854 - DNA, 22 bp, Homo sapiens
ggctcaggtttaaagtgcttta

SEQ ID NO: 7995855 - DNA, 22 bp, Homo sapiens
ggctcaggcctgtaatcctagc

SEQ ID NO: 7995856 - DNA, 22 bp, Homo sapiens
ggctcaggtttccttcccagct

SEQ ID NO: 7995857 - DNA, 22 bp, Homo sapiens
ggctcaggtttccttcccagct

SEQ ID NO: 7995858 - DNA, 22 bp, Homo sapiens
ggctcagtaagtcaggttcatt

SEQ ID NO: 7995859 - DNA, 22 bp, Homo sapiens
ggctcagtgtttgtggaacata

SEQ ID NO: 7995860 - DNA, 22 bp, Homo sapiens
ggctcagtgtttgtggaacata

SEQ ID NO: 7995861 - DNA, 22 bp, Homo sapiens
ggctcatatcccggccatcatt

SEQ ID NO: 7995862 - DNA, 22 bp, Homo sapiens
ggctcatatcccggccatcatt

SEQ ID NO: 7995863 - DNA, 22 bp, Homo sapiens
ggctcagtgggaacaagctgag

SEQ ID NO: 7995864 - DNA, 22 bp, Homo sapiens
ggctcagtgggaacaagctgag

SEQ ID NO: 7995865 - DNA, 19 bp, Homo sapiens
ggctcagtgacataggtgc

SEQ ID NO: 7995866 - DNA, 19 bp, Homo sapiens
ggctcagtcaactgactgt

SEQ ID NO: 7995867 - DNA, 19 bp, Homo sapiens
ggctcagtgacataggtgc

SEQ ID NO: 7995868 - DNA, 22 bp, Homo sapiens
ggctcatgtatgaaagggtgtg

SEQ ID NO: 7995869 - DNA, 18 bp, Homo sapiens
ggctcatctagcatcatt

SEQ ID NO: 7995870 - DNA, 22 bp, Homo sapiens
ggctcatcagaaatacctgaca

SEQ ID NO: 7995871 - DNA, 22 bp, Homo sapiens
ggctcatgtatgaaagggtgtg

SEQ ID NO: 7995872 - DNA, 22 bp, Homo sapiens
ggctccaaagggcagtgtgagg

SEQ ID NO: 7995873 - DNA, 22 bp, Homo sapiens
ggctcctgatttgagggggctg

SEQ ID NO: 7995874 - DNA, 22 bp, Homo sapiens
ggctcctgatttgagggggctg

SEQ ID NO: 7995875 - DNA, 22 bp, Homo sapiens
ggctcctgatttgagggggctg

SEQ ID NO: 7995876 - DNA, 22 bp, Homo sapiens
ggctcctgcacctgtccctctg

SEQ ID NO: 7995877 - DNA, 22 bp, Homo sapiens
ggctcctgcacctgtccctctg

SEQ ID NO: 7995878 - DNA, 22 bp, Homo sapiens
ggctcctgcacctgtccctctg

SEQ ID NO: 7995879 - DNA, 22 bp, Homo sapiens
ggctcctgcacctgtccctctg

SEQ ID NO: 7995880 - DNA, 22 bp, Homo sapiens
ggctcctgatttgagggggctg

SEQ ID NO: 7995881 - DNA, 22 bp, Homo sapiens
ggctccacaattacacactgga

SEQ ID NO: 7995882 - DNA, 22 bp, Homo sapiens
ggctccacaattacacactgga

SEQ ID NO: 7995883 - DNA, 22 bp, Homo sapiens
ggctccacaattacacactgga

SEQ ID NO: 7995884 - DNA, 22 bp, Homo sapiens
ggctccaacactaaatgtgttt

SEQ ID NO: 7995885 - DNA, 22 bp, Homo sapiens
ggctccaagtctcagagtgaag

SEQ ID NO: 7995886 - DNA, 22 bp, Homo sapiens
ggctccaccctgcttccagaag

SEQ ID NO: 7995887 - DNA, 22 bp, Homo sapiens
ggctcctgatgctcagatttca

SEQ ID NO: 7995888 - DNA, 22 bp, Homo sapiens
ggctccaccctgcttccagaag

SEQ ID NO: 7995889 - DNA, 23 bp, Homo sapiens
ggctcctgcttcatgtcccacct

SEQ ID NO: 7995890 - DNA, 21 bp, Homo sapiens
ggctcctgctttgtgaggggc

SEQ ID NO: 7995891 - DNA, 21 bp, Homo sapiens
ggctcctgctttgtgaggggc

SEQ ID NO: 7995892 - DNA, 21 bp, Homo sapiens
ggctcctgctttgtgaggggc

SEQ ID NO: 7995893 - DNA, 21 bp, Homo sapiens
ggctcctgctttgtgaggggc

SEQ ID NO: 7995894 - DNA, 22 bp, Homo sapiens
ggctcctggaaagccctcgctc

SEQ ID NO: 7995895 - DNA, 22 bp, Homo sapiens
ggctcctgcacctgtccctctg

SEQ ID NO: 7995896 - DNA, 22 bp, Homo sapiens
ggctcctgctgtcctttgaagc

SEQ ID NO: 7995897 - DNA, 23 bp, Homo sapiens
ggctcctgcttcatgtcccacct

SEQ ID NO: 7995898 - DNA, 23 bp, Homo sapiens
ggctcctgcttcatgtcccacct

SEQ ID NO: 7995899 - DNA, 22 bp, Homo sapiens
ggctcctgctgtcctttgaagc

SEQ ID NO: 7995900 - DNA, 22 bp, Homo sapiens
gggctgcttttaagggtctcag

SEQ ID NO: 7995901 - DNA, 22 bp, Homo sapiens
gggctgcttttttcttagcaga

SEQ ID NO: 7995902 - DNA, 22 bp, Homo sapiens
gggctgcttttaagggtctcag

SEQ ID NO: 7995903 - DNA, 22 bp, Homo sapiens
gggctgcttttaagggtctcag

SEQ ID NO: 7995904 - DNA, 22 bp, Homo sapiens
gggctgcttggaggaggcgctc

SEQ ID NO: 7995905 - DNA, 22 bp, Homo sapiens
gggctgcttgctggagacagac

SEQ ID NO: 7995906 - DNA, 22 bp, Homo sapiens
gggctgcttggaggaggcgctc

SEQ ID NO: 7995907 - DNA, 22 bp, Homo sapiens
gggctgcttgctggagacagac

SEQ ID NO: 7995908 - DNA, 22 bp, Homo sapiens
gggctgcttgctggagacagac

SEQ ID NO: 7995909 - DNA, 22 bp, Homo sapiens
gggctgcttcctggggaatgct

SEQ ID NO: 7995910 - DNA, 22 bp, Homo sapiens
gggctgcttatactgatgataa

SEQ ID NO: 7995911 - DNA, 22 bp, Homo sapiens
gggctggaaaaacaacatacaa

SEQ ID NO: 7995912 - DNA, 22 bp, Homo sapiens
gggctggaaaaacaacatacaa

SEQ ID NO: 7995913 - DNA, 22 bp, Homo sapiens
gggctgcttttaagggtctcag

SEQ ID NO: 7995914 - DNA, 22 bp, Homo sapiens
gggctggaagacaggaaatgct

SEQ ID NO: 7995915 - DNA, 22 bp, Homo sapiens
gggctggaagtgcattgatgct

SEQ ID NO: 7995916 - DNA, 22 bp, Homo sapiens
gggctggaagacaggaaatgct

SEQ ID NO: 7995917 - DNA, 22 bp, Homo sapiens
gggctggaagtgcattgatgct

SEQ ID NO: 7995918 - DNA, 22 bp, Homo sapiens
gggctggacatctaaggtagct

SEQ ID NO: 7995919 - DNA, 22 bp, Homo sapiens
gggctggacatctaaggtagct

SEQ ID NO: 7995920 - DNA, 22 bp, Homo sapiens
gggctggacatctaaggtagct

SEQ ID NO: 7995921 - DNA, 21 bp, Homo sapiens
gggctggacatggtggctcat

SEQ ID NO: 7995922 - DNA, 21 bp, Homo sapiens
gggctggacatggtggctcat

SEQ ID NO: 7995923 - DNA, 21 bp, Homo sapiens
gggctggacatggtggctcat

SEQ ID NO: 7995924 - DNA, 22 bp, Homo sapiens
gggctgagacgatggggtcttc

SEQ ID NO: 7995925 - DNA, 22 bp, Homo sapiens
gggctgagacgatggggtcttc

SEQ ID NO: 7995926 - DNA, 22 bp, Homo sapiens
gggctgagacgatggggtcttc

SEQ ID NO: 7995927 - DNA, 22 bp, Homo sapiens
gggctgagacgatggggtcttc

SEQ ID NO: 7995928 - DNA, 22 bp, Homo sapiens
gggctgagagctggaatctgag

SEQ ID NO: 7995929 - DNA, 22 bp, Homo sapiens
gggctgagacgatggggtcttc

SEQ ID NO: 7995930 - DNA, 22 bp, Homo sapiens
gggctgagacgatggggtcttc

SEQ ID NO: 7995931 - DNA, 22 bp, Homo sapiens
gggctgagaattcagctttcct

SEQ ID NO: 7995932 - DNA, 22 bp, Homo sapiens
gggctgagaattcagctttcct

SEQ ID NO: 7995933 - DNA, 22 bp, Homo sapiens
gggctgagaattcagctttcct

SEQ ID NO: 7995934 - DNA, 22 bp, Homo sapiens
gggctgagaattcagctttcct

SEQ ID NO: 7995935 - DNA, 22 bp, Homo sapiens
gggctgagaattcagctttcct

SEQ ID NO: 7995936 - DNA, 22 bp, Homo sapiens
gggctgagaattcagctttcct

SEQ ID NO: 7995937 - DNA, 22 bp, Homo sapiens
gggctgagacgatggggtcttc

SEQ ID NO: 7995938 - DNA, 22 bp, Homo sapiens
gggctgagaattcagctttcct

SEQ ID NO: 7995939 - DNA, 22 bp, Homo sapiens
gggctgagaattcagctttcct

SEQ ID NO: 7995940 - DNA, 22 bp, Homo sapiens
gggctctgtggttgtgctttgt

SEQ ID NO: 7995941 - DNA, 22 bp, Homo sapiens
gggctctgtggcttccttctta

SEQ ID NO: 7995942 - DNA, 22 bp, Homo sapiens
gggctctgtgttctagctctcg

SEQ ID NO: 7995943 - DNA, 22 bp, Homo sapiens
gggctctgtgttctagctctcg

SEQ ID NO: 7995944 - DNA, 22 bp, Homo sapiens
gggctctgtggttgtgctttgt

SEQ ID NO: 7995945 - DNA, 22 bp, Homo sapiens
gggctgagaattcagctttcct

SEQ ID NO: 7995946 - DNA, 22 bp, Homo sapiens
gggctgagaattcagctttcct

SEQ ID NO: 7995947 - DNA, 22 bp, Homo sapiens
gggctgagaagttgatcccaag

SEQ ID NO: 7995948 - DNA, 22 bp, Homo sapiens
gggctctgtgttctagctctcg

SEQ ID NO: 7995949 - DNA, 20 bp, Homo sapiens
gggctaggtagccatttggc

SEQ ID NO: 7995950 - DNA, 22 bp, Homo sapiens
gggctaggcttggccagcactg

SEQ ID NO: 7995951 - DNA, 22 bp, Homo sapiens
gggctctggtacttcctggctc

SEQ ID NO: 7995952 - DNA, 22 bp, Homo sapiens
gggctctggtacttcctggctc

SEQ ID NO: 7995953 - DNA, 22 bp, Homo sapiens
gggctctggtacttcctggctc

SEQ ID NO: 7995954 - DNA, 22 bp, Homo sapiens
gggctctggtacttcctggctc

SEQ ID NO: 7995955 - DNA, 22 bp, Homo sapiens
gggctctgggtcgtgtctccat

SEQ ID NO: 7995956 - DNA, 22 bp, Homo sapiens
gggctctgggtcgtgtctccat

SEQ ID NO: 7995957 - DNA, 22 bp, Homo sapiens
gggctctgggtcgtgtctccat

SEQ ID NO: 7995958 - DNA, 22 bp, Homo sapiens
gggctaggcttggccagcactg

SEQ ID NO: 7995959 - DNA, 18 bp, Homo sapiens
gggctaggcaaggaccac

SEQ ID NO: 7995960 - DNA, 18 bp, Homo sapiens
gggctaggcaaggaccac

SEQ ID NO: 7995961 - DNA, 22 bp, Homo sapiens
gggctagcctcttccctgctcc

SEQ ID NO: 7995962 - DNA, 22 bp, Homo sapiens
gggctagcctcttccctgctcc

SEQ ID NO: 7995963 - DNA, 22 bp, Homo sapiens
gggctagcctcttccctgctcc

SEQ ID NO: 7995964 - DNA, 22 bp, Homo sapiens
gggctagaatccgcgtctcttg

SEQ ID NO: 7995965 - DNA, 20 bp, Homo sapiens
gggctagaccagggcagagg

SEQ ID NO: 7995966 - DNA, 20 bp, Homo sapiens
gggctagaccagggcagagg

SEQ ID NO: 7995967 - DNA, 22 bp, Homo sapiens
gggctagcctcttccctgctcc

SEQ ID NO: 7995968 - DNA, 22 bp, Homo sapiens
gggctagcctcttccctgctcc

SEQ ID NO: 7995969 - DNA, 22 bp, Homo sapiens
gggctagcctcttccctgctcc

SEQ ID NO: 7995970 - DNA, 22 bp, Homo sapiens
gggctagcctcttccctgctcc

SEQ ID NO: 7995971 - DNA, 22 bp, Homo sapiens
gggctctggtgctattgacgaa

SEQ ID NO: 7995972 - DNA, 22 bp, Homo sapiens
gggctctggtgccttcacagaa

SEQ ID NO: 7995973 - DNA, 22 bp, Homo sapiens
gggctctggtcctgaactgaag

SEQ ID NO: 7995974 - DNA, 22 bp, Homo sapiens
gggctctggtgccttcacagaa

SEQ ID NO: 7995975 - DNA, 22 bp, Homo sapiens
gggctctggtgccttcacagaa

SEQ ID NO: 7995976 - DNA, 20 bp, Homo sapiens
gggctctgtaaggttgaaag

SEQ ID NO: 7995977 - DNA, 20 bp, Homo sapiens
gggctctgtaaggttgaaag

SEQ ID NO: 7995978 - DNA, 22 bp, Homo sapiens
gggctctgtccattccttcata

SEQ ID NO: 7995979 - DNA, 22 bp, Homo sapiens
gggctctgtccattccttcata

SEQ ID NO: 7995980 - DNA, 22 bp, Homo sapiens
gggctctgtccattccttcata

SEQ ID NO: 7995981 - DNA, 22 bp, Homo sapiens
gggctctggtacttcctggctc

SEQ ID NO: 7995982 - DNA, 22 bp, Homo sapiens
gggctctggtacttcctggctc

SEQ ID NO: 7995983 - DNA, 22 bp, Homo sapiens
gggctctggtcctgaactgaag

SEQ ID NO: 7995984 - DNA, 22 bp, Homo sapiens
gggctctggtcctgaactgaag

SEQ ID NO: 7995985 - DNA, 22 bp, Homo sapiens
gggctctggtcctgaactgaag

SEQ ID NO: 7995986 - DNA, 22 bp, Homo sapiens
gggctctgtgcaccccagcacc

SEQ ID NO: 7995987 - DNA, 22 bp, Homo sapiens
gggctctgtgcaccccagcacc

SEQ ID NO: 7995988 - DNA, 22 bp, Homo sapiens
gggctctgtgcaccccagcacc

SEQ ID NO: 7995989 - DNA, 22 bp, Homo sapiens
gggctctgtgcaccccagcacc

SEQ ID NO: 7995990 - DNA, 22 bp, Homo sapiens
gggctctgtgcaccccagcacc

SEQ ID NO: 7995991 - DNA, 22 bp, Homo sapiens
gggctctgtgcaccccagcacc

SEQ ID NO: 7995992 - DNA, 22 bp, Homo sapiens
gggctctgtgcaccccagcacc

SEQ ID NO: 7995993 - DNA, 22 bp, Homo sapiens
gggctctgtgcaccccagcacc

SEQ ID NO: 7995994 - DNA, 22 bp, Homo sapiens
gggctctgtggatgtgagagct

SEQ ID NO: 7995995 - DNA, 22 bp, Homo sapiens
gggctctgtggatgtgagagct

SEQ ID NO: 7995996 - DNA, 22 bp, Homo sapiens
gggctctgtggatgtgagagct

SEQ ID NO: 7995997 - DNA, 22 bp, Homo sapiens
gggctctgtggatgtgagagct

SEQ ID NO: 7995998 - DNA, 22 bp, Homo sapiens
gggctctgtggcttccttctta

SEQ ID NO: 7995999 - DNA, 22 bp, Homo sapiens
gggctctgtggcttccttctta

SEQ ID NO: 7996000 - DNA, 22 bp, Homo sapiens
gggctctgtggcttccttctta

SEQ ID NO: 7996001 - DNA, 22 bp, Homo sapiens
ggggaccctcaggactgcgtct

SEQ ID NO: 7996002 - DNA, 22 bp, Homo sapiens
ggggaccctcaggactgcgtct

SEQ ID NO: 7996003 - DNA, 23 bp, Homo sapiens
ggggacagttcccactggggtct

SEQ ID NO: 7996004 - DNA, 20 bp, Homo sapiens
ggggacccagaatcacagct

SEQ ID NO: 7996005 - DNA, 23 bp, Homo sapiens
ggggacagttcccactggggtct

SEQ ID NO: 7996006 - DNA, 23 bp, Homo sapiens
ggggacagttcccactggggtct

SEQ ID NO: 7996007 - DNA, 22 bp, Homo sapiens
ggggacagttaaagaccaagac

SEQ ID NO: 7996008 - DNA, 23 bp, Homo sapiens
ggggacagttcccactggggtct

SEQ ID NO: 7996009 - DNA, 23 bp, Homo sapiens
ggggacagttcccactggggtct

SEQ ID NO: 7996010 - DNA, 23 bp, Homo sapiens
ggggacagttcccactggggtct

SEQ ID NO: 7996011 - DNA, 22 bp, Homo sapiens
ggggacagtcgatctagtgatt

SEQ ID NO: 7996012 - DNA, 22 bp, Homo sapiens
ggggacagttaaagaccaagac

SEQ ID NO: 7996013 - DNA, 22 bp, Homo sapiens
ggggacagtcgatctagtgatt

SEQ ID NO: 7996014 - DNA, 22 bp, Homo sapiens
ggggacagtcgatctagtgatt

SEQ ID NO: 7996015 - DNA, 22 bp, Homo sapiens
ggggacagttaaagaccaagac

SEQ ID NO: 7996016 - DNA, 22 bp, Homo sapiens
ggggacagttaaagaccaagac

SEQ ID NO: 7996017 - DNA, 22 bp, Homo sapiens
ggggacagttaaagaccaagac

SEQ ID NO: 7996018 - DNA, 22 bp, Homo sapiens
ggggacagtcgatctagtgatt

SEQ ID NO: 7996019 - DNA, 22 bp, Homo sapiens
ggggacagtcgatctagtgatt

SEQ ID NO: 7996020 - DNA, 22 bp, Homo sapiens
ggggacagtcgatctagtgatt

SEQ ID NO: 7996021 - DNA, 22 bp, Homo sapiens
ggggacagtcgatctagtgatt

SEQ ID NO: 7996022 - DNA, 22 bp, Homo sapiens
ggggacagtcgatctagtgatt

SEQ ID NO: 7996023 - DNA, 22 bp, Homo sapiens
ggggacagtcgatctagtgatt

SEQ ID NO: 7996024 - DNA, 22 bp, Homo sapiens
ggggaagggagtccaagtgtta

SEQ ID NO: 7996025 - DNA, 22 bp, Homo sapiens
ggggaagggagtccaagtgtta

SEQ ID NO: 7996026 - DNA, 22 bp, Homo sapiens
ggggaagggagtccaagtgtta

SEQ ID NO: 7996027 - DNA, 22 bp, Homo sapiens
ggggaagggagtccaagtgtta

SEQ ID NO: 7996028 - DNA, 22 bp, Homo sapiens
ggggaagggagtccaagtgtta

SEQ ID NO: 7996029 - DNA, 22 bp, Homo sapiens
ggggaagggagtccaagtgtta

SEQ ID NO: 7996030 - DNA, 16 bp, Homo sapiens
ggggaaggcaagaggg

SEQ ID NO: 7996031 - DNA, 16 bp, Homo sapiens
ggggaaggcaagaggg

SEQ ID NO: 7996032 - DNA, 16 bp, Homo sapiens
ggggaaggcaagaggg

SEQ ID NO: 7996033 - DNA, 22 bp, Homo sapiens
ggggaaggattgagttgaccca

SEQ ID NO: 7996034 - DNA, 23 bp, Homo sapiens
ggggacagagggcagcccgcatc

SEQ ID NO: 7996035 - DNA, 22 bp, Homo sapiens
ggggaatgagtgcccagaaagc

SEQ ID NO: 7996036 - DNA, 23 bp, Homo sapiens
ggggacagagggcagcccgcatc

SEQ ID NO: 7996037 - DNA, 23 bp, Homo sapiens
ggggacagagggcagcccgcatc

SEQ ID NO: 7996038 - DNA, 23 bp, Homo sapiens
ggggacagagggcagcccgcatc

SEQ ID NO: 7996039 - DNA, 23 bp, Homo sapiens
ggggacagagggcagcccgcatc

SEQ ID NO: 7996040 - DNA, 23 bp, Homo sapiens
ggggacagagggcagcccgcatc

SEQ ID NO: 7996041 - DNA, 23 bp, Homo sapiens
ggggacagagggcagcccgcatc

SEQ ID NO: 7996042 - DNA, 23 bp, Homo sapiens
ggggacagagggcagcccgcatc

SEQ ID NO: 7996043 - DNA, 23 bp, Homo sapiens
ggggaagtggcagtgagtgaggc

SEQ ID NO: 7996044 - DNA, 22 bp, Homo sapiens
ggggaagggagtccaagtgtta

SEQ ID NO: 7996045 - DNA, 22 bp, Homo sapiens
gggctggcatcagttgccgaga

SEQ ID NO: 7996046 - DNA, 22 bp, Homo sapiens
gggctggcatcagttgccgaga

SEQ ID NO: 7996047 - DNA, 22 bp, Homo sapiens
gggctggcatcggttgctgaga

SEQ ID NO: 7996048 - DNA, 22 bp, Homo sapiens
gggctggcaggacctgggctga

SEQ ID NO: 7996049 - DNA, 22 bp, Homo sapiens
gggctggcaggacctgggctga

SEQ ID NO: 7996050 - DNA, 22 bp, Homo sapiens
gggctggcaggacctgggctga

SEQ ID NO: 7996051 - DNA, 22 bp, Homo sapiens
gggctggcaggacctgggctga

SEQ ID NO: 7996052 - DNA, 22 bp, Homo sapiens
gggctggcaggacctgggctga

SEQ ID NO: 7996053 - DNA, 22 bp, Homo sapiens
gggctggcaggacctgggctga

SEQ ID NO: 7996054 - DNA, 22 bp, Homo sapiens
gggctggattactgaactgagt

SEQ ID NO: 7996055 - DNA, 22 bp, Homo sapiens
gggctggattactgaactgagt

SEQ ID NO: 7996056 - DNA, 22 bp, Homo sapiens
gggctggattactgaactgagt

SEQ ID NO: 7996057 - DNA, 22 bp, Homo sapiens
gggctggatgtttgatgacgaa

SEQ ID NO: 7996058 - DNA, 22 bp, Homo sapiens
gggctggatgtttgatgacgaa

SEQ ID NO: 7996059 - DNA, 22 bp, Homo sapiens
gggctggatgtttgatgacgaa

SEQ ID NO: 7996060 - DNA, 22 bp, Homo sapiens
gggctggatgtttgatgacgaa

SEQ ID NO: 7996061 - DNA, 22 bp, Homo sapiens
gggctggatgggagccttggcc

SEQ ID NO: 7996062 - DNA, 22 bp, Homo sapiens
gggctggatgggagccttggcc

SEQ ID NO: 7996063 - DNA, 22 bp, Homo sapiens
gggctggatgggagccttggcc

SEQ ID NO: 7996064 - DNA, 22 bp, Homo sapiens
gggctggatgggagccttggcc

SEQ ID NO: 7996065 - DNA, 17 bp, Homo sapiens
gggctggatggccatgg

SEQ ID NO: 7996066 - DNA, 17 bp, Homo sapiens
gggctggatggccatgg

SEQ ID NO: 7996067 - DNA, 17 bp, Homo sapiens
gggctggatggccatgg

SEQ ID NO: 7996068 - DNA, 22 bp, Homo sapiens
gggctggatctcctgcaggcag

SEQ ID NO: 7996069 - DNA, 22 bp, Homo sapiens
gggctggatctcctgcaggcag

SEQ ID NO: 7996070 - DNA, 22 bp, Homo sapiens
gggctggagcctggcggtggtt

SEQ ID NO: 7996071 - DNA, 22 bp, Homo sapiens
gggctggatctcctgcaggcag

SEQ ID NO: 7996072 - DNA, 22 bp, Homo sapiens
gggctggatctcctgcaggcag

SEQ ID NO: 7996073 - DNA, 22 bp, Homo sapiens
gggctggatctcctgcaggcag

SEQ ID NO: 7996074 - DNA, 22 bp, Homo sapiens
gggctggatctcctgcaggcag

SEQ ID NO: 7996075 - DNA, 22 bp, Homo sapiens
gggctggagcctggcggtggtt

SEQ ID NO: 7996076 - DNA, 22 bp, Homo sapiens
gggctggagccagctgtggctg

SEQ ID NO: 7996077 - DNA, 22 bp, Homo sapiens
gggctggagcctggcggtggtt

SEQ ID NO: 7996078 - DNA, 22 bp, Homo sapiens
gggctggagcctggcggtggtt

SEQ ID NO: 7996079 - DNA, 22 bp, Homo sapiens
gggctggagcctggcggtggtt

SEQ ID NO: 7996080 - DNA, 22 bp, Homo sapiens
gggctggagccagctgtggctg

SEQ ID NO: 7996081 - DNA, 22 bp, Homo sapiens
gggctggagatgcttatggaga

SEQ ID NO: 7996082 - DNA, 22 bp, Homo sapiens
gggctggagccagctgtggctg

SEQ ID NO: 7996083 - DNA, 22 bp, Homo sapiens
gggctggagccagctgtggctg

SEQ ID NO: 7996084 - DNA, 22 bp, Homo sapiens
gggctggagccagctgtggctg

SEQ ID NO: 7996085 - DNA, 22 bp, Homo sapiens
gggctggagccagctgtggctg

SEQ ID NO: 7996086 - DNA, 22 bp, Homo sapiens
gggctggaccgcgacccctgag

SEQ ID NO: 7996087 - DNA, 22 bp, Homo sapiens
gggctggaccgctcgcctccct

SEQ ID NO: 7996088 - DNA, 22 bp, Homo sapiens
gggctggaccgctcgcctccct

SEQ ID NO: 7996089 - DNA, 22 bp, Homo sapiens
gggctggaccgctcgcctccct

SEQ ID NO: 7996090 - DNA, 22 bp, Homo sapiens
gggctggactgcattgcctcgc

SEQ ID NO: 7996091 - DNA, 22 bp, Homo sapiens
gggctggaccgcgacccctgag

SEQ ID NO: 7996092 - DNA, 21 bp, Homo sapiens
gggctggacatggtggctcat

SEQ ID NO: 7996093 - DNA, 22 bp, Homo sapiens
gggctggagagtcccacgtggg

SEQ ID NO: 7996094 - DNA, 22 bp, Homo sapiens
gggctggagagtcccacgtggg

SEQ ID NO: 7996095 - DNA, 16 bp, Homo sapiens
gggctggagatacagt

SEQ ID NO: 7996096 - DNA, 22 bp, Homo sapiens
gggctggagacaagtgagccgc

SEQ ID NO: 7996097 - DNA, 22 bp, Homo sapiens
gggctggagacaagtgagccgc

SEQ ID NO: 7996098 - DNA, 22 bp, Homo sapiens
gggctggagacaagtgagccgc

SEQ ID NO: 7996099 - DNA, 22 bp, Homo sapiens
ggggggtgacaagtagaggttg

SEQ ID NO: 7996100 - DNA, 22 bp, Homo sapiens
ggggggtgctgatcagtggagc

SEQ ID NO: 7996101 - DNA, 22 bp, Homo sapiens
ggggggtgctgatcagtggagc

SEQ ID NO: 7996102 - DNA, 22 bp, Homo sapiens
ggggggtgacaagtagaggttg

SEQ ID NO: 7996103 - DNA, 22 bp, Homo sapiens
ggggggtgctgatcagtggagc

SEQ ID NO: 7996104 - DNA, 22 bp, Homo sapiens
gggggtaggcagacaaggacat

SEQ ID NO: 7996105 - DNA, 22 bp, Homo sapiens
ggggggtgctgatcagtggagc

SEQ ID NO: 7996106 - DNA, 22 bp, Homo sapiens
gggggtcccaagctgggctgct

SEQ ID NO: 7996107 - DNA, 22 bp, Homo sapiens
gggggtcccaagctgggctgct

SEQ ID NO: 7996108 - DNA, 22 bp, Homo sapiens
gggggtgacgatggcagctggt

SEQ ID NO: 7996109 - DNA, 22 bp, Homo sapiens
gggggtgacgatggcagctggt

SEQ ID NO: 7996110 - DNA, 22 bp, Homo sapiens
gggggtgacgatggcagctggt

SEQ ID NO: 7996111 - DNA, 22 bp, Homo sapiens
ggggggcagctgtcctggccat

SEQ ID NO: 7996112 - DNA, 22 bp, Homo sapiens
ggggggcagctgtcctggccat

SEQ ID NO: 7996113 - DNA, 22 bp, Homo sapiens
ggggggcagctgtcctggccat

SEQ ID NO: 7996114 - DNA, 22 bp, Homo sapiens
ggggggcagctgtcctggccat

SEQ ID NO: 7996115 - DNA, 22 bp, Homo sapiens
ggggggtgacaagtagaggttg

SEQ ID NO: 7996116 - DNA, 22 bp, Homo sapiens
ggggggtgacaagtagaggttg

SEQ ID NO: 7996117 - DNA, 22 bp, Homo sapiens
gggggggtcttcagacctcaga

SEQ ID NO: 7996118 - DNA, 22 bp, Homo sapiens
gggggggtcttcagacctcaga

SEQ ID NO: 7996119 - DNA, 22 bp, Homo sapiens
ggggggtgacaagtagaggttg

SEQ ID NO: 7996120 - DNA, 20 bp, Homo sapiens
ggggggcttcagggcctgtg

SEQ ID NO: 7996121 - DNA, 20 bp, Homo sapiens
ggggggcttcagggcctgtg

SEQ ID NO: 7996122 - DNA, 22 bp, Homo sapiens
ggggtactggctggagccccac

SEQ ID NO: 7996123 - DNA, 22 bp, Homo sapiens
gggggtggttctaagtcctata

SEQ ID NO: 7996124 - DNA, 22 bp, Homo sapiens
gggggtggttctaagtcctata

SEQ ID NO: 7996125 - DNA, 22 bp, Homo sapiens
gggggtggttctaagtcctata

SEQ ID NO: 7996126 - DNA, 22 bp, Homo sapiens
gggggtggttctaagtcctata

SEQ ID NO: 7996127 - DNA, 22 bp, Homo sapiens
gggggtggttctaagtcctata

SEQ ID NO: 7996128 - DNA, 22 bp, Homo sapiens
gggggtggttctaagtcctata

SEQ ID NO: 7996129 - DNA, 22 bp, Homo sapiens
gggggtgagcctgccaggccca

SEQ ID NO: 7996130 - DNA, 16 bp, Homo sapiens
gggggtgagagagagt

SEQ ID NO: 7996131 - DNA, 22 bp, Homo sapiens
gggggtgaggacaggagcactg

SEQ ID NO: 7996132 - DNA, 22 bp, Homo sapiens
gggggtgaggacaggagcactg

SEQ ID NO: 7996133 - DNA, 22 bp, Homo sapiens
gggggtggttctaagtcctata

SEQ ID NO: 7996134 - DNA, 22 bp, Homo sapiens
gggtccagggccagtggctgag

SEQ ID NO: 7996135 - DNA, 22 bp, Homo sapiens
gggtccagggccagtggctgag

SEQ ID NO: 7996136 - DNA, 22 bp, Homo sapiens
gggtccagggacgtttctgcag

SEQ ID NO: 7996137 - DNA, 22 bp, Homo sapiens
gggtccagggccagtggctgag

SEQ ID NO: 7996138 - DNA, 22 bp, Homo sapiens
gggtccaggcgtggcccagatg

SEQ ID NO: 7996139 - DNA, 22 bp, Homo sapiens
ggggtaggcaggtgatctgatc

SEQ ID NO: 7996140 - DNA, 22 bp, Homo sapiens
gggtccaggcactatgctaagt

SEQ ID NO: 7996141 - DNA, 20 bp, Homo sapiens
gggtccaggactctgaattt

SEQ ID NO: 7996142 - DNA, 22 bp, Homo sapiens
ggggacgcagaaagagtggcag

SEQ ID NO: 7996143 - DNA, 22 bp, Homo sapiens
ggggacgcagaaagagtggcag

SEQ ID NO: 7996144 - DNA, 22 bp, Homo sapiens
ggggacgggacttagcatgagt

SEQ ID NO: 7996145 - DNA, 22 bp, Homo sapiens
ggggacgcagaaagagtggcag

SEQ ID NO: 7996146 - DNA, 22 bp, Homo sapiens
ggggacgggacttagcatgagt

SEQ ID NO: 7996147 - DNA, 22 bp, Homo sapiens
ggggactgaggcactgaaggtg

SEQ ID NO: 7996148 - DNA, 22 bp, Homo sapiens
ggggactgaggcactgaaggtg

SEQ ID NO: 7996149 - DNA, 22 bp, Homo sapiens
ggggactctgcttctgggatca

SEQ ID NO: 7996150 - DNA, 22 bp, Homo sapiens
ggggacgcagaaagagtggcag

SEQ ID NO: 7996151 - DNA, 22 bp, Homo sapiens
ggggaccctcaggactgcgtct

SEQ ID NO: 7996152 - DNA, 22 bp, Homo sapiens
ggggaccctcaggactgcgtct

SEQ ID NO: 7996153 - DNA, 23 bp, Homo sapiens
ggggacagttcccactggggtct

SEQ ID NO: 7996154 - DNA, 22 bp, Homo sapiens
ggggaccctcaggactgcgtct

SEQ ID NO: 7996155 - DNA, 22 bp, Homo sapiens
gggggctctgactccctcagct

SEQ ID NO: 7996156 - DNA, 22 bp, Homo sapiens
gggggctctgactccctcagct

SEQ ID NO: 7996157 - DNA, 22 bp, Homo sapiens
gggggctctgactccctcagct

SEQ ID NO: 7996158 - DNA, 22 bp, Homo sapiens
gggggctcctcccagctgccag

SEQ ID NO: 7996159 - DNA, 22 bp, Homo sapiens
gggggctcctcccagctgccag

SEQ ID NO: 7996160 - DNA, 22 bp, Homo sapiens
gggggctcctcccagctgccag

SEQ ID NO: 7996161 - DNA, 22 bp, Homo sapiens
gggggctcctcccagctgccag

SEQ ID NO: 7996162 - DNA, 19 bp, Homo sapiens
ggggagaactagagacagc

SEQ ID NO: 7996163 - DNA, 22 bp, Homo sapiens
gggggctagagagatgaaatat

SEQ ID NO: 7996164 - DNA, 22 bp, Homo sapiens
ggggactgccttccacagacac

SEQ ID NO: 7996165 - DNA, 19 bp, Homo sapiens
ggggagaactagagacagc

SEQ ID NO: 7996166 - DNA, 19 bp, Homo sapiens
ggggagaactagagacagc

SEQ ID NO: 7996167 - DNA, 22 bp, Homo sapiens
ggggactgaggcactgaaggtg

SEQ ID NO: 7996168 - DNA, 22 bp, Homo sapiens
ggggactgaggcactgaaggtg

SEQ ID NO: 7996169 - DNA, 16 bp, Homo sapiens
gggggctgcaagcttc

SEQ ID NO: 7996170 - DNA, 22 bp, Homo sapiens
gggggctggaatatccatcaac

SEQ ID NO: 7996171 - DNA, 22 bp, Homo sapiens
gggggctgatcatttactgggc

SEQ ID NO: 7996172 - DNA, 22 bp, Homo sapiens
gggggctgaggctgttctgagg

SEQ ID NO: 7996173 - DNA, 22 bp, Homo sapiens
gggggctggaatatccatcaac

SEQ ID NO: 7996174 - DNA, 22 bp, Homo sapiens
gggggctggaatatccatcaac

SEQ ID NO: 7996175 - DNA, 22 bp, Homo sapiens
gggggctggactttcccacaca

SEQ ID NO: 7996176 - DNA, 22 bp, Homo sapiens
gggggctggactttcccacaca

SEQ ID NO: 7996177 - DNA, 23 bp, Homo sapiens
gggggctggttgactctctgcag

SEQ ID NO: 7996178 - DNA, 23 bp, Homo sapiens
gggggctggttgactctctgcag

SEQ ID NO: 7996179 - DNA, 23 bp, Homo sapiens
gggggctggttgactctctgcag

SEQ ID NO: 7996180 - DNA, 22 bp, Homo sapiens
gggggctgtcctgtgcattgta

SEQ ID NO: 7996181 - DNA, 22 bp, Homo sapiens
gggggctgtcctgtgcattgta

SEQ ID NO: 7996182 - DNA, 22 bp, Homo sapiens
gggggctgtcctgtgcattgta

SEQ ID NO: 7996183 - DNA, 22 bp, Homo sapiens
gggggctgtcctgtgcattgta

SEQ ID NO: 7996184 - DNA, 22 bp, Homo sapiens
gggggctgtcctgtgcattgta

SEQ ID NO: 7996185 - DNA, 22 bp, Homo sapiens
ggggggacgcagtcgctgccta

SEQ ID NO: 7996186 - DNA, 22 bp, Homo sapiens
gggtgaataggggaaggctatt

SEQ ID NO: 7996187 - DNA, 22 bp, Homo sapiens
gggtgacagcagctaatgacag

SEQ ID NO: 7996188 - DNA, 22 bp, Homo sapiens
gggtgacatagtgatggggcat

SEQ ID NO: 7996189 - DNA, 22 bp, Homo sapiens
gggtgaagctcctgcaggggcc

SEQ ID NO: 7996190 - DNA, 22 bp, Homo sapiens
gggtgaagctcctgcaggggcc

SEQ ID NO: 7996191 - DNA, 22 bp, Homo sapiens
gggtgacatagtgatggggcat

SEQ ID NO: 7996192 - DNA, 22 bp, Homo sapiens
gggtgacattaggaagatagac

SEQ ID NO: 7996193 - DNA, 22 bp, Homo sapiens
gggtgagacagaaagagcaaaa

SEQ ID NO: 7996194 - DNA, 22 bp, Homo sapiens
gggtgagagtcaggcagagatt

SEQ ID NO: 7996195 - DNA, 20 bp, Homo sapiens
gggtgagatgtaggagaggg

SEQ ID NO: 7996196 - DNA, 20 bp, Homo sapiens
gggtgagatgtaggagaggg

SEQ ID NO: 7996197 - DNA, 20 bp, Homo sapiens
gggtgagatgtaggagaggg

SEQ ID NO: 7996198 - DNA, 22 bp, Homo sapiens
gggtctgggcaggcgcttcctc

SEQ ID NO: 7996199 - DNA, 22 bp, Homo sapiens
gggtctgggcaggcgcttcctc

SEQ ID NO: 7996200 - DNA, 22 bp, Homo sapiens
gggtcttctgatataggtccag

SEQ ID NO: 7996201 - DNA, 22 bp, Homo sapiens
gggtcttggctctggaaatgct

SEQ ID NO: 7996202 - DNA, 22 bp, Homo sapiens
gggtgaagctcctgcaggggcc

SEQ ID NO: 7996203 - DNA, 22 bp, Homo sapiens
gggtctggcatgctgagatgga

SEQ ID NO: 7996204 - DNA, 22 bp, Homo sapiens
gggtctggcatgctgagatgga

SEQ ID NO: 7996205 - DNA, 22 bp, Homo sapiens
gggtctggagggcagcccttct

SEQ ID NO: 7996206 - DNA, 22 bp, Homo sapiens
gggtctggcatgctgagatgga

SEQ ID NO: 7996207 - DNA, 22 bp, Homo sapiens
gggtctggcatgctgagatgga

SEQ ID NO: 7996208 - DNA, 22 bp, Homo sapiens
gggtctggcatgctgagatgga

SEQ ID NO: 7996209 - DNA, 22 bp, Homo sapiens
gggtctctcctccccagctgtg

SEQ ID NO: 7996210 - DNA, 22 bp, Homo sapiens
gggtctctcctccccagctgtg

SEQ ID NO: 7996211 - DNA, 22 bp, Homo sapiens
gggtctctccctttagttattt

SEQ ID NO: 7996212 - DNA, 22 bp, Homo sapiens
gggtctctcctccccagctgtg

SEQ ID NO: 7996213 - DNA, 22 bp, Homo sapiens
gggtctctgagcttccaagata

SEQ ID NO: 7996214 - DNA, 22 bp, Homo sapiens
gggtctctctcggctccacgcg

SEQ ID NO: 7996215 - DNA, 22 bp, Homo sapiens
gggtctctgagcttccaagata

SEQ ID NO: 7996216 - DNA, 22 bp, Homo sapiens
gggtctctcagaaggctgcaat

SEQ ID NO: 7996217 - DNA, 22 bp, Homo sapiens
gggtctctcatgcagttgctgt

SEQ ID NO: 7996218 - DNA, 22 bp, Homo sapiens
gggtctctcatgcagttgctgt

SEQ ID NO: 7996219 - DNA, 22 bp, Homo sapiens
gggtctctcagaaggctgcaat

SEQ ID NO: 7996220 - DNA, 22 bp, Homo sapiens
gggtctcctgagagaagatgct

SEQ ID NO: 7996221 - DNA, 22 bp, Homo sapiens
gggtctcctaatggaggatgac

SEQ ID NO: 7996222 - DNA, 22 bp, Homo sapiens
gggtctccatgttaacatcact

SEQ ID NO: 7996223 - DNA, 22 bp, Homo sapiens
gggtctggacggctgcaggaag

SEQ ID NO: 7996224 - DNA, 22 bp, Homo sapiens
gggtctggacggctgcaggaag

SEQ ID NO: 7996225 - DNA, 22 bp, Homo sapiens
gggtctggacggctgcaggaag

SEQ ID NO: 7996226 - DNA, 22 bp, Homo sapiens
gggtctggacggctgcaggaag

SEQ ID NO: 7996227 - DNA, 22 bp, Homo sapiens
gggtctggacggctgcaggaag

SEQ ID NO: 7996228 - DNA, 22 bp, Homo sapiens
gggtctgagctgaggggaaatc

SEQ ID NO: 7996229 - DNA, 22 bp, Homo sapiens
gggtctgcctgctgtgaagtca

SEQ ID NO: 7996230 - DNA, 22 bp, Homo sapiens
gggtctgcctgctgtgaagtca

SEQ ID NO: 7996231 - DNA, 22 bp, Homo sapiens
gggtctggacggctgcaggaag

SEQ ID NO: 7996232 - DNA, 22 bp, Homo sapiens
gggtctggacggctgcaggaag

SEQ ID NO: 7996233 - DNA, 22 bp, Homo sapiens
gggtctggagatccgggtgaag

SEQ ID NO: 7996234 - DNA, 22 bp, Homo sapiens
gggtctggagggcagcccttct

SEQ ID NO: 7996235 - DNA, 22 bp, Homo sapiens
gggtggctgagaacaggacccc

SEQ ID NO: 7996236 - DNA, 22 bp, Homo sapiens
gggtgaggagctgccagtcatg

SEQ ID NO: 7996237 - DNA, 22 bp, Homo sapiens
gggtgaggagctgccagtcatg

SEQ ID NO: 7996238 - DNA, 22 bp, Homo sapiens
gggtgaggagctgccagtcatg

SEQ ID NO: 7996239 - DNA, 22 bp, Homo sapiens
gggtgaggagctgccagtcatg

SEQ ID NO: 7996240 - DNA, 22 bp, Homo sapiens
gggtgaggagctgccagtcatg

SEQ ID NO: 7996241 - DNA, 22 bp, Homo sapiens
gggtgaggagctgccagtcatg

SEQ ID NO: 7996242 - DNA, 19 bp, Homo sapiens
gggtgaggaagagcgttgc

SEQ ID NO: 7996243 - DNA, 19 bp, Homo sapiens
gggtgaggaagagcgttgc

SEQ ID NO: 7996244 - DNA, 22 bp, Homo sapiens
gggtgaggagctgccagtcatg

SEQ ID NO: 7996245 - DNA, 20 bp, Homo sapiens
gggtgagatgtaggagaggg

SEQ ID NO: 7996246 - DNA, 22 bp, Homo sapiens
gggtgagagtcaggcagagatt

SEQ ID NO: 7996247 - DNA, 20 bp, Homo sapiens
gggtgagatgtaggagaggg

SEQ ID NO: 7996248 - DNA, 20 bp, Homo sapiens
gggtgagatgtaggagaggg

SEQ ID NO: 7996249 - DNA, 22 bp, Homo sapiens
gggtgggaacaggatgccagga

SEQ ID NO: 7996250 - DNA, 22 bp, Homo sapiens
gggtgggaacaggatgccagga

SEQ ID NO: 7996251 - DNA, 22 bp, Homo sapiens
gggtggctgagaacaggacccc

SEQ ID NO: 7996252 - DNA, 22 bp, Homo sapiens
gggtgggaacaggatgccagga

SEQ ID NO: 7996253 - DNA, 22 bp, Homo sapiens
gggtgggaacaggatgccagga

SEQ ID NO: 7996254 - DNA, 22 bp, Homo sapiens
gggtgggaacaggatgccagga

SEQ ID NO: 7996255 - DNA, 22 bp, Homo sapiens
gggtgggaacaggatgccagga

SEQ ID NO: 7996256 - DNA, 22 bp, Homo sapiens
gggtgggaacaggatgccagga

SEQ ID NO: 7996257 - DNA, 22 bp, Homo sapiens
gggtgggatggcaggagccgct

SEQ ID NO: 7996258 - DNA, 22 bp, Homo sapiens
gggtgggatgccgctgtctcca

SEQ ID NO: 7996259 - DNA, 22 bp, Homo sapiens
gggtgggatgccgctgtctcca

SEQ ID NO: 7996260 - DNA, 22 bp, Homo sapiens
gggtgggaacaggatgccagga

SEQ ID NO: 7996261 - DNA, 22 bp, Homo sapiens
gggtgggaaggctaagggattg

SEQ ID NO: 7996262 - DNA, 22 bp, Homo sapiens
gggtgggaaggctaagggattg

SEQ ID NO: 7996263 - DNA, 22 bp, Homo sapiens
gggtgggccccaggtatctgta

SEQ ID NO: 7996264 - DNA, 22 bp, Homo sapiens
gggtgggcctgtctggccatgt

SEQ ID NO: 7996265 - DNA, 22 bp, Homo sapiens
gggtgggcctgtctggccatgt

SEQ ID NO: 7996266 - DNA, 22 bp, Homo sapiens
gggtgggcccagcccagagaag

SEQ ID NO: 7996267 - DNA, 22 bp, Homo sapiens
gggtgggcccagcccagagaag

SEQ ID NO: 7996268 - DNA, 22 bp, Homo sapiens
gggtgggccccaggtatctgta

SEQ ID NO: 7996269 - DNA, 22 bp, Homo sapiens
gggtgggccccaggtatctgta

SEQ ID NO: 7996270 - DNA, 22 bp, Homo sapiens
gggtgggccactgagcagcgtg

SEQ ID NO: 7996271 - DNA, 22 bp, Homo sapiens
gggtgggcccagcccagagaag

SEQ ID NO: 7996272 - DNA, 22 bp, Homo sapiens
gggtgggcccagcccagagaag

SEQ ID NO: 7996273 - DNA, 22 bp, Homo sapiens
gggtgggcccagcccagagaag

SEQ ID NO: 7996274 - DNA, 22 bp, Homo sapiens
gggtgggcccagcccagagaag

SEQ ID NO: 7996275 - DNA, 22 bp, Homo sapiens
gggtgggcccagcccagagaag

SEQ ID NO: 7996276 - DNA, 22 bp, Homo sapiens
gggtgggccactgagcagcgtg

SEQ ID NO: 7996277 - DNA, 22 bp, Homo sapiens
gggtgggccactgagcagcgtg

SEQ ID NO: 7996278 - DNA, 22 bp, Homo sapiens
gggtgggccactgagcagcgtg

SEQ ID NO: 7996279 - DNA, 17 bp, Homo sapiens
gggtgggcactgctggc

SEQ ID NO: 7996280 - DNA, 23 bp, Homo sapiens
gggtgggccaaattaggtagcct

SEQ ID NO: 7996281 - DNA, 23 bp, Homo sapiens
gggtgggccaaattaggtagcct

SEQ ID NO: 7996282 - DNA, 23 bp, Homo sapiens
gggtgggccaaattaggtagcct

SEQ ID NO: 7996283 - DNA, 23 bp, Homo sapiens
gggtgggccaaattaggtagcct

SEQ ID NO: 7996284 - DNA, 23 bp, Homo sapiens
gggtgggccaaattaggtagcct

SEQ ID NO: 7996285 - DNA, 23 bp, Homo sapiens
gggtgggccaaattaggtagcct

SEQ ID NO: 7996286 - DNA, 23 bp, Homo sapiens
gggtgggccaaattaggtagcct

SEQ ID NO: 7996287 - DNA, 22 bp, Homo sapiens
gggtgggatggcaggagccgct

SEQ ID NO: 7996288 - DNA, 22 bp, Homo sapiens
gggtgggatggcaggagccgct

SEQ ID NO: 7996289 - DNA, 22 bp, Homo sapiens
gggtgggaacaggatgccagga

SEQ ID NO: 7996290 - DNA, 22 bp, Homo sapiens
gggtgggatggcaggagccgct

SEQ ID NO: 7996291 - DNA, 17 bp, Homo sapiens
gggtgggcactgctggc

SEQ ID NO: 7996292 - DNA, 17 bp, Homo sapiens
gggtgggcactgctggc

SEQ ID NO: 7996293 - DNA, 17 bp, Homo sapiens
gggtgggcactgctggc

SEQ ID NO: 7996294 - DNA, 17 bp, Homo sapiens
gggtgggcactgctggc

SEQ ID NO: 7996295 - DNA, 22 bp, Homo sapiens
gggcagcacagacagtgaaggc

SEQ ID NO: 7996296 - DNA, 22 bp, Homo sapiens
gggcagcacagacagtgaaggc

SEQ ID NO: 7996297 - DNA, 18 bp, Homo sapiens
gggcagcacagcagcctc

SEQ ID NO: 7996298 - DNA, 18 bp, Homo sapiens
gggcagcacagcagcctc

SEQ ID NO: 7996299 - DNA, 18 bp, Homo sapiens
gggcagcacagcagcctc

SEQ ID NO: 7996300 - DNA, 18 bp, Homo sapiens
gggcagcacagcagcctc

SEQ ID NO: 7996301 - DNA, 18 bp, Homo sapiens
gggcagcacagcagcctc

SEQ ID NO: 7996302 - DNA, 22 bp, Homo sapiens
gggcagcaaatctgagtctggt

SEQ ID NO: 7996303 - DNA, 22 bp, Homo sapiens
gggcagcaaatctgagtctggt

SEQ ID NO: 7996304 - DNA, 22 bp, Homo sapiens
gggcagcaaatctgagtctggt

SEQ ID NO: 7996305 - DNA, 22 bp, Homo sapiens
gggcagcaaatctgagtctggt

SEQ ID NO: 7996306 - DNA, 20 bp, Homo sapiens
gggcagcaagacatttgaca

SEQ ID NO: 7996307 - DNA, 22 bp, Homo sapiens
gggcagcaaatctgagtctggt

SEQ ID NO: 7996308 - DNA, 22 bp, Homo sapiens
gggcagcacagacagtgaaggc

SEQ ID NO: 7996309 - DNA, 20 bp, Homo sapiens
gggcagcaagacatttgaca

SEQ ID NO: 7996310 - DNA, 22 bp, Homo sapiens
gggcagatcacctgaggtcagg

SEQ ID NO: 7996311 - DNA, 22 bp, Homo sapiens
gggcagaggttcaacttcaaca

SEQ ID NO: 7996312 - DNA, 22 bp, Homo sapiens
gggcagaggttcaacttcaaca

SEQ ID NO: 7996313 - DNA, 22 bp, Homo sapiens
gggcagatgtctggacacctca

SEQ ID NO: 7996314 - DNA, 22 bp, Homo sapiens
gggcagcaaatctgagtctggt

SEQ ID NO: 7996315 - DNA, 22 bp, Homo sapiens
gggcagatggggcacaggctga

SEQ ID NO: 7996316 - DNA, 22 bp, Homo sapiens
gggcagatcacctgaggtcagg

SEQ ID NO: 7996317 - DNA, 22 bp, Homo sapiens
gggcagatggggcacaggctga

SEQ ID NO: 7996318 - DNA, 21 bp, Homo sapiens
gggcagcacgtcattcctgtg

SEQ ID NO: 7996319 - DNA, 18 bp, Homo sapiens
gggcagcacagcagcctc

SEQ ID NO: 7996320 - DNA, 22 bp, Homo sapiens
gggcagcacgtttcaggaggat

SEQ ID NO: 7996321 - DNA, 22 bp, Homo sapiens
gggcagcacgtttcaggaggat

SEQ ID NO: 7996322 - DNA, 22 bp, Homo sapiens
gggcagcacgtttcaggaggat

SEQ ID NO: 7996323 - DNA, 22 bp, Homo sapiens
gggcagcacgtttcaggaggat

SEQ ID NO: 7996324 - DNA, 22 bp, Homo sapiens
gggcagcactcatacctatatt

SEQ ID NO: 7996325 - DNA, 22 bp, Homo sapiens
gggcagcagaattggacagaaa

SEQ ID NO: 7996326 - DNA, 22 bp, Homo sapiens
gggcagcacgtttcaggaggat

SEQ ID NO: 7996327 - DNA, 22 bp, Homo sapiens
gggcagcacgtttcaggaggat

SEQ ID NO: 7996328 - DNA, 22 bp, Homo sapiens
gggcagcacgtttcaggaggat

SEQ ID NO: 7996329 - DNA, 22 bp, Homo sapiens
gggcagcagaattggacagaaa

SEQ ID NO: 7996330 - DNA, 22 bp, Homo sapiens
gggcagcagaattggacagaaa

SEQ ID NO: 7996331 - DNA, 22 bp, Homo sapiens
gggcagcagaattggacagaaa

SEQ ID NO: 7996332 - DNA, 22 bp, Homo sapiens
gggcagcagaattggacagaaa

SEQ ID NO: 7996333 - DNA, 22 bp, Homo sapiens
gggcagcagaattggacagaaa

SEQ ID NO: 7996334 - DNA, 22 bp, Homo sapiens
gggcagccgcgtgacctgccag

SEQ ID NO: 7996335 - DNA, 22 bp, Homo sapiens
gggcagccccagcgcgttggct

SEQ ID NO: 7996336 - DNA, 22 bp, Homo sapiens
gggcagcccagaactgctgcag

SEQ ID NO: 7996337 - DNA, 20 bp, Homo sapiens
gggcagcctcgggagtgggt

SEQ ID NO: 7996338 - DNA, 20 bp, Homo sapiens
gggcagcctcgggagtgggt

SEQ ID NO: 7996339 - DNA, 22 bp, Homo sapiens
gggccagtagcacctgtgtgga

SEQ ID NO: 7996340 - DNA, 22 bp, Homo sapiens
gggccaggtcggtgaatggtca

SEQ ID NO: 7996341 - DNA, 22 bp, Homo sapiens
gggccaggtcggtgaatggtca

SEQ ID NO: 7996342 - DNA, 22 bp, Homo sapiens
gggccaggtcggtgaatggtca

SEQ ID NO: 7996343 - DNA, 22 bp, Homo sapiens
gggccaggtcggtgaatggtca

SEQ ID NO: 7996344 - DNA, 22 bp, Homo sapiens
gggccaggtggaccccagcctc

SEQ ID NO: 7996345 - DNA, 22 bp, Homo sapiens
gggccaggtggaccccagcctc

SEQ ID NO: 7996346 - DNA, 22 bp, Homo sapiens
gggccaggtggaccccagcctc

SEQ ID NO: 7996347 - DNA, 22 bp, Homo sapiens
gggccaggagtggagatatggg

SEQ ID NO: 7996348 - DNA, 22 bp, Homo sapiens
gggccaggagtggagatatggg

SEQ ID NO: 7996349 - DNA, 22 bp, Homo sapiens
gggccaggagtggagatatggg

SEQ ID NO: 7996350 - DNA, 22 bp, Homo sapiens
gggccacattgaagggtgggta

SEQ ID NO: 7996351 - DNA, 22 bp, Homo sapiens
gggccacaggccttgcccgcag

SEQ ID NO: 7996352 - DNA, 22 bp, Homo sapiens
gggccacaggagaggctgtcag

SEQ ID NO: 7996353 - DNA, 22 bp, Homo sapiens
gggccacaggccttgcccgcag

SEQ ID NO: 7996354 - DNA, 22 bp, Homo sapiens
gggccacaggagaggctgtcag

SEQ ID NO: 7996355 - DNA, 22 bp, Homo sapiens
gggccacaggccttgcccgcag

SEQ ID NO: 7996356 - DNA, 22 bp, Homo sapiens
gggccaggtatcgtctttagta

SEQ ID NO: 7996357 - DNA, 22 bp, Homo sapiens
gggccaggtcggtgaatggtca

SEQ ID NO: 7996358 - DNA, 22 bp, Homo sapiens
gggccaggtcggtgaatggtca

SEQ ID NO: 7996359 - DNA, 22 bp, Homo sapiens
gggccaggtcggtgaatggtca

SEQ ID NO: 7996360 - DNA, 22 bp, Homo sapiens
gggccaggagtggagatatggg

SEQ ID NO: 7996361 - DNA, 22 bp, Homo sapiens
gggccaggtatcgtctttagta

SEQ ID NO: 7996362 - DNA, 22 bp, Homo sapiens
gggccaggtatcgtctttagta

SEQ ID NO: 7996363 - DNA, 22 bp, Homo sapiens
gggcagctcctgtggaatccac

SEQ ID NO: 7996364 - DNA, 22 bp, Homo sapiens
gggcagctcctgtggaatccac

SEQ ID NO: 7996365 - DNA, 22 bp, Homo sapiens
gggcagctcctgtggaatccac

SEQ ID NO: 7996366 - DNA, 22 bp, Homo sapiens
gggcagctcctgtggaatccac

SEQ ID NO: 7996367 - DNA, 22 bp, Homo sapiens
gggcagctcggaagtgggaaag

SEQ ID NO: 7996368 - DNA, 22 bp, Homo sapiens
gggcagctcggaagtgggaaag

SEQ ID NO: 7996369 - DNA, 22 bp, Homo sapiens
gggcagctcggaagtgggaaag

SEQ ID NO: 7996370 - DNA, 22 bp, Homo sapiens
gggcagctcggaagtgggaaag

SEQ ID NO: 7996371 - DNA, 22 bp, Homo sapiens
gggcagctcggaagtgggaaag

SEQ ID NO: 7996372 - DNA, 22 bp, Homo sapiens
gggcagctcggaagtgggaaag

SEQ ID NO: 7996373 - DNA, 22 bp, Homo sapiens
gggccacaggagaggctgtcag

SEQ ID NO: 7996374 - DNA, 21 bp, Homo sapiens
gggccacaccttctgcagacc

SEQ ID NO: 7996375 - DNA, 22 bp, Homo sapiens
gggcagctctcacagcagccaa

SEQ ID NO: 7996376 - DNA, 22 bp, Homo sapiens
gggcagctctcacagcagccaa

SEQ ID NO: 7996377 - DNA, 22 bp, Homo sapiens
gggcagctctcacagcagccaa

SEQ ID NO: 7996378 - DNA, 21 bp, Homo sapiens
gggccacaccttctgcagacc

SEQ ID NO: 7996379 - DNA, 22 bp, Homo sapiens
gggcagctctcacagcagccaa

SEQ ID NO: 7996380 - DNA, 22 bp, Homo sapiens
gggcagctctcacagcagccaa

SEQ ID NO: 7996381 - DNA, 22 bp, Homo sapiens
gggcagctcagccaccatgcag

SEQ ID NO: 7996382 - DNA, 22 bp, Homo sapiens
gggcagctcagccaccatgcag

SEQ ID NO: 7996383 - DNA, 22 bp, Homo sapiens
gggcagctagccctctagccca

SEQ ID NO: 7996384 - DNA, 22 bp, Homo sapiens
gggcagctagccctctagccca

SEQ ID NO: 7996385 - DNA, 22 bp, Homo sapiens
gggcagctcagccaccatgcag

SEQ ID NO: 7996386 - DNA, 22 bp, Homo sapiens
gggcagctcagccaccatgcag

SEQ ID NO: 7996387 - DNA, 20 bp, Homo sapiens
gggcagctcccctcattctg

SEQ ID NO: 7996388 - DNA, 20 bp, Homo sapiens
gggcagctcccctcattctg

SEQ ID NO: 7996389 - DNA, 22 bp, Homo sapiens
gggcagcctgctttctgatcca

SEQ ID NO: 7996390 - DNA, 22 bp, Homo sapiens
gggcagcctcggtgcctgctgc

SEQ ID NO: 7996391 - DNA, 22 bp, Homo sapiens
gggcagcctgctttctgatcca

SEQ ID NO: 7996392 - DNA, 22 bp, Homo sapiens
gggcagctagccctctagccca

SEQ ID NO: 7996393 - DNA, 22 bp, Homo sapiens
gggcagcctcggtgcctgctgc

SEQ ID NO: 7996394 - DNA, 22 bp, Homo sapiens
gggcggatcacctgaggtcagg

SEQ ID NO: 7996395 - DNA, 22 bp, Homo sapiens
gggcggatcacctgaggtcagg

SEQ ID NO: 7996396 - DNA, 22 bp, Homo sapiens
gggcggatcacctgaggtcagg

SEQ ID NO: 7996397 - DNA, 22 bp, Homo sapiens
gggcggatcacctgaggtcagg

SEQ ID NO: 7996398 - DNA, 22 bp, Homo sapiens
gggcggatcatttgaggtcagg

SEQ ID NO: 7996399 - DNA, 22 bp, Homo sapiens
gggcggatcatttgaggtcagg

SEQ ID NO: 7996400 - DNA, 22 bp, Homo sapiens
gggcggatcatttgaggtcagg

SEQ ID NO: 7996401 - DNA, 22 bp, Homo sapiens
gggcggatcatttgaggtcagg

SEQ ID NO: 7996402 - DNA, 22 bp, Homo sapiens
gggcggatcacctgaggtcagg

SEQ ID NO: 7996403 - DNA, 22 bp, Homo sapiens
gggcggatcacctgaggtcagg

SEQ ID NO: 7996404 - DNA, 22 bp, Homo sapiens
gggcggatcacctgaggtcagg

SEQ ID NO: 7996405 - DNA, 19 bp, Homo sapiens
gggcggagcctgacctggg

SEQ ID NO: 7996406 - DNA, 19 bp, Homo sapiens
gggcggagcctgacctggg

SEQ ID NO: 7996407 - DNA, 22 bp, Homo sapiens
gggcctgttctgattggcagat

SEQ ID NO: 7996408 - DNA, 22 bp, Homo sapiens
gggcggatcacctgaggtcagg

SEQ ID NO: 7996409 - DNA, 22 bp, Homo sapiens
gggcggatcacctgaggtcagg

SEQ ID NO: 7996410 - DNA, 22 bp, Homo sapiens
gggcggatcatttgaggtcagg

SEQ ID NO: 7996411 - DNA, 22 bp, Homo sapiens
gggcggatcatttgaggtcagg

SEQ ID NO: 7996412 - DNA, 22 bp, Homo sapiens
gggcggatcatttgaggtcagg

SEQ ID NO: 7996413 - DNA, 22 bp, Homo sapiens
gggcggcgtcggcgaggccatc

SEQ ID NO: 7996414 - DNA, 22 bp, Homo sapiens
gggcggatcatttgaggtcagg

SEQ ID NO: 7996415 - DNA, 22 bp, Homo sapiens
gggcggatcatttgaggtcagg

SEQ ID NO: 7996416 - DNA, 22 bp, Homo sapiens
gggcggggggagctggaatgaa

SEQ ID NO: 7996417 - DNA, 22 bp, Homo sapiens
gggcggggggagctggaatgaa

SEQ ID NO: 7996418 - DNA, 22 bp, Homo sapiens
gggcggggcttccgtcctccac

SEQ ID NO: 7996419 - DNA, 22 bp, Homo sapiens
gggcggggggagctggaatgaa

SEQ ID NO: 7996420 - DNA, 22 bp, Homo sapiens
gggcggggggagctggaatgaa

SEQ ID NO: 7996421 - DNA, 22 bp, Homo sapiens
gggcggggggagctggaatgaa

SEQ ID NO: 7996422 - DNA, 22 bp, Homo sapiens
gggcggggggagctggaatgaa

SEQ ID NO: 7996423 - DNA, 22 bp, Homo sapiens
gggcggggggagctggaatgaa

SEQ ID NO: 7996424 - DNA, 22 bp, Homo sapiens
gggcggggggagctggaatgaa

SEQ ID NO: 7996425 - DNA, 22 bp, Homo sapiens
gggcggggggagctggaatgaa

SEQ ID NO: 7996426 - DNA, 22 bp, Homo sapiens
gggcggggtggctcatgcctgt

SEQ ID NO: 7996427 - DNA, 22 bp, Homo sapiens
gggcggggtggctcatgcctgt

SEQ ID NO: 7996428 - DNA, 22 bp, Homo sapiens
gggcgtggatggtcagtgcagg

SEQ ID NO: 7996429 - DNA, 22 bp, Homo sapiens
gggcgtggatggtcagtgcagg

SEQ ID NO: 7996430 - DNA, 22 bp, Homo sapiens
gggcgtggatggtcagtgcagg

SEQ ID NO: 7996431 - DNA, 22 bp, Homo sapiens
gggcgtggatggtcagtgcagg

SEQ ID NO: 7996432 - DNA, 22 bp, Homo sapiens
gggctagaaattctgcagtgga

SEQ ID NO: 7996433 - DNA, 22 bp, Homo sapiens
gggctactgagctggaactggg

SEQ ID NO: 7996434 - DNA, 22 bp, Homo sapiens
gggctactgagctggaactggg

SEQ ID NO: 7996435 - DNA, 22 bp, Homo sapiens
gggctactgagctggaactggg

SEQ ID NO: 7996436 - DNA, 22 bp, Homo sapiens
gggctagaagttagctagagaa

SEQ ID NO: 7996437 - DNA, 22 bp, Homo sapiens
gggctagaagttagctagagaa

SEQ ID NO: 7996438 - DNA, 22 bp, Homo sapiens
gggctagaaattctgcagtgga

SEQ ID NO: 7996439 - DNA, 22 bp, Homo sapiens
gggctagaagttagctagagaa

SEQ ID NO: 7996440 - DNA, 22 bp, Homo sapiens
gggctagaagttagctagagaa

SEQ ID NO: 7996441 - DNA, 22 bp, Homo sapiens
gggctaagtggatcagtcagga

SEQ ID NO: 7996442 - DNA, 22 bp, Homo sapiens
gggctacattgtgagagaagtt

SEQ ID NO: 7996443 - DNA, 22 bp, Homo sapiens
gggcccagcgtggttccatctg

SEQ ID NO: 7996444 - DNA, 22 bp, Homo sapiens
gggcccagcgtggttccatctg

SEQ ID NO: 7996445 - DNA, 22 bp, Homo sapiens
gggcccagcgtggttccatctg

SEQ ID NO: 7996446 - DNA, 22 bp, Homo sapiens
gggcccagcgtggttccatctg

SEQ ID NO: 7996447 - DNA, 22 bp, Homo sapiens
gggcctggtgcttctgactcct

SEQ ID NO: 7996448 - DNA, 22 bp, Homo sapiens
gggcccagccctctgctcactg

SEQ ID NO: 7996449 - DNA, 19 bp, Homo sapiens
gggcccagcatggagggtt

SEQ ID NO: 7996450 - DNA, 19 bp, Homo sapiens
gggcccagcatggagggtt

SEQ ID NO: 7996451 - DNA, 19 bp, Homo sapiens
gggcccagcatggagggtt

SEQ ID NO: 7996452 - DNA, 19 bp, Homo sapiens
gggcccagcatggagggtt

SEQ ID NO: 7996453 - DNA, 19 bp, Homo sapiens
gggcccagcatggagggtt

SEQ ID NO: 7996454 - DNA, 22 bp, Homo sapiens
gggcccagcactggctgggatc

SEQ ID NO: 7996455 - DNA, 19 bp, Homo sapiens
gggcccagcatggagggtt

SEQ ID NO: 7996456 - DNA, 19 bp, Homo sapiens
gggcccagcatggagggtt

SEQ ID NO: 7996457 - DNA, 19 bp, Homo sapiens
gggcccagcatggagggtt

SEQ ID NO: 7996458 - DNA, 22 bp, Homo sapiens
gggcccagccctctgctcactg

SEQ ID NO: 7996459 - DNA, 22 bp, Homo sapiens
gggcccagccctctgctcactg

SEQ ID NO: 7996460 - DNA, 22 bp, Homo sapiens
gggcccagccctctgctcactg

SEQ ID NO: 7996461 - DNA, 22 bp, Homo sapiens
gggcccagccctctgctcactg

SEQ ID NO: 7996462 - DNA, 22 bp, Homo sapiens
gggcccagccctctgctcactg

SEQ ID NO: 7996463 - DNA, 22 bp, Homo sapiens
gggcccagccctctgctcactg

SEQ ID NO: 7996464 - DNA, 22 bp, Homo sapiens
gggcccagccctctgctcactg

SEQ ID NO: 7996465 - DNA, 22 bp, Homo sapiens
gggcccagccctctgctcactg

SEQ ID NO: 7996466 - DNA, 19 bp, Homo sapiens
gggcccagcatggagggtt

SEQ ID NO: 7996467 - DNA, 23 bp, Homo sapiens
gggcccagcacaggacctggcag

SEQ ID NO: 7996468 - DNA, 23 bp, Homo sapiens
gggcccagcacaggacctggcag

SEQ ID NO: 7996469 - DNA, 23 bp, Homo sapiens
gggcccagcacaggacctggcag

SEQ ID NO: 7996470 - DNA, 23 bp, Homo sapiens
gggcccagcacaggacctggcag

SEQ ID NO: 7996471 - DNA, 23 bp, Homo sapiens
gggcccagcacaggacctggcag

SEQ ID NO: 7996472 - DNA, 23 bp, Homo sapiens
gggcccagcacaggacctggcag

SEQ ID NO: 7996473 - DNA, 22 bp, Homo sapiens
gggcccagcactggctgggatc

SEQ ID NO: 7996474 - DNA, 22 bp, Homo sapiens
gggcccagcactggctgggatc

SEQ ID NO: 7996475 - DNA, 22 bp, Homo sapiens
gggcccagcactggctgggatc

SEQ ID NO: 7996476 - DNA, 22 bp, Homo sapiens
gggcccagcactggctgggatc

SEQ ID NO: 7996477 - DNA, 22 bp, Homo sapiens
gggcccagcactggctgggatc

SEQ ID NO: 7996478 - DNA, 22 bp, Homo sapiens
gggcccagcactggctgggatc

SEQ ID NO: 7996479 - DNA, 22 bp, Homo sapiens
gggcccagcactggctgggatc

SEQ ID NO: 7996480 - DNA, 22 bp, Homo sapiens
gggcccagcactggctgggatc

SEQ ID NO: 7996481 - DNA, 22 bp, Homo sapiens
gggcccagcactggctgggatc

SEQ ID NO: 7996482 - DNA, 22 bp, Homo sapiens
gggccatgagaggttcatcaac

SEQ ID NO: 7996483 - DNA, 22 bp, Homo sapiens
gggccatgagaggttcatcaac

SEQ ID NO: 7996484 - DNA, 22 bp, Homo sapiens
gggccatgagaggttcatcaac

SEQ ID NO: 7996485 - DNA, 22 bp, Homo sapiens
gggccatgagaggttcatcaac

SEQ ID NO: 7996486 - DNA, 22 bp, Homo sapiens
gggccatgagaggttcatcaac

SEQ ID NO: 7996487 - DNA, 22 bp, Homo sapiens
gggccatgagaggttcatcaac

SEQ ID NO: 7996488 - DNA, 22 bp, Homo sapiens
gggccagtgagtcgggagagct

SEQ ID NO: 7996489 - DNA, 22 bp, Homo sapiens
gggccagttctccgcctctttt

SEQ ID NO: 7996490 - DNA, 22 bp, Homo sapiens
gggccatgagaggttcatcaac

SEQ ID NO: 7996491 - DNA, 22 bp, Homo sapiens
gggccatctacactccccaaaa

SEQ ID NO: 7996492 - DNA, 22 bp, Homo sapiens
gggcagaggggcgcttccctct

SEQ ID NO: 7996493 - DNA, 22 bp, Homo sapiens
gggcagaggggcgcttccctct

SEQ ID NO: 7996494 - DNA, 22 bp, Homo sapiens
gggcagaggggcgcttccctct

SEQ ID NO: 7996495 - DNA, 22 bp, Homo sapiens
gggcagaggggcgcttccctct

SEQ ID NO: 7996496 - DNA, 22 bp, Homo sapiens
gggcagaggggcgcttccctct

SEQ ID NO: 7996497 - DNA, 22 bp, Homo sapiens
gggatggggagctggaaagggg

SEQ ID NO: 7996498 - DNA, 22 bp, Homo sapiens
gggatggggagctggaaagggg

SEQ ID NO: 7996499 - DNA, 22 bp, Homo sapiens
gggatggggagctggaaagggg

SEQ ID NO: 7996500 - DNA, 22 bp, Homo sapiens
gggcagaggggcgcttccctct

SEQ ID NO: 7996501 - DNA, 22 bp, Homo sapiens
gggatggggagctggaaagggg

SEQ ID NO: 7996502 - DNA, 22 bp, Homo sapiens
gggatggggagctggaaagggg

SEQ ID NO: 7996503 - DNA, 22 bp, Homo sapiens
gggatggggagctggaaagggg

SEQ ID NO: 7996504 - DNA, 22 bp, Homo sapiens
gggatggggagctggaaagggg

SEQ ID NO: 7996505 - DNA, 22 bp, Homo sapiens
gggatggggagctggaaagggg

SEQ ID NO: 7996506 - DNA, 22 bp, Homo sapiens
gggatggggagctggaaagggg

SEQ ID NO: 7996507 - DNA, 22 bp, Homo sapiens
gggatggggagctggaaagggg

SEQ ID NO: 7996508 - DNA, 22 bp, Homo sapiens
gggatggggagctggaaagggg

SEQ ID NO: 7996509 - DNA, 22 bp, Homo sapiens
gggatggggagctggaaagggg

SEQ ID NO: 7996510 - DNA, 22 bp, Homo sapiens
gggatggggagctggaaagggg

SEQ ID NO: 7996511 - DNA, 22 bp, Homo sapiens
gggatggggagctggaaagggg

SEQ ID NO: 7996512 - DNA, 22 bp, Homo sapiens
gggatggggagctggaaagggg

SEQ ID NO: 7996513 - DNA, 19 bp, Homo sapiens
gggatgggccctcaccctc

SEQ ID NO: 7996514 - DNA, 22 bp, Homo sapiens
gggatggggagctggaaagggg

SEQ ID NO: 7996515 - DNA, 22 bp, Homo sapiens
gggatggggagctggaaagggg

SEQ ID NO: 7996516 - DNA, 22 bp, Homo sapiens
gggatggctcaaaggagtcagg

SEQ ID NO: 7996517 - DNA, 22 bp, Homo sapiens
gggatggctcaaaggagtcagg

SEQ ID NO: 7996518 - DNA, 22 bp, Homo sapiens
gggatggctgcctgcatcagga

SEQ ID NO: 7996519 - DNA, 22 bp, Homo sapiens
gggatggctcaaaggagtcagg

SEQ ID NO: 7996520 - DNA, 22 bp, Homo sapiens
gggatggctgcctgcatcagga

SEQ ID NO: 7996521 - DNA, 22 bp, Homo sapiens
gggatggctgcctgcatcagga

SEQ ID NO: 7996522 - DNA, 22 bp, Homo sapiens
gggatggctttgtggctgactc

SEQ ID NO: 7996523 - DNA, 22 bp, Homo sapiens
gggatggctttgtggctgactc

SEQ ID NO: 7996524 - DNA, 22 bp, Homo sapiens
gggatggctttgtggctgactc

SEQ ID NO: 7996525 - DNA, 22 bp, Homo sapiens
gggatggctttgtggctgactc

SEQ ID NO: 7996526 - DNA, 22 bp, Homo sapiens
gggatggcctagactagcttgg

SEQ ID NO: 7996527 - DNA, 22 bp, Homo sapiens
gggatggatcttggctgaggct

SEQ ID NO: 7996528 - DNA, 22 bp, Homo sapiens
gggatggctcaaaggagtcagg

SEQ ID NO: 7996529 - DNA, 22 bp, Homo sapiens
gggatggctcaaaggagtcagg

SEQ ID NO: 7996530 - DNA, 22 bp, Homo sapiens
gggatggctcaaaggagtcagg

SEQ ID NO: 7996531 - DNA, 22 bp, Homo sapiens
gggatggctcaaaggagtcagg

SEQ ID NO: 7996532 - DNA, 22 bp, Homo sapiens
gggatggatcttggctgaggct

SEQ ID NO: 7996533 - DNA, 22 bp, Homo sapiens
gggatggatcttggctgaggct

SEQ ID NO: 7996534 - DNA, 22 bp, Homo sapiens
gggatggatcttggctgaggct

SEQ ID NO: 7996535 - DNA, 22 bp, Homo sapiens
gggatggatcttggctgaggct

SEQ ID NO: 7996536 - DNA, 22 bp, Homo sapiens
gggatggagggtagagcaagtg

SEQ ID NO: 7996537 - DNA, 22 bp, Homo sapiens
gggatggagggtagagcaagtg

SEQ ID NO: 7996538 - DNA, 22 bp, Homo sapiens
gggatggagggtagagcaagtg

SEQ ID NO: 7996539 - DNA, 22 bp, Homo sapiens
gggatggacttggggactccag

SEQ ID NO: 7996540 - DNA, 22 bp, Homo sapiens
gggatctgagtaggcagaagct

SEQ ID NO: 7996541 - DNA, 22 bp, Homo sapiens
gggatctgagttgtcaggaagg

SEQ ID NO: 7996542 - DNA, 22 bp, Homo sapiens
gggatctgatgcactgctgaaa

SEQ ID NO: 7996543 - DNA, 22 bp, Homo sapiens
gggatgaggatcaatcagggag

SEQ ID NO: 7996544 - DNA, 22 bp, Homo sapiens
gggatccatccgtgcagcagag

SEQ ID NO: 7996545 - DNA, 22 bp, Homo sapiens
gggagggacacaaagagttccc

SEQ ID NO: 7996546 - DNA, 22 bp, Homo sapiens
gggatctgacttgctggtgggt

SEQ ID NO: 7996547 - DNA, 22 bp, Homo sapiens
gggatcgtcatggaaagtgcta

SEQ ID NO: 7996548 - DNA, 21 bp, Homo sapiens
gggatctgaggcaagtctcct

SEQ ID NO: 7996549 - DNA, 22 bp, Homo sapiens
gggagggaaggtacctgtgtga

SEQ ID NO: 7996550 - DNA, 22 bp, Homo sapiens
gggatgcagtcagagcccctgt

SEQ ID NO: 7996551 - DNA, 22 bp, Homo sapiens
gggatgcagtcagagcccctgt

SEQ ID NO: 7996552 - DNA, 22 bp, Homo sapiens
gggatgcagtcagagcccctgt

SEQ ID NO: 7996553 - DNA, 22 bp, Homo sapiens
gggatggactgacggtagcgcg

SEQ ID NO: 7996554 - DNA, 22 bp, Homo sapiens
gggatggactgacggtagcgcg

SEQ ID NO: 7996555 - DNA, 22 bp, Homo sapiens
gggatggactgacggtagcgcg

SEQ ID NO: 7996556 - DNA, 22 bp, Homo sapiens
gggatgctggtgcctgtggcac

SEQ ID NO: 7996557 - DNA, 22 bp, Homo sapiens
gggatgctggtgcctgtggcac

SEQ ID NO: 7996558 - DNA, 22 bp, Homo sapiens
gggatggactgacggtagcgcg

SEQ ID NO: 7996559 - DNA, 19 bp, Homo sapiens
gggatgcactctgaccact

SEQ ID NO: 7996560 - DNA, 22 bp, Homo sapiens
gggatgcagactacagggctta

SEQ ID NO: 7996561 - DNA, 22 bp, Homo sapiens
gggatgatggaaaagtctgtta

SEQ ID NO: 7996562 - DNA, 22 bp, Homo sapiens
gggatgaggatcaatcagggag

SEQ ID NO: 7996563 - DNA, 19 bp, Homo sapiens
gggatgcactctgaccact

SEQ ID NO: 7996564 - DNA, 19 bp, Homo sapiens
gggatgcactctgaccact

SEQ ID NO: 7996565 - DNA, 22 bp, Homo sapiens
gggatgaggatcaatcagggag

SEQ ID NO: 7996566 - DNA, 22 bp, Homo sapiens
gggatgataatgccagagttaa

SEQ ID NO: 7996567 - DNA, 22 bp, Homo sapiens
gggatgaggatcaatcagggag

SEQ ID NO: 7996568 - DNA, 22 bp, Homo sapiens
gggagggaaggtacctgtgtga

SEQ ID NO: 7996569 - DNA, 22 bp, Homo sapiens
gggagggaaggtacctgtgtga

SEQ ID NO: 7996570 - DNA, 22 bp, Homo sapiens
gggagggaaggtacctgtgtga

SEQ ID NO: 7996571 - DNA, 22 bp, Homo sapiens
gggagggaaggtacctgtgtga

SEQ ID NO: 7996572 - DNA, 22 bp, Homo sapiens
gggagggaaggaccttatgaat

SEQ ID NO: 7996573 - DNA, 22 bp, Homo sapiens
gggagggaaggaccttatgaat

SEQ ID NO: 7996574 - DNA, 22 bp, Homo sapiens
gggagggaaggaggcgccgtgt

SEQ ID NO: 7996575 - DNA, 22 bp, Homo sapiens
gggagggaaggaggcgccgtgt

SEQ ID NO: 7996576 - DNA, 22 bp, Homo sapiens
gggaggctggctctggccacag

SEQ ID NO: 7996577 - DNA, 22 bp, Homo sapiens
gggaggctggctctggccacag

SEQ ID NO: 7996578 - DNA, 22 bp, Homo sapiens
gggaggctggctctggccacag

SEQ ID NO: 7996579 - DNA, 22 bp, Homo sapiens
gggaggctggctctggccacag

SEQ ID NO: 7996580 - DNA, 22 bp, Homo sapiens
gggaggcttgagccatactgcc

SEQ ID NO: 7996581 - DNA, 22 bp, Homo sapiens
gggaggcttgagccatactgcc

SEQ ID NO: 7996582 - DNA, 22 bp, Homo sapiens
gggagggaaagcttgatctgtc

SEQ ID NO: 7996583 - DNA, 22 bp, Homo sapiens
gggagggaaagcttgatctgtc

SEQ ID NO: 7996584 - DNA, 22 bp, Homo sapiens
gggagggaaagcttgatctgtc

SEQ ID NO: 7996585 - DNA, 22 bp, Homo sapiens
gggagggaaagcttgatctgtc

SEQ ID NO: 7996586 - DNA, 22 bp, Homo sapiens
gggaggcttgagccatactgcc

SEQ ID NO: 7996587 - DNA, 22 bp, Homo sapiens
gggagggaaagcttgatctgtc

SEQ ID NO: 7996588 - DNA, 22 bp, Homo sapiens
gggagggaaagcttgatctgtc

SEQ ID NO: 7996589 - DNA, 22 bp, Homo sapiens
gggagggaaagcttgatctgtc

SEQ ID NO: 7996590 - DNA, 22 bp, Homo sapiens
gggagggaaagcttgatctgtc

SEQ ID NO: 7996591 - DNA, 22 bp, Homo sapiens
gggagaaggagctagttcttga

SEQ ID NO: 7996592 - DNA, 22 bp, Homo sapiens
gggagaaggagctagttcttga

SEQ ID NO: 7996593 - DNA, 22 bp, Homo sapiens
gggagaaggagctagttcttga

SEQ ID NO: 7996594 - DNA, 22 bp, Homo sapiens
gggagaaggaggactgtgctgt

SEQ ID NO: 7996595 - DNA, 22 bp, Homo sapiens
gggagaaggaggactgtgctgt

SEQ ID NO: 7996596 - DNA, 22 bp, Homo sapiens
gggagaaggaggactgtgctgt

SEQ ID NO: 7996597 - DNA, 22 bp, Homo sapiens
gggagaaggaggactgtgctgt

SEQ ID NO: 7996598 - DNA, 20 bp, Homo sapiens
gggagaagggctgatgagag

SEQ ID NO: 7996599 - DNA, 20 bp, Homo sapiens
gggagaagggctgatgagag

SEQ ID NO: 7996600 - DNA, 20 bp, Homo sapiens
gggagaagggctgatgagag

SEQ ID NO: 7996601 - DNA, 20 bp, Homo sapiens
gggagaagggctgatgagag

SEQ ID NO: 7996602 - DNA, 20 bp, Homo sapiens
gggagaagggctgatgagag

SEQ ID NO: 7996603 - DNA, 20 bp, Homo sapiens
gggagaagggctgatgagag

SEQ ID NO: 7996604 - DNA, 20 bp, Homo sapiens
gggagaagggctgatgagag

SEQ ID NO: 7996605 - DNA, 20 bp, Homo sapiens
gggagaagggctgatgagag

SEQ ID NO: 7996606 - DNA, 22 bp, Homo sapiens
gggagaaggaggactgtgctgt

SEQ ID NO: 7996607 - DNA, 22 bp, Homo sapiens
gggagaaggaggactgtgctgt

SEQ ID NO: 7996608 - DNA, 22 bp, Homo sapiens
gggaggagggtgctggctaaac

SEQ ID NO: 7996609 - DNA, 22 bp, Homo sapiens
gggaggagggtgctggctaaac

SEQ ID NO: 7996610 - DNA, 22 bp, Homo sapiens
gggaggagggtgctggctaaac

SEQ ID NO: 7996611 - DNA, 20 bp, Homo sapiens
gggaggccccagagtccagg

SEQ ID NO: 7996612 - DNA, 22 bp, Homo sapiens
gggaggagggtgctggctaaac

SEQ ID NO: 7996613 - DNA, 22 bp, Homo sapiens
gggaggagggtgctggctaaac

SEQ ID NO: 7996614 - DNA, 22 bp, Homo sapiens
gggaggagggtgctggctaaac

SEQ ID NO: 7996615 - DNA, 22 bp, Homo sapiens
gggaggaggaatgttttgtgta

SEQ ID NO: 7996616 - DNA, 22 bp, Homo sapiens
gggaggaggaatgttttgtgta

SEQ ID NO: 7996617 - DNA, 22 bp, Homo sapiens
gggaggagcttggagattcact

SEQ ID NO: 7996618 - DNA, 22 bp, Homo sapiens
gggaggagcttggagattcact

SEQ ID NO: 7996619 - DNA, 20 bp, Homo sapiens
gggagaagggctgatgagag

SEQ ID NO: 7996620 - DNA, 22 bp, Homo sapiens
gggaggagcttggagattcact

SEQ ID NO: 7996621 - DNA, 22 bp, Homo sapiens
gggaggagcttggagattcact

SEQ ID NO: 7996622 - DNA, 20 bp, Homo sapiens
gggaggccccagagtccagg

SEQ ID NO: 7996623 - DNA, 18 bp, Homo sapiens
gggaggccccagcaggag

SEQ ID NO: 7996624 - DNA, 18 bp, Homo sapiens
gggaggccccagcaggag

SEQ ID NO: 7996625 - DNA, 18 bp, Homo sapiens
gggaggccccagcaggag

SEQ ID NO: 7996626 - DNA, 18 bp, Homo sapiens
gggaggccccagcaggag

SEQ ID NO: 7996627 - DNA, 18 bp, Homo sapiens
gggaggccccagcaggag

SEQ ID NO: 7996628 - DNA, 20 bp, Homo sapiens
gggaggcgagggctgagcag

SEQ ID NO: 7996629 - DNA, 20 bp, Homo sapiens
gggaggcgagggctgagcag

SEQ ID NO: 7996630 - DNA, 20 bp, Homo sapiens
gggaggcgagggctgagcag

SEQ ID NO: 7996631 - DNA, 20 bp, Homo sapiens
gggaggcgagggctgagcag

SEQ ID NO: 7996632 - DNA, 17 bp, Homo sapiens
gggaggccttggtttcc

SEQ ID NO: 7996633 - DNA, 20 bp, Homo sapiens
gggaggcgagggctgagcag

SEQ ID NO: 7996634 - DNA, 22 bp, Homo sapiens
gggaggcgccgagggtagctaa

SEQ ID NO: 7996635 - DNA, 22 bp, Homo sapiens
gggaggctcagtggtgtcctct

SEQ ID NO: 7996636 - DNA, 22 bp, Homo sapiens
gggaggcgccgagggtagctaa

SEQ ID NO: 7996637 - DNA, 22 bp, Homo sapiens
gggaggcgccgagggtagctaa

SEQ ID NO: 7996638 - DNA, 22 bp, Homo sapiens
gggaggcgccgagggtagctaa

SEQ ID NO: 7996639 - DNA, 22 bp, Homo sapiens
gggaggcgccgagggtagctaa

SEQ ID NO: 7996640 - DNA, 20 bp, Homo sapiens
gggaggcgagggctgagcag

SEQ ID NO: 7996641 - DNA, 22 bp, Homo sapiens
gggaggctgccatccttcagga

SEQ ID NO: 7996642 - DNA, 22 bp, Homo sapiens
gggaggctgccatccttcagga

SEQ ID NO: 7996643 - DNA, 22 bp, Homo sapiens
gggaggctgccatccttcagga

SEQ ID NO: 7996644 - DNA, 22 bp, Homo sapiens
gggaggctgccatccttcagga

SEQ ID NO: 7996645 - DNA, 22 bp, Homo sapiens
gggaggctggctctggccacag

SEQ ID NO: 7996646 - DNA, 22 bp, Homo sapiens
gggaggctctgctcagcccccg

SEQ ID NO: 7996647 - DNA, 22 bp, Homo sapiens
gggaggctctgctcagcccccg

SEQ ID NO: 7996648 - DNA, 22 bp, Homo sapiens
gggaggctctgctcagcccccg

SEQ ID NO: 7996649 - DNA, 22 bp, Homo sapiens
gggaggctctgctcagcccccg

SEQ ID NO: 7996650 - DNA, 22 bp, Homo sapiens
gggaggctctgctcagcccccg

SEQ ID NO: 7996651 - DNA, 22 bp, Homo sapiens
gggaggctcagtggtgtcctct

SEQ ID NO: 7996652 - DNA, 22 bp, Homo sapiens
gggaggctcagtggtgtcctct

SEQ ID NO: 7996653 - DNA, 22 bp, Homo sapiens
gggacgagatcttggcagtgtg

SEQ ID NO: 7996654 - DNA, 22 bp, Homo sapiens
gggacgagatcttggcagtgtg

SEQ ID NO: 7996655 - DNA, 22 bp, Homo sapiens
gggacgagccccaggctggagg

SEQ ID NO: 7996656 - DNA, 22 bp, Homo sapiens
gggacgagatcttggcagtgtg

SEQ ID NO: 7996657 - DNA, 22 bp, Homo sapiens
gggacgagatcttggcagtgtg

SEQ ID NO: 7996658 - DNA, 22 bp, Homo sapiens
gggacgacaggctctgtggtag

SEQ ID NO: 7996659 - DNA, 22 bp, Homo sapiens
gggacgacaggctctgtggtag

SEQ ID NO: 7996660 - DNA, 22 bp, Homo sapiens
gggacgacaggctctgtggtag

SEQ ID NO: 7996661 - DNA, 22 bp, Homo sapiens
gggacgagccccaggctggagg

SEQ ID NO: 7996662 - DNA, 22 bp, Homo sapiens
gggacgggcacggagggccctc

SEQ ID NO: 7996663 - DNA, 22 bp, Homo sapiens
gggacgggcacggagggccctc

SEQ ID NO: 7996664 - DNA, 22 bp, Homo sapiens
gggacgggcagtccaaggggtc

SEQ ID NO: 7996665 - DNA, 22 bp, Homo sapiens
gggacgggcagtccaaggggtc

SEQ ID NO: 7996666 - DNA, 22 bp, Homo sapiens
gggagaaatgtctggcctgctg

SEQ ID NO: 7996667 - DNA, 22 bp, Homo sapiens
gggagaaatgtctggcctgctg

SEQ ID NO: 7996668 - DNA, 22 bp, Homo sapiens
gggagaaatgtctggcctgctg

SEQ ID NO: 7996669 - DNA, 22 bp, Homo sapiens
gggagaaatgtctggcctgctg

SEQ ID NO: 7996670 - DNA, 22 bp, Homo sapiens
gggagaactgggtggagcatct

SEQ ID NO: 7996671 - DNA, 22 bp, Homo sapiens
gggagaactgggtggagcatct

SEQ ID NO: 7996672 - DNA, 22 bp, Homo sapiens
gggagaagaatgtgtcaattgt

SEQ ID NO: 7996673 - DNA, 22 bp, Homo sapiens
gggagaagaatgtgtcaattgt

SEQ ID NO: 7996674 - DNA, 22 bp, Homo sapiens
gggagaaggagctagttcttga

SEQ ID NO: 7996675 - DNA, 22 bp, Homo sapiens
gggacgtgagtgaagaaggtct

SEQ ID NO: 7996676 - DNA, 17 bp, Homo sapiens
gggactcaagatggggt

SEQ ID NO: 7996677 - DNA, 22 bp, Homo sapiens
gggactccataagcacatggat

SEQ ID NO: 7996678 - DNA, 22 bp, Homo sapiens
gggactccagggccactgggcc

SEQ ID NO: 7996679 - DNA, 22 bp, Homo sapiens
gggactccaaaactgtacccaa

SEQ ID NO: 7996680 - DNA, 22 bp, Homo sapiens
gggacctgcgccactcactgtc

SEQ ID NO: 7996681 - DNA, 22 bp, Homo sapiens
gggacctggacatgtgtgtgct

SEQ ID NO: 7996682 - DNA, 22 bp, Homo sapiens
gggacctggtctagcactgagc

SEQ ID NO: 7996683 - DNA, 22 bp, Homo sapiens
gggacctggtctagcactgagc

SEQ ID NO: 7996684 - DNA, 22 bp, Homo sapiens
gggacctggtctagcactgagc

SEQ ID NO: 7996685 - DNA, 22 bp, Homo sapiens
gggacctggtctagcactgagc

SEQ ID NO: 7996686 - DNA, 22 bp, Homo sapiens
gggacgacaggctctgtggtag

SEQ ID NO: 7996687 - DNA, 22 bp, Homo sapiens
gggacctggcgagggtcacaca

SEQ ID NO: 7996688 - DNA, 22 bp, Homo sapiens
gggacctgggccagaggacagt

SEQ ID NO: 7996689 - DNA, 22 bp, Homo sapiens
gggacctgggccagaggacagt

SEQ ID NO: 7996690 - DNA, 22 bp, Homo sapiens
gggacctgaggccctgctccac

SEQ ID NO: 7996691 - DNA, 22 bp, Homo sapiens
gggaccctgggaggctggcgca

SEQ ID NO: 7996692 - DNA, 22 bp, Homo sapiens
gggaccctgggaggctggcgca

SEQ ID NO: 7996693 - DNA, 22 bp, Homo sapiens
gggaccctcaacatctgcttct

SEQ ID NO: 7996694 - DNA, 22 bp, Homo sapiens
gggacccaggtaatcctgtgct

SEQ ID NO: 7996695 - DNA, 22 bp, Homo sapiens
gggacccacgaaaggctttgga

SEQ ID NO: 7996696 - DNA, 22 bp, Homo sapiens
gggaccagtgtctgtgagaaaa

SEQ ID NO: 7996697 - DNA, 22 bp, Homo sapiens
gggaccagtgtctgtgagaaaa

SEQ ID NO: 7996698 - DNA, 22 bp, Homo sapiens
gggaccagtgtctgtgagaaaa

SEQ ID NO: 7996699 - DNA, 22 bp, Homo sapiens
gggaccaggtgggtgcattccg

SEQ ID NO: 7996700 - DNA, 22 bp, Homo sapiens
gggaccaggtgggtgcattccg

SEQ ID NO: 7996701 - DNA, 22 bp, Homo sapiens
gggaccaggtcagggctctgac

SEQ ID NO: 7996702 - DNA, 22 bp, Homo sapiens
gggaccaggtcagggctctgac

SEQ ID NO: 7996703 - DNA, 22 bp, Homo sapiens
gggaccaggtcagggctctgac

SEQ ID NO: 7996704 - DNA, 22 bp, Homo sapiens
gacttaagtggtgtgataagtg

SEQ ID NO: 7996705 - DNA, 22 bp, Homo sapiens
gactgtgtccatgtgctggatt

SEQ ID NO: 7996706 - DNA, 22 bp, Homo sapiens
gacttcaaacagttaaaggcta

SEQ ID NO: 7996707 - DNA, 22 bp, Homo sapiens
gacttcaaagcgtgataaagat

SEQ ID NO: 7996708 - DNA, 17 bp, Homo sapiens
gacttcaacttctgctg

SEQ ID NO: 7996709 - DNA, 22 bp, Homo sapiens
gacttaatttccactttctgct

SEQ ID NO: 7996710 - DNA, 22 bp, Homo sapiens
gacttagaccctgtctttattc

SEQ ID NO: 7996711 - DNA, 20 bp, Homo sapiens
gacttcccatatcttcttca

SEQ ID NO: 7996712 - DNA, 21 bp, Homo sapiens
gacttcatgggtcaaccaatt

SEQ ID NO: 7996713 - DNA, 22 bp, Homo sapiens
gacttctgaattcctatcaggt

SEQ ID NO: 7996714 - DNA, 19 bp, Homo sapiens
gacttctgatgtccagatg

SEQ ID NO: 7996715 - DNA, 22 bp, Homo sapiens
gacttctccgtcatctccagtg

SEQ ID NO: 7996716 - DNA, 22 bp, Homo sapiens
gacttctccagactgcctggta

SEQ ID NO: 7996717 - DNA, 22 bp, Homo sapiens
gacttcctaagattcaggaatg

SEQ ID NO: 7996718 - DNA, 22 bp, Homo sapiens
gacttcttcatgtcttttccac

SEQ ID NO: 7996719 - DNA, 22 bp, Homo sapiens
gacttctgttaacttgtaagag

SEQ ID NO: 7996720 - DNA, 22 bp, Homo sapiens
gacttctgttaacttgtaagag

SEQ ID NO: 7996721 - DNA, 22 bp, Homo sapiens
gacttctgcctcaggggaaggt

SEQ ID NO: 7996722 - DNA, 22 bp, Homo sapiens
gacttgaaagggtgaacaactt

SEQ ID NO: 7996723 - DNA, 22 bp, Homo sapiens
gacttgcctgcactgagcctat

SEQ ID NO: 7996724 - DNA, 22 bp, Homo sapiens
gacttgaatcccaactcctctc

SEQ ID NO: 7996725 - DNA, 22 bp, Homo sapiens
gacttgggggaagatgtggctg

SEQ ID NO: 7996726 - DNA, 22 bp, Homo sapiens
gacttgggtggattgtgactct

SEQ ID NO: 7996727 - DNA, 22 bp, Homo sapiens
gacttggggatttatctcacag

SEQ ID NO: 7996728 - DNA, 22 bp, Homo sapiens
gacttgggagtcttctgagatg

SEQ ID NO: 7996729 - DNA, 22 bp, Homo sapiens
gacttgggagtcttctgagatg

SEQ ID NO: 7996730 - DNA, 22 bp, Homo sapiens
gacttgttctctgactgcttta

SEQ ID NO: 7996731 - DNA, 22 bp, Homo sapiens
gacttgttctctgactgcttta

SEQ ID NO: 7996732 - DNA, 22 bp, Homo sapiens
gacttgggtgtcggggcagtct

SEQ ID NO: 7996733 - DNA, 22 bp, Homo sapiens
gacttgggtgtcggggcagtct

SEQ ID NO: 7996734 - DNA, 18 bp, Homo sapiens
gactttaaaacactgctc

SEQ ID NO: 7996735 - DNA, 18 bp, Homo sapiens
gactttaaaacactgctc

SEQ ID NO: 7996736 - DNA, 22 bp, Homo sapiens
gactttaaaagtttgtgcttgg

SEQ ID NO: 7996737 - DNA, 22 bp, Homo sapiens
gactttaaaggttctgctgctt

SEQ ID NO: 7996738 - DNA, 22 bp, Homo sapiens
gactttaaaatgctagaacagg

SEQ ID NO: 7996739 - DNA, 22 bp, Homo sapiens
gactttaaagcctgacatttta

SEQ ID NO: 7996740 - DNA, 22 bp, Homo sapiens
gactttaaaatgctagaacagg

SEQ ID NO: 7996741 - DNA, 22 bp, Homo sapiens
gactgtggcgtagatgctggga

SEQ ID NO: 7996742 - DNA, 22 bp, Homo sapiens
gactgtgccagtcagtgggcgg

SEQ ID NO: 7996743 - DNA, 22 bp, Homo sapiens
gactgtcttttgaataaaaatg

SEQ ID NO: 7996744 - DNA, 22 bp, Homo sapiens
gactgtcttttgaataaaaatg

SEQ ID NO: 7996745 - DNA, 22 bp, Homo sapiens
gactgtcttgtttctaagatga

SEQ ID NO: 7996746 - DNA, 22 bp, Homo sapiens
gactgtctctgtgaatggtagg

SEQ ID NO: 7996747 - DNA, 22 bp, Homo sapiens
gactgtctctgtgaatggtagg

SEQ ID NO: 7996748 - DNA, 22 bp, Homo sapiens
gactgtctcctgtcatgaggga

SEQ ID NO: 7996749 - DNA, 22 bp, Homo sapiens
gactggtttctagcctcatagt

SEQ ID NO: 7996750 - DNA, 22 bp, Homo sapiens
gactggtttgccaccgacagat

SEQ ID NO: 7996751 - DNA, 22 bp, Homo sapiens
gactgtacttgagagaggaact

SEQ ID NO: 7996752 - DNA, 22 bp, Homo sapiens
gactgtccagaattcctaggtg

SEQ ID NO: 7996753 - DNA, 22 bp, Homo sapiens
gactggttgaactcaggacaga

SEQ ID NO: 7996754 - DNA, 22 bp, Homo sapiens
gactggaaagcctgtcctcaga

SEQ ID NO: 7996755 - DNA, 22 bp, Homo sapiens
gactggaaagcctgtcctcaga

SEQ ID NO: 7996756 - DNA, 22 bp, Homo sapiens
gactggggtaaggtgaggaggt

SEQ ID NO: 7996757 - DNA, 22 bp, Homo sapiens
gactggggtaaggtgaggaggt

SEQ ID NO: 7996758 - DNA, 22 bp, Homo sapiens
gactggtcttttgtgatggatg

SEQ ID NO: 7996759 - DNA, 22 bp, Homo sapiens
gactggttatccccagcacaca

SEQ ID NO: 7996760 - DNA, 22 bp, Homo sapiens
gactggttgaactcaggacaga

SEQ ID NO: 7996761 - DNA, 22 bp, Homo sapiens
gactggttgctaagcacagctt

SEQ ID NO: 7996762 - DNA, 22 bp, Homo sapiens
gactggtaaggtattggaattc

SEQ ID NO: 7996763 - DNA, 22 bp, Homo sapiens
gactggtaaggaaattcactaa

SEQ ID NO: 7996764 - DNA, 22 bp, Homo sapiens
gactgggtcctctgcttatggt

SEQ ID NO: 7996765 - DNA, 22 bp, Homo sapiens
gacccagggtttctgcacaggg

SEQ ID NO: 7996766 - DNA, 22 bp, Homo sapiens
gacccagggtttctgcacaggg

SEQ ID NO: 7996767 - DNA, 22 bp, Homo sapiens
gacccagggtttctgcacaggg

SEQ ID NO: 7996768 - DNA, 22 bp, Homo sapiens
gacccagggtttctgcacaggg

SEQ ID NO: 7996769 - DNA, 22 bp, Homo sapiens
gacccagggtggtcacctgaaa

SEQ ID NO: 7996770 - DNA, 22 bp, Homo sapiens
gacccagggtttctgcacaggg

SEQ ID NO: 7996771 - DNA, 22 bp, Homo sapiens
gacccagggtttctgcacaggg

SEQ ID NO: 7996772 - DNA, 22 bp, Homo sapiens
gactgcttatatgttaaagata

SEQ ID NO: 7996773 - DNA, 22 bp, Homo sapiens
gaccagttttctgctttggaag

SEQ ID NO: 7996774 - DNA, 22 bp, Homo sapiens
gaccatcctggccaacgtggta

SEQ ID NO: 7996775 - DNA, 22 bp, Homo sapiens
gaccatcctggccaacgtggta

SEQ ID NO: 7996776 - DNA, 22 bp, Homo sapiens
gaccatgtgaaaatagaggaga

SEQ ID NO: 7996777 - DNA, 22 bp, Homo sapiens
gaccatcctggccaacgtggta

SEQ ID NO: 7996778 - DNA, 22 bp, Homo sapiens
gaccatcctggccaacgtggta

SEQ ID NO: 7996779 - DNA, 22 bp, Homo sapiens
gaccagtcattactcatgccct

SEQ ID NO: 7996780 - DNA, 22 bp, Homo sapiens
gaccagtcattactcatgccct

SEQ ID NO: 7996781 - DNA, 22 bp, Homo sapiens
gaccagtcattactcatgccct

SEQ ID NO: 7996782 - DNA, 22 bp, Homo sapiens
gaccagtcattactcatgccct

SEQ ID NO: 7996783 - DNA, 22 bp, Homo sapiens
gaccagtcattactcatgccct

SEQ ID NO: 7996784 - DNA, 22 bp, Homo sapiens
gaccagtcattactcatgccct

SEQ ID NO: 7996785 - DNA, 22 bp, Homo sapiens
gaccagggtcactcacagggct

SEQ ID NO: 7996786 - DNA, 22 bp, Homo sapiens
gaccagggtcactcacagggct

SEQ ID NO: 7996787 - DNA, 22 bp, Homo sapiens
gaccagggtcactcacagggct

SEQ ID NO: 7996788 - DNA, 22 bp, Homo sapiens
gacaggcaggccagggctgtgg

SEQ ID NO: 7996789 - DNA, 22 bp, Homo sapiens
gacaggcaggccagggctgtgg

SEQ ID NO: 7996790 - DNA, 22 bp, Homo sapiens
gacaggcaggccagggctgtgg

SEQ ID NO: 7996791 - DNA, 22 bp, Homo sapiens
gacaggcagttttccagatcag

SEQ ID NO: 7996792 - DNA, 22 bp, Homo sapiens
gacaggcagttttccagatcag

SEQ ID NO: 7996793 - DNA, 22 bp, Homo sapiens
gaccaggcttccccagacctca

SEQ ID NO: 7996794 - DNA, 22 bp, Homo sapiens
gaccaggcttccccagacctca

SEQ ID NO: 7996795 - DNA, 22 bp, Homo sapiens
gaccaggcttccccagacctca

SEQ ID NO: 7996796 - DNA, 22 bp, Homo sapiens
gaccaggctgttccagtctaac

SEQ ID NO: 7996797 - DNA, 22 bp, Homo sapiens
gaccaggctgttccagtctaac

SEQ ID NO: 7996798 - DNA, 22 bp, Homo sapiens
gacaggccagacaggagactga

SEQ ID NO: 7996799 - DNA, 22 bp, Homo sapiens
gacaggccagacaggagactga

SEQ ID NO: 7996800 - DNA, 22 bp, Homo sapiens
gacaggcatgctttcaggacta

SEQ ID NO: 7996801 - DNA, 22 bp, Homo sapiens
gacaggaggcagagctcaggtg

SEQ ID NO: 7996802 - DNA, 22 bp, Homo sapiens
gacaggaggcagagctcaggtg

SEQ ID NO: 7996803 - DNA, 22 bp, Homo sapiens
gacaggaggcagagctcaggtg

SEQ ID NO: 7996804 - DNA, 22 bp, Homo sapiens
gacaggaggcagagctcaggtg

SEQ ID NO: 7996805 - DNA, 22 bp, Homo sapiens
gacaggaggcagagctcaggtg

SEQ ID NO: 7996806 - DNA, 22 bp, Homo sapiens
gacaggatattatgatagattc

SEQ ID NO: 7996807 - DNA, 22 bp, Homo sapiens
gacaggaggcagagctcaggtg

SEQ ID NO: 7996808 - DNA, 22 bp, Homo sapiens
gacaggaggcagagctcaggtg

SEQ ID NO: 7996809 - DNA, 20 bp, Homo sapiens
gacaggagagttaggtaggt

SEQ ID NO: 7996810 - DNA, 22 bp, Homo sapiens
gacaggcacgaaattgggctgg

SEQ ID NO: 7996811 - DNA, 22 bp, Homo sapiens
gacaggcagacctgtgccctgg

SEQ ID NO: 7996812 - DNA, 22 bp, Homo sapiens
gacaggcagacctgtgccctgg

SEQ ID NO: 7996813 - DNA, 22 bp, Homo sapiens
gacaggcaggccagggctgtgg

SEQ ID NO: 7996814 - DNA, 22 bp, Homo sapiens
gacaggcagacctgtgccctgg

SEQ ID NO: 7996815 - DNA, 22 bp, Homo sapiens
gacaggcagacctgtgccctgg

SEQ ID NO: 7996816 - DNA, 22 bp, Homo sapiens
gacaggaggcagagctcaggtg

SEQ ID NO: 7996817 - DNA, 22 bp, Homo sapiens
gacaggatgtattggcaagagg

SEQ ID NO: 7996818 - DNA, 22 bp, Homo sapiens
gacaggcaattaccagcgccca

SEQ ID NO: 7996819 - DNA, 22 bp, Homo sapiens
gacaggcaattaccagcgccca

SEQ ID NO: 7996820 - DNA, 22 bp, Homo sapiens
gacaggcaattaccagcgccca

SEQ ID NO: 7996821 - DNA, 22 bp, Homo sapiens
gacaggcaattaccagcgccca

SEQ ID NO: 7996822 - DNA, 22 bp, Homo sapiens
gacccagcttaagtcacatgtt

SEQ ID NO: 7996823 - DNA, 22 bp, Homo sapiens
gacccagctaaccaggtgggga

SEQ ID NO: 7996824 - DNA, 18 bp, Homo sapiens
gacccaggaaagagtcct

SEQ ID NO: 7996825 - DNA, 18 bp, Homo sapiens
gacccaggaaagagtcct

SEQ ID NO: 7996826 - DNA, 22 bp, Homo sapiens
gacccagcttaagtcacatgtt

SEQ ID NO: 7996827 - DNA, 18 bp, Homo sapiens
gacccaggaaagagtcct

SEQ ID NO: 7996828 - DNA, 18 bp, Homo sapiens
gacccaggaaagagtcct

SEQ ID NO: 7996829 - DNA, 22 bp, Homo sapiens
gacccagaggcctgacagtgtg

SEQ ID NO: 7996830 - DNA, 22 bp, Homo sapiens
gacccagaaggagtgccctaga

SEQ ID NO: 7996831 - DNA, 22 bp, Homo sapiens
gaccatttttacagagcattca

SEQ ID NO: 7996832 - DNA, 22 bp, Homo sapiens
gacccacctcaccaagcatgtg

SEQ ID NO: 7996833 - DNA, 22 bp, Homo sapiens
gacccagaggcctgacagtgtg

SEQ ID NO: 7996834 - DNA, 22 bp, Homo sapiens
gacccagaggcctgacagtgtg

SEQ ID NO: 7996835 - DNA, 18 bp, Homo sapiens
gacccagcagatgggctt

SEQ ID NO: 7996836 - DNA, 22 bp, Homo sapiens
gaccatttcaggggcagggact

SEQ ID NO: 7996837 - DNA, 22 bp, Homo sapiens
gaccattggcacagagcttttt

SEQ ID NO: 7996838 - DNA, 22 bp, Homo sapiens
gaccattagctgctattcagta

SEQ ID NO: 7996839 - DNA, 22 bp, Homo sapiens
gaccatttctaggaatcagact

SEQ ID NO: 7996840 - DNA, 22 bp, Homo sapiens
gaccatttccaccatgggcaca

SEQ ID NO: 7996841 - DNA, 22 bp, Homo sapiens
gaccatttgctagtaaattgca

SEQ ID NO: 7996842 - DNA, 22 bp, Homo sapiens
gaccatttctaggaatcagact

SEQ ID NO: 7996843 - DNA, 22 bp, Homo sapiens
gaccatttgttgaaaagattat

SEQ ID NO: 7996844 - DNA, 22 bp, Homo sapiens
gacccaggcccaaggctgccag

SEQ ID NO: 7996845 - DNA, 22 bp, Homo sapiens
gacccaggcccaaggctgccag

SEQ ID NO: 7996846 - DNA, 22 bp, Homo sapiens
gacccaggcccaaggctgccag

SEQ ID NO: 7996847 - DNA, 22 bp, Homo sapiens
gacccaggcccaaggctgccag

SEQ ID NO: 7996848 - DNA, 22 bp, Homo sapiens
gacccaggcccaaggctgccag

SEQ ID NO: 7996849 - DNA, 22 bp, Homo sapiens
gacccaggcctggggcttaagg

SEQ ID NO: 7996850 - DNA, 22 bp, Homo sapiens
gacccaggctcgtgggacggct

SEQ ID NO: 7996851 - DNA, 22 bp, Homo sapiens
gacccaggctcgtgggacggct

SEQ ID NO: 7996852 - DNA, 22 bp, Homo sapiens
gacccaggagagagggttgcat

SEQ ID NO: 7996853 - DNA, 22 bp, Homo sapiens
gacccaggagtgcagagagtgg

SEQ ID NO: 7996854 - DNA, 22 bp, Homo sapiens
gacccaggagagagggttgcat

SEQ ID NO: 7996855 - DNA, 22 bp, Homo sapiens
gacccaggagagagggttgcat

SEQ ID NO: 7996856 - DNA, 22 bp, Homo sapiens
gacccaggagtgcagagagtgg

SEQ ID NO: 7996857 - DNA, 22 bp, Homo sapiens
gacccaggagtgcagagagtgg

SEQ ID NO: 7996858 - DNA, 22 bp, Homo sapiens
gacccagggtatccagagctgc

SEQ ID NO: 7996859 - DNA, 22 bp, Homo sapiens
gacccagggtatccagagctgc

SEQ ID NO: 7996860 - DNA, 22 bp, Homo sapiens
gacccagggtatccagagctgc

SEQ ID NO: 7996861 - DNA, 22 bp, Homo sapiens
gacccagggtggtcacctgaaa

SEQ ID NO: 7996862 - DNA, 22 bp, Homo sapiens
gacccagggtggtcacctgaaa

SEQ ID NO: 7996863 - DNA, 22 bp, Homo sapiens
gacccagggtatccagagctgc

SEQ ID NO: 7996864 - DNA, 22 bp, Homo sapiens
gacccagggtatccagagctgc

SEQ ID NO: 7996865 - DNA, 22 bp, Homo sapiens
gacccaggggcagggagaaagt

SEQ ID NO: 7996866 - DNA, 22 bp, Homo sapiens
gacccaggggcagggagaaagt

SEQ ID NO: 7996867 - DNA, 22 bp, Homo sapiens
gacccagggtatccagagctgc

SEQ ID NO: 7996868 - DNA, 22 bp, Homo sapiens
gacccagggtatccagagctgc

SEQ ID NO: 7996869 - DNA, 22 bp, Homo sapiens
gagacacacccaaggttatgag

SEQ ID NO: 7996870 - DNA, 22 bp, Homo sapiens
gagacacacccaaggttatgag

SEQ ID NO: 7996871 - DNA, 22 bp, Homo sapiens
gagacacacccaaggttatgag

SEQ ID NO: 7996872 - DNA, 22 bp, Homo sapiens
gagacacacccaaggttatgag

SEQ ID NO: 7996873 - DNA, 22 bp, Homo sapiens
gagacacacacaggaggtggca

SEQ ID NO: 7996874 - DNA, 22 bp, Homo sapiens
gagacacacacaggaggtggca

SEQ ID NO: 7996875 - DNA, 22 bp, Homo sapiens
gagacacacacaggaggtggca

SEQ ID NO: 7996876 - DNA, 22 bp, Homo sapiens
gagacacacattctggagagaa

SEQ ID NO: 7996877 - DNA, 22 bp, Homo sapiens
gagacacacattctggagagaa

SEQ ID NO: 7996878 - DNA, 22 bp, Homo sapiens
gagacacacattctggagagaa

SEQ ID NO: 7996879 - DNA, 22 bp, Homo sapiens
gagacacaagaagacatgcaca

SEQ ID NO: 7996880 - DNA, 18 bp, Homo sapiens
gagacacaagggcctgga

SEQ ID NO: 7996881 - DNA, 22 bp, Homo sapiens
gagacacaagacgcaactctgt

SEQ ID NO: 7996882 - DNA, 22 bp, Homo sapiens
gagacacaagacgcaactctgt

SEQ ID NO: 7996883 - DNA, 22 bp, Homo sapiens
gagacacaatctcatttacatt

SEQ ID NO: 7996884 - DNA, 22 bp, Homo sapiens
gagacacaatttccccatccta

SEQ ID NO: 7996885 - DNA, 22 bp, Homo sapiens
gagacacaatttccccatccta

SEQ ID NO: 7996886 - DNA, 22 bp, Homo sapiens
gagacacaatctcatttacatt

SEQ ID NO: 7996887 - DNA, 22 bp, Homo sapiens
gagacacaatctcatttacatt

SEQ ID NO: 7996888 - DNA, 22 bp, Homo sapiens
gagacacaggtggttcctgtca

SEQ ID NO: 7996889 - DNA, 22 bp, Homo sapiens
gagacacaggtggttcctgtca

SEQ ID NO: 7996890 - DNA, 22 bp, Homo sapiens
gagacacagttatcaggcatac

SEQ ID NO: 7996891 - DNA, 22 bp, Homo sapiens
gagacacaggtggttcctgtca

SEQ ID NO: 7996892 - DNA, 22 bp, Homo sapiens
gagacacaggtggttcctgtca

SEQ ID NO: 7996893 - DNA, 22 bp, Homo sapiens
gagacacagagaggctgtgtga

SEQ ID NO: 7996894 - DNA, 22 bp, Homo sapiens
gagacacagcagatattcaatc

SEQ ID NO: 7996895 - DNA, 22 bp, Homo sapiens
gagacacaggcacagaagaggc

SEQ ID NO: 7996896 - DNA, 22 bp, Homo sapiens
gagacacaggcacagaagaggc

SEQ ID NO: 7996897 - DNA, 22 bp, Homo sapiens
gagacacaggcacagaagaggc

SEQ ID NO: 7996898 - DNA, 22 bp, Homo sapiens
gagacacaggcacagaagaggc

SEQ ID NO: 7996899 - DNA, 22 bp, Homo sapiens
gagacactcaacaaagatatga

SEQ ID NO: 7996900 - DNA, 22 bp, Homo sapiens
gagacacagttatcaggcatac

SEQ ID NO: 7996901 - DNA, 22 bp, Homo sapiens
gagacacagttatcaggcatac

SEQ ID NO: 7996902 - DNA, 22 bp, Homo sapiens
gagacacagttatcaggcatac

SEQ ID NO: 7996903 - DNA, 22 bp, Homo sapiens
gagacacagttatcaggcatac

SEQ ID NO: 7996904 - DNA, 22 bp, Homo sapiens
gagacacttgctgtgaggtcgc

SEQ ID NO: 7996905 - DNA, 22 bp, Homo sapiens
gagacactcaacaaagatatga

SEQ ID NO: 7996906 - DNA, 22 bp, Homo sapiens
gagacagagatcttgctgagtc

SEQ ID NO: 7996907 - DNA, 22 bp, Homo sapiens
gagacagagaggtactcaacat

SEQ ID NO: 7996908 - DNA, 22 bp, Homo sapiens
gagacagagaggtactcaacat

SEQ ID NO: 7996909 - DNA, 22 bp, Homo sapiens
gagaaaatgtcagacttggtcg

SEQ ID NO: 7996910 - DNA, 22 bp, Homo sapiens
gagaaaatgtcagacttggtcg

SEQ ID NO: 7996911 - DNA, 22 bp, Homo sapiens
gagaaaatcttgggtcaagaat

SEQ ID NO: 7996912 - DNA, 22 bp, Homo sapiens
gagaaaatcttgggtcaagaat

SEQ ID NO: 7996913 - DNA, 22 bp, Homo sapiens
gagaaaatcttgggtcaagaat

SEQ ID NO: 7996914 - DNA, 22 bp, Homo sapiens
gagaaacaacacttgatgcctt

SEQ ID NO: 7996915 - DNA, 22 bp, Homo sapiens
gagaaacaacacttgatgcctt

SEQ ID NO: 7996916 - DNA, 22 bp, Homo sapiens
gagaaacaacacttgatgcctt

SEQ ID NO: 7996917 - DNA, 22 bp, Homo sapiens
gagaaacaacacttgatgcctt

SEQ ID NO: 7996918 - DNA, 22 bp, Homo sapiens
gagaaacaacacttgatgcctt

SEQ ID NO: 7996919 - DNA, 22 bp, Homo sapiens
gagacacaagaagacatgcaca

SEQ ID NO: 7996920 - DNA, 22 bp, Homo sapiens
gagacacaagaagacatgcaca

SEQ ID NO: 7996921 - DNA, 22 bp, Homo sapiens
gagacacaagaagacatgcaca

SEQ ID NO: 7996922 - DNA, 22 bp, Homo sapiens
gagaaaatagcatgtgtagtat

SEQ ID NO: 7996923 - DNA, 22 bp, Homo sapiens
gagaaaatcttgggtcaagaat

SEQ ID NO: 7996924 - DNA, 22 bp, Homo sapiens
gagaaaagcgaaggacctggag

SEQ ID NO: 7996925 - DNA, 22 bp, Homo sapiens
gagaaaagcgaaggacctggag

SEQ ID NO: 7996926 - DNA, 22 bp, Homo sapiens
gagaaaatagcatgtgtagtat

SEQ ID NO: 7996927 - DNA, 22 bp, Homo sapiens
gactttgtgccaaacgccagaa

SEQ ID NO: 7996928 - DNA, 22 bp, Homo sapiens
gactttgtgccaaacgccagaa

SEQ ID NO: 7996929 - DNA, 22 bp, Homo sapiens
gacttttgaataaggtaggata

SEQ ID NO: 7996930 - DNA, 22 bp, Homo sapiens
gacttttctgagacaatgcttt

SEQ ID NO: 7996931 - DNA, 22 bp, Homo sapiens
gacttttagaatggtgaggaat

SEQ ID NO: 7996932 - DNA, 22 bp, Homo sapiens
gacttttagaatggtgaggaat

SEQ ID NO: 7996933 - DNA, 22 bp, Homo sapiens
gacttttccatcatccccctta

SEQ ID NO: 7996934 - DNA, 22 bp, Homo sapiens
gactttatttccttatttgtga

SEQ ID NO: 7996935 - DNA, 22 bp, Homo sapiens
gactttggtttgagcaagtcag

SEQ ID NO: 7996936 - DNA, 22 bp, Homo sapiens
gactttggttcagggctcagag

SEQ ID NO: 7996937 - DNA, 22 bp, Homo sapiens
gactttattttaacggagattc

SEQ ID NO: 7996938 - DNA, 22 bp, Homo sapiens
gactttattatagtggcaatag

SEQ ID NO: 7996939 - DNA, 22 bp, Homo sapiens
gactttattactaaccctgtga

SEQ ID NO: 7996940 - DNA, 22 bp, Homo sapiens
gactttattcgttaactgttaa

SEQ ID NO: 7996941 - DNA, 22 bp, Homo sapiens
gactttatttccttatttgtga

SEQ ID NO: 7996942 - DNA, 22 bp, Homo sapiens
gactttattactaaccctgtga

SEQ ID NO: 7996943 - DNA, 22 bp, Homo sapiens
gactttatgaagagatgaccaa

SEQ ID NO: 7996944 - DNA, 22 bp, Homo sapiens
gactttatcttgtccttcctgc

SEQ ID NO: 7996945 - DNA, 22 bp, Homo sapiens
gactttataaatgagaggcgga

SEQ ID NO: 7996946 - DNA, 22 bp, Homo sapiens
gactttatcctgcctgaccacg

SEQ ID NO: 7996947 - DNA, 22 bp, Homo sapiens
gagagctgggttcaagtagctg

SEQ ID NO: 7996948 - DNA, 22 bp, Homo sapiens
gagagctgggttcaagtagctg

SEQ ID NO: 7996949 - DNA, 22 bp, Homo sapiens
gagagctgggggactgtggatg

SEQ ID NO: 7996950 - DNA, 22 bp, Homo sapiens
gagagctgggttcaagtagctg

SEQ ID NO: 7996951 - DNA, 22 bp, Homo sapiens
gagagctgggttcaagtagctg

SEQ ID NO: 7996952 - DNA, 22 bp, Homo sapiens
gagagctgggttcaagtagctg

SEQ ID NO: 7996953 - DNA, 22 bp, Homo sapiens
gagagctgggttcaagtagctg

SEQ ID NO: 7996954 - DNA, 22 bp, Homo sapiens
gagagctgggttcaagtagctg

SEQ ID NO: 7996955 - DNA, 22 bp, Homo sapiens
gagaggtaatttgaagtgcaaa

SEQ ID NO: 7996956 - DNA, 22 bp, Homo sapiens
gagagctgtaatagtcatgtct

SEQ ID NO: 7996957 - DNA, 22 bp, Homo sapiens
gagagctgtaatagtcatgtct

SEQ ID NO: 7996958 - DNA, 20 bp, Homo sapiens
gagagctggggatgaggctg

SEQ ID NO: 7996959 - DNA, 20 bp, Homo sapiens
gagagctggggatgaggctg

SEQ ID NO: 7996960 - DNA, 22 bp, Homo sapiens
gagagctgggggactgtggatg

SEQ ID NO: 7996961 - DNA, 22 bp, Homo sapiens
gagagctgggggactgtggatg

SEQ ID NO: 7996962 - DNA, 22 bp, Homo sapiens
gagagctgggggactgtggatg

SEQ ID NO: 7996963 - DNA, 22 bp, Homo sapiens
gagagctgggggactgtggatg

SEQ ID NO: 7996964 - DNA, 22 bp, Homo sapiens
gagagctgggggactgtggatg

SEQ ID NO: 7996965 - DNA, 22 bp, Homo sapiens
gagagtctaggaacctcatata

SEQ ID NO: 7996966 - DNA, 22 bp, Homo sapiens
gagagtccttagtttgcaggta

SEQ ID NO: 7996967 - DNA, 22 bp, Homo sapiens
gagagtctaggaacctcatata

SEQ ID NO: 7996968 - DNA, 22 bp, Homo sapiens
gagagtctaggaacctcatata

SEQ ID NO: 7996969 - DNA, 22 bp, Homo sapiens
gagagtctaggaacctcatata

SEQ ID NO: 7996970 - DNA, 22 bp, Homo sapiens
gagaggtacaccctttaaactt

SEQ ID NO: 7996971 - DNA, 22 bp, Homo sapiens
gagaggtacggaaagagcgtgg

SEQ ID NO: 7996972 - DNA, 22 bp, Homo sapiens
gagaggtacggaaagagcgtgg

SEQ ID NO: 7996973 - DNA, 22 bp, Homo sapiens
gagaggtagaggctctgcttaa

SEQ ID NO: 7996974 - DNA, 20 bp, Homo sapiens
gagagctggggatgaggctg

SEQ ID NO: 7996975 - DNA, 20 bp, Homo sapiens
gagagctggggatgaggctg

SEQ ID NO: 7996976 - DNA, 22 bp, Homo sapiens
gagagctgggctttgggtgaag

SEQ ID NO: 7996977 - DNA, 22 bp, Homo sapiens
gagagctgggctttgggtgaag

SEQ ID NO: 7996978 - DNA, 20 bp, Homo sapiens
gagagctggggatgaggctg

SEQ ID NO: 7996979 - DNA, 20 bp, Homo sapiens
gagagctggggatgaggctg

SEQ ID NO: 7996980 - DNA, 20 bp, Homo sapiens
gagagctggggatgaggctg

SEQ ID NO: 7996981 - DNA, 22 bp, Homo sapiens
gagagctgggaaagccgtggag

SEQ ID NO: 7996982 - DNA, 22 bp, Homo sapiens
gagagctgggctttgggtgaag

SEQ ID NO: 7996983 - DNA, 22 bp, Homo sapiens
gagagctgggaaagccgtggag

SEQ ID NO: 7996984 - DNA, 22 bp, Homo sapiens
gagagctgggctttgggtgaag

SEQ ID NO: 7996985 - DNA, 22 bp, Homo sapiens
gagagctgggctttgggtgaag

SEQ ID NO: 7996986 - DNA, 22 bp, Homo sapiens
gagagctggccagcttcagtat

SEQ ID NO: 7996987 - DNA, 22 bp, Homo sapiens
gagagctggccagcttcagtat

SEQ ID NO: 7996988 - DNA, 22 bp, Homo sapiens
gagagctggccagcttcagtat

SEQ ID NO: 7996989 - DNA, 22 bp, Homo sapiens
gagagctggccagcttcagtat

SEQ ID NO: 7996990 - DNA, 22 bp, Homo sapiens
gagagctgggaaagccgtggag

SEQ ID NO: 7996991 - DNA, 22 bp, Homo sapiens
gagagctgggaaagccgtggag

SEQ ID NO: 7996992 - DNA, 22 bp, Homo sapiens
gagagctgggaaagccgtggag

SEQ ID NO: 7996993 - DNA, 22 bp, Homo sapiens
gagagctgggaaagccgtggag

SEQ ID NO: 7996994 - DNA, 22 bp, Homo sapiens
gagagctggattctggataggt

SEQ ID NO: 7996995 - DNA, 22 bp, Homo sapiens
gagagctggattctggataggt

SEQ ID NO: 7996996 - DNA, 22 bp, Homo sapiens
gagagctggattctggataggt

SEQ ID NO: 7996997 - DNA, 20 bp, Homo sapiens
gagagctggaaataaagtcc

SEQ ID NO: 7996998 - DNA, 20 bp, Homo sapiens
gagagctggaaataaagtcc

SEQ ID NO: 7996999 - DNA, 20 bp, Homo sapiens
gagagctggaaataaagtcc

SEQ ID NO: 7997000 - DNA, 20 bp, Homo sapiens
gagagctggaaataaagtcc

SEQ ID NO: 7997001 - DNA, 22 bp, Homo sapiens
gagagctggagttatttctctg

SEQ ID NO: 7997002 - DNA, 22 bp, Homo sapiens
gagagctggagttatttctctg

SEQ ID NO: 7997003 - DNA, 22 bp, Homo sapiens
gagagctggattctggataggt

SEQ ID NO: 7997004 - DNA, 22 bp, Homo sapiens
gagagctggattctggataggt

SEQ ID NO: 7997005 - DNA, 22 bp, Homo sapiens
gagagctggattctggataggt

SEQ ID NO: 7997006 - DNA, 22 bp, Homo sapiens
gagagctggagttatttctctg

SEQ ID NO: 7997007 - DNA, 22 bp, Homo sapiens
gagagctggagttatttctctg

SEQ ID NO: 7997008 - DNA, 22 bp, Homo sapiens
gagagcccttaggtttagagtt

SEQ ID NO: 7997009 - DNA, 22 bp, Homo sapiens
gagagcctgccagtgagtgtat

SEQ ID NO: 7997010 - DNA, 22 bp, Homo sapiens
gagacagatctcggctccatgc

SEQ ID NO: 7997011 - DNA, 22 bp, Homo sapiens
gagagcctttgaagggaagtga

SEQ ID NO: 7997012 - DNA, 22 bp, Homo sapiens
gagagcctgccagtgagtgtat

SEQ ID NO: 7997013 - DNA, 22 bp, Homo sapiens
gagagctccatgttcatgctgt

SEQ ID NO: 7997014 - DNA, 22 bp, Homo sapiens
gagagctccatgttcatgctgt

SEQ ID NO: 7997015 - DNA, 23 bp, Homo sapiens
gagagctgactgtcaagactgtt

SEQ ID NO: 7997016 - DNA, 22 bp, Homo sapiens
gagagctgaggggcctggcact

SEQ ID NO: 7997017 - DNA, 23 bp, Homo sapiens
gagagctgactgtcaagactgtt

SEQ ID NO: 7997018 - DNA, 22 bp, Homo sapiens
gagacagagatcttgctgagtc

SEQ ID NO: 7997019 - DNA, 22 bp, Homo sapiens
gagacagagatcttgctgagtc

SEQ ID NO: 7997020 - DNA, 22 bp, Homo sapiens
gagacagatctcggctccatgc

SEQ ID NO: 7997021 - DNA, 22 bp, Homo sapiens
gagagctgcagccgagaggggg

SEQ ID NO: 7997022 - DNA, 22 bp, Homo sapiens
gagagctgcaaggtagggcggg

SEQ ID NO: 7997023 - DNA, 22 bp, Homo sapiens
gagagctgcaaggtagggcggg

SEQ ID NO: 7997024 - DNA, 22 bp, Homo sapiens
gagagctgatagatgagctact

SEQ ID NO: 7997025 - DNA, 22 bp, Homo sapiens
gagagctgaggggcctggcact

SEQ ID NO: 7997026 - DNA, 22 bp, Homo sapiens
gagagctgaggggcctggcact

SEQ ID NO: 7997027 - DNA, 22 bp, Homo sapiens
gagagctgaggggcctggcact

SEQ ID NO: 7997028 - DNA, 22 bp, Homo sapiens
gagagctgatagatgagctact

SEQ ID NO: 7997029 - DNA, 22 bp, Homo sapiens
gagagctgaggggcctggcact

SEQ ID NO: 7997030 - DNA, 22 bp, Homo sapiens
gagagctgatagatgagctact

SEQ ID NO: 7997031 - DNA, 22 bp, Homo sapiens
gagagctgatagatgagctact

SEQ ID NO: 7997032 - DNA, 22 bp, Homo sapiens
gagagctgcattctcagacaca

SEQ ID NO: 7997033 - DNA, 22 bp, Homo sapiens
gagagctgcattctcagacaca

SEQ ID NO: 7997034 - DNA, 22 bp, Homo sapiens
gagagctgcattctcagacaca

SEQ ID NO: 7997035 - DNA, 18 bp, Homo sapiens
gagagctgctacctagct

SEQ ID NO: 7997036 - DNA, 18 bp, Homo sapiens
gagagctgctacctagct

SEQ ID NO: 7997037 - DNA, 18 bp, Homo sapiens
gagagctgctacctagct

SEQ ID NO: 7997038 - DNA, 22 bp, Homo sapiens
gagagctgcagccgagaggggg

SEQ ID NO: 7997039 - DNA, 17 bp, Homo sapiens
gagagctgctgcttccg

SEQ ID NO: 7997040 - DNA, 17 bp, Homo sapiens
gagagctgctgcttccg

SEQ ID NO: 7997041 - DNA, 17 bp, Homo sapiens
gagagctgctgcttccg

SEQ ID NO: 7997042 - DNA, 17 bp, Homo sapiens
gagagctgctgcttccg

SEQ ID NO: 7997043 - DNA, 17 bp, Homo sapiens
gagagctgctgcttccg

SEQ ID NO: 7997044 - DNA, 18 bp, Homo sapiens
gagagctgctacctagct

SEQ ID NO: 7997045 - DNA, 22 bp, Homo sapiens
gaaggctgatgacagattctgc

SEQ ID NO: 7997046 - DNA, 22 bp, Homo sapiens
gaaggctgcatggaggctgtgg

SEQ ID NO: 7997047 - DNA, 22 bp, Homo sapiens
gaaggctgatgacagattctgc

SEQ ID NO: 7997048 - DNA, 22 bp, Homo sapiens
gaaggctgcatggaggctgtgg

SEQ ID NO: 7997049 - DNA, 22 bp, Homo sapiens
gaaggctgcatggaggctgtgg

SEQ ID NO: 7997050 - DNA, 22 bp, Homo sapiens
gaaggctgcgaggggagtgccg

SEQ ID NO: 7997051 - DNA, 22 bp, Homo sapiens
gaaggctgcgaggggagtgccg

SEQ ID NO: 7997052 - DNA, 22 bp, Homo sapiens
gaaggctgccagtggccctctt

SEQ ID NO: 7997053 - DNA, 22 bp, Homo sapiens
gaaggctgcatggaggctgtgg

SEQ ID NO: 7997054 - DNA, 22 bp, Homo sapiens
gaaggctgcgaggggagtgccg

SEQ ID NO: 7997055 - DNA, 22 bp, Homo sapiens
gaaggctgagcagacaggccaa

SEQ ID NO: 7997056 - DNA, 22 bp, Homo sapiens
gaaggctgagcagacaggccaa

SEQ ID NO: 7997057 - DNA, 22 bp, Homo sapiens
gaaggctgagtgggtacggagg

SEQ ID NO: 7997058 - DNA, 22 bp, Homo sapiens
gaaggctgagcagacaggccaa

SEQ ID NO: 7997059 - DNA, 22 bp, Homo sapiens
gaaggctgagtgggtacggagg

SEQ ID NO: 7997060 - DNA, 22 bp, Homo sapiens
gaaggctgagtgggtacggagg

SEQ ID NO: 7997061 - DNA, 22 bp, Homo sapiens
gaaggctgatgacagattctgc

SEQ ID NO: 7997062 - DNA, 22 bp, Homo sapiens
gaaggctccttgagggaaggac

SEQ ID NO: 7997063 - DNA, 22 bp, Homo sapiens
gaaggctccttgagggaaggac

SEQ ID NO: 7997064 - DNA, 22 bp, Homo sapiens
gaaggctccttgagggaaggac

SEQ ID NO: 7997065 - DNA, 22 bp, Homo sapiens
gaaggctctgatttcttgcaaa

SEQ ID NO: 7997066 - DNA, 22 bp, Homo sapiens
gaaggctatatgactcagccct

SEQ ID NO: 7997067 - DNA, 22 bp, Homo sapiens
gaaggctatatgactcagccct

SEQ ID NO: 7997068 - DNA, 22 bp, Homo sapiens
gaaggctagaaacgatgcttat

SEQ ID NO: 7997069 - DNA, 22 bp, Homo sapiens
gaaggctacttctcctcagggc

SEQ ID NO: 7997070 - DNA, 22 bp, Homo sapiens
gaaggctaaaggggcagaggtt

SEQ ID NO: 7997071 - DNA, 22 bp, Homo sapiens
gaaggctaaaggggcagaggtt

SEQ ID NO: 7997072 - DNA, 22 bp, Homo sapiens
gaaggctaaaggggcagaggtt

SEQ ID NO: 7997073 - DNA, 22 bp, Homo sapiens
gaaggctcttgaggccaggtaa

SEQ ID NO: 7997074 - DNA, 19 bp, Homo sapiens
gaaggctgaaatgaagcac

SEQ ID NO: 7997075 - DNA, 22 bp, Homo sapiens
gaaggctgaattatttgttcct

SEQ ID NO: 7997076 - DNA, 22 bp, Homo sapiens
gaaggctgagcagacaggccaa

SEQ ID NO: 7997077 - DNA, 19 bp, Homo sapiens
gaaggctgaaatgaagcac

SEQ ID NO: 7997078 - DNA, 22 bp, Homo sapiens
gaaggctctggggattgagata

SEQ ID NO: 7997079 - DNA, 22 bp, Homo sapiens
gaaggctcttgaggccaggtaa

SEQ ID NO: 7997080 - DNA, 19 bp, Homo sapiens
gaaggctgaaatgaagcac

SEQ ID NO: 7997081 - DNA, 22 bp, Homo sapiens
gaaggcttgattgaggaatgcc

SEQ ID NO: 7997082 - DNA, 21 bp, Homo sapiens
gaaggcttctgcctggaggag

SEQ ID NO: 7997083 - DNA, 21 bp, Homo sapiens
gaaggcttctgcctggaggag

SEQ ID NO: 7997084 - DNA, 22 bp, Homo sapiens
gaaggcttcaaaaggtgtaatt

SEQ ID NO: 7997085 - DNA, 22 bp, Homo sapiens
gaaggcttcctgatgccaacca

SEQ ID NO: 7997086 - DNA, 22 bp, Homo sapiens
gaaggcttcctggaggaggtgg

SEQ ID NO: 7997087 - DNA, 22 bp, Homo sapiens
gaaggcttctccagggcttact

SEQ ID NO: 7997088 - DNA, 22 bp, Homo sapiens
gaaggcttcctggaggaggtgg

SEQ ID NO: 7997089 - DNA, 22 bp, Homo sapiens
gaaggcttcccacctgatattt

SEQ ID NO: 7997090 - DNA, 22 bp, Homo sapiens
gaaggcttcaaaaggtgtaatt

SEQ ID NO: 7997091 - DNA, 22 bp, Homo sapiens
gaaggcttattttctttgtaaa

SEQ ID NO: 7997092 - DNA, 22 bp, Homo sapiens
gaaggcttattttctttgtaaa

SEQ ID NO: 7997093 - DNA, 22 bp, Homo sapiens
gaaggctgcgaggggagtgccg

SEQ ID NO: 7997094 - DNA, 22 bp, Homo sapiens
gaaggctgcgaggggagtgccg

SEQ ID NO: 7997095 - DNA, 22 bp, Homo sapiens
gaaggctgcgaggggagtgccg

SEQ ID NO: 7997096 - DNA, 22 bp, Homo sapiens
gaaggcttttctaccagatctt

SEQ ID NO: 7997097 - DNA, 22 bp, Homo sapiens
gaaggctttagagagatataaa

SEQ ID NO: 7997098 - DNA, 22 bp, Homo sapiens
gaaggcttggttttttcaacac

SEQ ID NO: 7997099 - DNA, 19 bp, Homo sapiens
gaaggcttttggtatgttt

SEQ ID NO: 7997100 - DNA, 22 bp, Homo sapiens
gaaggctttttgggtaattgta

SEQ ID NO: 7997101 - DNA, 22 bp, Homo sapiens
gaagggaaagtgacttacccga

SEQ ID NO: 7997102 - DNA, 22 bp, Homo sapiens
gaaggcttgcagctctgtggca

SEQ ID NO: 7997103 - DNA, 22 bp, Homo sapiens
gaaggcttgcaagtggttcata

SEQ ID NO: 7997104 - DNA, 22 bp, Homo sapiens
gaaggcttgcaagtggttcata

SEQ ID NO: 7997105 - DNA, 22 bp, Homo sapiens
gaaggcttgcaagtggttcata

SEQ ID NO: 7997106 - DNA, 20 bp, Homo sapiens
gaaggcttggacagtgacag

SEQ ID NO: 7997107 - DNA, 20 bp, Homo sapiens
gaaggcttggacagtgacag

SEQ ID NO: 7997108 - DNA, 20 bp, Homo sapiens
gaaggcttggacagtgacag

SEQ ID NO: 7997109 - DNA, 22 bp, Homo sapiens
gaaggcttgccgggaagcggca

SEQ ID NO: 7997110 - DNA, 22 bp, Homo sapiens
gaagtgaaggttactctagatt

SEQ ID NO: 7997111 - DNA, 22 bp, Homo sapiens
gaagtgaaggttactctagatt

SEQ ID NO: 7997112 - DNA, 18 bp, Homo sapiens
gaagtgaagtgactcaat

SEQ ID NO: 7997113 - DNA, 18 bp, Homo sapiens
gaagtgaagtgactcaat

SEQ ID NO: 7997114 - DNA, 22 bp, Homo sapiens
gaagtgaagagattagaaatca

SEQ ID NO: 7997115 - DNA, 22 bp, Homo sapiens
gaagtgaagagattagaaatca

SEQ ID NO: 7997116 - DNA, 22 bp, Homo sapiens
gaagtgcaaaaccacatggtaa

SEQ ID NO: 7997117 - DNA, 22 bp, Homo sapiens
gaagtgcaacctgaaatactag

SEQ ID NO: 7997118 - DNA, 22 bp, Homo sapiens
gaagtgcaaaaccacatggtaa

SEQ ID NO: 7997119 - DNA, 22 bp, Homo sapiens
gaagtgcaaaaccacatggtaa

SEQ ID NO: 7997120 - DNA, 22 bp, Homo sapiens
gaagtggaagccatcggcagtc

SEQ ID NO: 7997121 - DNA, 22 bp, Homo sapiens
gaagtgcaacctgaaatactag

SEQ ID NO: 7997122 - DNA, 22 bp, Homo sapiens
gaagtacaaaggacatggaaac

SEQ ID NO: 7997123 - DNA, 22 bp, Homo sapiens
gaagtacaaaggacatggaaac

SEQ ID NO: 7997124 - DNA, 22 bp, Homo sapiens
gaagtacaaaggacatggaaac

SEQ ID NO: 7997125 - DNA, 22 bp, Homo sapiens
gaagtcttttcttccacccaaa

SEQ ID NO: 7997126 - DNA, 22 bp, Homo sapiens
gaagggaaggaaagaaccagca

SEQ ID NO: 7997127 - DNA, 22 bp, Homo sapiens
gaagggaaggaaagaaccagca

SEQ ID NO: 7997128 - DNA, 22 bp, Homo sapiens
gaagggaaattcagatcttcag

SEQ ID NO: 7997129 - DNA, 22 bp, Homo sapiens
gaagggaaattcagatcttcag

SEQ ID NO: 7997130 - DNA, 22 bp, Homo sapiens
gaagggaactgggtctccttgt

SEQ ID NO: 7997131 - DNA, 22 bp, Homo sapiens
gaagggaaggaaagaaccagca

SEQ ID NO: 7997132 - DNA, 20 bp, Homo sapiens
gaagtgtcttgtttctggat

SEQ ID NO: 7997133 - DNA, 22 bp, Homo sapiens
gaagtgtgcacatcttacaagt

SEQ ID NO: 7997134 - DNA, 22 bp, Homo sapiens
gaagtgtgcacatcttacaagt

SEQ ID NO: 7997135 - DNA, 22 bp, Homo sapiens
gaagttactctcgttaaatatg

SEQ ID NO: 7997136 - DNA, 20 bp, Homo sapiens
gaagtgtggagttgggaagc

SEQ ID NO: 7997137 - DNA, 22 bp, Homo sapiens
gaagtggggaagcaacaggaga

SEQ ID NO: 7997138 - DNA, 22 bp, Homo sapiens
gaagtgggctttgtggtcagct

SEQ ID NO: 7997139 - DNA, 22 bp, Homo sapiens
gaagtggggaagcaacaggaga

SEQ ID NO: 7997140 - DNA, 22 bp, Homo sapiens
gaagtggggaagcaacaggaga

SEQ ID NO: 7997141 - DNA, 22 bp, Homo sapiens
gaagtgggtggtgatatcactg

SEQ ID NO: 7997142 - DNA, 22 bp, Homo sapiens
gaagtgtagtcttgagccccca

SEQ ID NO: 7997143 - DNA, 22 bp, Homo sapiens
gaagtgggctttgtggtcagct

SEQ ID NO: 7997144 - DNA, 22 bp, Homo sapiens
gaagtgggctttgtggtcagct

SEQ ID NO: 7997145 - DNA, 22 bp, Homo sapiens
gaagtgggctttgtggtcagct

SEQ ID NO: 7997146 - DNA, 22 bp, Homo sapiens
gaagtggaagccatcggcagtc

SEQ ID NO: 7997147 - DNA, 22 bp, Homo sapiens
gaagtggaattactgggtcata

SEQ ID NO: 7997148 - DNA, 22 bp, Homo sapiens
gaagtggaattactgggtcata

SEQ ID NO: 7997149 - DNA, 22 bp, Homo sapiens
gaagtggaattactgggtcata

SEQ ID NO: 7997150 - DNA, 22 bp, Homo sapiens
gaaggagagggtcaaggataat

SEQ ID NO: 7997151 - DNA, 22 bp, Homo sapiens
gaaggagagggtcaaggataat

SEQ ID NO: 7997152 - DNA, 22 bp, Homo sapiens
gaaggagagggtcaaggataat

SEQ ID NO: 7997153 - DNA, 22 bp, Homo sapiens
gaaggagagggtcaaggataat

SEQ ID NO: 7997154 - DNA, 22 bp, Homo sapiens
gaaggcccgccctgagcaaggg

SEQ ID NO: 7997155 - DNA, 22 bp, Homo sapiens
gaaggcccgccctgagcaaggg

SEQ ID NO: 7997156 - DNA, 22 bp, Homo sapiens
gaaggagagggtcaaggataat

SEQ ID NO: 7997157 - DNA, 22 bp, Homo sapiens
gaaggagaggattgtgaggctg

SEQ ID NO: 7997158 - DNA, 22 bp, Homo sapiens
gaaggagaggattgtgaggctg

SEQ ID NO: 7997159 - DNA, 22 bp, Homo sapiens
gaaggagaggattgtgaggctg

SEQ ID NO: 7997160 - DNA, 22 bp, Homo sapiens
gaaggagaggattgtgaggctg

SEQ ID NO: 7997161 - DNA, 22 bp, Homo sapiens
gaaggagagggtcaaggataat

SEQ ID NO: 7997162 - DNA, 22 bp, Homo sapiens
gaaggagagggtcaaggataat

SEQ ID NO: 7997163 - DNA, 22 bp, Homo sapiens
gaaggagagggtcaaggataat

SEQ ID NO: 7997164 - DNA, 22 bp, Homo sapiens
gaaggcctaggaaggaagcctt

SEQ ID NO: 7997165 - DNA, 22 bp, Homo sapiens
gaaggccctgttttccctattt

SEQ ID NO: 7997166 - DNA, 22 bp, Homo sapiens
gaaggcctaggaaggaagcctt

SEQ ID NO: 7997167 - DNA, 22 bp, Homo sapiens
gaaggccctggtattcttgagg

SEQ ID NO: 7997168 - DNA, 22 bp, Homo sapiens
gaaggccctgttttccctattt

SEQ ID NO: 7997169 - DNA, 22 bp, Homo sapiens
gaaggcccgccctgagcaaggg

SEQ ID NO: 7997170 - DNA, 22 bp, Homo sapiens
gaaggccctggtattcttgagg

SEQ ID NO: 7997171 - DNA, 22 bp, Homo sapiens
gaaggcccgccctgagcaaggg

SEQ ID NO: 7997172 - DNA, 22 bp, Homo sapiens
gaaggcctgtggtagtgagacg

SEQ ID NO: 7997173 - DNA, 17 bp, Homo sapiens
gaaggcctgcacaggcc

SEQ ID NO: 7997174 - DNA, 17 bp, Homo sapiens
gaaggcctgcacaggcc

SEQ ID NO: 7997175 - DNA, 17 bp, Homo sapiens
gaaggcctgcacaggcc

SEQ ID NO: 7997176 - DNA, 22 bp, Homo sapiens
gaaggcctctaccatagaaggc

SEQ ID NO: 7997177 - DNA, 22 bp, Homo sapiens
gaaggcctctaccatagaaggc

SEQ ID NO: 7997178 - DNA, 22 bp, Homo sapiens
gaaggcctcactctgcagcata

SEQ ID NO: 7997179 - DNA, 22 bp, Homo sapiens
gaaggagagaaaggcaattctg

SEQ ID NO: 7997180 - DNA, 22 bp, Homo sapiens
gaaggagagaaaggcaattctg

SEQ ID NO: 7997181 - DNA, 22 bp, Homo sapiens
gaaggagagagacatcgtccct

SEQ ID NO: 7997182 - DNA, 22 bp, Homo sapiens
gaaggagagaaaggcaattctg

SEQ ID NO: 7997183 - DNA, 22 bp, Homo sapiens
gaaggagaccctgaagatgctg

SEQ ID NO: 7997184 - DNA, 22 bp, Homo sapiens
gaaggagagaaaggcaattctg

SEQ ID NO: 7997185 - DNA, 22 bp, Homo sapiens
gaaggagaccctgaagatgctg

SEQ ID NO: 7997186 - DNA, 22 bp, Homo sapiens
gaaggagaccctgaagatgctg

SEQ ID NO: 7997187 - DNA, 21 bp, Homo sapiens
gaaggagaaagcaagtgctgc

SEQ ID NO: 7997188 - DNA, 21 bp, Homo sapiens
gaaggagaaagcaagtgctgc

SEQ ID NO: 7997189 - DNA, 22 bp, Homo sapiens
gaaggagaccctgaagatgctg

SEQ ID NO: 7997190 - DNA, 22 bp, Homo sapiens
gaaggagagagacatcgtccct

SEQ ID NO: 7997191 - DNA, 22 bp, Homo sapiens
gaaggagagagacatcgtccct

SEQ ID NO: 7997192 - DNA, 21 bp, Homo sapiens
gaaggagaaagcaagtgctgc

SEQ ID NO: 7997193 - DNA, 19 bp, Homo sapiens
gaaggagagctgagttagg

SEQ ID NO: 7997194 - DNA, 19 bp, Homo sapiens
gaaggagagctgagttagg

SEQ ID NO: 7997195 - DNA, 22 bp, Homo sapiens
gaaggagaggattgtgaggctg

SEQ ID NO: 7997196 - DNA, 22 bp, Homo sapiens
gaaggagaggattgtgaggctg

SEQ ID NO: 7997197 - DNA, 22 bp, Homo sapiens
gaaggagaggattgtgaggctg

SEQ ID NO: 7997198 - DNA, 22 bp, Homo sapiens
gaaggagaggattgtgaggctg

SEQ ID NO: 7997199 - DNA, 22 bp, Homo sapiens
gaaggagaggattgtgaggctg

SEQ ID NO: 7997200 - DNA, 22 bp, Homo sapiens
gaaggaagtcattagtgcagac

SEQ ID NO: 7997201 - DNA, 22 bp, Homo sapiens
gaaggaagtcattagtgcagac

SEQ ID NO: 7997202 - DNA, 22 bp, Homo sapiens
gaaggaagtcattagtgcagac

SEQ ID NO: 7997203 - DNA, 22 bp, Homo sapiens
gaaggaagtcattagtgcagac

SEQ ID NO: 7997204 - DNA, 22 bp, Homo sapiens
gaaggaagtcattagtgcagac

SEQ ID NO: 7997205 - DNA, 22 bp, Homo sapiens
gaaggaagtcattagtgcagac

SEQ ID NO: 7997206 - DNA, 20 bp, Homo sapiens
gaaggaagggggcaaggtga

SEQ ID NO: 7997207 - DNA, 20 bp, Homo sapiens
gaaggaagggggcaaggtga

SEQ ID NO: 7997208 - DNA, 20 bp, Homo sapiens
gaaggaagggggcaaggtga

SEQ ID NO: 7997209 - DNA, 20 bp, Homo sapiens
gaaggaagggggcaaggtga

SEQ ID NO: 7997210 - DNA, 22 bp, Homo sapiens
gaaggaagtgctcatactagtt

SEQ ID NO: 7997211 - DNA, 21 bp, Homo sapiens
gaaggagaaagcaagtgctgc

SEQ ID NO: 7997212 - DNA, 21 bp, Homo sapiens
gaaggagaaagcaagtgctgc

SEQ ID NO: 7997213 - DNA, 21 bp, Homo sapiens
gaaggagaaagcaagtgctgc

SEQ ID NO: 7997214 - DNA, 21 bp, Homo sapiens
gaaggagaaagcaagtgctgc

SEQ ID NO: 7997215 - DNA, 21 bp, Homo sapiens
gaaggagaaagcaagtgctgc

SEQ ID NO: 7997216 - DNA, 22 bp, Homo sapiens
gaaggacccacgaagtcactgg

SEQ ID NO: 7997217 - DNA, 21 bp, Homo sapiens
gaaggagaaagcaagtgctgc

SEQ ID NO: 7997218 - DNA, 22 bp, Homo sapiens
gaaggaagggctggctgtcttg

SEQ ID NO: 7997219 - DNA, 22 bp, Homo sapiens
gaaggaagggctggctgtcttg

SEQ ID NO: 7997220 - DNA, 22 bp, Homo sapiens
gaaggaagggctggctgtcttg

SEQ ID NO: 7997221 - DNA, 22 bp, Homo sapiens
gaaggaagctgtctggatgtgt

SEQ ID NO: 7997222 - DNA, 22 bp, Homo sapiens
gaaggaaggaaaaatatattta

SEQ ID NO: 7997223 - DNA, 22 bp, Homo sapiens
gaaggaagctgtctggatgtgt

SEQ ID NO: 7997224 - DNA, 22 bp, Homo sapiens
gaaggaagctgtctggatgtgt

SEQ ID NO: 7997225 - DNA, 22 bp, Homo sapiens
gaaggaagctgtctggatgtgt

SEQ ID NO: 7997226 - DNA, 22 bp, Homo sapiens
gaaggaagccgtttctctccag

SEQ ID NO: 7997227 - DNA, 22 bp, Homo sapiens
gaactgttccctcacaggctgg

SEQ ID NO: 7997228 - DNA, 23 bp, Homo sapiens
gaactgttgatgaatagaatata

SEQ ID NO: 7997229 - DNA, 22 bp, Homo sapiens
gaactgtttctggtgaaagagt

SEQ ID NO: 7997230 - DNA, 22 bp, Homo sapiens
gaacttaacggcaactatttaa

SEQ ID NO: 7997231 - DNA, 22 bp, Homo sapiens
gaactgtgtttgtttctaggtc

SEQ ID NO: 7997232 - DNA, 22 bp, Homo sapiens
gaactgtcattggggacatcag

SEQ ID NO: 7997233 - DNA, 20 bp, Homo sapiens
gaactgtgcactggtcacag

SEQ ID NO: 7997234 - DNA, 19 bp, Homo sapiens
gacaggaaggctaccagta

SEQ ID NO: 7997235 - DNA, 19 bp, Homo sapiens
gacaggaaggctaccagta

SEQ ID NO: 7997236 - DNA, 22 bp, Homo sapiens
gacaggaagtctgaaggaggga

SEQ ID NO: 7997237 - DNA, 22 bp, Homo sapiens
gacaggaagtctgaaggaggga

SEQ ID NO: 7997238 - DNA, 22 bp, Homo sapiens
gacaggaagtctgaaggaggga

SEQ ID NO: 7997239 - DNA, 22 bp, Homo sapiens
gacaggaagtctgaaggaggga

SEQ ID NO: 7997240 - DNA, 22 bp, Homo sapiens
gacaggaagtctgaaggaggga

SEQ ID NO: 7997241 - DNA, 22 bp, Homo sapiens
gacaggaatgtgtggatgcgga

SEQ ID NO: 7997242 - DNA, 22 bp, Homo sapiens
gacaggaacataaatgtaggag

SEQ ID NO: 7997243 - DNA, 22 bp, Homo sapiens
gacaggaacataaatgtaggag

SEQ ID NO: 7997244 - DNA, 22 bp, Homo sapiens
gacaggaacataaatgtaggag

SEQ ID NO: 7997245 - DNA, 19 bp, Homo sapiens
gacaggaaggctaccagta

SEQ ID NO: 7997246 - DNA, 19 bp, Homo sapiens
gacaggaaggctaccagta

SEQ ID NO: 7997247 - DNA, 22 bp, Homo sapiens
gacaggaatgtgtggatgcgga

SEQ ID NO: 7997248 - DNA, 22 bp, Homo sapiens
gacaggaatgtgtggatgcgga

SEQ ID NO: 7997249 - DNA, 19 bp, Homo sapiens
gacaggacgaagggaagtt

SEQ ID NO: 7997250 - DNA, 20 bp, Homo sapiens
gacaggagagttaggtaggt

SEQ ID NO: 7997251 - DNA, 20 bp, Homo sapiens
gacaggagagttaggtaggt

SEQ ID NO: 7997252 - DNA, 20 bp, Homo sapiens
gacaggagagttaggtaggt

SEQ ID NO: 7997253 - DNA, 20 bp, Homo sapiens
gacaggagagttaggtaggt

SEQ ID NO: 7997254 - DNA, 22 bp, Homo sapiens
gacacaggtagaataaagtact

SEQ ID NO: 7997255 - DNA, 22 bp, Homo sapiens
gacacaggtagaataaagtact

SEQ ID NO: 7997256 - DNA, 22 bp, Homo sapiens
gacagctgtgcaggagaagggg

SEQ ID NO: 7997257 - DNA, 22 bp, Homo sapiens
gacagctgtgcaggagaagggg

SEQ ID NO: 7997258 - DNA, 22 bp, Homo sapiens
gacagctgtgcaggagaagggg

SEQ ID NO: 7997259 - DNA, 22 bp, Homo sapiens
gacagctgtgcaggagaagggg

SEQ ID NO: 7997260 - DNA, 22 bp, Homo sapiens
gacagctgtgcaggagaagggg

SEQ ID NO: 7997261 - DNA, 22 bp, Homo sapiens
gacagctgtggagaggcatgtg

SEQ ID NO: 7997262 - DNA, 22 bp, Homo sapiens
gacagctgtggagaggcatgtg

SEQ ID NO: 7997263 - DNA, 22 bp, Homo sapiens
gacagctgtggagaggcatgtg

SEQ ID NO: 7997264 - DNA, 22 bp, Homo sapiens
gacagctgtggagaggcatgtg

SEQ ID NO: 7997265 - DNA, 22 bp, Homo sapiens
gacaggaacataaatgtaggag

SEQ ID NO: 7997266 - DNA, 22 bp, Homo sapiens
gacagctgtggagaggcatgtg

SEQ ID NO: 7997267 - DNA, 22 bp, Homo sapiens
gacacagggacgtgctctgcct

SEQ ID NO: 7997268 - DNA, 22 bp, Homo sapiens
gacacagggacgtgctctgcct

SEQ ID NO: 7997269 - DNA, 22 bp, Homo sapiens
gacacagggacgtgctctgcct

SEQ ID NO: 7997270 - DNA, 22 bp, Homo sapiens
gacacagggacgtgctctgcct

SEQ ID NO: 7997271 - DNA, 22 bp, Homo sapiens
gacacagggggatgtgtggacg

SEQ ID NO: 7997272 - DNA, 22 bp, Homo sapiens
gacacagggggatgtgtggacg

SEQ ID NO: 7997273 - DNA, 22 bp, Homo sapiens
gacacagggggatgtgtggacg

SEQ ID NO: 7997274 - DNA, 22 bp, Homo sapiens
gacacaggggggcgctagaaga

SEQ ID NO: 7997275 - DNA, 22 bp, Homo sapiens
gacacaggggggcgctagaaga

SEQ ID NO: 7997276 - DNA, 22 bp, Homo sapiens
gacacaggtagaataaagtact

SEQ ID NO: 7997277 - DNA, 22 bp, Homo sapiens
gacacaggtagaataaagtact

SEQ ID NO: 7997278 - DNA, 22 bp, Homo sapiens
gacacagggggatgtgtggacg

SEQ ID NO: 7997279 - DNA, 22 bp, Homo sapiens
gacacagggggatgtgtggacg

SEQ ID NO: 7997280 - DNA, 22 bp, Homo sapiens
gacacaggggggcgctagaaga

SEQ ID NO: 7997281 - DNA, 22 bp, Homo sapiens
gacacaggggggcgctagaaga

SEQ ID NO: 7997282 - DNA, 22 bp, Homo sapiens
gacacaggggggcgctagaaga

SEQ ID NO: 7997283 - DNA, 22 bp, Homo sapiens
gacacaggaatcaccttggatg

SEQ ID NO: 7997284 - DNA, 18 bp, Homo sapiens
gacacaggagagagtccc

SEQ ID NO: 7997285 - DNA, 18 bp, Homo sapiens
gacacaggagagagtccc

SEQ ID NO: 7997286 - DNA, 18 bp, Homo sapiens
gacacaggagagagtccc

SEQ ID NO: 7997287 - DNA, 18 bp, Homo sapiens
gacacaggagagagtccc

SEQ ID NO: 7997288 - DNA, 18 bp, Homo sapiens
gacacaggagagagtccc

SEQ ID NO: 7997289 - DNA, 18 bp, Homo sapiens
gacacaggagagagtccc

SEQ ID NO: 7997290 - DNA, 18 bp, Homo sapiens
gacacaggagagagtccc

SEQ ID NO: 7997291 - DNA, 23 bp, Homo sapiens
gacacaggagcacccagctgagc

SEQ ID NO: 7997292 - DNA, 23 bp, Homo sapiens
gacacaggagcacccagctgagc

SEQ ID NO: 7997293 - DNA, 23 bp, Homo sapiens
gacacaggagcacccagctgagc

SEQ ID NO: 7997294 - DNA, 23 bp, Homo sapiens
gacacaggagcacccagctgagc

SEQ ID NO: 7997295 - DNA, 23 bp, Homo sapiens
gacacaggagcacccagctgagc

SEQ ID NO: 7997296 - DNA, 22 bp, Homo sapiens
gacacaggaatcaccttggatg

SEQ ID NO: 7997297 - DNA, 22 bp, Homo sapiens
gacacaggaaaagctccagccc

SEQ ID NO: 7997298 - DNA, 22 bp, Homo sapiens
gacacaggaaaagctccagccc

SEQ ID NO: 7997299 - DNA, 22 bp, Homo sapiens
gacacaggaatcaccttggatg

SEQ ID NO: 7997300 - DNA, 22 bp, Homo sapiens
gacacaggaaaagctccagccc

SEQ ID NO: 7997301 - DNA, 22 bp, Homo sapiens
gacacaggaaaagctccagccc

SEQ ID NO: 7997302 - DNA, 22 bp, Homo sapiens
gacacaggaaaagctccagccc

SEQ ID NO: 7997303 - DNA, 22 bp, Homo sapiens
gacacaggattcctggctctgc

SEQ ID NO: 7997304 - DNA, 20 bp, Homo sapiens
gacacaggcagtcctcagag

SEQ ID NO: 7997305 - DNA, 20 bp, Homo sapiens
gacacaggcagtcctcagag

SEQ ID NO: 7997306 - DNA, 20 bp, Homo sapiens
gacacaggcagtcctcagag

SEQ ID NO: 7997307 - DNA, 20 bp, Homo sapiens
gacacaggcagtcctcagag

SEQ ID NO: 7997308 - DNA, 20 bp, Homo sapiens
gacacaggcagtcctcagag

SEQ ID NO: 7997309 - DNA, 23 bp, Homo sapiens
gacacaggagcacccagctgagc

SEQ ID NO: 7997310 - DNA, 23 bp, Homo sapiens
gacacaggagcacccagctgagc

SEQ ID NO: 7997311 - DNA, 22 bp, Homo sapiens
gacacaggattcctggctctgc

SEQ ID NO: 7997312 - DNA, 22 bp, Homo sapiens
gacacaggattcctggctctgc

SEQ ID NO: 7997313 - DNA, 22 bp, Homo sapiens
gacacagagataggcctgtgtt

SEQ ID NO: 7997314 - DNA, 22 bp, Homo sapiens
gacacagagataggcctgtgtt

SEQ ID NO: 7997315 - DNA, 22 bp, Homo sapiens
gacacagagataggcctgtgtt

SEQ ID NO: 7997316 - DNA, 22 bp, Homo sapiens
gacacagagctcacagtctcct

SEQ ID NO: 7997317 - DNA, 22 bp, Homo sapiens
gacacagagctcacagtctcct

SEQ ID NO: 7997318 - DNA, 22 bp, Homo sapiens
gacacagagctcacagtctcct

SEQ ID NO: 7997319 - DNA, 22 bp, Homo sapiens
gacacagagctcacagtctcct

SEQ ID NO: 7997320 - DNA, 22 bp, Homo sapiens
gacacagagggcaccagatatg

SEQ ID NO: 7997321 - DNA, 22 bp, Homo sapiens
gacacagagctcacagtctcct

SEQ ID NO: 7997322 - DNA, 22 bp, Homo sapiens
gacacagatatctctgagatta

SEQ ID NO: 7997323 - DNA, 22 bp, Homo sapiens
gacacagagtattttaagtact

SEQ ID NO: 7997324 - DNA, 22 bp, Homo sapiens
gacacagagtattttaagtact

SEQ ID NO: 7997325 - DNA, 22 bp, Homo sapiens
gacacagatatctctgagatta

SEQ ID NO: 7997326 - DNA, 22 bp, Homo sapiens
gacacagatatctctgagatta

SEQ ID NO: 7997327 - DNA, 22 bp, Homo sapiens
gacacagatgatcaggtgtgga

SEQ ID NO: 7997328 - DNA, 22 bp, Homo sapiens
gacacagatgatcaggtgtgga

SEQ ID NO: 7997329 - DNA, 22 bp, Homo sapiens
gacacagatgatcaggtgtgga

SEQ ID NO: 7997330 - DNA, 22 bp, Homo sapiens
gacacagatgatcaggtgtgga

SEQ ID NO: 7997331 - DNA, 22 bp, Homo sapiens
gacacagcactgtacaaggaat

SEQ ID NO: 7997332 - DNA, 22 bp, Homo sapiens
gacacagcactgtacaaggaat

SEQ ID NO: 7997333 - DNA, 22 bp, Homo sapiens
gacacagcttgatgagggcttt

SEQ ID NO: 7997334 - DNA, 22 bp, Homo sapiens
gacacagcttgatgagggcttt

SEQ ID NO: 7997335 - DNA, 22 bp, Homo sapiens
gacacagctttctgaagagcat

SEQ ID NO: 7997336 - DNA, 22 bp, Homo sapiens
gaatttaagaggatgaatctgt

SEQ ID NO: 7997337 - DNA, 22 bp, Homo sapiens
gaatttaagaggatgaatctgt

SEQ ID NO: 7997338 - DNA, 22 bp, Homo sapiens
gaatttaagaggatgaatctgt

SEQ ID NO: 7997339 - DNA, 22 bp, Homo sapiens
gaatttaagaggatgaatctgt

SEQ ID NO: 7997340 - DNA, 22 bp, Homo sapiens
gaatttaaggaccaagcatttt

SEQ ID NO: 7997341 - DNA, 22 bp, Homo sapiens
gaatttaaggaccaagcatttt

SEQ ID NO: 7997342 - DNA, 22 bp, Homo sapiens
gaatttaaaggccagacctgag

SEQ ID NO: 7997343 - DNA, 22 bp, Homo sapiens
gaatttaagaggatgaatctgt

SEQ ID NO: 7997344 - DNA, 22 bp, Homo sapiens
gaatttaaatttaaatctacca

SEQ ID NO: 7997345 - DNA, 22 bp, Homo sapiens
gaattgtattgatttttcagag

SEQ ID NO: 7997346 - DNA, 22 bp, Homo sapiens
gaattgtattgatttttcagag

SEQ ID NO: 7997347 - DNA, 22 bp, Homo sapiens
gaattgtatgcagttacttgga

SEQ ID NO: 7997348 - DNA, 22 bp, Homo sapiens
gaattgtactgcaatcagggga

SEQ ID NO: 7997349 - DNA, 22 bp, Homo sapiens
gaattgtatgcagttacttgga

SEQ ID NO: 7997350 - DNA, 22 bp, Homo sapiens
gaattgtatgctgtcttgatag

SEQ ID NO: 7997351 - DNA, 22 bp, Homo sapiens
gaattgggggttttgcaaggca

SEQ ID NO: 7997352 - DNA, 22 bp, Homo sapiens
gaattgtaagtaccagcatgct

SEQ ID NO: 7997353 - DNA, 22 bp, Homo sapiens
gaattgtaagtaccagcatgct

SEQ ID NO: 7997354 - DNA, 22 bp, Homo sapiens
gaattgtacgctttacataggt

SEQ ID NO: 7997355 - DNA, 22 bp, Homo sapiens
gaattgtagagggaacagaagc

SEQ ID NO: 7997356 - DNA, 22 bp, Homo sapiens
gaattctgtcgcttactagatg

SEQ ID NO: 7997357 - DNA, 22 bp, Homo sapiens
gaattctgtcgcttactagatg

SEQ ID NO: 7997358 - DNA, 22 bp, Homo sapiens
gaattctgggagagatctgaca

SEQ ID NO: 7997359 - DNA, 22 bp, Homo sapiens
gaattctggttttgaaatgaat

SEQ ID NO: 7997360 - DNA, 22 bp, Homo sapiens
gaattctagggtaaatatccta

SEQ ID NO: 7997361 - DNA, 22 bp, Homo sapiens
gaattctagggtaaatatccta

SEQ ID NO: 7997362 - DNA, 22 bp, Homo sapiens
gaattctgggagagatctgaca

SEQ ID NO: 7997363 - DNA, 22 bp, Homo sapiens
gaattctagtcacacacattca

SEQ ID NO: 7997364 - DNA, 22 bp, Homo sapiens
gaattctagtcacacacattca

SEQ ID NO: 7997365 - DNA, 22 bp, Homo sapiens
gaattctagtcacacacattca

SEQ ID NO: 7997366 - DNA, 22 bp, Homo sapiens
gaattcttttctttctgaaagt

SEQ ID NO: 7997367 - DNA, 22 bp, Homo sapiens
gaattgctaatccaagtgactg

SEQ ID NO: 7997368 - DNA, 22 bp, Homo sapiens
gaattgctaaccaattcaaaat

SEQ ID NO: 7997369 - DNA, 22 bp, Homo sapiens
gaattgatgcttatggtcaggg

SEQ ID NO: 7997370 - DNA, 22 bp, Homo sapiens
gaagttctcaaggatcacagaa

SEQ ID NO: 7997371 - DNA, 22 bp, Homo sapiens
gaagttctcaaggatcacagaa

SEQ ID NO: 7997372 - DNA, 22 bp, Homo sapiens
gaagttatcaggattaaagttg

SEQ ID NO: 7997373 - DNA, 22 bp, Homo sapiens
gaagttatcaaagatgtattct

SEQ ID NO: 7997374 - DNA, 22 bp, Homo sapiens
gaagttatcaggattaaagttg

SEQ ID NO: 7997375 - DNA, 22 bp, Homo sapiens
gaagttatagctatgatcttaa

SEQ ID NO: 7997376 - DNA, 22 bp, Homo sapiens
gaagttataaacttttcctccc

SEQ ID NO: 7997377 - DNA, 22 bp, Homo sapiens
gaagttatcaaagatgtattct

SEQ ID NO: 7997378 - DNA, 22 bp, Homo sapiens
gaagttatttgctatctactga

SEQ ID NO: 7997379 - DNA, 22 bp, Homo sapiens
gaagttattgcctgtgatgaaa

SEQ ID NO: 7997380 - DNA, 22 bp, Homo sapiens
gaagttatgaaatttggacagc

SEQ ID NO: 7997381 - DNA, 22 bp, Homo sapiens
gaagttattttacctgttaaag

SEQ ID NO: 7997382 - DNA, 22 bp, Homo sapiens
gaagttattttacctgttaaag

SEQ ID NO: 7997383 - DNA, 22 bp, Homo sapiens
gaagttattttacctgttaaag

SEQ ID NO: 7997384 - DNA, 22 bp, Homo sapiens
gaattagacatgctttgctttt

SEQ ID NO: 7997385 - DNA, 22 bp, Homo sapiens
gaattacatttgtgttactgca

SEQ ID NO: 7997386 - DNA, 22 bp, Homo sapiens
gaattacatttgtgttactgca

SEQ ID NO: 7997387 - DNA, 22 bp, Homo sapiens
gaattacattgttagccttcct

SEQ ID NO: 7997388 - DNA, 22 bp, Homo sapiens
gaattacatgaccctgagtaga

SEQ ID NO: 7997389 - DNA, 22 bp, Homo sapiens
gaattacatgaccctgagtaga

SEQ ID NO: 7997390 - DNA, 22 bp, Homo sapiens
gaattataaactagtgacttca

SEQ ID NO: 7997391 - DNA, 22 bp, Homo sapiens
gaattataggcaaagcagtcat

SEQ ID NO: 7997392 - DNA, 22 bp, Homo sapiens
gaattataggcaaagcagtcat

SEQ ID NO: 7997393 - DNA, 22 bp, Homo sapiens
gaattataaactagtgacttca

SEQ ID NO: 7997394 - DNA, 22 bp, Homo sapiens
gaattataaactagtgacttca

SEQ ID NO: 7997395 - DNA, 22 bp, Homo sapiens
gaattaggtgcatgtttacaaa

SEQ ID NO: 7997396 - DNA, 22 bp, Homo sapiens
gaattaccattttaatggtgct

SEQ ID NO: 7997397 - DNA, 22 bp, Homo sapiens
gaattcacttgtcttccatttt

SEQ ID NO: 7997398 - DNA, 22 bp, Homo sapiens
gaattcaatttcttggtctttg

SEQ ID NO: 7997399 - DNA, 22 bp, Homo sapiens
gaattcagttatctaattcaag

SEQ ID NO: 7997400 - DNA, 22 bp, Homo sapiens
gaattataggtttgcatgctaa

SEQ ID NO: 7997401 - DNA, 22 bp, Homo sapiens
gaattataggtttgcatgctaa

SEQ ID NO: 7997402 - DNA, 22 bp, Homo sapiens
gaattatgggcttgtttggaga

SEQ ID NO: 7997403 - DNA, 22 bp, Homo sapiens
gaattcctctgagctaggagat

SEQ ID NO: 7997404 - DNA, 22 bp, Homo sapiens
gaattccactttggcttttggg

SEQ ID NO: 7997405 - DNA, 22 bp, Homo sapiens
gaattccactttggcttttggg

SEQ ID NO: 7997406 - DNA, 22 bp, Homo sapiens
gaattcagttatctaattcaag

SEQ ID NO: 7997407 - DNA, 22 bp, Homo sapiens
gaattcgggtactctaggccag

SEQ ID NO: 7997408 - DNA, 22 bp, Homo sapiens
gaattctaaccattaagccaag

SEQ ID NO: 7997409 - DNA, 22 bp, Homo sapiens
gaattccttaggctcttgactg

SEQ ID NO: 7997410 - DNA, 22 bp, Homo sapiens
gaattccttaggctcttgactg

SEQ ID NO: 7997411 - DNA, 22 bp, Homo sapiens
ctggctggttggggagaagaca

SEQ ID NO: 7997412 - DNA, 22 bp, Homo sapiens
ctggctggttccctgctccagg

SEQ ID NO: 7997413 - DNA, 22 bp, Homo sapiens
ctggctggttccctgctccagg

SEQ ID NO: 7997414 - DNA, 22 bp, Homo sapiens
ctggctggttccctgctccagg

SEQ ID NO: 7997415 - DNA, 22 bp, Homo sapiens
ctggctggttccctgctccagg

SEQ ID NO: 7997416 - DNA, 22 bp, Homo sapiens
ctggctggttccctgctccagg

SEQ ID NO: 7997417 - DNA, 22 bp, Homo sapiens
ctggctggttccctgctccagg

SEQ ID NO: 7997418 - DNA, 22 bp, Homo sapiens
ctggctggttccctgctccagg

SEQ ID NO: 7997419 - DNA, 22 bp, Homo sapiens
ctggctggttccctgctccagg

SEQ ID NO: 7997420 - DNA, 22 bp, Homo sapiens
ctggctggttccctgctccagg

SEQ ID NO: 7997421 - DNA, 22 bp, Homo sapiens
ctggctggtctgagcagtcgca

SEQ ID NO: 7997422 - DNA, 22 bp, Homo sapiens
ctggctggtctgagcagtcgca

SEQ ID NO: 7997423 - DNA, 22 bp, Homo sapiens
ctggctggtctgagcagtcgca

SEQ ID NO: 7997424 - DNA, 22 bp, Homo sapiens
ctggctggtctgagcagtcgca

SEQ ID NO: 7997425 - DNA, 22 bp, Homo sapiens
ctggctggtctgagcagtcgca

SEQ ID NO: 7997426 - DNA, 22 bp, Homo sapiens
ctggctggttactatttctggt

SEQ ID NO: 7997427 - DNA, 22 bp, Homo sapiens
ctggctggttactatttctggt

SEQ ID NO: 7997428 - DNA, 22 bp, Homo sapiens
ctggctggttactatttctggt

SEQ ID NO: 7997429 - DNA, 22 bp, Homo sapiens
ctggctggttactatttctggt

SEQ ID NO: 7997430 - DNA, 22 bp, Homo sapiens
ctggctgtgaaatggcagtgtc

SEQ ID NO: 7997431 - DNA, 22 bp, Homo sapiens
ctggctgtcttggaggaaggag

SEQ ID NO: 7997432 - DNA, 22 bp, Homo sapiens
ctggctgtcttctgggagctgt

SEQ ID NO: 7997433 - DNA, 22 bp, Homo sapiens
ctggctgtattagtttgatcct

SEQ ID NO: 7997434 - DNA, 22 bp, Homo sapiens
ctggctgtatgctggcctcaga

SEQ ID NO: 7997435 - DNA, 22 bp, Homo sapiens
ctggctgtattagtttgatcct

SEQ ID NO: 7997436 - DNA, 22 bp, Homo sapiens
ctggctggtttttaaagctagg

SEQ ID NO: 7997437 - DNA, 22 bp, Homo sapiens
ctggctgtaacattttgccata

SEQ ID NO: 7997438 - DNA, 22 bp, Homo sapiens
ctggctgtatgctggcctcaga

SEQ ID NO: 7997439 - DNA, 22 bp, Homo sapiens
ctggctgtaagcgtgtttccta

SEQ ID NO: 7997440 - DNA, 22 bp, Homo sapiens
ctggctgtaagcgtgtttccta

SEQ ID NO: 7997441 - DNA, 22 bp, Homo sapiens
ctggctggttggggagaagaca

SEQ ID NO: 7997442 - DNA, 22 bp, Homo sapiens
ctggctggttggggagaagaca

SEQ ID NO: 7997443 - DNA, 22 bp, Homo sapiens
ctggctggttgtctcaatccag

SEQ ID NO: 7997444 - DNA, 22 bp, Homo sapiens
ctggctggttgtctcaatccag

SEQ ID NO: 7997445 - DNA, 22 bp, Homo sapiens
ctggctggtttttaaagctagg

SEQ ID NO: 7997446 - DNA, 22 bp, Homo sapiens
ctggctggttgtctcaatccag

SEQ ID NO: 7997447 - DNA, 22 bp, Homo sapiens
cttctcagtcacctgtgagtct

SEQ ID NO: 7997448 - DNA, 22 bp, Homo sapiens
cttctcagttgcaagtgtcaga

SEQ ID NO: 7997449 - DNA, 22 bp, Homo sapiens
cttctcagttgcaagtgtcaga

SEQ ID NO: 7997450 - DNA, 22 bp, Homo sapiens
cttctcagttgcaagtgtcaga

SEQ ID NO: 7997451 - DNA, 22 bp, Homo sapiens
cttctctatctttggcacatca

SEQ ID NO: 7997452 - DNA, 22 bp, Homo sapiens
cttctccagccacgcccactcc

SEQ ID NO: 7997453 - DNA, 22 bp, Homo sapiens
cttctcattcaagcaaaacaga

SEQ ID NO: 7997454 - DNA, 22 bp, Homo sapiens
cttctcattcaagcaaaacaga

SEQ ID NO: 7997455 - DNA, 22 bp, Homo sapiens
cttctccagccacgcccactcc

SEQ ID NO: 7997456 - DNA, 22 bp, Homo sapiens
cttctctcggtgcatccctcac

SEQ ID NO: 7997457 - DNA, 22 bp, Homo sapiens
cttctctcggtgcatccctcac

SEQ ID NO: 7997458 - DNA, 22 bp, Homo sapiens
cttctctccctggcactcagac

SEQ ID NO: 7997459 - DNA, 22 bp, Homo sapiens
cttctctcggtgcatccctcac

SEQ ID NO: 7997460 - DNA, 22 bp, Homo sapiens
cttctctcggtgcatccctcac

SEQ ID NO: 7997461 - DNA, 22 bp, Homo sapiens
cttctctcggtgcatccctcac

SEQ ID NO: 7997462 - DNA, 22 bp, Homo sapiens
cttctctcggtgcatccctcac

SEQ ID NO: 7997463 - DNA, 22 bp, Homo sapiens
cttctctctgcataggcatggg

SEQ ID NO: 7997464 - DNA, 22 bp, Homo sapiens
cttctctccctggcactcagac

SEQ ID NO: 7997465 - DNA, 22 bp, Homo sapiens
cttctctccctggcactcagac

SEQ ID NO: 7997466 - DNA, 22 bp, Homo sapiens
cttctctccctggcactcagac

SEQ ID NO: 7997467 - DNA, 22 bp, Homo sapiens
cttctctccctggcactcagac

SEQ ID NO: 7997468 - DNA, 22 bp, Homo sapiens
cttctctccctggcactcagac

SEQ ID NO: 7997469 - DNA, 22 bp, Homo sapiens
ctggctggggaagtcatttgat

SEQ ID NO: 7997470 - DNA, 22 bp, Homo sapiens
ctggctggggaagtcatttgat

SEQ ID NO: 7997471 - DNA, 22 bp, Homo sapiens
ctggctggggtaccagttgaac

SEQ ID NO: 7997472 - DNA, 22 bp, Homo sapiens
ctggctggggccttagataaga

SEQ ID NO: 7997473 - DNA, 22 bp, Homo sapiens
ctggctggggtaccagttgaac

SEQ ID NO: 7997474 - DNA, 22 bp, Homo sapiens
ctggctggggtaccagttgaac

SEQ ID NO: 7997475 - DNA, 22 bp, Homo sapiens
ctggctggggtaccagttgaac

SEQ ID NO: 7997476 - DNA, 22 bp, Homo sapiens
ctggctggggtaccagttgaac

SEQ ID NO: 7997477 - DNA, 22 bp, Homo sapiens
ctggctggggtaccagttgaac

SEQ ID NO: 7997478 - DNA, 22 bp, Homo sapiens
ctggctggggtaccagttgaac

SEQ ID NO: 7997479 - DNA, 22 bp, Homo sapiens
ctggctgggcagacagaatgct

SEQ ID NO: 7997480 - DNA, 22 bp, Homo sapiens
ctggctgggcagacagaatgct

SEQ ID NO: 7997481 - DNA, 22 bp, Homo sapiens
ctggctgggattttaaagagca

SEQ ID NO: 7997482 - DNA, 22 bp, Homo sapiens
ctggctgggcagacagaatgct

SEQ ID NO: 7997483 - DNA, 22 bp, Homo sapiens
ctggctgggcagacagaatgct

SEQ ID NO: 7997484 - DNA, 22 bp, Homo sapiens
ctggctgggattttaaagagca

SEQ ID NO: 7997485 - DNA, 22 bp, Homo sapiens
ctggctgggccatttctttagg

SEQ ID NO: 7997486 - DNA, 22 bp, Homo sapiens
ctggctgggcagacagaatgct

SEQ ID NO: 7997487 - DNA, 22 bp, Homo sapiens
ctggctggaggtgagtcactga

SEQ ID NO: 7997488 - DNA, 22 bp, Homo sapiens
ctggctggaggtgagtcactga

SEQ ID NO: 7997489 - DNA, 22 bp, Homo sapiens
ctggctggagctgttgtaggct

SEQ ID NO: 7997490 - DNA, 21 bp, Homo sapiens
ctggctctgttgtcacccggc

SEQ ID NO: 7997491 - DNA, 22 bp, Homo sapiens
ctggctggagctgttgtaggct

SEQ ID NO: 7997492 - DNA, 22 bp, Homo sapiens
ctggctggagctgttgtaggct

SEQ ID NO: 7997493 - DNA, 22 bp, Homo sapiens
ctggctctgtgggacctggcct

SEQ ID NO: 7997494 - DNA, 22 bp, Homo sapiens
ctggctgggagctcgcctgcgg

SEQ ID NO: 7997495 - DNA, 22 bp, Homo sapiens
ctggctgggagctcgcctgcgg

SEQ ID NO: 7997496 - DNA, 22 bp, Homo sapiens
ctggctgggagctcgcctgcgg

SEQ ID NO: 7997497 - DNA, 22 bp, Homo sapiens
ctggctgggagctcgcctgcgg

SEQ ID NO: 7997498 - DNA, 22 bp, Homo sapiens
ctggctggagtgcaggtgagtg

SEQ ID NO: 7997499 - DNA, 22 bp, Homo sapiens
ctggctggagtgcaggtgagtg

SEQ ID NO: 7997500 - DNA, 22 bp, Homo sapiens
ctggctggagtgcaggtgagtg

SEQ ID NO: 7997501 - DNA, 22 bp, Homo sapiens
ctggctggaggtgagtcactga

SEQ ID NO: 7997502 - DNA, 22 bp, Homo sapiens
ctggctggaggtgagtcactga

SEQ ID NO: 7997503 - DNA, 22 bp, Homo sapiens
ctggctggtcctcggggacagc

SEQ ID NO: 7997504 - DNA, 22 bp, Homo sapiens
ctggctggtcctcggggacagc

SEQ ID NO: 7997505 - DNA, 22 bp, Homo sapiens
ctggctggtcctcggggacagc

SEQ ID NO: 7997506 - DNA, 22 bp, Homo sapiens
ctggctggtcatgtcatgagcc

SEQ ID NO: 7997507 - DNA, 22 bp, Homo sapiens
ctggctggtcatgtcatgagcc

SEQ ID NO: 7997508 - DNA, 22 bp, Homo sapiens
ctggctggtcatgtcatgagcc

SEQ ID NO: 7997509 - DNA, 22 bp, Homo sapiens
ctggctggtcatgtcatgagcc

SEQ ID NO: 7997510 - DNA, 22 bp, Homo sapiens
ctggctggtcatgtcatgagcc

SEQ ID NO: 7997511 - DNA, 22 bp, Homo sapiens
ctggctggtcatgtcatgagcc

SEQ ID NO: 7997512 - DNA, 22 bp, Homo sapiens
ctggctggtcatgtcatgagcc

SEQ ID NO: 7997513 - DNA, 22 bp, Homo sapiens
ctggctggtcatcagcagtacg

SEQ ID NO: 7997514 - DNA, 22 bp, Homo sapiens
ctggctggtcatcagcagtacg

SEQ ID NO: 7997515 - DNA, 22 bp, Homo sapiens
ctggctgggttccaggattcca

SEQ ID NO: 7997516 - DNA, 22 bp, Homo sapiens
ctggctgggttccaggattcca

SEQ ID NO: 7997517 - DNA, 22 bp, Homo sapiens
ctggctgggttccaggattcca

SEQ ID NO: 7997518 - DNA, 22 bp, Homo sapiens
ctggctggggtccatcctctaa

SEQ ID NO: 7997519 - DNA, 22 bp, Homo sapiens
ctggctggggtccatcctctaa

SEQ ID NO: 7997520 - DNA, 22 bp, Homo sapiens
ctggctggtaatggaacgacag

SEQ ID NO: 7997521 - DNA, 22 bp, Homo sapiens
ctggctggtagaattgtgacct

SEQ ID NO: 7997522 - DNA, 22 bp, Homo sapiens
ctggctggtaatggaacgacag

SEQ ID NO: 7997523 - DNA, 22 bp, Homo sapiens
ctggctggtaatggaacgacag

SEQ ID NO: 7997524 - DNA, 22 bp, Homo sapiens
ctggctggtcatcagcagtacg

SEQ ID NO: 7997525 - DNA, 22 bp, Homo sapiens
ctggctggtcatcagcagtacg

SEQ ID NO: 7997526 - DNA, 22 bp, Homo sapiens
ctggctggtagaattgtgacct

SEQ ID NO: 7997527 - DNA, 22 bp, Homo sapiens
ctggctggtagaattgtgacct

SEQ ID NO: 7997528 - DNA, 22 bp, Homo sapiens
ctggctggtagaattgtgacct

SEQ ID NO: 7997529 - DNA, 22 bp, Homo sapiens
cttctttgaaaaaggcagtcag

SEQ ID NO: 7997530 - DNA, 22 bp, Homo sapiens
cttctttgaaaaaggcagtcag

SEQ ID NO: 7997531 - DNA, 22 bp, Homo sapiens
cttctttcttttgatcacaggt

SEQ ID NO: 7997532 - DNA, 22 bp, Homo sapiens
cttctttcttttgatcacaggt

SEQ ID NO: 7997533 - DNA, 22 bp, Homo sapiens
cttctttcttttgatcacaggt

SEQ ID NO: 7997534 - DNA, 22 bp, Homo sapiens
cttctttcttttgatcacaggt

SEQ ID NO: 7997535 - DNA, 22 bp, Homo sapiens
cttctttccttcctccagtggc

SEQ ID NO: 7997536 - DNA, 22 bp, Homo sapiens
cttcttttacaggtcttgggtt

SEQ ID NO: 7997537 - DNA, 22 bp, Homo sapiens
cttcttttacaggtcttgggtt

SEQ ID NO: 7997538 - DNA, 22 bp, Homo sapiens
cttcttttcatggcttgggaag

SEQ ID NO: 7997539 - DNA, 22 bp, Homo sapiens
cttcttttcatggcttgggaag

SEQ ID NO: 7997540 - DNA, 22 bp, Homo sapiens
cttctttgttctgttgtctcac

SEQ ID NO: 7997541 - DNA, 22 bp, Homo sapiens
cttctttgtgcctattggtgac

SEQ ID NO: 7997542 - DNA, 22 bp, Homo sapiens
cttctttgaaaaaggcagtcag

SEQ ID NO: 7997543 - DNA, 22 bp, Homo sapiens
cttctttcaagaatggattagg

SEQ ID NO: 7997544 - DNA, 22 bp, Homo sapiens
cttctttcaagaatggattagg

SEQ ID NO: 7997545 - DNA, 22 bp, Homo sapiens
cttctttcccaggcatgtttta

SEQ ID NO: 7997546 - DNA, 22 bp, Homo sapiens
cttctttcccaggcatgtttta

SEQ ID NO: 7997547 - DNA, 22 bp, Homo sapiens
cttctttcccaggcatgtttta

SEQ ID NO: 7997548 - DNA, 22 bp, Homo sapiens
cttctttccttcctccagtggc

SEQ ID NO: 7997549 - DNA, 22 bp, Homo sapiens
cttctttccttcctccagtggc

SEQ ID NO: 7997550 - DNA, 22 bp, Homo sapiens
cttctttcccaggcatgtttta

SEQ ID NO: 7997551 - DNA, 22 bp, Homo sapiens
cttctttcccaggcatgtttta

SEQ ID NO: 7997552 - DNA, 22 bp, Homo sapiens
cttctttcccaggcatgtttta

SEQ ID NO: 7997553 - DNA, 22 bp, Homo sapiens
cttctttcccaggcatgtttta

SEQ ID NO: 7997554 - DNA, 22 bp, Homo sapiens
cttgaaatgacaggagcacatc

SEQ ID NO: 7997555 - DNA, 19 bp, Homo sapiens
cttgaaatgagactgaagg

SEQ ID NO: 7997556 - DNA, 19 bp, Homo sapiens
cttgaaatgagactgaagg

SEQ ID NO: 7997557 - DNA, 19 bp, Homo sapiens
cttgaaatgagactgaagg

SEQ ID NO: 7997558 - DNA, 22 bp, Homo sapiens
cttgaagaaatggagacaggat

SEQ ID NO: 7997559 - DNA, 22 bp, Homo sapiens
cttgaagaaatggagacaggat

SEQ ID NO: 7997560 - DNA, 20 bp, Homo sapiens
cttgaactgattctatttcc

SEQ ID NO: 7997561 - DNA, 22 bp, Homo sapiens
cttgaagaaagtatgttgggat

SEQ ID NO: 7997562 - DNA, 22 bp, Homo sapiens
cttgaaatccagatttcagagg

SEQ ID NO: 7997563 - DNA, 22 bp, Homo sapiens
cttgaaatccagatttcagagg

SEQ ID NO: 7997564 - DNA, 22 bp, Homo sapiens
cttgaaatccagatttcagagg

SEQ ID NO: 7997565 - DNA, 22 bp, Homo sapiens
cttgaaaataagaaagactttc

SEQ ID NO: 7997566 - DNA, 22 bp, Homo sapiens
cttgaaaataagaaagactttc

SEQ ID NO: 7997567 - DNA, 22 bp, Homo sapiens
cttgaaaataagaaagactttc

SEQ ID NO: 7997568 - DNA, 19 bp, Homo sapiens
cttgaaactactgttgaga

SEQ ID NO: 7997569 - DNA, 22 bp, Homo sapiens
cttgaaagaagggtcttttaat

SEQ ID NO: 7997570 - DNA, 22 bp, Homo sapiens
cttgaaaaatatgccttgcttc

SEQ ID NO: 7997571 - DNA, 22 bp, Homo sapiens
cttcttttgaagggcgttgtgt

SEQ ID NO: 7997572 - DNA, 22 bp, Homo sapiens
cttcttttcatggcttgggaag

SEQ ID NO: 7997573 - DNA, 22 bp, Homo sapiens
cttcttttgaagggcgttgtgt

SEQ ID NO: 7997574 - DNA, 22 bp, Homo sapiens
cttcttgattgctttcaaacca

SEQ ID NO: 7997575 - DNA, 19 bp, Homo sapiens
cttcttgataaggttcttt

SEQ ID NO: 7997576 - DNA, 19 bp, Homo sapiens
cttcttgataaggttcttt

SEQ ID NO: 7997577 - DNA, 19 bp, Homo sapiens
cttcttgataaggttcttt

SEQ ID NO: 7997578 - DNA, 22 bp, Homo sapiens
cttcttgagcatgggtagtact

SEQ ID NO: 7997579 - DNA, 22 bp, Homo sapiens
cttcttgacttctgggtgccct

SEQ ID NO: 7997580 - DNA, 22 bp, Homo sapiens
cttcttgaagtcctccagaagt

SEQ ID NO: 7997581 - DNA, 22 bp, Homo sapiens
cttcttgaaagtggtgaccctc

SEQ ID NO: 7997582 - DNA, 22 bp, Homo sapiens
cttcttgaaacctgctccctca

SEQ ID NO: 7997583 - DNA, 22 bp, Homo sapiens
cttcttgaaacctgctccctca

SEQ ID NO: 7997584 - DNA, 22 bp, Homo sapiens
cttcttcttttgtgggtggtaa

SEQ ID NO: 7997585 - DNA, 22 bp, Homo sapiens
cttctcttggtagttcttgttg

SEQ ID NO: 7997586 - DNA, 22 bp, Homo sapiens
cttctcttggtagttcttgttg

SEQ ID NO: 7997587 - DNA, 22 bp, Homo sapiens
cttcttcttttaataaatgtct

SEQ ID NO: 7997588 - DNA, 22 bp, Homo sapiens
cttctcttggtagttcttgttg

SEQ ID NO: 7997589 - DNA, 22 bp, Homo sapiens
cttcttcttttaataaatgtct

SEQ ID NO: 7997590 - DNA, 22 bp, Homo sapiens
cttctcttgggtgtggtgtctt

SEQ ID NO: 7997591 - DNA, 22 bp, Homo sapiens
cttctcttcctttgtcaactga

SEQ ID NO: 7997592 - DNA, 22 bp, Homo sapiens
cttctcttcctttgtcaactga

SEQ ID NO: 7997593 - DNA, 22 bp, Homo sapiens
cttctcttcctttgtcaactga

SEQ ID NO: 7997594 - DNA, 22 bp, Homo sapiens
cttctcttcctttgtcaactga

SEQ ID NO: 7997595 - DNA, 22 bp, Homo sapiens
cttctcttgggtgtggtgtctt

SEQ ID NO: 7997596 - DNA, 22 bp, Homo sapiens
cttctcttgggtgtggtgtctt

SEQ ID NO: 7997597 - DNA, 22 bp, Homo sapiens
cttctcttcctttgtcaactga

SEQ ID NO: 7997598 - DNA, 22 bp, Homo sapiens
cttctctgtgtagagattcaga

SEQ ID NO: 7997599 - DNA, 22 bp, Homo sapiens
cttctctgtcacagggttacgt

SEQ ID NO: 7997600 - DNA, 22 bp, Homo sapiens
cttctctggctcctcagcgccc

SEQ ID NO: 7997601 - DNA, 22 bp, Homo sapiens
cttctcttcccagggacacagg

SEQ ID NO: 7997602 - DNA, 22 bp, Homo sapiens
cttctctgtgtagagattcaga

SEQ ID NO: 7997603 - DNA, 22 bp, Homo sapiens
cttctctggctcctcagcgccc

SEQ ID NO: 7997604 - DNA, 22 bp, Homo sapiens
cttctctggctcctcagcgccc

SEQ ID NO: 7997605 - DNA, 22 bp, Homo sapiens
cttctctggcatagcaagcagg

SEQ ID NO: 7997606 - DNA, 22 bp, Homo sapiens
cttctctggcatagcaagcagg

SEQ ID NO: 7997607 - DNA, 22 bp, Homo sapiens
cttctctggctcctcagcgccc

SEQ ID NO: 7997608 - DNA, 22 bp, Homo sapiens
cttctctggcagatgtgtgtcc

SEQ ID NO: 7997609 - DNA, 17 bp, Homo sapiens
cttctctggcagaagat

SEQ ID NO: 7997610 - DNA, 22 bp, Homo sapiens
cttctctgcccataggaaatgc

SEQ ID NO: 7997611 - DNA, 22 bp, Homo sapiens
cttctctctgcataggcatggg

SEQ ID NO: 7997612 - DNA, 22 bp, Homo sapiens
cttctctctgcataggcatggg

SEQ ID NO: 7997613 - DNA, 22 bp, Homo sapiens
cttctctctgcataggcatggg

SEQ ID NO: 7997614 - DNA, 22 bp, Homo sapiens
cttctctctgcataggcatggg

SEQ ID NO: 7997615 - DNA, 22 bp, Homo sapiens
cttctctctgcataggcatggg

SEQ ID NO: 7997616 - DNA, 22 bp, Homo sapiens
cttctctctgcataggcatggg

SEQ ID NO: 7997617 - DNA, 22 bp, Homo sapiens
cttctctctgcataggcatggg

SEQ ID NO: 7997618 - DNA, 22 bp, Homo sapiens
cttctctgcaccccacttttgc

SEQ ID NO: 7997619 - DNA, 23 bp, Homo sapiens
cttctctgagctaggaatgctct

SEQ ID NO: 7997620 - DNA, 23 bp, Homo sapiens
cttctctgagctaggaatgctct

SEQ ID NO: 7997621 - DNA, 22 bp, Homo sapiens
cttctctgacagtctgtttcac

SEQ ID NO: 7997622 - DNA, 22 bp, Homo sapiens
cttctctgacagtctgtttcac

SEQ ID NO: 7997623 - DNA, 22 bp, Homo sapiens
ctttagatttctatgtatcact

SEQ ID NO: 7997624 - DNA, 22 bp, Homo sapiens
ctttagcaacgatgatgatatt

SEQ ID NO: 7997625 - DNA, 22 bp, Homo sapiens
ctttagatttctatgtatcact

SEQ ID NO: 7997626 - DNA, 21 bp, Homo sapiens
ctttagtgaaaaggggctaac

SEQ ID NO: 7997627 - DNA, 22 bp, Homo sapiens
ctttaggcccttgctggttctg

SEQ ID NO: 7997628 - DNA, 21 bp, Homo sapiens
ctttagtgaaaaggggctaac

SEQ ID NO: 7997629 - DNA, 18 bp, Homo sapiens
ctttagctgtcatctttg

SEQ ID NO: 7997630 - DNA, 22 bp, Homo sapiens
ctttagtgttgttgtgaggatt

SEQ ID NO: 7997631 - DNA, 22 bp, Homo sapiens
ctttagtgttgttgtgaggatt

SEQ ID NO: 7997632 - DNA, 22 bp, Homo sapiens
ctttagtgagtgtggagctaga

SEQ ID NO: 7997633 - DNA, 22 bp, Homo sapiens
ctttagtgagtgtggagctaga

SEQ ID NO: 7997634 - DNA, 22 bp, Homo sapiens
ctttagtggaagggtggttaat

SEQ ID NO: 7997635 - DNA, 22 bp, Homo sapiens
ctttagtggtattttagcaagt

SEQ ID NO: 7997636 - DNA, 22 bp, Homo sapiens
ctttagtggttagtttaggcca

SEQ ID NO: 7997637 - DNA, 22 bp, Homo sapiens
ctttagtgttcaacccagataa

SEQ ID NO: 7997638 - DNA, 20 bp, Homo sapiens
ctttagttattaacagcact

SEQ ID NO: 7997639 - DNA, 20 bp, Homo sapiens
ctttagttattaacagcact

SEQ ID NO: 7997640 - DNA, 22 bp, Homo sapiens
ctttagttagtagataatggca

SEQ ID NO: 7997641 - DNA, 20 bp, Homo sapiens
ctttagttattaacagcact

SEQ ID NO: 7997642 - DNA, 22 bp, Homo sapiens
ctttagttctagaaagtgaaac

SEQ ID NO: 7997643 - DNA, 22 bp, Homo sapiens
ctttagttgtctcctcaagggt

SEQ ID NO: 7997644 - DNA, 22 bp, Homo sapiens
ctttagttatttagactacagt

SEQ ID NO: 7997645 - DNA, 22 bp, Homo sapiens
ctttagttatttagactacagt

SEQ ID NO: 7997646 - DNA, 22 bp, Homo sapiens
ctttagttctaatgcattgaaa

SEQ ID NO: 7997647 - DNA, 22 bp, Homo sapiens
ctttagttctagaaagtgaaac

SEQ ID NO: 7997648 - DNA, 22 bp, Homo sapiens
ctttagttctagaaagtgaaac

SEQ ID NO: 7997649 - DNA, 22 bp, Homo sapiens
ctttagtttgtaagagcaagag

SEQ ID NO: 7997650 - DNA, 22 bp, Homo sapiens
ctttagttttcatcaaatctat

SEQ ID NO: 7997651 - DNA, 22 bp, Homo sapiens
ctttagtttgtgatacgaagat

SEQ ID NO: 7997652 - DNA, 22 bp, Homo sapiens
ctttagtttaagaacatgatga

SEQ ID NO: 7997653 - DNA, 22 bp, Homo sapiens
ctttagtttaagaacatgatga

SEQ ID NO: 7997654 - DNA, 22 bp, Homo sapiens
ctttagtttaagaacatgatga

SEQ ID NO: 7997655 - DNA, 22 bp, Homo sapiens
ctttagtttaagaacatgatga

SEQ ID NO: 7997656 - DNA, 22 bp, Homo sapiens
ctttacaacctaagttgaagct

SEQ ID NO: 7997657 - DNA, 22 bp, Homo sapiens
ctttacaacctaagttgaagct

SEQ ID NO: 7997658 - DNA, 22 bp, Homo sapiens
ctttacaattcaagggaactct

SEQ ID NO: 7997659 - DNA, 22 bp, Homo sapiens
ctttacacaatgattttcttta

SEQ ID NO: 7997660 - DNA, 22 bp, Homo sapiens
ctttagaaatctggatgtattt

SEQ ID NO: 7997661 - DNA, 20 bp, Homo sapiens
ctttagaagaacccaagcat

SEQ ID NO: 7997662 - DNA, 20 bp, Homo sapiens
ctttagaagaacccaagcat

SEQ ID NO: 7997663 - DNA, 22 bp, Homo sapiens
ctttagaagggtaacggaatta

SEQ ID NO: 7997664 - DNA, 22 bp, Homo sapiens
ctttagaagggtaacggaatta

SEQ ID NO: 7997665 - DNA, 22 bp, Homo sapiens
ctttagaagggtaacggaatta

SEQ ID NO: 7997666 - DNA, 20 bp, Homo sapiens
ctttagaagaacccaagcat

SEQ ID NO: 7997667 - DNA, 22 bp, Homo sapiens
ctttagaagggtaacggaatta

SEQ ID NO: 7997668 - DNA, 22 bp, Homo sapiens
ctttagaagggtaacggaatta

SEQ ID NO: 7997669 - DNA, 22 bp, Homo sapiens
ctttagatgttgctttaactat

SEQ ID NO: 7997670 - DNA, 19 bp, Homo sapiens
ctttagacacacctggaca

SEQ ID NO: 7997671 - DNA, 22 bp, Homo sapiens
ctttagaatttgatataatcaa

SEQ ID NO: 7997672 - DNA, 22 bp, Homo sapiens
ctttagaatttgatataatcaa

SEQ ID NO: 7997673 - DNA, 22 bp, Homo sapiens
ctttagaatttgatataatcaa

SEQ ID NO: 7997674 - DNA, 22 bp, Homo sapiens
ctttagaatttgatataatcaa

SEQ ID NO: 7997675 - DNA, 22 bp, Homo sapiens
ctttagaatttgatataatcaa

SEQ ID NO: 7997676 - DNA, 22 bp, Homo sapiens
ctttagaatttcatgtttggtc

SEQ ID NO: 7997677 - DNA, 22 bp, Homo sapiens
ctttagaagggtaacggaatta

SEQ ID NO: 7997678 - DNA, 22 bp, Homo sapiens
ctttagaatttcatgtttggtc

SEQ ID NO: 7997679 - DNA, 22 bp, Homo sapiens
ctttagaatttcatgtttggtc

SEQ ID NO: 7997680 - DNA, 22 bp, Homo sapiens
ctttatgaaaaccagattgggg

SEQ ID NO: 7997681 - DNA, 22 bp, Homo sapiens
ctttatcagaaaacacattagg

SEQ ID NO: 7997682 - DNA, 22 bp, Homo sapiens
ctttatcatggaggtaaatatg

SEQ ID NO: 7997683 - DNA, 22 bp, Homo sapiens
ctttatcgcaaacactgggtaa

SEQ ID NO: 7997684 - DNA, 22 bp, Homo sapiens
ctttatctagggtaagaaaacc

SEQ ID NO: 7997685 - DNA, 22 bp, Homo sapiens
ctttatcgcaaacactgggtaa

SEQ ID NO: 7997686 - DNA, 22 bp, Homo sapiens
ctttatatattcccaggctgcc

SEQ ID NO: 7997687 - DNA, 22 bp, Homo sapiens
ctttagttttcatcaaatctat

SEQ ID NO: 7997688 - DNA, 22 bp, Homo sapiens
ctttatatattcccaggctgcc

SEQ ID NO: 7997689 - DNA, 22 bp, Homo sapiens
ctttatatattcccaggctgcc

SEQ ID NO: 7997690 - DNA, 22 bp, Homo sapiens
ctttatgaaggaacaatgctcc

SEQ ID NO: 7997691 - DNA, 22 bp, Homo sapiens
ctttatgactgagttgtcaatt

SEQ ID NO: 7997692 - DNA, 22 bp, Homo sapiens
ctttatgagccttgtgaaggag

SEQ ID NO: 7997693 - DNA, 22 bp, Homo sapiens
ctttatgactgagttgtcaatt

SEQ ID NO: 7997694 - DNA, 22 bp, Homo sapiens
ctttggcagcctcagctgcagg

SEQ ID NO: 7997695 - DNA, 22 bp, Homo sapiens
ctttggcagcctcagctgcagg

SEQ ID NO: 7997696 - DNA, 22 bp, Homo sapiens
ctttggcagcctcagctgcagg

SEQ ID NO: 7997697 - DNA, 22 bp, Homo sapiens
ctttggcagcctcagctgcagg

SEQ ID NO: 7997698 - DNA, 22 bp, Homo sapiens
ctttatgagccttgtgaaggag

SEQ ID NO: 7997699 - DNA, 22 bp, Homo sapiens
ctttatgaaaacctgaattatg

SEQ ID NO: 7997700 - DNA, 22 bp, Homo sapiens
ctttatgaaaaccagattgggg

SEQ ID NO: 7997701 - DNA, 22 bp, Homo sapiens
ctttatgaaaacctgaattatg

SEQ ID NO: 7997702 - DNA, 22 bp, Homo sapiens
ctttatgaacctgttcagcttg

SEQ ID NO: 7997703 - DNA, 22 bp, Homo sapiens
ctttatgaacctgttcagcttg

SEQ ID NO: 7997704 - DNA, 22 bp, Homo sapiens
ctttatgaacctgttcagcttg

SEQ ID NO: 7997705 - DNA, 22 bp, Homo sapiens
ctttatgaaggaacaatgctcc

SEQ ID NO: 7997706 - DNA, 22 bp, Homo sapiens
ctttatgaaggaacaatgctcc

SEQ ID NO: 7997707 - DNA, 22 bp, Homo sapiens
ctttgtatctaaatatcttgaa

SEQ ID NO: 7997708 - DNA, 22 bp, Homo sapiens
ctttgtagctgcttctgattta

SEQ ID NO: 7997709 - DNA, 22 bp, Homo sapiens
ctttgtaatcattcccttggtt

SEQ ID NO: 7997710 - DNA, 22 bp, Homo sapiens
ctttgtatttaatagctgtctt

SEQ ID NO: 7997711 - DNA, 19 bp, Homo sapiens
ctttgtcagaacatgcttc

SEQ ID NO: 7997712 - DNA, 22 bp, Homo sapiens
ctttggttctgtccttcccaga

SEQ ID NO: 7997713 - DNA, 21 bp, Homo sapiens
ctttggtttcctcctgccttc

SEQ ID NO: 7997714 - DNA, 22 bp, Homo sapiens
ctttgtaagtctttctccaaga

SEQ ID NO: 7997715 - DNA, 22 bp, Homo sapiens
ctttgtaagtctttctccaaga

SEQ ID NO: 7997716 - DNA, 22 bp, Homo sapiens
ctttggttctgtccttcccaga

SEQ ID NO: 7997717 - DNA, 17 bp, Homo sapiens
ctttggcaggagggagg

SEQ ID NO: 7997718 - DNA, 22 bp, Homo sapiens
ctttggcatggtcctcactata

SEQ ID NO: 7997719 - DNA, 20 bp, Homo sapiens
ctttggcaggccttgccacg

SEQ ID NO: 7997720 - DNA, 22 bp, Homo sapiens
ctttggcagcctctgctattga

SEQ ID NO: 7997721 - DNA, 22 bp, Homo sapiens
ctttggcagcctctgctattga

SEQ ID NO: 7997722 - DNA, 22 bp, Homo sapiens
ctttggcagcctcagctgcagg

SEQ ID NO: 7997723 - DNA, 22 bp, Homo sapiens
cttggctgaactccaggatgca

SEQ ID NO: 7997724 - DNA, 18 bp, Homo sapiens
cttggctgatgggggtgt

SEQ ID NO: 7997725 - DNA, 21 bp, Homo sapiens
cttggctgcagtgacaggcat

SEQ ID NO: 7997726 - DNA, 22 bp, Homo sapiens
cttggctgcttttgtgcacatt

SEQ ID NO: 7997727 - DNA, 21 bp, Homo sapiens
cttggctgcagtgacaggcat

SEQ ID NO: 7997728 - DNA, 22 bp, Homo sapiens
cttggctgcttttgtgcacatt

SEQ ID NO: 7997729 - DNA, 22 bp, Homo sapiens
cttggctgcttttgtgcacatt

SEQ ID NO: 7997730 - DNA, 22 bp, Homo sapiens
cttggctggaactcctgagaaa

SEQ ID NO: 7997731 - DNA, 22 bp, Homo sapiens
cttggctggaactcctgagaaa

SEQ ID NO: 7997732 - DNA, 22 bp, Homo sapiens
cttggctgtcataaggtcctgg

SEQ ID NO: 7997733 - DNA, 22 bp, Homo sapiens
cttggctgtaaaatcagaggct

SEQ ID NO: 7997734 - DNA, 22 bp, Homo sapiens
cttggctgtaaaatcagaggct

SEQ ID NO: 7997735 - DNA, 22 bp, Homo sapiens
cttgggaatgctaacagatgac

SEQ ID NO: 7997736 - DNA, 22 bp, Homo sapiens
cttgggaagtgtttaaagctga

SEQ ID NO: 7997737 - DNA, 22 bp, Homo sapiens
cttgggaatgctaacagatgac

SEQ ID NO: 7997738 - DNA, 22 bp, Homo sapiens
cttgggaatgctaacagatgac

SEQ ID NO: 7997739 - DNA, 22 bp, Homo sapiens
cttgggaagtgtttaaagctga

SEQ ID NO: 7997740 - DNA, 22 bp, Homo sapiens
cttgggaagtgtttaaagctga

SEQ ID NO: 7997741 - DNA, 22 bp, Homo sapiens
cttgggaactgccttgcctttg

SEQ ID NO: 7997742 - DNA, 22 bp, Homo sapiens
cttgggaactgccttgcctttg

SEQ ID NO: 7997743 - DNA, 22 bp, Homo sapiens
cttggcttttgctcccagatca

SEQ ID NO: 7997744 - DNA, 22 bp, Homo sapiens
cttggctttctgacccttgtca

SEQ ID NO: 7997745 - DNA, 22 bp, Homo sapiens
cttggctttctgacccttgtca

SEQ ID NO: 7997746 - DNA, 19 bp, Homo sapiens
cttggcttagcttcttagc

SEQ ID NO: 7997747 - DNA, 22 bp, Homo sapiens
cttggctttagaacatgggagc

SEQ ID NO: 7997748 - DNA, 22 bp, Homo sapiens
cttggctttagaacatgggagc

SEQ ID NO: 7997749 - DNA, 19 bp, Homo sapiens
cttggcttagcttcttagc

SEQ ID NO: 7997750 - DNA, 19 bp, Homo sapiens
cttggcttagcttcttagc

SEQ ID NO: 7997751 - DNA, 22 bp, Homo sapiens
cttggctgtcataaggtcctgg

SEQ ID NO: 7997752 - DNA, 22 bp, Homo sapiens
cttggctgtctataggaaagag

SEQ ID NO: 7997753 - DNA, 22 bp, Homo sapiens
cttggctgtctataggaaagag

SEQ ID NO: 7997754 - DNA, 22 bp, Homo sapiens
cttggctgtcataaggtcctgg

SEQ ID NO: 7997755 - DNA, 22 bp, Homo sapiens
cttggatttgggcccttaaatt

SEQ ID NO: 7997756 - DNA, 22 bp, Homo sapiens
cttggattgtacctagtatggt

SEQ ID NO: 7997757 - DNA, 22 bp, Homo sapiens
cttggcacattttgttcttctg

SEQ ID NO: 7997758 - DNA, 22 bp, Homo sapiens
cttggcagagggctgggctcag

SEQ ID NO: 7997759 - DNA, 22 bp, Homo sapiens
cttggattcattgtgggaggga

SEQ ID NO: 7997760 - DNA, 22 bp, Homo sapiens
cttggattacccatatgattag

SEQ ID NO: 7997761 - DNA, 22 bp, Homo sapiens
cttgacaactggcagatatata

SEQ ID NO: 7997762 - DNA, 21 bp, Homo sapiens
cttggagttggttgaggatgc

SEQ ID NO: 7997763 - DNA, 22 bp, Homo sapiens
cttgaatcttctgagtatttgc

SEQ ID NO: 7997764 - DNA, 22 bp, Homo sapiens
cttgaattgggggaagatcact

SEQ ID NO: 7997765 - DNA, 22 bp, Homo sapiens
cttgaagagtgggaaggatttg

SEQ ID NO: 7997766 - DNA, 22 bp, Homo sapiens
cttgaagagtgggaaggatttg

SEQ ID NO: 7997767 - DNA, 22 bp, Homo sapiens
cttgaaggacagcatctccgag

SEQ ID NO: 7997768 - DNA, 22 bp, Homo sapiens
cttgggagacacaagaagacat

SEQ ID NO: 7997769 - DNA, 22 bp, Homo sapiens
cttgggaggagaacaaagctcc

SEQ ID NO: 7997770 - DNA, 22 bp, Homo sapiens
cttgggaggagaacaaagctcc

SEQ ID NO: 7997771 - DNA, 22 bp, Homo sapiens
cttgggaggcagaggttgcagt

SEQ ID NO: 7997772 - DNA, 22 bp, Homo sapiens
cttgggaggcagaggttgcagt

SEQ ID NO: 7997773 - DNA, 22 bp, Homo sapiens
cttgggaggcagaggttgcagt

SEQ ID NO: 7997774 - DNA, 22 bp, Homo sapiens
cttgggagtagaggcaggagca

SEQ ID NO: 7997775 - DNA, 22 bp, Homo sapiens
cttgggagtagaggcaggagca

SEQ ID NO: 7997776 - DNA, 22 bp, Homo sapiens
cttgggagtagaggcaggagca

SEQ ID NO: 7997777 - DNA, 22 bp, Homo sapiens
cttgggagtagaggcaggagca

SEQ ID NO: 7997778 - DNA, 22 bp, Homo sapiens
cttgggagtagaggcaggagca

SEQ ID NO: 7997779 - DNA, 22 bp, Homo sapiens
cttgggaggggagcattggcct

SEQ ID NO: 7997780 - DNA, 22 bp, Homo sapiens
cttgggaggggagcattggcct

SEQ ID NO: 7997781 - DNA, 22 bp, Homo sapiens
cttgggaggggagcattggcct

SEQ ID NO: 7997782 - DNA, 23 bp, Homo sapiens
cttgggctagagacttagcagtg

SEQ ID NO: 7997783 - DNA, 23 bp, Homo sapiens
cttgggctagagacttagcagtg

SEQ ID NO: 7997784 - DNA, 22 bp, Homo sapiens
cttgggccacctggagggactg

SEQ ID NO: 7997785 - DNA, 19 bp, Homo sapiens
cttgggcatatctgaggca

SEQ ID NO: 7997786 - DNA, 22 bp, Homo sapiens
cttgggcagggtattgtagaag

SEQ ID NO: 7997787 - DNA, 22 bp, Homo sapiens
cttgggccagcccagggggcat

SEQ ID NO: 7997788 - DNA, 19 bp, Homo sapiens
cttgggcatatctgaggca

SEQ ID NO: 7997789 - DNA, 19 bp, Homo sapiens
cttgggcatatctgaggca

SEQ ID NO: 7997790 - DNA, 22 bp, Homo sapiens
cttgggcaagcagcattcagaa

SEQ ID NO: 7997791 - DNA, 22 bp, Homo sapiens
cttgggatgtaacctttgttcc

SEQ ID NO: 7997792 - DNA, 22 bp, Homo sapiens
cttgggagtagaggcaggagca

SEQ ID NO: 7997793 - DNA, 22 bp, Homo sapiens
cttggggcagtgcttggcacat

SEQ ID NO: 7997794 - DNA, 22 bp, Homo sapiens
cttggggctgtcactctggcat

SEQ ID NO: 7997795 - DNA, 22 bp, Homo sapiens
cttggggctttgtgtgtaggat

SEQ ID NO: 7997796 - DNA, 22 bp, Homo sapiens
ctttacaacctaagttgaagct

SEQ ID NO: 7997797 - DNA, 22 bp, Homo sapiens
ctttacaacctaagttgaagct

SEQ ID NO: 7997798 - DNA, 22 bp, Homo sapiens
cttgggggccattaaggggcct

SEQ ID NO: 7997799 - DNA, 22 bp, Homo sapiens
cttggggaagccactgatccct

SEQ ID NO: 7997800 - DNA, 22 bp, Homo sapiens
cttgggctgtgccttaaattct

SEQ ID NO: 7997801 - DNA, 22 bp, Homo sapiens
cttgggctgtgccttaaattct

SEQ ID NO: 7997802 - DNA, 21 bp, Homo sapiens
cttgggcttgtagatggtgga

SEQ ID NO: 7997803 - DNA, 22 bp, Homo sapiens
cttgggcttagaaggtaagtga

SEQ ID NO: 7997804 - DNA, 22 bp, Homo sapiens
cttgggctctgtgggccttagt

SEQ ID NO: 7997805 - DNA, 22 bp, Homo sapiens
cttgggcttagaaggtaagtga

SEQ ID NO: 7997806 - DNA, 22 bp, Homo sapiens
cttgggctcagcaccgtgtgga

SEQ ID NO: 7997807 - DNA, 22 bp, Homo sapiens
cttgggctcagacttgaggaca

SEQ ID NO: 7997808 - DNA, 22 bp, Homo sapiens
cttgggctcagacttgaggaca

SEQ ID NO: 7997809 - DNA, 22 bp, Homo sapiens
cttgggctcagacttgaggaca

SEQ ID NO: 7997810 - DNA, 22 bp, Homo sapiens
cttgggctataaatataaccat

SEQ ID NO: 7997811 - DNA, 22 bp, Homo sapiens
cttgggctctaaatgccagtga

SEQ ID NO: 7997812 - DNA, 22 bp, Homo sapiens
cttgggctctaaatgccagtga

SEQ ID NO: 7997813 - DNA, 22 bp, Homo sapiens
cttgggctcagcaccgtgtgga

SEQ ID NO: 7997814 - DNA, 22 bp, Homo sapiens
cttgggctctaaatgccagtga

SEQ ID NO: 7997815 - DNA, 22 bp, Homo sapiens
cttggggacacagagcccaggg

SEQ ID NO: 7997816 - DNA, 22 bp, Homo sapiens
cttggggaggacgcagtgtcct

SEQ ID NO: 7997817 - DNA, 22 bp, Homo sapiens
cttggggacacagagcccaggg

SEQ ID NO: 7997818 - DNA, 22 bp, Homo sapiens
cttggggatgcaaagccagtgt

SEQ ID NO: 7997819 - DNA, 22 bp, Homo sapiens
cttggggattttaaagacctct

SEQ ID NO: 7997820 - DNA, 22 bp, Homo sapiens
cttggggatgcaaagccagtgt

SEQ ID NO: 7997821 - DNA, 22 bp, Homo sapiens
gaacagacttggaggagtgatc

SEQ ID NO: 7997822 - DNA, 22 bp, Homo sapiens
gaacagagttgaaacaaggctg

SEQ ID NO: 7997823 - DNA, 22 bp, Homo sapiens
gaacagagttgaaacaaggctg

SEQ ID NO: 7997824 - DNA, 22 bp, Homo sapiens
gaacagagctgactacaaggca

SEQ ID NO: 7997825 - DNA, 17 bp, Homo sapiens
gaacagcagaggggaca

SEQ ID NO: 7997826 - DNA, 18 bp, Homo sapiens
gaacagcaatttcatgtt

SEQ ID NO: 7997827 - DNA, 22 bp, Homo sapiens
gaacagatgggctcagatcctg

SEQ ID NO: 7997828 - DNA, 18 bp, Homo sapiens
gaacagcaatttcatgtt

SEQ ID NO: 7997829 - DNA, 22 bp, Homo sapiens
gaacagatgggctcagatcctg

SEQ ID NO: 7997830 - DNA, 22 bp, Homo sapiens
gaacccagtccaggtgcagcct

SEQ ID NO: 7997831 - DNA, 22 bp, Homo sapiens
gaacccagtccaggtgcagcct

SEQ ID NO: 7997832 - DNA, 22 bp, Homo sapiens
gaacccaggaggttgcagtgag

SEQ ID NO: 7997833 - DNA, 22 bp, Homo sapiens
gaacctctatatttgtgacatc

SEQ ID NO: 7997834 - DNA, 22 bp, Homo sapiens
gaaccccaacttataagacaga

SEQ ID NO: 7997835 - DNA, 22 bp, Homo sapiens
gaaccccaacttataagacaga

SEQ ID NO: 7997836 - DNA, 22 bp, Homo sapiens
gaacccggggaggttgcagtga

SEQ ID NO: 7997837 - DNA, 22 bp, Homo sapiens
gaacccggggaggttgcagtga

SEQ ID NO: 7997838 - DNA, 23 bp, Homo sapiens
gaacccagctctgccacttgcca

SEQ ID NO: 7997839 - DNA, 23 bp, Homo sapiens
gaacccagctctgccacttgcca

SEQ ID NO: 7997840 - DNA, 21 bp, Homo sapiens
gaacccagcagcagtgctctg

SEQ ID NO: 7997841 - DNA, 22 bp, Homo sapiens
gaacccagccagactccctaca

SEQ ID NO: 7997842 - DNA, 22 bp, Homo sapiens
gaacccaggaggttgcagtgag

SEQ ID NO: 7997843 - DNA, 22 bp, Homo sapiens
gaacccaggaggttgcagtgag

SEQ ID NO: 7997844 - DNA, 22 bp, Homo sapiens
gaacccaggaggttgcagtgag

SEQ ID NO: 7997845 - DNA, 19 bp, Homo sapiens
gaacacttactatatttct

SEQ ID NO: 7997846 - DNA, 22 bp, Homo sapiens
gaacactgtttcttcgtgaaca

SEQ ID NO: 7997847 - DNA, 22 bp, Homo sapiens
gaacacttgctgttaataagtg

SEQ ID NO: 7997848 - DNA, 22 bp, Homo sapiens
gaacacttggctttggatttaa

SEQ ID NO: 7997849 - DNA, 22 bp, Homo sapiens
gaacagaagaggctggtgccac

SEQ ID NO: 7997850 - DNA, 22 bp, Homo sapiens
gaacactttaacattccttttc

SEQ ID NO: 7997851 - DNA, 23 bp, Homo sapiens
gaacagacattagtgagccaggc

SEQ ID NO: 7997852 - DNA, 22 bp, Homo sapiens
gaacagaattaccgaagatctg

SEQ ID NO: 7997853 - DNA, 22 bp, Homo sapiens
gaacagaattaccgaagatctg

SEQ ID NO: 7997854 - DNA, 22 bp, Homo sapiens
gaacagaattaccgaagatctg

SEQ ID NO: 7997855 - DNA, 22 bp, Homo sapiens
gaacagaagaggctggtgccac

SEQ ID NO: 7997856 - DNA, 22 bp, Homo sapiens
gaacagaattaccgaagatctg

SEQ ID NO: 7997857 - DNA, 22 bp, Homo sapiens
gaacactggggtatcattgagc

SEQ ID NO: 7997858 - DNA, 22 bp, Homo sapiens
gaacactgtttcttcgtgaaca

SEQ ID NO: 7997859 - DNA, 22 bp, Homo sapiens
gaacactgtttcttcgtgaaca

SEQ ID NO: 7997860 - DNA, 22 bp, Homo sapiens
gaacactggggtatcattgagc

SEQ ID NO: 7997861 - DNA, 22 bp, Homo sapiens
gaacactggggtatcattgagc

SEQ ID NO: 7997862 - DNA, 22 bp, Homo sapiens
gaacactgaggacactgagaat

SEQ ID NO: 7997863 - DNA, 22 bp, Homo sapiens
gaacactgaggacactgagaat

SEQ ID NO: 7997864 - DNA, 22 bp, Homo sapiens
gaacactgaggacactgagaat

SEQ ID NO: 7997865 - DNA, 22 bp, Homo sapiens
gaacactgctgttgggttctga

SEQ ID NO: 7997866 - DNA, 22 bp, Homo sapiens
gaacactgaggacactgagaat

SEQ ID NO: 7997867 - DNA, 22 bp, Homo sapiens
gaacactgaggacactgagaat

SEQ ID NO: 7997868 - DNA, 22 bp, Homo sapiens
gaacgggtgcagccatgggccc

SEQ ID NO: 7997869 - DNA, 22 bp, Homo sapiens
gaacgcaacggaaaagatttca

SEQ ID NO: 7997870 - DNA, 22 bp, Homo sapiens
gaacctttttccaagtaaacaa

SEQ ID NO: 7997871 - DNA, 22 bp, Homo sapiens
gaactaaaagctaacatcaggc

SEQ ID NO: 7997872 - DNA, 22 bp, Homo sapiens
gaactaaatgaaattactggtg

SEQ ID NO: 7997873 - DNA, 22 bp, Homo sapiens
gaactacagtgcattttcttaa

SEQ ID NO: 7997874 - DNA, 22 bp, Homo sapiens
gaactaaatttgacagacaaca

SEQ ID NO: 7997875 - DNA, 22 bp, Homo sapiens
gaacctctatatttgtgacatc

SEQ ID NO: 7997876 - DNA, 22 bp, Homo sapiens
gaacctctttagtgcatccttc

SEQ ID NO: 7997877 - DNA, 22 bp, Homo sapiens
gaacctgatccaatatttactc

SEQ ID NO: 7997878 - DNA, 22 bp, Homo sapiens
gaacctgatccaatatttactc

SEQ ID NO: 7997879 - DNA, 21 bp, Homo sapiens
gaacctgagtgaagacttggg

SEQ ID NO: 7997880 - DNA, 21 bp, Homo sapiens
gaacctgagtgaagacttggg

SEQ ID NO: 7997881 - DNA, 22 bp, Homo sapiens
gaacctgagcgggcagcaagcg

SEQ ID NO: 7997882 - DNA, 22 bp, Homo sapiens
gaacctgagcgggcagcaagcg

SEQ ID NO: 7997883 - DNA, 22 bp, Homo sapiens
gaacctgagcccaggtggcatt

SEQ ID NO: 7997884 - DNA, 22 bp, Homo sapiens
gaacctgagcccaggtggcatt

SEQ ID NO: 7997885 - DNA, 22 bp, Homo sapiens
gaacctgtttatgttacctgcg

SEQ ID NO: 7997886 - DNA, 22 bp, Homo sapiens
gaaccttatggtaaatctagag

SEQ ID NO: 7997887 - DNA, 22 bp, Homo sapiens
gaacctgtaagtatagatgtgg

SEQ ID NO: 7997888 - DNA, 22 bp, Homo sapiens
gaactcattagcctgctttcag

SEQ ID NO: 7997889 - DNA, 22 bp, Homo sapiens
gaactccagatgactcaggaac

SEQ ID NO: 7997890 - DNA, 22 bp, Homo sapiens
gaactcccagccctttgttggc

SEQ ID NO: 7997891 - DNA, 22 bp, Homo sapiens
gaactcttgcagtgaaagctta

SEQ ID NO: 7997892 - DNA, 22 bp, Homo sapiens
gaactcttggtggtcattagat

SEQ ID NO: 7997893 - DNA, 22 bp, Homo sapiens
gaactcttggtggtcattagat

SEQ ID NO: 7997894 - DNA, 22 bp, Homo sapiens
gaactcagagcctgagctagga

SEQ ID NO: 7997895 - DNA, 22 bp, Homo sapiens
gaactcattagcctgctttcag

SEQ ID NO: 7997896 - DNA, 22 bp, Homo sapiens
gaactcaacgctttcttaggag

SEQ ID NO: 7997897 - DNA, 22 bp, Homo sapiens
gaactcaacacagtatttggta

SEQ ID NO: 7997898 - DNA, 22 bp, Homo sapiens
gaactagaatgttctgatggag

SEQ ID NO: 7997899 - DNA, 22 bp, Homo sapiens
gaactatatcttcaagaaaatg

SEQ ID NO: 7997900 - DNA, 22 bp, Homo sapiens
gaactatatgtcttaaagcttt

SEQ ID NO: 7997901 - DNA, 22 bp, Homo sapiens
gaactattcattctcattagcg

SEQ ID NO: 7997902 - DNA, 22 bp, Homo sapiens
gaactgggtccttgagtctaga

SEQ ID NO: 7997903 - DNA, 22 bp, Homo sapiens
gaactgggtccttgagtctaga

SEQ ID NO: 7997904 - DNA, 22 bp, Homo sapiens
gaactgggaatgctgtcccatc

SEQ ID NO: 7997905 - DNA, 22 bp, Homo sapiens
gaactctttatcaaaatgcgtt

SEQ ID NO: 7997906 - DNA, 22 bp, Homo sapiens
gaactgaaacttggtttaaagc

SEQ ID NO: 7997907 - DNA, 22 bp, Homo sapiens
gaactggtgagagttcacggga

SEQ ID NO: 7997908 - DNA, 22 bp, Homo sapiens
gaactggttacagagggatgtt

SEQ ID NO: 7997909 - DNA, 22 bp, Homo sapiens
gaactggtcagtttagcccact

SEQ ID NO: 7997910 - DNA, 22 bp, Homo sapiens
gaactggtcttttaggttttct

SEQ ID NO: 7997911 - DNA, 22 bp, Homo sapiens
gaactggtgaagtgaagggcag

SEQ ID NO: 7997912 - DNA, 22 bp, Homo sapiens
gaaatttacaactttctcatgg

SEQ ID NO: 7997913 - DNA, 22 bp, Homo sapiens
gaaatttattatctacatcatt

SEQ ID NO: 7997914 - DNA, 22 bp, Homo sapiens
gaaatttattatctacatcatt

SEQ ID NO: 7997915 - DNA, 22 bp, Homo sapiens
gaaatttacaactttctcatgg

SEQ ID NO: 7997916 - DNA, 22 bp, Homo sapiens
gaaatttacaactttctcatgg

SEQ ID NO: 7997917 - DNA, 22 bp, Homo sapiens
gaacacaactcagaatgctggt

SEQ ID NO: 7997918 - DNA, 22 bp, Homo sapiens
gaacacaactcagaatgctggt

SEQ ID NO: 7997919 - DNA, 22 bp, Homo sapiens
gaacacaagcgtatgtctttgt

SEQ ID NO: 7997920 - DNA, 22 bp, Homo sapiens
gaacacaactcagaatgctggt

SEQ ID NO: 7997921 - DNA, 22 bp, Homo sapiens
gaacacaactcagaatgctggt

SEQ ID NO: 7997922 - DNA, 22 bp, Homo sapiens
gaaatacaattttgtcccagct

SEQ ID NO: 7997923 - DNA, 22 bp, Homo sapiens
gaaatacaattttgtcccagct

SEQ ID NO: 7997924 - DNA, 22 bp, Homo sapiens
gaaatacaattttgtcccagct

SEQ ID NO: 7997925 - DNA, 22 bp, Homo sapiens
gaaatacaaatgcctagatcct

SEQ ID NO: 7997926 - DNA, 22 bp, Homo sapiens
gaaatacaaatgcctagatcct

SEQ ID NO: 7997927 - DNA, 22 bp, Homo sapiens
gaaatacaaatgcctagatcct

SEQ ID NO: 7997928 - DNA, 22 bp, Homo sapiens
gaaatttacaactttctcatgg

SEQ ID NO: 7997929 - DNA, 22 bp, Homo sapiens
gaaatacagaaagggctgaatg

SEQ ID NO: 7997930 - DNA, 22 bp, Homo sapiens
gaaattgtgcatttagcaacac

SEQ ID NO: 7997931 - DNA, 22 bp, Homo sapiens
gaaatacaattttgtcccagct

SEQ ID NO: 7997932 - DNA, 22 bp, Homo sapiens
gaaatacagaaagggctgaatg

SEQ ID NO: 7997933 - DNA, 22 bp, Homo sapiens
gaacacatcacattttacagtg

SEQ ID NO: 7997934 - DNA, 22 bp, Homo sapiens
gaacacatcacattttacagtg

SEQ ID NO: 7997935 - DNA, 22 bp, Homo sapiens
gaacacagtcaagggctgctgt

SEQ ID NO: 7997936 - DNA, 22 bp, Homo sapiens
gaacacagtcaagggctgctgt

SEQ ID NO: 7997937 - DNA, 22 bp, Homo sapiens
gaacacagtcaagggctgctgt

SEQ ID NO: 7997938 - DNA, 22 bp, Homo sapiens
gaacacagtggttgtttggagg

SEQ ID NO: 7997939 - DNA, 22 bp, Homo sapiens
gaacacagtgtgatcgtatgtc

SEQ ID NO: 7997940 - DNA, 22 bp, Homo sapiens
gaacacaggtggcccggcaggg

SEQ ID NO: 7997941 - DNA, 22 bp, Homo sapiens
gaacacagcggggcttacccgg

SEQ ID NO: 7997942 - DNA, 22 bp, Homo sapiens
gaacacaggtggcccggcaggg

SEQ ID NO: 7997943 - DNA, 22 bp, Homo sapiens
gaacacagtacttgttcgtctt

SEQ ID NO: 7997944 - DNA, 22 bp, Homo sapiens
gaacacaggtggcccggcaggg

SEQ ID NO: 7997945 - DNA, 22 bp, Homo sapiens
gaacacagcggggcttacccgg

SEQ ID NO: 7997946 - DNA, 22 bp, Homo sapiens
gaacacagtacttttcctgatg

SEQ ID NO: 7997947 - DNA, 22 bp, Homo sapiens
gaacacagtcaagggctgctgt

SEQ ID NO: 7997948 - DNA, 22 bp, Homo sapiens
gaacacagtcaagggctgctgt

SEQ ID NO: 7997949 - DNA, 22 bp, Homo sapiens
gaacactgacattttcctgact

SEQ ID NO: 7997950 - DNA, 22 bp, Homo sapiens
gaacactgagaaagtcagcttt

SEQ ID NO: 7997951 - DNA, 22 bp, Homo sapiens
gaacactgacattttcctgact

SEQ ID NO: 7997952 - DNA, 22 bp, Homo sapiens
gaacactgacattttcctgact

SEQ ID NO: 7997953 - DNA, 22 bp, Homo sapiens
gaacactgagaaagtcagcttt

SEQ ID NO: 7997954 - DNA, 22 bp, Homo sapiens
gaacactgagagagatgggcag

SEQ ID NO: 7997955 - DNA, 22 bp, Homo sapiens
gaacacctgggtcccctggggc

SEQ ID NO: 7997956 - DNA, 22 bp, Homo sapiens
gaacacatttctctgactgtag

SEQ ID NO: 7997957 - DNA, 22 bp, Homo sapiens
gaacacatgattataaatgcta

SEQ ID NO: 7997958 - DNA, 22 bp, Homo sapiens
gaacacatgattataaatgcta

SEQ ID NO: 7997959 - DNA, 22 bp, Homo sapiens
gaacacatgtcctccttggatt

SEQ ID NO: 7997960 - DNA, 22 bp, Homo sapiens
gaacacattagtctgagttggc

SEQ ID NO: 7997961 - DNA, 22 bp, Homo sapiens
gaaagttttcatatataccaaa

SEQ ID NO: 7997962 - DNA, 22 bp, Homo sapiens
gaaagtttgcctctctcttgag

SEQ ID NO: 7997963 - DNA, 22 bp, Homo sapiens
gaaagttttcatatataccaaa

SEQ ID NO: 7997964 - DNA, 22 bp, Homo sapiens
gaaagttttctcacacagtaat

SEQ ID NO: 7997965 - DNA, 22 bp, Homo sapiens
gaaagttttctcacacagtaat

SEQ ID NO: 7997966 - DNA, 22 bp, Homo sapiens
gaaagtttcttcattaagatgt

SEQ ID NO: 7997967 - DNA, 22 bp, Homo sapiens
gaaagtttgcctctctcttgag

SEQ ID NO: 7997968 - DNA, 17 bp, Homo sapiens
gaaagtttctctctctt

SEQ ID NO: 7997969 - DNA, 22 bp, Homo sapiens
gaaagtttcttcattaagatgt

SEQ ID NO: 7997970 - DNA, 22 bp, Homo sapiens
gaaagtttcttcattaagatgt

SEQ ID NO: 7997971 - DNA, 22 bp, Homo sapiens
gaaagtttcttcattaagatgt

SEQ ID NO: 7997972 - DNA, 22 bp, Homo sapiens
gaaataatacagtgctcttctc

SEQ ID NO: 7997973 - DNA, 22 bp, Homo sapiens
gaaataatacagtgctcttctc

SEQ ID NO: 7997974 - DNA, 22 bp, Homo sapiens
gaaataatacagtgctcttctc

SEQ ID NO: 7997975 - DNA, 22 bp, Homo sapiens
gaaataatacagtgctcttctc

SEQ ID NO: 7997976 - DNA, 22 bp, Homo sapiens
gaaataatacagtgctcttctc

SEQ ID NO: 7997977 - DNA, 22 bp, Homo sapiens
gaaataagagtccatgccaggt

SEQ ID NO: 7997978 - DNA, 22 bp, Homo sapiens
gaaataagagtccatgccaggt

SEQ ID NO: 7997979 - DNA, 22 bp, Homo sapiens
gaaataagagtccatgccaggt

SEQ ID NO: 7997980 - DNA, 22 bp, Homo sapiens
gaaataagagtccatgccaggt

SEQ ID NO: 7997981 - DNA, 22 bp, Homo sapiens
gaaataacctcatgcaccatga

SEQ ID NO: 7997982 - DNA, 22 bp, Homo sapiens
gaaataacagctctggaagagt

SEQ ID NO: 7997983 - DNA, 22 bp, Homo sapiens
gaaatacaaatgcctagatcct

SEQ ID NO: 7997984 - DNA, 22 bp, Homo sapiens
gaaatacaaatgcctagatcct

SEQ ID NO: 7997985 - DNA, 22 bp, Homo sapiens
gaaatacaaatgcctagatcct

SEQ ID NO: 7997986 - DNA, 22 bp, Homo sapiens
gaaatacaaagccagccatttt

SEQ ID NO: 7997987 - DNA, 22 bp, Homo sapiens
gaaatacaaagccagccatttt

SEQ ID NO: 7997988 - DNA, 22 bp, Homo sapiens
gaaatacaaagccagccatttt

SEQ ID NO: 7997989 - DNA, 22 bp, Homo sapiens
gaaatacaaagccagccatttt

SEQ ID NO: 7997990 - DNA, 22 bp, Homo sapiens
gaaatacaaagccagccatttt

SEQ ID NO: 7997991 - DNA, 22 bp, Homo sapiens
gaaataattctgtgtctgaaca

SEQ ID NO: 7997992 - DNA, 22 bp, Homo sapiens
gaaataattctgtgtctgaaca

SEQ ID NO: 7997993 - DNA, 22 bp, Homo sapiens
gaaataattctgtgtctgaaca

SEQ ID NO: 7997994 - DNA, 22 bp, Homo sapiens
gaaataatttagaaggtattcc

SEQ ID NO: 7997995 - DNA, 22 bp, Homo sapiens
gaaataatttagaaggtattcc

SEQ ID NO: 7997996 - DNA, 22 bp, Homo sapiens
gaaataattctgtgtctgaaca

SEQ ID NO: 7997997 - DNA, 22 bp, Homo sapiens
gaaataatttagaaggtattcc

SEQ ID NO: 7997998 - DNA, 22 bp, Homo sapiens
gaaataatttagaaggtattcc

SEQ ID NO: 7997999 - DNA, 22 bp, Homo sapiens
ctttgttatctgtaaatggtta

SEQ ID NO: 7998000 - DNA, 22 bp, Homo sapiens
ctttgttcatgacatctgcttc

SEQ ID NO: 7998001 - DNA, 22 bp, Homo sapiens
ctttgttcatgacatctgcttc

SEQ ID NO: 7998002 - DNA, 22 bp, Homo sapiens
ctttgttatctgtaaatggtta

SEQ ID NO: 7998003 - DNA, 22 bp, Homo sapiens
ctttgttctgcacacacagaca

SEQ ID NO: 7998004 - DNA, 22 bp, Homo sapiens
ctttgttcatgacatctgcttc

SEQ ID NO: 7998005 - DNA, 22 bp, Homo sapiens
ctttgttctgcacacacagaca

SEQ ID NO: 7998006 - DNA, 22 bp, Homo sapiens
ctttgttctgccaatggcccat

SEQ ID NO: 7998007 - DNA, 22 bp, Homo sapiens
ctttgttgtgcctgagtgcacc

SEQ ID NO: 7998008 - DNA, 22 bp, Homo sapiens
ctttgttgttaattggcgctta

SEQ ID NO: 7998009 - DNA, 22 bp, Homo sapiens
ctttgtttatatttctcctcga

SEQ ID NO: 7998010 - DNA, 22 bp, Homo sapiens
ctttgttttactcagaggcatg

SEQ ID NO: 7998011 - DNA, 22 bp, Homo sapiens
ctttgtttatatttctcctcga

SEQ ID NO: 7998012 - DNA, 22 bp, Homo sapiens
ctttgtgtctgttaataattat

SEQ ID NO: 7998013 - DNA, 22 bp, Homo sapiens
ctttgtgtctgttaataattat

SEQ ID NO: 7998014 - DNA, 22 bp, Homo sapiens
ctttgtgtctgttaataattat

SEQ ID NO: 7998015 - DNA, 22 bp, Homo sapiens
ctttgttactgatttcagtggg

SEQ ID NO: 7998016 - DNA, 22 bp, Homo sapiens
ctttgtgtctgttaataattat

SEQ ID NO: 7998017 - DNA, 22 bp, Homo sapiens
ctttgttagcagccaatttgtt

SEQ ID NO: 7998018 - DNA, 22 bp, Homo sapiens
ctttgttaggggctcagggtgg

SEQ ID NO: 7998019 - DNA, 22 bp, Homo sapiens
ctttgtccattgattcgttcaa

SEQ ID NO: 7998020 - DNA, 22 bp, Homo sapiens
ctttgtgatagtgttaagacca

SEQ ID NO: 7998021 - DNA, 22 bp, Homo sapiens
ctttgtgatagtgttaagacca

SEQ ID NO: 7998022 - DNA, 22 bp, Homo sapiens
ctttgtgccacagcttgactac

SEQ ID NO: 7998023 - DNA, 22 bp, Homo sapiens
cttttacactcatctgggaggg

SEQ ID NO: 7998024 - DNA, 22 bp, Homo sapiens
cttttacactcatctgggaggg

SEQ ID NO: 7998025 - DNA, 22 bp, Homo sapiens
gaaaacactttgatctgaaagt

SEQ ID NO: 7998026 - DNA, 22 bp, Homo sapiens
gaaaacactttgatctgaaagt

SEQ ID NO: 7998027 - DNA, 17 bp, Homo sapiens
cttttaatttacttccc

SEQ ID NO: 7998028 - DNA, 22 bp, Homo sapiens
cttttacactcatctgggaggg

SEQ ID NO: 7998029 - DNA, 22 bp, Homo sapiens
cttttaatgggagcagtatttg

SEQ ID NO: 7998030 - DNA, 17 bp, Homo sapiens
cttttaatttacttccc

SEQ ID NO: 7998031 - DNA, 22 bp, Homo sapiens
cttttaatgggagcagtatttg

SEQ ID NO: 7998032 - DNA, 23 bp, Homo sapiens
cttttaactagagtatcagctgc

SEQ ID NO: 7998033 - DNA, 23 bp, Homo sapiens
cttttaacttgatctgagaccag

SEQ ID NO: 7998034 - DNA, 22 bp, Homo sapiens
cttttaagggataataagatgt

SEQ ID NO: 7998035 - DNA, 22 bp, Homo sapiens
cttttaagggataataagatgt

SEQ ID NO: 7998036 - DNA, 22 bp, Homo sapiens
cttttaatgagcattgctgtct

SEQ ID NO: 7998037 - DNA, 23 bp, Homo sapiens
cttttaacttgatctgagaccag

SEQ ID NO: 7998038 - DNA, 22 bp, Homo sapiens
cttttaagggataataagatgt

SEQ ID NO: 7998039 - DNA, 22 bp, Homo sapiens
ctttgttttactcagaggcatg

SEQ ID NO: 7998040 - DNA, 22 bp, Homo sapiens
ctttgttttactcagaggcatg

SEQ ID NO: 7998041 - DNA, 23 bp, Homo sapiens
cttttaaccggcatgggagggca

SEQ ID NO: 7998042 - DNA, 23 bp, Homo sapiens
cttttaactagagtatcagctgc

SEQ ID NO: 7998043 - DNA, 22 bp, Homo sapiens
ctttgttttactcagaggcatg

SEQ ID NO: 7998044 - DNA, 23 bp, Homo sapiens
cttttaaccggcatgggagggca

SEQ ID NO: 7998045 - DNA, 23 bp, Homo sapiens
cttttaacttgatctgagaccag

SEQ ID NO: 7998046 - DNA, 23 bp, Homo sapiens
cttttaactagagtatcagctgc

SEQ ID NO: 7998047 - DNA, 22 bp, Homo sapiens
gaaaagtatgtttattttgact

SEQ ID NO: 7998048 - DNA, 22 bp, Homo sapiens
gaaaagtatgtttattttgact

SEQ ID NO: 7998049 - DNA, 22 bp, Homo sapiens
gaaaagtatgtttattttgact

SEQ ID NO: 7998050 - DNA, 22 bp, Homo sapiens
gaaaagtacacagcccaaacat

SEQ ID NO: 7998051 - DNA, 22 bp, Homo sapiens
gaaaagtaaacactaggggtca

SEQ ID NO: 7998052 - DNA, 22 bp, Homo sapiens
gaaaagggcaagagagagggca

SEQ ID NO: 7998053 - DNA, 22 bp, Homo sapiens
gaaaagggcaagagagagggca

SEQ ID NO: 7998054 - DNA, 22 bp, Homo sapiens
gaaaagtaaacactaggggtca

SEQ ID NO: 7998055 - DNA, 22 bp, Homo sapiens
gaaaagggcaagagagagggca

SEQ ID NO: 7998056 - DNA, 22 bp, Homo sapiens
gaaaaggctgcccacttattga

SEQ ID NO: 7998057 - DNA, 22 bp, Homo sapiens
gaaaaggctgcccacttattga

SEQ ID NO: 7998058 - DNA, 22 bp, Homo sapiens
gaaaaggctctcactccctccg

SEQ ID NO: 7998059 - DNA, 22 bp, Homo sapiens
gaaaaggctgcccacttattga

SEQ ID NO: 7998060 - DNA, 22 bp, Homo sapiens
gaaaaggctctcactccctccg

SEQ ID NO: 7998061 - DNA, 22 bp, Homo sapiens
gaaaaggcctggggcaaagtgt

SEQ ID NO: 7998062 - DNA, 22 bp, Homo sapiens
gaaaaggctctcactccctccg

SEQ ID NO: 7998063 - DNA, 22 bp, Homo sapiens
gaaaaggccactcctaggagct

SEQ ID NO: 7998064 - DNA, 22 bp, Homo sapiens
gaaaaggccactcctaggagct

SEQ ID NO: 7998065 - DNA, 22 bp, Homo sapiens
gaaaaggccactcctaggagct

SEQ ID NO: 7998066 - DNA, 22 bp, Homo sapiens
gaaaaggccactcctaggagct

SEQ ID NO: 7998067 - DNA, 22 bp, Homo sapiens
gaaaaggcctccccataggaat

SEQ ID NO: 7998068 - DNA, 22 bp, Homo sapiens
gaaaaggcctggggcaaagtgt

SEQ ID NO: 7998069 - DNA, 22 bp, Homo sapiens
gaaaaggcctccccataggaat

SEQ ID NO: 7998070 - DNA, 22 bp, Homo sapiens
gaaaaggcctccccataggaat

SEQ ID NO: 7998071 - DNA, 22 bp, Homo sapiens
gaaaaggcagagttccggggaa

SEQ ID NO: 7998072 - DNA, 22 bp, Homo sapiens
gaaaaggcagagttccggggaa

SEQ ID NO: 7998073 - DNA, 22 bp, Homo sapiens
gaaaaggcagagttccggggaa

SEQ ID NO: 7998074 - DNA, 22 bp, Homo sapiens
gaaaaggaaatttatagagatc

SEQ ID NO: 7998075 - DNA, 22 bp, Homo sapiens
gaaaaggattggtaaaatatct

SEQ ID NO: 7998076 - DNA, 22 bp, Homo sapiens
gaaaaggattggtaaaatatct

SEQ ID NO: 7998077 - DNA, 22 bp, Homo sapiens
gaaaaggattggtaaaatatct

SEQ ID NO: 7998078 - DNA, 21 bp, Homo sapiens
gaaaagcaagggagtagaaca

SEQ ID NO: 7998079 - DNA, 21 bp, Homo sapiens
gaaaagcaagggagtagaaca

SEQ ID NO: 7998080 - DNA, 21 bp, Homo sapiens
gaaaagcaagggagtagaaca

SEQ ID NO: 7998081 - DNA, 21 bp, Homo sapiens
gaaaagcaagggagtagaaca

SEQ ID NO: 7998082 - DNA, 21 bp, Homo sapiens
gaaaagcaagggagtagaaca

SEQ ID NO: 7998083 - DNA, 22 bp, Homo sapiens
gaaaagccttctcacataagta

SEQ ID NO: 7998084 - DNA, 22 bp, Homo sapiens
gaaaagctaggccagttcagct

SEQ ID NO: 7998085 - DNA, 22 bp, Homo sapiens
gaaaaggaaatttatagagatc

SEQ ID NO: 7998086 - DNA, 22 bp, Homo sapiens
gaaaaggaaatttatagagatc

SEQ ID NO: 7998087 - DNA, 22 bp, Homo sapiens
gaaaaggaaatttatagagatc

SEQ ID NO: 7998088 - DNA, 22 bp, Homo sapiens
gaaaaggaaatttatagagatc

SEQ ID NO: 7998089 - DNA, 22 bp, Homo sapiens
gaaaaggaaatttatagagatc

SEQ ID NO: 7998090 - DNA, 22 bp, Homo sapiens
gaaaagagtcctgtgtgaggag

SEQ ID NO: 7998091 - DNA, 21 bp, Homo sapiens
gaaaagcaagggagtagaaca

SEQ ID NO: 7998092 - DNA, 22 bp, Homo sapiens
gaaaagagtcctgtgtgaggag

SEQ ID NO: 7998093 - DNA, 21 bp, Homo sapiens
gaaaagcaagggagtagaaca

SEQ ID NO: 7998094 - DNA, 21 bp, Homo sapiens
gaaaagcaagggagtagaaca

SEQ ID NO: 7998095 - DNA, 21 bp, Homo sapiens
gaaaagcaagggagtagaaca

SEQ ID NO: 7998096 - DNA, 21 bp, Homo sapiens
gaaaagcaagggagtagaaca

SEQ ID NO: 7998097 - DNA, 22 bp, Homo sapiens
gaaaacatccagagatagacct

SEQ ID NO: 7998098 - DNA, 22 bp, Homo sapiens
gaaaacatccagagatagacct

SEQ ID NO: 7998099 - DNA, 22 bp, Homo sapiens
gaaaacatccagagatagacct

SEQ ID NO: 7998100 - DNA, 22 bp, Homo sapiens
gaaaacatccagagatagacct

SEQ ID NO: 7998101 - DNA, 22 bp, Homo sapiens
gaaaacatccagagatagacct

SEQ ID NO: 7998102 - DNA, 22 bp, Homo sapiens
gaaaagagacagggtgggtgat

SEQ ID NO: 7998103 - DNA, 22 bp, Homo sapiens
gaaagtttctcacacatgcaga

SEQ ID NO: 7998104 - DNA, 22 bp, Homo sapiens
gaaagtttctcacacatgcaga

SEQ ID NO: 7998105 - DNA, 22 bp, Homo sapiens
gaaagtttataggttatataat

SEQ ID NO: 7998106 - DNA, 22 bp, Homo sapiens
gaaagttattgaaccttattta

SEQ ID NO: 7998107 - DNA, 22 bp, Homo sapiens
gaaagttattcagcctctctga

SEQ ID NO: 7998108 - DNA, 22 bp, Homo sapiens
gaaagttattgaaccttattta

SEQ ID NO: 7998109 - DNA, 22 bp, Homo sapiens
gaaagtttataggttatataat

SEQ ID NO: 7998110 - DNA, 22 bp, Homo sapiens
gaaagtttataggttatataat

SEQ ID NO: 7998111 - DNA, 22 bp, Homo sapiens
gaaagttgcaatcatggctttt

SEQ ID NO: 7998112 - DNA, 22 bp, Homo sapiens
gaaagtgctaggaagtgttaga

SEQ ID NO: 7998113 - DNA, 22 bp, Homo sapiens
gaaagtgctctctctatacaca

SEQ ID NO: 7998114 - DNA, 22 bp, Homo sapiens
gaaagtgcttttgagtgtgtgc

SEQ ID NO: 7998115 - DNA, 22 bp, Homo sapiens
gaaagtgcttagagtgtggtat

SEQ ID NO: 7998116 - DNA, 22 bp, Homo sapiens
gaaagttatatcatgattttag

SEQ ID NO: 7998117 - DNA, 18 bp, Homo sapiens
gaaagtgttgctggtttt

SEQ ID NO: 7998118 - DNA, 22 bp, Homo sapiens
gaaagtgcatgtgcccaccatt

SEQ ID NO: 7998119 - DNA, 22 bp, Homo sapiens
gaaaggttcttgggagttcaca

SEQ ID NO: 7998120 - DNA, 22 bp, Homo sapiens
gaaaggttgggtgaatggtgga

SEQ ID NO: 7998121 - DNA, 18 bp, Homo sapiens
gaaagtgcggggcagggg

SEQ ID NO: 7998122 - DNA, 22 bp, Homo sapiens
gaaagtgcctcagtcctcttat

SEQ ID NO: 7998123 - DNA, 22 bp, Homo sapiens
gaaagtgccagaataggaggcc

SEQ ID NO: 7998124 - DNA, 22 bp, Homo sapiens
gaaaggtgccccataggcagga

SEQ ID NO: 7998125 - DNA, 22 bp, Homo sapiens
gaaaggtgccccataggcagga

SEQ ID NO: 7998126 - DNA, 21 bp, Homo sapiens
gaaaggtcttaacttacagag

SEQ ID NO: 7998127 - DNA, 22 bp, Homo sapiens
gaaaggggcatgtagggatcac

SEQ ID NO: 7998128 - DNA, 22 bp, Homo sapiens
gaaaggggcatgtagggatcac

SEQ ID NO: 7998129 - DNA, 22 bp, Homo sapiens
gaaaggggcatgtagggatcac

SEQ ID NO: 7998130 - DNA, 22 bp, Homo sapiens
gaaagggcatgggcatgacaac

SEQ ID NO: 7998131 - DNA, 22 bp, Homo sapiens
gaaagggcatgggcatgacaac

SEQ ID NO: 7998132 - DNA, 22 bp, Homo sapiens
gaaagggagtggacaacaggca

SEQ ID NO: 7998133 - DNA, 22 bp, Homo sapiens
gaaagggagtggacaacaggca

SEQ ID NO: 7998134 - DNA, 22 bp, Homo sapiens
gaaaggcatcttcagtctctga

SEQ ID NO: 7998135 - DNA, 22 bp, Homo sapiens
gaaaggccacgtgccaagatta

SEQ ID NO: 7998136 - DNA, 22 bp, Homo sapiens
gaaaggccaccatgccagggac

SEQ ID NO: 7998137 - DNA, 22 bp, Homo sapiens
gaaaggccagctcacagatgag

SEQ ID NO: 7998138 - DNA, 22 bp, Homo sapiens
gaaaggccatttctgagggttt

SEQ ID NO: 7998139 - DNA, 22 bp, Homo sapiens
gaaaggctaaaattataagggt

SEQ ID NO: 7998140 - DNA, 22 bp, Homo sapiens
gaaaggctactgtcatcaatta

SEQ ID NO: 7998141 - DNA, 22 bp, Homo sapiens
gaaaggctactgtcatcaatta

SEQ ID NO: 7998142 - DNA, 22 bp, Homo sapiens
gaaaggctatgagtttggtata

SEQ ID NO: 7998143 - DNA, 22 bp, Homo sapiens
gaaaggctcactttagatcatg

SEQ ID NO: 7998144 - DNA, 22 bp, Homo sapiens
gaaaggctcagaagtttgtatt

SEQ ID NO: 7998145 - DNA, 22 bp, Homo sapiens
gaaaggctcagattcccccagg

SEQ ID NO: 7998146 - DNA, 22 bp, Homo sapiens
gaaaggctcagattcccccagg

SEQ ID NO: 7998147 - DNA, 23 bp, Homo sapiens
gaaaggctctgggacccccaact

SEQ ID NO: 7998148 - DNA, 23 bp, Homo sapiens
gaaaggctctgggacccccaact

SEQ ID NO: 7998149 - DNA, 22 bp, Homo sapiens
gaaagggagtgaagatggtata

SEQ ID NO: 7998150 - DNA, 22 bp, Homo sapiens
gaaagggagtgaagatggtata

SEQ ID NO: 7998151 - DNA, 22 bp, Homo sapiens
gaaagggagtgaagatggtata

SEQ ID NO: 7998152 - DNA, 22 bp, Homo sapiens
gaaaggcttgcttttgctcggt

SEQ ID NO: 7998153 - DNA, 22 bp, Homo sapiens
gaaaggcttggttttgaatata

SEQ ID NO: 7998154 - DNA, 22 bp, Homo sapiens
gaaaggctgcatctcgcctcag

SEQ ID NO: 7998155 - DNA, 19 bp, Homo sapiens
gaaaggctgctgctacctg

SEQ ID NO: 7998156 - DNA, 22 bp, Homo sapiens
gaaaggctgggatttagcgctg

SEQ ID NO: 7998157 - DNA, 22 bp, Homo sapiens
gaaaggcttaaattgtaagggc

SEQ ID NO: 7998158 - DNA, 22 bp, Homo sapiens
gaaaggcttcttaagcttcact

SEQ ID NO: 7998159 - DNA, 22 bp, Homo sapiens
gaaaggcttgagacattgatga

SEQ ID NO: 7998160 - DNA, 22 bp, Homo sapiens
gaaaagtatgtttattttgact

SEQ ID NO: 7998161 - DNA, 22 bp, Homo sapiens
gaaaagtatgtttattttgact

SEQ ID NO: 7998162 - DNA, 22 bp, Homo sapiens
gaaaagttcatcatatattcag

SEQ ID NO: 7998163 - DNA, 22 bp, Homo sapiens
gaaaagttcatcatatattcag

SEQ ID NO: 7998164 - DNA, 22 bp, Homo sapiens
gaaaagttcatcatatattcag

SEQ ID NO: 7998165 - DNA, 21 bp, Homo sapiens
gaaaatacaatgagcttgacc

SEQ ID NO: 7998166 - DNA, 22 bp, Homo sapiens
gaaaatacaaatagccttgaaa

SEQ ID NO: 7998167 - DNA, 22 bp, Homo sapiens
gaaaatacaaatagccttgaaa

SEQ ID NO: 7998168 - DNA, 22 bp, Homo sapiens
gaaaggcagtacagctgagcct

SEQ ID NO: 7998169 - DNA, 22 bp, Homo sapiens
gaaaggcatcttcagtctctga

SEQ ID NO: 7998170 - DNA, 22 bp, Homo sapiens
gaaaggcagtacagctgagcct

SEQ ID NO: 7998171 - DNA, 22 bp, Homo sapiens
gaaaggcagtacagctgagcct

SEQ ID NO: 7998172 - DNA, 21 bp, Homo sapiens
gaaaatacaatgagcttgacc

SEQ ID NO: 7998173 - DNA, 18 bp, Homo sapiens
gaaaatactctgggctca

SEQ ID NO: 7998174 - DNA, 18 bp, Homo sapiens
gaaaatactctgggctca

SEQ ID NO: 7998175 - DNA, 18 bp, Homo sapiens
gaaaatactctgggctca

SEQ ID NO: 7998176 - DNA, 22 bp, Homo sapiens
gaggcagctgggatacaaggga

SEQ ID NO: 7998177 - DNA, 22 bp, Homo sapiens
gaggcagctgggatacaaggga

SEQ ID NO: 7998178 - DNA, 22 bp, Homo sapiens
gaggcagctgaaggagtgacag

SEQ ID NO: 7998179 - DNA, 22 bp, Homo sapiens
gaggcagctgaaggagtgacag

SEQ ID NO: 7998180 - DNA, 22 bp, Homo sapiens
gaggcagctgaaggagtgacag

SEQ ID NO: 7998181 - DNA, 22 bp, Homo sapiens
gaggcagctgaaggagtgacag

SEQ ID NO: 7998182 - DNA, 22 bp, Homo sapiens
gaggcagctgggctggtggttt

SEQ ID NO: 7998183 - DNA, 22 bp, Homo sapiens
gaggcagctgggctggtggttt

SEQ ID NO: 7998184 - DNA, 22 bp, Homo sapiens
gaggcagctgggctggtggttt

SEQ ID NO: 7998185 - DNA, 22 bp, Homo sapiens
gaggcagctgggctggtggttt

SEQ ID NO: 7998186 - DNA, 22 bp, Homo sapiens
gaggcagctgggatacaaggga

SEQ ID NO: 7998187 - DNA, 22 bp, Homo sapiens
gaggcagctgggatacaaggga

SEQ ID NO: 7998188 - DNA, 22 bp, Homo sapiens
gaggcagctgggatacaaggga

SEQ ID NO: 7998189 - DNA, 22 bp, Homo sapiens
gaggcagctgggatacaaggga

SEQ ID NO: 7998190 - DNA, 22 bp, Homo sapiens
gaggcagctgggatacaaggga

SEQ ID NO: 7998191 - DNA, 22 bp, Homo sapiens
gaggcccaggtcaagcagccac

SEQ ID NO: 7998192 - DNA, 22 bp, Homo sapiens
gaggcccaggtcaagcagccac

SEQ ID NO: 7998193 - DNA, 22 bp, Homo sapiens
gaggcccagggtacaggccgct

SEQ ID NO: 7998194 - DNA, 22 bp, Homo sapiens
gaggcccagtcctgcaagcacg

SEQ ID NO: 7998195 - DNA, 22 bp, Homo sapiens
gaggcagctgggctggtggttt

SEQ ID NO: 7998196 - DNA, 22 bp, Homo sapiens
gaggcagctgggctggtggttt

SEQ ID NO: 7998197 - DNA, 22 bp, Homo sapiens
gaggcagctgggtccggtcggg

SEQ ID NO: 7998198 - DNA, 22 bp, Homo sapiens
gaggcccagcattcagggcagg

SEQ ID NO: 7998199 - DNA, 22 bp, Homo sapiens
gaggcccagggtacaggccgct

SEQ ID NO: 7998200 - DNA, 22 bp, Homo sapiens
gaggcagcaggctgaggaggat

SEQ ID NO: 7998201 - DNA, 22 bp, Homo sapiens
gaggcagcaggctgaggaggat

SEQ ID NO: 7998202 - DNA, 18 bp, Homo sapiens
gaggcagctagcaatttt

SEQ ID NO: 7998203 - DNA, 18 bp, Homo sapiens
gaggcagctagcaatttt

SEQ ID NO: 7998204 - DNA, 22 bp, Homo sapiens
gaggcagcaggctgaggaggat

SEQ ID NO: 7998205 - DNA, 22 bp, Homo sapiens
gaggcagcaggctgaggaggat

SEQ ID NO: 7998206 - DNA, 22 bp, Homo sapiens
gaggcagcaggctgaggaggat

SEQ ID NO: 7998207 - DNA, 22 bp, Homo sapiens
gaggcagcaggctgaggaggat

SEQ ID NO: 7998208 - DNA, 22 bp, Homo sapiens
gaggcagcaggctgaggaggat

SEQ ID NO: 7998209 - DNA, 22 bp, Homo sapiens
gaggcagcaggctgaggaggat

SEQ ID NO: 7998210 - DNA, 22 bp, Homo sapiens
gaggcagcagaacatggaagag

SEQ ID NO: 7998211 - DNA, 22 bp, Homo sapiens
gaggcagcagaacatggaagag

SEQ ID NO: 7998212 - DNA, 22 bp, Homo sapiens
gaggcagctgaagcttcaaaga

SEQ ID NO: 7998213 - DNA, 22 bp, Homo sapiens
gaggcagctgaaggagtgacag

SEQ ID NO: 7998214 - DNA, 22 bp, Homo sapiens
gaggcagctcttctgaatgggg

SEQ ID NO: 7998215 - DNA, 22 bp, Homo sapiens
gaggcagctcttctgaatgggg

SEQ ID NO: 7998216 - DNA, 23 bp, Homo sapiens
gaggcagctcctgcagtgccctg

SEQ ID NO: 7998217 - DNA, 23 bp, Homo sapiens
gaggcagctcctgcagtgccctg

SEQ ID NO: 7998218 - DNA, 23 bp, Homo sapiens
gaggcagctcctgcagtgccctg

SEQ ID NO: 7998219 - DNA, 23 bp, Homo sapiens
gaggcagctcctgcagtgccctg

SEQ ID NO: 7998220 - DNA, 23 bp, Homo sapiens
gaggcagctcctgcagtgccctg

SEQ ID NO: 7998221 - DNA, 23 bp, Homo sapiens
gaggcagctcctgcagtgccctg

SEQ ID NO: 7998222 - DNA, 23 bp, Homo sapiens
gaggcagctcctgcagtgccctg

SEQ ID NO: 7998223 - DNA, 23 bp, Homo sapiens
gaggcagctcctgcagtgccctg

SEQ ID NO: 7998224 - DNA, 23 bp, Homo sapiens
gaggcagctcctgcagtgccctg

SEQ ID NO: 7998225 - DNA, 18 bp, Homo sapiens
gaggcagctagcaatttt

SEQ ID NO: 7998226 - DNA, 18 bp, Homo sapiens
gaggcagctagcaatttt

SEQ ID NO: 7998227 - DNA, 22 bp, Homo sapiens
gaggcctcctctgagacatctg

SEQ ID NO: 7998228 - DNA, 22 bp, Homo sapiens
gaggcctcctctgagacatctg

SEQ ID NO: 7998229 - DNA, 22 bp, Homo sapiens
gaggcctctgtcccaccaggga

SEQ ID NO: 7998230 - DNA, 22 bp, Homo sapiens
gaggcctcctctgagacatctg

SEQ ID NO: 7998231 - DNA, 22 bp, Homo sapiens
gaggcctctgtcccaccaggga

SEQ ID NO: 7998232 - DNA, 22 bp, Homo sapiens
gaggcctctgtcccaccaggga

SEQ ID NO: 7998233 - DNA, 22 bp, Homo sapiens
gaggcctcaggaatgtcgtgtg

SEQ ID NO: 7998234 - DNA, 22 bp, Homo sapiens
gaggcctcagcctgccctgaac

SEQ ID NO: 7998235 - DNA, 22 bp, Homo sapiens
gaggcctcagcctgccctgaac

SEQ ID NO: 7998236 - DNA, 21 bp, Homo sapiens
gaggcctcagcctcagctcct

SEQ ID NO: 7998237 - DNA, 22 bp, Homo sapiens
gaggcctcctctgagacatctg

SEQ ID NO: 7998238 - DNA, 22 bp, Homo sapiens
gaggcctcctctgagacatctg

SEQ ID NO: 7998239 - DNA, 22 bp, Homo sapiens
gaggcctcatgaggtgagcatt

SEQ ID NO: 7998240 - DNA, 22 bp, Homo sapiens
gaggcctcaggcgtgggaaggg

SEQ ID NO: 7998241 - DNA, 18 bp, Homo sapiens
gaggcctgagaaccaggt

SEQ ID NO: 7998242 - DNA, 22 bp, Homo sapiens
gaggcctgaaaggggacctatg

SEQ ID NO: 7998243 - DNA, 22 bp, Homo sapiens
gaggcctgaaaggggacctatg

SEQ ID NO: 7998244 - DNA, 22 bp, Homo sapiens
gaggcctgaaaggggacctatg

SEQ ID NO: 7998245 - DNA, 22 bp, Homo sapiens
gaggcctctgtcccgccaggga

SEQ ID NO: 7998246 - DNA, 22 bp, Homo sapiens
gaggcctcttctttgttaacct

SEQ ID NO: 7998247 - DNA, 22 bp, Homo sapiens
gaggcctctgtcccgccaggga

SEQ ID NO: 7998248 - DNA, 22 bp, Homo sapiens
gaggcctcttctttgttaacct

SEQ ID NO: 7998249 - DNA, 17 bp, Homo sapiens
gaggcctcttggcatct

SEQ ID NO: 7998250 - DNA, 18 bp, Homo sapiens
gaggcctgagaaccaggt

SEQ ID NO: 7998251 - DNA, 18 bp, Homo sapiens
gaggcctgagaaccaggt

SEQ ID NO: 7998252 - DNA, 18 bp, Homo sapiens
gaggcctgagaaccaggt

SEQ ID NO: 7998253 - DNA, 22 bp, Homo sapiens
gaggcctgaggctgcctggagc

SEQ ID NO: 7998254 - DNA, 22 bp, Homo sapiens
gaggcctgaggctgcctggagc

SEQ ID NO: 7998255 - DNA, 22 bp, Homo sapiens
gaggcctgaggctgcctggagc

SEQ ID NO: 7998256 - DNA, 22 bp, Homo sapiens
gaggcctgaggctgcctggagc

SEQ ID NO: 7998257 - DNA, 22 bp, Homo sapiens
gaggcctgaggctgcctggagc

SEQ ID NO: 7998258 - DNA, 20 bp, Homo sapiens
gaggcctcagcctcagctcc

SEQ ID NO: 7998259 - DNA, 20 bp, Homo sapiens
gaggcctcagcctcagctcc

SEQ ID NO: 7998260 - DNA, 21 bp, Homo sapiens
gaggcctcagcctcagctcct

SEQ ID NO: 7998261 - DNA, 20 bp, Homo sapiens
gaggcctcagcctcagctcc

SEQ ID NO: 7998262 - DNA, 22 bp, Homo sapiens
gaggccctgaagacagctgggg

SEQ ID NO: 7998263 - DNA, 22 bp, Homo sapiens
gaggccctcttgccacaatgaa

SEQ ID NO: 7998264 - DNA, 22 bp, Homo sapiens
gaggccctgaagacagctgggg

SEQ ID NO: 7998265 - DNA, 22 bp, Homo sapiens
gaggccctgaagacagctgggg

SEQ ID NO: 7998266 - DNA, 22 bp, Homo sapiens
gaggccctgaagacagctgggg

SEQ ID NO: 7998267 - DNA, 22 bp, Homo sapiens
gaggccctgaagacagctgggg

SEQ ID NO: 7998268 - DNA, 22 bp, Homo sapiens
gaggccctggtaggtcagagtg

SEQ ID NO: 7998269 - DNA, 22 bp, Homo sapiens
gaggccctgaagacagctgggg

SEQ ID NO: 7998270 - DNA, 22 bp, Homo sapiens
gaggccctccagctgtcagctg

SEQ ID NO: 7998271 - DNA, 22 bp, Homo sapiens
gaggccctcttgccacaatgaa

SEQ ID NO: 7998272 - DNA, 21 bp, Homo sapiens
gaggcccatgggacaggggct

SEQ ID NO: 7998273 - DNA, 22 bp, Homo sapiens
gaggcccagtcctgcaagcacg

SEQ ID NO: 7998274 - DNA, 22 bp, Homo sapiens
gaggcccagtggagggccatgg

SEQ ID NO: 7998275 - DNA, 19 bp, Homo sapiens
gaggcccatgagggtgctc

SEQ ID NO: 7998276 - DNA, 22 bp, Homo sapiens
gaggcagcaataaaaagaattt

SEQ ID NO: 7998277 - DNA, 22 bp, Homo sapiens
gaggcagcagaacatggaagag

SEQ ID NO: 7998278 - DNA, 22 bp, Homo sapiens
gaggcagcagaacatggaagag

SEQ ID NO: 7998279 - DNA, 22 bp, Homo sapiens
gaggcagcagaacatggaagag

SEQ ID NO: 7998280 - DNA, 22 bp, Homo sapiens
gaggcagcagaacatggaagag

SEQ ID NO: 7998281 - DNA, 22 bp, Homo sapiens
gaggcagcaaaatatatcataa

SEQ ID NO: 7998282 - DNA, 22 bp, Homo sapiens
gaggcagagtgcaccccaggag

SEQ ID NO: 7998283 - DNA, 22 bp, Homo sapiens
gaggcagagtgcaccccaggag

SEQ ID NO: 7998284 - DNA, 22 bp, Homo sapiens
gaggcagagtgcaccccaggag

SEQ ID NO: 7998285 - DNA, 22 bp, Homo sapiens
gaggcagagtcacaaagagtct

SEQ ID NO: 7998286 - DNA, 22 bp, Homo sapiens
gaggcagagtgcaccccaggag

SEQ ID NO: 7998287 - DNA, 22 bp, Homo sapiens
gaggcagagtgcaccccaggag

SEQ ID NO: 7998288 - DNA, 22 bp, Homo sapiens
gaggcagagtgcaccccaggag

SEQ ID NO: 7998289 - DNA, 22 bp, Homo sapiens
gaggcagagtgcaccccaggag

SEQ ID NO: 7998290 - DNA, 22 bp, Homo sapiens
gaggcagagtcacaaagagtct

SEQ ID NO: 7998291 - DNA, 22 bp, Homo sapiens
gaggcagagtcacaaagagtct

SEQ ID NO: 7998292 - DNA, 22 bp, Homo sapiens
gaggcagagtcacaaagagtct

SEQ ID NO: 7998293 - DNA, 22 bp, Homo sapiens
gaggcagaggttgcagtgagct

SEQ ID NO: 7998294 - DNA, 22 bp, Homo sapiens
gaggcagaggttgcagtgagct

SEQ ID NO: 7998295 - DNA, 22 bp, Homo sapiens
gaggcagaggttgcagtgagct

SEQ ID NO: 7998296 - DNA, 22 bp, Homo sapiens
gaggcagaggttgttgcagtga

SEQ ID NO: 7998297 - DNA, 22 bp, Homo sapiens
gaggcagaggttgttgcagtga

SEQ ID NO: 7998298 - DNA, 22 bp, Homo sapiens
gaggcagaggttgttgcagtga

SEQ ID NO: 7998299 - DNA, 22 bp, Homo sapiens
gaggcagaggttgttgcagtga

SEQ ID NO: 7998300 - DNA, 22 bp, Homo sapiens
gaggcagaggttgttgcagtga

SEQ ID NO: 7998301 - DNA, 22 bp, Homo sapiens
gaggaggtcgctgctgagcccc

SEQ ID NO: 7998302 - DNA, 22 bp, Homo sapiens
gaggaggtcgctgctgagcccc

SEQ ID NO: 7998303 - DNA, 22 bp, Homo sapiens
gaggaggtcgctgctgagcccc

SEQ ID NO: 7998304 - DNA, 22 bp, Homo sapiens
gaggaggtcgctgctgagcccc

SEQ ID NO: 7998305 - DNA, 22 bp, Homo sapiens
gaggaggtcccccgacatgcct

SEQ ID NO: 7998306 - DNA, 22 bp, Homo sapiens
gaggaggtcccccgacatgcct

SEQ ID NO: 7998307 - DNA, 22 bp, Homo sapiens
gaggagggttggccttaggtag

SEQ ID NO: 7998308 - DNA, 22 bp, Homo sapiens
gaggagggttggccttaggtag

SEQ ID NO: 7998309 - DNA, 22 bp, Homo sapiens
gaggagggttggccttaggtag

SEQ ID NO: 7998310 - DNA, 22 bp, Homo sapiens
gaggagggttggccttaggtag

SEQ ID NO: 7998311 - DNA, 22 bp, Homo sapiens
gaggagggttggccttaggtag

SEQ ID NO: 7998312 - DNA, 22 bp, Homo sapiens
gaggaggtggagtcatgcagag

SEQ ID NO: 7998313 - DNA, 22 bp, Homo sapiens
gaggaggtggaattccaggaat

SEQ ID NO: 7998314 - DNA, 22 bp, Homo sapiens
gaggaggtggaattccaggaat

SEQ ID NO: 7998315 - DNA, 22 bp, Homo sapiens
gaggaggtggagtcatgcagag

SEQ ID NO: 7998316 - DNA, 22 bp, Homo sapiens
gaggaggtctcctccgcagggg

SEQ ID NO: 7998317 - DNA, 22 bp, Homo sapiens
gaggaggtctcctccgcagggg

SEQ ID NO: 7998318 - DNA, 22 bp, Homo sapiens
gaggaggtggaattccaggaat

SEQ ID NO: 7998319 - DNA, 22 bp, Homo sapiens
gaggaggtggaattccaggaat

SEQ ID NO: 7998320 - DNA, 22 bp, Homo sapiens
gaggcagaggttgcagtgagct

SEQ ID NO: 7998321 - DNA, 22 bp, Homo sapiens
gaggaggtggagtcatgcagag

SEQ ID NO: 7998322 - DNA, 22 bp, Homo sapiens
gaggcagaggttgcagtgagct

SEQ ID NO: 7998323 - DNA, 22 bp, Homo sapiens
gaggcagaggttgcagtgagct

SEQ ID NO: 7998324 - DNA, 22 bp, Homo sapiens
gaggcagaggttgcagtgagct

SEQ ID NO: 7998325 - DNA, 22 bp, Homo sapiens
gaggcagaggttgcagtgagct

SEQ ID NO: 7998326 - DNA, 22 bp, Homo sapiens
gaggagggagaattaggcttaa

SEQ ID NO: 7998327 - DNA, 22 bp, Homo sapiens
gaggaggcttccgggaggcacg

SEQ ID NO: 7998328 - DNA, 22 bp, Homo sapiens
gaggagggagctggaagctctt

SEQ ID NO: 7998329 - DNA, 22 bp, Homo sapiens
gaggagggagctggaagctctt

SEQ ID NO: 7998330 - DNA, 22 bp, Homo sapiens
gaggagggagctggaagctctt

SEQ ID NO: 7998331 - DNA, 22 bp, Homo sapiens
gaggagggagctggaagctctt

SEQ ID NO: 7998332 - DNA, 22 bp, Homo sapiens
gaggagggagctggaagctctt

SEQ ID NO: 7998333 - DNA, 22 bp, Homo sapiens
gaggagggagctggaagctctt

SEQ ID NO: 7998334 - DNA, 22 bp, Homo sapiens
gaggagggagctggaagctctt

SEQ ID NO: 7998335 - DNA, 22 bp, Homo sapiens
gaggagggagctggaagctctt

SEQ ID NO: 7998336 - DNA, 22 bp, Homo sapiens
gaggagggagctggaagctctt

SEQ ID NO: 7998337 - DNA, 22 bp, Homo sapiens
gaggagggagctggaagctctt

SEQ ID NO: 7998338 - DNA, 22 bp, Homo sapiens
gaggagggagctggaagctctt

SEQ ID NO: 7998339 - DNA, 22 bp, Homo sapiens
gaggagggagctggaagctctt

SEQ ID NO: 7998340 - DNA, 22 bp, Homo sapiens
gaggagggagctggaagctctt

SEQ ID NO: 7998341 - DNA, 22 bp, Homo sapiens
gaggagggagctggaagctctt

SEQ ID NO: 7998342 - DNA, 22 bp, Homo sapiens
gaggagggagctggaagctctt

SEQ ID NO: 7998343 - DNA, 22 bp, Homo sapiens
gaggagggagctggaagctctt

SEQ ID NO: 7998344 - DNA, 22 bp, Homo sapiens
gaggagggagctggaagctctt

SEQ ID NO: 7998345 - DNA, 23 bp, Homo sapiens
gaggagggtctgacaagtgtagc

SEQ ID NO: 7998346 - DNA, 23 bp, Homo sapiens
gaggagggtctgacaagtgtagc

SEQ ID NO: 7998347 - DNA, 23 bp, Homo sapiens
gaggagggtctgacaagtgtagc

SEQ ID NO: 7998348 - DNA, 23 bp, Homo sapiens
gaggagggtctgacaagtgtagc

SEQ ID NO: 7998349 - DNA, 23 bp, Homo sapiens
gaggagggtctgacaagtgtagc

SEQ ID NO: 7998350 - DNA, 23 bp, Homo sapiens
gaggagggtctgacaagtgtagc

SEQ ID NO: 7998351 - DNA, 22 bp, Homo sapiens
gaggagggttggccttaggtag

SEQ ID NO: 7998352 - DNA, 22 bp, Homo sapiens
gaggaggctgtttctctgcatt

SEQ ID NO: 7998353 - DNA, 22 bp, Homo sapiens
gaggaggctgtttctctgcatt

SEQ ID NO: 7998354 - DNA, 22 bp, Homo sapiens
gaggaggctgtttctctgcatt

SEQ ID NO: 7998355 - DNA, 22 bp, Homo sapiens
gaggaggctgtttctctgcatt

SEQ ID NO: 7998356 - DNA, 22 bp, Homo sapiens
gaggaggctgtttctctgcatt

SEQ ID NO: 7998357 - DNA, 22 bp, Homo sapiens
gaggaggctggcgccgcctgcc

SEQ ID NO: 7998358 - DNA, 22 bp, Homo sapiens
gaggaggctgtttctctgcatt

SEQ ID NO: 7998359 - DNA, 22 bp, Homo sapiens
gaggaggctggcgccgcctgcc

SEQ ID NO: 7998360 - DNA, 22 bp, Homo sapiens
gaggaggctggcgccgcctgcc

SEQ ID NO: 7998361 - DNA, 19 bp, Homo sapiens
gaggaggcttcagctttct

SEQ ID NO: 7998362 - DNA, 22 bp, Homo sapiens
gaggaggcttccgggaggcacg

SEQ ID NO: 7998363 - DNA, 22 bp, Homo sapiens
gaggaggcttccgggaggcacg

SEQ ID NO: 7998364 - DNA, 19 bp, Homo sapiens
gaggaggcttcagctttct

SEQ ID NO: 7998365 - DNA, 19 bp, Homo sapiens
gaggaggcttcagctttct

SEQ ID NO: 7998366 - DNA, 22 bp, Homo sapiens
gaggaggctgtttctctgcatt

SEQ ID NO: 7998367 - DNA, 19 bp, Homo sapiens
gaggaggcttcagctttct

SEQ ID NO: 7998368 - DNA, 22 bp, Homo sapiens
gaggaggcttccgggaggcacg

SEQ ID NO: 7998369 - DNA, 22 bp, Homo sapiens
gaggaggcttccgggaggcacg

SEQ ID NO: 7998370 - DNA, 22 bp, Homo sapiens
gaggaggcttccgggaggcacg

SEQ ID NO: 7998371 - DNA, 22 bp, Homo sapiens
gaggaggcttccgggaggcacg

SEQ ID NO: 7998372 - DNA, 22 bp, Homo sapiens
gaggaggcttccgggaggcacg

SEQ ID NO: 7998373 - DNA, 22 bp, Homo sapiens
gaggaggcttccgggaggcacg

SEQ ID NO: 7998374 - DNA, 22 bp, Homo sapiens
gaggaggcttccgggaggcacg

SEQ ID NO: 7998375 - DNA, 22 bp, Homo sapiens
gaggaggcttccgggaggcacg

SEQ ID NO: 7998376 - DNA, 23 bp, Homo sapiens
gagctgggatacaggcttactgc

SEQ ID NO: 7998377 - DNA, 22 bp, Homo sapiens
gaggaagaattggttattggag

SEQ ID NO: 7998378 - DNA, 22 bp, Homo sapiens
gagctgggattcatctatgtct

SEQ ID NO: 7998379 - DNA, 23 bp, Homo sapiens
gagctgggatacaggcttactgc

SEQ ID NO: 7998380 - DNA, 22 bp, Homo sapiens
gagctgggagttatagcatgtt

SEQ ID NO: 7998381 - DNA, 22 bp, Homo sapiens
gagctgggagttatagcatgtt

SEQ ID NO: 7998382 - DNA, 22 bp, Homo sapiens
gaggaagatggttgagtggtcc

SEQ ID NO: 7998383 - DNA, 22 bp, Homo sapiens
gaggaagatggttgagtggtcc

SEQ ID NO: 7998384 - DNA, 22 bp, Homo sapiens
gaggaagagcatggccagtttc

SEQ ID NO: 7998385 - DNA, 22 bp, Homo sapiens
gaggaagagagctctgccttgt

SEQ ID NO: 7998386 - DNA, 22 bp, Homo sapiens
gaggaagatggttgagtggtcc

SEQ ID NO: 7998387 - DNA, 22 bp, Homo sapiens
gaggaagatggttgagtggtcc

SEQ ID NO: 7998388 - DNA, 22 bp, Homo sapiens
gaggaagggactttattatctg

SEQ ID NO: 7998389 - DNA, 22 bp, Homo sapiens
gaggaagggactttattatctg

SEQ ID NO: 7998390 - DNA, 22 bp, Homo sapiens
gaggaagggctgcctgccgggc

SEQ ID NO: 7998391 - DNA, 22 bp, Homo sapiens
gaggaagggctgcctgccgggc

SEQ ID NO: 7998392 - DNA, 22 bp, Homo sapiens
gaggaagggactttattatctg

SEQ ID NO: 7998393 - DNA, 22 bp, Homo sapiens
gaggaagggctgcctgccgggc

SEQ ID NO: 7998394 - DNA, 22 bp, Homo sapiens
gaggaagggctgcctgccgggc

SEQ ID NO: 7998395 - DNA, 22 bp, Homo sapiens
gaggaagggctgcctgccgggc

SEQ ID NO: 7998396 - DNA, 22 bp, Homo sapiens
gaggaagggctgcctgccgggc

SEQ ID NO: 7998397 - DNA, 22 bp, Homo sapiens
gaggaaggtcccatcagaattt

SEQ ID NO: 7998398 - DNA, 22 bp, Homo sapiens
gagctgggagttatagcatgtt

SEQ ID NO: 7998399 - DNA, 22 bp, Homo sapiens
gagctgggagttatagcatgtt

SEQ ID NO: 7998400 - DNA, 22 bp, Homo sapiens
gagctgggagttatagcatgtt

SEQ ID NO: 7998401 - DNA, 22 bp, Homo sapiens
gagctgggagttatagcatgtt

SEQ ID NO: 7998402 - DNA, 22 bp, Homo sapiens
gagctgggaggactgggaactt

SEQ ID NO: 7998403 - DNA, 22 bp, Homo sapiens
gagctgggagttatagcatgtt

SEQ ID NO: 7998404 - DNA, 22 bp, Homo sapiens
gagctgggagttatagcatgtt

SEQ ID NO: 7998405 - DNA, 22 bp, Homo sapiens
gagctgggagctgggatttgga

SEQ ID NO: 7998406 - DNA, 22 bp, Homo sapiens
gagctgggagctgggatttgga

SEQ ID NO: 7998407 - DNA, 22 bp, Homo sapiens
gagctgggagctgggatttgga

SEQ ID NO: 7998408 - DNA, 22 bp, Homo sapiens
gagctgggaggactgggaactt

SEQ ID NO: 7998409 - DNA, 22 bp, Homo sapiens
gagctgggaggactgggaactt

SEQ ID NO: 7998410 - DNA, 22 bp, Homo sapiens
gagctgggaggactgggaactt

SEQ ID NO: 7998411 - DNA, 22 bp, Homo sapiens
gagctgggaggactgggaactt

SEQ ID NO: 7998412 - DNA, 22 bp, Homo sapiens
gagctgggaggactgggaactt

SEQ ID NO: 7998413 - DNA, 22 bp, Homo sapiens
gagctgggaggactgggaactt

SEQ ID NO: 7998414 - DNA, 18 bp, Homo sapiens
gagctgggagaaggaagg

SEQ ID NO: 7998415 - DNA, 18 bp, Homo sapiens
gagctgggagaaggaagg

SEQ ID NO: 7998416 - DNA, 18 bp, Homo sapiens
gagctgggagaaggaagg

SEQ ID NO: 7998417 - DNA, 22 bp, Homo sapiens
gagctgggagctgggatttgga

SEQ ID NO: 7998418 - DNA, 22 bp, Homo sapiens
gagctgggagctgggatttgga

SEQ ID NO: 7998419 - DNA, 22 bp, Homo sapiens
gagctgggagctgggatttgga

SEQ ID NO: 7998420 - DNA, 22 bp, Homo sapiens
gagctgggacttggaatccaca

SEQ ID NO: 7998421 - DNA, 18 bp, Homo sapiens
gagctgggagaaggaagg

SEQ ID NO: 7998422 - DNA, 18 bp, Homo sapiens
gagctgggagaaggaagg

SEQ ID NO: 7998423 - DNA, 18 bp, Homo sapiens
gagctgggagaaggaagg

SEQ ID NO: 7998424 - DNA, 18 bp, Homo sapiens
gagctgggagaaggaagg

SEQ ID NO: 7998425 - DNA, 18 bp, Homo sapiens
gagctgggagaaggaagg

SEQ ID NO: 7998426 - DNA, 22 bp, Homo sapiens
gagctgggacttggaatccaca

SEQ ID NO: 7998427 - DNA, 22 bp, Homo sapiens
gaggacagagccgcctggcaag

SEQ ID NO: 7998428 - DNA, 22 bp, Homo sapiens
gaggacagagccgcctggcaag

SEQ ID NO: 7998429 - DNA, 22 bp, Homo sapiens
gaggacagagccgcctggcaag

SEQ ID NO: 7998430 - DNA, 22 bp, Homo sapiens
gaggacagagccgcctggcaag

SEQ ID NO: 7998431 - DNA, 22 bp, Homo sapiens
gaggacagagccgcctggcaag

SEQ ID NO: 7998432 - DNA, 22 bp, Homo sapiens
gaggacagagccgcctggcaag

SEQ ID NO: 7998433 - DNA, 22 bp, Homo sapiens
gaggacacctcacagcctcaca

SEQ ID NO: 7998434 - DNA, 22 bp, Homo sapiens
gaggacacctcacagcctcaca

SEQ ID NO: 7998435 - DNA, 22 bp, Homo sapiens
gaggacacctcacagcctcaca

SEQ ID NO: 7998436 - DNA, 22 bp, Homo sapiens
gaggacagctctaactaaagtc

SEQ ID NO: 7998437 - DNA, 22 bp, Homo sapiens
gaggacagcttagggcttcctg

SEQ ID NO: 7998438 - DNA, 22 bp, Homo sapiens
gaggacagcttagggcttcctg

SEQ ID NO: 7998439 - DNA, 22 bp, Homo sapiens
gaggacagctctaactaaagtc

SEQ ID NO: 7998440 - DNA, 22 bp, Homo sapiens
gaggacagctctaactaaagtc

SEQ ID NO: 7998441 - DNA, 22 bp, Homo sapiens
gaggacagcttagggcttcctg

SEQ ID NO: 7998442 - DNA, 22 bp, Homo sapiens
gaggacagcttagggcttcctg

SEQ ID NO: 7998443 - DNA, 22 bp, Homo sapiens
gaggacagcttagggcttcctg

SEQ ID NO: 7998444 - DNA, 22 bp, Homo sapiens
gaggacagcttagggcttcctg

SEQ ID NO: 7998445 - DNA, 22 bp, Homo sapiens
gaggacaggagactcactgttt

SEQ ID NO: 7998446 - DNA, 22 bp, Homo sapiens
gaggaggctgaacaatgccctg

SEQ ID NO: 7998447 - DNA, 22 bp, Homo sapiens
gaggaggctgaacaatgccctg

SEQ ID NO: 7998448 - DNA, 22 bp, Homo sapiens
gaggacagcttagggcttcctg

SEQ ID NO: 7998449 - DNA, 22 bp, Homo sapiens
gaggaaggtcccatcagaattt

SEQ ID NO: 7998450 - DNA, 22 bp, Homo sapiens
gaggaagtctctctacaagaaa

SEQ ID NO: 7998451 - DNA, 22 bp, Homo sapiens
gaggaagtctctctacaagaaa

SEQ ID NO: 7998452 - DNA, 22 bp, Homo sapiens
gaggaagttctatgattacatc

SEQ ID NO: 7998453 - DNA, 22 bp, Homo sapiens
gaggaaggtcccatcagaattt

SEQ ID NO: 7998454 - DNA, 22 bp, Homo sapiens
gaggaaggtcccatcagaattt

SEQ ID NO: 7998455 - DNA, 22 bp, Homo sapiens
gaggaaggtcccatcagaattt

SEQ ID NO: 7998456 - DNA, 22 bp, Homo sapiens
gaggaatgggtgtctcgtgatt

SEQ ID NO: 7998457 - DNA, 22 bp, Homo sapiens
gaggaagttctatgattacatc

SEQ ID NO: 7998458 - DNA, 22 bp, Homo sapiens
gaggaagtttacaaagcatctg

SEQ ID NO: 7998459 - DNA, 22 bp, Homo sapiens
gaggaatgggtgtctcgtgatt

SEQ ID NO: 7998460 - DNA, 21 bp, Homo sapiens
gaggaatggtttgcaaagcac

SEQ ID NO: 7998461 - DNA, 21 bp, Homo sapiens
gaggaatggtttgcaaagcac

SEQ ID NO: 7998462 - DNA, 21 bp, Homo sapiens
gaggaatggtttgcaaagcac

SEQ ID NO: 7998463 - DNA, 22 bp, Homo sapiens
gaggacacatgactccagcagg

SEQ ID NO: 7998464 - DNA, 23 bp, Homo sapiens
gaggacacagcccagacagccgt

SEQ ID NO: 7998465 - DNA, 22 bp, Homo sapiens
gaggacacaaagtggctgagat

SEQ ID NO: 7998466 - DNA, 23 bp, Homo sapiens
gaggacacagcccagacagccgt

SEQ ID NO: 7998467 - DNA, 22 bp, Homo sapiens
gaggacacaaagtggctgagat

SEQ ID NO: 7998468 - DNA, 22 bp, Homo sapiens
gaggacacaaagtggctgagat

SEQ ID NO: 7998469 - DNA, 22 bp, Homo sapiens
gaggacaaagcccaggtgctgg

SEQ ID NO: 7998470 - DNA, 22 bp, Homo sapiens
gaggacaaagcccaggtgctgg

SEQ ID NO: 7998471 - DNA, 22 bp, Homo sapiens
gaggacaaagcccaggtgctgg

SEQ ID NO: 7998472 - DNA, 22 bp, Homo sapiens
gaggaatgttattaaaggagct

SEQ ID NO: 7998473 - DNA, 22 bp, Homo sapiens
gaggaatgttattaaaggagct

SEQ ID NO: 7998474 - DNA, 22 bp, Homo sapiens
gaggaatgttattaaaggagct

SEQ ID NO: 7998475 - DNA, 22 bp, Homo sapiens
gaggaatgtcagcacaggcctc

SEQ ID NO: 7998476 - DNA, 22 bp, Homo sapiens
gaggaatgtcagcacaggcctc

SEQ ID NO: 7998477 - DNA, 22 bp, Homo sapiens
gaggaatgtcagcacaggcctc

SEQ ID NO: 7998478 - DNA, 22 bp, Homo sapiens
gagctgggaagatagcttgagc

SEQ ID NO: 7998479 - DNA, 22 bp, Homo sapiens
gagctgggaagatagcttgagc

SEQ ID NO: 7998480 - DNA, 22 bp, Homo sapiens
gagctgggaagatagcttgagc

SEQ ID NO: 7998481 - DNA, 22 bp, Homo sapiens
gagctggctgtggttgagtgca

SEQ ID NO: 7998482 - DNA, 22 bp, Homo sapiens
gagctggctgtggttgagtgca

SEQ ID NO: 7998483 - DNA, 22 bp, Homo sapiens
gagctgggaagatagcttgagc

SEQ ID NO: 7998484 - DNA, 22 bp, Homo sapiens
gagctgggacatgggtcctctc

SEQ ID NO: 7998485 - DNA, 22 bp, Homo sapiens
gagctgggacatgggtcctctc

SEQ ID NO: 7998486 - DNA, 22 bp, Homo sapiens
gagctgggacatgggtcctctc

SEQ ID NO: 7998487 - DNA, 22 bp, Homo sapiens
gagctgggaagatagcttgagc

SEQ ID NO: 7998488 - DNA, 22 bp, Homo sapiens
gagctgggacatgggtcctctc

SEQ ID NO: 7998489 - DNA, 22 bp, Homo sapiens
gagctgggacatgggtcctctc

SEQ ID NO: 7998490 - DNA, 22 bp, Homo sapiens
gagctgggacttggaatccaca

SEQ ID NO: 7998491 - DNA, 22 bp, Homo sapiens
gagctgggacatgggtcctctc

SEQ ID NO: 7998492 - DNA, 22 bp, Homo sapiens
gagctgggacatgggtcctctc

SEQ ID NO: 7998493 - DNA, 22 bp, Homo sapiens
gagctggctccgccatgctgct

SEQ ID NO: 7998494 - DNA, 22 bp, Homo sapiens
gagctggctccgccatgctgct

SEQ ID NO: 7998495 - DNA, 22 bp, Homo sapiens
gagctggctccgccatgctgct

SEQ ID NO: 7998496 - DNA, 22 bp, Homo sapiens
gagctggctcctccgaggatgg

SEQ ID NO: 7998497 - DNA, 22 bp, Homo sapiens
gagctggctgtggttgagtgca

SEQ ID NO: 7998498 - DNA, 22 bp, Homo sapiens
gagctggctaatactgacttat

SEQ ID NO: 7998499 - DNA, 22 bp, Homo sapiens
gagctggctaatactgacttat

SEQ ID NO: 7998500 - DNA, 22 bp, Homo sapiens
gagctggctccgccatgctgct

SEQ ID NO: 7998501 - DNA, 22 bp, Homo sapiens
gagctggctccgccatgctgct

SEQ ID NO: 7998502 - DNA, 22 bp, Homo sapiens
gagctggctccgccatgctgct

SEQ ID NO: 7998503 - DNA, 22 bp, Homo sapiens
gagctggctccgccatgctgct

SEQ ID NO: 7998504 - DNA, 22 bp, Homo sapiens
gagctggctaatactgacttat

SEQ ID NO: 7998505 - DNA, 22 bp, Homo sapiens
gagctggcctcaggcacaggag

SEQ ID NO: 7998506 - DNA, 22 bp, Homo sapiens
gagctggcctcaggcacaggag

SEQ ID NO: 7998507 - DNA, 22 bp, Homo sapiens
gagctggcctcaggcacaggag

SEQ ID NO: 7998508 - DNA, 22 bp, Homo sapiens
gagctggcctcaggcacaggag

SEQ ID NO: 7998509 - DNA, 22 bp, Homo sapiens
gagctggcctcaggcacaggag

SEQ ID NO: 7998510 - DNA, 22 bp, Homo sapiens
gagctggcctcaggcacaggag

SEQ ID NO: 7998511 - DNA, 22 bp, Homo sapiens
gagctggcctcaggcacaggag

SEQ ID NO: 7998512 - DNA, 22 bp, Homo sapiens
gagctggcctcaggcacaggag

SEQ ID NO: 7998513 - DNA, 22 bp, Homo sapiens
gagctggaggcagtgctgaggt

SEQ ID NO: 7998514 - DNA, 22 bp, Homo sapiens
gagctggaggcagtgctgaggt

SEQ ID NO: 7998515 - DNA, 22 bp, Homo sapiens
gagctggaggaccaggactggg

SEQ ID NO: 7998516 - DNA, 22 bp, Homo sapiens
gagctggaggaccaggactggg

SEQ ID NO: 7998517 - DNA, 22 bp, Homo sapiens
gagctggaggaccaggactggg

SEQ ID NO: 7998518 - DNA, 22 bp, Homo sapiens
gagctggactttcagatacatc

SEQ ID NO: 7998519 - DNA, 22 bp, Homo sapiens
gagctggactttcagatacatc

SEQ ID NO: 7998520 - DNA, 22 bp, Homo sapiens
gagctggaagtctgtggtcaga

SEQ ID NO: 7998521 - DNA, 22 bp, Homo sapiens
gagctggaagtctgtggtcaga

SEQ ID NO: 7998522 - DNA, 22 bp, Homo sapiens
gagctggaagtctgtggtcaga

SEQ ID NO: 7998523 - DNA, 22 bp, Homo sapiens
gagatcctgtaggcagctaaga

SEQ ID NO: 7998524 - DNA, 22 bp, Homo sapiens
gagctgcttgcccagaagcaga

SEQ ID NO: 7998525 - DNA, 22 bp, Homo sapiens
gagatccataagtgatagaaat

SEQ ID NO: 7998526 - DNA, 22 bp, Homo sapiens
gagatccagatttccattcctt

SEQ ID NO: 7998527 - DNA, 22 bp, Homo sapiens
gagatccagatttccattcctt

SEQ ID NO: 7998528 - DNA, 22 bp, Homo sapiens
gagctggccgcagagagggcag

SEQ ID NO: 7998529 - DNA, 22 bp, Homo sapiens
gagctggccgcagagagggcag

SEQ ID NO: 7998530 - DNA, 22 bp, Homo sapiens
gagctggccgcagagagggcag

SEQ ID NO: 7998531 - DNA, 22 bp, Homo sapiens
gagctggcaggaggctccccga

SEQ ID NO: 7998532 - DNA, 22 bp, Homo sapiens
gagctggcaggaggctccccga

SEQ ID NO: 7998533 - DNA, 22 bp, Homo sapiens
gagctggccgcagagagggcag

SEQ ID NO: 7998534 - DNA, 22 bp, Homo sapiens
gagctggccgcagagagggcag

SEQ ID NO: 7998535 - DNA, 22 bp, Homo sapiens
gagctggcagtggtagacatgg

SEQ ID NO: 7998536 - DNA, 22 bp, Homo sapiens
gagctggcagtggtagacatgg

SEQ ID NO: 7998537 - DNA, 22 bp, Homo sapiens
gagctggcacagaaggatctta

SEQ ID NO: 7998538 - DNA, 22 bp, Homo sapiens
gagctggcaatgacttgtgtat

SEQ ID NO: 7998539 - DNA, 22 bp, Homo sapiens
gagctggaggcagtgctgaggt

SEQ ID NO: 7998540 - DNA, 22 bp, Homo sapiens
gagctggaggcagtgctgaggt

SEQ ID NO: 7998541 - DNA, 22 bp, Homo sapiens
gagctggcacagaaggatctta

SEQ ID NO: 7998542 - DNA, 22 bp, Homo sapiens
gagctggcaggaggctccccga

SEQ ID NO: 7998543 - DNA, 22 bp, Homo sapiens
gagctggcacagaaggatctta

SEQ ID NO: 7998544 - DNA, 22 bp, Homo sapiens
gagctggcacagaaggatctta

SEQ ID NO: 7998545 - DNA, 22 bp, Homo sapiens
gagctggcacagaaggatctta

SEQ ID NO: 7998546 - DNA, 22 bp, Homo sapiens
gagctggcacagaaggatctta

SEQ ID NO: 7998547 - DNA, 22 bp, Homo sapiens
gagatatttattcatactgtca

SEQ ID NO: 7998548 - DNA, 22 bp, Homo sapiens
gagatatgttggcagctggtat

SEQ ID NO: 7998549 - DNA, 22 bp, Homo sapiens
gagatatgttggcagctggtat

SEQ ID NO: 7998550 - DNA, 19 bp, Homo sapiens
gagatatagaagtagatgt

SEQ ID NO: 7998551 - DNA, 22 bp, Homo sapiens
gagatcatggcttctgctgata

SEQ ID NO: 7998552 - DNA, 22 bp, Homo sapiens
gagatccacacatttagggtgc

SEQ ID NO: 7998553 - DNA, 22 bp, Homo sapiens
gagatccagatttccattcctt

SEQ ID NO: 7998554 - DNA, 22 bp, Homo sapiens
gagatccacttaatttttttgc

SEQ ID NO: 7998555 - DNA, 22 bp, Homo sapiens
gagatccacttaatttttttgc

SEQ ID NO: 7998556 - DNA, 22 bp, Homo sapiens
gagatataagatctagaaagga

SEQ ID NO: 7998557 - DNA, 19 bp, Homo sapiens
gagatatagaagtagatgt

SEQ ID NO: 7998558 - DNA, 19 bp, Homo sapiens
gagatatagaagtagatgt

SEQ ID NO: 7998559 - DNA, 22 bp, Homo sapiens
gagatatattaacattaatctt

SEQ ID NO: 7998560 - DNA, 22 bp, Homo sapiens
gagatataacctaaaggtcact

SEQ ID NO: 7998561 - DNA, 22 bp, Homo sapiens
gagataaagctaccatgttgat

SEQ ID NO: 7998562 - DNA, 22 bp, Homo sapiens
gagagttctacctctgaaggcg

SEQ ID NO: 7998563 - DNA, 22 bp, Homo sapiens
gagataaagctaccatgttgat

SEQ ID NO: 7998564 - DNA, 22 bp, Homo sapiens
gagataataatcgcttgatgga

SEQ ID NO: 7998565 - DNA, 22 bp, Homo sapiens
gagataactctaggtcttcgag

SEQ ID NO: 7998566 - DNA, 22 bp, Homo sapiens
gagataaatttttgataaatat

SEQ ID NO: 7998567 - DNA, 22 bp, Homo sapiens
gagataaatttttgataaatat

SEQ ID NO: 7998568 - DNA, 22 bp, Homo sapiens
gagagtctagtgcacctagttt

SEQ ID NO: 7998569 - DNA, 22 bp, Homo sapiens
gagagtctagtgcacctagttt

SEQ ID NO: 7998570 - DNA, 22 bp, Homo sapiens
gagagtgaggcatcaggggcag

SEQ ID NO: 7998571 - DNA, 22 bp, Homo sapiens
gagagtgaggcctgggaatcta

SEQ ID NO: 7998572 - DNA, 22 bp, Homo sapiens
gagagtgaggcatcaggggcag

SEQ ID NO: 7998573 - DNA, 22 bp, Homo sapiens
gagagtgagatcctcctgggga

SEQ ID NO: 7998574 - DNA, 22 bp, Homo sapiens
gagagtgagatcctcctgggga

SEQ ID NO: 7998575 - DNA, 22 bp, Homo sapiens
gagagtgaggcatcaggggcag

SEQ ID NO: 7998576 - DNA, 22 bp, Homo sapiens
gagagtgagatcctcctgggga

SEQ ID NO: 7998577 - DNA, 22 bp, Homo sapiens
gagagtgctgaacggcaagggt

SEQ ID NO: 7998578 - DNA, 22 bp, Homo sapiens
gagagtggaaagcaagctgagt

SEQ ID NO: 7998579 - DNA, 22 bp, Homo sapiens
gagagtggaaagcaagctgagt

SEQ ID NO: 7998580 - DNA, 22 bp, Homo sapiens
gagagtgctgaacggcaagggt

SEQ ID NO: 7998581 - DNA, 22 bp, Homo sapiens
gagagtgatgaatggttaaaca

SEQ ID NO: 7998582 - DNA, 22 bp, Homo sapiens
gagagtggatggagctgcgaag

SEQ ID NO: 7998583 - DNA, 22 bp, Homo sapiens
gagagtggatggagctgcgaag

SEQ ID NO: 7998584 - DNA, 22 bp, Homo sapiens
gagagtggatggagctgcgaag

SEQ ID NO: 7998585 - DNA, 17 bp, Homo sapiens
gagagtgtattggatgc

SEQ ID NO: 7998586 - DNA, 22 bp, Homo sapiens
gagggatggtagttgacactga

SEQ ID NO: 7998587 - DNA, 22 bp, Homo sapiens
gagggatggtagttgacactga

SEQ ID NO: 7998588 - DNA, 22 bp, Homo sapiens
gagggcagagacagtgattcac

SEQ ID NO: 7998589 - DNA, 22 bp, Homo sapiens
gagggatgcagaaacagaggcc

SEQ ID NO: 7998590 - DNA, 22 bp, Homo sapiens
gagggatggtagttgacactga

SEQ ID NO: 7998591 - DNA, 22 bp, Homo sapiens
gagggatggtagttgacactga

SEQ ID NO: 7998592 - DNA, 22 bp, Homo sapiens
gagggatgcagaaacagaggcc

SEQ ID NO: 7998593 - DNA, 22 bp, Homo sapiens
gagggatgcagaaacagaggcc

SEQ ID NO: 7998594 - DNA, 22 bp, Homo sapiens
gaggctgggggctgccttcctc

SEQ ID NO: 7998595 - DNA, 22 bp, Homo sapiens
gaggctgggggctgccttcctc

SEQ ID NO: 7998596 - DNA, 16 bp, Homo sapiens
gagggcagaggcggaa

SEQ ID NO: 7998597 - DNA, 16 bp, Homo sapiens
gagggcagaggcggaa

SEQ ID NO: 7998598 - DNA, 22 bp, Homo sapiens
gagggcagagacagtgattcac

SEQ ID NO: 7998599 - DNA, 22 bp, Homo sapiens
gagggcagagacagtgattcac

SEQ ID NO: 7998600 - DNA, 16 bp, Homo sapiens
gagggcagaggcggaa

SEQ ID NO: 7998601 - DNA, 22 bp, Homo sapiens
gagggcagagtctaatgatgca

SEQ ID NO: 7998602 - DNA, 16 bp, Homo sapiens
gagggcagaggcggaa

SEQ ID NO: 7998603 - DNA, 16 bp, Homo sapiens
gagggcagaggcggaa

SEQ ID NO: 7998604 - DNA, 22 bp, Homo sapiens
gaggctgggaagtccaagatca

SEQ ID NO: 7998605 - DNA, 22 bp, Homo sapiens
gaggctgggaagtccaagacca

SEQ ID NO: 7998606 - DNA, 22 bp, Homo sapiens
gaggctgggaagtccaagacca

SEQ ID NO: 7998607 - DNA, 22 bp, Homo sapiens
gaggctgggaagtccaagacca

SEQ ID NO: 7998608 - DNA, 22 bp, Homo sapiens
gaggctgggaagtccaagacca

SEQ ID NO: 7998609 - DNA, 22 bp, Homo sapiens
gaggctgggaagtccaagacca

SEQ ID NO: 7998610 - DNA, 22 bp, Homo sapiens
gaggctgggaagtccaagacca

SEQ ID NO: 7998611 - DNA, 22 bp, Homo sapiens
gaggctgggaagtccaagacca

SEQ ID NO: 7998612 - DNA, 22 bp, Homo sapiens
gaggctgggaagtccaagacca

SEQ ID NO: 7998613 - DNA, 22 bp, Homo sapiens
gaggctgggaagtccaagacca

SEQ ID NO: 7998614 - DNA, 22 bp, Homo sapiens
gaggctgggaagtccaagacca

SEQ ID NO: 7998615 - DNA, 22 bp, Homo sapiens
gaggctgggaagtccaagacca

SEQ ID NO: 7998616 - DNA, 22 bp, Homo sapiens
gaggctgggaagtccaatatca

SEQ ID NO: 7998617 - DNA, 22 bp, Homo sapiens
gaggctgggaagtccaagatca

SEQ ID NO: 7998618 - DNA, 22 bp, Homo sapiens
gaggctgggaagtccaagatca

SEQ ID NO: 7998619 - DNA, 22 bp, Homo sapiens
gaggctgggaagtccaagatca

SEQ ID NO: 7998620 - DNA, 22 bp, Homo sapiens
gaggctgggaagtccaagatca

SEQ ID NO: 7998621 - DNA, 22 bp, Homo sapiens
gaggctgggggctgccttcctc

SEQ ID NO: 7998622 - DNA, 22 bp, Homo sapiens
gaggctgggggctgccttcctc

SEQ ID NO: 7998623 - DNA, 22 bp, Homo sapiens
gaggctgggggctgccttcctc

SEQ ID NO: 7998624 - DNA, 22 bp, Homo sapiens
gaggctgggaagtccaatatca

SEQ ID NO: 7998625 - DNA, 22 bp, Homo sapiens
gaggctgggggctgccttcctc

SEQ ID NO: 7998626 - DNA, 22 bp, Homo sapiens
gaggctgggggctgccttcctc

SEQ ID NO: 7998627 - DNA, 22 bp, Homo sapiens
gaggctgggggctgccttcctc

SEQ ID NO: 7998628 - DNA, 22 bp, Homo sapiens
gaggctgggggctgccttcctc

SEQ ID NO: 7998629 - DNA, 22 bp, Homo sapiens
gaggctgggggctgccttcctc

SEQ ID NO: 7998630 - DNA, 22 bp, Homo sapiens
gaggcctgcagcgtggtccctg

SEQ ID NO: 7998631 - DNA, 22 bp, Homo sapiens
gaggcctgcagcgtggtccctg

SEQ ID NO: 7998632 - DNA, 22 bp, Homo sapiens
gaggcctgcagcgtggtccctg

SEQ ID NO: 7998633 - DNA, 22 bp, Homo sapiens
gaggcctgaggctgcctggagc

SEQ ID NO: 7998634 - DNA, 22 bp, Homo sapiens
gaggcctgctttggcactctgg

SEQ ID NO: 7998635 - DNA, 22 bp, Homo sapiens
gaggcctgctttggcactctgg

SEQ ID NO: 7998636 - DNA, 22 bp, Homo sapiens
gaggcctgctttggcactctgg

SEQ ID NO: 7998637 - DNA, 22 bp, Homo sapiens
gaggctgcccaactggagtgga

SEQ ID NO: 7998638 - DNA, 22 bp, Homo sapiens
gaggcctggaattccagcctgg

SEQ ID NO: 7998639 - DNA, 22 bp, Homo sapiens
gaggctgcccaactggagtgga

SEQ ID NO: 7998640 - DNA, 22 bp, Homo sapiens
gaggctggacgtgcatttctac

SEQ ID NO: 7998641 - DNA, 22 bp, Homo sapiens
gaggctggacgtgcatttctac

SEQ ID NO: 7998642 - DNA, 22 bp, Homo sapiens
gaggctggaatattagaaatgt

SEQ ID NO: 7998643 - DNA, 22 bp, Homo sapiens
gaggctgccccttcctcagctg

SEQ ID NO: 7998644 - DNA, 22 bp, Homo sapiens
gaggctgcccaactggagtgga

SEQ ID NO: 7998645 - DNA, 22 bp, Homo sapiens
gaggctgcccaactggagtgga

SEQ ID NO: 7998646 - DNA, 22 bp, Homo sapiens
gaggctgcccacacctgcgccg

SEQ ID NO: 7998647 - DNA, 22 bp, Homo sapiens
gaggctgcccacacctgcgccg

SEQ ID NO: 7998648 - DNA, 16 bp, Homo sapiens
gaggctggcagatgtc

SEQ ID NO: 7998649 - DNA, 16 bp, Homo sapiens
gaggctggcagatgtc

SEQ ID NO: 7998650 - DNA, 16 bp, Homo sapiens
gaggctggcagatgtc

SEQ ID NO: 7998651 - DNA, 22 bp, Homo sapiens
gaggctggcagaaaagcacagg

SEQ ID NO: 7998652 - DNA, 22 bp, Homo sapiens
gaggctggcagaaaagcacagg

SEQ ID NO: 7998653 - DNA, 22 bp, Homo sapiens
gaggctggcagaaaagcacagg

SEQ ID NO: 7998654 - DNA, 22 bp, Homo sapiens
gaggctggcagaaaagcacagg

SEQ ID NO: 7998655 - DNA, 22 bp, Homo sapiens
gaggctggcagaaaagcacagg

SEQ ID NO: 7998656 - DNA, 22 bp, Homo sapiens
gaggctggcagaaaagcacagg

SEQ ID NO: 7998657 - DNA, 22 bp, Homo sapiens
gaggctggcagaaaagcacagg

SEQ ID NO: 7998658 - DNA, 22 bp, Homo sapiens
gaggctggcagaaaagcacagg

SEQ ID NO: 7998659 - DNA, 22 bp, Homo sapiens
gaggctggaggtcaaagatgaa

SEQ ID NO: 7998660 - DNA, 22 bp, Homo sapiens
gaggctggaggtcaaagatgaa

SEQ ID NO: 7998661 - DNA, 22 bp, Homo sapiens
gaggctggagatattccaatct

SEQ ID NO: 7998662 - DNA, 22 bp, Homo sapiens
gaggctggagatattccaatct

SEQ ID NO: 7998663 - DNA, 22 bp, Homo sapiens
gaggctggagatattccaatct

SEQ ID NO: 7998664 - DNA, 22 bp, Homo sapiens
gaggctggaggtcaaagatgaa

SEQ ID NO: 7998665 - DNA, 22 bp, Homo sapiens
gaggctggaggtcaaagatgaa

SEQ ID NO: 7998666 - DNA, 22 bp, Homo sapiens
gaggctggaggtcaaagatgaa

SEQ ID NO: 7998667 - DNA, 22 bp, Homo sapiens
gaggggatgcagagaggcttat

SEQ ID NO: 7998668 - DNA, 22 bp, Homo sapiens
gaggggatgcagagaggcttat

SEQ ID NO: 7998669 - DNA, 22 bp, Homo sapiens
gaggggagtgtcctccgggccc

SEQ ID NO: 7998670 - DNA, 22 bp, Homo sapiens
gaggggagtgtcctccgggccc

SEQ ID NO: 7998671 - DNA, 22 bp, Homo sapiens
gaggggagtaaagtcatgttac

SEQ ID NO: 7998672 - DNA, 22 bp, Homo sapiens
gaggggagtaaagtcatgttac

SEQ ID NO: 7998673 - DNA, 22 bp, Homo sapiens
gaggggagtaaagtcatgttac

SEQ ID NO: 7998674 - DNA, 22 bp, Homo sapiens
gaggggagtgtcctccgggccc

SEQ ID NO: 7998675 - DNA, 22 bp, Homo sapiens
gaggggagtgtcctccgggccc

SEQ ID NO: 7998676 - DNA, 22 bp, Homo sapiens
gaggggagtgtcctccgggccc

SEQ ID NO: 7998677 - DNA, 22 bp, Homo sapiens
gaggggcaatgagggaaagagt

SEQ ID NO: 7998678 - DNA, 22 bp, Homo sapiens
gaggggcaatgagggaaagagt

SEQ ID NO: 7998679 - DNA, 22 bp, Homo sapiens
gaggggcaatgagggaaagagt

SEQ ID NO: 7998680 - DNA, 22 bp, Homo sapiens
gaggggattggaaggaacaccc

SEQ ID NO: 7998681 - DNA, 22 bp, Homo sapiens
gaggggcaagaagttggcctct

SEQ ID NO: 7998682 - DNA, 22 bp, Homo sapiens
gaggggcaagaagttggcctct

SEQ ID NO: 7998683 - DNA, 22 bp, Homo sapiens
gaggggcaatgagggaaagagt

SEQ ID NO: 7998684 - DNA, 22 bp, Homo sapiens
gaggggcaatgagggaaagagt

SEQ ID NO: 7998685 - DNA, 22 bp, Homo sapiens
gaggggcaatgagggaaagagt

SEQ ID NO: 7998686 - DNA, 22 bp, Homo sapiens
gaggggcacagcagctgttgca

SEQ ID NO: 7998687 - DNA, 22 bp, Homo sapiens
gaggggcacagcagctgttgca

SEQ ID NO: 7998688 - DNA, 22 bp, Homo sapiens
gaggggcacagtaaagggtccc

SEQ ID NO: 7998689 - DNA, 22 bp, Homo sapiens
gaggggcacagtaaagggtccc

SEQ ID NO: 7998690 - DNA, 22 bp, Homo sapiens
gaggggcacagtaaagggtccc

SEQ ID NO: 7998691 - DNA, 22 bp, Homo sapiens
gaggggcacagtaaagggtccc

SEQ ID NO: 7998692 - DNA, 22 bp, Homo sapiens
gaggggcacagtaaagggtccc

SEQ ID NO: 7998693 - DNA, 22 bp, Homo sapiens
gaggggcagaggtagagaacaa

SEQ ID NO: 7998694 - DNA, 22 bp, Homo sapiens
gaggggcagaatgtgatcaggg

SEQ ID NO: 7998695 - DNA, 22 bp, Homo sapiens
gaggggcagaatgtgatcaggg

SEQ ID NO: 7998696 - DNA, 22 bp, Homo sapiens
gaggggcagaatgtgatcaggg

SEQ ID NO: 7998697 - DNA, 22 bp, Homo sapiens
gaggggcagaatgtgatcaggg

SEQ ID NO: 7998698 - DNA, 22 bp, Homo sapiens
gaggggcagaatgtgatcaggg

SEQ ID NO: 7998699 - DNA, 22 bp, Homo sapiens
gaggggcagaggtagagaacaa

SEQ ID NO: 7998700 - DNA, 22 bp, Homo sapiens
gaggggcagaggtagagaacaa

SEQ ID NO: 7998701 - DNA, 22 bp, Homo sapiens
gaggggcagaggtagagaacaa

SEQ ID NO: 7998702 - DNA, 22 bp, Homo sapiens
gaggggcagaggtagagaacaa

SEQ ID NO: 7998703 - DNA, 22 bp, Homo sapiens
gaggggcagaggtagagaacaa

SEQ ID NO: 7998704 - DNA, 21 bp, Homo sapiens
gaggggcagctcttagcatta

SEQ ID NO: 7998705 - DNA, 21 bp, Homo sapiens
gaggggcagctcttagcatta

SEQ ID NO: 7998706 - DNA, 22 bp, Homo sapiens
gaggggcaggattattgggatt

SEQ ID NO: 7998707 - DNA, 22 bp, Homo sapiens
gaggggcaggattattgggatt

SEQ ID NO: 7998708 - DNA, 22 bp, Homo sapiens
gaggggcagtgcacccgggccc

SEQ ID NO: 7998709 - DNA, 22 bp, Homo sapiens
gaggggccggcatgtgcctctc

SEQ ID NO: 7998710 - DNA, 22 bp, Homo sapiens
gaggggcagttgattgtgctat

SEQ ID NO: 7998711 - DNA, 22 bp, Homo sapiens
gaggggcagttgattgtgctat

SEQ ID NO: 7998712 - DNA, 22 bp, Homo sapiens
gaggggcagttgattgtgctat

SEQ ID NO: 7998713 - DNA, 22 bp, Homo sapiens
gagggccaaagagcaagagcct

SEQ ID NO: 7998714 - DNA, 22 bp, Homo sapiens
gagggccaaagagcaagagcct

SEQ ID NO: 7998715 - DNA, 22 bp, Homo sapiens
gagggccaactagcaccacttt

SEQ ID NO: 7998716 - DNA, 22 bp, Homo sapiens
gagggccaaagagcaagagcct

SEQ ID NO: 7998717 - DNA, 22 bp, Homo sapiens
gagggccaaagagcaagagcct

SEQ ID NO: 7998718 - DNA, 22 bp, Homo sapiens
gagggccaaagagcaagagcct

SEQ ID NO: 7998719 - DNA, 22 bp, Homo sapiens
gagggccaaagagcaagagcct

SEQ ID NO: 7998720 - DNA, 22 bp, Homo sapiens
gagggccaaagagcaagagcct

SEQ ID NO: 7998721 - DNA, 22 bp, Homo sapiens
gagggcagtgaattttgaagct

SEQ ID NO: 7998722 - DNA, 22 bp, Homo sapiens
gagggcagtgaattttgaagct

SEQ ID NO: 7998723 - DNA, 22 bp, Homo sapiens
gagggcagtgaattttgaagct

SEQ ID NO: 7998724 - DNA, 22 bp, Homo sapiens
gagggcagtgaattttgaagct

SEQ ID NO: 7998725 - DNA, 22 bp, Homo sapiens
gagggcatctagagcctaatcc

SEQ ID NO: 7998726 - DNA, 22 bp, Homo sapiens
gagggccaatgtgtccctgagc

SEQ ID NO: 7998727 - DNA, 22 bp, Homo sapiens
gagggccaactagcaccacttt

SEQ ID NO: 7998728 - DNA, 22 bp, Homo sapiens
gagggccaatggatttcaactg

SEQ ID NO: 7998729 - DNA, 22 bp, Homo sapiens
gaggggaaagtgtgaggctgcg

SEQ ID NO: 7998730 - DNA, 22 bp, Homo sapiens
gaggggaaagtgtgaggctgcg

SEQ ID NO: 7998731 - DNA, 22 bp, Homo sapiens
gaggggaaagtgtgaggctgcg

SEQ ID NO: 7998732 - DNA, 22 bp, Homo sapiens
gaggggaaagtgtgaggctgcg

SEQ ID NO: 7998733 - DNA, 22 bp, Homo sapiens
gaggggaaagtgtgaggctgcg

SEQ ID NO: 7998734 - DNA, 22 bp, Homo sapiens
gaggggaaagtgtgaggctgcg

SEQ ID NO: 7998735 - DNA, 22 bp, Homo sapiens
gaggggaaagtgtgaggctgcg

SEQ ID NO: 7998736 - DNA, 22 bp, Homo sapiens
gaggggaaagttctgcacaagg

SEQ ID NO: 7998737 - DNA, 22 bp, Homo sapiens
gaggggaaagttctgcacaagg

SEQ ID NO: 7998738 - DNA, 22 bp, Homo sapiens
gaggggaagacttctggacagt

SEQ ID NO: 7998739 - DNA, 22 bp, Homo sapiens
gaggggaaagtgtgaggctgcg

SEQ ID NO: 7998740 - DNA, 22 bp, Homo sapiens
gaggggaaagtgtgaggctgcg

SEQ ID NO: 7998741 - DNA, 22 bp, Homo sapiens
gagggcagtagcctcgtaccct

SEQ ID NO: 7998742 - DNA, 22 bp, Homo sapiens
gagggcagtagcctcgtaccct

SEQ ID NO: 7998743 - DNA, 22 bp, Homo sapiens
gagggcagtagcctcgtaccct

SEQ ID NO: 7998744 - DNA, 22 bp, Homo sapiens
gagggcagtagcctcgtaccct

SEQ ID NO: 7998745 - DNA, 22 bp, Homo sapiens
gagggcagtagcctcgtaccct

SEQ ID NO: 7998746 - DNA, 22 bp, Homo sapiens
gagggcaggggtcttgcacggt

SEQ ID NO: 7998747 - DNA, 22 bp, Homo sapiens
gagggcaggggtcttgcacggt

SEQ ID NO: 7998748 - DNA, 20 bp, Homo sapiens
gagggcaggcacccatttca

SEQ ID NO: 7998749 - DNA, 20 bp, Homo sapiens
gagggcaggcacccatttca

SEQ ID NO: 7998750 - DNA, 20 bp, Homo sapiens
gagggcaggcacccatttca

SEQ ID NO: 7998751 - DNA, 22 bp, Homo sapiens
gagggcaggggtcttgcacggt

SEQ ID NO: 7998752 - DNA, 22 bp, Homo sapiens
gagggcaggggtcttgcacggt

SEQ ID NO: 7998753 - DNA, 22 bp, Homo sapiens
gagggcaggggtcttgcacggt

SEQ ID NO: 7998754 - DNA, 22 bp, Homo sapiens
gagggcaggggtcttgcacggt

SEQ ID NO: 7998755 - DNA, 22 bp, Homo sapiens
gagggcagagtctaatgatgca

SEQ ID NO: 7998756 - DNA, 20 bp, Homo sapiens
gagggcaggcacccatttca

SEQ ID NO: 7998757 - DNA, 20 bp, Homo sapiens
gagggcaggcacccatttca

SEQ ID NO: 7998758 - DNA, 22 bp, Homo sapiens
gagggcagagtctaatgatgca

SEQ ID NO: 7998759 - DNA, 22 bp, Homo sapiens
gagggcagagtctaatgatgca

SEQ ID NO: 7998760 - DNA, 22 bp, Homo sapiens
gagggcagagtctaatgatgca

SEQ ID NO: 7998761 - DNA, 22 bp, Homo sapiens
gaggggctctttaatagtaaca

SEQ ID NO: 7998762 - DNA, 22 bp, Homo sapiens
gaggggctctttaatagtaaca

SEQ ID NO: 7998763 - DNA, 22 bp, Homo sapiens
gagggttggtgcaaatgggatg

SEQ ID NO: 7998764 - DNA, 22 bp, Homo sapiens
gaggggctcttgggcatgaagg

SEQ ID NO: 7998765 - DNA, 22 bp, Homo sapiens
gaggggctcttgggcatgaagg

SEQ ID NO: 7998766 - DNA, 22 bp, Homo sapiens
gaggggcgtcctgagtgggcct

SEQ ID NO: 7998767 - DNA, 22 bp, Homo sapiens
gaggggcgtcctgagtgggcct

SEQ ID NO: 7998768 - DNA, 22 bp, Homo sapiens
gaggggcgtcctgagtgggcct

SEQ ID NO: 7998769 - DNA, 22 bp, Homo sapiens
gaggggcgtcctgagtgggcct

SEQ ID NO: 7998770 - DNA, 22 bp, Homo sapiens
gaggggcctggcgaggacatgt

SEQ ID NO: 7998771 - DNA, 22 bp, Homo sapiens
gaggggcctggcactgagctgg

SEQ ID NO: 7998772 - DNA, 22 bp, Homo sapiens
gaggggcctggcgaggacatgt

SEQ ID NO: 7998773 - DNA, 22 bp, Homo sapiens
gaggggcctggcgaggacatgt

SEQ ID NO: 7998774 - DNA, 22 bp, Homo sapiens
gaggggcctggcgaggacatgt

SEQ ID NO: 7998775 - DNA, 22 bp, Homo sapiens
gaggggcctggcactgagctgg

SEQ ID NO: 7998776 - DNA, 22 bp, Homo sapiens
gaggggcctggcactgagctgg

SEQ ID NO: 7998777 - DNA, 22 bp, Homo sapiens
gaggggcctggcactgagctgg

SEQ ID NO: 7998778 - DNA, 22 bp, Homo sapiens
gaggggccggcatgtgcctctc

SEQ ID NO: 7998779 - DNA, 22 bp, Homo sapiens
gaggtaggtgtaggaggcctgc

SEQ ID NO: 7998780 - DNA, 22 bp, Homo sapiens
gaggtaggtgtaggaggcctgc

SEQ ID NO: 7998781 - DNA, 22 bp, Homo sapiens
gaggtaggtgtaggaggcctgc

SEQ ID NO: 7998782 - DNA, 22 bp, Homo sapiens
gaggtaacaactgaaatgagaa

SEQ ID NO: 7998783 - DNA, 22 bp, Homo sapiens
gaggtaacactgttcagtgggc

SEQ ID NO: 7998784 - DNA, 22 bp, Homo sapiens
gaggtaggtgtaggaggcctgc

SEQ ID NO: 7998785 - DNA, 22 bp, Homo sapiens
gaggtaggtgtaggaggcctgc

SEQ ID NO: 7998786 - DNA, 22 bp, Homo sapiens
gaggtaggtgtaggaggcctgc

SEQ ID NO: 7998787 - DNA, 22 bp, Homo sapiens
gaggtatagttctattagatga

SEQ ID NO: 7998788 - DNA, 22 bp, Homo sapiens
gaggtagtgagttaaacagatg

SEQ ID NO: 7998789 - DNA, 22 bp, Homo sapiens
gaggtagtgagcagctgaacta

SEQ ID NO: 7998790 - DNA, 22 bp, Homo sapiens
gaggtagtaagcagagtggggt

SEQ ID NO: 7998791 - DNA, 22 bp, Homo sapiens
gaggtaggtgtaggaggcctgc

SEQ ID NO: 7998792 - DNA, 23 bp, Homo sapiens
gaggtcaaggctgcagtgattgc

SEQ ID NO: 7998793 - DNA, 22 bp, Homo sapiens
gaggtatgttatttcttgaaac

SEQ ID NO: 7998794 - DNA, 22 bp, Homo sapiens
gaggtattggccattgtctgtt

SEQ ID NO: 7998795 - DNA, 22 bp, Homo sapiens
gaggtatttgatcctctgcagt

SEQ ID NO: 7998796 - DNA, 22 bp, Homo sapiens
gaggtatcttagagagtgtaga

SEQ ID NO: 7998797 - DNA, 22 bp, Homo sapiens
gaggtatgtatgctacattctt

SEQ ID NO: 7998798 - DNA, 22 bp, Homo sapiens
gaggtatggatatctggagagg

SEQ ID NO: 7998799 - DNA, 22 bp, Homo sapiens
gaggtatgttatttcttgaaac

SEQ ID NO: 7998800 - DNA, 19 bp, Homo sapiens
gaggtcagcaagaagtatt

SEQ ID NO: 7998801 - DNA, 19 bp, Homo sapiens
gaggtcagcaagaagtatt

SEQ ID NO: 7998802 - DNA, 19 bp, Homo sapiens
gaggtcagcaagaagtatt

SEQ ID NO: 7998803 - DNA, 22 bp, Homo sapiens
gaggtcaaggtcaagagacaga

SEQ ID NO: 7998804 - DNA, 22 bp, Homo sapiens
gaggtgggatgtgtgtgctact

SEQ ID NO: 7998805 - DNA, 22 bp, Homo sapiens
gaggtgggatgtgtgtgctact

SEQ ID NO: 7998806 - DNA, 22 bp, Homo sapiens
gaggtgggatgtgtgtgctact

SEQ ID NO: 7998807 - DNA, 22 bp, Homo sapiens
gaggtgggatgtgtgtgctact

SEQ ID NO: 7998808 - DNA, 22 bp, Homo sapiens
gaggtgggatgtgtgtgctact

SEQ ID NO: 7998809 - DNA, 22 bp, Homo sapiens
gaggtgggcggatcacaaggtc

SEQ ID NO: 7998810 - DNA, 22 bp, Homo sapiens
gaggtgggcggatcacaaggtc

SEQ ID NO: 7998811 - DNA, 22 bp, Homo sapiens
gaggtgggcggatcacaaggtc

SEQ ID NO: 7998812 - DNA, 22 bp, Homo sapiens
gaggtggggttttgttcttgaa

SEQ ID NO: 7998813 - DNA, 22 bp, Homo sapiens
gaggtgggcggatcacaaggtc

SEQ ID NO: 7998814 - DNA, 22 bp, Homo sapiens
gaggtgggcggatcacaaggtc

SEQ ID NO: 7998815 - DNA, 22 bp, Homo sapiens
gaggtgggcggatcacaaggtc

SEQ ID NO: 7998816 - DNA, 22 bp, Homo sapiens
gaggtgggcggatcacaaggtc

SEQ ID NO: 7998817 - DNA, 22 bp, Homo sapiens
gaggtgggcggatcacaaggtc

SEQ ID NO: 7998818 - DNA, 22 bp, Homo sapiens
gaggtccagggtggggcctgag

SEQ ID NO: 7998819 - DNA, 22 bp, Homo sapiens
gaggtccagggtggggcctgag

SEQ ID NO: 7998820 - DNA, 22 bp, Homo sapiens
gaggtccagccaagcggcaagg

SEQ ID NO: 7998821 - DNA, 22 bp, Homo sapiens
gaggtccagggtggggcctgag

SEQ ID NO: 7998822 - DNA, 22 bp, Homo sapiens
gaggtccagccaagcggcaagg

SEQ ID NO: 7998823 - DNA, 22 bp, Homo sapiens
gaggtccagagcaggttcagtg

SEQ ID NO: 7998824 - DNA, 22 bp, Homo sapiens
gaggtccagagcaggttcagtg

SEQ ID NO: 7998825 - DNA, 22 bp, Homo sapiens
gaggtccagagcaggttcagtg

SEQ ID NO: 7998826 - DNA, 22 bp, Homo sapiens
gaggtccagggtggggcctgag

SEQ ID NO: 7998827 - DNA, 22 bp, Homo sapiens
gaggtccatacagctattctac

SEQ ID NO: 7998828 - DNA, 22 bp, Homo sapiens
gaggtccagggtggggcctgag

SEQ ID NO: 7998829 - DNA, 22 bp, Homo sapiens
gaggtccagggtggggcctgag

SEQ ID NO: 7998830 - DNA, 22 bp, Homo sapiens
gaggtccagggtggggcctgag

SEQ ID NO: 7998831 - DNA, 22 bp, Homo sapiens
gaggtcccccatggctgtgact

SEQ ID NO: 7998832 - DNA, 22 bp, Homo sapiens
gaggtccactgaggcaacaggg

SEQ ID NO: 7998833 - DNA, 22 bp, Homo sapiens
gaggtccactgaggcaacaggg

SEQ ID NO: 7998834 - DNA, 22 bp, Homo sapiens
gaggtccactgaggcaacaggg

SEQ ID NO: 7998835 - DNA, 22 bp, Homo sapiens
gaggtccaacacaatgggtgtt

SEQ ID NO: 7998836 - DNA, 22 bp, Homo sapiens
gaggtcattgttgcattaattg

SEQ ID NO: 7998837 - DNA, 22 bp, Homo sapiens
gaggtcatgcaaaattgaatca

SEQ ID NO: 7998838 - DNA, 22 bp, Homo sapiens
gaggtcattacactttgtttgt

SEQ ID NO: 7998839 - DNA, 22 bp, Homo sapiens
gaggtcaggggagaggctgatg

SEQ ID NO: 7998840 - DNA, 22 bp, Homo sapiens
gaggtcaggggagaggctgatg

SEQ ID NO: 7998841 - DNA, 22 bp, Homo sapiens
gaggtcaggtgaggaattaaga

SEQ ID NO: 7998842 - DNA, 22 bp, Homo sapiens
gaggtcagtcagaccagggttt

SEQ ID NO: 7998843 - DNA, 22 bp, Homo sapiens
gaggtcatcaccaatatatgcc

SEQ ID NO: 7998844 - DNA, 22 bp, Homo sapiens
gaggtcataattggtttgtagt

SEQ ID NO: 7998845 - DNA, 22 bp, Homo sapiens
gaggtcataattggtttgtagt

SEQ ID NO: 7998846 - DNA, 22 bp, Homo sapiens
gaggtcaggcttgcagcagggt

SEQ ID NO: 7998847 - DNA, 22 bp, Homo sapiens
gaggtcaggctcaagctgggcc

SEQ ID NO: 7998848 - DNA, 22 bp, Homo sapiens
gaggtcaggctcaagctgggcc

SEQ ID NO: 7998849 - DNA, 22 bp, Homo sapiens
gaggtcaggctcaagctgggcc

SEQ ID NO: 7998850 - DNA, 22 bp, Homo sapiens
gaggtcaggctcaagctgggcc

SEQ ID NO: 7998851 - DNA, 22 bp, Homo sapiens
gaggtcaggctcaagctgggcc

SEQ ID NO: 7998852 - DNA, 22 bp, Homo sapiens
gaggtcaggggagaggctgatg

SEQ ID NO: 7998853 - DNA, 22 bp, Homo sapiens
gaggtcaggggagaggctgatg

SEQ ID NO: 7998854 - DNA, 22 bp, Homo sapiens
gaggtcaggcttgcagcagggt

SEQ ID NO: 7998855 - DNA, 22 bp, Homo sapiens
gaggtcaggcttgcagcagggt

SEQ ID NO: 7998856 - DNA, 22 bp, Homo sapiens
gaggtcaggcttgcagcagggt

SEQ ID NO: 7998857 - DNA, 22 bp, Homo sapiens
gagtcaggctagaggtgagtct

SEQ ID NO: 7998858 - DNA, 22 bp, Homo sapiens
gagtcaggctagaggtgagtct

SEQ ID NO: 7998859 - DNA, 22 bp, Homo sapiens
gagtcaggcatgaaggtaatta

SEQ ID NO: 7998860 - DNA, 22 bp, Homo sapiens
gagtcaggctagggtgacaggc

SEQ ID NO: 7998861 - DNA, 22 bp, Homo sapiens
gagtcaggatgcaaggggatgg

SEQ ID NO: 7998862 - DNA, 22 bp, Homo sapiens
gagtcaggcatgaaggtaatta

SEQ ID NO: 7998863 - DNA, 22 bp, Homo sapiens
gagtcaggcatgaaggtaatta

SEQ ID NO: 7998864 - DNA, 22 bp, Homo sapiens
gagtcaggagtcctgtgtgaga

SEQ ID NO: 7998865 - DNA, 22 bp, Homo sapiens
gagtcaggagtcctgtgtgaga

SEQ ID NO: 7998866 - DNA, 22 bp, Homo sapiens
gagtcaggagttatgctccacc

SEQ ID NO: 7998867 - DNA, 22 bp, Homo sapiens
gagtcaggatgcaaggggatgg

SEQ ID NO: 7998868 - DNA, 22 bp, Homo sapiens
gagtcagatgaagataaaaggg

SEQ ID NO: 7998869 - DNA, 22 bp, Homo sapiens
gagtcagatgaagataaaaggg

SEQ ID NO: 7998870 - DNA, 22 bp, Homo sapiens
gagtcagattgcagacagggct

SEQ ID NO: 7998871 - DNA, 22 bp, Homo sapiens
gagtcagaccgactgggctcat

SEQ ID NO: 7998872 - DNA, 22 bp, Homo sapiens
gagtcagatgaagataaaaggg

SEQ ID NO: 7998873 - DNA, 22 bp, Homo sapiens
gagtcagatgaagataaaaggg

SEQ ID NO: 7998874 - DNA, 22 bp, Homo sapiens
gagtcagaccgactgggctcat

SEQ ID NO: 7998875 - DNA, 22 bp, Homo sapiens
gagtcagattgcagacagggct

SEQ ID NO: 7998876 - DNA, 22 bp, Homo sapiens
gagtcagctagtctccttcttt

SEQ ID NO: 7998877 - DNA, 22 bp, Homo sapiens
gagtcagattgcagacagggct

SEQ ID NO: 7998878 - DNA, 22 bp, Homo sapiens
gagtcagattgcagacagggct

SEQ ID NO: 7998879 - DNA, 22 bp, Homo sapiens
gagtcagaattgtattttaaac

SEQ ID NO: 7998880 - DNA, 22 bp, Homo sapiens
gagtcagaatgtcctcctgcgg

SEQ ID NO: 7998881 - DNA, 22 bp, Homo sapiens
gagtcagaattgtattttaaac

SEQ ID NO: 7998882 - DNA, 22 bp, Homo sapiens
gagtcagacagggtcacccaga

SEQ ID NO: 7998883 - DNA, 22 bp, Homo sapiens
gagtcagaagaaactatttaca

SEQ ID NO: 7998884 - DNA, 22 bp, Homo sapiens
gagtcagaagaaactatttaca

SEQ ID NO: 7998885 - DNA, 22 bp, Homo sapiens
gagtcagaagaaactatttaca

SEQ ID NO: 7998886 - DNA, 22 bp, Homo sapiens
gagtcagaatgtcctcctgcgg

SEQ ID NO: 7998887 - DNA, 22 bp, Homo sapiens
gagtcaggctagggtgacaggc

SEQ ID NO: 7998888 - DNA, 22 bp, Homo sapiens
gagtcattgcacactagctcag

SEQ ID NO: 7998889 - DNA, 22 bp, Homo sapiens
gagtcatgcactgtctttctcc

SEQ ID NO: 7998890 - DNA, 22 bp, Homo sapiens
gagtcatgcactgtctttctcc

SEQ ID NO: 7998891 - DNA, 22 bp, Homo sapiens
gagtcagtaatggatatgtcat

SEQ ID NO: 7998892 - DNA, 22 bp, Homo sapiens
gagtcatttgggggcttcttga

SEQ ID NO: 7998893 - DNA, 22 bp, Homo sapiens
gagtccaagctagagccactca

SEQ ID NO: 7998894 - DNA, 22 bp, Homo sapiens
gagtcattgttggtccctcccc

SEQ ID NO: 7998895 - DNA, 22 bp, Homo sapiens
gagtcattgttggtccctcccc

SEQ ID NO: 7998896 - DNA, 22 bp, Homo sapiens
gagtccagttctttccagcagt

SEQ ID NO: 7998897 - DNA, 22 bp, Homo sapiens
gagtccagttctttccagcagt

SEQ ID NO: 7998898 - DNA, 22 bp, Homo sapiens
gagtccagagattaagcacctc

SEQ ID NO: 7998899 - DNA, 22 bp, Homo sapiens
gagtccagagattaagcacctc

SEQ ID NO: 7998900 - DNA, 22 bp, Homo sapiens
gagtccagttctttccagcagt

SEQ ID NO: 7998901 - DNA, 22 bp, Homo sapiens
gagtccagagattaagcacctc

SEQ ID NO: 7998902 - DNA, 22 bp, Homo sapiens
gagtccagacaccatacctgat

SEQ ID NO: 7998903 - DNA, 22 bp, Homo sapiens
gagtccagacaccatacctgat

SEQ ID NO: 7998904 - DNA, 18 bp, Homo sapiens
gagtccaataaatttctg

SEQ ID NO: 7998905 - DNA, 22 bp, Homo sapiens
gagtccacttaagtatctgcag

SEQ ID NO: 7998906 - DNA, 22 bp, Homo sapiens
gagtcctcagatagaaagtgcg

SEQ ID NO: 7998907 - DNA, 22 bp, Homo sapiens
gagtcctcaacggggagaggcg

SEQ ID NO: 7998908 - DNA, 22 bp, Homo sapiens
gagtcctgaatcctgtggcaac

SEQ ID NO: 7998909 - DNA, 22 bp, Homo sapiens
gagtcccatgatgatagccaca

SEQ ID NO: 7998910 - DNA, 22 bp, Homo sapiens
gagtcccatgatgatagccaca

SEQ ID NO: 7998911 - DNA, 22 bp, Homo sapiens
gagtccagttgttcacagaggc

SEQ ID NO: 7998912 - DNA, 22 bp, Homo sapiens
gagtccagttgttcacagaggc

SEQ ID NO: 7998913 - DNA, 22 bp, Homo sapiens
gagtccagttgttcacagaggc

SEQ ID NO: 7998914 - DNA, 22 bp, Homo sapiens
gagtccagttctttccagcagt

SEQ ID NO: 7998915 - DNA, 22 bp, Homo sapiens
gagtccagttgttcacagaggc

SEQ ID NO: 7998916 - DNA, 22 bp, Homo sapiens
gagtcccaggatatgtgctgtt

SEQ ID NO: 7998917 - DNA, 22 bp, Homo sapiens
gagtccagttgttcacagaggc

SEQ ID NO: 7998918 - DNA, 22 bp, Homo sapiens
gagtccagttgttcacagaggc

SEQ ID NO: 7998919 - DNA, 22 bp, Homo sapiens
gagtcccaggaatgagcatagt

SEQ ID NO: 7998920 - DNA, 22 bp, Homo sapiens
gagtcagaaactcactctatag

SEQ ID NO: 7998921 - DNA, 22 bp, Homo sapiens
gagtcagaaactcactctatag

SEQ ID NO: 7998922 - DNA, 22 bp, Homo sapiens
gagtcagaaactcactctatag

SEQ ID NO: 7998923 - DNA, 22 bp, Homo sapiens
gagtcagaaagtagtgtgccta

SEQ ID NO: 7998924 - DNA, 22 bp, Homo sapiens
gagtcagaaagtagtgtgccta

SEQ ID NO: 7998925 - DNA, 22 bp, Homo sapiens
gagtcactgtttcccggctctg

SEQ ID NO: 7998926 - DNA, 22 bp, Homo sapiens
gagtcacatactatgtaataga

SEQ ID NO: 7998927 - DNA, 22 bp, Homo sapiens
gaggtgtctgctgtgttcaaag

SEQ ID NO: 7998928 - DNA, 22 bp, Homo sapiens
gaggtgtcatcaggcagctctg

SEQ ID NO: 7998929 - DNA, 22 bp, Homo sapiens
gaggtgtcgtagattattctca

SEQ ID NO: 7998930 - DNA, 22 bp, Homo sapiens
gaggtgtcctcagccaactctg

SEQ ID NO: 7998931 - DNA, 22 bp, Homo sapiens
gaggtgtcctagaagtattcag

SEQ ID NO: 7998932 - DNA, 22 bp, Homo sapiens
gaggtgggtgtatcacaggtca

SEQ ID NO: 7998933 - DNA, 22 bp, Homo sapiens
gaggtgggtgtatcacaggtca

SEQ ID NO: 7998934 - DNA, 22 bp, Homo sapiens
gaggtgggtgtatcacaggtca

SEQ ID NO: 7998935 - DNA, 22 bp, Homo sapiens
gaggtgggtgtatcacaggtca

SEQ ID NO: 7998936 - DNA, 22 bp, Homo sapiens
gaggtgggtgtatcacaggtca

SEQ ID NO: 7998937 - DNA, 22 bp, Homo sapiens
gaggtgggtgtatcacaggtca

SEQ ID NO: 7998938 - DNA, 22 bp, Homo sapiens
gaggtgggtgtatcacaggtca

SEQ ID NO: 7998939 - DNA, 19 bp, Homo sapiens
gaggtgggtccccgcagcc

SEQ ID NO: 7998940 - DNA, 19 bp, Homo sapiens
gaggtgggtccccgcagcc

SEQ ID NO: 7998941 - DNA, 19 bp, Homo sapiens
gaggtgggtccccgcagcc

SEQ ID NO: 7998942 - DNA, 19 bp, Homo sapiens
gaggtgggtccccgcagcc

SEQ ID NO: 7998943 - DNA, 19 bp, Homo sapiens
gaggtgggtccccgcagcc

SEQ ID NO: 7998944 - DNA, 22 bp, Homo sapiens
gaggtgggtgtatcacaggtca

SEQ ID NO: 7998945 - DNA, 22 bp, Homo sapiens
gaggtggtggtggaggcatagc

SEQ ID NO: 7998946 - DNA, 22 bp, Homo sapiens
gaggtggtggtggaggcatagc

SEQ ID NO: 7998947 - DNA, 22 bp, Homo sapiens
gaggtggtggtggaggcatagc

SEQ ID NO: 7998948 - DNA, 22 bp, Homo sapiens
gaggtggttcaggtagagccca

SEQ ID NO: 7998949 - DNA, 22 bp, Homo sapiens
gaggtggttcaggtagagccca

SEQ ID NO: 7998950 - DNA, 22 bp, Homo sapiens
gaggtgtcagggtagtcatgat

SEQ ID NO: 7998951 - DNA, 22 bp, Homo sapiens
gaggtgtcagggtagtcatgat

SEQ ID NO: 7998952 - DNA, 22 bp, Homo sapiens
gagtcctgttgtcccagatggg

SEQ ID NO: 7998953 - DNA, 22 bp, Homo sapiens
gagtcctgttttgaggacttga

SEQ ID NO: 7998954 - DNA, 19 bp, Homo sapiens
gagtcctgtgctccttgtt

SEQ ID NO: 7998955 - DNA, 19 bp, Homo sapiens
gagtcctgtgctccttgtt

SEQ ID NO: 7998956 - DNA, 22 bp, Homo sapiens
gagtcctgtaactttcttccta

SEQ ID NO: 7998957 - DNA, 22 bp, Homo sapiens
gagtcctgtaactttcttccta

SEQ ID NO: 7998958 - DNA, 22 bp, Homo sapiens
gagtcctgcccttgtgtagtcc

SEQ ID NO: 7998959 - DNA, 22 bp, Homo sapiens
gagtcctgcccttgtgtagtcc

SEQ ID NO: 7998960 - DNA, 22 bp, Homo sapiens
gagtcctggaaccctgaatgct

SEQ ID NO: 7998961 - DNA, 22 bp, Homo sapiens
gagtcctgctttcaattctttt

SEQ ID NO: 7998962 - DNA, 22 bp, Homo sapiens
gagtcctggaaccctgaatgct

SEQ ID NO: 7998963 - DNA, 21 bp, Homo sapiens
gagtcctggctagggtggcag

SEQ ID NO: 7998964 - DNA, 22 bp, Homo sapiens
gagtcctggcgtccaatttcct

SEQ ID NO: 7998965 - DNA, 22 bp, Homo sapiens
gagtctctggaggggtcagacc

SEQ ID NO: 7998966 - DNA, 22 bp, Homo sapiens
gagtcggaggcaggagacctgg

SEQ ID NO: 7998967 - DNA, 22 bp, Homo sapiens
gagtctatctcactcccccagg

SEQ ID NO: 7998968 - DNA, 22 bp, Homo sapiens
gagtctaagtagaatgtgaaaa

SEQ ID NO: 7998969 - DNA, 22 bp, Homo sapiens
gagtctcctactggctgtcctt

SEQ ID NO: 7998970 - DNA, 22 bp, Homo sapiens
gagtcgagcagaaagccgtcgg

SEQ ID NO: 7998971 - DNA, 22 bp, Homo sapiens
gagtcgagcagaaagccgtcgg

SEQ ID NO: 7998972 - DNA, 22 bp, Homo sapiens
gagtcggaggcaggagacctgg

SEQ ID NO: 7998973 - DNA, 22 bp, Homo sapiens
gagtcggaggcaggagacctgg

SEQ ID NO: 7998974 - DNA, 22 bp, Homo sapiens
gagtcgagcagaaagccgtcgg

SEQ ID NO: 7998975 - DNA, 22 bp, Homo sapiens
gagtccttttcatagcagtggg

SEQ ID NO: 7998976 - DNA, 22 bp, Homo sapiens
gagtccttctggctggcaggat

SEQ ID NO: 7998977 - DNA, 22 bp, Homo sapiens
gagtgagggcagcaggggctgc

SEQ ID NO: 7998978 - DNA, 22 bp, Homo sapiens
gagtgagggcagcaggggctgc

SEQ ID NO: 7998979 - DNA, 22 bp, Homo sapiens
gagtgaggctggaatcatggct

SEQ ID NO: 7998980 - DNA, 22 bp, Homo sapiens
gagtgaggctggaatcatggct

SEQ ID NO: 7998981 - DNA, 22 bp, Homo sapiens
gagtgactgtatcattttacat

SEQ ID NO: 7998982 - DNA, 22 bp, Homo sapiens
gagtgactctagaaagtttctt

SEQ ID NO: 7998983 - DNA, 22 bp, Homo sapiens
gagtgaggctggaatcatggct

SEQ ID NO: 7998984 - DNA, 22 bp, Homo sapiens
gagtgaggctggaatcatggct

SEQ ID NO: 7998985 - DNA, 22 bp, Homo sapiens
gagtgagggccaacatccagct

SEQ ID NO: 7998986 - DNA, 22 bp, Homo sapiens
gagtgagggccaacatccagct

SEQ ID NO: 7998987 - DNA, 22 bp, Homo sapiens
gagtgagggccaacatccagct

SEQ ID NO: 7998988 - DNA, 22 bp, Homo sapiens
gagtgagggccaacatccagct

SEQ ID NO: 7998989 - DNA, 22 bp, Homo sapiens
gagtgagggccaacatccagct

SEQ ID NO: 7998990 - DNA, 22 bp, Homo sapiens
gagtgagggcagcaggggctgc

SEQ ID NO: 7998991 - DNA, 22 bp, Homo sapiens
gagtgatttccagagagacgtt

SEQ ID NO: 7998992 - DNA, 22 bp, Homo sapiens
gagtgcaagttcttccttcttc

SEQ ID NO: 7998993 - DNA, 22 bp, Homo sapiens
gagtgcaagttttgggtttctt

SEQ ID NO: 7998994 - DNA, 22 bp, Homo sapiens
gagtgatttaagctatttttaa

SEQ ID NO: 7998995 - DNA, 22 bp, Homo sapiens
gagtgattgctcctttaaactt

SEQ ID NO: 7998996 - DNA, 22 bp, Homo sapiens
gagtgcaatggcatgatctggg

SEQ ID NO: 7998997 - DNA, 22 bp, Homo sapiens
gagtgcaataaactgttttcta

SEQ ID NO: 7998998 - DNA, 22 bp, Homo sapiens
gagtgcagaaattcccttcctg

SEQ ID NO: 7998999 - DNA, 22 bp, Homo sapiens
gagtgcagaaattcccttcctg

SEQ ID NO: 7999000 - DNA, 22 bp, Homo sapiens
gagtgcaatgtagacatcaggg

SEQ ID NO: 7999001 - DNA, 22 bp, Homo sapiens
gagtgatgtctgtagtgaagaa

SEQ ID NO: 7999002 - DNA, 22 bp, Homo sapiens
gagtgagtagctacagttttta

SEQ ID NO: 7999003 - DNA, 22 bp, Homo sapiens
gagtcttaggcaaaaataatgg

SEQ ID NO: 7999004 - DNA, 22 bp, Homo sapiens
gagtcttctgagttattggata

SEQ ID NO: 7999005 - DNA, 22 bp, Homo sapiens
gagtcttctacgctcacacaaa

SEQ ID NO: 7999006 - DNA, 22 bp, Homo sapiens
gagtgaatgcgtggaggttgca

SEQ ID NO: 7999007 - DNA, 21 bp, Homo sapiens
gagtgaattggggagtttcca

SEQ ID NO: 7999008 - DNA, 22 bp, Homo sapiens
gagtgacaggaatatttatctg

SEQ ID NO: 7999009 - DNA, 22 bp, Homo sapiens
gagtgacaggaatatttatctg

SEQ ID NO: 7999010 - DNA, 22 bp, Homo sapiens
gagtctttggtaaagtctgctg

SEQ ID NO: 7999011 - DNA, 18 bp, Homo sapiens
gagtctttgttactgctg

SEQ ID NO: 7999012 - DNA, 22 bp, Homo sapiens
gagtctggccctgatgcatcat

SEQ ID NO: 7999013 - DNA, 22 bp, Homo sapiens
gagtctggtcattttctctccc

SEQ ID NO: 7999014 - DNA, 22 bp, Homo sapiens
gagtctggtgatggtcattgtc

SEQ ID NO: 7999015 - DNA, 22 bp, Homo sapiens
gagtctggactattctggtctt

SEQ ID NO: 7999016 - DNA, 22 bp, Homo sapiens
gagtctggaatgatgaagacct

SEQ ID NO: 7999017 - DNA, 22 bp, Homo sapiens
gagtctggactattctggtctt

SEQ ID NO: 7999018 - DNA, 22 bp, Homo sapiens
gagtctggccctgatgcatcat

SEQ ID NO: 7999019 - DNA, 22 bp, Homo sapiens
gagtctggactattctggtctt

SEQ ID NO: 7999020 - DNA, 22 bp, Homo sapiens
gagtctggccctgatgcatcat

SEQ ID NO: 7999021 - DNA, 22 bp, Homo sapiens
gagtctggaaactttgacaaaa

SEQ ID NO: 7999022 - DNA, 22 bp, Homo sapiens
gagtctggaatgatgaagacct

SEQ ID NO: 7999023 - DNA, 22 bp, Homo sapiens
gagtctggaatgatgaagacct

SEQ ID NO: 7999024 - DNA, 22 bp, Homo sapiens
gagtctgaggggagagctgggt

SEQ ID NO: 7999025 - DNA, 22 bp, Homo sapiens
gagtgctcgggcctctgcctgc

SEQ ID NO: 7999026 - DNA, 21 bp, Homo sapiens
gagtgctcagttaagtggaga

SEQ ID NO: 7999027 - DNA, 22 bp, Homo sapiens
gagtgctccgtcttggacaggg

SEQ ID NO: 7999028 - DNA, 22 bp, Homo sapiens
gagtgcctggggcatctcctgc

SEQ ID NO: 7999029 - DNA, 22 bp, Homo sapiens
gagtgccatgtgttacctctgg

SEQ ID NO: 7999030 - DNA, 22 bp, Homo sapiens
gagtgctagcattagtatataa

SEQ ID NO: 7999031 - DNA, 16 bp, Homo sapiens
gagtgctagaatcggg

SEQ ID NO: 7999032 - DNA, 22 bp, Homo sapiens
gagtgccagatggacctcttgg

SEQ ID NO: 7999033 - DNA, 22 bp, Homo sapiens
gagtgcgtgtttggggatgtgg

SEQ ID NO: 7999034 - DNA, 22 bp, Homo sapiens
gagtgcatcgtggccattttaa

SEQ ID NO: 7999035 - DNA, 22 bp, Homo sapiens
gagtgcatggactactggcttg

SEQ ID NO: 7999036 - DNA, 22 bp, Homo sapiens
gagtgccaagagaagaggctgg

SEQ ID NO: 7999037 - DNA, 22 bp, Homo sapiens
gagtgccaagagaagaggctgg

SEQ ID NO: 7999038 - DNA, 22 bp, Homo sapiens
gagtgccagatggacctcttgg

SEQ ID NO: 7999039 - DNA, 22 bp, Homo sapiens
gagtgcagttggggtgagggga

SEQ ID NO: 7999040 - DNA, 22 bp, Homo sapiens
gagtgcagttggggtgagggga

SEQ ID NO: 7999041 - DNA, 23 bp, Homo sapiens
gagtgcagaatagacatgcagtg

SEQ ID NO: 7999042 - DNA, 23 bp, Homo sapiens
gagtgcagaatagacatgcagtg

SEQ ID NO: 7999043 - DNA, 23 bp, Homo sapiens
gagtgcagaatagacatgcagtg

SEQ ID NO: 7999044 - DNA, 23 bp, Homo sapiens
gagtgcagaatagacatgcagtg

SEQ ID NO: 7999045 - DNA, 22 bp, Homo sapiens
gagtgcagtatgagaggctgct

SEQ ID NO: 7999046 - DNA, 22 bp, Homo sapiens
gagtgcagtatgagaggctgct

SEQ ID NO: 7999047 - DNA, 22 bp, Homo sapiens
gagtgcagtatgagaggctgct

SEQ ID NO: 7999048 - DNA, 22 bp, Homo sapiens
gagtgcagtatgagaggctgct

SEQ ID NO: 7999049 - DNA, 22 bp, Homo sapiens
gagtgcagtatgagaggctgct

SEQ ID NO: 7999050 - DNA, 22 bp, Homo sapiens
gagtgcagtatgagaggctgct

SEQ ID NO: 7999051 - DNA, 22 bp, Homo sapiens
gagtgcagtatgagaggctgct

SEQ ID NO: 7999052 - DNA, 22 bp, Homo sapiens
gagtgcagtatgagaggctgct

SEQ ID NO: 7999053 - DNA, 22 bp, Homo sapiens
gagtgcagtggcgtgatctctg

SEQ ID NO: 7999054 - DNA, 22 bp, Homo sapiens
gagtgcagttggggtgagggga

SEQ ID NO: 7999055 - DNA, 22 bp, Homo sapiens
gagtgcagtggcgtgatctctg

SEQ ID NO: 7999056 - DNA, 22 bp, Homo sapiens
gagtgctgaatgcgagaacaga

SEQ ID NO: 7999057 - DNA, 22 bp, Homo sapiens
gagtgctgaatgcgagaacaga

SEQ ID NO: 7999058 - DNA, 22 bp, Homo sapiens
gagtgctgctaatgcaagggtg

SEQ ID NO: 7999059 - DNA, 22 bp, Homo sapiens
gagtgctgcttgggatagtgag

SEQ ID NO: 7999060 - DNA, 22 bp, Homo sapiens
gagtgctgcttgggatagtgag

SEQ ID NO: 7999061 - DNA, 22 bp, Homo sapiens
gagtgctgctaatgcaagggtg

SEQ ID NO: 7999062 - DNA, 22 bp, Homo sapiens
gagtgctgctaatgcaagggtg

SEQ ID NO: 7999063 - DNA, 22 bp, Homo sapiens
gagtgctggaggtgtgagtggg

SEQ ID NO: 7999064 - DNA, 22 bp, Homo sapiens
gagtgctggaggtgtgagtggg

SEQ ID NO: 7999065 - DNA, 22 bp, Homo sapiens
gagtgctggaggtgtgagtggg

SEQ ID NO: 7999066 - DNA, 22 bp, Homo sapiens
gagtgctgcttgggatagtgag

SEQ ID NO: 7999067 - DNA, 22 bp, Homo sapiens
gagtgctggaggtgtgagtggg

SEQ ID NO: 7999068 - DNA, 22 bp, Homo sapiens
gagtgctggaggtgtgagtggg

SEQ ID NO: 7999069 - DNA, 22 bp, Homo sapiens
gagtgctggggtgcagagaggt

SEQ ID NO: 7999070 - DNA, 22 bp, Homo sapiens
gagtgctggaggtgtgagtggg

SEQ ID NO: 7999071 - DNA, 17 bp, Homo sapiens
gagtgctggtggagctc

SEQ ID NO: 7999072 - DNA, 17 bp, Homo sapiens
gagtgctggtggagctc

SEQ ID NO: 7999073 - DNA, 22 bp, Homo sapiens
gagtgctggggtgcagagaggt

SEQ ID NO: 7999074 - DNA, 22 bp, Homo sapiens
gagtgctggggtgcagagaggt

SEQ ID NO: 7999075 - DNA, 22 bp, Homo sapiens
gagtgctgtaggactgagccct

SEQ ID NO: 7999076 - DNA, 22 bp, Homo sapiens
gagtgctgtatctgagaaagca

SEQ ID NO: 7999077 - DNA, 17 bp, Homo sapiens
gagtgctggtggagctc

SEQ ID NO: 7999078 - DNA, 17 bp, Homo sapiens
gagtgctggtggagctc

SEQ ID NO: 7999079 - DNA, 17 bp, Homo sapiens
gagtgctggtggagctc

SEQ ID NO: 7999080 - DNA, 22 bp, Homo sapiens
gagtgctgtaggactgagccct

SEQ ID NO: 7999081 - DNA, 22 bp, Homo sapiens
gagtgctgtaggactgagccct

SEQ ID NO: 7999082 - DNA, 22 bp, Homo sapiens
gagtggggctttaaaggctcag

SEQ ID NO: 7999083 - DNA, 22 bp, Homo sapiens
gagtggggctttaaaggctcag

SEQ ID NO: 7999084 - DNA, 22 bp, Homo sapiens
gagtggggctttaaaggctcag

SEQ ID NO: 7999085 - DNA, 22 bp, Homo sapiens
gagtggggctttaaaggctcag

SEQ ID NO: 7999086 - DNA, 22 bp, Homo sapiens
gagtggggctttaaaggctcag

SEQ ID NO: 7999087 - DNA, 22 bp, Homo sapiens
gagtgggcaccgtgggcacact

SEQ ID NO: 7999088 - DNA, 21 bp, Homo sapiens
gagtgggacatgggagtggtt

SEQ ID NO: 7999089 - DNA, 21 bp, Homo sapiens
gagtgggacatgggagtggtt

SEQ ID NO: 7999090 - DNA, 21 bp, Homo sapiens
gagtgggacatgggagtggtt

SEQ ID NO: 7999091 - DNA, 22 bp, Homo sapiens
gagtggcttttttatggtaatg

SEQ ID NO: 7999092 - DNA, 22 bp, Homo sapiens
gagtggcttttttatggtaatg

SEQ ID NO: 7999093 - DNA, 21 bp, Homo sapiens
gagtgggacatgggagtggtt

SEQ ID NO: 7999094 - DNA, 22 bp, Homo sapiens
gagtggcatatgtgcctgtgaa

SEQ ID NO: 7999095 - DNA, 22 bp, Homo sapiens
gagtggccagtggtggcatgtc

SEQ ID NO: 7999096 - DNA, 22 bp, Homo sapiens
gagtggctaaagtatgtcatgg

SEQ ID NO: 7999097 - DNA, 22 bp, Homo sapiens
gagtggctacaggcagcttaca

SEQ ID NO: 7999098 - DNA, 22 bp, Homo sapiens
gagtggctattgatccgtgatg

SEQ ID NO: 7999099 - DNA, 22 bp, Homo sapiens
gagtggctattgatccgtgatg

SEQ ID NO: 7999100 - DNA, 22 bp, Homo sapiens
gagtggctccaatttggtccta

SEQ ID NO: 7999101 - DNA, 22 bp, Homo sapiens
gagtggctccctgggtttggca

SEQ ID NO: 7999102 - DNA, 22 bp, Homo sapiens
gagtggctccttacaagttcca

SEQ ID NO: 7999103 - DNA, 22 bp, Homo sapiens
gagtggctgagtaagaggggag

SEQ ID NO: 7999104 - DNA, 22 bp, Homo sapiens
gagtggctgggtgtttgaatcc

SEQ ID NO: 7999105 - DNA, 15 bp, Homo sapiens
gagtggctggtgaaa

SEQ ID NO: 7999106 - DNA, 22 bp, Homo sapiens
gagtggctgtgtacatgcccag

SEQ ID NO: 7999107 - DNA, 22 bp, Homo sapiens
gagtggctgtgtacatgcccag

SEQ ID NO: 7999108 - DNA, 22 bp, Homo sapiens
gagtggctgtgtacatgcccag

SEQ ID NO: 7999109 - DNA, 15 bp, Homo sapiens
gagtggctttcagaa

SEQ ID NO: 7999110 - DNA, 22 bp, Homo sapiens
gagtggctttggagaagtaggg

SEQ ID NO: 7999111 - DNA, 22 bp, Homo sapiens
gagtggctttggagaagtaggg

SEQ ID NO: 7999112 - DNA, 22 bp, Homo sapiens
gagtggagatcgtgccactgca

SEQ ID NO: 7999113 - DNA, 22 bp, Homo sapiens
gagtggagatcgtgccactgca

SEQ ID NO: 7999114 - DNA, 22 bp, Homo sapiens
gagtggagatcgtgccactgca

SEQ ID NO: 7999115 - DNA, 22 bp, Homo sapiens
gagtggagatcgtgccactgca

SEQ ID NO: 7999116 - DNA, 22 bp, Homo sapiens
gagtggagatcgtgccactgca

SEQ ID NO: 7999117 - DNA, 22 bp, Homo sapiens
gagtggagatcgtgccactgca

SEQ ID NO: 7999118 - DNA, 22 bp, Homo sapiens
gagtggagatcgtgccactgca

SEQ ID NO: 7999119 - DNA, 22 bp, Homo sapiens
gagtgcttgcatatttattgtc

SEQ ID NO: 7999120 - DNA, 20 bp, Homo sapiens
gagtgctttggcttgctctc

SEQ ID NO: 7999121 - DNA, 22 bp, Homo sapiens
gagtgcttgcatatttattgtc

SEQ ID NO: 7999122 - DNA, 21 bp, Homo sapiens
gagtggaacgctcttcacacc

SEQ ID NO: 7999123 - DNA, 21 bp, Homo sapiens
gagtggaacgctcttcacacc

SEQ ID NO: 7999124 - DNA, 21 bp, Homo sapiens
gagtggaacgctcttcacacc

SEQ ID NO: 7999125 - DNA, 22 bp, Homo sapiens
gagtggagatcgtgccactgca

SEQ ID NO: 7999126 - DNA, 22 bp, Homo sapiens
gagtggagcaaaagaggtagat

SEQ ID NO: 7999127 - DNA, 22 bp, Homo sapiens
gagtggagcaaaagaggtagat

SEQ ID NO: 7999128 - DNA, 22 bp, Homo sapiens
gagtggagcaaaagaggtagat

SEQ ID NO: 7999129 - DNA, 22 bp, Homo sapiens
gagtggagcaaaagaggtagat

SEQ ID NO: 7999130 - DNA, 22 bp, Homo sapiens
gagtggagcaaaagaggtagat

SEQ ID NO: 7999131 - DNA, 22 bp, Homo sapiens
gagtggagcaaaagaggtagat

SEQ ID NO: 7999132 - DNA, 22 bp, Homo sapiens
gagtggagcaaaagaggtagat

SEQ ID NO: 7999133 - DNA, 22 bp, Homo sapiens
gagtggagcaaaagaggtagat

SEQ ID NO: 7999134 - DNA, 22 bp, Homo sapiens
gagtggcagaactgggggtcct

SEQ ID NO: 7999135 - DNA, 22 bp, Homo sapiens
gagtggcatatgtgcctgtgaa

SEQ ID NO: 7999136 - DNA, 22 bp, Homo sapiens
gagtggcatagaagcatataga

SEQ ID NO: 7999137 - DNA, 22 bp, Homo sapiens
gagtggcatatgtgcctgtgaa

SEQ ID NO: 7999138 - DNA, 22 bp, Homo sapiens
gagtggcaggcactgtgacgga

SEQ ID NO: 7999139 - DNA, 22 bp, Homo sapiens
gagtggcatagaagcatataga

SEQ ID NO: 7999140 - DNA, 22 bp, Homo sapiens
gagtgtgttctttatgctgtga

SEQ ID NO: 7999141 - DNA, 22 bp, Homo sapiens
gagtgttttactcaaagaaaga

SEQ ID NO: 7999142 - DNA, 22 bp, Homo sapiens
gagtgtgtgcatgatctcttat

SEQ ID NO: 7999143 - DNA, 22 bp, Homo sapiens
gagtgtggtgaacaggagcacc

SEQ ID NO: 7999144 - DNA, 22 bp, Homo sapiens
gagtgtgtcggtcagcgtggcg

SEQ ID NO: 7999145 - DNA, 22 bp, Homo sapiens
gagttaaaagccctctcagcag

SEQ ID NO: 7999146 - DNA, 22 bp, Homo sapiens
gagttaaaggaaaataacttta

SEQ ID NO: 7999147 - DNA, 22 bp, Homo sapiens
gagttaaaagccctctcagcag

SEQ ID NO: 7999148 - DNA, 22 bp, Homo sapiens
gagttaaaaatgcctccatgga

SEQ ID NO: 7999149 - DNA, 22 bp, Homo sapiens
gagttaaagtacctttgtatgt

SEQ ID NO: 7999150 - DNA, 22 bp, Homo sapiens
gagttaaaggaaaataacttta

SEQ ID NO: 7999151 - DNA, 22 bp, Homo sapiens
gagttctggtcagcagggcagc

SEQ ID NO: 7999152 - DNA, 22 bp, Homo sapiens
gagttctggtcagcagggcagc

SEQ ID NO: 7999153 - DNA, 22 bp, Homo sapiens
gagttctgtagggtgaaatagt

SEQ ID NO: 7999154 - DNA, 22 bp, Homo sapiens
gagttctcaagcaatcaaagag

SEQ ID NO: 7999155 - DNA, 22 bp, Homo sapiens
gagttctattatggttagaagt

SEQ ID NO: 7999156 - DNA, 22 bp, Homo sapiens
gagttctcaagcaatcaaagag

SEQ ID NO: 7999157 - DNA, 22 bp, Homo sapiens
gagttctcagtaaagttctttg

SEQ ID NO: 7999158 - DNA, 19 bp, Homo sapiens
gagttctctgcatcagtga

SEQ ID NO: 7999159 - DNA, 22 bp, Homo sapiens
gagtgtggatcccagaagcaga

SEQ ID NO: 7999160 - DNA, 22 bp, Homo sapiens
gagtgtgcttagagagctgcat

SEQ ID NO: 7999161 - DNA, 22 bp, Homo sapiens
gagtgtctgtggggcatggaca

SEQ ID NO: 7999162 - DNA, 22 bp, Homo sapiens
gagtgtctgtgacagctcatga

SEQ ID NO: 7999163 - DNA, 18 bp, Homo sapiens
gagtgtggcactgggccc

SEQ ID NO: 7999164 - DNA, 18 bp, Homo sapiens
gagtgtggcactgggccc

SEQ ID NO: 7999165 - DNA, 18 bp, Homo sapiens
gagtgtggcactgggccc

SEQ ID NO: 7999166 - DNA, 18 bp, Homo sapiens
gagtgtggcactgggccc

SEQ ID NO: 7999167 - DNA, 22 bp, Homo sapiens
gagtgtgggcacgggggccttg

SEQ ID NO: 7999168 - DNA, 22 bp, Homo sapiens
gagtgtgggcacgggggccttg

SEQ ID NO: 7999169 - DNA, 22 bp, Homo sapiens
gagtgtggtgaacaggagcacc

SEQ ID NO: 7999170 - DNA, 22 bp, Homo sapiens
gagtgtggtgaacaggagcacc

SEQ ID NO: 7999171 - DNA, 22 bp, Homo sapiens
gagtgtggtatgctctgaggct

SEQ ID NO: 7999172 - DNA, 22 bp, Homo sapiens
gagtgtggtgaacaggagcacc

SEQ ID NO: 7999173 - DNA, 22 bp, Homo sapiens
gagtgtgggggtgctgaggaca

SEQ ID NO: 7999174 - DNA, 22 bp, Homo sapiens
gagtgtgggtctcagctttaag

SEQ ID NO: 7999175 - DNA, 22 bp, Homo sapiens
gagtgtgggtctcagctttaag

SEQ ID NO: 7999176 - DNA, 22 bp, Homo sapiens
gagtgtgggcacgggggccttg

SEQ ID NO: 7999177 - DNA, 22 bp, Homo sapiens
gagtgtgggcacgggggccttg

SEQ ID NO: 7999178 - DNA, 22 bp, Homo sapiens
gagtgtcagtgcctggcttgtt

SEQ ID NO: 7999179 - DNA, 22 bp, Homo sapiens
gagtgtcagtgcctggcttgtt

SEQ ID NO: 7999180 - DNA, 22 bp, Homo sapiens
gagtgtcagcagggcagagcac

SEQ ID NO: 7999181 - DNA, 22 bp, Homo sapiens
gagtgtcagcagggcagagcac

SEQ ID NO: 7999182 - DNA, 22 bp, Homo sapiens
gagtgtcagcagggcagagcac

SEQ ID NO: 7999183 - DNA, 22 bp, Homo sapiens
gagtgtcagtgcttggggctac

SEQ ID NO: 7999184 - DNA, 22 bp, Homo sapiens
gagtgtcagtgcttggggctac

SEQ ID NO: 7999185 - DNA, 22 bp, Homo sapiens
gagtgtcagtgcttggggctac

SEQ ID NO: 7999186 - DNA, 22 bp, Homo sapiens
gagtgtccgtgcagccccagac

SEQ ID NO: 7999187 - DNA, 22 bp, Homo sapiens
gagtgtctaatcacgtttcaca

SEQ ID NO: 7999188 - DNA, 22 bp, Homo sapiens
gagtgtctatgtttagtctttc

SEQ ID NO: 7999189 - DNA, 21 bp, Homo sapiens
gagtgtctaatccaggctgtc

SEQ ID NO: 7999190 - DNA, 22 bp, Homo sapiens
gagtgtctaatcacgtttcaca

SEQ ID NO: 7999191 - DNA, 21 bp, Homo sapiens
gagtgtctaatccaggctgtc

SEQ ID NO: 7999192 - DNA, 22 bp, Homo sapiens
gagtgtctcacagtagcatttt

SEQ ID NO: 7999193 - DNA, 22 bp, Homo sapiens
gagtgtctgaattagagcacaa

SEQ ID NO: 7999194 - DNA, 22 bp, Homo sapiens
gagtgtctgtattttgggcaag

SEQ ID NO: 7999195 - DNA, 22 bp, Homo sapiens
gagtgtcacttgatgcagggca

SEQ ID NO: 7999196 - DNA, 22 bp, Homo sapiens
gagtgtcaaggctctctttggc

SEQ ID NO: 7999197 - DNA, 22 bp, Homo sapiens
gagtgtcacagggtaattgttt

SEQ ID NO: 7999198 - DNA, 21 bp, Homo sapiens
gagtgtcagcaagaggtttgg

SEQ ID NO: 7999199 - DNA, 22 bp, Homo sapiens
gagtgtcacttgatgcagggca

SEQ ID NO: 7999200 - DNA, 22 bp, Homo sapiens
gagtgtcaaggctctctttggc

SEQ ID NO: 7999201 - DNA, 22 bp, Homo sapiens
gagtgtaatctgaaaacttgaa

SEQ ID NO: 7999202 - DNA, 22 bp, Homo sapiens
gagtgtagttcattccgtccta

SEQ ID NO: 7999203 - DNA, 22 bp, Homo sapiens
gagtggttagaagtagtgtggc

SEQ ID NO: 7999204 - DNA, 22 bp, Homo sapiens
gagtgggtgagagacttggcac

SEQ ID NO: 7999205 - DNA, 22 bp, Homo sapiens
gagtgggtgagagacttggcac

SEQ ID NO: 7999206 - DNA, 22 bp, Homo sapiens
gagtgggtgaatgtgctcataa

SEQ ID NO: 7999207 - DNA, 22 bp, Homo sapiens
gagtgggtgaatgtgctcataa

SEQ ID NO: 7999208 - DNA, 22 bp, Homo sapiens
gagtggggtctgggcatcagtc

SEQ ID NO: 7999209 - DNA, 22 bp, Homo sapiens
gagtggggtctgggcatcagtc

SEQ ID NO: 7999210 - DNA, 22 bp, Homo sapiens
gagtggggtctgggcatcagtc

SEQ ID NO: 7999211 - DNA, 22 bp, Homo sapiens
gagtggggtctgggcatcagtc

SEQ ID NO: 7999212 - DNA, 22 bp, Homo sapiens
gagtgggtaaaggtgcttggct

SEQ ID NO: 7999213 - DNA, 22 bp, Homo sapiens
gagtgggtaaaggtgcttggct

SEQ ID NO: 7999214 - DNA, 22 bp, Homo sapiens
gagtggggtctgggcatcagtc

SEQ ID NO: 7999215 - DNA, 22 bp, Homo sapiens
gagtgggtccacagaggtgaca

SEQ ID NO: 7999216 - DNA, 22 bp, Homo sapiens
gagtgggtccacagaggtgaca

SEQ ID NO: 7999217 - DNA, 22 bp, Homo sapiens
gagtgggtctcatatatctggc

SEQ ID NO: 7999218 - DNA, 22 bp, Homo sapiens
gagtgggtaccggagcaggtgc

SEQ ID NO: 7999219 - DNA, 22 bp, Homo sapiens
gagtgggtaccggagcaggtgc

SEQ ID NO: 7999220 - DNA, 22 bp, Homo sapiens
gagtgggtaccggagcaggtgc

SEQ ID NO: 7999221 - DNA, 22 bp, Homo sapiens
gagtgggtaaaggtgcttggct

SEQ ID NO: 7999222 - DNA, 22 bp, Homo sapiens
gagtggggggtccgtctcagtg

SEQ ID NO: 7999223 - DNA, 22 bp, Homo sapiens
gagtggggggtccgtctcagtg

SEQ ID NO: 7999224 - DNA, 22 bp, Homo sapiens
gagtggggggtccgtctcagtg

SEQ ID NO: 7999225 - DNA, 22 bp, Homo sapiens
gagtggggggtccgtctcagtg

SEQ ID NO: 7999226 - DNA, 22 bp, Homo sapiens
gagtggggctttaaaggctcag

SEQ ID NO: 7999227 - DNA, 22 bp, Homo sapiens
gagtggggggtccgtctcagtg

SEQ ID NO: 7999228 - DNA, 22 bp, Homo sapiens
gagtggggggtccgtctcagtg

SEQ ID NO: 7999229 - DNA, 22 bp, Homo sapiens
gagtggggggtccgtctcagtg

SEQ ID NO: 7999230 - DNA, 22 bp, Homo sapiens
gagtggggggtccgtctcagtg

SEQ ID NO: 7999231 - DNA, 22 bp, Homo sapiens
gagtggggtctgggcatcagtc

SEQ ID NO: 7999232 - DNA, 22 bp, Homo sapiens
gagtggggtctgggcatcagtc

SEQ ID NO: 7999233 - DNA, 22 bp, Homo sapiens
gagtggggtctgggcatcagtc

SEQ ID NO: 7999234 - DNA, 22 bp, Homo sapiens
gagtggggtctgggcatcagtc

SEQ ID NO: 7999235 - DNA, 22 bp, Homo sapiens
gagtggggtctgggcatcagtc

SEQ ID NO: 7999236 - DNA, 22 bp, Homo sapiens
gataaaattcttattttacccg

SEQ ID NO: 7999237 - DNA, 22 bp, Homo sapiens
gataaaattcttattttacccg

SEQ ID NO: 7999238 - DNA, 22 bp, Homo sapiens
gataaaattcttattttacccg

SEQ ID NO: 7999239 - DNA, 21 bp, Homo sapiens
gataaaatgggccttggtcct

SEQ ID NO: 7999240 - DNA, 21 bp, Homo sapiens
gataaaatgggccttggtcct

SEQ ID NO: 7999241 - DNA, 22 bp, Homo sapiens
gataaaatatgtggcctttagt

SEQ ID NO: 7999242 - DNA, 22 bp, Homo sapiens
gataaaatatgtggcctttagt

SEQ ID NO: 7999243 - DNA, 22 bp, Homo sapiens
gataaaatatgtggcctttagt

SEQ ID NO: 7999244 - DNA, 22 bp, Homo sapiens
gataaaataactatggaatact

SEQ ID NO: 7999245 - DNA, 22 bp, Homo sapiens
gataaacatgggagaaaggaat

SEQ ID NO: 7999246 - DNA, 22 bp, Homo sapiens
gataaacattcttgcacatgtg

SEQ ID NO: 7999247 - DNA, 22 bp, Homo sapiens
gataaacattcttgcacatgtg

SEQ ID NO: 7999248 - DNA, 22 bp, Homo sapiens
gataaacatgaagttctgtgta

SEQ ID NO: 7999249 - DNA, 22 bp, Homo sapiens
gataaacactgatgatatgggg

SEQ ID NO: 7999250 - DNA, 22 bp, Homo sapiens
gataaacactaaggtcgctgaa

SEQ ID NO: 7999251 - DNA, 22 bp, Homo sapiens
gataaaattcttattttacccg

SEQ ID NO: 7999252 - DNA, 22 bp, Homo sapiens
gataaacacaaggtgatttcat

SEQ ID NO: 7999253 - DNA, 22 bp, Homo sapiens
gataaacacaaggtgatttcat

SEQ ID NO: 7999254 - DNA, 22 bp, Homo sapiens
gataaacacaaggtgatttcat

SEQ ID NO: 7999255 - DNA, 22 bp, Homo sapiens
gataaacactaaggtcgctgaa

SEQ ID NO: 7999256 - DNA, 22 bp, Homo sapiens
gataaacacaaggtgatttcat

SEQ ID NO: 7999257 - DNA, 22 bp, Homo sapiens
gataaacacaaggtgatttcat

SEQ ID NO: 7999258 - DNA, 22 bp, Homo sapiens
gataaattgcactttttcttac

SEQ ID NO: 7999259 - DNA, 22 bp, Homo sapiens
gataaattgcactttttcttac

SEQ ID NO: 7999260 - DNA, 22 bp, Homo sapiens
gataaattgcactttttcttac

SEQ ID NO: 7999261 - DNA, 22 bp, Homo sapiens
gataaattatcaggggtttaaa

SEQ ID NO: 7999262 - DNA, 20 bp, Homo sapiens
gataaattgtctcttaagtg

SEQ ID NO: 7999263 - DNA, 20 bp, Homo sapiens
gataaattgtctcttaagtg

SEQ ID NO: 7999264 - DNA, 20 bp, Homo sapiens
gataaattgtctcttaagtg

SEQ ID NO: 7999265 - DNA, 20 bp, Homo sapiens
gataaattgtctcttaagtg

SEQ ID NO: 7999266 - DNA, 20 bp, Homo sapiens
gataaattgtctcttaagtg

SEQ ID NO: 7999267 - DNA, 22 bp, Homo sapiens
gataacatggttagtgttttta

SEQ ID NO: 7999268 - DNA, 22 bp, Homo sapiens
gataacaatatgaagtagatat

SEQ ID NO: 7999269 - DNA, 22 bp, Homo sapiens
gataacaatatgaagtagatat

SEQ ID NO: 7999270 - DNA, 22 bp, Homo sapiens
gataacaatatgaagtagatat

SEQ ID NO: 7999271 - DNA, 22 bp, Homo sapiens
gataacaatatgaagtagatat

SEQ ID NO: 7999272 - DNA, 20 bp, Homo sapiens
gataaattgtctcttaagtg

SEQ ID NO: 7999273 - DNA, 22 bp, Homo sapiens
gataaattatcaggggtttaaa

SEQ ID NO: 7999274 - DNA, 22 bp, Homo sapiens
gataaatggctgaagaaatagt

SEQ ID NO: 7999275 - DNA, 22 bp, Homo sapiens
gataaatggctgaagaaatagt

SEQ ID NO: 7999276 - DNA, 22 bp, Homo sapiens
gataaacttgtggagttttggt

SEQ ID NO: 7999277 - DNA, 22 bp, Homo sapiens
gataaagcaaggatgactgaag

SEQ ID NO: 7999278 - DNA, 22 bp, Homo sapiens
gataaagcaggtaggagaagat

SEQ ID NO: 7999279 - DNA, 21 bp, Homo sapiens
gataaagcagcttgcctaagg

SEQ ID NO: 7999280 - DNA, 22 bp, Homo sapiens
gagttgactcctccagaggagt

SEQ ID NO: 7999281 - DNA, 22 bp, Homo sapiens
gagttgacaggccaaggcccat

SEQ ID NO: 7999282 - DNA, 22 bp, Homo sapiens
gagttgactacatagatgcaga

SEQ ID NO: 7999283 - DNA, 22 bp, Homo sapiens
gagttctgtgattatttgggac

SEQ ID NO: 7999284 - DNA, 22 bp, Homo sapiens
gagttctgttccttgggagttt

SEQ ID NO: 7999285 - DNA, 22 bp, Homo sapiens
gagtttaaagcatacatatttt

SEQ ID NO: 7999286 - DNA, 22 bp, Homo sapiens
gagtttaaagcatacatatttt

SEQ ID NO: 7999287 - DNA, 22 bp, Homo sapiens
gagtttaaaacgcttgtattta

SEQ ID NO: 7999288 - DNA, 22 bp, Homo sapiens
gagtttaaaaagcctggtttgt

SEQ ID NO: 7999289 - DNA, 22 bp, Homo sapiens
gagtttaaaacgcttgtattta

SEQ ID NO: 7999290 - DNA, 22 bp, Homo sapiens
gagtttaaaacgcttgtattta

SEQ ID NO: 7999291 - DNA, 23 bp, Homo sapiens
gagttgggtgctgaacgaccata

SEQ ID NO: 7999292 - DNA, 22 bp, Homo sapiens
gagtttaaaaagcctggtttgt

SEQ ID NO: 7999293 - DNA, 22 bp, Homo sapiens
gagttgtatatggctttattga

SEQ ID NO: 7999294 - DNA, 22 bp, Homo sapiens
gagttggctactctctgaggct

SEQ ID NO: 7999295 - DNA, 22 bp, Homo sapiens
gagttggctgttcgaaggtagc

SEQ ID NO: 7999296 - DNA, 22 bp, Homo sapiens
gagtttatgtctttcattgttc

SEQ ID NO: 7999297 - DNA, 19 bp, Homo sapiens
gagtttatctcctagccct

SEQ ID NO: 7999298 - DNA, 22 bp, Homo sapiens
gagtttattcaggaaatagcca

SEQ ID NO: 7999299 - DNA, 22 bp, Homo sapiens
gagtttattcaggaaatagcca

SEQ ID NO: 7999300 - DNA, 22 bp, Homo sapiens
gagtttattcaggaaatagcca

SEQ ID NO: 7999301 - DNA, 22 bp, Homo sapiens
gagtttaaataacacatttcca

SEQ ID NO: 7999302 - DNA, 22 bp, Homo sapiens
gagtttaaagcatacatatttt

SEQ ID NO: 7999303 - DNA, 22 bp, Homo sapiens
gagtttaatcattgttctatcc

SEQ ID NO: 7999304 - DNA, 22 bp, Homo sapiens
gagtttaacacttggagaaaag

SEQ ID NO: 7999305 - DNA, 22 bp, Homo sapiens
gagtttaatcattgttctatcc

SEQ ID NO: 7999306 - DNA, 22 bp, Homo sapiens
gagtttaatcattgttctatcc

SEQ ID NO: 7999307 - DNA, 22 bp, Homo sapiens
gagtttctccagtgctagttgt

SEQ ID NO: 7999308 - DNA, 22 bp, Homo sapiens
gagtttctaggatggaggtgag

SEQ ID NO: 7999309 - DNA, 22 bp, Homo sapiens
gagtttccaaatccctgaaggg

SEQ ID NO: 7999310 - DNA, 22 bp, Homo sapiens
gagtttatttgactggattctc

SEQ ID NO: 7999311 - DNA, 22 bp, Homo sapiens
gagtttattgtcttccaggctt

SEQ ID NO: 7999312 - DNA, 22 bp, Homo sapiens
gagtttctgatttagtaggtct

SEQ ID NO: 7999313 - DNA, 22 bp, Homo sapiens
gagtttctccagtgctagttgt

SEQ ID NO: 7999314 - DNA, 22 bp, Homo sapiens
gagtttccaaatccctgaaggg

SEQ ID NO: 7999315 - DNA, 22 bp, Homo sapiens
gagtttctgattcagtctgtgt

SEQ ID NO: 7999316 - DNA, 22 bp, Homo sapiens
gagtttattcaggaaatagcca

SEQ ID NO: 7999317 - DNA, 22 bp, Homo sapiens
gagtttcttaacaggtggaagc

SEQ ID NO: 7999318 - DNA, 22 bp, Homo sapiens
gagtttcttcatggtgcagagg

SEQ ID NO: 7999319 - DNA, 22 bp, Homo sapiens
gagtttctgctctaggtctggt

SEQ ID NO: 7999320 - DNA, 22 bp, Homo sapiens
gagtttcttaacaggtggaagc

SEQ ID NO: 7999321 - DNA, 23 bp, Homo sapiens
gagtttcttccaggagccctggg

SEQ ID NO: 7999322 - DNA, 22 bp, Homo sapiens
gagtttgatagagaggaaccgg

SEQ ID NO: 7999323 - DNA, 22 bp, Homo sapiens
gagttttaacctcagctctctg

SEQ ID NO: 7999324 - DNA, 22 bp, Homo sapiens
gataaaataactatggaatact

SEQ ID NO: 7999325 - DNA, 22 bp, Homo sapiens
gataaaataactatggaatact

SEQ ID NO: 7999326 - DNA, 22 bp, Homo sapiens
gataaaagaggaaatttgttca

SEQ ID NO: 7999327 - DNA, 22 bp, Homo sapiens
gatgagaaatggacaggagtgg

SEQ ID NO: 7999328 - DNA, 22 bp, Homo sapiens
gatgagaaggctcagatccaaa

SEQ ID NO: 7999329 - DNA, 22 bp, Homo sapiens
gatgagaatgtttatcaaatgc

SEQ ID NO: 7999330 - DNA, 22 bp, Homo sapiens
gatgagaatgtttatcaaatgc

SEQ ID NO: 7999331 - DNA, 22 bp, Homo sapiens
gatgagacagaatagcccaagg

SEQ ID NO: 7999332 - DNA, 22 bp, Homo sapiens
gatgagacagaatagcccaagg

SEQ ID NO: 7999333 - DNA, 22 bp, Homo sapiens
gatgagaatgtttatcaaatgc

SEQ ID NO: 7999334 - DNA, 22 bp, Homo sapiens
gatgacatgatggacactcagt

SEQ ID NO: 7999335 - DNA, 22 bp, Homo sapiens
gatgacttatgtttacaaatgt

SEQ ID NO: 7999336 - DNA, 22 bp, Homo sapiens
gatgacttatgtttacaaatgt

SEQ ID NO: 7999337 - DNA, 22 bp, Homo sapiens
gatgacatggctagcactgtga

SEQ ID NO: 7999338 - DNA, 22 bp, Homo sapiens
gatgagaaatggacaggagtgg

SEQ ID NO: 7999339 - DNA, 22 bp, Homo sapiens
gatgacttatgtttacaaatgt

SEQ ID NO: 7999340 - DNA, 22 bp, Homo sapiens
gatgacataacctaattacagt

SEQ ID NO: 7999341 - DNA, 22 bp, Homo sapiens
gatgacataacctaattacagt

SEQ ID NO: 7999342 - DNA, 20 bp, Homo sapiens
gatgacatactcacttaggg

SEQ ID NO: 7999343 - DNA, 22 bp, Homo sapiens
gatgacatctcaatttgttctt

SEQ ID NO: 7999344 - DNA, 22 bp, Homo sapiens
gatgacatgatggacactcagt

SEQ ID NO: 7999345 - DNA, 22 bp, Homo sapiens
gatgacatgatggacactcagt

SEQ ID NO: 7999346 - DNA, 22 bp, Homo sapiens
gatgagcattgtttcatgtgtt

SEQ ID NO: 7999347 - DNA, 22 bp, Homo sapiens
gatgagctgctcaatctgtggt

SEQ ID NO: 7999348 - DNA, 22 bp, Homo sapiens
gatgaggaaaccaaggctcagg

SEQ ID NO: 7999349 - DNA, 22 bp, Homo sapiens
gatgagctgtgtgtgagggtca

SEQ ID NO: 7999350 - DNA, 22 bp, Homo sapiens
gatgaggaatgctcagctcaat

SEQ ID NO: 7999351 - DNA, 22 bp, Homo sapiens
gatgaggaaaccaaggctcagg

SEQ ID NO: 7999352 - DNA, 22 bp, Homo sapiens
gatgaggaaaccaaggctcagg

SEQ ID NO: 7999353 - DNA, 22 bp, Homo sapiens
gatgatggtactgtatttgaat

SEQ ID NO: 7999354 - DNA, 22 bp, Homo sapiens
gatgatgggttgatgtgaaggg

SEQ ID NO: 7999355 - DNA, 22 bp, Homo sapiens
gatgatgggatccagcaatgta

SEQ ID NO: 7999356 - DNA, 22 bp, Homo sapiens
gatgaggaatttgaggttagaa

SEQ ID NO: 7999357 - DNA, 22 bp, Homo sapiens
gatgaggaatttgaggttagaa

SEQ ID NO: 7999358 - DNA, 22 bp, Homo sapiens
gatgaaatttgggcaggttaaa

SEQ ID NO: 7999359 - DNA, 22 bp, Homo sapiens
gatgaaatttgaaaatagtgtt

SEQ ID NO: 7999360 - DNA, 22 bp, Homo sapiens
gatgaagaggcactgacatatt

SEQ ID NO: 7999361 - DNA, 22 bp, Homo sapiens
gatgaagaggcactgacatatt

SEQ ID NO: 7999362 - DNA, 22 bp, Homo sapiens
gatgaagaggcactgacatatt

SEQ ID NO: 7999363 - DNA, 22 bp, Homo sapiens
gatgaacatttaaagcctcttg

SEQ ID NO: 7999364 - DNA, 22 bp, Homo sapiens
gatgacagttctagcatctgaa

SEQ ID NO: 7999365 - DNA, 22 bp, Homo sapiens
gatgacataaacttaacagtat

SEQ ID NO: 7999366 - DNA, 22 bp, Homo sapiens
gatgacagcagctgtggctcac

SEQ ID NO: 7999367 - DNA, 22 bp, Homo sapiens
gatgaattgttatggctacgag

SEQ ID NO: 7999368 - DNA, 22 bp, Homo sapiens
gatgaattgaaatcattgggca

SEQ ID NO: 7999369 - DNA, 22 bp, Homo sapiens
gatgaattctggcttggacaga

SEQ ID NO: 7999370 - DNA, 22 bp, Homo sapiens
gatgaattctggcttggacaga

SEQ ID NO: 7999371 - DNA, 22 bp, Homo sapiens
gatgattttgatgcagtaaaga

SEQ ID NO: 7999372 - DNA, 22 bp, Homo sapiens
gatgattttctgtgttagaaga

SEQ ID NO: 7999373 - DNA, 22 bp, Homo sapiens
gatgattttctgtgttagaaga

SEQ ID NO: 7999374 - DNA, 22 bp, Homo sapiens
gatgattttatgtcttgtcatt

SEQ ID NO: 7999375 - DNA, 22 bp, Homo sapiens
gatgattttatgtcttgtcatt

SEQ ID NO: 7999376 - DNA, 22 bp, Homo sapiens
gatgatttgaggatttcatgag

SEQ ID NO: 7999377 - DNA, 22 bp, Homo sapiens
gatgatttgaggatttcatgag

SEQ ID NO: 7999378 - DNA, 22 bp, Homo sapiens
gatgattttagttgactaaact

SEQ ID NO: 7999379 - DNA, 22 bp, Homo sapiens
gatgattcctttgttcattgtg

SEQ ID NO: 7999380 - DNA, 22 bp, Homo sapiens
gatgagaaggctcagatccaaa

SEQ ID NO: 7999381 - DNA, 22 bp, Homo sapiens
gatgattgttgctgcccaatga

SEQ ID NO: 7999382 - DNA, 22 bp, Homo sapiens
gatgattctgtgtttggaatgc

SEQ ID NO: 7999383 - DNA, 22 bp, Homo sapiens
gatgatttctccattcccttct

SEQ ID NO: 7999384 - DNA, 22 bp, Homo sapiens
gatgatttaagtggccaaagta

SEQ ID NO: 7999385 - DNA, 22 bp, Homo sapiens
gatgatttctccattcccttct

SEQ ID NO: 7999386 - DNA, 22 bp, Homo sapiens
gatgatttaagtggccaaagta

SEQ ID NO: 7999387 - DNA, 22 bp, Homo sapiens
gatgattttgttggtgattcaa

SEQ ID NO: 7999388 - DNA, 22 bp, Homo sapiens
gatgattttgatgcagtaaaga

SEQ ID NO: 7999389 - DNA, 22 bp, Homo sapiens
gatgattttgatgcagtaaaga

SEQ ID NO: 7999390 - DNA, 22 bp, Homo sapiens
gatgcaaaagtatcattttaat

SEQ ID NO: 7999391 - DNA, 22 bp, Homo sapiens
gatgcaaaccttacatggacct

SEQ ID NO: 7999392 - DNA, 22 bp, Homo sapiens
gatgcaaaagtatcattttaat

SEQ ID NO: 7999393 - DNA, 22 bp, Homo sapiens
gatgcaaaccttacatggacct

SEQ ID NO: 7999394 - DNA, 22 bp, Homo sapiens
gatgatttttgccagtgtgatg

SEQ ID NO: 7999395 - DNA, 22 bp, Homo sapiens
gatgatttttgccagtgtgatg

SEQ ID NO: 7999396 - DNA, 22 bp, Homo sapiens
gatgcaaaccttacatggacct

SEQ ID NO: 7999397 - DNA, 22 bp, Homo sapiens
gatgcaaaccttacatggacct

SEQ ID NO: 7999398 - DNA, 22 bp, Homo sapiens
gatgatttttgccagtgtgatg

SEQ ID NO: 7999399 - DNA, 22 bp, Homo sapiens
gatgcaaactgtgacatagagt

SEQ ID NO: 7999400 - DNA, 22 bp, Homo sapiens
gatgcagggcagctctgggaca

SEQ ID NO: 7999401 - DNA, 22 bp, Homo sapiens
gatgcagggcagctctgggaca

SEQ ID NO: 7999402 - DNA, 22 bp, Homo sapiens
gatgcagggaacttagtgggct

SEQ ID NO: 7999403 - DNA, 22 bp, Homo sapiens
gatgcagaaagtagacaccatc

SEQ ID NO: 7999404 - DNA, 22 bp, Homo sapiens
gatgcagggctggcaggagctt

SEQ ID NO: 7999405 - DNA, 22 bp, Homo sapiens
gatgcatgtatggagtgagggt

SEQ ID NO: 7999406 - DNA, 22 bp, Homo sapiens
gatgcacggtcatgtcttttca

SEQ ID NO: 7999407 - DNA, 22 bp, Homo sapiens
gatgcacattgaacaatcacaa

SEQ ID NO: 7999408 - DNA, 22 bp, Homo sapiens
gatgcaaagataaaacagacgc

SEQ ID NO: 7999409 - DNA, 22 bp, Homo sapiens
gatgaaattcagaattgagggg

SEQ ID NO: 7999410 - DNA, 22 bp, Homo sapiens
gatgaaattgttttgatacttt

SEQ ID NO: 7999411 - DNA, 22 bp, Homo sapiens
gatgaaatgtgaaagttctggg

SEQ ID NO: 7999412 - DNA, 17 bp, Homo sapiens
gatgaaatgatgcacac

SEQ ID NO: 7999413 - DNA, 22 bp, Homo sapiens
gatgaaatgctgagcctgagtt

SEQ ID NO: 7999414 - DNA, 22 bp, Homo sapiens
gatgaaatgctgagcctgagtt

SEQ ID NO: 7999415 - DNA, 20 bp, Homo sapiens
gatgaaatcactgggcagcc

SEQ ID NO: 7999416 - DNA, 22 bp, Homo sapiens
gatgaaatccagatcacaggtg

SEQ ID NO: 7999417 - DNA, 22 bp, Homo sapiens
gatgaaatccagatcacaggtg

SEQ ID NO: 7999418 - DNA, 17 bp, Homo sapiens
gatgaaatgatgcacac

SEQ ID NO: 7999419 - DNA, 22 bp, Homo sapiens
gatgaaatagaattaatttagg

SEQ ID NO: 7999420 - DNA, 22 bp, Homo sapiens
gatgaaatagaattaatttagg

SEQ ID NO: 7999421 - DNA, 22 bp, Homo sapiens
gatgaaatagcaaaggcatttg

SEQ ID NO: 7999422 - DNA, 22 bp, Homo sapiens
gatgaaatagcaaaggcatttg

SEQ ID NO: 7999423 - DNA, 22 bp, Homo sapiens
gatgaaaaattgctgtgtcata

SEQ ID NO: 7999424 - DNA, 22 bp, Homo sapiens
gatgaaaaattgctgtgtcata

SEQ ID NO: 7999425 - DNA, 22 bp, Homo sapiens
gatgaaaaattgctgtgtcata

SEQ ID NO: 7999426 - DNA, 22 bp, Homo sapiens
gatgaaaaattgctgtgtcata

SEQ ID NO: 7999427 - DNA, 22 bp, Homo sapiens
gatgaaaatcttgagatgtcga

SEQ ID NO: 7999428 - DNA, 22 bp, Homo sapiens
gatgaaaatcttgagatgtcga

SEQ ID NO: 7999429 - DNA, 22 bp, Homo sapiens
gatgaaatagaattaatttagg

SEQ ID NO: 7999430 - DNA, 22 bp, Homo sapiens
gatgaaaaattgctgtgtcata

SEQ ID NO: 7999431 - DNA, 22 bp, Homo sapiens
gatcttttcaggtttctctagt

SEQ ID NO: 7999432 - DNA, 22 bp, Homo sapiens
gatcttttcagtcttggtagtt

SEQ ID NO: 7999433 - DNA, 22 bp, Homo sapiens
gatgaaaaaagacgagcatata

SEQ ID NO: 7999434 - DNA, 22 bp, Homo sapiens
gatgaaaaaagacgagcatata

SEQ ID NO: 7999435 - DNA, 22 bp, Homo sapiens
gatctttactactgccttctct

SEQ ID NO: 7999436 - DNA, 22 bp, Homo sapiens
gatgaaaaaagacgagcatata

SEQ ID NO: 7999437 - DNA, 22 bp, Homo sapiens
gatcttttcaggtttctctagt

SEQ ID NO: 7999438 - DNA, 22 bp, Homo sapiens
gatcttttcagaatttatcagt

SEQ ID NO: 7999439 - DNA, 22 bp, Homo sapiens
gatcttttcagaatttatcagt

SEQ ID NO: 7999440 - DNA, 22 bp, Homo sapiens
gatcttttcagaatttatcagt

SEQ ID NO: 7999441 - DNA, 22 bp, Homo sapiens
gatcttttcagaatttatcagt

SEQ ID NO: 7999442 - DNA, 22 bp, Homo sapiens
gatctttggaatctgtgtatca

SEQ ID NO: 7999443 - DNA, 22 bp, Homo sapiens
gatctttatactgtaataatga

SEQ ID NO: 7999444 - DNA, 22 bp, Homo sapiens
gatctttgcaaactttgtcact

SEQ ID NO: 7999445 - DNA, 19 bp, Homo sapiens
gatctttgccaatttaagc

SEQ ID NO: 7999446 - DNA, 22 bp, Homo sapiens
gatctttgcaaactttgtcact

SEQ ID NO: 7999447 - DNA, 22 bp, Homo sapiens
gatctgggctggagactgagaa

SEQ ID NO: 7999448 - DNA, 22 bp, Homo sapiens
gatctggtacaggcctgcagcc

SEQ ID NO: 7999449 - DNA, 22 bp, Homo sapiens
gatctgggctggagactgagaa

SEQ ID NO: 7999450 - DNA, 22 bp, Homo sapiens
gatctgggagcctcatggagac

SEQ ID NO: 7999451 - DNA, 22 bp, Homo sapiens
gatcccttgggccaaggagttg

SEQ ID NO: 7999452 - DNA, 22 bp, Homo sapiens
gatcccttgggccaaggagttg

SEQ ID NO: 7999453 - DNA, 22 bp, Homo sapiens
gatccgaatcattgctctttta

SEQ ID NO: 7999454 - DNA, 22 bp, Homo sapiens
gatctggtttcatcatggactt

SEQ ID NO: 7999455 - DNA, 22 bp, Homo sapiens
gatctgttataatctcttttat

SEQ ID NO: 7999456 - DNA, 22 bp, Homo sapiens
gatctgttataatctcttttat

SEQ ID NO: 7999457 - DNA, 22 bp, Homo sapiens
gatctgtttcaattgtcttagt

SEQ ID NO: 7999458 - DNA, 22 bp, Homo sapiens
gatctgtttcaattgtcttagt

SEQ ID NO: 7999459 - DNA, 22 bp, Homo sapiens
gatctgttataatctcttttat

SEQ ID NO: 7999460 - DNA, 22 bp, Homo sapiens
gatcttggaatggcacagctga

SEQ ID NO: 7999461 - DNA, 22 bp, Homo sapiens
gatctttatactgtaataatga

SEQ ID NO: 7999462 - DNA, 22 bp, Homo sapiens
gatctttatactgtaataatga

SEQ ID NO: 7999463 - DNA, 22 bp, Homo sapiens
gatctttaaggcttaccctgga

SEQ ID NO: 7999464 - DNA, 21 bp, Homo sapiens
gatctttactttcctacttac

SEQ ID NO: 7999465 - DNA, 22 bp, Homo sapiens
gatctttagccaagacacacca

SEQ ID NO: 7999466 - DNA, 22 bp, Homo sapiens
gatcttctctttagtagaaaca

SEQ ID NO: 7999467 - DNA, 22 bp, Homo sapiens
gatcttctttctctgtagaggt

SEQ ID NO: 7999468 - DNA, 22 bp, Homo sapiens
gatcttctgaactggagtatct

SEQ ID NO: 7999469 - DNA, 22 bp, Homo sapiens
gatcttctatgtaatgaagtgt

SEQ ID NO: 7999470 - DNA, 22 bp, Homo sapiens
gatctgtttgcctagagattta

SEQ ID NO: 7999471 - DNA, 22 bp, Homo sapiens
gatctgtttcattcacagtctg

SEQ ID NO: 7999472 - DNA, 22 bp, Homo sapiens
gatccacagtttgatgatcata

SEQ ID NO: 7999473 - DNA, 22 bp, Homo sapiens
gatccacagtttgatgatcata

SEQ ID NO: 7999474 - DNA, 21 bp, Homo sapiens
gatccactgacctggggatcc

SEQ ID NO: 7999475 - DNA, 22 bp, Homo sapiens
gatccagatatttgggctggta

SEQ ID NO: 7999476 - DNA, 22 bp, Homo sapiens
gatccactgtgtttgtgttgag

SEQ ID NO: 7999477 - DNA, 21 bp, Homo sapiens
gatccactgacctggggatcc

SEQ ID NO: 7999478 - DNA, 22 bp, Homo sapiens
gatccagcttctacacagagct

SEQ ID NO: 7999479 - DNA, 22 bp, Homo sapiens
gatccagcttctacacagagct

SEQ ID NO: 7999480 - DNA, 22 bp, Homo sapiens
gatcccaggtgatcttatttgt

SEQ ID NO: 7999481 - DNA, 22 bp, Homo sapiens
gatccccaggactagggggtgg

SEQ ID NO: 7999482 - DNA, 22 bp, Homo sapiens
gatccctgccctcagcctggac

SEQ ID NO: 7999483 - DNA, 22 bp, Homo sapiens
gatcccctattcttttcctcag

SEQ ID NO: 7999484 - DNA, 22 bp, Homo sapiens
gatcattttgtatagcaaaggt

SEQ ID NO: 7999485 - DNA, 22 bp, Homo sapiens
gatccacagcccgcttgggccc

SEQ ID NO: 7999486 - DNA, 22 bp, Homo sapiens
gatccacagctgcggtaggaga

SEQ ID NO: 7999487 - DNA, 22 bp, Homo sapiens
gatccacaggaaccaaaacgca

SEQ ID NO: 7999488 - DNA, 22 bp, Homo sapiens
gatccacagggccctggcccag

SEQ ID NO: 7999489 - DNA, 22 bp, Homo sapiens
gatcattttgatgcccttttag

SEQ ID NO: 7999490 - DNA, 22 bp, Homo sapiens
gatcattttgtatagcaaaggt

SEQ ID NO: 7999491 - DNA, 22 bp, Homo sapiens
gatcatttcagtccagtaaata

SEQ ID NO: 7999492 - DNA, 22 bp, Homo sapiens
gatcatttgactttataaggct

SEQ ID NO: 7999493 - DNA, 22 bp, Homo sapiens
gatcatttgcaggaaacattaa

SEQ ID NO: 7999494 - DNA, 22 bp, Homo sapiens
gatatacataggtttctatgca

SEQ ID NO: 7999495 - DNA, 22 bp, Homo sapiens
gatatacagagcattctttgat

SEQ ID NO: 7999496 - DNA, 22 bp, Homo sapiens
gatatacataggtttctatgca

SEQ ID NO: 7999497 - DNA, 22 bp, Homo sapiens
gatatacataggtttctatgca

SEQ ID NO: 7999498 - DNA, 22 bp, Homo sapiens
gatatacataggtttctatgca

SEQ ID NO: 7999499 - DNA, 22 bp, Homo sapiens
gatatactgtctgtattacata

SEQ ID NO: 7999500 - DNA, 22 bp, Homo sapiens
gatatactgtctgtattacata

SEQ ID NO: 7999501 - DNA, 22 bp, Homo sapiens
gatatactgtctgtattacata

SEQ ID NO: 7999502 - DNA, 22 bp, Homo sapiens
gatataggttcatagtgttaca

SEQ ID NO: 7999503 - DNA, 22 bp, Homo sapiens
gatataggttcatagtgttaca

SEQ ID NO: 7999504 - DNA, 18 bp, Homo sapiens
gatatataggaggaaagt

SEQ ID NO: 7999505 - DNA, 22 bp, Homo sapiens
gatataggttcatagtgttaca

SEQ ID NO: 7999506 - DNA, 18 bp, Homo sapiens
gatatataggaggaaagt

SEQ ID NO: 7999507 - DNA, 18 bp, Homo sapiens
gatatataggaggaaagt

SEQ ID NO: 7999508 - DNA, 22 bp, Homo sapiens
gatatatcacagcttactgtca

SEQ ID NO: 7999509 - DNA, 22 bp, Homo sapiens
gatatatgtaaaagtagacaga

SEQ ID NO: 7999510 - DNA, 22 bp, Homo sapiens
gatatatttggaccagagcatt

SEQ ID NO: 7999511 - DNA, 22 bp, Homo sapiens
gatatatttggaccagagcatt

SEQ ID NO: 7999512 - DNA, 22 bp, Homo sapiens
gatatatgtaaaagtagacaga

SEQ ID NO: 7999513 - DNA, 22 bp, Homo sapiens
gatattttcagtctcctttcaa

SEQ ID NO: 7999514 - DNA, 22 bp, Homo sapiens
gatatttattaagtggttggta

SEQ ID NO: 7999515 - DNA, 22 bp, Homo sapiens
gatatttacattaagcacattg

SEQ ID NO: 7999516 - DNA, 22 bp, Homo sapiens
gatattttgagaaatcctatga

SEQ ID NO: 7999517 - DNA, 22 bp, Homo sapiens
gatattttgagaaatcctatga

SEQ ID NO: 7999518 - DNA, 22 bp, Homo sapiens
gatattttgagaaatcctatga

SEQ ID NO: 7999519 - DNA, 22 bp, Homo sapiens
gatattttgagaaatcctatga

SEQ ID NO: 7999520 - DNA, 22 bp, Homo sapiens
gatattttgagaaatcctatga

SEQ ID NO: 7999521 - DNA, 22 bp, Homo sapiens
gatatttttaggtgatgcaggc

SEQ ID NO: 7999522 - DNA, 22 bp, Homo sapiens
gatatttttaggtgatgcaggc

SEQ ID NO: 7999523 - DNA, 22 bp, Homo sapiens
gatatttttaggtgatgcaggc

SEQ ID NO: 7999524 - DNA, 22 bp, Homo sapiens
gatatttttaggtgatgcaggc

SEQ ID NO: 7999525 - DNA, 22 bp, Homo sapiens
gatattttgagaaatcctatga

SEQ ID NO: 7999526 - DNA, 22 bp, Homo sapiens
gatatttttaggtgatgcaggc

SEQ ID NO: 7999527 - DNA, 22 bp, Homo sapiens
gatattttcattcggatgctca

SEQ ID NO: 7999528 - DNA, 22 bp, Homo sapiens
gatattttcattcggatgctca

SEQ ID NO: 7999529 - DNA, 22 bp, Homo sapiens
gatattttcagtctcctttcaa

SEQ ID NO: 7999530 - DNA, 22 bp, Homo sapiens
gatattttcagtctcctttcaa

SEQ ID NO: 7999531 - DNA, 22 bp, Homo sapiens
gatattttcagtctcctttcaa

SEQ ID NO: 7999532 - DNA, 22 bp, Homo sapiens
gatattttcgcagggagaattc

SEQ ID NO: 7999533 - DNA, 22 bp, Homo sapiens
gatattttcgcagggagaattc

SEQ ID NO: 7999534 - DNA, 22 bp, Homo sapiens
gatattttcgcagggagaattc

SEQ ID NO: 7999535 - DNA, 22 bp, Homo sapiens
gatattttcattcggatgctca

SEQ ID NO: 7999536 - DNA, 22 bp, Homo sapiens
gatattttcgcagggagaattc

SEQ ID NO: 7999537 - DNA, 22 bp, Homo sapiens
gatcaatggtgtaacttgtcct

SEQ ID NO: 7999538 - DNA, 22 bp, Homo sapiens
gatcaatactattaagatcata

SEQ ID NO: 7999539 - DNA, 22 bp, Homo sapiens
gatcaataagaactggccctaa

SEQ ID NO: 7999540 - DNA, 22 bp, Homo sapiens
gatcacataatttggaaacagc

SEQ ID NO: 7999541 - DNA, 22 bp, Homo sapiens
gatcacagtattttagatgtgt

SEQ ID NO: 7999542 - DNA, 22 bp, Homo sapiens
gatcacatgaatggaatagaag

SEQ ID NO: 7999543 - DNA, 22 bp, Homo sapiens
gatcagaatcttcattttcagt

SEQ ID NO: 7999544 - DNA, 22 bp, Homo sapiens
gatcacatgaatggaatagaag

SEQ ID NO: 7999545 - DNA, 22 bp, Homo sapiens
gatcacatctttatgagtattt

SEQ ID NO: 7999546 - DNA, 22 bp, Homo sapiens
gatatttttgcagacacctggg

SEQ ID NO: 7999547 - DNA, 22 bp, Homo sapiens
gatatttttgcagacacctggg

SEQ ID NO: 7999548 - DNA, 22 bp, Homo sapiens
gatatttttagtatttctgcct

SEQ ID NO: 7999549 - DNA, 22 bp, Homo sapiens
gatatttttagtatttctgcct

SEQ ID NO: 7999550 - DNA, 22 bp, Homo sapiens
gatcaacaacttttgaatagct

SEQ ID NO: 7999551 - DNA, 22 bp, Homo sapiens
gatcaacatgtatttaagagtt

SEQ ID NO: 7999552 - DNA, 22 bp, Homo sapiens
gatcaaatatattatgccacag

SEQ ID NO: 7999553 - DNA, 22 bp, Homo sapiens
gatcaaaagctgggttctaaaa

SEQ ID NO: 7999554 - DNA, 22 bp, Homo sapiens
gatcaaagccagtgaggagtga

SEQ ID NO: 7999555 - DNA, 22 bp, Homo sapiens
gatcaaaagctgggttctaaaa

SEQ ID NO: 7999556 - DNA, 22 bp, Homo sapiens
gatcagtaagtgaataatgagt

SEQ ID NO: 7999557 - DNA, 22 bp, Homo sapiens
gatcaggacatagctataggct

SEQ ID NO: 7999558 - DNA, 20 bp, Homo sapiens
gatcaggaagcggcttggga

SEQ ID NO: 7999559 - DNA, 19 bp, Homo sapiens
gatcagagtgtcagcttgt

SEQ ID NO: 7999560 - DNA, 22 bp, Homo sapiens
gatcagagagttagaaatgtca

SEQ ID NO: 7999561 - DNA, 22 bp, Homo sapiens
gatcagagagttagaaatgtca

SEQ ID NO: 7999562 - DNA, 22 bp, Homo sapiens
gatcagagtggctagagccttg

SEQ ID NO: 7999563 - DNA, 22 bp, Homo sapiens
gatcagaatttacttataattg

SEQ ID NO: 7999564 - DNA, 22 bp, Homo sapiens
gatcagaattcttgtgtgtttc

SEQ ID NO: 7999565 - DNA, 22 bp, Homo sapiens
gatcagagagctctttatggcc

SEQ ID NO: 7999566 - DNA, 22 bp, Homo sapiens
gatcattagcttttcaaaggag

SEQ ID NO: 7999567 - DNA, 22 bp, Homo sapiens
gatcatttcagtccagtaaata

SEQ ID NO: 7999568 - DNA, 22 bp, Homo sapiens
gatcatttacttgttctggact

SEQ ID NO: 7999569 - DNA, 22 bp, Homo sapiens
gatcatgctggctgccctgttg

SEQ ID NO: 7999570 - DNA, 22 bp, Homo sapiens
gatacacattttagctttgtct

SEQ ID NO: 7999571 - DNA, 23 bp, Homo sapiens
gatacactccctgctgggcactg

SEQ ID NO: 7999572 - DNA, 23 bp, Homo sapiens
gatacactccctgctgggcactg

SEQ ID NO: 7999573 - DNA, 22 bp, Homo sapiens
gatacactggccaagtggagga

SEQ ID NO: 7999574 - DNA, 22 bp, Homo sapiens
gatacactggagcttcctgaca

SEQ ID NO: 7999575 - DNA, 22 bp, Homo sapiens
gatacactggccaagtggagga

SEQ ID NO: 7999576 - DNA, 22 bp, Homo sapiens
gatacagatctttaactgccct

SEQ ID NO: 7999577 - DNA, 22 bp, Homo sapiens
gatacagtatttaaagagcaac

SEQ ID NO: 7999578 - DNA, 22 bp, Homo sapiens
gatacagacaccactcttttcc

SEQ ID NO: 7999579 - DNA, 21 bp, Homo sapiens
gatacagagggccactgattg

SEQ ID NO: 7999580 - DNA, 22 bp, Homo sapiens
gatacattttatctcctaacag

SEQ ID NO: 7999581 - DNA, 22 bp, Homo sapiens
gatacatttcaaggaggactgg

SEQ ID NO: 7999582 - DNA, 22 bp, Homo sapiens
gatacattgagggtggaggacc

SEQ ID NO: 7999583 - DNA, 22 bp, Homo sapiens
gatacatttcaaggaggactgg

SEQ ID NO: 7999584 - DNA, 22 bp, Homo sapiens
gatacattttatctcctaacag

SEQ ID NO: 7999585 - DNA, 22 bp, Homo sapiens
gatacattccatttctacttaa

SEQ ID NO: 7999586 - DNA, 22 bp, Homo sapiens
gatacattccatttctacttaa

SEQ ID NO: 7999587 - DNA, 22 bp, Homo sapiens
gatacattccgggagggctacc

SEQ ID NO: 7999588 - DNA, 22 bp, Homo sapiens
gatacattgagggtggaggacc

SEQ ID NO: 7999589 - DNA, 22 bp, Homo sapiens
gatacattgagggtggaggacc

SEQ ID NO: 7999590 - DNA, 22 bp, Homo sapiens
gatacattccgggagggctacc

SEQ ID NO: 7999591 - DNA, 22 bp, Homo sapiens
gatacattccatttctacttaa

SEQ ID NO: 7999592 - DNA, 22 bp, Homo sapiens
gatacataaaaatgtgctctat

SEQ ID NO: 7999593 - DNA, 20 bp, Homo sapiens
gatacacagcttcactgttg

SEQ ID NO: 7999594 - DNA, 22 bp, Homo sapiens
gatacacagggctaagatggat

SEQ ID NO: 7999595 - DNA, 15 bp, Homo sapiens
gatacacatgactgg

SEQ ID NO: 7999596 - DNA, 22 bp, Homo sapiens
gatacacatgcatgtgcatgta

SEQ ID NO: 7999597 - DNA, 20 bp, Homo sapiens
gatacacagcacagagggcc

SEQ ID NO: 7999598 - DNA, 20 bp, Homo sapiens
gatacacagcacagagggcc

SEQ ID NO: 7999599 - DNA, 22 bp, Homo sapiens
gatacacacccttgataggact

SEQ ID NO: 7999600 - DNA, 22 bp, Homo sapiens
gatacacacccttgataggact

SEQ ID NO: 7999601 - DNA, 22 bp, Homo sapiens
gatacacacccttgataggact

SEQ ID NO: 7999602 - DNA, 22 bp, Homo sapiens
gataatatctggtttattcacc

SEQ ID NO: 7999603 - DNA, 22 bp, Homo sapiens
gataatatctggtttattcacc

SEQ ID NO: 7999604 - DNA, 22 bp, Homo sapiens
gataatacttattaagcactta

SEQ ID NO: 7999605 - DNA, 22 bp, Homo sapiens
gataagttatgtaacttgctca

SEQ ID NO: 7999606 - DNA, 22 bp, Homo sapiens
gataataagcacagcaggatgt

SEQ ID NO: 7999607 - DNA, 22 bp, Homo sapiens
gataataagcacagcaggatgt

SEQ ID NO: 7999608 - DNA, 22 bp, Homo sapiens
gataagcactatataagtattt

SEQ ID NO: 7999609 - DNA, 22 bp, Homo sapiens
gataactacacttaagacaacc

SEQ ID NO: 7999610 - DNA, 22 bp, Homo sapiens
gataactgaacagattcacaaa

SEQ ID NO: 7999611 - DNA, 22 bp, Homo sapiens
gataaggactttggggtctaca

SEQ ID NO: 7999612 - DNA, 21 bp, Homo sapiens
gataaggcaggaggataagta

SEQ ID NO: 7999613 - DNA, 22 bp, Homo sapiens
gataccttttgttggaatttcc

SEQ ID NO: 7999614 - DNA, 22 bp, Homo sapiens
gatacccagcaaaatgcaggag

SEQ ID NO: 7999615 - DNA, 22 bp, Homo sapiens
gataccagacagggagggagaa

SEQ ID NO: 7999616 - DNA, 22 bp, Homo sapiens
gataccagacagggagggagaa

SEQ ID NO: 7999617 - DNA, 22 bp, Homo sapiens
gataccagacagggagggagaa

SEQ ID NO: 7999618 - DNA, 22 bp, Homo sapiens
gataccagacagggagggagaa

SEQ ID NO: 7999619 - DNA, 22 bp, Homo sapiens
gatagaaagaatatagattcca

SEQ ID NO: 7999620 - DNA, 22 bp, Homo sapiens
gatagaaagaatatagattcca

SEQ ID NO: 7999621 - DNA, 22 bp, Homo sapiens
gatagaaagaatatagattcca

SEQ ID NO: 7999622 - DNA, 22 bp, Homo sapiens
gatagaaagaatatagattcca

SEQ ID NO: 7999623 - DNA, 22 bp, Homo sapiens
gatactttccatccaaatgcat

SEQ ID NO: 7999624 - DNA, 22 bp, Homo sapiens
gatactttccatccaaatgcat

SEQ ID NO: 7999625 - DNA, 22 bp, Homo sapiens
gatagaaagaatatagattcca

SEQ ID NO: 7999626 - DNA, 22 bp, Homo sapiens
gatagaaagagtggttcttttt

SEQ ID NO: 7999627 - DNA, 22 bp, Homo sapiens
gatagaaagagtggttcttttt

SEQ ID NO: 7999628 - DNA, 22 bp, Homo sapiens
gatagaaaggtgttgaaatcca

SEQ ID NO: 7999629 - DNA, 22 bp, Homo sapiens
gatagaaaggtgttgaaatcca

SEQ ID NO: 7999630 - DNA, 22 bp, Homo sapiens
gatagaaaggtgttgaaatcca

SEQ ID NO: 7999631 - DNA, 22 bp, Homo sapiens
gatagagactataatgctcttt

SEQ ID NO: 7999632 - DNA, 22 bp, Homo sapiens
gatagagaaacacagataaatg

SEQ ID NO: 7999633 - DNA, 22 bp, Homo sapiens
gatagataaaactatattttca

SEQ ID NO: 7999634 - DNA, 22 bp, Homo sapiens
gatagcaacatagaacagaatt

SEQ ID NO: 7999635 - DNA, 22 bp, Homo sapiens
gatagcaacatagaacagaatt

SEQ ID NO: 7999636 - DNA, 22 bp, Homo sapiens
gatagataaaactatattttca

SEQ ID NO: 7999637 - DNA, 22 bp, Homo sapiens
gatatacaatccacagttgatt

SEQ ID NO: 7999638 - DNA, 22 bp, Homo sapiens
gatatacaatccacagttgatt

SEQ ID NO: 7999639 - DNA, 22 bp, Homo sapiens
gatataaattaatcaagtgcaa

SEQ ID NO: 7999640 - DNA, 22 bp, Homo sapiens
gatatacaatccacagttgatt

SEQ ID NO: 7999641 - DNA, 22 bp, Homo sapiens
gatatacaatccacagttgatt

SEQ ID NO: 7999642 - DNA, 22 bp, Homo sapiens
gatatacagagcattctttgat

SEQ ID NO: 7999643 - DNA, 22 bp, Homo sapiens
gatatacagagcattctttgat

SEQ ID NO: 7999644 - DNA, 22 bp, Homo sapiens
gatatacaatccacagttgatt

SEQ ID NO: 7999645 - DNA, 22 bp, Homo sapiens
gatatacagagcattctttgat

SEQ ID NO: 7999646 - DNA, 22 bp, Homo sapiens
gatataaattaatcaagtgcaa

SEQ ID NO: 7999647 - DNA, 22 bp, Homo sapiens
gatataaattaatcaagtgcaa

SEQ ID NO: 7999648 - DNA, 22 bp, Homo sapiens
gatataaattaatcaagtgcaa

SEQ ID NO: 7999649 - DNA, 22 bp, Homo sapiens
gatataaattaatcaagtgcaa

SEQ ID NO: 7999650 - DNA, 22 bp, Homo sapiens
gatataaattaatcaagtgcaa

SEQ ID NO: 7999651 - DNA, 19 bp, Homo sapiens
gatagctgatgaccatcat

SEQ ID NO: 7999652 - DNA, 22 bp, Homo sapiens
gatagctgctgggatattttta

SEQ ID NO: 7999653 - DNA, 22 bp, Homo sapiens
gatagctgctgggatattttta

SEQ ID NO: 7999654 - DNA, 22 bp, Homo sapiens
gataggagatgatccaatggga

SEQ ID NO: 7999655 - DNA, 22 bp, Homo sapiens
gatagataaaactatattttca

SEQ ID NO: 7999656 - DNA, 19 bp, Homo sapiens
gataggcagccatgagccc

SEQ ID NO: 7999657 - DNA, 22 bp, Homo sapiens
gataggctgaaagactatggcg

SEQ ID NO: 7999658 - DNA, 22 bp, Homo sapiens
gatagtcacctcccttaacttt

SEQ ID NO: 7999659 - DNA, 22 bp, Homo sapiens
gatagtcacctcccttaacttt

SEQ ID NO: 7999660 - DNA, 19 bp, Homo sapiens
gatataaagagatggtgaa

SEQ ID NO: 7999661 - DNA, 19 bp, Homo sapiens
gatataaagagatggtgaa

SEQ ID NO: 7999662 - DNA, 22 bp, Homo sapiens
gcagcgtggggctgagtcagct

SEQ ID NO: 7999663 - DNA, 22 bp, Homo sapiens
gcagcgtggggacaggagctca

SEQ ID NO: 7999664 - DNA, 22 bp, Homo sapiens
gcagcgtggggacaggagctca

SEQ ID NO: 7999665 - DNA, 22 bp, Homo sapiens
gcagcgtggggctgagtcagct

SEQ ID NO: 7999666 - DNA, 22 bp, Homo sapiens
gcagcgtggggctgagtcagct

SEQ ID NO: 7999667 - DNA, 18 bp, Homo sapiens
gcagctagccaggggggc

SEQ ID NO: 7999668 - DNA, 18 bp, Homo sapiens
gcagctagccaggggggc

SEQ ID NO: 7999669 - DNA, 18 bp, Homo sapiens
gcagctagccaggggggc

SEQ ID NO: 7999670 - DNA, 18 bp, Homo sapiens
gcagctagccaggggggc

SEQ ID NO: 7999671 - DNA, 23 bp, Homo sapiens
gcagcgtccgcaccccggccggg

SEQ ID NO: 7999672 - DNA, 22 bp, Homo sapiens
gcagcgtgatcccgcatttagg

SEQ ID NO: 7999673 - DNA, 17 bp, Homo sapiens
gcagcctcttggtagtg

SEQ ID NO: 7999674 - DNA, 22 bp, Homo sapiens
gcagcctctgcagttcaggagg

SEQ ID NO: 7999675 - DNA, 22 bp, Homo sapiens
gcagcctctgcagttcaggagg

SEQ ID NO: 7999676 - DNA, 16 bp, Homo sapiens
gcagagctcagggact

SEQ ID NO: 7999677 - DNA, 16 bp, Homo sapiens
gcagagctcagggact

SEQ ID NO: 7999678 - DNA, 22 bp, Homo sapiens
gcagagctcaaggtgttcagct

SEQ ID NO: 7999679 - DNA, 22 bp, Homo sapiens
gcagagctcaaggtgttcagct

SEQ ID NO: 7999680 - DNA, 22 bp, Homo sapiens
gcagagcggtgatcaggcgcag

SEQ ID NO: 7999681 - DNA, 22 bp, Homo sapiens
gcagcctctgcagttcaggagg

SEQ ID NO: 7999682 - DNA, 22 bp, Homo sapiens
gcagcctctgatgatggccgta

SEQ ID NO: 7999683 - DNA, 22 bp, Homo sapiens
gcagcctctgatgatggccgta

SEQ ID NO: 7999684 - DNA, 22 bp, Homo sapiens
gcagagctcatgcctgcacctc

SEQ ID NO: 7999685 - DNA, 20 bp, Homo sapiens
gcagagcctcactgcaaggg

SEQ ID NO: 7999686 - DNA, 22 bp, Homo sapiens
gcagagccgtgaatggatttca

SEQ ID NO: 7999687 - DNA, 20 bp, Homo sapiens
gcagagcctcactgcaaggg

SEQ ID NO: 7999688 - DNA, 20 bp, Homo sapiens
gcagagcctcactgcaaggg

SEQ ID NO: 7999689 - DNA, 20 bp, Homo sapiens
gcagagcctcactgcaaggg

SEQ ID NO: 7999690 - DNA, 20 bp, Homo sapiens
gcagagcctcactgcaaggg

SEQ ID NO: 7999691 - DNA, 21 bp, Homo sapiens
gcagagccggggcgagaaggc

SEQ ID NO: 7999692 - DNA, 21 bp, Homo sapiens
gcagagccggggcgagaaggc

SEQ ID NO: 7999693 - DNA, 22 bp, Homo sapiens
gcagagcccctcaagccagcct

SEQ ID NO: 7999694 - DNA, 21 bp, Homo sapiens
gcagagccggggcgagaaggc

SEQ ID NO: 7999695 - DNA, 21 bp, Homo sapiens
gcagagccggggcgagaaggc

SEQ ID NO: 7999696 - DNA, 22 bp, Homo sapiens
gcagagcctgggggtctgcgga

SEQ ID NO: 7999697 - DNA, 22 bp, Homo sapiens
gcagagcctgggggtctgcgga

SEQ ID NO: 7999698 - DNA, 22 bp, Homo sapiens
gcagagcctgggggtctgcgga

SEQ ID NO: 7999699 - DNA, 21 bp, Homo sapiens
gcagagcctgaggttcttgag

SEQ ID NO: 7999700 - DNA, 22 bp, Homo sapiens
gcagagcctgggggtctgcgga

SEQ ID NO: 7999701 - DNA, 22 bp, Homo sapiens
gcagagcctgggggtctgcgga

SEQ ID NO: 7999702 - DNA, 22 bp, Homo sapiens
gcagagcctgtgtctgagcaaa

SEQ ID NO: 7999703 - DNA, 22 bp, Homo sapiens
gcagagcctgtgtctgagcaaa

SEQ ID NO: 7999704 - DNA, 22 bp, Homo sapiens
gcagagcctgtgtctgagcaaa

SEQ ID NO: 7999705 - DNA, 22 bp, Homo sapiens
gcagagcctgtgtctgagcaaa

SEQ ID NO: 7999706 - DNA, 22 bp, Homo sapiens
gcagagcctgtgtctgagcaaa

SEQ ID NO: 7999707 - DNA, 22 bp, Homo sapiens
gcagagcctgtgtctgagcaaa

SEQ ID NO: 7999708 - DNA, 22 bp, Homo sapiens
gcagagccttgcgtcatgtgcc

SEQ ID NO: 7999709 - DNA, 22 bp, Homo sapiens
gcagagcggtgatcaggcgcag

SEQ ID NO: 7999710 - DNA, 22 bp, Homo sapiens
gcagagccttgcgtcatgtgcc

SEQ ID NO: 7999711 - DNA, 22 bp, Homo sapiens
gcagagccttgcgtcatgtgcc

SEQ ID NO: 7999712 - DNA, 22 bp, Homo sapiens
gcagctcagggagagggcacca

SEQ ID NO: 7999713 - DNA, 22 bp, Homo sapiens
gcagctcccatcagggcacaga

SEQ ID NO: 7999714 - DNA, 22 bp, Homo sapiens
gcagctcccagcttgaaaggtc

SEQ ID NO: 7999715 - DNA, 22 bp, Homo sapiens
gcagctcaagagaggtgctatg

SEQ ID NO: 7999716 - DNA, 22 bp, Homo sapiens
gcagctattgtctcctgggccc

SEQ ID NO: 7999717 - DNA, 22 bp, Homo sapiens
gcagctattgtctcctgggccc

SEQ ID NO: 7999718 - DNA, 22 bp, Homo sapiens
gcagctattgtctcctgggccc

SEQ ID NO: 7999719 - DNA, 22 bp, Homo sapiens
gcagctattgtctcctgggccc

SEQ ID NO: 7999720 - DNA, 22 bp, Homo sapiens
gcagctattgtctcctgggccc

SEQ ID NO: 7999721 - DNA, 22 bp, Homo sapiens
gcagctagtccagttatgtggc

SEQ ID NO: 7999722 - DNA, 22 bp, Homo sapiens
gcagctcaaaggccacggacgg

SEQ ID NO: 7999723 - DNA, 22 bp, Homo sapiens
gcagctattgtctcctgggccc

SEQ ID NO: 7999724 - DNA, 22 bp, Homo sapiens
gcagctattgtctcctgggccc

SEQ ID NO: 7999725 - DNA, 22 bp, Homo sapiens
gcagctcctggcacagtttttt

SEQ ID NO: 7999726 - DNA, 22 bp, Homo sapiens
gcagctcctcctgggctggaga

SEQ ID NO: 7999727 - DNA, 22 bp, Homo sapiens
gcagctcctggcacagtttttt

SEQ ID NO: 7999728 - DNA, 22 bp, Homo sapiens
gcagctccttcaatctcaccat

SEQ ID NO: 7999729 - DNA, 22 bp, Homo sapiens
gcagctccttcaatctcaccat

SEQ ID NO: 7999730 - DNA, 22 bp, Homo sapiens
gcagctcctttaggctgcaaag

SEQ ID NO: 7999731 - DNA, 22 bp, Homo sapiens
gcagctcccatcagggcacaga

SEQ ID NO: 7999732 - DNA, 22 bp, Homo sapiens
gcagctcccatcagggcacaga

SEQ ID NO: 7999733 - DNA, 22 bp, Homo sapiens
gcagctccctggctgcaaatga

SEQ ID NO: 7999734 - DNA, 22 bp, Homo sapiens
gcagctccctggctgcaaatga

SEQ ID NO: 7999735 - DNA, 22 bp, Homo sapiens
gcagctccctggctgcaaatga

SEQ ID NO: 7999736 - DNA, 22 bp, Homo sapiens
gcagctcccttgaacttctcct

SEQ ID NO: 7999737 - DNA, 22 bp, Homo sapiens
gcagctcccttgaacttctcct

SEQ ID NO: 7999738 - DNA, 22 bp, Homo sapiens
gcagctcccttgaacttctcct

SEQ ID NO: 7999739 - DNA, 22 bp, Homo sapiens
gcagctcctcctgggctggaga

SEQ ID NO: 7999740 - DNA, 22 bp, Homo sapiens
gcagctcctcctgggctggaga

SEQ ID NO: 7999741 - DNA, 18 bp, Homo sapiens
gcagctgacactggagtt

SEQ ID NO: 7999742 - DNA, 22 bp, Homo sapiens
gcagctgaatgtccattgctgc

SEQ ID NO: 7999743 - DNA, 22 bp, Homo sapiens
gcagctgaatgtccattgctgc

SEQ ID NO: 7999744 - DNA, 22 bp, Homo sapiens
gcagctgaagctgcagttccag

SEQ ID NO: 7999745 - DNA, 20 bp, Homo sapiens
gcagctgaaagtatgacacc

SEQ ID NO: 7999746 - DNA, 22 bp, Homo sapiens
gcagctgaaagggatctctaca

SEQ ID NO: 7999747 - DNA, 22 bp, Homo sapiens
gcagctgaaagggatctctaca

SEQ ID NO: 7999748 - DNA, 22 bp, Homo sapiens
gcagctgaaagggatctctaca

SEQ ID NO: 7999749 - DNA, 22 bp, Homo sapiens
gcagctcctttaggctgcaaag

SEQ ID NO: 7999750 - DNA, 22 bp, Homo sapiens
gcagctctatgtgatggtaaat

SEQ ID NO: 7999751 - DNA, 22 bp, Homo sapiens
gcagctctcctctgtgaggaac

SEQ ID NO: 7999752 - DNA, 22 bp, Homo sapiens
gcagctctcctctgtgaggaac

SEQ ID NO: 7999753 - DNA, 22 bp, Homo sapiens
gcagctctcctctgtgaggaac

SEQ ID NO: 7999754 - DNA, 22 bp, Homo sapiens
gcagctctctggcctgccctgg

SEQ ID NO: 7999755 - DNA, 22 bp, Homo sapiens
gcagctctctggcctgccctgg

SEQ ID NO: 7999756 - DNA, 22 bp, Homo sapiens
gcagctctgacaatgcctggaa

SEQ ID NO: 7999757 - DNA, 22 bp, Homo sapiens
gcagctctgacaatgcctggaa

SEQ ID NO: 7999758 - DNA, 22 bp, Homo sapiens
gcagctctgattggttcagcct

SEQ ID NO: 7999759 - DNA, 22 bp, Homo sapiens
gcagctctgagactctacagaa

SEQ ID NO: 7999760 - DNA, 22 bp, Homo sapiens
gcagctctgagactctacagaa

SEQ ID NO: 7999761 - DNA, 22 bp, Homo sapiens
gcagctctggggcaggcctgag

SEQ ID NO: 7999762 - DNA, 22 bp, Homo sapiens
gcagctctggggcaggcctgag

SEQ ID NO: 7999763 - DNA, 22 bp, Homo sapiens
gcagctctgagactctacagaa

SEQ ID NO: 7999764 - DNA, 22 bp, Homo sapiens
gcagctctgtctttcttaaagt

SEQ ID NO: 7999765 - DNA, 22 bp, Homo sapiens
gcagctcttttcttaaagagat

SEQ ID NO: 7999766 - DNA, 22 bp, Homo sapiens
gcagctcttttcttaaagagat

SEQ ID NO: 7999767 - DNA, 19 bp, Homo sapiens
gcaggcacagccctgggtg

SEQ ID NO: 7999768 - DNA, 19 bp, Homo sapiens
gcaggcacagccctgggtg

SEQ ID NO: 7999769 - DNA, 19 bp, Homo sapiens
gcaggcacagccctgggtg

SEQ ID NO: 7999770 - DNA, 22 bp, Homo sapiens
gcaggcaccacggctcaggtct

SEQ ID NO: 7999771 - DNA, 22 bp, Homo sapiens
gcaggcacatgggcgggtctgg

SEQ ID NO: 7999772 - DNA, 22 bp, Homo sapiens
gcaggcacatgggcgggtctgg

SEQ ID NO: 7999773 - DNA, 22 bp, Homo sapiens
gcaggagttagggtaaaaatga

SEQ ID NO: 7999774 - DNA, 23 bp, Homo sapiens
gcaggagttcctggactccagga

SEQ ID NO: 7999775 - DNA, 22 bp, Homo sapiens
gcaggagttcaattgcccatga

SEQ ID NO: 7999776 - DNA, 19 bp, Homo sapiens
gcaggcacagccctgggtg

SEQ ID NO: 7999777 - DNA, 23 bp, Homo sapiens
gcaggagttcctggactccagga

SEQ ID NO: 7999778 - DNA, 22 bp, Homo sapiens
gcaggcaccgcggcggcaggtt

SEQ ID NO: 7999779 - DNA, 22 bp, Homo sapiens
gcaggcaccgcggcggcaggtt

SEQ ID NO: 7999780 - DNA, 22 bp, Homo sapiens
gcaggcaccgcggcggcaggtt

SEQ ID NO: 7999781 - DNA, 22 bp, Homo sapiens
gcaggcaccacggctcaggtct

SEQ ID NO: 7999782 - DNA, 22 bp, Homo sapiens
gcaggcaccacggctcaggtct

SEQ ID NO: 7999783 - DNA, 22 bp, Homo sapiens
gcaggcaccgcggcggcaggtt

SEQ ID NO: 7999784 - DNA, 22 bp, Homo sapiens
gcaggcaccacggctcaggtct

SEQ ID NO: 7999785 - DNA, 22 bp, Homo sapiens
gcaggcaccgggttgctcccct

SEQ ID NO: 7999786 - DNA, 22 bp, Homo sapiens
gcaggcaccgggttgctcccct

SEQ ID NO: 7999787 - DNA, 22 bp, Homo sapiens
gcaggcaccgcggcggcaggtt

SEQ ID NO: 7999788 - DNA, 22 bp, Homo sapiens
gcaggcaccgggttgctcccct

SEQ ID NO: 7999789 - DNA, 22 bp, Homo sapiens
gcaggcactcctaggaccatca

SEQ ID NO: 7999790 - DNA, 22 bp, Homo sapiens
gcaggcacctcgtggagtggaa

SEQ ID NO: 7999791 - DNA, 22 bp, Homo sapiens
gcaggagccaggccgagctggt

SEQ ID NO: 7999792 - DNA, 22 bp, Homo sapiens
gcaggagccaggccgagctggt

SEQ ID NO: 7999793 - DNA, 22 bp, Homo sapiens
gcaggagccaggccgagctggt

SEQ ID NO: 7999794 - DNA, 22 bp, Homo sapiens
gcaggagccacttcagggatgc

SEQ ID NO: 7999795 - DNA, 22 bp, Homo sapiens
gcaggagccacttcagggatgc

SEQ ID NO: 7999796 - DNA, 22 bp, Homo sapiens
gcaggagagccagcaggcttcc

SEQ ID NO: 7999797 - DNA, 22 bp, Homo sapiens
gcaggagccaggccgagctggt

SEQ ID NO: 7999798 - DNA, 22 bp, Homo sapiens
gcaggagccaggccgagctggt

SEQ ID NO: 7999799 - DNA, 22 bp, Homo sapiens
gcaggagccaggccgagctggt

SEQ ID NO: 7999800 - DNA, 22 bp, Homo sapiens
gcaggagccagggattccagga

SEQ ID NO: 7999801 - DNA, 22 bp, Homo sapiens
gcaggagccctggcatgttctt

SEQ ID NO: 7999802 - DNA, 22 bp, Homo sapiens
gcaggagttaggcgtcgtggat

SEQ ID NO: 7999803 - DNA, 22 bp, Homo sapiens
gcaggagctgctctcctgacga

SEQ ID NO: 7999804 - DNA, 22 bp, Homo sapiens
gcaggagctgctctcctgacga

SEQ ID NO: 7999805 - DNA, 22 bp, Homo sapiens
gcaggagctgctctcctgacga

SEQ ID NO: 7999806 - DNA, 22 bp, Homo sapiens
gcaggagctcgtttccaggctg

SEQ ID NO: 7999807 - DNA, 22 bp, Homo sapiens
gcaggagctcgtttccaggctg

SEQ ID NO: 7999808 - DNA, 22 bp, Homo sapiens
gcaggagccctggcatgttctt

SEQ ID NO: 7999809 - DNA, 22 bp, Homo sapiens
gcaggagctcgtttccaggctg

SEQ ID NO: 7999810 - DNA, 22 bp, Homo sapiens
gcaggagctcgtttccaggctg

SEQ ID NO: 7999811 - DNA, 22 bp, Homo sapiens
gcaggagctcgtttccaggctg

SEQ ID NO: 7999812 - DNA, 22 bp, Homo sapiens
gcaggagctcgtttccaggctg

SEQ ID NO: 7999813 - DNA, 22 bp, Homo sapiens
gcaggagctcgtttccaggctg

SEQ ID NO: 7999814 - DNA, 22 bp, Homo sapiens
gcaggacaggcgttggtccagt

SEQ ID NO: 7999815 - DNA, 22 bp, Homo sapiens
gcaggacaggcgttggtccagt

SEQ ID NO: 7999816 - DNA, 22 bp, Homo sapiens
gcaggacaggcgttggtccagt

SEQ ID NO: 7999817 - DNA, 22 bp, Homo sapiens
gcaggacaggcgttggtccagt

SEQ ID NO: 7999818 - DNA, 22 bp, Homo sapiens
gcaggacattcagtgaatgggc

SEQ ID NO: 7999819 - DNA, 22 bp, Homo sapiens
gcaggaccaggcacgagggcca

SEQ ID NO: 7999820 - DNA, 22 bp, Homo sapiens
gcaggaccaggcacgagggcca

SEQ ID NO: 7999821 - DNA, 19 bp, Homo sapiens
gcaggactcccagctcctc

SEQ ID NO: 7999822 - DNA, 22 bp, Homo sapiens
gcaggacttgaatccaggcagt

SEQ ID NO: 7999823 - DNA, 22 bp, Homo sapiens
gcaggacttgaatccaggcagt

SEQ ID NO: 7999824 - DNA, 22 bp, Homo sapiens
gcaggactcaaatctgaaggca

SEQ ID NO: 7999825 - DNA, 22 bp, Homo sapiens
gcaggactcaaatctgaaggca

SEQ ID NO: 7999826 - DNA, 22 bp, Homo sapiens
gcagctgacatctggctgggcc

SEQ ID NO: 7999827 - DNA, 22 bp, Homo sapiens
gcagctgaatgtccattgctgc

SEQ ID NO: 7999828 - DNA, 22 bp, Homo sapiens
gcagctgagagaagaacagggc

SEQ ID NO: 7999829 - DNA, 22 bp, Homo sapiens
gcaggacagcaggatgcttaga

SEQ ID NO: 7999830 - DNA, 22 bp, Homo sapiens
gcaggacaggcgttggtccagt

SEQ ID NO: 7999831 - DNA, 22 bp, Homo sapiens
gcaggacaggcgttggtccagt

SEQ ID NO: 7999832 - DNA, 22 bp, Homo sapiens
gcaggacagacccaagcagtct

SEQ ID NO: 7999833 - DNA, 22 bp, Homo sapiens
gcaggagaacaaagcaagctgc

SEQ ID NO: 7999834 - DNA, 22 bp, Homo sapiens
gcaggagaacaaagcaagctgc

SEQ ID NO: 7999835 - DNA, 22 bp, Homo sapiens
gcaggagaacaaagcaagctgc

SEQ ID NO: 7999836 - DNA, 22 bp, Homo sapiens
gcaggagaacaaagcaagctgc

SEQ ID NO: 7999837 - DNA, 22 bp, Homo sapiens
gcaggagaacaaagcaagctgc

SEQ ID NO: 7999838 - DNA, 22 bp, Homo sapiens
gcaggagaacaaagcaagctgc

SEQ ID NO: 7999839 - DNA, 22 bp, Homo sapiens
gcaggagaaatgaagattgggt

SEQ ID NO: 7999840 - DNA, 22 bp, Homo sapiens
gcaggagaaatgaagattgggt

SEQ ID NO: 7999841 - DNA, 22 bp, Homo sapiens
gcaggagaaatgaagattgggt

SEQ ID NO: 7999842 - DNA, 22 bp, Homo sapiens
gcaggagaaatgaagattgggt

SEQ ID NO: 7999843 - DNA, 22 bp, Homo sapiens
gcaggagaaatgaagattgggt

SEQ ID NO: 7999844 - DNA, 22 bp, Homo sapiens
gcaggagaaatgaagattgggt

SEQ ID NO: 7999845 - DNA, 22 bp, Homo sapiens
gcaggagaaatgaagattgggt

SEQ ID NO: 7999846 - DNA, 22 bp, Homo sapiens
gcaggagagccagcaggcttcc

SEQ ID NO: 7999847 - DNA, 22 bp, Homo sapiens
gcaggagagccagcaggcttcc

SEQ ID NO: 7999848 - DNA, 22 bp, Homo sapiens
gcaggagagccagcaggcttcc

SEQ ID NO: 7999849 - DNA, 22 bp, Homo sapiens
gcaggagagccagcaggcttcc

SEQ ID NO: 7999850 - DNA, 22 bp, Homo sapiens
gcaggagactggctgtggtagt

SEQ ID NO: 7999851 - DNA, 22 bp, Homo sapiens
gcaggagactggctgtggtagt

SEQ ID NO: 7999852 - DNA, 22 bp, Homo sapiens
gcaggagaacaaagcaagctgc

SEQ ID NO: 7999853 - DNA, 22 bp, Homo sapiens
gcaggagacaactgtaaggaga

SEQ ID NO: 7999854 - DNA, 22 bp, Homo sapiens
gcaggagactggctgtggtagt

SEQ ID NO: 7999855 - DNA, 22 bp, Homo sapiens
gcaggagactggctgtggtagt

SEQ ID NO: 7999856 - DNA, 21 bp, Homo sapiens
gcaggggatagaaatggtctg

SEQ ID NO: 7999857 - DNA, 21 bp, Homo sapiens
gcaggggatagaaatggtctg

SEQ ID NO: 7999858 - DNA, 22 bp, Homo sapiens
gcagggcagccacaggccccct

SEQ ID NO: 7999859 - DNA, 22 bp, Homo sapiens
gcagggcagccacaggccccct

SEQ ID NO: 7999860 - DNA, 22 bp, Homo sapiens
gcagggcagccacaggccccct

SEQ ID NO: 7999861 - DNA, 22 bp, Homo sapiens
gcagggcagccacaggccccct

SEQ ID NO: 7999862 - DNA, 22 bp, Homo sapiens
gcaggggcaggagatctcaggc

SEQ ID NO: 7999863 - DNA, 22 bp, Homo sapiens
gcaggggcaggagatctcaggc

SEQ ID NO: 7999864 - DNA, 22 bp, Homo sapiens
gcagggcagacctccagcctat

SEQ ID NO: 7999865 - DNA, 22 bp, Homo sapiens
gcaggggcaggagatctcaggc

SEQ ID NO: 7999866 - DNA, 22 bp, Homo sapiens
gcaggggcaggagatctcaggc

SEQ ID NO: 7999867 - DNA, 22 bp, Homo sapiens
gcaggggctaaggacacagaga

SEQ ID NO: 7999868 - DNA, 22 bp, Homo sapiens
gcaggggctaaggacacagaga

SEQ ID NO: 7999869 - DNA, 22 bp, Homo sapiens
gcaggggcggctgggtttccag

SEQ ID NO: 7999870 - DNA, 22 bp, Homo sapiens
gcaggggctactctgagcttcc

SEQ ID NO: 7999871 - DNA, 22 bp, Homo sapiens
gcaggggctactctgagcttcc

SEQ ID NO: 7999872 - DNA, 22 bp, Homo sapiens
gcaggggctactctgagcttcc

SEQ ID NO: 7999873 - DNA, 22 bp, Homo sapiens
gcaggggctactctgagcttcc

SEQ ID NO: 7999874 - DNA, 22 bp, Homo sapiens
gcaggggctactctgagcttcc

SEQ ID NO: 7999875 - DNA, 22 bp, Homo sapiens
gcaggggctgctgggaactcgg

SEQ ID NO: 7999876 - DNA, 22 bp, Homo sapiens
gcagggggatggagttgaaatg

SEQ ID NO: 7999877 - DNA, 22 bp, Homo sapiens
gcagggggtcattcacgctggc

SEQ ID NO: 7999878 - DNA, 22 bp, Homo sapiens
gcagggggtcattcacgctggc

SEQ ID NO: 7999879 - DNA, 22 bp, Homo sapiens
gcagggggtcattcacgctggc

SEQ ID NO: 7999880 - DNA, 22 bp, Homo sapiens
gcagggggtcattcacgctggc

SEQ ID NO: 7999881 - DNA, 22 bp, Homo sapiens
gcagggggtcattcacgctggc

SEQ ID NO: 7999882 - DNA, 22 bp, Homo sapiens
gcagggggtcattcacgctggc

SEQ ID NO: 7999883 - DNA, 22 bp, Homo sapiens
gcagggtgaaggtcacatagaa

SEQ ID NO: 7999884 - DNA, 22 bp, Homo sapiens
gcagggtgaaggtcacatagaa

SEQ ID NO: 7999885 - DNA, 22 bp, Homo sapiens
gcagggtgacgttgcccacctc

SEQ ID NO: 7999886 - DNA, 22 bp, Homo sapiens
gcaggggctgagcaccagcggg

SEQ ID NO: 7999887 - DNA, 22 bp, Homo sapiens
gcaggggctgagcaccagcggg

SEQ ID NO: 7999888 - DNA, 22 bp, Homo sapiens
gcaggggctgagcaccagcggg

SEQ ID NO: 7999889 - DNA, 22 bp, Homo sapiens
gcaggggctgagcaccagcggg

SEQ ID NO: 7999890 - DNA, 22 bp, Homo sapiens
gcaggggctactctgagcttcc

SEQ ID NO: 7999891 - DNA, 22 bp, Homo sapiens
gcaggggctgagcaccagcggg

SEQ ID NO: 7999892 - DNA, 22 bp, Homo sapiens
gcaggggctgctgggaactcgg

SEQ ID NO: 7999893 - DNA, 22 bp, Homo sapiens
gcaggggctgagcaccagcggg

SEQ ID NO: 7999894 - DNA, 22 bp, Homo sapiens
gcaggggctgctgggaactcgg

SEQ ID NO: 7999895 - DNA, 22 bp, Homo sapiens
gcaggggctgctgggaactcgg

SEQ ID NO: 7999896 - DNA, 22 bp, Homo sapiens
gcagggcaaatgtggaaaggag

SEQ ID NO: 7999897 - DNA, 22 bp, Homo sapiens
gcagggcaaatgtggaaaggag

SEQ ID NO: 7999898 - DNA, 22 bp, Homo sapiens
gcagggcaaatgtggaaaggag

SEQ ID NO: 7999899 - DNA, 22 bp, Homo sapiens
gcagggcaaatgtggaaaggag

SEQ ID NO: 7999900 - DNA, 22 bp, Homo sapiens
gcagggcaaatgtggaaaggag

SEQ ID NO: 7999901 - DNA, 22 bp, Homo sapiens
gcagggcaaatgtggaaaggag

SEQ ID NO: 7999902 - DNA, 20 bp, Homo sapiens
gcagggcaagggatatgaaa

SEQ ID NO: 7999903 - DNA, 20 bp, Homo sapiens
gcagggcaagggatatgaaa

SEQ ID NO: 7999904 - DNA, 20 bp, Homo sapiens
gcagggcaagggatatgaaa

SEQ ID NO: 7999905 - DNA, 22 bp, Homo sapiens
gcagggcaaatgtggaaaggag

SEQ ID NO: 7999906 - DNA, 22 bp, Homo sapiens
gcagggcaaatgtggaaaggag

SEQ ID NO: 7999907 - DNA, 22 bp, Homo sapiens
gcagggcacaaggacgcacagg

SEQ ID NO: 7999908 - DNA, 22 bp, Homo sapiens
gcagggcacaaggacgcacagg

SEQ ID NO: 7999909 - DNA, 22 bp, Homo sapiens
gcagggcacaaggacgcacagg

SEQ ID NO: 7999910 - DNA, 22 bp, Homo sapiens
gcagggcaatgatcccgagagg

SEQ ID NO: 7999911 - DNA, 22 bp, Homo sapiens
gcagggcacacaagaatgataa

SEQ ID NO: 7999912 - DNA, 22 bp, Homo sapiens
gcagggcacaaggacgcacagg

SEQ ID NO: 7999913 - DNA, 22 bp, Homo sapiens
gcagggcacaaggacgcacagg

SEQ ID NO: 7999914 - DNA, 22 bp, Homo sapiens
gcagggcagacctccagcctat

SEQ ID NO: 7999915 - DNA, 22 bp, Homo sapiens
gcagggcagacctccagcctat

SEQ ID NO: 7999916 - DNA, 22 bp, Homo sapiens
gcagggcagacctccagcctat

SEQ ID NO: 7999917 - DNA, 22 bp, Homo sapiens
gcagggcagacctccagcctat

SEQ ID NO: 7999918 - DNA, 22 bp, Homo sapiens
gcagggcagacctccagcctat

SEQ ID NO: 7999919 - DNA, 22 bp, Homo sapiens
gcagggcagaaggtgctgagga

SEQ ID NO: 7999920 - DNA, 22 bp, Homo sapiens
gcagggcagacctccagcctat

SEQ ID NO: 7999921 - DNA, 22 bp, Homo sapiens
gcagggcagagggagaatctct

SEQ ID NO: 7999922 - DNA, 22 bp, Homo sapiens
gcagggcagagggagaatctct

SEQ ID NO: 7999923 - DNA, 22 bp, Homo sapiens
gcagggcagagggagaatctct

SEQ ID NO: 7999924 - DNA, 22 bp, Homo sapiens
gcagggcagacctccagcctat

SEQ ID NO: 7999925 - DNA, 22 bp, Homo sapiens
gcagggcagacctccagcctat

SEQ ID NO: 7999926 - DNA, 22 bp, Homo sapiens
gcagggcagaaggtgctgagga

SEQ ID NO: 7999927 - DNA, 22 bp, Homo sapiens
gcagggcagaaggtgctgagga

SEQ ID NO: 7999928 - DNA, 22 bp, Homo sapiens
gcagggcagaaggtgctgagga

SEQ ID NO: 7999929 - DNA, 22 bp, Homo sapiens
gcagggcagaaggtgctgagga

SEQ ID NO: 7999930 - DNA, 22 bp, Homo sapiens
gcagggcagaaggtgctgagga

SEQ ID NO: 7999931 - DNA, 22 bp, Homo sapiens
gcagggcagaaggtgctgagga

SEQ ID NO: 7999932 - DNA, 22 bp, Homo sapiens
gcagggcacagacagtgccaag

SEQ ID NO: 7999933 - DNA, 22 bp, Homo sapiens
gcagggcacagacagtgccaag

SEQ ID NO: 7999934 - DNA, 22 bp, Homo sapiens
gcagggcacagacagtgccaag

SEQ ID NO: 7999935 - DNA, 22 bp, Homo sapiens
gcagggcacagacagtgccaag

SEQ ID NO: 7999936 - DNA, 22 bp, Homo sapiens
gcagggcacagacagtgccaag

SEQ ID NO: 7999937 - DNA, 22 bp, Homo sapiens
gcagggcacagacagtgccaag

SEQ ID NO: 7999938 - DNA, 22 bp, Homo sapiens
gcagggacgcagcactctccgt

SEQ ID NO: 7999939 - DNA, 22 bp, Homo sapiens
gcagggaccttgcccaccctcc

SEQ ID NO: 7999940 - DNA, 22 bp, Homo sapiens
gcagggaccttgcccaccctcc

SEQ ID NO: 7999941 - DNA, 22 bp, Homo sapiens
gcagggacgcagcactctccgt

SEQ ID NO: 7999942 - DNA, 22 bp, Homo sapiens
gcagggaagacccggagcagcg

SEQ ID NO: 7999943 - DNA, 22 bp, Homo sapiens
gcagggaaacaggtgctaagga

SEQ ID NO: 7999944 - DNA, 22 bp, Homo sapiens
gcagggacgccagggacagcaa

SEQ ID NO: 7999945 - DNA, 22 bp, Homo sapiens
gcagggacgccagggacagcaa

SEQ ID NO: 7999946 - DNA, 22 bp, Homo sapiens
gcagggacgcagcactctccgt

SEQ ID NO: 7999947 - DNA, 22 bp, Homo sapiens
gcagggacgcagcactctccgt

SEQ ID NO: 7999948 - DNA, 22 bp, Homo sapiens
gcagggcaaacccaggtgttca

SEQ ID NO: 7999949 - DNA, 22 bp, Homo sapiens
gcagggacgccagggacagcaa

SEQ ID NO: 7999950 - DNA, 22 bp, Homo sapiens
gcagggacgccagggacagcaa

SEQ ID NO: 7999951 - DNA, 22 bp, Homo sapiens
gcagggacgccagggacagcaa

SEQ ID NO: 7999952 - DNA, 22 bp, Homo sapiens
gcaggcttgggacgagctggag

SEQ ID NO: 7999953 - DNA, 22 bp, Homo sapiens
gcaggcttgggacgagctggag

SEQ ID NO: 7999954 - DNA, 19 bp, Homo sapiens
gcaggcttgggtctcccca

SEQ ID NO: 7999955 - DNA, 19 bp, Homo sapiens
gcaggcttgggtctcccca

SEQ ID NO: 7999956 - DNA, 22 bp, Homo sapiens
gcaggcttgggacgagctggag

SEQ ID NO: 7999957 - DNA, 22 bp, Homo sapiens
gcaggcttgcccggcctccttc

SEQ ID NO: 7999958 - DNA, 22 bp, Homo sapiens
gcaggcttgagagatcagatgg

SEQ ID NO: 7999959 - DNA, 22 bp, Homo sapiens
gcaggctttgacttggggcagc

SEQ ID NO: 7999960 - DNA, 22 bp, Homo sapiens
gcaggctttgacttggggcagc

SEQ ID NO: 7999961 - DNA, 22 bp, Homo sapiens
gcaggctttgacttggggcaac

SEQ ID NO: 7999962 - DNA, 22 bp, Homo sapiens
gcaggctttgacttggggcaac

SEQ ID NO: 7999963 - DNA, 22 bp, Homo sapiens
gcagggaaacaggtgctaagga

SEQ ID NO: 7999964 - DNA, 22 bp, Homo sapiens
gcagggaagacccggagcagcg

SEQ ID NO: 7999965 - DNA, 18 bp, Homo sapiens
gcaggcttttcctgggtc

SEQ ID NO: 7999966 - DNA, 22 bp, Homo sapiens
gcagggaaacaggtgctaagga

SEQ ID NO: 7999967 - DNA, 22 bp, Homo sapiens
gcaggctggtctgaccatccct

SEQ ID NO: 7999968 - DNA, 22 bp, Homo sapiens
gcaggctggtctgaccatccct

SEQ ID NO: 7999969 - DNA, 22 bp, Homo sapiens
gcaggctggtctgaccatccct

SEQ ID NO: 7999970 - DNA, 22 bp, Homo sapiens
gcaggctgtggtatgttgggca

SEQ ID NO: 7999971 - DNA, 22 bp, Homo sapiens
gcaggctggtctgaccatccct

SEQ ID NO: 7999972 - DNA, 22 bp, Homo sapiens
gcaggctggtctgaccatccct

SEQ ID NO: 7999973 - DNA, 22 bp, Homo sapiens
gcaggctggtctgaccatccct

SEQ ID NO: 7999974 - DNA, 21 bp, Homo sapiens
gcaggctggtcaaacctcagt

SEQ ID NO: 7999975 - DNA, 22 bp, Homo sapiens
gcaggcttcaagcacagctttt

SEQ ID NO: 7999976 - DNA, 22 bp, Homo sapiens
gcaggcttatggggagacagag

SEQ ID NO: 7999977 - DNA, 22 bp, Homo sapiens
gcaggctgtggtatgttgggca

SEQ ID NO: 7999978 - DNA, 22 bp, Homo sapiens
gcaggcttgcccggcctccttc

SEQ ID NO: 7999979 - DNA, 22 bp, Homo sapiens
gcaggcttgagagatcagatgg

SEQ ID NO: 7999980 - DNA, 22 bp, Homo sapiens
gcaggctggggtagccccactt

SEQ ID NO: 7999981 - DNA, 22 bp, Homo sapiens
gcaggctggggtagccccactt

SEQ ID NO: 7999982 - DNA, 22 bp, Homo sapiens
gcaggctggggtagccccactt

SEQ ID NO: 7999983 - DNA, 22 bp, Homo sapiens
gcaggctggggtagccccactt

SEQ ID NO: 7999984 - DNA, 22 bp, Homo sapiens
gcaggctggggtagccccactt

SEQ ID NO: 7999985 - DNA, 22 bp, Homo sapiens
gcaggctggggtagccccactt

SEQ ID NO: 7999986 - DNA, 22 bp, Homo sapiens
gcaggctggggtagccccactt

SEQ ID NO: 7999987 - DNA, 22 bp, Homo sapiens
gcaggctggggtagccccactt

SEQ ID NO: 7999988 - DNA, 21 bp, Homo sapiens
gcaggctggtcaaacctcagt

SEQ ID NO: 7999989 - DNA, 21 bp, Homo sapiens
gcaggctggtcaaacctcagt

SEQ ID NO: 7999990 - DNA, 21 bp, Homo sapiens
gcaggctggtcaaacctcagt

SEQ ID NO: 7999991 - DNA, 21 bp, Homo sapiens
gcaggctggtcaaacctcagt

SEQ ID NO: 7999992 - DNA, 21 bp, Homo sapiens
gcaggctggtcaaacctcagt

SEQ ID NO: 7999993 - DNA, 21 bp, Homo sapiens
gcaggctggtcaaacctcagt

SEQ ID NO: 7999994 - DNA, 22 bp, Homo sapiens
gcaggcagaggtggaggagaca

SEQ ID NO: 7999995 - DNA, 22 bp, Homo sapiens
gcaggcagaggtggaggagaca

SEQ ID NO: 7999996 - DNA, 22 bp, Homo sapiens
gcaggcagaggtggaggagaca

SEQ ID NO: 7999997 - DNA, 22 bp, Homo sapiens
gcaggcagaggtggaggagaca

SEQ ID NO: 7999998 - DNA, 22 bp, Homo sapiens
gcaggcagaggtggaggagaca

SEQ ID NO: 7999999 - DNA, 22 bp, Homo sapiens
gcaggcagaggtggaggagaca

SEQ ID NO: 8000000 - DNA, 22 bp, Homo sapiens
gcaggcagaggtggaggagaca

SEQ ID NO: 8000001 - DNA, 22 bp, Homo sapiens
gcaggcagaggtggaggagaca

SEQ ID NO: 8000002 - DNA, 22 bp, Homo sapiens
gcaggcagaggtggaggagaca

SEQ ID NO: 8000003 - DNA, 22 bp, Homo sapiens
gcaggcagaggtggaggagaca

SEQ ID NO: 8000004 - DNA, 22 bp, Homo sapiens
gcaggctgccctcttgtgttga

SEQ ID NO: 8000005 - DNA, 22 bp, Homo sapiens
gcaggctgccctcttgtgttga

SEQ ID NO: 8000006 - DNA, 22 bp, Homo sapiens
gcaggctgccctcttgtgttga

SEQ ID NO: 8000007 - DNA, 22 bp, Homo sapiens
gcaggctgccaccttctgagtt

SEQ ID NO: 8000008 - DNA, 22 bp, Homo sapiens
gcaggctgccaccttctgagtt

SEQ ID NO: 8000009 - DNA, 22 bp, Homo sapiens
gcaggcagaggtggaggagaca

SEQ ID NO: 8000010 - DNA, 22 bp, Homo sapiens
gcaggctgccaccttctgagtt

SEQ ID NO: 8000011 - DNA, 22 bp, Homo sapiens
gcaggctgctgagatccttagg

SEQ ID NO: 8000012 - DNA, 22 bp, Homo sapiens
gcaggctgctgagatccttagg

SEQ ID NO: 8000013 - DNA, 22 bp, Homo sapiens
gcaggctgccctcttgtgttga

SEQ ID NO: 8000014 - DNA, 22 bp, Homo sapiens
gcaggctgccctcttgtgttga

SEQ ID NO: 8000015 - DNA, 22 bp, Homo sapiens
gcaggctgctgagatccttagg

SEQ ID NO: 8000016 - DNA, 22 bp, Homo sapiens
gcaggctgctgagatccttagg

SEQ ID NO: 8000017 - DNA, 22 bp, Homo sapiens
gcaggctgctgagatccttagg

SEQ ID NO: 8000018 - DNA, 22 bp, Homo sapiens
gcaggctgctgagatccttagg

SEQ ID NO: 8000019 - DNA, 22 bp, Homo sapiens
gcaggctggaggctgttctggg

SEQ ID NO: 8000020 - DNA, 22 bp, Homo sapiens
gcaggctggaggctgttctggg

SEQ ID NO: 8000021 - DNA, 22 bp, Homo sapiens
gcaggctggaggctgttctggg

SEQ ID NO: 8000022 - DNA, 22 bp, Homo sapiens
gcaggctggaggctgttctggg

SEQ ID NO: 8000023 - DNA, 22 bp, Homo sapiens
gcaggctggaggctgttctggg

SEQ ID NO: 8000024 - DNA, 22 bp, Homo sapiens
gcaggctggaggctgttctggg

SEQ ID NO: 8000025 - DNA, 22 bp, Homo sapiens
gcaggctggaggctgttctggg

SEQ ID NO: 8000026 - DNA, 17 bp, Homo sapiens
gcaggcactgctgcctg

SEQ ID NO: 8000027 - DNA, 17 bp, Homo sapiens
gcaggcactgctgcctg

SEQ ID NO: 8000028 - DNA, 17 bp, Homo sapiens
gcaggcactgctgcctg

SEQ ID NO: 8000029 - DNA, 17 bp, Homo sapiens
gcaggcactgctgcctg

SEQ ID NO: 8000030 - DNA, 17 bp, Homo sapiens
gcaggcactgctgcctg

SEQ ID NO: 8000031 - DNA, 21 bp, Homo sapiens
gcaggcactctagaggagctg

SEQ ID NO: 8000032 - DNA, 21 bp, Homo sapiens
gcaggcactctagaggagctg

SEQ ID NO: 8000033 - DNA, 21 bp, Homo sapiens
gcaggcactctagaggagctg

SEQ ID NO: 8000034 - DNA, 21 bp, Homo sapiens
gcaggcactctagaggagctg

SEQ ID NO: 8000035 - DNA, 21 bp, Homo sapiens
gcaggcactctagaggagctg

SEQ ID NO: 8000036 - DNA, 22 bp, Homo sapiens
gcaggcactcctaggaccatca

SEQ ID NO: 8000037 - DNA, 22 bp, Homo sapiens
gcaggcactcctaggaccatca

SEQ ID NO: 8000038 - DNA, 22 bp, Homo sapiens
gcaggcactcctaggaccatca

SEQ ID NO: 8000039 - DNA, 22 bp, Homo sapiens
gcaggcagagaggggtttccag

SEQ ID NO: 8000040 - DNA, 22 bp, Homo sapiens
gcaggcagagaggggtttccag

SEQ ID NO: 8000041 - DNA, 22 bp, Homo sapiens
gcaggcagagaggggtttccag

SEQ ID NO: 8000042 - DNA, 22 bp, Homo sapiens
gcaggcagagaggggtttccag

SEQ ID NO: 8000043 - DNA, 22 bp, Homo sapiens
gcaggcagagaggggtttccag

SEQ ID NO: 8000044 - DNA, 22 bp, Homo sapiens
gcaggcagaggtggaggagaca

SEQ ID NO: 8000045 - DNA, 22 bp, Homo sapiens
gcaggcagagaggggtttccag

SEQ ID NO: 8000046 - DNA, 22 bp, Homo sapiens
gcaggcagagaaggaacattta

SEQ ID NO: 8000047 - DNA, 22 bp, Homo sapiens
gcaggcagagaaggaacattta

SEQ ID NO: 8000048 - DNA, 22 bp, Homo sapiens
gcaggcagagaaggaacattta

SEQ ID NO: 8000049 - DNA, 22 bp, Homo sapiens
gcaggcagagaaggaacattta

SEQ ID NO: 8000050 - DNA, 22 bp, Homo sapiens
gcaggcagagaaggaacattta

SEQ ID NO: 8000051 - DNA, 22 bp, Homo sapiens
gcaggcagagaaggaacattta

SEQ ID NO: 8000052 - DNA, 14 bp, Homo sapiens
gcaggcagaccacc

SEQ ID NO: 8000053 - DNA, 17 bp, Homo sapiens
gcaggcactgctgcctg

SEQ ID NO: 8000054 - DNA, 14 bp, Homo sapiens
gcaggcagaccacc

SEQ ID NO: 8000055 - DNA, 14 bp, Homo sapiens
gcaggcagaccacc

SEQ ID NO: 8000056 - DNA, 14 bp, Homo sapiens
gcaggcagaccacc

SEQ ID NO: 8000057 - DNA, 22 bp, Homo sapiens
gcaggcagagaaggaacattta

SEQ ID NO: 8000058 - DNA, 22 bp, Homo sapiens
gccacagcggggccgctagagc

SEQ ID NO: 8000059 - DNA, 22 bp, Homo sapiens
gccacagcggggccgctagagc

SEQ ID NO: 8000060 - DNA, 22 bp, Homo sapiens
gccacagcggggccgctagagc

SEQ ID NO: 8000061 - DNA, 22 bp, Homo sapiens
gccacagctcacgttccccatt

SEQ ID NO: 8000062 - DNA, 22 bp, Homo sapiens
gccacagcggggccgctagagc

SEQ ID NO: 8000063 - DNA, 22 bp, Homo sapiens
gccacagctcacgttccccatt

SEQ ID NO: 8000064 - DNA, 22 bp, Homo sapiens
gccacagcttagatcacagcct

SEQ ID NO: 8000065 - DNA, 22 bp, Homo sapiens
gccacagcttagatcacagcct

SEQ ID NO: 8000066 - DNA, 22 bp, Homo sapiens
gccacagcttagatcacagcct

SEQ ID NO: 8000067 - DNA, 22 bp, Homo sapiens
gccacagctccagtcaggtgac

SEQ ID NO: 8000068 - DNA, 22 bp, Homo sapiens
gccacagctccagtcaggtgac

SEQ ID NO: 8000069 - DNA, 22 bp, Homo sapiens
gccacagctccagtcaggtgac

SEQ ID NO: 8000070 - DNA, 22 bp, Homo sapiens
gccacaggaaagcaccctggag

SEQ ID NO: 8000071 - DNA, 22 bp, Homo sapiens
gccacaggaaagcaccctggag

SEQ ID NO: 8000072 - DNA, 22 bp, Homo sapiens
gccacaggaaagcaccctggag

SEQ ID NO: 8000073 - DNA, 22 bp, Homo sapiens
gccacaggaaagcaccctggag

SEQ ID NO: 8000074 - DNA, 22 bp, Homo sapiens
gccacaggaaagcaccctggag

SEQ ID NO: 8000075 - DNA, 19 bp, Homo sapiens
gccacaggatgaagtttgg

SEQ ID NO: 8000076 - DNA, 19 bp, Homo sapiens
gccacaggatgaagtttgg

SEQ ID NO: 8000077 - DNA, 22 bp, Homo sapiens
gccacaggcacttaagggctgg

SEQ ID NO: 8000078 - DNA, 22 bp, Homo sapiens
gccacaggcacttaagggctgg

SEQ ID NO: 8000079 - DNA, 22 bp, Homo sapiens
gccacagcttttaacctcgggg

SEQ ID NO: 8000080 - DNA, 22 bp, Homo sapiens
gccacagcttttaacctcgggg

SEQ ID NO: 8000081 - DNA, 22 bp, Homo sapiens
gccacagcttttaacctcgggg

SEQ ID NO: 8000082 - DNA, 22 bp, Homo sapiens
gccacagcttagatcacagcct

SEQ ID NO: 8000083 - DNA, 22 bp, Homo sapiens
gccacagcttagatcacagcct

SEQ ID NO: 8000084 - DNA, 22 bp, Homo sapiens
gccacagcttagatcacagcct

SEQ ID NO: 8000085 - DNA, 22 bp, Homo sapiens
gccacagcttttaacctcgggg

SEQ ID NO: 8000086 - DNA, 22 bp, Homo sapiens
gccacaggaaagcaccctggag

SEQ ID NO: 8000087 - DNA, 22 bp, Homo sapiens
gccagatgtagatagcaaggta

SEQ ID NO: 8000088 - DNA, 22 bp, Homo sapiens
gccagcaaagcaagttgtcagc

SEQ ID NO: 8000089 - DNA, 22 bp, Homo sapiens
gccagatttacagatttgccct

SEQ ID NO: 8000090 - DNA, 22 bp, Homo sapiens
gccagatttacagatttgccct

SEQ ID NO: 8000091 - DNA, 22 bp, Homo sapiens
gccagatttacagatttgccct

SEQ ID NO: 8000092 - DNA, 22 bp, Homo sapiens
gccagatgccgtaaagatgggc

SEQ ID NO: 8000093 - DNA, 22 bp, Homo sapiens
gccagatctgacatagtggaag

SEQ ID NO: 8000094 - DNA, 22 bp, Homo sapiens
gccagaggctcaggttgccatg

SEQ ID NO: 8000095 - DNA, 22 bp, Homo sapiens
gccagaggctcaggttgccatg

SEQ ID NO: 8000096 - DNA, 22 bp, Homo sapiens
gccagaggctcaggttgccatg

SEQ ID NO: 8000097 - DNA, 20 bp, Homo sapiens
gccagaggccggcaggggct

SEQ ID NO: 8000098 - DNA, 22 bp, Homo sapiens
gccacaggctccagcatcagta

SEQ ID NO: 8000099 - DNA, 22 bp, Homo sapiens
gccacaggctccagcatcagta

SEQ ID NO: 8000100 - DNA, 22 bp, Homo sapiens
gccacaggctccagcatcagta

SEQ ID NO: 8000101 - DNA, 20 bp, Homo sapiens
gccagaggccggcaggggct

SEQ ID NO: 8000102 - DNA, 20 bp, Homo sapiens
gccagaggccggcaggggct

SEQ ID NO: 8000103 - DNA, 22 bp, Homo sapiens
gccacaggctccagcatcagta

SEQ ID NO: 8000104 - DNA, 20 bp, Homo sapiens
gccagaggccggcaggggct

SEQ ID NO: 8000105 - DNA, 20 bp, Homo sapiens
gccagaggccggcaggggct

SEQ ID NO: 8000106 - DNA, 20 bp, Homo sapiens
gccagaggccggcaggggct

SEQ ID NO: 8000107 - DNA, 22 bp, Homo sapiens
gccacaggcacttaagggctgg

SEQ ID NO: 8000108 - DNA, 22 bp, Homo sapiens
gccacaggcacttaagggctgg

SEQ ID NO: 8000109 - DNA, 22 bp, Homo sapiens
gccacaggctccagcatcagta

SEQ ID NO: 8000110 - DNA, 22 bp, Homo sapiens
gccacaggctccagcatcagta

SEQ ID NO: 8000111 - DNA, 22 bp, Homo sapiens
gccacaggctccagcatcagta

SEQ ID NO: 8000112 - DNA, 22 bp, Homo sapiens
gccacaggctccagcatcagta

SEQ ID NO: 8000113 - DNA, 22 bp, Homo sapiens
gccagcagccacagaagtcact

SEQ ID NO: 8000114 - DNA, 22 bp, Homo sapiens
gccagcagccacagaagtcact

SEQ ID NO: 8000115 - DNA, 19 bp, Homo sapiens
gccagcagaatgatgaggc

SEQ ID NO: 8000116 - DNA, 22 bp, Homo sapiens
gccagcagccacagaagtcact

SEQ ID NO: 8000117 - DNA, 22 bp, Homo sapiens
gccagcagccacagaagtcact

SEQ ID NO: 8000118 - DNA, 22 bp, Homo sapiens
gccagcagccacagaagtcact

SEQ ID NO: 8000119 - DNA, 19 bp, Homo sapiens
gccagcagaatgatgaggc

SEQ ID NO: 8000120 - DNA, 19 bp, Homo sapiens
gccagcagaatgatgaggc

SEQ ID NO: 8000121 - DNA, 19 bp, Homo sapiens
gccagcagaatgatgaggc

SEQ ID NO: 8000122 - DNA, 19 bp, Homo sapiens
gccagcagaatgatgaggc

SEQ ID NO: 8000123 - DNA, 19 bp, Homo sapiens
gccagcagaatgatgaggc

SEQ ID NO: 8000124 - DNA, 19 bp, Homo sapiens
gccagcagaatgatgaggc

SEQ ID NO: 8000125 - DNA, 19 bp, Homo sapiens
gccagcagaatgatgaggc

SEQ ID NO: 8000126 - DNA, 19 bp, Homo sapiens
gccagcagaatgatgaggc

SEQ ID NO: 8000127 - DNA, 20 bp, Homo sapiens
gccagcacagggagcagttc

SEQ ID NO: 8000128 - DNA, 22 bp, Homo sapiens
gccagcaagggtccactgtcac

SEQ ID NO: 8000129 - DNA, 22 bp, Homo sapiens
gccagcaagggtccactgtcac

SEQ ID NO: 8000130 - DNA, 22 bp, Homo sapiens
gccagcaaagcaagttgtcagc

SEQ ID NO: 8000131 - DNA, 22 bp, Homo sapiens
gccagcaccttctcatatgttt

SEQ ID NO: 8000132 - DNA, 22 bp, Homo sapiens
gccagcaccttctcatatgttt

SEQ ID NO: 8000133 - DNA, 22 bp, Homo sapiens
gccagcaccttagcatgaatca

SEQ ID NO: 8000134 - DNA, 19 bp, Homo sapiens
gccagcacatgtcttctag

SEQ ID NO: 8000135 - DNA, 19 bp, Homo sapiens
gccagcacatgtcttctag

SEQ ID NO: 8000136 - DNA, 22 bp, Homo sapiens
gccagcaccagctactagtcac

SEQ ID NO: 8000137 - DNA, 22 bp, Homo sapiens
gccagcaccagctactagtcac

SEQ ID NO: 8000138 - DNA, 19 bp, Homo sapiens
gccagcacccagctgtgtc

SEQ ID NO: 8000139 - DNA, 22 bp, Homo sapiens
gccagcagggaagccttgggct

SEQ ID NO: 8000140 - DNA, 22 bp, Homo sapiens
gccagcagggaagccttgggct

SEQ ID NO: 8000141 - DNA, 22 bp, Homo sapiens
gccagcagcttcttctcatcct

SEQ ID NO: 8000142 - DNA, 22 bp, Homo sapiens
gccagcagcttcttctcatcct

SEQ ID NO: 8000143 - DNA, 22 bp, Homo sapiens
gccagcagggaagccttgggct

SEQ ID NO: 8000144 - DNA, 22 bp, Homo sapiens
gccagcagggaagccttgggct

SEQ ID NO: 8000145 - DNA, 22 bp, Homo sapiens
gccagcagggaagccttgggct

SEQ ID NO: 8000146 - DNA, 22 bp, Homo sapiens
gccagcagggaagccttgggct

SEQ ID NO: 8000147 - DNA, 22 bp, Homo sapiens
gccagcagggaagccttgggct

SEQ ID NO: 8000148 - DNA, 22 bp, Homo sapiens
gccagcagggaagccttgggct

SEQ ID NO: 8000149 - DNA, 22 bp, Homo sapiens
gccagcagctgtggggtggcca

SEQ ID NO: 8000150 - DNA, 22 bp, Homo sapiens
gccagcagctgtggggtggcca

SEQ ID NO: 8000151 - DNA, 22 bp, Homo sapiens
gccagcagctgtggggtggcca

SEQ ID NO: 8000152 - DNA, 22 bp, Homo sapiens
gccagcagctgtggggtggcca

SEQ ID NO: 8000153 - DNA, 22 bp, Homo sapiens
gccagcagctgtggggtggcca

SEQ ID NO: 8000154 - DNA, 22 bp, Homo sapiens
gccagcagctgtggggtggcca

SEQ ID NO: 8000155 - DNA, 22 bp, Homo sapiens
gccagcagctgtggggtggcca

SEQ ID NO: 8000156 - DNA, 22 bp, Homo sapiens
gccagcagctgtggggtggcca

SEQ ID NO: 8000157 - DNA, 22 bp, Homo sapiens
gccagcagctgtggggtggcca

SEQ ID NO: 8000158 - DNA, 22 bp, Homo sapiens
gccagcagctcttgggcgggca

SEQ ID NO: 8000159 - DNA, 22 bp, Homo sapiens
gccagcagctcttgggcgggca

SEQ ID NO: 8000160 - DNA, 22 bp, Homo sapiens
gccagcagctcttgggcgggca

SEQ ID NO: 8000161 - DNA, 22 bp, Homo sapiens
gccagcagctcttgggcgggca

SEQ ID NO: 8000162 - DNA, 22 bp, Homo sapiens
gccagcagcgagagtttaacct

SEQ ID NO: 8000163 - DNA, 22 bp, Homo sapiens
gccagcagctcttgggcgggca

SEQ ID NO: 8000164 - DNA, 22 bp, Homo sapiens
gccagcagctcttgggcgggca

SEQ ID NO: 8000165 - DNA, 22 bp, Homo sapiens
gccagcagctcttgggcgggca

SEQ ID NO: 8000166 - DNA, 22 bp, Homo sapiens
gccagcagctcttgggcgggca

SEQ ID NO: 8000167 - DNA, 22 bp, Homo sapiens
gccagcagctcttgggcgggca

SEQ ID NO: 8000168 - DNA, 22 bp, Homo sapiens
gccagcagctgtggggtggcca

SEQ ID NO: 8000169 - DNA, 22 bp, Homo sapiens
gccagcagcccagaaggacttt

SEQ ID NO: 8000170 - DNA, 22 bp, Homo sapiens
gccagcagcccagaaggacttt

SEQ ID NO: 8000171 - DNA, 22 bp, Homo sapiens
gccagcagcccagaaggacttt

SEQ ID NO: 8000172 - DNA, 22 bp, Homo sapiens
gccagcagcgagagtttaacct

SEQ ID NO: 8000173 - DNA, 22 bp, Homo sapiens
gccacagcagggccctctcagg

SEQ ID NO: 8000174 - DNA, 22 bp, Homo sapiens
gccacagcagggccctctcagg

SEQ ID NO: 8000175 - DNA, 22 bp, Homo sapiens
gccacagcagggccctctcagg

SEQ ID NO: 8000176 - DNA, 22 bp, Homo sapiens
gccacagcccgagcaccatgag

SEQ ID NO: 8000177 - DNA, 22 bp, Homo sapiens
gccacagcccgagcaccatgag

SEQ ID NO: 8000178 - DNA, 22 bp, Homo sapiens
gccacagcccgagcaccatgag

SEQ ID NO: 8000179 - DNA, 22 bp, Homo sapiens
gccacagcccgagcaccatgag

SEQ ID NO: 8000180 - DNA, 22 bp, Homo sapiens
gccacagccgaacccttgggcc

SEQ ID NO: 8000181 - DNA, 22 bp, Homo sapiens
gccacagcctctgggaaaactc

SEQ ID NO: 8000182 - DNA, 22 bp, Homo sapiens
gccacagccgaacccttgggcc

SEQ ID NO: 8000183 - DNA, 22 bp, Homo sapiens
gccacagccgaacccttgggcc

SEQ ID NO: 8000184 - DNA, 22 bp, Homo sapiens
gccacagccgaacccttgggcc

SEQ ID NO: 8000185 - DNA, 22 bp, Homo sapiens
gccacagccgaacccttgggcc

SEQ ID NO: 8000186 - DNA, 22 bp, Homo sapiens
gccacagcccgagcaccatgag

SEQ ID NO: 8000187 - DNA, 22 bp, Homo sapiens
gccacacttattctcatgcaca

SEQ ID NO: 8000188 - DNA, 23 bp, Homo sapiens
gccaatttttgactgtcagtagg

SEQ ID NO: 8000189 - DNA, 22 bp, Homo sapiens
gccaatttcctgaggtaaagct

SEQ ID NO: 8000190 - DNA, 22 bp, Homo sapiens
gccaatttatcttactcgtgct

SEQ ID NO: 8000191 - DNA, 22 bp, Homo sapiens
gccacagacagagagtctagtg

SEQ ID NO: 8000192 - DNA, 22 bp, Homo sapiens
gccacagcaacaataatgcagc

SEQ ID NO: 8000193 - DNA, 22 bp, Homo sapiens
gccacagcaacaataatgcagc

SEQ ID NO: 8000194 - DNA, 22 bp, Homo sapiens
gccacagcagggccctctcagg

SEQ ID NO: 8000195 - DNA, 22 bp, Homo sapiens
gccacagacagagagtctagtg

SEQ ID NO: 8000196 - DNA, 22 bp, Homo sapiens
gccacacttattctcatgcaca

SEQ ID NO: 8000197 - DNA, 22 bp, Homo sapiens
gccaatgccttctagaggagtc

SEQ ID NO: 8000198 - DNA, 22 bp, Homo sapiens
gccaatgacagtctcagttctg

SEQ ID NO: 8000199 - DNA, 22 bp, Homo sapiens
gccaatttatagccaaaaatca

SEQ ID NO: 8000200 - DNA, 23 bp, Homo sapiens
gccaatttagtaaaggcagtggg

SEQ ID NO: 8000201 - DNA, 20 bp, Homo sapiens
gccaattgtgtggtgggctg

SEQ ID NO: 8000202 - DNA, 22 bp, Homo sapiens
gccaatgacagtctcagttctg

SEQ ID NO: 8000203 - DNA, 22 bp, Homo sapiens
gcatgtttcttaagattgcatt

SEQ ID NO: 8000204 - DNA, 22 bp, Homo sapiens
gcatgttttgcaacaagtgacc

SEQ ID NO: 8000205 - DNA, 22 bp, Homo sapiens
gccaataaatggaaaagatgga

SEQ ID NO: 8000206 - DNA, 22 bp, Homo sapiens
gccaatgacagtctcagttctg

SEQ ID NO: 8000207 - DNA, 22 bp, Homo sapiens
gccaatcaggaggctgtacatc

SEQ ID NO: 8000208 - DNA, 22 bp, Homo sapiens
gccaatcagcgctcagacgacc

SEQ ID NO: 8000209 - DNA, 22 bp, Homo sapiens
gccaataggaagagaaagatgg

SEQ ID NO: 8000210 - DNA, 22 bp, Homo sapiens
gccaatagcaatttctaggccc

SEQ ID NO: 8000211 - DNA, 22 bp, Homo sapiens
gccaatagcaatttctaggccc

SEQ ID NO: 8000212 - DNA, 22 bp, Homo sapiens
gcatgttttgcaacaagtgacc

SEQ ID NO: 8000213 - DNA, 22 bp, Homo sapiens
gcatgttttgcaacaagtgacc

SEQ ID NO: 8000214 - DNA, 22 bp, Homo sapiens
gcatgtgttatttctctgtggg

SEQ ID NO: 8000215 - DNA, 22 bp, Homo sapiens
gcatgtgttagagtgtgcatgc

SEQ ID NO: 8000216 - DNA, 22 bp, Homo sapiens
gcatgtgttattttatgtatga

SEQ ID NO: 8000217 - DNA, 22 bp, Homo sapiens
gcatgtaatcactctaggaagg

SEQ ID NO: 8000218 - DNA, 22 bp, Homo sapiens
gcatggtggggagatggcagcc

SEQ ID NO: 8000219 - DNA, 17 bp, Homo sapiens
gcatgtagtacatgtaa

SEQ ID NO: 8000220 - DNA, 22 bp, Homo sapiens
gcatgtctttgtctcaatataa

SEQ ID NO: 8000221 - DNA, 22 bp, Homo sapiens
gcatgtggaatctctccatggt

SEQ ID NO: 8000222 - DNA, 22 bp, Homo sapiens
gcatggtggggagatggcagcc

SEQ ID NO: 8000223 - DNA, 22 bp, Homo sapiens
gcatggtggccttagggtagcc

SEQ ID NO: 8000224 - DNA, 22 bp, Homo sapiens
gcatggtggccttagggtagcc

SEQ ID NO: 8000225 - DNA, 22 bp, Homo sapiens
gcatggtggccttagggtagcc

SEQ ID NO: 8000226 - DNA, 22 bp, Homo sapiens
gcatggtggccttagggtagcc

SEQ ID NO: 8000227 - DNA, 22 bp, Homo sapiens
gcatggtggagtctgagcaggg

SEQ ID NO: 8000228 - DNA, 22 bp, Homo sapiens
gcatggtggagtctgagcaggg

SEQ ID NO: 8000229 - DNA, 22 bp, Homo sapiens
gcatggtggagtctgagcaggg

SEQ ID NO: 8000230 - DNA, 22 bp, Homo sapiens
gcatggtggagtctgagcaggg

SEQ ID NO: 8000231 - DNA, 22 bp, Homo sapiens
gcatgggctttctcagagttct

SEQ ID NO: 8000232 - DNA, 22 bp, Homo sapiens
gcatggtgacatcatgtgaatg

SEQ ID NO: 8000233 - DNA, 22 bp, Homo sapiens
gcatggtgacatcatgtgaatg

SEQ ID NO: 8000234 - DNA, 22 bp, Homo sapiens
gcatgggaggacagtctgggct

SEQ ID NO: 8000235 - DNA, 22 bp, Homo sapiens
gcatgggaggacagtctgggct

SEQ ID NO: 8000236 - DNA, 22 bp, Homo sapiens
gcagtgttgagtggtggctgaa

SEQ ID NO: 8000237 - DNA, 22 bp, Homo sapiens
gcatggcttcggggtgctgcct

SEQ ID NO: 8000238 - DNA, 22 bp, Homo sapiens
gcagtgttgctaggtgcggtga

SEQ ID NO: 8000239 - DNA, 22 bp, Homo sapiens
gcatggcttctgccaggcacct

SEQ ID NO: 8000240 - DNA, 22 bp, Homo sapiens
gcatgggaggacagtctgggct

SEQ ID NO: 8000241 - DNA, 22 bp, Homo sapiens
gcatgggaggacagtctgggct

SEQ ID NO: 8000242 - DNA, 22 bp, Homo sapiens
gcatgggcaccagtctctaggt

SEQ ID NO: 8000243 - DNA, 22 bp, Homo sapiens
gcatgggcaagaggactggggg

SEQ ID NO: 8000244 - DNA, 22 bp, Homo sapiens
gcatgggcaagaggactggggg

SEQ ID NO: 8000245 - DNA, 22 bp, Homo sapiens
gcatgtggccttcaggctggaa

SEQ ID NO: 8000246 - DNA, 22 bp, Homo sapiens
gcatgtggccttcaggctggaa

SEQ ID NO: 8000247 - DNA, 22 bp, Homo sapiens
gcatgtgggaacacttaggcac

SEQ ID NO: 8000248 - DNA, 22 bp, Homo sapiens
gcatgtgggaacacttaggcac

SEQ ID NO: 8000249 - DNA, 22 bp, Homo sapiens
gcatgtggcccaaggaggctgt

SEQ ID NO: 8000250 - DNA, 22 bp, Homo sapiens
gcatgtggatatgttagggtga

SEQ ID NO: 8000251 - DNA, 22 bp, Homo sapiens
gcatgtggaatctctccatggt

SEQ ID NO: 8000252 - DNA, 22 bp, Homo sapiens
gcatgtggtgctgaggctgtcg

SEQ ID NO: 8000253 - DNA, 22 bp, Homo sapiens
gcatgtggtgctgaggctgtcg

SEQ ID NO: 8000254 - DNA, 22 bp, Homo sapiens
gcatgtggtgctgaggctgtcg

SEQ ID NO: 8000255 - DNA, 22 bp, Homo sapiens
gcatgtggtgggctggccactc

SEQ ID NO: 8000256 - DNA, 22 bp, Homo sapiens
gcatgtggtgggctggccactc

SEQ ID NO: 8000257 - DNA, 22 bp, Homo sapiens
gcatgtgtcatctgcctttcgt

SEQ ID NO: 8000258 - DNA, 22 bp, Homo sapiens
gcatgtgtgagaccttttagca

SEQ ID NO: 8000259 - DNA, 22 bp, Homo sapiens
gcatgtgtccctcagtctgtgc

SEQ ID NO: 8000260 - DNA, 22 bp, Homo sapiens
gcatgtgtctccccagtggagg

SEQ ID NO: 8000261 - DNA, 22 bp, Homo sapiens
gcatgtgtctccccagtggagg

SEQ ID NO: 8000262 - DNA, 22 bp, Homo sapiens
gcaggtggtccccgtggagtgg

SEQ ID NO: 8000263 - DNA, 22 bp, Homo sapiens
gcaggtggtccccgtggagtgg

SEQ ID NO: 8000264 - DNA, 22 bp, Homo sapiens
gcaggtggtccccgtggagtgg

SEQ ID NO: 8000265 - DNA, 22 bp, Homo sapiens
gcaggtggtccccgtggagtgg

SEQ ID NO: 8000266 - DNA, 22 bp, Homo sapiens
gcaggtggtccccgtggagtgg

SEQ ID NO: 8000267 - DNA, 22 bp, Homo sapiens
gcaggtggtccccgtggagtgg

SEQ ID NO: 8000268 - DNA, 22 bp, Homo sapiens
gcaggtggtggcgcgcgccctg

SEQ ID NO: 8000269 - DNA, 22 bp, Homo sapiens
gcaggtggtggcgcgcgccctg

SEQ ID NO: 8000270 - DNA, 22 bp, Homo sapiens
gcaggtggtggggctatgatct

SEQ ID NO: 8000271 - DNA, 22 bp, Homo sapiens
gcaggtggtggggctatgatct

SEQ ID NO: 8000272 - DNA, 22 bp, Homo sapiens
gcaggtggtgggggagccgttc

SEQ ID NO: 8000273 - DNA, 23 bp, Homo sapiens
gcaggtggttcgaacagaagttt

SEQ ID NO: 8000274 - DNA, 23 bp, Homo sapiens
gcaggtggttcgaacagaagttt

SEQ ID NO: 8000275 - DNA, 22 bp, Homo sapiens
gcaggtggttaaggtcccatgt

SEQ ID NO: 8000276 - DNA, 22 bp, Homo sapiens
gcaggtggttaaggtcccatgt

SEQ ID NO: 8000277 - DNA, 22 bp, Homo sapiens
gcaggtggttaaggtcccatgt

SEQ ID NO: 8000278 - DNA, 22 bp, Homo sapiens
gcaggtggtgggggagccgttc

SEQ ID NO: 8000279 - DNA, 22 bp, Homo sapiens
gcaggtggtgggggagccgttc

SEQ ID NO: 8000280 - DNA, 22 bp, Homo sapiens
gcaggtggtgggggagccgttc

SEQ ID NO: 8000281 - DNA, 22 bp, Homo sapiens
gcaggtggtgggggagccgttc

SEQ ID NO: 8000282 - DNA, 22 bp, Homo sapiens
gcaggtggtgggggagccgttc

SEQ ID NO: 8000283 - DNA, 22 bp, Homo sapiens
gcaggtggttaaggtcccatgt

SEQ ID NO: 8000284 - DNA, 22 bp, Homo sapiens
gcaggtggtgggggagccgttc

SEQ ID NO: 8000285 - DNA, 22 bp, Homo sapiens
gcaggtggtgggggagccgttc

SEQ ID NO: 8000286 - DNA, 22 bp, Homo sapiens
gcaggtggttaaggtcccatgt

SEQ ID NO: 8000287 - DNA, 22 bp, Homo sapiens
gcaggtgggggtcggtgcatct

SEQ ID NO: 8000288 - DNA, 22 bp, Homo sapiens
gcaggtgggggtcggtgcatct

SEQ ID NO: 8000289 - DNA, 22 bp, Homo sapiens
gcaggtgggggtcggtgcatct

SEQ ID NO: 8000290 - DNA, 22 bp, Homo sapiens
gcaggtgggggtcggtgcatct

SEQ ID NO: 8000291 - DNA, 22 bp, Homo sapiens
gcaggtgggggagaagttgtga

SEQ ID NO: 8000292 - DNA, 22 bp, Homo sapiens
gcaggtgggggtcggtgcatct

SEQ ID NO: 8000293 - DNA, 22 bp, Homo sapiens
gcaggtgggggtcggtgcatct

SEQ ID NO: 8000294 - DNA, 22 bp, Homo sapiens
gcaggtgggggtcggtgcatct

SEQ ID NO: 8000295 - DNA, 22 bp, Homo sapiens
gcaggtgggggtcggtgcatct

SEQ ID NO: 8000296 - DNA, 22 bp, Homo sapiens
gcaggtggtcactcatccccag

SEQ ID NO: 8000297 - DNA, 22 bp, Homo sapiens
gcaggtggtccccgtggagtgg

SEQ ID NO: 8000298 - DNA, 22 bp, Homo sapiens
gcaggtgggggtcggtgcatct

SEQ ID NO: 8000299 - DNA, 22 bp, Homo sapiens
gcaggtggggctgctaccagaa

SEQ ID NO: 8000300 - DNA, 22 bp, Homo sapiens
gcaggtggggctgctaccagaa

SEQ ID NO: 8000301 - DNA, 22 bp, Homo sapiens
gcaggtggggctgctaccagaa

SEQ ID NO: 8000302 - DNA, 22 bp, Homo sapiens
gcaggtggggctgctaccagaa

SEQ ID NO: 8000303 - DNA, 22 bp, Homo sapiens
gcaggtgggggagaagttgtga

SEQ ID NO: 8000304 - DNA, 22 bp, Homo sapiens
gcaggtggggctgctaccagaa

SEQ ID NO: 8000305 - DNA, 22 bp, Homo sapiens
gcaggtggggctgctaccagaa

SEQ ID NO: 8000306 - DNA, 16 bp, Homo sapiens
gcaggtggggcgcgca

SEQ ID NO: 8000307 - DNA, 22 bp, Homo sapiens
gcaggtgggagccgctgcctga

SEQ ID NO: 8000308 - DNA, 19 bp, Homo sapiens
gcaggtggatgtggtcagc

SEQ ID NO: 8000309 - DNA, 19 bp, Homo sapiens
gcaggtggatgtggtcagc

SEQ ID NO: 8000310 - DNA, 19 bp, Homo sapiens
gcaggtggatgtggtcagc

SEQ ID NO: 8000311 - DNA, 22 bp, Homo sapiens
gcaggtggattatcagaagtgc

SEQ ID NO: 8000312 - DNA, 19 bp, Homo sapiens
gcaggtggatgtggtcagc

SEQ ID NO: 8000313 - DNA, 22 bp, Homo sapiens
gcaggtggattatcagaagtgc

SEQ ID NO: 8000314 - DNA, 22 bp, Homo sapiens
gcaggtggaagcagcagactca

SEQ ID NO: 8000315 - DNA, 22 bp, Homo sapiens
gcaggtggagcagtagtctggt

SEQ ID NO: 8000316 - DNA, 19 bp, Homo sapiens
gcaggtggatgtggtcagc

SEQ ID NO: 8000317 - DNA, 19 bp, Homo sapiens
gcaggtggatgtggtcagc

SEQ ID NO: 8000318 - DNA, 22 bp, Homo sapiens
gcaggtggagcagtagtctggt

SEQ ID NO: 8000319 - DNA, 22 bp, Homo sapiens
gcaggtggcagaggtgggatct

SEQ ID NO: 8000320 - DNA, 22 bp, Homo sapiens
gcaggtggcagaggtgggatct

SEQ ID NO: 8000321 - DNA, 22 bp, Homo sapiens
gcaggtggcagaggtgggatct

SEQ ID NO: 8000322 - DNA, 22 bp, Homo sapiens
gcaggtggcagaggtgggatct

SEQ ID NO: 8000323 - DNA, 22 bp, Homo sapiens
gcaggtggcagaggtgggatct

SEQ ID NO: 8000324 - DNA, 22 bp, Homo sapiens
gcaggtggattatcagaagtgc

SEQ ID NO: 8000325 - DNA, 22 bp, Homo sapiens
gcaggtggcagaggtgggatct

SEQ ID NO: 8000326 - DNA, 22 bp, Homo sapiens
gcaggtggattatcagaagtgc

SEQ ID NO: 8000327 - DNA, 22 bp, Homo sapiens
gcaggtgggagccgctgcctga

SEQ ID NO: 8000328 - DNA, 22 bp, Homo sapiens
gcaggtgggagccgctgcctga

SEQ ID NO: 8000329 - DNA, 22 bp, Homo sapiens
gcaggtggcagaggtgggatct

SEQ ID NO: 8000330 - DNA, 22 bp, Homo sapiens
gcaggtggcagaggtgggatct

SEQ ID NO: 8000331 - DNA, 22 bp, Homo sapiens
gcagggtggatggcagggccag

SEQ ID NO: 8000332 - DNA, 19 bp, Homo sapiens
gcagggtggcagagctctt

SEQ ID NO: 8000333 - DNA, 19 bp, Homo sapiens
gcagggtggcagagctctt

SEQ ID NO: 8000334 - DNA, 22 bp, Homo sapiens
gcaggtggaagcagcagactca

SEQ ID NO: 8000335 - DNA, 22 bp, Homo sapiens
gcaggtggaagcagcagactca

SEQ ID NO: 8000336 - DNA, 22 bp, Homo sapiens
gcagggtgccgacttcagggat

SEQ ID NO: 8000337 - DNA, 22 bp, Homo sapiens
gcagggtgccgacttcagggat

SEQ ID NO: 8000338 - DNA, 22 bp, Homo sapiens
gcagggtggatggcagggccag

SEQ ID NO: 8000339 - DNA, 22 bp, Homo sapiens
gcagggtggatggcagggccag

SEQ ID NO: 8000340 - DNA, 22 bp, Homo sapiens
gcagggtgatagtgaggctcag

SEQ ID NO: 8000341 - DNA, 22 bp, Homo sapiens
gcagggtgccgacttcagggat

SEQ ID NO: 8000342 - DNA, 22 bp, Homo sapiens
gcagggtgatagtgaggctcag

SEQ ID NO: 8000343 - DNA, 22 bp, Homo sapiens
gcagggtgatagtgaggctcag

SEQ ID NO: 8000344 - DNA, 22 bp, Homo sapiens
gcagggtgatagtgaggctcag

SEQ ID NO: 8000345 - DNA, 22 bp, Homo sapiens
gcagggtgatagtgaggctcag

SEQ ID NO: 8000346 - DNA, 22 bp, Homo sapiens
gcagggtgatagtgaggctcag

SEQ ID NO: 8000347 - DNA, 22 bp, Homo sapiens
gcagggtgacgttgcccacctc

SEQ ID NO: 8000348 - DNA, 22 bp, Homo sapiens
gcagggtgacgttgcccacctc

SEQ ID NO: 8000349 - DNA, 22 bp, Homo sapiens
gcagtagtgtcagtacagcaaa

SEQ ID NO: 8000350 - DNA, 22 bp, Homo sapiens
gcagtagtcgctggagatgagg

SEQ ID NO: 8000351 - DNA, 22 bp, Homo sapiens
gcagtataagtggattatgtcc

SEQ ID NO: 8000352 - DNA, 22 bp, Homo sapiens
gcagtatacactgatacatgag

SEQ ID NO: 8000353 - DNA, 22 bp, Homo sapiens
gcagtgggcaacaagagctgga

SEQ ID NO: 8000354 - DNA, 22 bp, Homo sapiens
gcagtgggcaacaagagctgga

SEQ ID NO: 8000355 - DNA, 22 bp, Homo sapiens
gcagtgggcaacaagagctgga

SEQ ID NO: 8000356 - DNA, 22 bp, Homo sapiens
gcagtatatccattacttcata

SEQ ID NO: 8000357 - DNA, 22 bp, Homo sapiens
gcagtgggagcttaggcagtgc

SEQ ID NO: 8000358 - DNA, 22 bp, Homo sapiens
gcagtgggagcttaggcagtgc

SEQ ID NO: 8000359 - DNA, 22 bp, Homo sapiens
gcagtaggagggacaactacct

SEQ ID NO: 8000360 - DNA, 22 bp, Homo sapiens
gcagtagcagtatccagaagca

SEQ ID NO: 8000361 - DNA, 22 bp, Homo sapiens
gcagtaggagaagaggatgctt

SEQ ID NO: 8000362 - DNA, 22 bp, Homo sapiens
gcagtaggagaagaggatgctt

SEQ ID NO: 8000363 - DNA, 22 bp, Homo sapiens
gcagtaggagtttccagggtgg

SEQ ID NO: 8000364 - DNA, 22 bp, Homo sapiens
gcagtaggagggacaactacct

SEQ ID NO: 8000365 - DNA, 22 bp, Homo sapiens
gcagtaggagaagaggatgctt

SEQ ID NO: 8000366 - DNA, 22 bp, Homo sapiens
gcagtagcagtatccagaagca

SEQ ID NO: 8000367 - DNA, 22 bp, Homo sapiens
gcagtagatctggaagagaatt

SEQ ID NO: 8000368 - DNA, 22 bp, Homo sapiens
gcagtagcagtatccagaagca

SEQ ID NO: 8000369 - DNA, 22 bp, Homo sapiens
gcagtaggggctggagggctgt

SEQ ID NO: 8000370 - DNA, 22 bp, Homo sapiens
gcagtaggggctggagggctgt

SEQ ID NO: 8000371 - DNA, 22 bp, Homo sapiens
gcagtaggggctggagggctgt

SEQ ID NO: 8000372 - DNA, 22 bp, Homo sapiens
gcagtagtccataagtactctg

SEQ ID NO: 8000373 - DNA, 18 bp, Homo sapiens
gcagtaggcgcgcaggac

SEQ ID NO: 8000374 - DNA, 18 bp, Homo sapiens
gcagtaggcgcgcaggac

SEQ ID NO: 8000375 - DNA, 18 bp, Homo sapiens
gcagtaggcgcgcaggac

SEQ ID NO: 8000376 - DNA, 22 bp, Homo sapiens
gcagtacacacatatgtattcg

SEQ ID NO: 8000377 - DNA, 22 bp, Homo sapiens
gcagtaagttaatagtgctggt

SEQ ID NO: 8000378 - DNA, 22 bp, Homo sapiens
gcagtactttatcacatggaat

SEQ ID NO: 8000379 - DNA, 22 bp, Homo sapiens
gcagtactttaagggatgaagc

SEQ ID NO: 8000380 - DNA, 22 bp, Homo sapiens
gcagtagaaatttcattgctct

SEQ ID NO: 8000381 - DNA, 22 bp, Homo sapiens
gcagtagaaatttcattgctct

SEQ ID NO: 8000382 - DNA, 22 bp, Homo sapiens
gcagtaccaaggagataagata

SEQ ID NO: 8000383 - DNA, 17 bp, Homo sapiens
gcagtacctactttcta

SEQ ID NO: 8000384 - DNA, 22 bp, Homo sapiens
gcagtacctgctatgttatacg

SEQ ID NO: 8000385 - DNA, 22 bp, Homo sapiens
gcagtagaactgtcatgatgtt

SEQ ID NO: 8000386 - DNA, 22 bp, Homo sapiens
gcagtagaactgtcatgatgtt

SEQ ID NO: 8000387 - DNA, 22 bp, Homo sapiens
gcagtagaaggtgctttctgga

SEQ ID NO: 8000388 - DNA, 22 bp, Homo sapiens
gcagtagaaggtgctttctgga

SEQ ID NO: 8000389 - DNA, 22 bp, Homo sapiens
gcagtagaacgtgttgaatcaa

SEQ ID NO: 8000390 - DNA, 22 bp, Homo sapiens
gcagtagaactgtcatgatgtt

SEQ ID NO: 8000391 - DNA, 22 bp, Homo sapiens
gcagtagaacgtgttgaatcaa

SEQ ID NO: 8000392 - DNA, 22 bp, Homo sapiens
gcagtagagaagccaggctgta

SEQ ID NO: 8000393 - DNA, 20 bp, Homo sapiens
gcagtagaccatgcttggaa

SEQ ID NO: 8000394 - DNA, 20 bp, Homo sapiens
gcagtagaccatgcttggaa

SEQ ID NO: 8000395 - DNA, 22 bp, Homo sapiens
gcagtagagcttcttttgatga

SEQ ID NO: 8000396 - DNA, 22 bp, Homo sapiens
gcagtagagcagagattttcct

SEQ ID NO: 8000397 - DNA, 22 bp, Homo sapiens
gcagtagagaagccaggctgta

SEQ ID NO: 8000398 - DNA, 23 bp, Homo sapiens
gcaggtggttcgaacagaagttt

SEQ ID NO: 8000399 - DNA, 23 bp, Homo sapiens
gcaggtggttcgaacagaagttt

SEQ ID NO: 8000400 - DNA, 22 bp, Homo sapiens
gcaggtgtcctgggctggcagt

SEQ ID NO: 8000401 - DNA, 22 bp, Homo sapiens
gcaggtgtcttcagcaggatga

SEQ ID NO: 8000402 - DNA, 22 bp, Homo sapiens
gcagtgtctttgacctccaccc

SEQ ID NO: 8000403 - DNA, 23 bp, Homo sapiens
gcagtgtgaatccagtgtttcag

SEQ ID NO: 8000404 - DNA, 22 bp, Homo sapiens
gcagtgtctttgacctccaccc

SEQ ID NO: 8000405 - DNA, 22 bp, Homo sapiens
gcagtgtccagggtggtctgca

SEQ ID NO: 8000406 - DNA, 21 bp, Homo sapiens
gcagtgtcatggtttcaagtt

SEQ ID NO: 8000407 - DNA, 22 bp, Homo sapiens
gcagtgtcagtgcctgggtggt

SEQ ID NO: 8000408 - DNA, 22 bp, Homo sapiens
gcagtgtcagtgcctgggtggt

SEQ ID NO: 8000409 - DNA, 19 bp, Homo sapiens
gcagtgtcatggtaggagc

SEQ ID NO: 8000410 - DNA, 22 bp, Homo sapiens
gcagtggtccttacttcccagc

SEQ ID NO: 8000411 - DNA, 22 bp, Homo sapiens
gcagtggtggtgtttcagtgac

SEQ ID NO: 8000412 - DNA, 22 bp, Homo sapiens
gcagtgtcagtgcctgggtggt

SEQ ID NO: 8000413 - DNA, 22 bp, Homo sapiens
gcagtgttaggaataaaaatga

SEQ ID NO: 8000414 - DNA, 22 bp, Homo sapiens
gcagtgttaggaataaaaatga

SEQ ID NO: 8000415 - DNA, 22 bp, Homo sapiens
gcagtgttaggaataaaaatga

SEQ ID NO: 8000416 - DNA, 22 bp, Homo sapiens
gcagtgttatgttttctataat

SEQ ID NO: 8000417 - DNA, 22 bp, Homo sapiens
gcagtgttcagtgaagcaggag

SEQ ID NO: 8000418 - DNA, 22 bp, Homo sapiens
gcagtgttccttctactggggc

SEQ ID NO: 8000419 - DNA, 22 bp, Homo sapiens
gcagtgttatgttttctataat

SEQ ID NO: 8000420 - DNA, 22 bp, Homo sapiens
gcagtgttgagccagctggggg

SEQ ID NO: 8000421 - DNA, 22 bp, Homo sapiens
gcagtgttctaaattgggtgtg

SEQ ID NO: 8000422 - DNA, 22 bp, Homo sapiens
gcagtgttcttgttgcttttat

SEQ ID NO: 8000423 - DNA, 22 bp, Homo sapiens
gcagtgttgactatggtatgag

SEQ ID NO: 8000424 - DNA, 22 bp, Homo sapiens
gcagtgttctaaattgggtgtg

SEQ ID NO: 8000425 - DNA, 22 bp, Homo sapiens
gcagtggggaatgctggggaga

SEQ ID NO: 8000426 - DNA, 22 bp, Homo sapiens
gcagtggggaatgctggggaga

SEQ ID NO: 8000427 - DNA, 22 bp, Homo sapiens
gcagtggggaatgctggggaga

SEQ ID NO: 8000428 - DNA, 22 bp, Homo sapiens
gcagtggggcaatcatagctca

SEQ ID NO: 8000429 - DNA, 22 bp, Homo sapiens
gcagtggggcgctgggagttgg

SEQ ID NO: 8000430 - DNA, 22 bp, Homo sapiens
gcagtggggcgctgggagttgg

SEQ ID NO: 8000431 - DNA, 22 bp, Homo sapiens
gcagtggtccagctaagatttg

SEQ ID NO: 8000432 - DNA, 22 bp, Homo sapiens
gcagtggtccagttcacaccca

SEQ ID NO: 8000433 - DNA, 22 bp, Homo sapiens
gcagtgggcaacaagagctgga

SEQ ID NO: 8000434 - DNA, 22 bp, Homo sapiens
gcagtgggcaacaagagctgga

SEQ ID NO: 8000435 - DNA, 22 bp, Homo sapiens
gcagtgggcaacaagagctgga

SEQ ID NO: 8000436 - DNA, 22 bp, Homo sapiens
gcagtgggcaacaagagctgga

SEQ ID NO: 8000437 - DNA, 22 bp, Homo sapiens
gcagtgggcctgaggaagggtg

SEQ ID NO: 8000438 - DNA, 22 bp, Homo sapiens
gcagtgggcctgaggaagggtg

SEQ ID NO: 8000439 - DNA, 22 bp, Homo sapiens
gcagtgggcaacaagagctgga

SEQ ID NO: 8000440 - DNA, 22 bp, Homo sapiens
gcagtggggaatgctggggaga

SEQ ID NO: 8000441 - DNA, 22 bp, Homo sapiens
gcagtgggcctgaggaagggtg

SEQ ID NO: 8000442 - DNA, 22 bp, Homo sapiens
gcagtgggcctgaggaagggtg

SEQ ID NO: 8000443 - DNA, 22 bp, Homo sapiens
gcacccctgcgtgccttccctt

SEQ ID NO: 8000444 - DNA, 22 bp, Homo sapiens
gcacccctggacggtagggcca

SEQ ID NO: 8000445 - DNA, 22 bp, Homo sapiens
gcacccctgcgtgccttccctt

SEQ ID NO: 8000446 - DNA, 22 bp, Homo sapiens
gcacccctggacggtagggcca

SEQ ID NO: 8000447 - DNA, 22 bp, Homo sapiens
gcacccctgcgtgccttccctt

SEQ ID NO: 8000448 - DNA, 22 bp, Homo sapiens
gcacccctcagcttgtttacta

SEQ ID NO: 8000449 - DNA, 19 bp, Homo sapiens
gcaccccatcttcctcctg

SEQ ID NO: 8000450 - DNA, 19 bp, Homo sapiens
gcaccctgaggtcatggcc

SEQ ID NO: 8000451 - DNA, 19 bp, Homo sapiens
gcaccctgaggtcatggcc

SEQ ID NO: 8000452 - DNA, 19 bp, Homo sapiens
gcaccctgaggtcatggcc

SEQ ID NO: 8000453 - DNA, 22 bp, Homo sapiens
gcaccctctgagctccgctccg

SEQ ID NO: 8000454 - DNA, 22 bp, Homo sapiens
gcaccctctgagctccgctccg

SEQ ID NO: 8000455 - DNA, 22 bp, Homo sapiens
gcaccctctgagctccgctccg

SEQ ID NO: 8000456 - DNA, 22 bp, Homo sapiens
gcacccctggacggtagggcca

SEQ ID NO: 8000457 - DNA, 22 bp, Homo sapiens
gcaccctagagttgcctgagga

SEQ ID NO: 8000458 - DNA, 22 bp, Homo sapiens
gcaccctgtttatcctgagttc

SEQ ID NO: 8000459 - DNA, 22 bp, Homo sapiens
gcacccttgctgccaagtggat

SEQ ID NO: 8000460 - DNA, 22 bp, Homo sapiens
gcaccctgtttatcctgagttc

SEQ ID NO: 8000461 - DNA, 22 bp, Homo sapiens
gcaccgccttggaccgcccgct

SEQ ID NO: 8000462 - DNA, 22 bp, Homo sapiens
gcaccgccttggaccgcccgct

SEQ ID NO: 8000463 - DNA, 22 bp, Homo sapiens
gcaccctgagtgttcagctcca

SEQ ID NO: 8000464 - DNA, 22 bp, Homo sapiens
gcaccctgctctatccttgcta

SEQ ID NO: 8000465 - DNA, 22 bp, Homo sapiens
gcaccctgctctatccttgcta

SEQ ID NO: 8000466 - DNA, 22 bp, Homo sapiens
gcaccctgctctatccttgcta

SEQ ID NO: 8000467 - DNA, 19 bp, Homo sapiens
gcaccctgaggtcatggcc

SEQ ID NO: 8000468 - DNA, 22 bp, Homo sapiens
gcaccctgagtgttcagctcca

SEQ ID NO: 8000469 - DNA, 22 bp, Homo sapiens
gcaccctgagtgttcagctcca

SEQ ID NO: 8000470 - DNA, 22 bp, Homo sapiens
gcaccctgctctatccttgcta

SEQ ID NO: 8000471 - DNA, 19 bp, Homo sapiens
gcaccctggccactcccac

SEQ ID NO: 8000472 - DNA, 19 bp, Homo sapiens
gcaccctggccactcccac

SEQ ID NO: 8000473 - DNA, 22 bp, Homo sapiens
gcaccctggctctctggaatgg

SEQ ID NO: 8000474 - DNA, 22 bp, Homo sapiens
gcaccctgtcaaaatggaccaa

SEQ ID NO: 8000475 - DNA, 22 bp, Homo sapiens
gcaccctgtcaaaatggaccaa

SEQ ID NO: 8000476 - DNA, 22 bp, Homo sapiens
gcacctggctgcccaggtggag

SEQ ID NO: 8000477 - DNA, 22 bp, Homo sapiens
gcacctggctgcccaggtggag

SEQ ID NO: 8000478 - DNA, 22 bp, Homo sapiens
gcacctggctgcccaggtggag

SEQ ID NO: 8000479 - DNA, 22 bp, Homo sapiens
gcacctggctgcccaggtggag

SEQ ID NO: 8000480 - DNA, 22 bp, Homo sapiens
gcacttggcctttatctgggga

SEQ ID NO: 8000481 - DNA, 22 bp, Homo sapiens
gcacctgctgggtgtagaggct

SEQ ID NO: 8000482 - DNA, 22 bp, Homo sapiens
gcacctgctggggctgatgaga

SEQ ID NO: 8000483 - DNA, 22 bp, Homo sapiens
gcacctgctggggctgatgaga

SEQ ID NO: 8000484 - DNA, 22 bp, Homo sapiens
gcacctggacagtgaccctagc

SEQ ID NO: 8000485 - DNA, 21 bp, Homo sapiens
gcacttggggattcagggagg

SEQ ID NO: 8000486 - DNA, 20 bp, Homo sapiens
gcacttggctgctgcttctc

SEQ ID NO: 8000487 - DNA, 22 bp, Homo sapiens
gcacttgtggatttgatataca

SEQ ID NO: 8000488 - DNA, 22 bp, Homo sapiens
gcactttaaagtttggtggcat

SEQ ID NO: 8000489 - DNA, 22 bp, Homo sapiens
gcacctgctcacacatgtgact

SEQ ID NO: 8000490 - DNA, 22 bp, Homo sapiens
gcacctgctcacacatgtgact

SEQ ID NO: 8000491 - DNA, 22 bp, Homo sapiens
gcacctgcctgggactgaagat

SEQ ID NO: 8000492 - DNA, 22 bp, Homo sapiens
gcacctgcctgggactgaagat

SEQ ID NO: 8000493 - DNA, 22 bp, Homo sapiens
gcacctgctggaatcagtctgt

SEQ ID NO: 8000494 - DNA, 22 bp, Homo sapiens
gcacctgctggaatcagtctgt

SEQ ID NO: 8000495 - DNA, 22 bp, Homo sapiens
gcacctgctggaatcagtctgt

SEQ ID NO: 8000496 - DNA, 22 bp, Homo sapiens
gcacctgcaggatgagccaggg

SEQ ID NO: 8000497 - DNA, 22 bp, Homo sapiens
gcacctgcaggatgagccaggg

SEQ ID NO: 8000498 - DNA, 22 bp, Homo sapiens
gcacctgattgatttcactgct

SEQ ID NO: 8000499 - DNA, 22 bp, Homo sapiens
gcacctcattttgcaggtagaa

SEQ ID NO: 8000500 - DNA, 22 bp, Homo sapiens
gcaccgttcactctccgccaga

SEQ ID NO: 8000501 - DNA, 22 bp, Homo sapiens
gcacctgaacgacctgctccag

SEQ ID NO: 8000502 - DNA, 22 bp, Homo sapiens
gcacccttgctgccaagtggat

SEQ ID NO: 8000503 - DNA, 22 bp, Homo sapiens
gcacccaggcactttcctttct

SEQ ID NO: 8000504 - DNA, 22 bp, Homo sapiens
gcacacactgttttcctcacat

SEQ ID NO: 8000505 - DNA, 22 bp, Homo sapiens
gcacacactgttttcctcacat

SEQ ID NO: 8000506 - DNA, 22 bp, Homo sapiens
gcacacacatgtgagtacatgc

SEQ ID NO: 8000507 - DNA, 22 bp, Homo sapiens
gcacacacatgtgagtacatgc

SEQ ID NO: 8000508 - DNA, 22 bp, Homo sapiens
gcacacactgttttcctcacat

SEQ ID NO: 8000509 - DNA, 22 bp, Homo sapiens
gcacacactgttttcctcacat

SEQ ID NO: 8000510 - DNA, 22 bp, Homo sapiens
gcacacactgttttcctcacat

SEQ ID NO: 8000511 - DNA, 22 bp, Homo sapiens
gcacacacatgtgagtacatgc

SEQ ID NO: 8000512 - DNA, 22 bp, Homo sapiens
gcacacacatgtgagtacatgc

SEQ ID NO: 8000513 - DNA, 22 bp, Homo sapiens
gcacaatggaccgtgtgctctg

SEQ ID NO: 8000514 - DNA, 22 bp, Homo sapiens
gcacaatggaccgtgtgctctg

SEQ ID NO: 8000515 - DNA, 22 bp, Homo sapiens
gcacaattccatgggacagccc

SEQ ID NO: 8000516 - DNA, 22 bp, Homo sapiens
gcacaattccatgggacagccc

SEQ ID NO: 8000517 - DNA, 22 bp, Homo sapiens
gcacaagggtggtctctggagc

SEQ ID NO: 8000518 - DNA, 22 bp, Homo sapiens
gcacaagtttcttcattgttca

SEQ ID NO: 8000519 - DNA, 22 bp, Homo sapiens
gcacaataacagccaaggttat

SEQ ID NO: 8000520 - DNA, 16 bp, Homo sapiens
gcacacacatcaatga

SEQ ID NO: 8000521 - DNA, 22 bp, Homo sapiens
gcacacacatgtgagtacatgc

SEQ ID NO: 8000522 - DNA, 16 bp, Homo sapiens
gcacacacatcaatga

SEQ ID NO: 8000523 - DNA, 22 bp, Homo sapiens
gcacaattttgttgtcatggag

SEQ ID NO: 8000524 - DNA, 22 bp, Homo sapiens
gcacaatttgactctattcata

SEQ ID NO: 8000525 - DNA, 16 bp, Homo sapiens
gcacacacatcaatga

SEQ ID NO: 8000526 - DNA, 22 bp, Homo sapiens
gcacaattccatgggacagccc

SEQ ID NO: 8000527 - DNA, 22 bp, Homo sapiens
gcacaattgacattttgggcca

SEQ ID NO: 8000528 - DNA, 22 bp, Homo sapiens
gcacaatttattaatcaggtcc

SEQ ID NO: 8000529 - DNA, 22 bp, Homo sapiens
gcacaattccatgggacagccc

SEQ ID NO: 8000530 - DNA, 22 bp, Homo sapiens
gcacccaggcttgggcagcaac

SEQ ID NO: 8000531 - DNA, 22 bp, Homo sapiens
gcacccaggccggcgactgcag

SEQ ID NO: 8000532 - DNA, 22 bp, Homo sapiens
gcacccaggccggcgactgcag

SEQ ID NO: 8000533 - DNA, 22 bp, Homo sapiens
gcacccaggcttgggcagcaac

SEQ ID NO: 8000534 - DNA, 22 bp, Homo sapiens
gcacccagggacttggctggcc

SEQ ID NO: 8000535 - DNA, 22 bp, Homo sapiens
gcacccagggacttggctggcc

SEQ ID NO: 8000536 - DNA, 22 bp, Homo sapiens
gcacccaggcttgggcagcaac

SEQ ID NO: 8000537 - DNA, 22 bp, Homo sapiens
gcacccaggcttgggcagcaac

SEQ ID NO: 8000538 - DNA, 22 bp, Homo sapiens
gcacccagtttgtctcagggtt

SEQ ID NO: 8000539 - DNA, 22 bp, Homo sapiens
gcacccagtttgtctcagggtt

SEQ ID NO: 8000540 - DNA, 22 bp, Homo sapiens
gcacccagtttgtctcagggtt

SEQ ID NO: 8000541 - DNA, 22 bp, Homo sapiens
gcacccagtttgtctcagggtt

SEQ ID NO: 8000542 - DNA, 22 bp, Homo sapiens
gcacccatgctcttgtctcagg

SEQ ID NO: 8000543 - DNA, 22 bp, Homo sapiens
gcacccagggcaggaagtgagg

SEQ ID NO: 8000544 - DNA, 22 bp, Homo sapiens
gcacccagggcaggaagtgagg

SEQ ID NO: 8000545 - DNA, 22 bp, Homo sapiens
gcacccagggcaggaagtgagg

SEQ ID NO: 8000546 - DNA, 22 bp, Homo sapiens
gcacccagggcaggaagtgagg

SEQ ID NO: 8000547 - DNA, 22 bp, Homo sapiens
gcacccagtgggatgcttagca

SEQ ID NO: 8000548 - DNA, 22 bp, Homo sapiens
gcacccagtgggatgcttagca

SEQ ID NO: 8000549 - DNA, 18 bp, Homo sapiens
gcagagcatcaagggtta

SEQ ID NO: 8000550 - DNA, 18 bp, Homo sapiens
gcagagcatcaagggtta

SEQ ID NO: 8000551 - DNA, 18 bp, Homo sapiens
gcagagcatcaagggtta

SEQ ID NO: 8000552 - DNA, 22 bp, Homo sapiens
gcagagcatgtcctcaggacag

SEQ ID NO: 8000553 - DNA, 22 bp, Homo sapiens
gcagaaggatccgcaggtgcaa

SEQ ID NO: 8000554 - DNA, 22 bp, Homo sapiens
gcagagcatgtcctcaggacag

SEQ ID NO: 8000555 - DNA, 22 bp, Homo sapiens
gcagagcatgtcctcaggacag

SEQ ID NO: 8000556 - DNA, 22 bp, Homo sapiens
gcagagcattggagggaccctg

SEQ ID NO: 8000557 - DNA, 22 bp, Homo sapiens
gcagagcattggagggaccctg

SEQ ID NO: 8000558 - DNA, 22 bp, Homo sapiens
gcagagcattggagggaccctg

SEQ ID NO: 8000559 - DNA, 22 bp, Homo sapiens
gcagagcatttcggttgcttcc

SEQ ID NO: 8000560 - DNA, 22 bp, Homo sapiens
gcagagcatttcggttgcttcc

SEQ ID NO: 8000561 - DNA, 22 bp, Homo sapiens
gcagagccagaatggccaggac

SEQ ID NO: 8000562 - DNA, 22 bp, Homo sapiens
gcagagccagaatggccaggac

SEQ ID NO: 8000563 - DNA, 22 bp, Homo sapiens
gcagagcatttcggttgcttcc

SEQ ID NO: 8000564 - DNA, 22 bp, Homo sapiens
gcagagcatgtcctcaggacag

SEQ ID NO: 8000565 - DNA, 22 bp, Homo sapiens
gcagagcatgtcctcaggacag

SEQ ID NO: 8000566 - DNA, 22 bp, Homo sapiens
gcagagcattggagggaccctg

SEQ ID NO: 8000567 - DNA, 22 bp, Homo sapiens
gcagagcattggagggaccctg

SEQ ID NO: 8000568 - DNA, 22 bp, Homo sapiens
gcagaagctgggcagcgaggtg

SEQ ID NO: 8000569 - DNA, 22 bp, Homo sapiens
gcagaagctgggcagcgaggtg

SEQ ID NO: 8000570 - DNA, 22 bp, Homo sapiens
gcagaaggatccgcaggtgcaa

SEQ ID NO: 8000571 - DNA, 22 bp, Homo sapiens
gcagaaggatccgcaggtgcaa

SEQ ID NO: 8000572 - DNA, 22 bp, Homo sapiens
gcagaagctgttcgaaggccgc

SEQ ID NO: 8000573 - DNA, 22 bp, Homo sapiens
gcagaaggatccgcaggtgcaa

SEQ ID NO: 8000574 - DNA, 22 bp, Homo sapiens
gcagaaggatccgcaggtgcaa

SEQ ID NO: 8000575 - DNA, 22 bp, Homo sapiens
gcagaaggatccgcaggtgcaa

SEQ ID NO: 8000576 - DNA, 22 bp, Homo sapiens
gcagagcagtgcttgcccagcg

SEQ ID NO: 8000577 - DNA, 22 bp, Homo sapiens
gcagagcagtgcttgcccagcg

SEQ ID NO: 8000578 - DNA, 22 bp, Homo sapiens
gcagagcagtactctcttgact

SEQ ID NO: 8000579 - DNA, 22 bp, Homo sapiens
gcagagcagtactctcttgact

SEQ ID NO: 8000580 - DNA, 22 bp, Homo sapiens
gcagagcagtgcttgcccagcg

SEQ ID NO: 8000581 - DNA, 22 bp, Homo sapiens
gcagagccccattgctggcggg

SEQ ID NO: 8000582 - DNA, 22 bp, Homo sapiens
gcagagccccattgctggcggg

SEQ ID NO: 8000583 - DNA, 22 bp, Homo sapiens
gcagagccccattgctggcggg

SEQ ID NO: 8000584 - DNA, 22 bp, Homo sapiens
gcagagccaggctggggcaggt

SEQ ID NO: 8000585 - DNA, 22 bp, Homo sapiens
gcagagccaggctggggcaggt

SEQ ID NO: 8000586 - DNA, 22 bp, Homo sapiens
gcagagccaggctggggcaggt

SEQ ID NO: 8000587 - DNA, 22 bp, Homo sapiens
gcagagcccctcaagccagcct

SEQ ID NO: 8000588 - DNA, 22 bp, Homo sapiens
gcagagcccctcaagccagcct

SEQ ID NO: 8000589 - DNA, 22 bp, Homo sapiens
gcagagccccattgctggcggg

SEQ ID NO: 8000590 - DNA, 22 bp, Homo sapiens
gcagagccccattgctggcggg

SEQ ID NO: 8000591 - DNA, 22 bp, Homo sapiens
gcagagcccctcaagccagcct

SEQ ID NO: 8000592 - DNA, 22 bp, Homo sapiens
gcagagcccctcaagccagcct

SEQ ID NO: 8000593 - DNA, 22 bp, Homo sapiens
gcagagccaggctggggcaggt

SEQ ID NO: 8000594 - DNA, 22 bp, Homo sapiens
gcagagccaggctggggcaggt

SEQ ID NO: 8000595 - DNA, 22 bp, Homo sapiens
gcagagccaggagcccaggatc

SEQ ID NO: 8000596 - DNA, 22 bp, Homo sapiens
gcagagccaggagcccaggatc

SEQ ID NO: 8000597 - DNA, 22 bp, Homo sapiens
gcagagccagaatggccaggac

SEQ ID NO: 8000598 - DNA, 22 bp, Homo sapiens
gcagagcatttcggttgcttcc

SEQ ID NO: 8000599 - DNA, 22 bp, Homo sapiens
gcagagccaggagagacccttg

SEQ ID NO: 8000600 - DNA, 22 bp, Homo sapiens
gcagagccaggagagacccttg

SEQ ID NO: 8000601 - DNA, 22 bp, Homo sapiens
gcagagccaggagagacccttg

SEQ ID NO: 8000602 - DNA, 22 bp, Homo sapiens
gcactttgtggattgtatttcc

SEQ ID NO: 8000603 - DNA, 22 bp, Homo sapiens
gcactttgtggattgtatttcc

SEQ ID NO: 8000604 - DNA, 22 bp, Homo sapiens
gcactttgcccctcctttggca

SEQ ID NO: 8000605 - DNA, 22 bp, Homo sapiens
gcactttcagcaggcagacaga

SEQ ID NO: 8000606 - DNA, 22 bp, Homo sapiens
gcactttaaatgttcacggaaa

SEQ ID NO: 8000607 - DNA, 17 bp, Homo sapiens
gcagaaaagtcaaggga

SEQ ID NO: 8000608 - DNA, 17 bp, Homo sapiens
gcagaaaagtcaaggga

SEQ ID NO: 8000609 - DNA, 17 bp, Homo sapiens
gcagaaaagtcaaggga

SEQ ID NO: 8000610 - DNA, 17 bp, Homo sapiens
gcagaaaagtcaaggga

SEQ ID NO: 8000611 - DNA, 22 bp, Homo sapiens
gcacttttcaaagcttcctgtg

SEQ ID NO: 8000612 - DNA, 22 bp, Homo sapiens
gcacttttcaaagcttcctgtg

SEQ ID NO: 8000613 - DNA, 17 bp, Homo sapiens
gcagaaaagtcaaggga

SEQ ID NO: 8000614 - DNA, 23 bp, Homo sapiens
gcacttttataggtggggaaaca

SEQ ID NO: 8000615 - DNA, 22 bp, Homo sapiens
gcagaacaacgtaggagtggag

SEQ ID NO: 8000616 - DNA, 22 bp, Homo sapiens
gcagaacaacgtaggagtggag

SEQ ID NO: 8000617 - DNA, 23 bp, Homo sapiens
gcagaaattctcacactgaggcc

SEQ ID NO: 8000618 - DNA, 22 bp, Homo sapiens
gcagaaatatgatgcataaagg

SEQ ID NO: 8000619 - DNA, 22 bp, Homo sapiens
gcagaaatatgatgcataaagg

SEQ ID NO: 8000620 - DNA, 22 bp, Homo sapiens
gcagaaacttggagaagccagg

SEQ ID NO: 8000621 - DNA, 22 bp, Homo sapiens
gcagaaacttggagaagccagg

SEQ ID NO: 8000622 - DNA, 22 bp, Homo sapiens
gcagaaagctccttgcgatctg

SEQ ID NO: 8000623 - DNA, 22 bp, Homo sapiens
gcagaaagctccttgcgatctg

SEQ ID NO: 8000624 - DNA, 21 bp, Homo sapiens
gcagaaaggaatcttaggtcc

SEQ ID NO: 8000625 - DNA, 21 bp, Homo sapiens
gcagaaaggaatcttaggtcc

SEQ ID NO: 8000626 - DNA, 21 bp, Homo sapiens
gcagaaaggaatcttaggtcc

SEQ ID NO: 8000627 - DNA, 22 bp, Homo sapiens
gcagaaagcttagagggtttgc

SEQ ID NO: 8000628 - DNA, 22 bp, Homo sapiens
gcagaaagcttagagggtttgc

SEQ ID NO: 8000629 - DNA, 22 bp, Homo sapiens
gcagaagctgggcagcgaggtg

SEQ ID NO: 8000630 - DNA, 22 bp, Homo sapiens
gcagaagctgggagaagggatt

SEQ ID NO: 8000631 - DNA, 22 bp, Homo sapiens
gcagaagctgggagaagggatt

SEQ ID NO: 8000632 - DNA, 22 bp, Homo sapiens
gcagaagctgggagaagggatt

SEQ ID NO: 8000633 - DNA, 22 bp, Homo sapiens
gcagaagcccggtcagcgcacg

SEQ ID NO: 8000634 - DNA, 22 bp, Homo sapiens
gcagaagcccggtcagcgcacg

SEQ ID NO: 8000635 - DNA, 22 bp, Homo sapiens
gcagaagcccggtcagcgcacg

SEQ ID NO: 8000636 - DNA, 22 bp, Homo sapiens
gcagaagcagggcaggggcaaa

SEQ ID NO: 8000637 - DNA, 22 bp, Homo sapiens
gcagaagcagcagatgggcgca

SEQ ID NO: 8000638 - DNA, 22 bp, Homo sapiens
gcagaagcagcagatgggcgca

SEQ ID NO: 8000639 - DNA, 22 bp, Homo sapiens
gcagaagcagaggagcctatga

SEQ ID NO: 8000640 - DNA, 22 bp, Homo sapiens
gcagaagcagaggagcctatga

SEQ ID NO: 8000641 - DNA, 22 bp, Homo sapiens
gcagaagcagggcaggggcaaa

SEQ ID NO: 8000642 - DNA, 22 bp, Homo sapiens
gcagaagcagggcaggggcaaa

SEQ ID NO: 8000643 - DNA, 22 bp, Homo sapiens
gcagaacagtctgtcggttcta

SEQ ID NO: 8000644 - DNA, 22 bp, Homo sapiens
gcagaacagtctgtcggttcta

SEQ ID NO: 8000645 - DNA, 22 bp, Homo sapiens
gcagaacatttcacagtatctt

SEQ ID NO: 8000646 - DNA, 22 bp, Homo sapiens
gcagaacatttcacagtatctt

SEQ ID NO: 8000647 - DNA, 22 bp, Homo sapiens
gcagaacatttcacagtatctt

SEQ ID NO: 8000648 - DNA, 22 bp, Homo sapiens
gcagaagaccatggtggaaaga

SEQ ID NO: 8000649 - DNA, 22 bp, Homo sapiens
gcagaagaccatggtggaaaga

SEQ ID NO: 8000650 - DNA, 22 bp, Homo sapiens
gcagaagaccatggtggaaaga

SEQ ID NO: 8000651 - DNA, 22 bp, Homo sapiens
gcagaagcacaggtgacgggcc

SEQ ID NO: 8000652 - DNA, 22 bp, Homo sapiens
gcagaagaccatggtggaaaga

SEQ ID NO: 8000653 - DNA, 22 bp, Homo sapiens
gcagaagaccatggtggaaaga

SEQ ID NO: 8000654 - DNA, 22 bp, Homo sapiens
gcaatgcaatcagatgattatt

SEQ ID NO: 8000655 - DNA, 22 bp, Homo sapiens
gcaatgcaatctttattatatt

SEQ ID NO: 8000656 - DNA, 22 bp, Homo sapiens
gcaatgattgcattagaagatg

SEQ ID NO: 8000657 - DNA, 22 bp, Homo sapiens
gcaatgattgcattagaagatg

SEQ ID NO: 8000658 - DNA, 22 bp, Homo sapiens
gcaatctttaaaaatcaagtcg

SEQ ID NO: 8000659 - DNA, 19 bp, Homo sapiens
gcaatccacccacctcagc

SEQ ID NO: 8000660 - DNA, 22 bp, Homo sapiens
gcaatccaggaaaaaccaggga

SEQ ID NO: 8000661 - DNA, 22 bp, Homo sapiens
gcaatgagcacccagagggcag

SEQ ID NO: 8000662 - DNA, 17 bp, Homo sapiens
gcaatctcagtctcctt

SEQ ID NO: 8000663 - DNA, 22 bp, Homo sapiens
gcaatcaatttaaaatgaggtc

SEQ ID NO: 8000664 - DNA, 22 bp, Homo sapiens
gcaatgtttttccttccatatt

SEQ ID NO: 8000665 - DNA, 20 bp, Homo sapiens
gcaatgttggttcctgtcac

SEQ ID NO: 8000666 - DNA, 22 bp, Homo sapiens
gcaatgttgtgttggcattcta

SEQ ID NO: 8000667 - DNA, 20 bp, Homo sapiens
gcaatgttggttcctgtcac

SEQ ID NO: 8000668 - DNA, 22 bp, Homo sapiens
gcaatgtgcacgcccttgggga

SEQ ID NO: 8000669 - DNA, 22 bp, Homo sapiens
gcaatgtgcacgcccttgggga

SEQ ID NO: 8000670 - DNA, 22 bp, Homo sapiens
gcaattatatcaccagagatct

SEQ ID NO: 8000671 - DNA, 22 bp, Homo sapiens
gcaattatatcaccagagatct

SEQ ID NO: 8000672 - DNA, 22 bp, Homo sapiens
gcaattacagtggcatgtattt

SEQ ID NO: 8000673 - DNA, 22 bp, Homo sapiens
gcaattatttttgcaccaatgt

SEQ ID NO: 8000674 - DNA, 19 bp, Homo sapiens
gcaattcagaagcacctgt

SEQ ID NO: 8000675 - DNA, 17 bp, Homo sapiens
gcaattattgggcattt

SEQ ID NO: 8000676 - DNA, 22 bp, Homo sapiens
gcaattattatgtgacttttac

SEQ ID NO: 8000677 - DNA, 22 bp, Homo sapiens
gcaattatatcaccagagatct

SEQ ID NO: 8000678 - DNA, 22 bp, Homo sapiens
gcacaacaccaagggaggtatc

SEQ ID NO: 8000679 - DNA, 22 bp, Homo sapiens
gcacaagaaatcatggactgaa

SEQ ID NO: 8000680 - DNA, 22 bp, Homo sapiens
gcacaagaataaccatatttaa

SEQ ID NO: 8000681 - DNA, 22 bp, Homo sapiens
gcacaagaataaccatatttaa

SEQ ID NO: 8000682 - DNA, 17 bp, Homo sapiens
gcacaaatcaattacta

SEQ ID NO: 8000683 - DNA, 17 bp, Homo sapiens
gcacaaatcaattacta

SEQ ID NO: 8000684 - DNA, 22 bp, Homo sapiens
gcacaaaggtggaaggaggaag

SEQ ID NO: 8000685 - DNA, 22 bp, Homo sapiens
gcacaaatacaaagttgagaaa

SEQ ID NO: 8000686 - DNA, 23 bp, Homo sapiens
gcacaagacctggcagcttccat

SEQ ID NO: 8000687 - DNA, 22 bp, Homo sapiens
gcacaagcagcccactgacatt

SEQ ID NO: 8000688 - DNA, 22 bp, Homo sapiens
gcacaagcagcccactgacatt

SEQ ID NO: 8000689 - DNA, 22 bp, Homo sapiens
gcacaaggagaattcattagtg

SEQ ID NO: 8000690 - DNA, 22 bp, Homo sapiens
gcacaaggagaattcattagtg

SEQ ID NO: 8000691 - DNA, 22 bp, Homo sapiens
gcacaaggagcagtgtatgaaa

SEQ ID NO: 8000692 - DNA, 22 bp, Homo sapiens
gcacaaggagcagtgtatgaaa

SEQ ID NO: 8000693 - DNA, 22 bp, Homo sapiens
gcacaaaacacattttgacaat

SEQ ID NO: 8000694 - DNA, 22 bp, Homo sapiens
gcacaaaaggtacttcatgtag

SEQ ID NO: 8000695 - DNA, 22 bp, Homo sapiens
gcacaaaaggtacttcatgtag

SEQ ID NO: 8000696 - DNA, 22 bp, Homo sapiens
gcacaaaaggtacttcatgtag

SEQ ID NO: 8000697 - DNA, 22 bp, Homo sapiens
gcacaaaaggtacttcatgtag

SEQ ID NO: 8000698 - DNA, 22 bp, Homo sapiens
gcacaaactgcaattacttttg

SEQ ID NO: 8000699 - DNA, 22 bp, Homo sapiens
gcacaaaaggtacttcatgtag

SEQ ID NO: 8000700 - DNA, 22 bp, Homo sapiens
gcacaaactgcaattacttttg

SEQ ID NO: 8000701 - DNA, 22 bp, Homo sapiens
gcacaaactgcaattacttttg

SEQ ID NO: 8000702 - DNA, 22 bp, Homo sapiens
gcacaaaggtggaaggaggaag

SEQ ID NO: 8000703 - DNA, 22 bp, Homo sapiens
gcacaaagatgaatacagaatg

SEQ ID NO: 8000704 - DNA, 22 bp, Homo sapiens
gcacaaagatgaatacagaatg

SEQ ID NO: 8000705 - DNA, 22 bp, Homo sapiens
gcaaacaaggacatacatcctg

SEQ ID NO: 8000706 - DNA, 22 bp, Homo sapiens
gcaaacagaaatgcaggacgct

SEQ ID NO: 8000707 - DNA, 22 bp, Homo sapiens
gcaaaaaatgcttgttgcttag

SEQ ID NO: 8000708 - DNA, 22 bp, Homo sapiens
gcaaacatccactgcccttgta

SEQ ID NO: 8000709 - DNA, 22 bp, Homo sapiens
gcaaacatccactgcccttgta

SEQ ID NO: 8000710 - DNA, 22 bp, Homo sapiens
gcaaacataatatgaagacact

SEQ ID NO: 8000711 - DNA, 22 bp, Homo sapiens
gcaaacataatatgaagacact

SEQ ID NO: 8000712 - DNA, 22 bp, Homo sapiens
gcaaacataatatgaagacact

SEQ ID NO: 8000713 - DNA, 22 bp, Homo sapiens
gatttttcagtataaaatatat

SEQ ID NO: 8000714 - DNA, 22 bp, Homo sapiens
gcaaaaaatgcttgttgcttag

SEQ ID NO: 8000715 - DNA, 22 bp, Homo sapiens
gcaaaaaatgcttgttgcttag

SEQ ID NO: 8000716 - DNA, 22 bp, Homo sapiens
gcaaaaaatgcttgttgcttag

SEQ ID NO: 8000717 - DNA, 22 bp, Homo sapiens
gattttctgagccttcaaattt

SEQ ID NO: 8000718 - DNA, 22 bp, Homo sapiens
gattttctgagccttcaaattt

SEQ ID NO: 8000719 - DNA, 22 bp, Homo sapiens
gattttcttgggaaacaatgag

SEQ ID NO: 8000720 - DNA, 22 bp, Homo sapiens
gattttcttgggaaacaatgag

SEQ ID NO: 8000721 - DNA, 22 bp, Homo sapiens
gattttcttgggaaacaatgag

SEQ ID NO: 8000722 - DNA, 22 bp, Homo sapiens
gattttgtcaaattccaaatgt

SEQ ID NO: 8000723 - DNA, 22 bp, Homo sapiens
gattttgtcaaattccaaatgt

SEQ ID NO: 8000724 - DNA, 22 bp, Homo sapiens
gattttgaatattaaagaagag

SEQ ID NO: 8000725 - DNA, 22 bp, Homo sapiens
gattttgaatattaaagaagag

SEQ ID NO: 8000726 - DNA, 22 bp, Homo sapiens
gattttgtcaaattccaaatgt

SEQ ID NO: 8000727 - DNA, 22 bp, Homo sapiens
gattttgtcaaattccaaatgt

SEQ ID NO: 8000728 - DNA, 22 bp, Homo sapiens
gatttttatataaagtgagaaa

SEQ ID NO: 8000729 - DNA, 22 bp, Homo sapiens
gcaaacatgctgagaaataaga

SEQ ID NO: 8000730 - DNA, 22 bp, Homo sapiens
gcaaacatgctgagaaataaga

SEQ ID NO: 8000731 - DNA, 22 bp, Homo sapiens
gcaaacatctttatttggcaag

SEQ ID NO: 8000732 - DNA, 22 bp, Homo sapiens
gcaaacatcttagccatagagt

SEQ ID NO: 8000733 - DNA, 22 bp, Homo sapiens
gcaaacatcttagccatagagt

SEQ ID NO: 8000734 - DNA, 22 bp, Homo sapiens
gcaaacatgtgctcattttgtg

SEQ ID NO: 8000735 - DNA, 22 bp, Homo sapiens
gcaaacatgtgctcattttgtg

SEQ ID NO: 8000736 - DNA, 22 bp, Homo sapiens
gcaaacatgttgtgagatacca

SEQ ID NO: 8000737 - DNA, 22 bp, Homo sapiens
gcaaacatgttgtgagatacca

SEQ ID NO: 8000738 - DNA, 22 bp, Homo sapiens
gcaaacatgttgtgagatacca

SEQ ID NO: 8000739 - DNA, 22 bp, Homo sapiens
gcaaacattcaggagtacagga

SEQ ID NO: 8000740 - DNA, 22 bp, Homo sapiens
gcaaacattcaggagtacagga

SEQ ID NO: 8000741 - DNA, 22 bp, Homo sapiens
gcaaacattcaggagtacagga

SEQ ID NO: 8000742 - DNA, 22 bp, Homo sapiens
gcaatataaccagttgtcatgc

SEQ ID NO: 8000743 - DNA, 22 bp, Homo sapiens
gcaaactggcaaacctgtctgt

SEQ ID NO: 8000744 - DNA, 22 bp, Homo sapiens
gcaaacattccacagaaggaag

SEQ ID NO: 8000745 - DNA, 22 bp, Homo sapiens
gcaaactggcaaacctgtctgt

SEQ ID NO: 8000746 - DNA, 22 bp, Homo sapiens
gcaaacattccacagaaggaag

SEQ ID NO: 8000747 - DNA, 22 bp, Homo sapiens
gcaaacattccacagaaggaag

SEQ ID NO: 8000748 - DNA, 18 bp, Homo sapiens
gcaaacattcttccagtc

SEQ ID NO: 8000749 - DNA, 18 bp, Homo sapiens
gcaaacattcttccagtc

SEQ ID NO: 8000750 - DNA, 22 bp, Homo sapiens
gcaaacatttggtctagtgtgt

SEQ ID NO: 8000751 - DNA, 22 bp, Homo sapiens
gcaaactgatttccaagtccgt

SEQ ID NO: 8000752 - DNA, 22 bp, Homo sapiens
gcaaactgatttccaagtccgt

SEQ ID NO: 8000753 - DNA, 22 bp, Homo sapiens
gcaaactgcattctatagcttg

SEQ ID NO: 8000754 - DNA, 22 bp, Homo sapiens
gatttctgttgagaaacatggg

SEQ ID NO: 8000755 - DNA, 22 bp, Homo sapiens
gatttctgtggcttgtacatat

SEQ ID NO: 8000756 - DNA, 22 bp, Homo sapiens
gatttctgtggcttgtacatat

SEQ ID NO: 8000757 - DNA, 22 bp, Homo sapiens
gatttctgttgagaaacatggg

SEQ ID NO: 8000758 - DNA, 22 bp, Homo sapiens
gatttctgttgagaaacatggg

SEQ ID NO: 8000759 - DNA, 22 bp, Homo sapiens
gatttcaatccagctttcttct

SEQ ID NO: 8000760 - DNA, 22 bp, Homo sapiens
gatttcaatccagctttcttct

SEQ ID NO: 8000761 - DNA, 22 bp, Homo sapiens
gatttcaaggatgttagaggtg

SEQ ID NO: 8000762 - DNA, 22 bp, Homo sapiens
gatttcaagtatcttgggcgag

SEQ ID NO: 8000763 - DNA, 22 bp, Homo sapiens
gatttcaagcccccagagattc

SEQ ID NO: 8000764 - DNA, 22 bp, Homo sapiens
gatttcaaggagttttcacagt

SEQ ID NO: 8000765 - DNA, 22 bp, Homo sapiens
gatttcaaggagttttcacagt

SEQ ID NO: 8000766 - DNA, 22 bp, Homo sapiens
gatttcttgagcaagttgctta

SEQ ID NO: 8000767 - DNA, 22 bp, Homo sapiens
gatttcttgagcaagttgctta

SEQ ID NO: 8000768 - DNA, 22 bp, Homo sapiens
gatttcttgagcaagttgctta

SEQ ID NO: 8000769 - DNA, 22 bp, Homo sapiens
gatttcttgagcaagttgctta

SEQ ID NO: 8000770 - DNA, 22 bp, Homo sapiens
gatttcttgacccctgtctcag

SEQ ID NO: 8000771 - DNA, 22 bp, Homo sapiens
gatttcttgataagtagtgtga

SEQ ID NO: 8000772 - DNA, 22 bp, Homo sapiens
gatttcttgataagtagtgtga

SEQ ID NO: 8000773 - DNA, 22 bp, Homo sapiens
gatttcttgataagtagtgtga

SEQ ID NO: 8000774 - DNA, 22 bp, Homo sapiens
gatttcttcatttgtggtgaat

SEQ ID NO: 8000775 - DNA, 22 bp, Homo sapiens
gatttcttcatttgtggtgaat

SEQ ID NO: 8000776 - DNA, 22 bp, Homo sapiens
gatttcttcattcattagatgg

SEQ ID NO: 8000777 - DNA, 22 bp, Homo sapiens
gatttcttcattcattagatgg

SEQ ID NO: 8000778 - DNA, 22 bp, Homo sapiens
gatttcttctctcccaagagga

SEQ ID NO: 8000779 - DNA, 22 bp, Homo sapiens
gatttcttgacccctgtctcag

SEQ ID NO: 8000780 - DNA, 22 bp, Homo sapiens
gatttcttgataattcaaatcc

SEQ ID NO: 8000781 - DNA, 22 bp, Homo sapiens
gatttcttgataattcaaatcc

SEQ ID NO: 8000782 - DNA, 22 bp, Homo sapiens
gatttcttgataattcaaatcc

SEQ ID NO: 8000783 - DNA, 22 bp, Homo sapiens
gatttcttggcccactctcaga

SEQ ID NO: 8000784 - DNA, 22 bp, Homo sapiens
gatttcttggcccactctcaga

SEQ ID NO: 8000785 - DNA, 22 bp, Homo sapiens
gatttctttagctcatcagatc

SEQ ID NO: 8000786 - DNA, 22 bp, Homo sapiens
gatttctttaggtgtaatagtg

SEQ ID NO: 8000787 - DNA, 22 bp, Homo sapiens
gatttctttagctcatcagatc

SEQ ID NO: 8000788 - DNA, 22 bp, Homo sapiens
gatttctttagctcatcagatc

SEQ ID NO: 8000789 - DNA, 22 bp, Homo sapiens
gatttctttaggtgtaatagtg

SEQ ID NO: 8000790 - DNA, 22 bp, Homo sapiens
gatttctttaggtgtaatagtg

SEQ ID NO: 8000791 - DNA, 22 bp, Homo sapiens
gatttctttatgaagtacagaa

SEQ ID NO: 8000792 - DNA, 22 bp, Homo sapiens
gatttctttatgaagtacagaa

SEQ ID NO: 8000793 - DNA, 22 bp, Homo sapiens
gatttctttatgaagtacagaa

SEQ ID NO: 8000794 - DNA, 22 bp, Homo sapiens
gatttctttgaattagagaggt

SEQ ID NO: 8000795 - DNA, 22 bp, Homo sapiens
gatttctttatgaagtacagaa

SEQ ID NO: 8000796 - DNA, 22 bp, Homo sapiens
gatttctttgcaagctgtgttc

SEQ ID NO: 8000797 - DNA, 22 bp, Homo sapiens
gatttctttgtacccacaatcc

SEQ ID NO: 8000798 - DNA, 22 bp, Homo sapiens
gatttgacacctggggcatata

SEQ ID NO: 8000799 - DNA, 22 bp, Homo sapiens
gatttgaccttctcccgtcttt

SEQ ID NO: 8000800 - DNA, 22 bp, Homo sapiens
gatttgactttgtcctacctca

SEQ ID NO: 8000801 - DNA, 22 bp, Homo sapiens
gatttgacaaccaattaggttt

SEQ ID NO: 8000802 - DNA, 22 bp, Homo sapiens
gatttctttgcaagctgtgttc

SEQ ID NO: 8000803 - DNA, 22 bp, Homo sapiens
gatttctttgaattagagaggt

SEQ ID NO: 8000804 - DNA, 22 bp, Homo sapiens
gatttctttgcaagctgtgttc

SEQ ID NO: 8000805 - DNA, 22 bp, Homo sapiens
gatttctttgcaagctgtgttc

SEQ ID NO: 8000806 - DNA, 22 bp, Homo sapiens
gatttgcagctagagcaaaggt

SEQ ID NO: 8000807 - DNA, 21 bp, Homo sapiens
gatttgcagaaactagacagg

SEQ ID NO: 8000808 - DNA, 22 bp, Homo sapiens
gatttgcattctgaaagctacc

SEQ ID NO: 8000809 - DNA, 22 bp, Homo sapiens
gatttgtagttttatgtgtcag

SEQ ID NO: 8000810 - DNA, 22 bp, Homo sapiens
gatttgtagttttatgtgtcag

SEQ ID NO: 8000811 - DNA, 22 bp, Homo sapiens
gattttctgagccttcaaattt

SEQ ID NO: 8000812 - DNA, 22 bp, Homo sapiens
gattttctgagccttcaaattt

SEQ ID NO: 8000813 - DNA, 22 bp, Homo sapiens
gattttcatttgcactctagaa

SEQ ID NO: 8000814 - DNA, 22 bp, Homo sapiens
gattttattagcccaaactttg

SEQ ID NO: 8000815 - DNA, 22 bp, Homo sapiens
gattttattagcccaaactttg

SEQ ID NO: 8000816 - DNA, 22 bp, Homo sapiens
gattttattagcccaaactttg

SEQ ID NO: 8000817 - DNA, 22 bp, Homo sapiens
gattttatctttgtgtgcagta

SEQ ID NO: 8000818 - DNA, 22 bp, Homo sapiens
gattttatctttgtgtgcagta

SEQ ID NO: 8000819 - DNA, 22 bp, Homo sapiens
gattttatcgtcatccttctgg

SEQ ID NO: 8000820 - DNA, 22 bp, Homo sapiens
gattttatatggcatactgtgg

SEQ ID NO: 8000821 - DNA, 22 bp, Homo sapiens
gattttatcgtcatccttctgg

SEQ ID NO: 8000822 - DNA, 22 bp, Homo sapiens
gattttatcgtcatccttctgg

SEQ ID NO: 8000823 - DNA, 22 bp, Homo sapiens
gattttatctttgtgtgcagta

SEQ ID NO: 8000824 - DNA, 22 bp, Homo sapiens
gattttatcgtcatccttctgg

SEQ ID NO: 8000825 - DNA, 21 bp, Homo sapiens
gattttaaagagactgccaca

SEQ ID NO: 8000826 - DNA, 22 bp, Homo sapiens
gattttaattataggaggtcct

SEQ ID NO: 8000827 - DNA, 22 bp, Homo sapiens
gattttaattataggaggtcct

SEQ ID NO: 8000828 - DNA, 21 bp, Homo sapiens
gattttaaagagactgccaca

SEQ ID NO: 8000829 - DNA, 22 bp, Homo sapiens
gatttgtttcaagttagcatct

SEQ ID NO: 8000830 - DNA, 21 bp, Homo sapiens
gattttaaagagactgccaca

SEQ ID NO: 8000831 - DNA, 21 bp, Homo sapiens
gattttaaagagactgccaca

SEQ ID NO: 8000832 - DNA, 21 bp, Homo sapiens
gattttaaagagactgccaca

SEQ ID NO: 8000833 - DNA, 22 bp, Homo sapiens
gatttgtttcaagttagcatct

SEQ ID NO: 8000834 - DNA, 22 bp, Homo sapiens
gatttgtttcaagttagcatct

SEQ ID NO: 8000835 - DNA, 22 bp, Homo sapiens
gatttgtttcaagttagcatct

SEQ ID NO: 8000836 - DNA, 22 bp, Homo sapiens
gatttgtccacagagtgatgaa

SEQ ID NO: 8000837 - DNA, 22 bp, Homo sapiens
gatttgtccacagagtgatgaa

SEQ ID NO: 8000838 - DNA, 22 bp, Homo sapiens
gatttgtagcttttcagtctgt

SEQ ID NO: 8000839 - DNA, 21 bp, Homo sapiens
gatttgtattattggttccaa

SEQ ID NO: 8000840 - DNA, 22 bp, Homo sapiens
gatttgtcacggttgagagcca

SEQ ID NO: 8000841 - DNA, 22 bp, Homo sapiens
gatttgtctatattcaaatatg

SEQ ID NO: 8000842 - DNA, 22 bp, Homo sapiens
gattttatatggcatactgtgg

SEQ ID NO: 8000843 - DNA, 22 bp, Homo sapiens
gattttatatggcatactgtgg

SEQ ID NO: 8000844 - DNA, 22 bp, Homo sapiens
gattttatatggcatactgtgg

SEQ ID NO: 8000845 - DNA, 22 bp, Homo sapiens
gattttatatggcatactgtgg

SEQ ID NO: 8000846 - DNA, 22 bp, Homo sapiens
gattttatatggcatactgtgg

SEQ ID NO: 8000847 - DNA, 22 bp, Homo sapiens
gattttatagtcaggaaaaaga

SEQ ID NO: 8000848 - DNA, 22 bp, Homo sapiens
gattttatagtcaggaaaaaga

SEQ ID NO: 8000849 - DNA, 22 bp, Homo sapiens
gattttatagtcaggaaaaaga

SEQ ID NO: 8000850 - DNA, 22 bp, Homo sapiens
gattttactgtctgtgtatctc

SEQ ID NO: 8000851 - DNA, 22 bp, Homo sapiens
gattttaattataggaggtcct

SEQ ID NO: 8000852 - DNA, 22 bp, Homo sapiens
gattttacaaactgcaggaccc

SEQ ID NO: 8000853 - DNA, 22 bp, Homo sapiens
gattttaattataggaggtcct

SEQ ID NO: 8000854 - DNA, 22 bp, Homo sapiens
gattttacatgtcatatctatt

SEQ ID NO: 8000855 - DNA, 22 bp, Homo sapiens
gattttacaaactgcaggaccc

SEQ ID NO: 8000856 - DNA, 22 bp, Homo sapiens
gattgttgcctggctttgacct

SEQ ID NO: 8000857 - DNA, 22 bp, Homo sapiens
gattgtggaagtcagtggttct

SEQ ID NO: 8000858 - DNA, 22 bp, Homo sapiens
gattgtggaagtcagtggttct

SEQ ID NO: 8000859 - DNA, 22 bp, Homo sapiens
gattgtgatacctagagcagca

SEQ ID NO: 8000860 - DNA, 19 bp, Homo sapiens
gatttaaacgtggctctat

SEQ ID NO: 8000861 - DNA, 19 bp, Homo sapiens
gatttaaacgtggctctat

SEQ ID NO: 8000862 - DNA, 19 bp, Homo sapiens
gatttaaacgtggctctat

SEQ ID NO: 8000863 - DNA, 19 bp, Homo sapiens
gatttaaacgtggctctat

SEQ ID NO: 8000864 - DNA, 22 bp, Homo sapiens
gatttaaagtagacctttgttt

SEQ ID NO: 8000865 - DNA, 22 bp, Homo sapiens
gatttaaagtagacctttgttt

SEQ ID NO: 8000866 - DNA, 22 bp, Homo sapiens
gatttacaaagctctctagtgt

SEQ ID NO: 8000867 - DNA, 22 bp, Homo sapiens
gatttacaaagctctctagtgt

SEQ ID NO: 8000868 - DNA, 22 bp, Homo sapiens
gatttaaagtagacctttgttt

SEQ ID NO: 8000869 - DNA, 22 bp, Homo sapiens
gatttacaaagctctctagtgt

SEQ ID NO: 8000870 - DNA, 22 bp, Homo sapiens
gatttacaaagctctctagtgt

SEQ ID NO: 8000871 - DNA, 22 bp, Homo sapiens
gatttacagatctaagggtcac

SEQ ID NO: 8000872 - DNA, 22 bp, Homo sapiens
gatttacagatctaagggtcac

SEQ ID NO: 8000873 - DNA, 22 bp, Homo sapiens
gatttacagatctaagggtcac

SEQ ID NO: 8000874 - DNA, 22 bp, Homo sapiens
gatttacagatctaagggtcac

SEQ ID NO: 8000875 - DNA, 22 bp, Homo sapiens
gattgtacacatctggtgcctt

SEQ ID NO: 8000876 - DNA, 22 bp, Homo sapiens
gattgtacttattgagctaaac

SEQ ID NO: 8000877 - DNA, 22 bp, Homo sapiens
gattgtaaaacagatcattatc

SEQ ID NO: 8000878 - DNA, 21 bp, Homo sapiens
gattggttcactcatgttgac

SEQ ID NO: 8000879 - DNA, 22 bp, Homo sapiens
gattggttgaaagtagaatact

SEQ ID NO: 8000880 - DNA, 22 bp, Homo sapiens
gattgggcctcattttcaccct

SEQ ID NO: 8000881 - DNA, 22 bp, Homo sapiens
gattgggccaaggggttagtag

SEQ ID NO: 8000882 - DNA, 22 bp, Homo sapiens
gattgggcagaaatttccttaa

SEQ ID NO: 8000883 - DNA, 22 bp, Homo sapiens
gattggagagtggaacatgctg

SEQ ID NO: 8000884 - DNA, 22 bp, Homo sapiens
gattgggggtcaggctcaggtc

SEQ ID NO: 8000885 - DNA, 22 bp, Homo sapiens
gattggggggcaggagaagtgt

SEQ ID NO: 8000886 - DNA, 22 bp, Homo sapiens
gattggggggcaggagaagtgt

SEQ ID NO: 8000887 - DNA, 22 bp, Homo sapiens
gattggggaaggttttactgac

SEQ ID NO: 8000888 - DNA, 22 bp, Homo sapiens
gattggggaaggttttactgac

SEQ ID NO: 8000889 - DNA, 22 bp, Homo sapiens
gattgagtctgaggatgctgca

SEQ ID NO: 8000890 - DNA, 22 bp, Homo sapiens
gattgagtctgaggatgctgca

SEQ ID NO: 8000891 - DNA, 22 bp, Homo sapiens
gattgagtctgaggatgctgca

SEQ ID NO: 8000892 - DNA, 22 bp, Homo sapiens
gattgagtctgaggatgctgca

SEQ ID NO: 8000893 - DNA, 22 bp, Homo sapiens
gattgagtctgaggatgctgca

SEQ ID NO: 8000894 - DNA, 22 bp, Homo sapiens
gattgagtctgaggatgctgca

SEQ ID NO: 8000895 - DNA, 22 bp, Homo sapiens
gattgagtctgaggatgctgca

SEQ ID NO: 8000896 - DNA, 22 bp, Homo sapiens
gattgcgtctgtgtcaccttca

SEQ ID NO: 8000897 - DNA, 22 bp, Homo sapiens
gattgctgcaatcaacaagtat

SEQ ID NO: 8000898 - DNA, 22 bp, Homo sapiens
gattgcccagaatattctcatt

SEQ ID NO: 8000899 - DNA, 22 bp, Homo sapiens
gattgcttctggaaagcagttt

SEQ ID NO: 8000900 - DNA, 22 bp, Homo sapiens
gattgcttctggaaagcagttt

SEQ ID NO: 8000901 - DNA, 22 bp, Homo sapiens
gatttattgtccctgtcctgct

SEQ ID NO: 8000902 - DNA, 22 bp, Homo sapiens
gatttattgtccctgtcctgct

SEQ ID NO: 8000903 - DNA, 22 bp, Homo sapiens
gatttattgtccctgtcctgct

SEQ ID NO: 8000904 - DNA, 22 bp, Homo sapiens
gatttattgtccctgtcctgct

SEQ ID NO: 8000905 - DNA, 22 bp, Homo sapiens
gatttattgtccctgtcctgct

SEQ ID NO: 8000906 - DNA, 22 bp, Homo sapiens
gatttattgtccctgtcctgct

SEQ ID NO: 8000907 - DNA, 22 bp, Homo sapiens
gatttattggtctttcattggt

SEQ ID NO: 8000908 - DNA, 22 bp, Homo sapiens
gatttattggtctttcattggt

SEQ ID NO: 8000909 - DNA, 22 bp, Homo sapiens
gatttattggtctttcattggt

SEQ ID NO: 8000910 - DNA, 22 bp, Homo sapiens
gatttattggtctttcattggt

SEQ ID NO: 8000911 - DNA, 22 bp, Homo sapiens
gatttatgacagagctgactct

SEQ ID NO: 8000912 - DNA, 22 bp, Homo sapiens
gatttattggtctttcattggt

SEQ ID NO: 8000913 - DNA, 22 bp, Homo sapiens
gatttattggtctttcattggt

SEQ ID NO: 8000914 - DNA, 22 bp, Homo sapiens
gatttattggtctttcattggt

SEQ ID NO: 8000915 - DNA, 22 bp, Homo sapiens
gatttattggtctttcattggt

SEQ ID NO: 8000916 - DNA, 22 bp, Homo sapiens
gatttatttttaatcagcaggg

SEQ ID NO: 8000917 - DNA, 22 bp, Homo sapiens
gatttatttttaatcagcaggg

SEQ ID NO: 8000918 - DNA, 22 bp, Homo sapiens
gatttatttttaatcagcaggg

SEQ ID NO: 8000919 - DNA, 22 bp, Homo sapiens
gatttatttttaatcagcaggg

SEQ ID NO: 8000920 - DNA, 22 bp, Homo sapiens
gatttatttttaatcagcaggg

SEQ ID NO: 8000921 - DNA, 22 bp, Homo sapiens
gatttatttttaatcagcaggg

SEQ ID NO: 8000922 - DNA, 22 bp, Homo sapiens
gatttatttttaatcagcaggg

SEQ ID NO: 8000923 - DNA, 22 bp, Homo sapiens
gatttcaaaagtagatccatca

SEQ ID NO: 8000924 - DNA, 22 bp, Homo sapiens
gatttcaacctaacagtatgac

SEQ ID NO: 8000925 - DNA, 20 bp, Homo sapiens
gatttcaaagcagagtggcc

SEQ ID NO: 8000926 - DNA, 22 bp, Homo sapiens
gatttcaaaggttctgcatgcc

SEQ ID NO: 8000927 - DNA, 22 bp, Homo sapiens
gatttagtggcccttggtacac

SEQ ID NO: 8000928 - DNA, 22 bp, Homo sapiens
gatttagagcaggaatgcatgg

SEQ ID NO: 8000929 - DNA, 21 bp, Homo sapiens
gatttagtggctgttctacct

SEQ ID NO: 8000930 - DNA, 21 bp, Homo sapiens
gatttataagccttaagccta

SEQ ID NO: 8000931 - DNA, 22 bp, Homo sapiens
gatttataaaggttgcactgga

SEQ ID NO: 8000932 - DNA, 21 bp, Homo sapiens
gatttataagccttaagccta

SEQ ID NO: 8000933 - DNA, 22 bp, Homo sapiens
gatttacaggttaggtcctgta

SEQ ID NO: 8000934 - DNA, 22 bp, Homo sapiens
gatttacaggttaggtcctgta

SEQ ID NO: 8000935 - DNA, 22 bp, Homo sapiens
gatttacaggttaggtcctgta

SEQ ID NO: 8000936 - DNA, 22 bp, Homo sapiens
gatttacagctatacccaatgg

SEQ ID NO: 8000937 - DNA, 22 bp, Homo sapiens
gatttacagctatacccaatgg

SEQ ID NO: 8000938 - DNA, 22 bp, Homo sapiens
gatttacagctatacccaatgg

SEQ ID NO: 8000939 - DNA, 22 bp, Homo sapiens
gatttacagctatacccaatgg

SEQ ID NO: 8000940 - DNA, 22 bp, Homo sapiens
gatttacagctatacccaatgg

SEQ ID NO: 8000941 - DNA, 22 bp, Homo sapiens
gattaaaaataacccatgctga

SEQ ID NO: 8000942 - DNA, 22 bp, Homo sapiens
gattaaaaataacccatgctga

SEQ ID NO: 8000943 - DNA, 22 bp, Homo sapiens
gattaaaaataacccatgctga

SEQ ID NO: 8000944 - DNA, 22 bp, Homo sapiens
gattaaaaataacccatgctga

SEQ ID NO: 8000945 - DNA, 22 bp, Homo sapiens
gattaaaaataacccatgctga

SEQ ID NO: 8000946 - DNA, 22 bp, Homo sapiens
gattaaaaataacccatgctga

SEQ ID NO: 8000947 - DNA, 22 bp, Homo sapiens
gattaaaaataacccatgctga

SEQ ID NO: 8000948 - DNA, 22 bp, Homo sapiens
gattaaaaataacccatgctga

SEQ ID NO: 8000949 - DNA, 22 bp, Homo sapiens
gattaaaaataacccatgctga

SEQ ID NO: 8000950 - DNA, 22 bp, Homo sapiens
gattaagattacatatttaagt

SEQ ID NO: 8000951 - DNA, 22 bp, Homo sapiens
gattaagagaagtttcttatcg

SEQ ID NO: 8000952 - DNA, 21 bp, Homo sapiens
gattaaatttaagctacatgc

SEQ ID NO: 8000953 - DNA, 22 bp, Homo sapiens
gattaacaaatttcatatccaa

SEQ ID NO: 8000954 - DNA, 22 bp, Homo sapiens
gattacattctccttgtattag

SEQ ID NO: 8000955 - DNA, 22 bp, Homo sapiens
gattacattctccttgtattag

SEQ ID NO: 8000956 - DNA, 20 bp, Homo sapiens
gattacaaaatgaaatgcat

SEQ ID NO: 8000957 - DNA, 22 bp, Homo sapiens
gattacaaaggtccttttctct

SEQ ID NO: 8000958 - DNA, 22 bp, Homo sapiens
gattacaaaactcatctatgac

SEQ ID NO: 8000959 - DNA, 22 bp, Homo sapiens
gattaatagacacaaccaagct

SEQ ID NO: 8000960 - DNA, 22 bp, Homo sapiens
gattaatagacacaaccaagct

SEQ ID NO: 8000961 - DNA, 22 bp, Homo sapiens
gattaagtaactgaacactttg

SEQ ID NO: 8000962 - DNA, 22 bp, Homo sapiens
gattaatagtacaggttcttag

SEQ ID NO: 8000963 - DNA, 22 bp, Homo sapiens
gattaatagtacaggttcttag

SEQ ID NO: 8000964 - DNA, 22 bp, Homo sapiens
gatgtgtttccaggatttgttt

SEQ ID NO: 8000965 - DNA, 22 bp, Homo sapiens
gatgtgtttccaggatttgttt

SEQ ID NO: 8000966 - DNA, 22 bp, Homo sapiens
gatgtgtttccaggatttgttt

SEQ ID NO: 8000967 - DNA, 22 bp, Homo sapiens
gatgtgtttccaggatttgttt

SEQ ID NO: 8000968 - DNA, 22 bp, Homo sapiens
gatgtgtttccaggatttgttt

SEQ ID NO: 8000969 - DNA, 22 bp, Homo sapiens
gatgttctggggtgtttgtggc

SEQ ID NO: 8000970 - DNA, 22 bp, Homo sapiens
gatgttcttataccattgtggg

SEQ ID NO: 8000971 - DNA, 22 bp, Homo sapiens
gatgttcttataccattgtggg

SEQ ID NO: 8000972 - DNA, 22 bp, Homo sapiens
gatgttctagaagtgtggtgtt

SEQ ID NO: 8000973 - DNA, 22 bp, Homo sapiens
gatgttcagtggttgaccataa

SEQ ID NO: 8000974 - DNA, 22 bp, Homo sapiens
gatgttaagaaggaattgaagt

SEQ ID NO: 8000975 - DNA, 21 bp, Homo sapiens
gatgttggaggctggggtctg

SEQ ID NO: 8000976 - DNA, 21 bp, Homo sapiens
gatgttggaggctggggtctg

SEQ ID NO: 8000977 - DNA, 22 bp, Homo sapiens
gatgtttcatgctagcatgtgt

SEQ ID NO: 8000978 - DNA, 22 bp, Homo sapiens
gatgtttatgctgggacaggaa

SEQ ID NO: 8000979 - DNA, 22 bp, Homo sapiens
gatgtttatatctaacttaagt

SEQ ID NO: 8000980 - DNA, 22 bp, Homo sapiens
gatgttcttcgatgatctgttt

SEQ ID NO: 8000981 - DNA, 22 bp, Homo sapiens
gatgttcttcgatgatctgttt

SEQ ID NO: 8000982 - DNA, 22 bp, Homo sapiens
gatgttgaggaagaaagggcag

SEQ ID NO: 8000983 - DNA, 22 bp, Homo sapiens
gatgtttctgggaaggaaaagt

SEQ ID NO: 8000984 - DNA, 22 bp, Homo sapiens
gatgttttttaggatctcagca

SEQ ID NO: 8000985 - DNA, 22 bp, Homo sapiens
gatgttttctggaaaatgaatg

SEQ ID NO: 8000986 - DNA, 22 bp, Homo sapiens
gattagatgactaatgagctgt

SEQ ID NO: 8000987 - DNA, 22 bp, Homo sapiens
gattaggacatggatgtatgtt

SEQ ID NO: 8000988 - DNA, 22 bp, Homo sapiens
gattagaaatgttaccatacag

SEQ ID NO: 8000989 - DNA, 17 bp, Homo sapiens
gattagaaaacacatga

SEQ ID NO: 8000990 - DNA, 22 bp, Homo sapiens
gattacccgactcccttcaatg

SEQ ID NO: 8000991 - DNA, 22 bp, Homo sapiens
gattagaagaacttgttagcct

SEQ ID NO: 8000992 - DNA, 22 bp, Homo sapiens
gattagttgattaagagtcaga

SEQ ID NO: 8000993 - DNA, 22 bp, Homo sapiens
gattatataatggaagctcttg

SEQ ID NO: 8000994 - DNA, 22 bp, Homo sapiens
gattatataatggaagctcttg

SEQ ID NO: 8000995 - DNA, 22 bp, Homo sapiens
gattatgactgtcctagaaaaa

SEQ ID NO: 8000996 - DNA, 22 bp, Homo sapiens
gattatggagaaataattagaa

SEQ ID NO: 8000997 - DNA, 22 bp, Homo sapiens
gattatgattaagatggacctg

SEQ ID NO: 8000998 - DNA, 22 bp, Homo sapiens
gattcaaagttaatgaagatgc

SEQ ID NO: 8000999 - DNA, 22 bp, Homo sapiens
gattattttgtgcaataatcgg

SEQ ID NO: 8001000 - DNA, 22 bp, Homo sapiens
gattatggtagaaacaagaagt

SEQ ID NO: 8001001 - DNA, 22 bp, Homo sapiens
gattatggagaagaacaatgaa

SEQ ID NO: 8001002 - DNA, 22 bp, Homo sapiens
gattatggatggacagtggagc

SEQ ID NO: 8001003 - DNA, 22 bp, Homo sapiens
gattatggtaacaatgattaaa

SEQ ID NO: 8001004 - DNA, 22 bp, Homo sapiens
gattctttggcctttattgaca

SEQ ID NO: 8001005 - DNA, 22 bp, Homo sapiens
gattctttggcctttattgaca

SEQ ID NO: 8001006 - DNA, 22 bp, Homo sapiens
gattctttgacagggtgttggg

SEQ ID NO: 8001007 - DNA, 22 bp, Homo sapiens
gattgaaatataaatatgtgtt

SEQ ID NO: 8001008 - DNA, 22 bp, Homo sapiens
gattgaaaggaaaaccagagtg

SEQ ID NO: 8001009 - DNA, 22 bp, Homo sapiens
gattgaaaggaaaaccagagtg

SEQ ID NO: 8001010 - DNA, 22 bp, Homo sapiens
gattgaaaggtctttaaattgg

SEQ ID NO: 8001011 - DNA, 22 bp, Homo sapiens
gattgaaagactgtttgggaga

SEQ ID NO: 8001012 - DNA, 21 bp, Homo sapiens
gattgaaaccatggcagtgag

SEQ ID NO: 8001013 - DNA, 22 bp, Homo sapiens
gattgaaacataggcagtcgag

SEQ ID NO: 8001014 - DNA, 22 bp, Homo sapiens
gattctttacatctctgctgac

SEQ ID NO: 8001015 - DNA, 22 bp, Homo sapiens
gattcacctttatttcattggg

SEQ ID NO: 8001016 - DNA, 22 bp, Homo sapiens
gattcactcatattttacgttt

SEQ ID NO: 8001017 - DNA, 22 bp, Homo sapiens
gattcactcatattttacgttt

SEQ ID NO: 8001018 - DNA, 22 bp, Homo sapiens
gattcactcatattttacgttt

SEQ ID NO: 8001019 - DNA, 22 bp, Homo sapiens
gattcactcatattttacgttt

SEQ ID NO: 8001020 - DNA, 22 bp, Homo sapiens
gattcacagtttaggctgggct

SEQ ID NO: 8001021 - DNA, 23 bp, Homo sapiens
gattcacagggtggtttatgggg

SEQ ID NO: 8001022 - DNA, 22 bp, Homo sapiens
gattcacctgaagcacttgtta

SEQ ID NO: 8001023 - DNA, 22 bp, Homo sapiens
gattcactcatattttacgttt

SEQ ID NO: 8001024 - DNA, 22 bp, Homo sapiens
gattcaagacctagctcagcca

SEQ ID NO: 8001025 - DNA, 22 bp, Homo sapiens
gattcaatgttgcagatggaat

SEQ ID NO: 8001026 - DNA, 22 bp, Homo sapiens
gattcaaagttaatgaagatgc

SEQ ID NO: 8001027 - DNA, 22 bp, Homo sapiens
gattcacaactgccctgaaggg

SEQ ID NO: 8001028 - DNA, 22 bp, Homo sapiens
gattcacagaacttagtcaagc

SEQ ID NO: 8001029 - DNA, 23 bp, Homo sapiens
gattcacagggtggtttatgggg

SEQ ID NO: 8001030 - DNA, 22 bp, Homo sapiens
gatgtgtgtgccctgggcctgc

SEQ ID NO: 8001031 - DNA, 22 bp, Homo sapiens
gatgtgtgcttttcgcagtgtc

SEQ ID NO: 8001032 - DNA, 22 bp, Homo sapiens
gatgtgtctccatacaccaccc

SEQ ID NO: 8001033 - DNA, 22 bp, Homo sapiens
gatgtctgggtcttcctggctt

SEQ ID NO: 8001034 - DNA, 22 bp, Homo sapiens
gatgtctgggtcttcctggctt

SEQ ID NO: 8001035 - DNA, 22 bp, Homo sapiens
gatgtctgggtgaggtctactg

SEQ ID NO: 8001036 - DNA, 22 bp, Homo sapiens
gatgtctgggtgaggtctactg

SEQ ID NO: 8001037 - DNA, 22 bp, Homo sapiens
gatgtctgggtgaggtctactg

SEQ ID NO: 8001038 - DNA, 22 bp, Homo sapiens
gatgtctggctaccactcgcac

SEQ ID NO: 8001039 - DNA, 22 bp, Homo sapiens
gatgtctgtctgagccgctgga

SEQ ID NO: 8001040 - DNA, 22 bp, Homo sapiens
gatgtctgtctgagccgctgga

SEQ ID NO: 8001041 - DNA, 22 bp, Homo sapiens
gatgtctgtgagatcaaactaa

SEQ ID NO: 8001042 - DNA, 22 bp, Homo sapiens
gatgtctgtgagatcaaactaa

SEQ ID NO: 8001043 - DNA, 22 bp, Homo sapiens
gatgtcttaagcccagaagttc

SEQ ID NO: 8001044 - DNA, 22 bp, Homo sapiens
gatgtcttaggtaacattctat

SEQ ID NO: 8001045 - DNA, 22 bp, Homo sapiens
gatgtcttaggtaacattctat

SEQ ID NO: 8001046 - DNA, 22 bp, Homo sapiens
gatgtcttactaactagccttt

SEQ ID NO: 8001047 - DNA, 22 bp, Homo sapiens
gatgtcttactaactagccttt

SEQ ID NO: 8001048 - DNA, 22 bp, Homo sapiens
gatgtacttgccttatctatcc

SEQ ID NO: 8001049 - DNA, 22 bp, Homo sapiens
gatgtacatggattcctttcct

SEQ ID NO: 8001050 - DNA, 22 bp, Homo sapiens
gatgtacatgcaagcacttaga

SEQ ID NO: 8001051 - DNA, 22 bp, Homo sapiens
gatgtacaggagtttttcaagg

SEQ ID NO: 8001052 - DNA, 21 bp, Homo sapiens
gatgtacatcaagcactttgc

SEQ ID NO: 8001053 - DNA, 22 bp, Homo sapiens
gatgtagacacttggaggctta

SEQ ID NO: 8001054 - DNA, 22 bp, Homo sapiens
gatgtagacacttggaggctta

SEQ ID NO: 8001055 - DNA, 22 bp, Homo sapiens
gatgtagacacttggaggctta

SEQ ID NO: 8001056 - DNA, 22 bp, Homo sapiens
gatgtagacacttggaggctta

SEQ ID NO: 8001057 - DNA, 22 bp, Homo sapiens
gatgtagagggaagattttaaa

SEQ ID NO: 8001058 - DNA, 22 bp, Homo sapiens
gatgtagattcatatgtggtgt

SEQ ID NO: 8001059 - DNA, 22 bp, Homo sapiens
gatgtataacctggctatgtta

SEQ ID NO: 8001060 - DNA, 22 bp, Homo sapiens
gatgtcctttgagggtatctgt

SEQ ID NO: 8001061 - DNA, 22 bp, Homo sapiens
gatgtctcaagtatccaagccc

SEQ ID NO: 8001062 - DNA, 18 bp, Homo sapiens
gatgtcaaggactggaca

SEQ ID NO: 8001063 - DNA, 22 bp, Homo sapiens
gatggggatgagaagtgagcag

SEQ ID NO: 8001064 - DNA, 22 bp, Homo sapiens
gatgggcttcttccatgaagaa

SEQ ID NO: 8001065 - DNA, 22 bp, Homo sapiens
gatggggatgagaagtgagcag

SEQ ID NO: 8001066 - DNA, 22 bp, Homo sapiens
gatggggatgagaagtgagcag

SEQ ID NO: 8001067 - DNA, 22 bp, Homo sapiens
gatggggatgagaagtgagcag

SEQ ID NO: 8001068 - DNA, 17 bp, Homo sapiens
gatggggctgacatcag

SEQ ID NO: 8001069 - DNA, 17 bp, Homo sapiens
gatggggctgacatcag

SEQ ID NO: 8001070 - DNA, 22 bp, Homo sapiens
gatgggggccagggcctgcttt

SEQ ID NO: 8001071 - DNA, 22 bp, Homo sapiens
gatgggggccagggcctgcttt

SEQ ID NO: 8001072 - DNA, 22 bp, Homo sapiens
gatggggtccttgacctggcca

SEQ ID NO: 8001073 - DNA, 22 bp, Homo sapiens
gatgggggccagggcctgcttt

SEQ ID NO: 8001074 - DNA, 21 bp, Homo sapiens
gatggtagcctcatagaagta

SEQ ID NO: 8001075 - DNA, 21 bp, Homo sapiens
gatggtagcctcatagaagta

SEQ ID NO: 8001076 - DNA, 22 bp, Homo sapiens
gatggtcaggctttaacatctg

SEQ ID NO: 8001077 - DNA, 22 bp, Homo sapiens
gatgggtggtctcagacttgcc

SEQ ID NO: 8001078 - DNA, 22 bp, Homo sapiens
gatggtcctcctgctgcctctc

SEQ ID NO: 8001079 - DNA, 22 bp, Homo sapiens
gatggtcaggtcatctcatgga

SEQ ID NO: 8001080 - DNA, 22 bp, Homo sapiens
gatggtcatctcctatttggtt

SEQ ID NO: 8001081 - DNA, 22 bp, Homo sapiens
gatgggtgggttctgtgagagg

SEQ ID NO: 8001082 - DNA, 22 bp, Homo sapiens
gatgggtattggcagaagaggg

SEQ ID NO: 8001083 - DNA, 22 bp, Homo sapiens
gatgggtagaagtggaagaggt

SEQ ID NO: 8001084 - DNA, 18 bp, Homo sapiens
gatgggtaaaggcataaa

SEQ ID NO: 8001085 - DNA, 22 bp, Homo sapiens
gatgggtagcctttcaatagca

SEQ ID NO: 8001086 - DNA, 20 bp, Homo sapiens
gatgggtattgaagtcacct

SEQ ID NO: 8001087 - DNA, 22 bp, Homo sapiens
gatggggttttgccaggctggt

SEQ ID NO: 8001088 - DNA, 22 bp, Homo sapiens
gatggggttttgccaggctggt

SEQ ID NO: 8001089 - DNA, 22 bp, Homo sapiens
gatgggtagaagtggaagaggt

SEQ ID NO: 8001090 - DNA, 22 bp, Homo sapiens
gatgggtactcgttggactgag

SEQ ID NO: 8001091 - DNA, 18 bp, Homo sapiens
gatgtaaaatagtagctt

SEQ ID NO: 8001092 - DNA, 22 bp, Homo sapiens
gatgtacaaagagaggatttca

SEQ ID NO: 8001093 - DNA, 22 bp, Homo sapiens
gatgtacaagattgtaggaatg

SEQ ID NO: 8001094 - DNA, 22 bp, Homo sapiens
gatgtaatagatatagattgct

SEQ ID NO: 8001095 - DNA, 22 bp, Homo sapiens
gatgtaatagatatagattgct

SEQ ID NO: 8001096 - DNA, 22 bp, Homo sapiens
gatgtacaagtaaaatatgtgt

SEQ ID NO: 8001097 - DNA, 22 bp, Homo sapiens
gatgtacaagtaaaatatgtgt

SEQ ID NO: 8001098 - DNA, 22 bp, Homo sapiens
gatgtacaatgtcactatgacc

SEQ ID NO: 8001099 - DNA, 22 bp, Homo sapiens
gatgtacactcagaaaagtcat

SEQ ID NO: 8001100 - DNA, 22 bp, Homo sapiens
gatgtacaatgtcactatgacc

SEQ ID NO: 8001101 - DNA, 22 bp, Homo sapiens
gatgtaaaacctatggagctga

SEQ ID NO: 8001102 - DNA, 22 bp, Homo sapiens
gatgtaaaaactcctttcgaaa

SEQ ID NO: 8001103 - DNA, 22 bp, Homo sapiens
gatgtaaaacctatggagctga

SEQ ID NO: 8001104 - DNA, 22 bp, Homo sapiens
gatggtgtcccaggctcaggct

SEQ ID NO: 8001105 - DNA, 22 bp, Homo sapiens
gatggtggcaagagccaagtct

SEQ ID NO: 8001106 - DNA, 22 bp, Homo sapiens
gatggtggagtaacattgccta

SEQ ID NO: 8001107 - DNA, 22 bp, Homo sapiens
gatggtggcaagagccaagtct

SEQ ID NO: 8001108 - DNA, 22 bp, Homo sapiens
gatggtgtcccaggctcaggct

SEQ ID NO: 8001109 - DNA, 22 bp, Homo sapiens
gatggtgcaggtgaagtgctgg

SEQ ID NO: 8001110 - DNA, 22 bp, Homo sapiens
gatggtctgtattaaacagatg

SEQ ID NO: 8001111 - DNA, 22 bp, Homo sapiens
gatggtgcaattatcgtgcatg

SEQ ID NO: 8001112 - DNA, 22 bp, Homo sapiens
gatggtgcaggtgaagtgctgg

SEQ ID NO: 8001113 - DNA, 22 bp, Homo sapiens
gatggtgcaggtgaagtgctgg

SEQ ID NO: 8001114 - DNA, 22 bp, Homo sapiens
gatggcctgtatttgggccaga

SEQ ID NO: 8001115 - DNA, 22 bp, Homo sapiens
gatggcctcatggctgcaggcc

SEQ ID NO: 8001116 - DNA, 22 bp, Homo sapiens
gatggcccgctagctggcctct

SEQ ID NO: 8001117 - DNA, 22 bp, Homo sapiens
gatggctgtcttctccctgtgt

SEQ ID NO: 8001118 - DNA, 22 bp, Homo sapiens
gatggctgtcttctccctgtgt

SEQ ID NO: 8001119 - DNA, 22 bp, Homo sapiens
gatggctggctatatcagggga

SEQ ID NO: 8001120 - DNA, 22 bp, Homo sapiens
gatggctggagccagtgctttg

SEQ ID NO: 8001121 - DNA, 22 bp, Homo sapiens
gatggctgccttctccctgtgt

SEQ ID NO: 8001122 - DNA, 22 bp, Homo sapiens
gatggctgccttctccctgtgt

SEQ ID NO: 8001123 - DNA, 22 bp, Homo sapiens
gatggctaggggactggagtta

SEQ ID NO: 8001124 - DNA, 22 bp, Homo sapiens
gatggcggtggccacctccttg

SEQ ID NO: 8001125 - DNA, 22 bp, Homo sapiens
gatggcggtggccacctccttg

SEQ ID NO: 8001126 - DNA, 22 bp, Homo sapiens
gatggctgcctcctgcggtcct

SEQ ID NO: 8001127 - DNA, 22 bp, Homo sapiens
gatggctgcctcctgcggtcct

SEQ ID NO: 8001128 - DNA, 22 bp, Homo sapiens
gatggctgcctcctgcggtcct

SEQ ID NO: 8001129 - DNA, 22 bp, Homo sapiens
gatggctcaagagcttttgaga

SEQ ID NO: 8001130 - DNA, 22 bp, Homo sapiens
gatggaggagatggcagggtgc

SEQ ID NO: 8001131 - DNA, 22 bp, Homo sapiens
gatggaggagatggcagggtgc

SEQ ID NO: 8001132 - DNA, 22 bp, Homo sapiens
gatggaggagatggcagggtgc

SEQ ID NO: 8001133 - DNA, 22 bp, Homo sapiens
gatggaggagatggcagggtgc

SEQ ID NO: 8001134 - DNA, 22 bp, Homo sapiens
gatggaggagatggcagggtgc

SEQ ID NO: 8001135 - DNA, 22 bp, Homo sapiens
gatggaagaaaaatgcatgtct

SEQ ID NO: 8001136 - DNA, 22 bp, Homo sapiens
gatggaagaaaaatgcatgtct

SEQ ID NO: 8001137 - DNA, 22 bp, Homo sapiens
gatggacagcctggaaggaaag

SEQ ID NO: 8001138 - DNA, 22 bp, Homo sapiens
gatggacagcctggaaggaaag

SEQ ID NO: 8001139 - DNA, 22 bp, Homo sapiens
gatgggaggaacctgggtccct

SEQ ID NO: 8001140 - DNA, 22 bp, Homo sapiens
gatgggcacggcagtctgagag

SEQ ID NO: 8001141 - DNA, 22 bp, Homo sapiens
gatgggcacggcagtctgagag

SEQ ID NO: 8001142 - DNA, 18 bp, Homo sapiens
gatgggagcaagagaaga

SEQ ID NO: 8001143 - DNA, 18 bp, Homo sapiens
gatgggagcaagagaaga

SEQ ID NO: 8001144 - DNA, 22 bp, Homo sapiens
gatgggcacggcagtctgagag

SEQ ID NO: 8001145 - DNA, 22 bp, Homo sapiens
gatgggctgtctgagcgctgtg

SEQ ID NO: 8001146 - DNA, 22 bp, Homo sapiens
gatgggctgtctgagcgctgtg

SEQ ID NO: 8001147 - DNA, 22 bp, Homo sapiens
gatgggctggggagaaagcatg

SEQ ID NO: 8001148 - DNA, 22 bp, Homo sapiens
gatggcttctctctagcttggt

SEQ ID NO: 8001149 - DNA, 22 bp, Homo sapiens
gatggcttgcttagtgacagca

SEQ ID NO: 8001150 - DNA, 22 bp, Homo sapiens
gatggcttacagacagttagga

SEQ ID NO: 8001151 - DNA, 22 bp, Homo sapiens
gatggcttaagagtaaaaggca

SEQ ID NO: 8001152 - DNA, 20 bp, Homo sapiens
gatgggaatcggagctggta

SEQ ID NO: 8001153 - DNA, 20 bp, Homo sapiens
gatggctttagaagctggta

SEQ ID NO: 8001154 - DNA, 22 bp, Homo sapiens
gatggctttgcctgctgtgagg

SEQ ID NO: 8001155 - DNA, 20 bp, Homo sapiens
gatgggaatcggagctggta

SEQ ID NO: 8001156 - DNA, 18 bp, Homo sapiens
gatgggagcaagagaaga

SEQ ID NO: 8001157 - DNA, 18 bp, Homo sapiens
gatgggagcaagagaaga

SEQ ID NO: 8001158 - DNA, 18 bp, Homo sapiens
gatgggagcaagagaaga

SEQ ID NO: 8001159 - DNA, 22 bp, Homo sapiens
gatgccctgcatgagtcctgct

SEQ ID NO: 8001160 - DNA, 22 bp, Homo sapiens
gatgcccctgtgctctttttcc

SEQ ID NO: 8001161 - DNA, 22 bp, Homo sapiens
gatgcattcgggatgtttactt

SEQ ID NO: 8001162 - DNA, 22 bp, Homo sapiens
gatgccttccaggattttggct

SEQ ID NO: 8001163 - DNA, 22 bp, Homo sapiens
gatgcctgcatttcaggagagt

SEQ ID NO: 8001164 - DNA, 22 bp, Homo sapiens
gatgcgggcccgctccactgcc

SEQ ID NO: 8001165 - DNA, 22 bp, Homo sapiens
gatgcgggcccgctccactgcc

SEQ ID NO: 8001166 - DNA, 22 bp, Homo sapiens
gatgcgggcccgctccactgcc

SEQ ID NO: 8001167 - DNA, 22 bp, Homo sapiens
gatgcgggcccgctccactgcc

SEQ ID NO: 8001168 - DNA, 22 bp, Homo sapiens
gatgcgggcccgctccactgcc

SEQ ID NO: 8001169 - DNA, 19 bp, Homo sapiens
gatgctcattcaggtggaa

SEQ ID NO: 8001170 - DNA, 22 bp, Homo sapiens
gatgctgactgaccaaaaggat

SEQ ID NO: 8001171 - DNA, 22 bp, Homo sapiens
gatgctgaagtgaagtgatctt

SEQ ID NO: 8001172 - DNA, 22 bp, Homo sapiens
gatgctgaccagctgtttcctt

SEQ ID NO: 8001173 - DNA, 22 bp, Homo sapiens
gatgctgagagattggagacta

SEQ ID NO: 8001174 - DNA, 22 bp, Homo sapiens
gatgctgactggtgtttgcctt

SEQ ID NO: 8001175 - DNA, 22 bp, Homo sapiens
gatgctgactttccgctgccac

SEQ ID NO: 8001176 - DNA, 22 bp, Homo sapiens
gatgctccttggtgatagaata

SEQ ID NO: 8001177 - DNA, 22 bp, Homo sapiens
gatgctgaaatccagttcgggg

SEQ ID NO: 8001178 - DNA, 22 bp, Homo sapiens
gatgctgaagtgaagtgatctt

SEQ ID NO: 8001179 - DNA, 22 bp, Homo sapiens
gatgctgaaatccagttcgggg

SEQ ID NO: 8001180 - DNA, 22 bp, Homo sapiens
gatgctggcctggccatctggg

SEQ ID NO: 8001181 - DNA, 22 bp, Homo sapiens
gatgctggcctggccatctggg

SEQ ID NO: 8001182 - DNA, 22 bp, Homo sapiens
gatgctgggaccacagagtgtt

SEQ ID NO: 8001183 - DNA, 22 bp, Homo sapiens
gatgctgggaccacagagtgtt

SEQ ID NO: 8001184 - DNA, 22 bp, Homo sapiens
gatgctgggaccacagagtgtt

SEQ ID NO: 8001185 - DNA, 22 bp, Homo sapiens
gatgctgtaaaatgctaaacat

SEQ ID NO: 8001186 - DNA, 22 bp, Homo sapiens
gatgctgtagatgagaacattg

SEQ ID NO: 8001187 - DNA, 22 bp, Homo sapiens
gatgctgtagatgagaacattg

SEQ ID NO: 8001188 - DNA, 22 bp, Homo sapiens
gatgctgtaaaatgctaaacat

SEQ ID NO: 8001189 - DNA, 22 bp, Homo sapiens
gatgctgataattcatgagaag

SEQ ID NO: 8001190 - DNA, 22 bp, Homo sapiens
gatgctgataattcatgagaag

SEQ ID NO: 8001191 - DNA, 22 bp, Homo sapiens
gatgctgagctgtatggctggt

SEQ ID NO: 8001192 - DNA, 22 bp, Homo sapiens
gatgctgataattcatgagaag

SEQ ID NO: 8001193 - DNA, 22 bp, Homo sapiens
gatgctgagaggtggagggaac

SEQ ID NO: 8001194 - DNA, 22 bp, Homo sapiens
gatgctgattatttcttgctag

SEQ ID NO: 8001195 - DNA, 22 bp, Homo sapiens
gatgctgattttactgttttct

SEQ ID NO: 8001196 - DNA, 22 bp, Homo sapiens
gatgctggcctggccatctggg

SEQ ID NO: 8001197 - DNA, 22 bp, Homo sapiens
gatgctggcctggccatctggg

SEQ ID NO: 8001198 - DNA, 22 bp, Homo sapiens
gatgctggaagtgctgatcttg

SEQ ID NO: 8001199 - DNA, 22 bp, Homo sapiens
gatgcttttcttttcagcaaga

SEQ ID NO: 8001200 - DNA, 22 bp, Homo sapiens
gatgcttttccagtatgagagt

SEQ ID NO: 8001201 - DNA, 22 bp, Homo sapiens
gatgctttggccccatcatgag

SEQ ID NO: 8001202 - DNA, 22 bp, Homo sapiens
gatgctttctcctttctccacc

SEQ ID NO: 8001203 - DNA, 22 bp, Homo sapiens
gatgctttctcctttctccacc

SEQ ID NO: 8001204 - DNA, 22 bp, Homo sapiens
gatggaagaaaaatgcatgtct

SEQ ID NO: 8001205 - DNA, 22 bp, Homo sapiens
gatggaagaaaaatgcatgtct

SEQ ID NO: 8001206 - DNA, 18 bp, Homo sapiens
gatggaaagtgtatgagt

SEQ ID NO: 8001207 - DNA, 22 bp, Homo sapiens
gatgctgtggggttgaccctgg

SEQ ID NO: 8001208 - DNA, 22 bp, Homo sapiens
gatgctgtgctatgtctacaga

SEQ ID NO: 8001209 - DNA, 22 bp, Homo sapiens
gatgctgtgctatgtctacaga

SEQ ID NO: 8001210 - DNA, 22 bp, Homo sapiens
gatgctgtggtaagccccaccg

SEQ ID NO: 8001211 - DNA, 22 bp, Homo sapiens
gatgctttccaagaaatcctca

SEQ ID NO: 8001212 - DNA, 22 bp, Homo sapiens
gatgcttcctgttttaaatagg

SEQ ID NO: 8001213 - DNA, 22 bp, Homo sapiens
gatgctttccaagaaatcctca

SEQ ID NO: 8001214 - DNA, 22 bp, Homo sapiens
gatgcttaccgacttacagtgc

SEQ ID NO: 8001215 - DNA, 22 bp, Homo sapiens
gcccaggaggagaggctgcagt

SEQ ID NO: 8001216 - DNA, 22 bp, Homo sapiens
gcccaggaggagaggctgcagt

SEQ ID NO: 8001217 - DNA, 22 bp, Homo sapiens
gcccaggaggagaggctgcagt

SEQ ID NO: 8001218 - DNA, 21 bp, Homo sapiens
gccatttcacacagacatttg

SEQ ID NO: 8001219 - DNA, 21 bp, Homo sapiens
gccatttcacacagacatttg

SEQ ID NO: 8001220 - DNA, 18 bp, Homo sapiens
gccattcttctaagtact

SEQ ID NO: 8001221 - DNA, 22 bp, Homo sapiens
gccattcttaacagtcatcact

SEQ ID NO: 8001222 - DNA, 22 bp, Homo sapiens
gccattaatgagatcaagaatc

SEQ ID NO: 8001223 - DNA, 22 bp, Homo sapiens
gccattcaattctacaagtata

SEQ ID NO: 8001224 - DNA, 22 bp, Homo sapiens
gccattcattcagaattccaga

SEQ ID NO: 8001225 - DNA, 22 bp, Homo sapiens
gccattcaattctacaagtata

SEQ ID NO: 8001226 - DNA, 22 bp, Homo sapiens
gccattcatattttagcattaa

SEQ ID NO: 8001227 - DNA, 22 bp, Homo sapiens
gcccaggaggtcaagtagctat

SEQ ID NO: 8001228 - DNA, 22 bp, Homo sapiens
gcccaggaggtcaagtagctat

SEQ ID NO: 8001229 - DNA, 22 bp, Homo sapiens
gcccaggaggtcaagtagctat

SEQ ID NO: 8001230 - DNA, 22 bp, Homo sapiens
gcccaggaggcagaggttgtgg

SEQ ID NO: 8001231 - DNA, 22 bp, Homo sapiens
gcccaggaggcagaggttgtgg

SEQ ID NO: 8001232 - DNA, 22 bp, Homo sapiens
gcccaggaggcagaggttgtgg

SEQ ID NO: 8001233 - DNA, 22 bp, Homo sapiens
gcccaggaggagaggctgcagt

SEQ ID NO: 8001234 - DNA, 22 bp, Homo sapiens
gcccaggagttggaggctgcag

SEQ ID NO: 8001235 - DNA, 22 bp, Homo sapiens
gcccaggagttggaggctgcag

SEQ ID NO: 8001236 - DNA, 22 bp, Homo sapiens
gcccaggagttgaatgcagcag

SEQ ID NO: 8001237 - DNA, 22 bp, Homo sapiens
gcccaggagttgaatgcagcag

SEQ ID NO: 8001238 - DNA, 22 bp, Homo sapiens
gcccaggagttggaggctgcag

SEQ ID NO: 8001239 - DNA, 22 bp, Homo sapiens
gcccaggagttggaggctgcag

SEQ ID NO: 8001240 - DNA, 22 bp, Homo sapiens
gcccaggagttggaggctgcag

SEQ ID NO: 8001241 - DNA, 22 bp, Homo sapiens
gccatgtcctgggcatctgcca

SEQ ID NO: 8001242 - DNA, 22 bp, Homo sapiens
gccatgtcctgggcatctgcca

SEQ ID NO: 8001243 - DNA, 21 bp, Homo sapiens
gccatgtttccttactaagag

SEQ ID NO: 8001244 - DNA, 22 bp, Homo sapiens
gccatgttcttgaatctgggtc

SEQ ID NO: 8001245 - DNA, 22 bp, Homo sapiens
gccatggggagggcagcgcctg

SEQ ID NO: 8001246 - DNA, 22 bp, Homo sapiens
gccatggggagggcagcgcctg

SEQ ID NO: 8001247 - DNA, 22 bp, Homo sapiens
gccatggggctcagctgcacta

SEQ ID NO: 8001248 - DNA, 22 bp, Homo sapiens
gccatggggagggcagcgcctg

SEQ ID NO: 8001249 - DNA, 22 bp, Homo sapiens
gccatgggtctgctggctcagc

SEQ ID NO: 8001250 - DNA, 22 bp, Homo sapiens
gccatggggctcagctgcacta

SEQ ID NO: 8001251 - DNA, 22 bp, Homo sapiens
gccatggggctcagctgcacta

SEQ ID NO: 8001252 - DNA, 22 bp, Homo sapiens
gccatgggcaaatgcagagctg

SEQ ID NO: 8001253 - DNA, 22 bp, Homo sapiens
gccatgggcaaatgcagagctg

SEQ ID NO: 8001254 - DNA, 22 bp, Homo sapiens
gccatgggcaaatgcagagctg

SEQ ID NO: 8001255 - DNA, 19 bp, Homo sapiens
gccatgggctggcagcaga

SEQ ID NO: 8001256 - DNA, 19 bp, Homo sapiens
gccatgggctggcagcaga

SEQ ID NO: 8001257 - DNA, 22 bp, Homo sapiens
gccatggggacttcatggattt

SEQ ID NO: 8001258 - DNA, 19 bp, Homo sapiens
gccatgggctggcagcaga

SEQ ID NO: 8001259 - DNA, 19 bp, Homo sapiens
gccatgggctggcagcaga

SEQ ID NO: 8001260 - DNA, 23 bp, Homo sapiens
gccatggctgccccacaggcctc

SEQ ID NO: 8001261 - DNA, 22 bp, Homo sapiens
gccatgggcaaatgcagagctg

SEQ ID NO: 8001262 - DNA, 23 bp, Homo sapiens
gccatggctgccccacaggcctc

SEQ ID NO: 8001263 - DNA, 22 bp, Homo sapiens
gccatgggcaaatgcagagctg

SEQ ID NO: 8001264 - DNA, 23 bp, Homo sapiens
gccatcacgttcaaccaaagcct

SEQ ID NO: 8001265 - DNA, 22 bp, Homo sapiens
gcccaggctggagtgcagtagc

SEQ ID NO: 8001266 - DNA, 22 bp, Homo sapiens
gcccaggctggagtgcagtagc

SEQ ID NO: 8001267 - DNA, 22 bp, Homo sapiens
gcccaggctggagtgcagtagc

SEQ ID NO: 8001268 - DNA, 22 bp, Homo sapiens
gcccaggctagcgtagagtgca

SEQ ID NO: 8001269 - DNA, 22 bp, Homo sapiens
gcccaggctggagtgcagtagc

SEQ ID NO: 8001270 - DNA, 22 bp, Homo sapiens
gcccaggctagcgtagagtgca

SEQ ID NO: 8001271 - DNA, 22 bp, Homo sapiens
gcccaggctggagtgcagtagc

SEQ ID NO: 8001272 - DNA, 22 bp, Homo sapiens
gcccaggctggagtgcagtagc

SEQ ID NO: 8001273 - DNA, 22 bp, Homo sapiens
gcccaggctggagtgcagtggc

SEQ ID NO: 8001274 - DNA, 22 bp, Homo sapiens
gcccaggctagcgtagagtgca

SEQ ID NO: 8001275 - DNA, 22 bp, Homo sapiens
gcccaggctagcgtagagtgca

SEQ ID NO: 8001276 - DNA, 22 bp, Homo sapiens
gcccaggctagcgtagagtgca

SEQ ID NO: 8001277 - DNA, 22 bp, Homo sapiens
gcccaggctagcgtagagtgca

SEQ ID NO: 8001278 - DNA, 22 bp, Homo sapiens
gcccaggattctttcttcctta

SEQ ID NO: 8001279 - DNA, 22 bp, Homo sapiens
gcccaggattctttcttcctta

SEQ ID NO: 8001280 - DNA, 22 bp, Homo sapiens
gcccaggattctttcttcctta

SEQ ID NO: 8001281 - DNA, 22 bp, Homo sapiens
gcccaggatggctggaggtgct

SEQ ID NO: 8001282 - DNA, 22 bp, Homo sapiens
gcccaggatggctggaggtgct

SEQ ID NO: 8001283 - DNA, 22 bp, Homo sapiens
gcccaggatggctggaggtgct

SEQ ID NO: 8001284 - DNA, 22 bp, Homo sapiens
gcccaggatggtgtgtagtggt

SEQ ID NO: 8001285 - DNA, 22 bp, Homo sapiens
gcccaggatggtgtgtagtggt

SEQ ID NO: 8001286 - DNA, 22 bp, Homo sapiens
gcccaggattctttcttcctta

SEQ ID NO: 8001287 - DNA, 22 bp, Homo sapiens
gcccaggatggctggaggtgct

SEQ ID NO: 8001288 - DNA, 22 bp, Homo sapiens
gcccaggatggctggaggtgct

SEQ ID NO: 8001289 - DNA, 22 bp, Homo sapiens
gcccaggatctgctcagatcat

SEQ ID NO: 8001290 - DNA, 22 bp, Homo sapiens
gcccaggatggagaatagtggt

SEQ ID NO: 8001291 - DNA, 22 bp, Homo sapiens
gcccaggatggagaatagtggt

SEQ ID NO: 8001292 - DNA, 20 bp, Homo sapiens
gcccaggatctctgaggcat

SEQ ID NO: 8001293 - DNA, 20 bp, Homo sapiens
gcccaggatctctgaggcat

SEQ ID NO: 8001294 - DNA, 20 bp, Homo sapiens
gcccaggatctctgaggcat

SEQ ID NO: 8001295 - DNA, 20 bp, Homo sapiens
gcccaggatctctgaggcat

SEQ ID NO: 8001296 - DNA, 20 bp, Homo sapiens
gcccaggatctctgaggcat

SEQ ID NO: 8001297 - DNA, 20 bp, Homo sapiens
gcccaggatctctgaggcat

SEQ ID NO: 8001298 - DNA, 22 bp, Homo sapiens
gcccaggatctgctcagatcat

SEQ ID NO: 8001299 - DNA, 22 bp, Homo sapiens
gcccaggagttggtggctgcag

SEQ ID NO: 8001300 - DNA, 22 bp, Homo sapiens
gcccaggagttggtggctgcag

SEQ ID NO: 8001301 - DNA, 22 bp, Homo sapiens
gcccaggagtttgcattttaac

SEQ ID NO: 8001302 - DNA, 22 bp, Homo sapiens
gcccaggagttggtggctgcag

SEQ ID NO: 8001303 - DNA, 22 bp, Homo sapiens
gcccaggagttggtggctgcag

SEQ ID NO: 8001304 - DNA, 22 bp, Homo sapiens
gcccaggagttggtggctgcag

SEQ ID NO: 8001305 - DNA, 22 bp, Homo sapiens
gcccaggagttggaggctgcag

SEQ ID NO: 8001306 - DNA, 22 bp, Homo sapiens
gcccaggagttggaggctgcag

SEQ ID NO: 8001307 - DNA, 22 bp, Homo sapiens
gcccaggataatgctgtccctg

SEQ ID NO: 8001308 - DNA, 22 bp, Homo sapiens
gcccaggataatgctgtccctg

SEQ ID NO: 8001309 - DNA, 20 bp, Homo sapiens
gcccaggatctctgaggcat

SEQ ID NO: 8001310 - DNA, 20 bp, Homo sapiens
gcccaggatctctgaggcat

SEQ ID NO: 8001311 - DNA, 22 bp, Homo sapiens
gcccaggagtttgcattttaac

SEQ ID NO: 8001312 - DNA, 22 bp, Homo sapiens
gcccaggataatgctgtccctg

SEQ ID NO: 8001313 - DNA, 22 bp, Homo sapiens
gcccaggataatgctgtccctg

SEQ ID NO: 8001314 - DNA, 22 bp, Homo sapiens
gccaggctcttggttatgtttt

SEQ ID NO: 8001315 - DNA, 22 bp, Homo sapiens
gccaggctcttccatttgggtc

SEQ ID NO: 8001316 - DNA, 22 bp, Homo sapiens
gccaggctcttccatttgggtc

SEQ ID NO: 8001317 - DNA, 19 bp, Homo sapiens
gccaggctcttattctgtg

SEQ ID NO: 8001318 - DNA, 19 bp, Homo sapiens
gccaggctcttattctgtg

SEQ ID NO: 8001319 - DNA, 22 bp, Homo sapiens
gccaggctcttccatttgggtc

SEQ ID NO: 8001320 - DNA, 22 bp, Homo sapiens
gccagcagggcccaaatgctgg

SEQ ID NO: 8001321 - DNA, 22 bp, Homo sapiens
gccagcagggcccaaatgctgg

SEQ ID NO: 8001322 - DNA, 22 bp, Homo sapiens
gccaggctctcagtgactgccc

SEQ ID NO: 8001323 - DNA, 19 bp, Homo sapiens
gccaggctcttattctgtg

SEQ ID NO: 8001324 - DNA, 19 bp, Homo sapiens
gccaggctcttattctgtg

SEQ ID NO: 8001325 - DNA, 19 bp, Homo sapiens
gccaggctcttattctgtg

SEQ ID NO: 8001326 - DNA, 22 bp, Homo sapiens
gccaggctgaggctctggaaga

SEQ ID NO: 8001327 - DNA, 22 bp, Homo sapiens
gccaggctgaggctctggaaga

SEQ ID NO: 8001328 - DNA, 22 bp, Homo sapiens
gccaggctgccttatctctagc

SEQ ID NO: 8001329 - DNA, 22 bp, Homo sapiens
gccaggctgccttatctctagc

SEQ ID NO: 8001330 - DNA, 22 bp, Homo sapiens
gccaggctgaggctctggaaga

SEQ ID NO: 8001331 - DNA, 22 bp, Homo sapiens
gccaggctgaggctctggaaga

SEQ ID NO: 8001332 - DNA, 22 bp, Homo sapiens
gccaggctgactcccccggcct

SEQ ID NO: 8001333 - DNA, 22 bp, Homo sapiens
gccaggctgactcccccggcct

SEQ ID NO: 8001334 - DNA, 22 bp, Homo sapiens
gccaggctgactcccccggcct

SEQ ID NO: 8001335 - DNA, 22 bp, Homo sapiens
gccaggctcttggttatgtttt

SEQ ID NO: 8001336 - DNA, 22 bp, Homo sapiens
gccaggctcttggttatgtttt

SEQ ID NO: 8001337 - DNA, 22 bp, Homo sapiens
gccaggctcttggttatgtttt

SEQ ID NO: 8001338 - DNA, 22 bp, Homo sapiens
gccaggctgactcccccggcct

SEQ ID NO: 8001339 - DNA, 22 bp, Homo sapiens
gccaggctgctggctgctgtcc

SEQ ID NO: 8001340 - DNA, 22 bp, Homo sapiens
gccaggctgctccagggaggcc

SEQ ID NO: 8001341 - DNA, 22 bp, Homo sapiens
gccaggctgctggctgctgtcc

SEQ ID NO: 8001342 - DNA, 22 bp, Homo sapiens
gccaggctgctccagggaggcc

SEQ ID NO: 8001343 - DNA, 22 bp, Homo sapiens
gccaggctgccttatctctagc

SEQ ID NO: 8001344 - DNA, 22 bp, Homo sapiens
gccaggctgctccagggaggcc

SEQ ID NO: 8001345 - DNA, 22 bp, Homo sapiens
gccaggctgctccagggaggcc

SEQ ID NO: 8001346 - DNA, 22 bp, Homo sapiens
gccaggctgccttatctctagc

SEQ ID NO: 8001347 - DNA, 22 bp, Homo sapiens
gccaggctgccttatctctagc

SEQ ID NO: 8001348 - DNA, 22 bp, Homo sapiens
gccaggctgccttatctctagc

SEQ ID NO: 8001349 - DNA, 22 bp, Homo sapiens
gccaggctgccttatctctagc

SEQ ID NO: 8001350 - DNA, 22 bp, Homo sapiens
gccaggctggtgtcacaactct

SEQ ID NO: 8001351 - DNA, 22 bp, Homo sapiens
gccaggctgctggctgctgtcc

SEQ ID NO: 8001352 - DNA, 22 bp, Homo sapiens
gccaggctgctggctgctgtcc

SEQ ID NO: 8001353 - DNA, 22 bp, Homo sapiens
gccaggctggtgtcacaactct

SEQ ID NO: 8001354 - DNA, 22 bp, Homo sapiens
gccaggctggtgtcacaactct

SEQ ID NO: 8001355 - DNA, 22 bp, Homo sapiens
gccaggctggtgtcacaactct

SEQ ID NO: 8001356 - DNA, 22 bp, Homo sapiens
gccaggctggtgtcacaactct

SEQ ID NO: 8001357 - DNA, 22 bp, Homo sapiens
gccaggctgtggggaacttgaa

SEQ ID NO: 8001358 - DNA, 22 bp, Homo sapiens
gccaggctggttatttaatgag

SEQ ID NO: 8001359 - DNA, 22 bp, Homo sapiens
gccaggctggttatttaatgag

SEQ ID NO: 8001360 - DNA, 22 bp, Homo sapiens
gccaggctggttatttaatgag

SEQ ID NO: 8001361 - DNA, 22 bp, Homo sapiens
gccaggctggttatttaatgag

SEQ ID NO: 8001362 - DNA, 22 bp, Homo sapiens
gccatacctgaggctcctatgg

SEQ ID NO: 8001363 - DNA, 22 bp, Homo sapiens
gccataggcagcgtggccagca

SEQ ID NO: 8001364 - DNA, 22 bp, Homo sapiens
gccatatacccactgtctccat

SEQ ID NO: 8001365 - DNA, 22 bp, Homo sapiens
gccatcacatccaggctacctc

SEQ ID NO: 8001366 - DNA, 22 bp, Homo sapiens
gccatacatgaaaagtccacac

SEQ ID NO: 8001367 - DNA, 22 bp, Homo sapiens
gccagtttccacctaggcaatt

SEQ ID NO: 8001368 - DNA, 22 bp, Homo sapiens
gccataaaatgtggatgaggga

SEQ ID NO: 8001369 - DNA, 22 bp, Homo sapiens
gccataaatgaaggaaaggtat

SEQ ID NO: 8001370 - DNA, 17 bp, Homo sapiens
gccagttgtcttggcat

SEQ ID NO: 8001371 - DNA, 22 bp, Homo sapiens
gccagttcctgtggagtcagag

SEQ ID NO: 8001372 - DNA, 22 bp, Homo sapiens
gccagttacccacaactactga

SEQ ID NO: 8001373 - DNA, 22 bp, Homo sapiens
gccagtggtgagattccctggg

SEQ ID NO: 8001374 - DNA, 22 bp, Homo sapiens
gccagtgttattcctggggctg

SEQ ID NO: 8001375 - DNA, 22 bp, Homo sapiens
gccagtgggacccgctgtgggc

SEQ ID NO: 8001376 - DNA, 22 bp, Homo sapiens
gccagggaaactgcagaccagc

SEQ ID NO: 8001377 - DNA, 22 bp, Homo sapiens
gccagtgggacccgctgtgggc

SEQ ID NO: 8001378 - DNA, 22 bp, Homo sapiens
gccaggctgtttttattactgt

SEQ ID NO: 8001379 - DNA, 22 bp, Homo sapiens
gccaggctgtttttattactgt

SEQ ID NO: 8001380 - DNA, 22 bp, Homo sapiens
gccaggctgtttttattactgt

SEQ ID NO: 8001381 - DNA, 22 bp, Homo sapiens
gccagggaaactgcagaccagc

SEQ ID NO: 8001382 - DNA, 22 bp, Homo sapiens
gccaggctgtttttattactgt

SEQ ID NO: 8001383 - DNA, 22 bp, Homo sapiens
gccaggctgtttttattactgt

SEQ ID NO: 8001384 - DNA, 22 bp, Homo sapiens
gccaggctgtttttattactgt

SEQ ID NO: 8001385 - DNA, 22 bp, Homo sapiens
gccaggctgtggggaacttgaa

SEQ ID NO: 8001386 - DNA, 22 bp, Homo sapiens
gccaggctgtggggaacttgaa

SEQ ID NO: 8001387 - DNA, 22 bp, Homo sapiens
gccaggctgtggggaacttgaa

SEQ ID NO: 8001388 - DNA, 18 bp, Homo sapiens
gccagtgggtccaggtgc

SEQ ID NO: 8001389 - DNA, 18 bp, Homo sapiens
gccagtgggtccaggtgc

SEQ ID NO: 8001390 - DNA, 18 bp, Homo sapiens
gccagtgggtccaggtgc

SEQ ID NO: 8001391 - DNA, 22 bp, Homo sapiens
gccagtggtagaggggaggccg

SEQ ID NO: 8001392 - DNA, 22 bp, Homo sapiens
gccagtgggtagttggagctgg

SEQ ID NO: 8001393 - DNA, 22 bp, Homo sapiens
gccagtgggtagttggagctgg

SEQ ID NO: 8001394 - DNA, 22 bp, Homo sapiens
gccagtgggtagttggagctgg

SEQ ID NO: 8001395 - DNA, 22 bp, Homo sapiens
gccagtgggtagttggagctgg

SEQ ID NO: 8001396 - DNA, 22 bp, Homo sapiens
gccagtggtcactgaggaagaa

SEQ ID NO: 8001397 - DNA, 22 bp, Homo sapiens
gccagtggtcactgaggaagaa

SEQ ID NO: 8001398 - DNA, 22 bp, Homo sapiens
gccagtggtcagtgggagggtg

SEQ ID NO: 8001399 - DNA, 22 bp, Homo sapiens
gccagtggtcagtgggagggtg

SEQ ID NO: 8001400 - DNA, 22 bp, Homo sapiens
gccagtggtcagctacgcttag

SEQ ID NO: 8001401 - DNA, 22 bp, Homo sapiens
gccagtggtcagtgggagggtg

SEQ ID NO: 8001402 - DNA, 22 bp, Homo sapiens
gccggggctggggagagacatg

SEQ ID NO: 8001403 - DNA, 19 bp, Homo sapiens
gccgggggcgccccgctct

SEQ ID NO: 8001404 - DNA, 22 bp, Homo sapiens
gccgggttcaagccattctcct

SEQ ID NO: 8001405 - DNA, 22 bp, Homo sapiens
gccgggtgcagcgggcccgcca

SEQ ID NO: 8001406 - DNA, 22 bp, Homo sapiens
gccgggtgcagcgggcccgcca

SEQ ID NO: 8001407 - DNA, 22 bp, Homo sapiens
gccgggttcaagccattctcct

SEQ ID NO: 8001408 - DNA, 22 bp, Homo sapiens
gccggtggcttttgtctcccct

SEQ ID NO: 8001409 - DNA, 22 bp, Homo sapiens
gccgtggcttctccagctggct

SEQ ID NO: 8001410 - DNA, 22 bp, Homo sapiens
gccgtggcttctccagctggct

SEQ ID NO: 8001411 - DNA, 22 bp, Homo sapiens
gccgtggcttctccagctggct

SEQ ID NO: 8001412 - DNA, 22 bp, Homo sapiens
gccgtggcttctccagctggct

SEQ ID NO: 8001413 - DNA, 22 bp, Homo sapiens
gcctcctgtcccaggctgagga

SEQ ID NO: 8001414 - DNA, 22 bp, Homo sapiens
gcctcctgtcccaggctgagga

SEQ ID NO: 8001415 - DNA, 22 bp, Homo sapiens
gcctcctgtcccaggctgagga

SEQ ID NO: 8001416 - DNA, 22 bp, Homo sapiens
gcctcctgtcccaggctgagga

SEQ ID NO: 8001417 - DNA, 22 bp, Homo sapiens
gcctcctgttatgccatgtgcc

SEQ ID NO: 8001418 - DNA, 22 bp, Homo sapiens
gcctcctgttatgccatgtgcc

SEQ ID NO: 8001419 - DNA, 22 bp, Homo sapiens
gcctcctgtcccaggctgagga

SEQ ID NO: 8001420 - DNA, 22 bp, Homo sapiens
gcctcctgtcccaggctgagga

SEQ ID NO: 8001421 - DNA, 22 bp, Homo sapiens
gcctcctgtcccaggctgagga

SEQ ID NO: 8001422 - DNA, 22 bp, Homo sapiens
gccgtgtcatctgcgggtggca

SEQ ID NO: 8001423 - DNA, 22 bp, Homo sapiens
gccgggaccaaggccacggagc

SEQ ID NO: 8001424 - DNA, 19 bp, Homo sapiens
gccgggcccgggttggccg

SEQ ID NO: 8001425 - DNA, 22 bp, Homo sapiens
gccgggccctgacctcagagtt

SEQ ID NO: 8001426 - DNA, 22 bp, Homo sapiens
gccgggaccaaggccacggagc

SEQ ID NO: 8001427 - DNA, 22 bp, Homo sapiens
gccgggaccaaggccacggagc

SEQ ID NO: 8001428 - DNA, 22 bp, Homo sapiens
gccgggaccaaggccacggagc

SEQ ID NO: 8001429 - DNA, 22 bp, Homo sapiens
gccgcggcactggcctggctcc

SEQ ID NO: 8001430 - DNA, 22 bp, Homo sapiens
gccggggctggggagagacatg

SEQ ID NO: 8001431 - DNA, 22 bp, Homo sapiens
gccggggctggggagagacatg

SEQ ID NO: 8001432 - DNA, 22 bp, Homo sapiens
gccggggctggggagagacatg

SEQ ID NO: 8001433 - DNA, 22 bp, Homo sapiens
gccggggctggggagagacatg

SEQ ID NO: 8001434 - DNA, 22 bp, Homo sapiens
gccggggctggggagagacatg

SEQ ID NO: 8001435 - DNA, 22 bp, Homo sapiens
gccggggctggggagagacatg

SEQ ID NO: 8001436 - DNA, 22 bp, Homo sapiens
gccggggctggggagagacatg

SEQ ID NO: 8001437 - DNA, 22 bp, Homo sapiens
gccgaggctctgcccagctgct

SEQ ID NO: 8001438 - DNA, 22 bp, Homo sapiens
gccgaggctctgcccagctgct

SEQ ID NO: 8001439 - DNA, 20 bp, Homo sapiens
gccgactgccttgtgagcct

SEQ ID NO: 8001440 - DNA, 20 bp, Homo sapiens
gccgactgccttgtgagcct

SEQ ID NO: 8001441 - DNA, 22 bp, Homo sapiens
gccgagcacagtgcagctgcct

SEQ ID NO: 8001442 - DNA, 22 bp, Homo sapiens
gccgaagacgctgggcgtgggc

SEQ ID NO: 8001443 - DNA, 20 bp, Homo sapiens
gccgactgccttgtgagcct

SEQ ID NO: 8001444 - DNA, 22 bp, Homo sapiens
gccgccctctgcaggggctgag

SEQ ID NO: 8001445 - DNA, 22 bp, Homo sapiens
gccgccatatcatctgcctctt

SEQ ID NO: 8001446 - DNA, 22 bp, Homo sapiens
gccgccatatcatctgcctctt

SEQ ID NO: 8001447 - DNA, 22 bp, Homo sapiens
gccgaggctctgcccagctgct

SEQ ID NO: 8001448 - DNA, 22 bp, Homo sapiens
gccgcgtcgatgccctctagtt

SEQ ID NO: 8001449 - DNA, 22 bp, Homo sapiens
gcctcctgttatgccatgtgcc

SEQ ID NO: 8001450 - DNA, 22 bp, Homo sapiens
gcctcctgttatgccatgtgcc

SEQ ID NO: 8001451 - DNA, 22 bp, Homo sapiens
gcctctgcaactccgccttggt

SEQ ID NO: 8001452 - DNA, 22 bp, Homo sapiens
gcctctgcaattacattgtgcc

SEQ ID NO: 8001453 - DNA, 22 bp, Homo sapiens
gcctctgcaccagtactgtgcc

SEQ ID NO: 8001454 - DNA, 22 bp, Homo sapiens
gcctctgcaggtgcggttatcc

SEQ ID NO: 8001455 - DNA, 23 bp, Homo sapiens
gcctctgcagcctagttagtgtc

SEQ ID NO: 8001456 - DNA, 22 bp, Homo sapiens
gcctctgcactgtggcacacca

SEQ ID NO: 8001457 - DNA, 22 bp, Homo sapiens
gcctctgcaccagtactgtgcc

SEQ ID NO: 8001458 - DNA, 22 bp, Homo sapiens
gcctctgcactgtggcacacca

SEQ ID NO: 8001459 - DNA, 22 bp, Homo sapiens
gcctctgcactgtggcacacca

SEQ ID NO: 8001460 - DNA, 22 bp, Homo sapiens
gcctctgcatcatcactccagc

SEQ ID NO: 8001461 - DNA, 22 bp, Homo sapiens
gcctctgcatcttcgccgcact

SEQ ID NO: 8001462 - DNA, 22 bp, Homo sapiens
gcctctgcatcatcactccagc

SEQ ID NO: 8001463 - DNA, 22 bp, Homo sapiens
gcctctgcatcatcactccagc

SEQ ID NO: 8001464 - DNA, 22 bp, Homo sapiens
gcctctgcatgctcagcaccca

SEQ ID NO: 8001465 - DNA, 22 bp, Homo sapiens
gcctctgccaagggggctgcgg

SEQ ID NO: 8001466 - DNA, 22 bp, Homo sapiens
gcctctgcatgctcagcaccca

SEQ ID NO: 8001467 - DNA, 22 bp, Homo sapiens
gcctctgccaagggggctgcgg

SEQ ID NO: 8001468 - DNA, 22 bp, Homo sapiens
gcctctgcccatccaccatcag

SEQ ID NO: 8001469 - DNA, 23 bp, Homo sapiens
gcctctgctctgcgttggggact

SEQ ID NO: 8001470 - DNA, 22 bp, Homo sapiens
gcctctgctctcaggtagcctc

SEQ ID NO: 8001471 - DNA, 22 bp, Homo sapiens
gcctctgctgacaagatggaca

SEQ ID NO: 8001472 - DNA, 22 bp, Homo sapiens
gcctctgctgcaagcctggttg

SEQ ID NO: 8001473 - DNA, 22 bp, Homo sapiens
gcctctgctgcaagcctggttg

SEQ ID NO: 8001474 - DNA, 19 bp, Homo sapiens
gcctctgctggggacaggc

SEQ ID NO: 8001475 - DNA, 19 bp, Homo sapiens
gcctctgctggggacaggc

SEQ ID NO: 8001476 - DNA, 19 bp, Homo sapiens
gcctctgctggggacaggc

SEQ ID NO: 8001477 - DNA, 21 bp, Homo sapiens
gcctctgctgtcttattgtga

SEQ ID NO: 8001478 - DNA, 22 bp, Homo sapiens
gcctctgccctcctgggactgc

SEQ ID NO: 8001479 - DNA, 22 bp, Homo sapiens
gcctctgccctcctgggactgc

SEQ ID NO: 8001480 - DNA, 22 bp, Homo sapiens
gcctctgcccatccaccatcag

SEQ ID NO: 8001481 - DNA, 22 bp, Homo sapiens
gcctctgccctcctgggactgc

SEQ ID NO: 8001482 - DNA, 22 bp, Homo sapiens
gcctctgcgcctcagccgacct

SEQ ID NO: 8001483 - DNA, 22 bp, Homo sapiens
gcctctgcggagctgtacatca

SEQ ID NO: 8001484 - DNA, 22 bp, Homo sapiens
gcctctgctcggactttgcctc

SEQ ID NO: 8001485 - DNA, 22 bp, Homo sapiens
gcctctgctcggactttgcctc

SEQ ID NO: 8001486 - DNA, 22 bp, Homo sapiens
gcctctgcggggcccgagcccg

SEQ ID NO: 8001487 - DNA, 22 bp, Homo sapiens
gcctctgcggagctgtacatca

SEQ ID NO: 8001488 - DNA, 22 bp, Homo sapiens
gcctctgcggggcccgagcccg

SEQ ID NO: 8001489 - DNA, 22 bp, Homo sapiens
gccctctggcacagagatgcag

SEQ ID NO: 8001490 - DNA, 22 bp, Homo sapiens
gccctctgctggcctcacctcg

SEQ ID NO: 8001491 - DNA, 22 bp, Homo sapiens
gccctctggcacagagatgcag

SEQ ID NO: 8001492 - DNA, 22 bp, Homo sapiens
gccctctggcacagagatgcag

SEQ ID NO: 8001493 - DNA, 22 bp, Homo sapiens
gccctctggcacagagatgcag

SEQ ID NO: 8001494 - DNA, 22 bp, Homo sapiens
gcccttagccttatagcctcta

SEQ ID NO: 8001495 - DNA, 22 bp, Homo sapiens
gccctgttttctgggttccttg

SEQ ID NO: 8001496 - DNA, 22 bp, Homo sapiens
gcccttacagggtggtcagcca

SEQ ID NO: 8001497 - DNA, 22 bp, Homo sapiens
gcccttacagggtggtcagcca

SEQ ID NO: 8001498 - DNA, 22 bp, Homo sapiens
gcccttacagggtggtcagcca

SEQ ID NO: 8001499 - DNA, 22 bp, Homo sapiens
gccctctgatgctcaccgagga

SEQ ID NO: 8001500 - DNA, 22 bp, Homo sapiens
gccctctgatgctcaccgagga

SEQ ID NO: 8001501 - DNA, 22 bp, Homo sapiens
gccctctgcacagctctgagca

SEQ ID NO: 8001502 - DNA, 22 bp, Homo sapiens
gccctctgatgctcaccgagga

SEQ ID NO: 8001503 - DNA, 22 bp, Homo sapiens
gccctctgccacaggacgccag

SEQ ID NO: 8001504 - DNA, 22 bp, Homo sapiens
gccctctgccacaggacgccag

SEQ ID NO: 8001505 - DNA, 22 bp, Homo sapiens
gccctctgcacagctctgagca

SEQ ID NO: 8001506 - DNA, 22 bp, Homo sapiens
gccctctgcacagctctgagca

SEQ ID NO: 8001507 - DNA, 20 bp, Homo sapiens
gccctctgcctccctcagcg

SEQ ID NO: 8001508 - DNA, 22 bp, Homo sapiens
gccctctgccacaggacgccag

SEQ ID NO: 8001509 - DNA, 22 bp, Homo sapiens
gccctctgctcagctcctcagc

SEQ ID NO: 8001510 - DNA, 22 bp, Homo sapiens
gccctctgctcagctcctcagc

SEQ ID NO: 8001511 - DNA, 22 bp, Homo sapiens
gccctctgctcagctcctcagc

SEQ ID NO: 8001512 - DNA, 22 bp, Homo sapiens
gcccttggaacagcctcctgct

SEQ ID NO: 8001513 - DNA, 22 bp, Homo sapiens
gcccttggaaagccaaggcagc

SEQ ID NO: 8001514 - DNA, 22 bp, Homo sapiens
gcccttggaaagccaaggcagc

SEQ ID NO: 8001515 - DNA, 22 bp, Homo sapiens
gcccttgggaggttccactggg

SEQ ID NO: 8001516 - DNA, 22 bp, Homo sapiens
gcccttgggaggttccactggg

SEQ ID NO: 8001517 - DNA, 22 bp, Homo sapiens
gcccttgggaggttccactggg

SEQ ID NO: 8001518 - DNA, 22 bp, Homo sapiens
gcccttggcaaattctccttta

SEQ ID NO: 8001519 - DNA, 22 bp, Homo sapiens
gcccttggaagcggcaggtagc

SEQ ID NO: 8001520 - DNA, 22 bp, Homo sapiens
gccctttcttcttctggactgg

SEQ ID NO: 8001521 - DNA, 22 bp, Homo sapiens
gccctttcttcttctggactgg

SEQ ID NO: 8001522 - DNA, 22 bp, Homo sapiens
gccctttgaagtaagctggtgt

SEQ ID NO: 8001523 - DNA, 22 bp, Homo sapiens
gccctttgtggtcagaggcctg

SEQ ID NO: 8001524 - DNA, 22 bp, Homo sapiens
gccctttgtggtcagaggcctg

SEQ ID NO: 8001525 - DNA, 22 bp, Homo sapiens
gccctttgagagtggccttgtt

SEQ ID NO: 8001526 - DNA, 22 bp, Homo sapiens
gccctttgtggtcagaggcctg

SEQ ID NO: 8001527 - DNA, 22 bp, Homo sapiens
gcccttggggtgtctgtaataa

SEQ ID NO: 8001528 - DNA, 22 bp, Homo sapiens
gccctttattagagctgccatt

SEQ ID NO: 8001529 - DNA, 22 bp, Homo sapiens
gccctttattagagctgccatt

SEQ ID NO: 8001530 - DNA, 16 bp, Homo sapiens
gccctttccttggctg

SEQ ID NO: 8001531 - DNA, 22 bp, Homo sapiens
gcccttctgctgttaggtagcc

SEQ ID NO: 8001532 - DNA, 22 bp, Homo sapiens
gcccttctgctgttaggtagcc

SEQ ID NO: 8001533 - DNA, 22 bp, Homo sapiens
gcccttccttagacagcaggat

SEQ ID NO: 8001534 - DNA, 22 bp, Homo sapiens
gcccttccttagacagcaggat

SEQ ID NO: 8001535 - DNA, 22 bp, Homo sapiens
gcccttccaacccagagggcaa

SEQ ID NO: 8001536 - DNA, 22 bp, Homo sapiens
gcccttagtcagcactttcact

SEQ ID NO: 8001537 - DNA, 22 bp, Homo sapiens
gcccttagggccactgtcactg

SEQ ID NO: 8001538 - DNA, 22 bp, Homo sapiens
gcccttataaacaaggcttcag

SEQ ID NO: 8001539 - DNA, 22 bp, Homo sapiens
gcccttcacgatggtatcttag

SEQ ID NO: 8001540 - DNA, 22 bp, Homo sapiens
gcccttcagttactccttgatg

SEQ ID NO: 8001541 - DNA, 20 bp, Homo sapiens
gcccttatgcagtgatggga

SEQ ID NO: 8001542 - DNA, 22 bp, Homo sapiens
gcccttcatttatagttggaat

SEQ ID NO: 8001543 - DNA, 22 bp, Homo sapiens
gccctcagcatcctcagggcca

SEQ ID NO: 8001544 - DNA, 22 bp, Homo sapiens
gccctcagctcctggacacatg

SEQ ID NO: 8001545 - DNA, 22 bp, Homo sapiens
gccctcagctcctggacacatg

SEQ ID NO: 8001546 - DNA, 22 bp, Homo sapiens
gccctcagcaggaaagatcaac

SEQ ID NO: 8001547 - DNA, 22 bp, Homo sapiens
gccctcagcatcctcagggcca

SEQ ID NO: 8001548 - DNA, 22 bp, Homo sapiens
gccctcaggacaaggttacgct

SEQ ID NO: 8001549 - DNA, 17 bp, Homo sapiens
gccctcagctttaacca

SEQ ID NO: 8001550 - DNA, 22 bp, Homo sapiens
gccctcagctcctggacacatg

SEQ ID NO: 8001551 - DNA, 22 bp, Homo sapiens
gccctcagcttgatgttgttct

SEQ ID NO: 8001552 - DNA, 22 bp, Homo sapiens
gccctcagagttccccacagtg

SEQ ID NO: 8001553 - DNA, 22 bp, Homo sapiens
gccctcagatgggaaaggaggg

SEQ ID NO: 8001554 - DNA, 22 bp, Homo sapiens
gccctcagcaggaaagatcaac

SEQ ID NO: 8001555 - DNA, 22 bp, Homo sapiens
gccctcagagttccccacagtg

SEQ ID NO: 8001556 - DNA, 22 bp, Homo sapiens
gccctcagcaggaaagatcaac

SEQ ID NO: 8001557 - DNA, 22 bp, Homo sapiens
gccctcagagttccccacagtg

SEQ ID NO: 8001558 - DNA, 22 bp, Homo sapiens
gcccaggctggagtgcagtggc

SEQ ID NO: 8001559 - DNA, 22 bp, Homo sapiens
gcccaggctggagtgcagtggc

SEQ ID NO: 8001560 - DNA, 22 bp, Homo sapiens
gcccaggctggagtgcagtggc

SEQ ID NO: 8001561 - DNA, 22 bp, Homo sapiens
gcccaggctggagtgcagtggc

SEQ ID NO: 8001562 - DNA, 22 bp, Homo sapiens
gccctctcttctgcagcctcca

SEQ ID NO: 8001563 - DNA, 22 bp, Homo sapiens
gccctctcttctgcagcctcca

SEQ ID NO: 8001564 - DNA, 22 bp, Homo sapiens
gccctcgcttcttcctaggggt

SEQ ID NO: 8001565 - DNA, 22 bp, Homo sapiens
gccctcctttgcttctcctagt

SEQ ID NO: 8001566 - DNA, 22 bp, Homo sapiens
gccctcagtggattcttattgt

SEQ ID NO: 8001567 - DNA, 20 bp, Homo sapiens
gccctcagtcttgtctttat

SEQ ID NO: 8001568 - DNA, 22 bp, Homo sapiens
gccctcagtgaccactgattca

SEQ ID NO: 8001569 - DNA, 23 bp, Homo sapiens
gccctcagtagaaaatgttagaa

SEQ ID NO: 8001570 - DNA, 21 bp, Homo sapiens
gccctcaggggaggatggcct

SEQ ID NO: 8001571 - DNA, 22 bp, Homo sapiens
gccctcaggcagggagtctttc

SEQ ID NO: 8001572 - DNA, 15 bp, Homo sapiens
gccctcaggcgacac

SEQ ID NO: 8001573 - DNA, 19 bp, Homo sapiens
gccctcaggcagctccatc

SEQ ID NO: 8001574 - DNA, 19 bp, Homo sapiens
gccctcaggcagctccatc

SEQ ID NO: 8001575 - DNA, 21 bp, Homo sapiens
gcctgtgtaaattgagtttcc

SEQ ID NO: 8001576 - DNA, 22 bp, Homo sapiens
gcctgtgtcatgtagtagcttc

SEQ ID NO: 8001577 - DNA, 22 bp, Homo sapiens
gcctgtgtccttcccagtgggg

SEQ ID NO: 8001578 - DNA, 22 bp, Homo sapiens
gcctgtgtccttcccagtgggg

SEQ ID NO: 8001579 - DNA, 22 bp, Homo sapiens
gcctgtgggttggagcttggcc

SEQ ID NO: 8001580 - DNA, 22 bp, Homo sapiens
gcctgtgggttggagcttggcc

SEQ ID NO: 8001581 - DNA, 22 bp, Homo sapiens
gcctgtggttgctttgggatcc

SEQ ID NO: 8001582 - DNA, 22 bp, Homo sapiens
gcctgtggggctgaggctgcct

SEQ ID NO: 8001583 - DNA, 22 bp, Homo sapiens
gcctgtttaagtattctgacat

SEQ ID NO: 8001584 - DNA, 22 bp, Homo sapiens
gcctgttggtgactttctgttg

SEQ ID NO: 8001585 - DNA, 22 bp, Homo sapiens
gcctgttgggtaacagagttca

SEQ ID NO: 8001586 - DNA, 22 bp, Homo sapiens
gcctgttctccagcatccaggt

SEQ ID NO: 8001587 - DNA, 22 bp, Homo sapiens
gcctgttaaacatgcggctcaa

SEQ ID NO: 8001588 - DNA, 22 bp, Homo sapiens
gcctgtgtggatgcgccggtgc

SEQ ID NO: 8001589 - DNA, 18 bp, Homo sapiens
gcctgtgttcagcctttc

SEQ ID NO: 8001590 - DNA, 22 bp, Homo sapiens
gcctgtgtttttaactctagga

SEQ ID NO: 8001591 - DNA, 22 bp, Homo sapiens
gcctgtgtgtttagctctgggg

SEQ ID NO: 8001592 - DNA, 22 bp, Homo sapiens
gcctgtatttattgagagtgta

SEQ ID NO: 8001593 - DNA, 22 bp, Homo sapiens
gcctggtgtgcgccgcgcagct

SEQ ID NO: 8001594 - DNA, 22 bp, Homo sapiens
gcctgtcaattttgtgtacaat

SEQ ID NO: 8001595 - DNA, 22 bp, Homo sapiens
gcctgtatttattgagagtgta

SEQ ID NO: 8001596 - DNA, 22 bp, Homo sapiens
gcctggtgtctccccaaggaag

SEQ ID NO: 8001597 - DNA, 22 bp, Homo sapiens
gcctggtgtgcgccgcgcagct

SEQ ID NO: 8001598 - DNA, 22 bp, Homo sapiens
gcctggtgtctccccaaggaag

SEQ ID NO: 8001599 - DNA, 22 bp, Homo sapiens
gcctggtgtccagaggcgagtg

SEQ ID NO: 8001600 - DNA, 22 bp, Homo sapiens
gcctggtgtctccccaaggaag

SEQ ID NO: 8001601 - DNA, 22 bp, Homo sapiens
gcctgggattctcaaaggggtg

SEQ ID NO: 8001602 - DNA, 22 bp, Homo sapiens
gcctgggattgtgtaagtgaat

SEQ ID NO: 8001603 - DNA, 22 bp, Homo sapiens
gcctgggattgtgtaagtgaat

SEQ ID NO: 8001604 - DNA, 22 bp, Homo sapiens
gcctggtgtccagaggcgagtg

SEQ ID NO: 8001605 - DNA, 22 bp, Homo sapiens
gcctggtgtctccccaaggaag

SEQ ID NO: 8001606 - DNA, 22 bp, Homo sapiens
gcctggggaacttgatcctgtc

SEQ ID NO: 8001607 - DNA, 22 bp, Homo sapiens
gcctgtggccgactgagagcct

SEQ ID NO: 8001608 - DNA, 19 bp, Homo sapiens
gcctgtggcttgatgttgg

SEQ ID NO: 8001609 - DNA, 22 bp, Homo sapiens
gcctgtggccgactgagagcct

SEQ ID NO: 8001610 - DNA, 22 bp, Homo sapiens
gcctgtggccgactgagagcct

SEQ ID NO: 8001611 - DNA, 22 bp, Homo sapiens
gcctgtggcccaactgtctgtc

SEQ ID NO: 8001612 - DNA, 22 bp, Homo sapiens
gcctgtggcccaactgtctgtc

SEQ ID NO: 8001613 - DNA, 22 bp, Homo sapiens
gcctgtggcccaactgtctgtc

SEQ ID NO: 8001614 - DNA, 22 bp, Homo sapiens
gcctgtggccactgcgtctgca

SEQ ID NO: 8001615 - DNA, 22 bp, Homo sapiens
gcctgtggccactgcgtctgca

SEQ ID NO: 8001616 - DNA, 22 bp, Homo sapiens
gcctgtggccactgcgtctgca

SEQ ID NO: 8001617 - DNA, 20 bp, Homo sapiens
gcctgtggaggaggacggac

SEQ ID NO: 8001618 - DNA, 20 bp, Homo sapiens
gcctgtggaggaggacggac

SEQ ID NO: 8001619 - DNA, 21 bp, Homo sapiens
gcctgtggagcccaagggccc

SEQ ID NO: 8001620 - DNA, 22 bp, Homo sapiens
gcctgtgctttcttccctcctg

SEQ ID NO: 8001621 - DNA, 22 bp, Homo sapiens
gcctgtgctttcttccctcctg

SEQ ID NO: 8001622 - DNA, 21 bp, Homo sapiens
gcctgtggagcccaagggccc

SEQ ID NO: 8001623 - DNA, 22 bp, Homo sapiens
gcctgggaagactaagtgggag

SEQ ID NO: 8001624 - DNA, 21 bp, Homo sapiens
gcctgggaagagaaaggtaag

SEQ ID NO: 8001625 - DNA, 23 bp, Homo sapiens
gcctgggactcaggaggagctca

SEQ ID NO: 8001626 - DNA, 23 bp, Homo sapiens
gcctgggactcaggaggagctca

SEQ ID NO: 8001627 - DNA, 23 bp, Homo sapiens
gcctgggactcaggaggagctca

SEQ ID NO: 8001628 - DNA, 23 bp, Homo sapiens
gcctgggactcaggaggagctca

SEQ ID NO: 8001629 - DNA, 22 bp, Homo sapiens
gcctgggactgcagatccccag

SEQ ID NO: 8001630 - DNA, 23 bp, Homo sapiens
gcctgggactcaggaggagctca

SEQ ID NO: 8001631 - DNA, 23 bp, Homo sapiens
gcctgggactcaggaggagctca

SEQ ID NO: 8001632 - DNA, 23 bp, Homo sapiens
gcctgggactggtagtgtgacct

SEQ ID NO: 8001633 - DNA, 23 bp, Homo sapiens
gcctgggactggtagtgtgacct

SEQ ID NO: 8001634 - DNA, 21 bp, Homo sapiens
gcctgggatagtggcctccgg

SEQ ID NO: 8001635 - DNA, 21 bp, Homo sapiens
gcctgggatagtggcctccgg

SEQ ID NO: 8001636 - DNA, 21 bp, Homo sapiens
gcctgggatagtggcctccgg

SEQ ID NO: 8001637 - DNA, 19 bp, Homo sapiens
gcctgggatgggcagaact

SEQ ID NO: 8001638 - DNA, 22 bp, Homo sapiens
gcctgggatagaggcaatgcat

SEQ ID NO: 8001639 - DNA, 22 bp, Homo sapiens
gcctgggagaatgacctccaac

SEQ ID NO: 8001640 - DNA, 22 bp, Homo sapiens
gcctgggattcccagaggggca

SEQ ID NO: 8001641 - DNA, 22 bp, Homo sapiens
gcctgggattcccagaggggca

SEQ ID NO: 8001642 - DNA, 22 bp, Homo sapiens
gcctgggattcccagaggggca

SEQ ID NO: 8001643 - DNA, 22 bp, Homo sapiens
gcctgggattcccagaggggca

SEQ ID NO: 8001644 - DNA, 22 bp, Homo sapiens
gcctgggattctcaaaggggtg

SEQ ID NO: 8001645 - DNA, 22 bp, Homo sapiens
gcctggccgggtcttggatttt

SEQ ID NO: 8001646 - DNA, 22 bp, Homo sapiens
gcctggcctgaactaggaggtg

SEQ ID NO: 8001647 - DNA, 22 bp, Homo sapiens
gcctggcctgaactaggaggtg

SEQ ID NO: 8001648 - DNA, 22 bp, Homo sapiens
gcctggccgggtcttggatttt

SEQ ID NO: 8001649 - DNA, 22 bp, Homo sapiens
gcctggcctgaactaggaggtg

SEQ ID NO: 8001650 - DNA, 22 bp, Homo sapiens
gcctggcttttgcctcatgttc

SEQ ID NO: 8001651 - DNA, 22 bp, Homo sapiens
gcctggctaagcagaaggaccc

SEQ ID NO: 8001652 - DNA, 22 bp, Homo sapiens
gcctggcttttgcctcatgttc

SEQ ID NO: 8001653 - DNA, 22 bp, Homo sapiens
gcctggcttttgcctcatgttc

SEQ ID NO: 8001654 - DNA, 22 bp, Homo sapiens
gcctggcttttgcctcatgttc

SEQ ID NO: 8001655 - DNA, 22 bp, Homo sapiens
gcctggcttttgcctcatgttc

SEQ ID NO: 8001656 - DNA, 22 bp, Homo sapiens
gcctggcttttgcctcatgttc

SEQ ID NO: 8001657 - DNA, 22 bp, Homo sapiens
gcctgggaaatggtggggtcag

SEQ ID NO: 8001658 - DNA, 22 bp, Homo sapiens
gcctgggaactctgatctcctg

SEQ ID NO: 8001659 - DNA, 21 bp, Homo sapiens
gcctgggaaatctgggaagcc

SEQ ID NO: 8001660 - DNA, 21 bp, Homo sapiens
gcctgggaaatctgggaagcc

SEQ ID NO: 8001661 - DNA, 22 bp, Homo sapiens
gcctgggaaagagtagggaaat

SEQ ID NO: 8001662 - DNA, 22 bp, Homo sapiens
gcctgggaaagagtagggaaat

SEQ ID NO: 8001663 - DNA, 22 bp, Homo sapiens
gcctgggaaagagtagggaaat

SEQ ID NO: 8001664 - DNA, 21 bp, Homo sapiens
gcctgggaaatctgggaagcc

SEQ ID NO: 8001665 - DNA, 21 bp, Homo sapiens
gcctgggaaatctgggaagcc

SEQ ID NO: 8001666 - DNA, 22 bp, Homo sapiens
gcctggccgctccgagctccgc

SEQ ID NO: 8001667 - DNA, 22 bp, Homo sapiens
gcctggccgctccgagctccgc

SEQ ID NO: 8001668 - DNA, 22 bp, Homo sapiens
gcctggccgctccgagctccgc

SEQ ID NO: 8001669 - DNA, 22 bp, Homo sapiens
gcctggccgctccgagctccgc

SEQ ID NO: 8001670 - DNA, 22 bp, Homo sapiens
gcctggcccagggctcttgttg

SEQ ID NO: 8001671 - DNA, 22 bp, Homo sapiens
gcctggccgctccgagctccgc

SEQ ID NO: 8001672 - DNA, 22 bp, Homo sapiens
gcctggccgctccgagctccgc

SEQ ID NO: 8001673 - DNA, 22 bp, Homo sapiens
gcctggcccagggctccgcagg

SEQ ID NO: 8001674 - DNA, 22 bp, Homo sapiens
gcctggcccagggctccgcagg

SEQ ID NO: 8001675 - DNA, 22 bp, Homo sapiens
gcctggcccagggctccgcagg

SEQ ID NO: 8001676 - DNA, 22 bp, Homo sapiens
gcctggcccagggctcttgttg

SEQ ID NO: 8001677 - DNA, 23 bp, Homo sapiens
gcctggccaccccagggctgctt

SEQ ID NO: 8001678 - DNA, 22 bp, Homo sapiens
gcctggccaacgtggtgaaacc

SEQ ID NO: 8001679 - DNA, 23 bp, Homo sapiens
gcctggccaccccagggctgctt

SEQ ID NO: 8001680 - DNA, 22 bp, Homo sapiens
gcctggccaacgtggtgaaacc

SEQ ID NO: 8001681 - DNA, 23 bp, Homo sapiens
gcctggccaccccagggctgctt

SEQ ID NO: 8001682 - DNA, 17 bp, Homo sapiens
gcctggcccagcctggc

SEQ ID NO: 8001683 - DNA, 17 bp, Homo sapiens
gcctggcccagcctggc

SEQ ID NO: 8001684 - DNA, 17 bp, Homo sapiens
gcctggcccagcctggc

SEQ ID NO: 8001685 - DNA, 17 bp, Homo sapiens
gcctggcccagcctggc

SEQ ID NO: 8001686 - DNA, 17 bp, Homo sapiens
gcctggcccagcctggc

SEQ ID NO: 8001687 - DNA, 22 bp, Homo sapiens
gcctggcagtgatgtcttttgg

SEQ ID NO: 8001688 - DNA, 22 bp, Homo sapiens
gcctggcagtgatgtcttttgg

SEQ ID NO: 8001689 - DNA, 22 bp, Homo sapiens
gcctggcagtggggccctggga

SEQ ID NO: 8001690 - DNA, 21 bp, Homo sapiens
gcctggcaggtggaagggctc

SEQ ID NO: 8001691 - DNA, 21 bp, Homo sapiens
gcctggcaggtggaagggctc

SEQ ID NO: 8001692 - DNA, 21 bp, Homo sapiens
gcctggcaggtggaagggctc

SEQ ID NO: 8001693 - DNA, 21 bp, Homo sapiens
gcctggcaggtggaagggctc

SEQ ID NO: 8001694 - DNA, 22 bp, Homo sapiens
gcctggcaggggcctgggagtg

SEQ ID NO: 8001695 - DNA, 22 bp, Homo sapiens
gcctggcaggggcctgggagtg

SEQ ID NO: 8001696 - DNA, 22 bp, Homo sapiens
gcctggcaggggcctgggagtg

SEQ ID NO: 8001697 - DNA, 22 bp, Homo sapiens
gcctggcaggggcctgggagtg

SEQ ID NO: 8001698 - DNA, 22 bp, Homo sapiens
gcctggcagggcccggacggca

SEQ ID NO: 8001699 - DNA, 22 bp, Homo sapiens
gcctggcattacagcactcctg

SEQ ID NO: 8001700 - DNA, 22 bp, Homo sapiens
gcctggcattacagcactcctg

SEQ ID NO: 8001701 - DNA, 22 bp, Homo sapiens
gcctggcatatagtagttgtgc

SEQ ID NO: 8001702 - DNA, 22 bp, Homo sapiens
gcctggcattacagcactcctg

SEQ ID NO: 8001703 - DNA, 22 bp, Homo sapiens
gcctggcattacagcactcctg

SEQ ID NO: 8001704 - DNA, 22 bp, Homo sapiens
gcctggcattacagcactcctg

SEQ ID NO: 8001705 - DNA, 22 bp, Homo sapiens
gcctggcattggagccggggca

SEQ ID NO: 8001706 - DNA, 22 bp, Homo sapiens
gcctggcattggagccggggca

SEQ ID NO: 8001707 - DNA, 19 bp, Homo sapiens
gcctggcagtgtacaaggc

SEQ ID NO: 8001708 - DNA, 22 bp, Homo sapiens
gcctggcagttgacagtttgct

SEQ ID NO: 8001709 - DNA, 22 bp, Homo sapiens
gcctggcagttgacagtttgct

SEQ ID NO: 8001710 - DNA, 22 bp, Homo sapiens
gcctggcagtggggccctggga

SEQ ID NO: 8001711 - DNA, 22 bp, Homo sapiens
gcctggcagtggggccctggga

SEQ ID NO: 8001712 - DNA, 22 bp, Homo sapiens
gcctggcagtgtaattcctgtc

SEQ ID NO: 8001713 - DNA, 22 bp, Homo sapiens
gcctggcaggcctgttggggct

SEQ ID NO: 8001714 - DNA, 22 bp, Homo sapiens
gcctggcaggcctgttggggct

SEQ ID NO: 8001715 - DNA, 22 bp, Homo sapiens
gcctggcagggcccggacggca

SEQ ID NO: 8001716 - DNA, 22 bp, Homo sapiens
gcctggcagggcccggacggca

SEQ ID NO: 8001717 - DNA, 22 bp, Homo sapiens
gcctggcagggagattgtaaga

SEQ ID NO: 8001718 - DNA, 22 bp, Homo sapiens
gcctggcaggcctgggccagca

SEQ ID NO: 8001719 - DNA, 22 bp, Homo sapiens
gcctggcaggcctgggccagca

SEQ ID NO: 8001720 - DNA, 22 bp, Homo sapiens
gcctggcaggcctgggccagca

SEQ ID NO: 8001721 - DNA, 22 bp, Homo sapiens
gcctggagtagcatggcaagcc

SEQ ID NO: 8001722 - DNA, 22 bp, Homo sapiens
gcctggagtactccttgaagtg

SEQ ID NO: 8001723 - DNA, 22 bp, Homo sapiens
gcctggagtactccttgaagtg

SEQ ID NO: 8001724 - DNA, 22 bp, Homo sapiens
gcctggagtactccttgaagtg

SEQ ID NO: 8001725 - DNA, 22 bp, Homo sapiens
gcctggagtagcatggcaagcc

SEQ ID NO: 8001726 - DNA, 22 bp, Homo sapiens
gcctggagtagcatggcaagcc

SEQ ID NO: 8001727 - DNA, 22 bp, Homo sapiens
gcctggagtagcatggcaagcc

SEQ ID NO: 8001728 - DNA, 22 bp, Homo sapiens
gcctggagtagcatggcaagcc

SEQ ID NO: 8001729 - DNA, 22 bp, Homo sapiens
gcctggagtactccttgaagtg

SEQ ID NO: 8001730 - DNA, 22 bp, Homo sapiens
gcctggagtactccttgaagtg

SEQ ID NO: 8001731 - DNA, 22 bp, Homo sapiens
gcctggagcctcagcaaggagg

SEQ ID NO: 8001732 - DNA, 22 bp, Homo sapiens
gcctggacaccgcccttgcaga

SEQ ID NO: 8001733 - DNA, 22 bp, Homo sapiens
gcctggacaccgcccttgcaga

SEQ ID NO: 8001734 - DNA, 22 bp, Homo sapiens
gcctggagcctcagcaaggagg

SEQ ID NO: 8001735 - DNA, 22 bp, Homo sapiens
gcctggagcctcagcaaggagg

SEQ ID NO: 8001736 - DNA, 22 bp, Homo sapiens
gcctggagcctcagcaaggagg

SEQ ID NO: 8001737 - DNA, 22 bp, Homo sapiens
gcctggagcctcagcaaggagg

SEQ ID NO: 8001738 - DNA, 22 bp, Homo sapiens
gcctggagcctcagcaaggagg

SEQ ID NO: 8001739 - DNA, 20 bp, Homo sapiens
gcctggaggcaatgggaaga

SEQ ID NO: 8001740 - DNA, 22 bp, Homo sapiens
gcctggaggcgagaacccaatg

SEQ ID NO: 8001741 - DNA, 20 bp, Homo sapiens
gcctggaggcagagataaag

SEQ ID NO: 8001742 - DNA, 20 bp, Homo sapiens
gcctggaggcagagataaag

SEQ ID NO: 8001743 - DNA, 20 bp, Homo sapiens
gcctggaggcagagataaag

SEQ ID NO: 8001744 - DNA, 22 bp, Homo sapiens
gcctggagggatagaatgcaag

SEQ ID NO: 8001745 - DNA, 22 bp, Homo sapiens
gcctggagggctctagagaggc

SEQ ID NO: 8001746 - DNA, 22 bp, Homo sapiens
gcctggagggatagaatgcaag

SEQ ID NO: 8001747 - DNA, 22 bp, Homo sapiens
gcctggaggggccagggtggta

SEQ ID NO: 8001748 - DNA, 22 bp, Homo sapiens
gcctggaggggccagggtggta

SEQ ID NO: 8001749 - DNA, 22 bp, Homo sapiens
gcctggaggggccagggtggta

SEQ ID NO: 8001750 - DNA, 22 bp, Homo sapiens
gcctggaggggccagggtggta

SEQ ID NO: 8001751 - DNA, 22 bp, Homo sapiens
gcctggaggggccagggtggta

SEQ ID NO: 8001752 - DNA, 22 bp, Homo sapiens
gcctggaggggccagggtggta

SEQ ID NO: 8001753 - DNA, 22 bp, Homo sapiens
gcctggaggggccagggtggta

SEQ ID NO: 8001754 - DNA, 22 bp, Homo sapiens
gcctggagggtccctctctgga

SEQ ID NO: 8001755 - DNA, 22 bp, Homo sapiens
gcctggagggtccctctctgga

SEQ ID NO: 8001756 - DNA, 22 bp, Homo sapiens
gcctggagggtccctctctgga

SEQ ID NO: 8001757 - DNA, 22 bp, Homo sapiens
gcctggagggtccctctctgga

SEQ ID NO: 8001758 - DNA, 22 bp, Homo sapiens
gcctggaggggccagggtggta

SEQ ID NO: 8001759 - DNA, 22 bp, Homo sapiens
gcctggaggggacagtctctgg

SEQ ID NO: 8001760 - DNA, 22 bp, Homo sapiens
gcctggaggggccagggtggta

SEQ ID NO: 8001761 - DNA, 22 bp, Homo sapiens
gcctggaggggacagtctctgg

SEQ ID NO: 8001762 - DNA, 22 bp, Homo sapiens
gcctggaggggacagtctctgg

SEQ ID NO: 8001763 - DNA, 22 bp, Homo sapiens
gcctggagggctctagagaggc

SEQ ID NO: 8001764 - DNA, 22 bp, Homo sapiens
gcctggagggctctagagaggc

SEQ ID NO: 8001765 - DNA, 22 bp, Homo sapiens
gcctggagggctctagagaggc

SEQ ID NO: 8001766 - DNA, 22 bp, Homo sapiens
gcctggagggctctagagaggc

SEQ ID NO: 8001767 - DNA, 22 bp, Homo sapiens
gcctggagggctctagagaggc

SEQ ID NO: 8001768 - DNA, 22 bp, Homo sapiens
gcctgcttcctagccttccaag

SEQ ID NO: 8001769 - DNA, 22 bp, Homo sapiens
gcctgcttccttttcatagatg

SEQ ID NO: 8001770 - DNA, 22 bp, Homo sapiens
gcctggaaacagtgagcgaagg

SEQ ID NO: 8001771 - DNA, 22 bp, Homo sapiens
gcctggaagtgtgtcgtgggaa

SEQ ID NO: 8001772 - DNA, 22 bp, Homo sapiens
gcctggaatcatgcaggggtta

SEQ ID NO: 8001773 - DNA, 22 bp, Homo sapiens
gcctggaatgcaatgtgacgaa

SEQ ID NO: 8001774 - DNA, 22 bp, Homo sapiens
gcctggaagtccagagtacatt

SEQ ID NO: 8001775 - DNA, 22 bp, Homo sapiens
gcctggaaattgaggcacagtt

SEQ ID NO: 8001776 - DNA, 22 bp, Homo sapiens
gcctgctgttaactgcaggaat

SEQ ID NO: 8001777 - DNA, 22 bp, Homo sapiens
gcctgctgttaactgcaggaat

SEQ ID NO: 8001778 - DNA, 22 bp, Homo sapiens
gcctgctgttaactgcaggaat

SEQ ID NO: 8001779 - DNA, 21 bp, Homo sapiens
gcctgctgttcaccctgccac

SEQ ID NO: 8001780 - DNA, 22 bp, Homo sapiens
gcctgctgttaactgcaggaat

SEQ ID NO: 8001781 - DNA, 22 bp, Homo sapiens
gcctgctgttgagggaagagct

SEQ ID NO: 8001782 - DNA, 22 bp, Homo sapiens
gcctgctgttgagggaagagct

SEQ ID NO: 8001783 - DNA, 22 bp, Homo sapiens
gcctgctgttgagggaagagct

SEQ ID NO: 8001784 - DNA, 22 bp, Homo sapiens
gcctgctgttgagggaagagct

SEQ ID NO: 8001785 - DNA, 21 bp, Homo sapiens
gcctgctgttcaccctgccac

SEQ ID NO: 8001786 - DNA, 21 bp, Homo sapiens
gcctgctgttcaccctgccac

SEQ ID NO: 8001787 - DNA, 22 bp, Homo sapiens
gcctgccttttggaggcacatt

SEQ ID NO: 8001788 - DNA, 22 bp, Homo sapiens
gcctgctcagacctagcaggcc

SEQ ID NO: 8001789 - DNA, 22 bp, Homo sapiens
gcctgctcagacctagcaggcc

SEQ ID NO: 8001790 - DNA, 22 bp, Homo sapiens
gcctgctcagacctagcaggcc

SEQ ID NO: 8001791 - DNA, 22 bp, Homo sapiens
gcctgctctccggatccctgat

SEQ ID NO: 8001792 - DNA, 23 bp, Homo sapiens
gcctgctgtcacagcgggcccag

SEQ ID NO: 8001793 - DNA, 23 bp, Homo sapiens
gcctgctgtcacagcgggcccag

SEQ ID NO: 8001794 - DNA, 22 bp, Homo sapiens
gcctgctctgacatccatccca

SEQ ID NO: 8001795 - DNA, 22 bp, Homo sapiens
gcctgccttttggaggcacatt

SEQ ID NO: 8001796 - DNA, 22 bp, Homo sapiens
gcctgcctttgtgaggaagcgg

SEQ ID NO: 8001797 - DNA, 22 bp, Homo sapiens
gcctgcctttgtgaggaagcgg

SEQ ID NO: 8001798 - DNA, 22 bp, Homo sapiens
gcctgcctttgtgaggaagcgg

SEQ ID NO: 8001799 - DNA, 22 bp, Homo sapiens
gcctgcctttgtgaggaagcgg

SEQ ID NO: 8001800 - DNA, 22 bp, Homo sapiens
gcctgccttttggaggcacatt

SEQ ID NO: 8001801 - DNA, 22 bp, Homo sapiens
gcctgccttttggaggcacatt

SEQ ID NO: 8001802 - DNA, 22 bp, Homo sapiens
gcctgccttttggaggcacatt

SEQ ID NO: 8001803 - DNA, 22 bp, Homo sapiens
gcctgccttttggaggcacatt

SEQ ID NO: 8001804 - DNA, 22 bp, Homo sapiens
gcctgccacgcatgcagagtca

SEQ ID NO: 8001805 - DNA, 18 bp, Homo sapiens
gcctgccaactcctgatc

SEQ ID NO: 8001806 - DNA, 22 bp, Homo sapiens
gcctgccacgcatgcagagtca

SEQ ID NO: 8001807 - DNA, 23 bp, Homo sapiens
gcctctggagccccagtgctcag

SEQ ID NO: 8001808 - DNA, 23 bp, Homo sapiens
gcctctggagccccagtgctcag

SEQ ID NO: 8001809 - DNA, 22 bp, Homo sapiens
gcctgccaaaagaagctgctgg

SEQ ID NO: 8001810 - DNA, 22 bp, Homo sapiens
gcctgccagtgtttgaggattg

SEQ ID NO: 8001811 - DNA, 22 bp, Homo sapiens
gcctgccagtgtttgaggattg

SEQ ID NO: 8001812 - DNA, 23 bp, Homo sapiens
gcctgccatatacctggaaacag

SEQ ID NO: 8001813 - DNA, 22 bp, Homo sapiens
gcctgccagccacagtggcagc

SEQ ID NO: 8001814 - DNA, 22 bp, Homo sapiens
gcctgccagccacagtggcagc

SEQ ID NO: 8001815 - DNA, 18 bp, Homo sapiens
gcctgccagccgagggac

SEQ ID NO: 8001816 - DNA, 18 bp, Homo sapiens
gcctgccagccgagggac

SEQ ID NO: 8001817 - DNA, 17 bp, Homo sapiens
gcctctgcttgtgtcat

SEQ ID NO: 8001818 - DNA, 22 bp, Homo sapiens
gcctctggaagaattacatcca

SEQ ID NO: 8001819 - DNA, 17 bp, Homo sapiens
gcctctgcttgtgtcat

SEQ ID NO: 8001820 - DNA, 22 bp, Homo sapiens
gcctctggaagtgggaaggggt

SEQ ID NO: 8001821 - DNA, 22 bp, Homo sapiens
gcctctggaagtgggaaggggt

SEQ ID NO: 8001822 - DNA, 23 bp, Homo sapiens
gcctctggagccccagtgctcag

SEQ ID NO: 8001823 - DNA, 23 bp, Homo sapiens
gcctctggagccccagtgctcag

SEQ ID NO: 8001824 - DNA, 23 bp, Homo sapiens
gcctctggagccccagtgctcag

SEQ ID NO: 8001825 - DNA, 20 bp, Homo sapiens
gcctctggagccaaggacca

SEQ ID NO: 8001826 - DNA, 20 bp, Homo sapiens
gcctctggagccaaggacca

SEQ ID NO: 8001827 - DNA, 20 bp, Homo sapiens
gcctctggagccaaggacca

SEQ ID NO: 8001828 - DNA, 20 bp, Homo sapiens
gcctctggagccaaggacca

SEQ ID NO: 8001829 - DNA, 20 bp, Homo sapiens
gcctgcctcagctagctgag

SEQ ID NO: 8001830 - DNA, 20 bp, Homo sapiens
gcctgcctcagctagctgag

SEQ ID NO: 8001831 - DNA, 22 bp, Homo sapiens
gcctgcctcaaaatcccagttc

SEQ ID NO: 8001832 - DNA, 20 bp, Homo sapiens
gcctgcctcagctagctgag

SEQ ID NO: 8001833 - DNA, 20 bp, Homo sapiens
gcctgcctcagctagctgag

SEQ ID NO: 8001834 - DNA, 18 bp, Homo sapiens
gcctgcctagagcttgcc

SEQ ID NO: 8001835 - DNA, 18 bp, Homo sapiens
gcctgcctagagcttgcc

SEQ ID NO: 8001836 - DNA, 22 bp, Homo sapiens
gcctgcctcaaaatcccagttc

SEQ ID NO: 8001837 - DNA, 22 bp, Homo sapiens
gcctgcctcaaaatcccagttc

SEQ ID NO: 8001838 - DNA, 22 bp, Homo sapiens
gcctgcctcaaaatcccagttc

SEQ ID NO: 8001839 - DNA, 20 bp, Homo sapiens
gcctgcctcagctagctgag

SEQ ID NO: 8001840 - DNA, 20 bp, Homo sapiens
gcctgcctcagctagctgag

SEQ ID NO: 8001841 - DNA, 20 bp, Homo sapiens
gcctgcctcagctagctgag

SEQ ID NO: 8001842 - DNA, 22 bp, Homo sapiens
gcctgcctgaaggctgtaccag

SEQ ID NO: 8001843 - DNA, 22 bp, Homo sapiens
gcctgcctgaaggctgtaccag

SEQ ID NO: 8001844 - DNA, 23 bp, Homo sapiens
gcctgcctgacctgtgcaaagtc

SEQ ID NO: 8001845 - DNA, 22 bp, Homo sapiens
gcctgcctgaaggctgtaccag

SEQ ID NO: 8001846 - DNA, 22 bp, Homo sapiens
gcctgcctgaaggctgtaccag

SEQ ID NO: 8001847 - DNA, 23 bp, Homo sapiens
gcctgcctgacctgtgcaaagtc

SEQ ID NO: 8001848 - DNA, 22 bp, Homo sapiens
gcctgccttcggtgcgcagcgg

SEQ ID NO: 8001849 - DNA, 22 bp, Homo sapiens
gcctgccttcggtgcgcagcgg

SEQ ID NO: 8001850 - DNA, 22 bp, Homo sapiens
gcctgccttcggtgcgcagcgg

SEQ ID NO: 8001851 - DNA, 22 bp, Homo sapiens
gcctgccttcggtgcgcagcgg

SEQ ID NO: 8001852 - DNA, 22 bp, Homo sapiens
gcctgccttcggtgcgcagcgg

SEQ ID NO: 8001853 - DNA, 22 bp, Homo sapiens
gcctgccttcggtgcgcagcgg

SEQ ID NO: 8001854 - DNA, 22 bp, Homo sapiens
gcctgccttcggtgcgcagcgg

SEQ ID NO: 8001855 - DNA, 22 bp, Homo sapiens
gcctgcctttgtatgaccctga

SEQ ID NO: 8001856 - DNA, 22 bp, Homo sapiens
gcctgcctttgtatgaccctga

SEQ ID NO: 8001857 - DNA, 22 bp, Homo sapiens
gcctgcctttgtatgaccctga

SEQ ID NO: 8001858 - DNA, 22 bp, Homo sapiens
gcctgcctttgtatgaccctga

SEQ ID NO: 8001859 - DNA, 22 bp, Homo sapiens
gcctgcctttgtgaggaagcgg

SEQ ID NO: 8001860 - DNA, 22 bp, Homo sapiens
gcctgcctgttggctgaggtgc

SEQ ID NO: 8001861 - DNA, 22 bp, Homo sapiens
gcctgccttcggtgcgcagcgg

SEQ ID NO: 8001862 - DNA, 22 bp, Homo sapiens
gcctgcctgttggctgaggtgc

SEQ ID NO: 8001863 - DNA, 22 bp, Homo sapiens
gcctgcctgttggctgaggtgc

SEQ ID NO: 8001864 - DNA, 22 bp, Homo sapiens
gcctgcctgttggctgaggtgc

SEQ ID NO: 8001865 - DNA, 19 bp, Homo sapiens
gcctgcctgggtttctgag

SEQ ID NO: 8001866 - DNA, 22 bp, Homo sapiens
gcctgcctgttggctgaggtgc

SEQ ID NO: 8001867 - DNA, 22 bp, Homo sapiens
gcctgcctgttggctgaggtgc

SEQ ID NO: 8001868 - DNA, 19 bp, Homo sapiens
gcctgcctgggtttctgag

SEQ ID NO: 8001869 - DNA, 19 bp, Homo sapiens
gcctgcctgggtttctgag

SEQ ID NO: 8001870 - DNA, 19 bp, Homo sapiens
gcctgcctgggtttctgag

SEQ ID NO: 8001871 - DNA, 22 bp, Homo sapiens
gcctgcctggagcttgaggtga

SEQ ID NO: 8001872 - DNA, 22 bp, Homo sapiens
gcctgcctggagcttgaggtga

SEQ ID NO: 8001873 - DNA, 22 bp, Homo sapiens
gcctgcctgctgtgtgcaagtt

SEQ ID NO: 8001874 - DNA, 22 bp, Homo sapiens
gcctgcctgctgtgtgcaagtt

SEQ ID NO: 8001875 - DNA, 22 bp, Homo sapiens
gcctgcctgctgtgtgcaagtt

SEQ ID NO: 8001876 - DNA, 22 bp, Homo sapiens
gcctgcctgctgtgtgcaagtt

SEQ ID NO: 8001877 - DNA, 22 bp, Homo sapiens
gcctgcctggagcttgaggtga

SEQ ID NO: 8001878 - DNA, 22 bp, Homo sapiens
gcctgcctgctgtgtgcaagtt

SEQ ID NO: 8001879 - DNA, 22 bp, Homo sapiens
gcctgcctgctgtcatctgcct

SEQ ID NO: 8001880 - DNA, 22 bp, Homo sapiens
gcctgcctgctgtcatctgcct

SEQ ID NO: 8001881 - DNA, 22 bp, Homo sapiens
gcctgcctgctgtcatctgcct

SEQ ID NO: 8001882 - DNA, 21 bp, Homo sapiens
gcctgcctgcgtgaccctctt

SEQ ID NO: 8001883 - DNA, 21 bp, Homo sapiens
gcctgcctgcgtgaccctctt

SEQ ID NO: 8001884 - DNA, 21 bp, Homo sapiens
gcctgcctgcgtgaccctctt

SEQ ID NO: 8001885 - DNA, 22 bp, Homo sapiens
gcctgcctgctgtcatctgcct

SEQ ID NO: 8001886 - DNA, 22 bp, Homo sapiens
gcctgcctgctgtcatctgcct

SEQ ID NO: 8001887 - DNA, 22 bp, Homo sapiens
gctgagctgaggcagggctggg

SEQ ID NO: 8001888 - DNA, 22 bp, Homo sapiens
gctgagctcccagcagtatctg

SEQ ID NO: 8001889 - DNA, 22 bp, Homo sapiens
gctgagctcccagcagtatctg

SEQ ID NO: 8001890 - DNA, 22 bp, Homo sapiens
gctgagcctagctgtctcctgt

SEQ ID NO: 8001891 - DNA, 22 bp, Homo sapiens
gctgaggatatagcaggaacaa

SEQ ID NO: 8001892 - DNA, 22 bp, Homo sapiens
gctgagctcccagcagtatctg

SEQ ID NO: 8001893 - DNA, 22 bp, Homo sapiens
gctgaggatatagcaggaacaa

SEQ ID NO: 8001894 - DNA, 22 bp, Homo sapiens
gctgaggaggtgtggttaggtg

SEQ ID NO: 8001895 - DNA, 22 bp, Homo sapiens
gctgagctagctatctcagtct

SEQ ID NO: 8001896 - DNA, 22 bp, Homo sapiens
gctgagctagaaaaggaccaca

SEQ ID NO: 8001897 - DNA, 22 bp, Homo sapiens
gctgagctagctatctcagtct

SEQ ID NO: 8001898 - DNA, 22 bp, Homo sapiens
gctgagctagaaaaggaccaca

SEQ ID NO: 8001899 - DNA, 22 bp, Homo sapiens
gctgagctagaaaaggaccaca

SEQ ID NO: 8001900 - DNA, 22 bp, Homo sapiens
gctgagcctagctgtctcctgt

SEQ ID NO: 8001901 - DNA, 22 bp, Homo sapiens
gctgagctagaaaaggaccaca

SEQ ID NO: 8001902 - DNA, 22 bp, Homo sapiens
gctgagccctcatccctagttt

SEQ ID NO: 8001903 - DNA, 22 bp, Homo sapiens
gctgagcctagctgtctcctgt

SEQ ID NO: 8001904 - DNA, 22 bp, Homo sapiens
gctgagccctcatccctagttt

SEQ ID NO: 8001905 - DNA, 22 bp, Homo sapiens
gctgagcccccctgcgtgggtc

SEQ ID NO: 8001906 - DNA, 22 bp, Homo sapiens
gctgagccatgaggcctcttgc

SEQ ID NO: 8001907 - DNA, 22 bp, Homo sapiens
gctgagccctcatccctagttt

SEQ ID NO: 8001908 - DNA, 22 bp, Homo sapiens
gctgagccatgaggcctcttgc

SEQ ID NO: 8001909 - DNA, 22 bp, Homo sapiens
gctgagccatgaggcctcttgc

SEQ ID NO: 8001910 - DNA, 22 bp, Homo sapiens
gctgagcccccctgcgtgggtc

SEQ ID NO: 8001911 - DNA, 22 bp, Homo sapiens
gctgagccatgaggcctcttgc

SEQ ID NO: 8001912 - DNA, 22 bp, Homo sapiens
gctgagccacccttgcttccct

SEQ ID NO: 8001913 - DNA, 22 bp, Homo sapiens
gctgagccacccttgcttccct

SEQ ID NO: 8001914 - DNA, 22 bp, Homo sapiens
gctgagccacaggcagtgcact

SEQ ID NO: 8001915 - DNA, 22 bp, Homo sapiens
gctgagccacaggcagtgcact

SEQ ID NO: 8001916 - DNA, 22 bp, Homo sapiens
gctgagccacaggcagtgcact

SEQ ID NO: 8001917 - DNA, 22 bp, Homo sapiens
gctgagccacaggcagtgcact

SEQ ID NO: 8001918 - DNA, 22 bp, Homo sapiens
gctgagccacaggcagtgcact

SEQ ID NO: 8001919 - DNA, 22 bp, Homo sapiens
gctgagccacaggcagtgcact

SEQ ID NO: 8001920 - DNA, 22 bp, Homo sapiens
gctgagcaggtttgatgctttt

SEQ ID NO: 8001921 - DNA, 22 bp, Homo sapiens
gctgagcaggtttgatgctttt

SEQ ID NO: 8001922 - DNA, 22 bp, Homo sapiens
gctgagcaggtgtaaggaaggc

SEQ ID NO: 8001923 - DNA, 22 bp, Homo sapiens
gctgaggattacttgaagtcag

SEQ ID NO: 8001924 - DNA, 20 bp, Homo sapiens
gctgaggattcctggcccct

SEQ ID NO: 8001925 - DNA, 20 bp, Homo sapiens
gctgaggattcctggcccct

SEQ ID NO: 8001926 - DNA, 22 bp, Homo sapiens
gctgaggattgaagagttgcca

SEQ ID NO: 8001927 - DNA, 22 bp, Homo sapiens
gctgaggattgaagagttgcca

SEQ ID NO: 8001928 - DNA, 22 bp, Homo sapiens
gctgaggatatagcaggaacaa

SEQ ID NO: 8001929 - DNA, 22 bp, Homo sapiens
gctgaggatatagcaggaacaa

SEQ ID NO: 8001930 - DNA, 22 bp, Homo sapiens
gctgaggatatagcaggaacaa

SEQ ID NO: 8001931 - DNA, 22 bp, Homo sapiens
gctgaggattacttgaagtcag

SEQ ID NO: 8001932 - DNA, 22 bp, Homo sapiens
gctgaggattacttgaagtcag

SEQ ID NO: 8001933 - DNA, 22 bp, Homo sapiens
gctgaggattacttgaagtcag

SEQ ID NO: 8001934 - DNA, 22 bp, Homo sapiens
gctgaggcaagatttgaaccca

SEQ ID NO: 8001935 - DNA, 22 bp, Homo sapiens
gctgaggcaaatagttttaagt

SEQ ID NO: 8001936 - DNA, 22 bp, Homo sapiens
gctgaggcaaaccaagaatgta

SEQ ID NO: 8001937 - DNA, 22 bp, Homo sapiens
gctgaggcaaaccaagaatgta

SEQ ID NO: 8001938 - DNA, 22 bp, Homo sapiens
gctgaggcaaaccaagaatgta

SEQ ID NO: 8001939 - DNA, 22 bp, Homo sapiens
gctgcctgatcatacaccaggg

SEQ ID NO: 8001940 - DNA, 22 bp, Homo sapiens
gctgcctgatcatacaccaggg

SEQ ID NO: 8001941 - DNA, 22 bp, Homo sapiens
gctgcctgatcatacaccaggg

SEQ ID NO: 8001942 - DNA, 22 bp, Homo sapiens
gctgaggccaggccccaccgga

SEQ ID NO: 8001943 - DNA, 22 bp, Homo sapiens
gctgaggcagtccacccttgtg

SEQ ID NO: 8001944 - DNA, 22 bp, Homo sapiens
gctgaggcagtccacccttgtg

SEQ ID NO: 8001945 - DNA, 22 bp, Homo sapiens
gctgcctggagaggcagggatg

SEQ ID NO: 8001946 - DNA, 22 bp, Homo sapiens
gctgcctggagaggcagggatg

SEQ ID NO: 8001947 - DNA, 22 bp, Homo sapiens
gctgcctggagaggcagggatg

SEQ ID NO: 8001948 - DNA, 22 bp, Homo sapiens
gctgcctggagaggcagggatg

SEQ ID NO: 8001949 - DNA, 22 bp, Homo sapiens
gctgcctggagaggcagggatg

SEQ ID NO: 8001950 - DNA, 22 bp, Homo sapiens
gctgcctggaataacggctggc

SEQ ID NO: 8001951 - DNA, 22 bp, Homo sapiens
gctgcctggagaggcagggatg

SEQ ID NO: 8001952 - DNA, 22 bp, Homo sapiens
gctgcctggaataacggctggc

SEQ ID NO: 8001953 - DNA, 22 bp, Homo sapiens
gctgcctggagctcagcctgcc

SEQ ID NO: 8001954 - DNA, 22 bp, Homo sapiens
gctgcctggagctcagcctgcc

SEQ ID NO: 8001955 - DNA, 22 bp, Homo sapiens
gctgcctggagctcagcctgcc

SEQ ID NO: 8001956 - DNA, 22 bp, Homo sapiens
gctgcctggagctcagcctgcc

SEQ ID NO: 8001957 - DNA, 22 bp, Homo sapiens
gctgcctggagctcagcctgcc

SEQ ID NO: 8001958 - DNA, 22 bp, Homo sapiens
gctgcctggagaggcagggatg

SEQ ID NO: 8001959 - DNA, 22 bp, Homo sapiens
gctgcctggagaggcagggatg

SEQ ID NO: 8001960 - DNA, 22 bp, Homo sapiens
gctgcctggagaggcagggatg

SEQ ID NO: 8001961 - DNA, 22 bp, Homo sapiens
gctgcctggagctcagcctgcc

SEQ ID NO: 8001962 - DNA, 22 bp, Homo sapiens
gctgcctggctttagtccactt

SEQ ID NO: 8001963 - DNA, 22 bp, Homo sapiens
gctgcctggctttagtccactt

SEQ ID NO: 8001964 - DNA, 22 bp, Homo sapiens
gctgcctggctttagtccactt

SEQ ID NO: 8001965 - DNA, 22 bp, Homo sapiens
gctgcctggctttagtccactt

SEQ ID NO: 8001966 - DNA, 22 bp, Homo sapiens
gctgcctgggcaggaggcgctg

SEQ ID NO: 8001967 - DNA, 22 bp, Homo sapiens
gctgcctggatttgcaatcctc

SEQ ID NO: 8001968 - DNA, 22 bp, Homo sapiens
gctgcctgggcaggaggcgctg

SEQ ID NO: 8001969 - DNA, 22 bp, Homo sapiens
gctgcctgggcaggaggcgctg

SEQ ID NO: 8001970 - DNA, 22 bp, Homo sapiens
gctgcctggatttgcaatcctc

SEQ ID NO: 8001971 - DNA, 22 bp, Homo sapiens
gctgcctggatttgcaatcctc

SEQ ID NO: 8001972 - DNA, 22 bp, Homo sapiens
gctgcctggagctcagcctgcc

SEQ ID NO: 8001973 - DNA, 22 bp, Homo sapiens
gctgcctggagctcagcctgcc

SEQ ID NO: 8001974 - DNA, 22 bp, Homo sapiens
gctgcctggagctcagcctgcc

SEQ ID NO: 8001975 - DNA, 22 bp, Homo sapiens
gctgcctgcttcatgtgggaga

SEQ ID NO: 8001976 - DNA, 22 bp, Homo sapiens
gctgcctgcttcatgtgggaga

SEQ ID NO: 8001977 - DNA, 22 bp, Homo sapiens
gctgcctgctcggctcctggga

SEQ ID NO: 8001978 - DNA, 22 bp, Homo sapiens
gctgcctgcttcatgtgggaga

SEQ ID NO: 8001979 - DNA, 22 bp, Homo sapiens
gctgcctgcttcatgtgggaga

SEQ ID NO: 8001980 - DNA, 22 bp, Homo sapiens
gctgcctggaataacggctggc

SEQ ID NO: 8001981 - DNA, 22 bp, Homo sapiens
gctgcctggaataacggctggc

SEQ ID NO: 8001982 - DNA, 22 bp, Homo sapiens
gctgcctggaataacggctggc

SEQ ID NO: 8001983 - DNA, 22 bp, Homo sapiens
gctgcctggaataacggctggc

SEQ ID NO: 8001984 - DNA, 22 bp, Homo sapiens
gctgcctgctcggctcctggga

SEQ ID NO: 8001985 - DNA, 22 bp, Homo sapiens
gctgcctgctcggctcctggga

SEQ ID NO: 8001986 - DNA, 22 bp, Homo sapiens
gctgcctgctcggctcctggga

SEQ ID NO: 8001987 - DNA, 22 bp, Homo sapiens
gctgcctgctcggctcctggga

SEQ ID NO: 8001988 - DNA, 22 bp, Homo sapiens
gctgcctgctcggctcctggga

SEQ ID NO: 8001989 - DNA, 22 bp, Homo sapiens
gctgcctgctcggctcctggga

SEQ ID NO: 8001990 - DNA, 22 bp, Homo sapiens
gctgcctgctcggctcctggga

SEQ ID NO: 8001991 - DNA, 22 bp, Homo sapiens
gctgcctgccttgcctggagga

SEQ ID NO: 8001992 - DNA, 22 bp, Homo sapiens
gctgcctgccttgcctggagga

SEQ ID NO: 8001993 - DNA, 22 bp, Homo sapiens
gctgcctgccttgcctggagga

SEQ ID NO: 8001994 - DNA, 22 bp, Homo sapiens
gctgcctgctcacccggcctgg

SEQ ID NO: 8001995 - DNA, 22 bp, Homo sapiens
gctgcctgctcacccggcctgg

SEQ ID NO: 8001996 - DNA, 22 bp, Homo sapiens
gctgcctgctcacccggcctgg

SEQ ID NO: 8001997 - DNA, 22 bp, Homo sapiens
gctgcctgctcacccggcctgg

SEQ ID NO: 8001998 - DNA, 22 bp, Homo sapiens
gctgcctgctcacccggcctgg

SEQ ID NO: 8001999 - DNA, 22 bp, Homo sapiens
gctgcctgatgtccagcaggac

SEQ ID NO: 8002000 - DNA, 22 bp, Homo sapiens
gctgcctgatgtccagcaggac

SEQ ID NO: 8002001 - DNA, 22 bp, Homo sapiens
gctgcctgatgtccagcaggac

SEQ ID NO: 8002002 - DNA, 22 bp, Homo sapiens
gctgcctgatgtccagcaggac

SEQ ID NO: 8002003 - DNA, 22 bp, Homo sapiens
gctgcctgatgtccagcaggac

SEQ ID NO: 8002004 - DNA, 22 bp, Homo sapiens
gctgcctgatcatacaccaggg

SEQ ID NO: 8002005 - DNA, 22 bp, Homo sapiens
gctgctctgttaattgctgtaa

SEQ ID NO: 8002006 - DNA, 22 bp, Homo sapiens
gctgctcttgaggggctcactg

SEQ ID NO: 8002007 - DNA, 22 bp, Homo sapiens
gctgctcttgaggggctcactg

SEQ ID NO: 8002008 - DNA, 22 bp, Homo sapiens
gctgctcttgaggggctcactg

SEQ ID NO: 8002009 - DNA, 22 bp, Homo sapiens
gctgctctgttaattgctgtaa

SEQ ID NO: 8002010 - DNA, 22 bp, Homo sapiens
gctgctctgtgacagcctccgg

SEQ ID NO: 8002011 - DNA, 22 bp, Homo sapiens
gctgctctgtgacagcctccgg

SEQ ID NO: 8002012 - DNA, 22 bp, Homo sapiens
gctgctctgtgacagcctccgg

SEQ ID NO: 8002013 - DNA, 22 bp, Homo sapiens
gctgctctgggtctgcccagct

SEQ ID NO: 8002014 - DNA, 22 bp, Homo sapiens
gctgctctgggtctgcccagct

SEQ ID NO: 8002015 - DNA, 22 bp, Homo sapiens
gctgctctgggtctgcccagct

SEQ ID NO: 8002016 - DNA, 22 bp, Homo sapiens
gctgctctgggtctgcccagct

SEQ ID NO: 8002017 - DNA, 22 bp, Homo sapiens
gctgctctgggtctgcccagct

SEQ ID NO: 8002018 - DNA, 22 bp, Homo sapiens
gctgctctgggtctgcccagct

SEQ ID NO: 8002019 - DNA, 22 bp, Homo sapiens
gctgctctgggtctgcccagct

SEQ ID NO: 8002020 - DNA, 22 bp, Homo sapiens
gctgctgccgcggccgctggga

SEQ ID NO: 8002021 - DNA, 22 bp, Homo sapiens
gctgctgccgcggccgctggga

SEQ ID NO: 8002022 - DNA, 21 bp, Homo sapiens
gctgctgcccctagtgaggcc

SEQ ID NO: 8002023 - DNA, 21 bp, Homo sapiens
gctgctgcccctagtgaggcc

SEQ ID NO: 8002024 - DNA, 22 bp, Homo sapiens
gctgctgcatgaacagcggtca

SEQ ID NO: 8002025 - DNA, 22 bp, Homo sapiens
gctgctgcatgaacagcggtca

SEQ ID NO: 8002026 - DNA, 22 bp, Homo sapiens
gctgctcttttcagagatgaga

SEQ ID NO: 8002027 - DNA, 20 bp, Homo sapiens
gctgctgagcttccctgggg

SEQ ID NO: 8002028 - DNA, 22 bp, Homo sapiens
gctgctgatgggcagggagtcg

SEQ ID NO: 8002029 - DNA, 22 bp, Homo sapiens
gctgctgagctgcaggagtagg

SEQ ID NO: 8002030 - DNA, 22 bp, Homo sapiens
gctgctgagctgcaggagtagg

SEQ ID NO: 8002031 - DNA, 22 bp, Homo sapiens
gctgctgcaagagccagctctt

SEQ ID NO: 8002032 - DNA, 22 bp, Homo sapiens
gctgctgctggtctggggccac

SEQ ID NO: 8002033 - DNA, 22 bp, Homo sapiens
gctgctgctggtctggggccac

SEQ ID NO: 8002034 - DNA, 22 bp, Homo sapiens
gctgctgctggtctggggccac

SEQ ID NO: 8002035 - DNA, 22 bp, Homo sapiens
gctgctgctgaggatgcacctg

SEQ ID NO: 8002036 - DNA, 19 bp, Homo sapiens
gctgctgctcctccctcgc

SEQ ID NO: 8002037 - DNA, 22 bp, Homo sapiens
gctgctgcgcttgtctactgtt

SEQ ID NO: 8002038 - DNA, 22 bp, Homo sapiens
gctgctgcgcttgtctactgtt

SEQ ID NO: 8002039 - DNA, 19 bp, Homo sapiens
gctgctgctcctccctcgc

SEQ ID NO: 8002040 - DNA, 22 bp, Homo sapiens
gctgctgcctgtagccagggtg

SEQ ID NO: 8002041 - DNA, 22 bp, Homo sapiens
gctgctgcctgtagccagggtg

SEQ ID NO: 8002042 - DNA, 22 bp, Homo sapiens
gctgctgcctgtagccagggtg

SEQ ID NO: 8002043 - DNA, 22 bp, Homo sapiens
gctgctgcctgtagccagggtg

SEQ ID NO: 8002044 - DNA, 22 bp, Homo sapiens
gctgctgccgcggccgctggga

SEQ ID NO: 8002045 - DNA, 22 bp, Homo sapiens
gctgctgcgcttgtctactgtt

SEQ ID NO: 8002046 - DNA, 22 bp, Homo sapiens
gctgctgcgcttgtctactgtt

SEQ ID NO: 8002047 - DNA, 22 bp, Homo sapiens
gctgctgcgcttgtctactgtt

SEQ ID NO: 8002048 - DNA, 22 bp, Homo sapiens
gctgctgcctgtagccagggtg

SEQ ID NO: 8002049 - DNA, 22 bp, Homo sapiens
gctgctgcctgtagccagggtg

SEQ ID NO: 8002050 - DNA, 22 bp, Homo sapiens
gctgctgcttgaaggctcggag

SEQ ID NO: 8002051 - DNA, 16 bp, Homo sapiens
gctgctgcttcctgct

SEQ ID NO: 8002052 - DNA, 21 bp, Homo sapiens
gctggagagccaggcaggggc

SEQ ID NO: 8002053 - DNA, 21 bp, Homo sapiens
gctggagagccaggcaggggc

SEQ ID NO: 8002054 - DNA, 21 bp, Homo sapiens
gctggagagccaggcaggggc

SEQ ID NO: 8002055 - DNA, 21 bp, Homo sapiens
gctggagagccaggcaggggc

SEQ ID NO: 8002056 - DNA, 21 bp, Homo sapiens
gctggagagccaggcaggggc

SEQ ID NO: 8002057 - DNA, 22 bp, Homo sapiens
gctggagaggggtcactctgag

SEQ ID NO: 8002058 - DNA, 22 bp, Homo sapiens
gctggagaggggtcactctgag

SEQ ID NO: 8002059 - DNA, 22 bp, Homo sapiens
gctggagaggatcccaaagcca

SEQ ID NO: 8002060 - DNA, 22 bp, Homo sapiens
gctggagaggatcccaaagcca

SEQ ID NO: 8002061 - DNA, 22 bp, Homo sapiens
gctggagaggggtcactctgag

SEQ ID NO: 8002062 - DNA, 21 bp, Homo sapiens
gctggagagccaggcaggggc

SEQ ID NO: 8002063 - DNA, 21 bp, Homo sapiens
gctggagagccaggcaggggc

SEQ ID NO: 8002064 - DNA, 22 bp, Homo sapiens
gctggagaggatcccaaagcca

SEQ ID NO: 8002065 - DNA, 22 bp, Homo sapiens
gctgctctcagagctcatgctg

SEQ ID NO: 8002066 - DNA, 20 bp, Homo sapiens
gctgctcgctgcagtcactc

SEQ ID NO: 8002067 - DNA, 22 bp, Homo sapiens
gctgctctacccatgcatctgt

SEQ ID NO: 8002068 - DNA, 22 bp, Homo sapiens
gctgctctacccatgcatctgt

SEQ ID NO: 8002069 - DNA, 22 bp, Homo sapiens
gctgcctgtcccaggatgagga

SEQ ID NO: 8002070 - DNA, 22 bp, Homo sapiens
gctgcctgtcccaggatgagga

SEQ ID NO: 8002071 - DNA, 22 bp, Homo sapiens
gctgcctgtcccaggatgagga

SEQ ID NO: 8002072 - DNA, 22 bp, Homo sapiens
gctgcctgtcccaggatgagga

SEQ ID NO: 8002073 - DNA, 21 bp, Homo sapiens
gctgctcgagatccagtgctt

SEQ ID NO: 8002074 - DNA, 21 bp, Homo sapiens
gctgctcgagatccagtgctt

SEQ ID NO: 8002075 - DNA, 21 bp, Homo sapiens
gctgctcgagatccagtgctt

SEQ ID NO: 8002076 - DNA, 22 bp, Homo sapiens
gctgcctggtttctcagctgca

SEQ ID NO: 8002077 - DNA, 22 bp, Homo sapiens
gctgcctggtttctcagctgca

SEQ ID NO: 8002078 - DNA, 22 bp, Homo sapiens
gctgcctggtttctcagctgca

SEQ ID NO: 8002079 - DNA, 22 bp, Homo sapiens
gctgcctggtttctcagctgca

SEQ ID NO: 8002080 - DNA, 22 bp, Homo sapiens
gctgcctggtttctcagctgca

SEQ ID NO: 8002081 - DNA, 22 bp, Homo sapiens
gctgcctggtttctcagctgca

SEQ ID NO: 8002082 - DNA, 22 bp, Homo sapiens
gctgcctgtcccaggatgagga

SEQ ID NO: 8002083 - DNA, 22 bp, Homo sapiens
gctgcctgtcccaggatgagga

SEQ ID NO: 8002084 - DNA, 22 bp, Homo sapiens
gctgcctggtttctcagctgca

SEQ ID NO: 8002085 - DNA, 22 bp, Homo sapiens
gctgcctggtttctcagctgca

SEQ ID NO: 8002086 - DNA, 22 bp, Homo sapiens
gctgcctggtttctcagctgca

SEQ ID NO: 8002087 - DNA, 22 bp, Homo sapiens
gctgcctgggcaggaggcgctg

SEQ ID NO: 8002088 - DNA, 22 bp, Homo sapiens
gctgcctgggcaggaggcgctg

SEQ ID NO: 8002089 - DNA, 22 bp, Homo sapiens
gctgcctgggcaggaggcgctg

SEQ ID NO: 8002090 - DNA, 22 bp, Homo sapiens
gctgcctgggctggcattccca

SEQ ID NO: 8002091 - DNA, 22 bp, Homo sapiens
gctgcctggtttctcagctgca

SEQ ID NO: 8002092 - DNA, 22 bp, Homo sapiens
gctgcctggtttctcagctgca

SEQ ID NO: 8002093 - DNA, 22 bp, Homo sapiens
gctgcctggtttctcagctgca

SEQ ID NO: 8002094 - DNA, 19 bp, Homo sapiens
gctgctctgggtctcatct

SEQ ID NO: 8002095 - DNA, 22 bp, Homo sapiens
gctgctctggctctgcagtgtc

SEQ ID NO: 8002096 - DNA, 19 bp, Homo sapiens
gctgctctgggtctcatct

SEQ ID NO: 8002097 - DNA, 19 bp, Homo sapiens
gctgctctgggtctcatct

SEQ ID NO: 8002098 - DNA, 19 bp, Homo sapiens
gctgctctgggtctcatct

SEQ ID NO: 8002099 - DNA, 22 bp, Homo sapiens
gctgctctggctctgcagtgtc

SEQ ID NO: 8002100 - DNA, 22 bp, Homo sapiens
gctgctctggctctgcagtgtc

SEQ ID NO: 8002101 - DNA, 22 bp, Homo sapiens
gctgctctggctctgcagtgtc

SEQ ID NO: 8002102 - DNA, 22 bp, Homo sapiens
gctgctctgaaaatgactgttg

SEQ ID NO: 8002103 - DNA, 22 bp, Homo sapiens
gctgctctgaaaatgactgttg

SEQ ID NO: 8002104 - DNA, 22 bp, Homo sapiens
gctgctctcagagctcatgctg

SEQ ID NO: 8002105 - DNA, 22 bp, Homo sapiens
gctgctctcatagatggcttca

SEQ ID NO: 8002106 - DNA, 22 bp, Homo sapiens
gctgctctccaagcctccttga

SEQ ID NO: 8002107 - DNA, 22 bp, Homo sapiens
gctgctctccaagcctccttga

SEQ ID NO: 8002108 - DNA, 22 bp, Homo sapiens
gctgctctcatagatggcttca

SEQ ID NO: 8002109 - DNA, 20 bp, Homo sapiens
gctgctctccacggtctgca

SEQ ID NO: 8002110 - DNA, 22 bp, Homo sapiens
gctgctctccatggccgtgagt

SEQ ID NO: 8002111 - DNA, 22 bp, Homo sapiens
gctgctctctccctaagttggg

SEQ ID NO: 8002112 - DNA, 22 bp, Homo sapiens
gctggagatagaatggccactg

SEQ ID NO: 8002113 - DNA, 22 bp, Homo sapiens
gctggagatagaatggccactg

SEQ ID NO: 8002114 - DNA, 22 bp, Homo sapiens
gctggagatactgctcagtatc

SEQ ID NO: 8002115 - DNA, 22 bp, Homo sapiens
gctggagatactgctcagtatc

SEQ ID NO: 8002116 - DNA, 22 bp, Homo sapiens
gctggagatagaatggccactg

SEQ ID NO: 8002117 - DNA, 22 bp, Homo sapiens
gctggagatagaatggccactg

SEQ ID NO: 8002118 - DNA, 22 bp, Homo sapiens
gctggagatagaatggccactg

SEQ ID NO: 8002119 - DNA, 22 bp, Homo sapiens
gctggagatagaatggccactg

SEQ ID NO: 8002120 - DNA, 22 bp, Homo sapiens
gctggagatagaatggccactg

SEQ ID NO: 8002121 - DNA, 22 bp, Homo sapiens
gctggagatagtaggatccata

SEQ ID NO: 8002122 - DNA, 22 bp, Homo sapiens
gctggagatagtaggatccata

SEQ ID NO: 8002123 - DNA, 22 bp, Homo sapiens
gctggagatagtaggatccata

SEQ ID NO: 8002124 - DNA, 22 bp, Homo sapiens
gctggagatgctatgcagaggg

SEQ ID NO: 8002125 - DNA, 22 bp, Homo sapiens
gctggagatgctatgcagaggg

SEQ ID NO: 8002126 - DNA, 22 bp, Homo sapiens
gctggagatgctatgcagaggg

SEQ ID NO: 8002127 - DNA, 22 bp, Homo sapiens
gctggagatgctatgcagaggg

SEQ ID NO: 8002128 - DNA, 22 bp, Homo sapiens
gctggagagtgaggggagcaag

SEQ ID NO: 8002129 - DNA, 22 bp, Homo sapiens
gctggagagtagtaagcagtta

SEQ ID NO: 8002130 - DNA, 22 bp, Homo sapiens
gctggagagtagtaagcagtta

SEQ ID NO: 8002131 - DNA, 22 bp, Homo sapiens
gctggagagtgaggggagcaag

SEQ ID NO: 8002132 - DNA, 22 bp, Homo sapiens
gctggagagtagtaagcagtta

SEQ ID NO: 8002133 - DNA, 22 bp, Homo sapiens
gctggagagtagtaagcagtta

SEQ ID NO: 8002134 - DNA, 22 bp, Homo sapiens
gctggagagtagtaagcagtta

SEQ ID NO: 8002135 - DNA, 22 bp, Homo sapiens
gctggagaggggtcactctgag

SEQ ID NO: 8002136 - DNA, 22 bp, Homo sapiens
gctggagaggggtcactctgag

SEQ ID NO: 8002137 - DNA, 22 bp, Homo sapiens
gctggagatactgctcagtatc

SEQ ID NO: 8002138 - DNA, 22 bp, Homo sapiens
gctggagatactgctcagtatc

SEQ ID NO: 8002139 - DNA, 22 bp, Homo sapiens
gctggagagtgaggggagcaag

SEQ ID NO: 8002140 - DNA, 22 bp, Homo sapiens
gctggagagtgaggggagcaag

SEQ ID NO: 8002141 - DNA, 22 bp, Homo sapiens
gctggagagtgaggggagcaag

SEQ ID NO: 8002142 - DNA, 22 bp, Homo sapiens
gctggagctgagttccctgggc

SEQ ID NO: 8002143 - DNA, 22 bp, Homo sapiens
gctggagctgagttccctgggc

SEQ ID NO: 8002144 - DNA, 22 bp, Homo sapiens
gctggagcgtgatccttgatct

SEQ ID NO: 8002145 - DNA, 22 bp, Homo sapiens
gctggagctgagttccctgggc

SEQ ID NO: 8002146 - DNA, 22 bp, Homo sapiens
gctggagcgtgatccttgatct

SEQ ID NO: 8002147 - DNA, 22 bp, Homo sapiens
gctggagctgagttccctgggc

SEQ ID NO: 8002148 - DNA, 22 bp, Homo sapiens
gctggagctgagttccctgggc

SEQ ID NO: 8002149 - DNA, 22 bp, Homo sapiens
gctggagctgcagcctgggcct

SEQ ID NO: 8002150 - DNA, 22 bp, Homo sapiens
gctggagctgagttccctgggc

SEQ ID NO: 8002151 - DNA, 22 bp, Homo sapiens
gctggagctgagttccctgggc

SEQ ID NO: 8002152 - DNA, 22 bp, Homo sapiens
gctggagccttctgctctgttg

SEQ ID NO: 8002153 - DNA, 22 bp, Homo sapiens
gctggagccttctgctctgttg

SEQ ID NO: 8002154 - DNA, 22 bp, Homo sapiens
gctggagcgggttcgggccgct

SEQ ID NO: 8002155 - DNA, 22 bp, Homo sapiens
gctggagcgggttcgggccgct

SEQ ID NO: 8002156 - DNA, 22 bp, Homo sapiens
gctggagcgggttcgggccgct

SEQ ID NO: 8002157 - DNA, 22 bp, Homo sapiens
gctggagccattggcttggcct

SEQ ID NO: 8002158 - DNA, 22 bp, Homo sapiens
gctggagccattggcttggcct

SEQ ID NO: 8002159 - DNA, 22 bp, Homo sapiens
gctggagccattggcttggcct

SEQ ID NO: 8002160 - DNA, 22 bp, Homo sapiens
gctggagccaagctgctcttgg

SEQ ID NO: 8002161 - DNA, 22 bp, Homo sapiens
gctggagccaagctgctcttgg

SEQ ID NO: 8002162 - DNA, 22 bp, Homo sapiens
gctggagccaagctgctcttgg

SEQ ID NO: 8002163 - DNA, 22 bp, Homo sapiens
gctggagccattggcttggcct

SEQ ID NO: 8002164 - DNA, 22 bp, Homo sapiens
gctggagccttctgctctgttg

SEQ ID NO: 8002165 - DNA, 22 bp, Homo sapiens
gctggagccttctgctctgttg

SEQ ID NO: 8002166 - DNA, 22 bp, Homo sapiens
gctggagccattggcttggcct

SEQ ID NO: 8002167 - DNA, 22 bp, Homo sapiens
gctggagatgctatgcagaggg

SEQ ID NO: 8002168 - DNA, 22 bp, Homo sapiens
gctggagatgctatgcagaggg

SEQ ID NO: 8002169 - DNA, 22 bp, Homo sapiens
gctggagatgctatgcagaggg

SEQ ID NO: 8002170 - DNA, 22 bp, Homo sapiens
gctggagatgctatgcagaggg

SEQ ID NO: 8002171 - DNA, 22 bp, Homo sapiens
gctggagatgctatgcagaggg

SEQ ID NO: 8002172 - DNA, 22 bp, Homo sapiens
gctggagatgctatgcagaggg

SEQ ID NO: 8002173 - DNA, 22 bp, Homo sapiens
gctggagatgctatgcagaggg

SEQ ID NO: 8002174 - DNA, 22 bp, Homo sapiens
gctggccagtgtcccagggatc

SEQ ID NO: 8002175 - DNA, 22 bp, Homo sapiens
gctggccagtgtcccagggatc

SEQ ID NO: 8002176 - DNA, 22 bp, Homo sapiens
gctggccagtgtcccagggatc

SEQ ID NO: 8002177 - DNA, 22 bp, Homo sapiens
gctggccagtgtcccagggatc

SEQ ID NO: 8002178 - DNA, 22 bp, Homo sapiens
gctggccagtgtcccagggatc

SEQ ID NO: 8002179 - DNA, 22 bp, Homo sapiens
gctggagctgcagcctgggcct

SEQ ID NO: 8002180 - DNA, 22 bp, Homo sapiens
gctggagctgcagcctgggcct

SEQ ID NO: 8002181 - DNA, 22 bp, Homo sapiens
gctggagctgcagcctgggcct

SEQ ID NO: 8002182 - DNA, 22 bp, Homo sapiens
gctggagctgcagcctgggcct

SEQ ID NO: 8002183 - DNA, 22 bp, Homo sapiens
gctggagctgcagcctgggcct

SEQ ID NO: 8002184 - DNA, 22 bp, Homo sapiens
gctggcctcgcaggcaggatgt

SEQ ID NO: 8002185 - DNA, 22 bp, Homo sapiens
gctggcctcgcaggcaggatgt

SEQ ID NO: 8002186 - DNA, 22 bp, Homo sapiens
gctggcctcctgctagatggaa

SEQ ID NO: 8002187 - DNA, 22 bp, Homo sapiens
gctggcctcctgctagatggaa

SEQ ID NO: 8002188 - DNA, 22 bp, Homo sapiens
gctggcctcctgctagatggaa

SEQ ID NO: 8002189 - DNA, 22 bp, Homo sapiens
gctggcctcatcactgacttct

SEQ ID NO: 8002190 - DNA, 19 bp, Homo sapiens
gctggcccctgggatccag

SEQ ID NO: 8002191 - DNA, 22 bp, Homo sapiens
gctggccgaacggtgccctggc

SEQ ID NO: 8002192 - DNA, 22 bp, Homo sapiens
gctggccgaacggtgccctggc

SEQ ID NO: 8002193 - DNA, 22 bp, Homo sapiens
gctggcccagtgacccacagtg

SEQ ID NO: 8002194 - DNA, 22 bp, Homo sapiens
gctggcccagtgacccacagtg

SEQ ID NO: 8002195 - DNA, 22 bp, Homo sapiens
gctggcccagtgacccacagtg

SEQ ID NO: 8002196 - DNA, 22 bp, Homo sapiens
gctggcccagggtcacctagga

SEQ ID NO: 8002197 - DNA, 22 bp, Homo sapiens
gctggccccgagtgctacgctc

SEQ ID NO: 8002198 - DNA, 22 bp, Homo sapiens
gctggccccgagtgctacgctc

SEQ ID NO: 8002199 - DNA, 22 bp, Homo sapiens
gctggccccgagtgctacgctc

SEQ ID NO: 8002200 - DNA, 22 bp, Homo sapiens
gctggccccgagtgctacgctc

SEQ ID NO: 8002201 - DNA, 22 bp, Homo sapiens
gctggccccgagtgctacgctc

SEQ ID NO: 8002202 - DNA, 19 bp, Homo sapiens
gctggcccctgggatccag

SEQ ID NO: 8002203 - DNA, 22 bp, Homo sapiens
gctggcctctggagaagggctt

SEQ ID NO: 8002204 - DNA, 22 bp, Homo sapiens
gctggcctctggagaagggctt

SEQ ID NO: 8002205 - DNA, 22 bp, Homo sapiens
gctggcctctggagaagggctt

SEQ ID NO: 8002206 - DNA, 22 bp, Homo sapiens
gctggcctctggagaagggctt

SEQ ID NO: 8002207 - DNA, 22 bp, Homo sapiens
gctggcctgaccagccacaggc

SEQ ID NO: 8002208 - DNA, 22 bp, Homo sapiens
gctggcctgaccagccacaggc

SEQ ID NO: 8002209 - DNA, 22 bp, Homo sapiens
gctggcctctggagaagggctt

SEQ ID NO: 8002210 - DNA, 22 bp, Homo sapiens
gctggcctctacaggccggcca

SEQ ID NO: 8002211 - DNA, 22 bp, Homo sapiens
gctggcctctacaggccggcca

SEQ ID NO: 8002212 - DNA, 22 bp, Homo sapiens
gctggcctctacaggccggcca

SEQ ID NO: 8002213 - DNA, 22 bp, Homo sapiens
gctggcctctacaggccggcca

SEQ ID NO: 8002214 - DNA, 22 bp, Homo sapiens
gctggcctctacaggccggcca

SEQ ID NO: 8002215 - DNA, 22 bp, Homo sapiens
gctggcctcgcaggcaggatgt

SEQ ID NO: 8002216 - DNA, 22 bp, Homo sapiens
gctggcctcgcaggcaggatgt

SEQ ID NO: 8002217 - DNA, 22 bp, Homo sapiens
gctggcctgacctgaggctggg

SEQ ID NO: 8002218 - DNA, 22 bp, Homo sapiens
gctggcctgacctgaggctggg

SEQ ID NO: 8002219 - DNA, 22 bp, Homo sapiens
gctggcctgaccagccacaggc

SEQ ID NO: 8002220 - DNA, 22 bp, Homo sapiens
gctggcctgacctgaggctggg

SEQ ID NO: 8002221 - DNA, 22 bp, Homo sapiens
gctggcctgacctgaggctggg

SEQ ID NO: 8002222 - DNA, 22 bp, Homo sapiens
gctggcctgacctgaggctggg

SEQ ID NO: 8002223 - DNA, 22 bp, Homo sapiens
gctggcctgacctgaggctggg

SEQ ID NO: 8002224 - DNA, 22 bp, Homo sapiens
gctggcctgacctgaggctggg

SEQ ID NO: 8002225 - DNA, 22 bp, Homo sapiens
gctggcctgagggccgaggctc

SEQ ID NO: 8002226 - DNA, 22 bp, Homo sapiens
gctggcctgagggccgaggctc

SEQ ID NO: 8002227 - DNA, 22 bp, Homo sapiens
gctggcctgacctgaggctggg

SEQ ID NO: 8002228 - DNA, 22 bp, Homo sapiens
gctggcctgcaaagcccggctg

SEQ ID NO: 8002229 - DNA, 22 bp, Homo sapiens
gctggcctgcaaagcccggctg

SEQ ID NO: 8002230 - DNA, 22 bp, Homo sapiens
gctggcctgcgagggcaggctg

SEQ ID NO: 8002231 - DNA, 22 bp, Homo sapiens
gctggccttgtgtctgaggaag

SEQ ID NO: 8002232 - DNA, 22 bp, Homo sapiens
gctggccttgtgtctgaggaag

SEQ ID NO: 8002233 - DNA, 22 bp, Homo sapiens
gctggccttgtgtctgaggaag

SEQ ID NO: 8002234 - DNA, 22 bp, Homo sapiens
gctggccttgtgtctgaggaag

SEQ ID NO: 8002235 - DNA, 22 bp, Homo sapiens
gctggccttgtgtctgaggaag

SEQ ID NO: 8002236 - DNA, 22 bp, Homo sapiens
gctggccttgaggtgtctttat

SEQ ID NO: 8002237 - DNA, 22 bp, Homo sapiens
gctggcctgggcagcctgtcgg

SEQ ID NO: 8002238 - DNA, 22 bp, Homo sapiens
gctggcctgggctcaagaccag

SEQ ID NO: 8002239 - DNA, 22 bp, Homo sapiens
gctggcctgggctcaagaccag

SEQ ID NO: 8002240 - DNA, 22 bp, Homo sapiens
gctggcctgtctagagccttac

SEQ ID NO: 8002241 - DNA, 22 bp, Homo sapiens
gctggcctgtctagagccttac

SEQ ID NO: 8002242 - DNA, 22 bp, Homo sapiens
gctggcctgggcagaggctatg

SEQ ID NO: 8002243 - DNA, 22 bp, Homo sapiens
gctggcctgggcagaggctatg

SEQ ID NO: 8002244 - DNA, 22 bp, Homo sapiens
gctggcctgggcagaggctatg

SEQ ID NO: 8002245 - DNA, 22 bp, Homo sapiens
gctggcctgggcagaggctatg

SEQ ID NO: 8002246 - DNA, 22 bp, Homo sapiens
gctggcctgggcagcctgtcgg

SEQ ID NO: 8002247 - DNA, 22 bp, Homo sapiens
gctggcctgggcagcctgtcgg

SEQ ID NO: 8002248 - DNA, 22 bp, Homo sapiens
gctggcctgggcagcctgtcgg

SEQ ID NO: 8002249 - DNA, 22 bp, Homo sapiens
gctggcctgggcagcctgtcgg

SEQ ID NO: 8002250 - DNA, 22 bp, Homo sapiens
gctggcctgcgagggcaggctg

SEQ ID NO: 8002251 - DNA, 22 bp, Homo sapiens
gctggcctgcgagggcaggctg

SEQ ID NO: 8002252 - DNA, 22 bp, Homo sapiens
gctggcctgcgagggcaggctg

SEQ ID NO: 8002253 - DNA, 22 bp, Homo sapiens
gctggcctgcgagggcaggctg

SEQ ID NO: 8002254 - DNA, 22 bp, Homo sapiens
gctggcctgctgggcaccaccg

SEQ ID NO: 8002255 - DNA, 22 bp, Homo sapiens
gctggcctgctgggcaccaccg

SEQ ID NO: 8002256 - DNA, 22 bp, Homo sapiens
gctggcctgggcagaggctatg

SEQ ID NO: 8002257 - DNA, 22 bp, Homo sapiens
gctggcctgggcagaggctatg

SEQ ID NO: 8002258 - DNA, 22 bp, Homo sapiens
gctggcctgctgggcaccaccg

SEQ ID NO: 8002259 - DNA, 22 bp, Homo sapiens
gctgggagttactgtctccttt

SEQ ID NO: 8002260 - DNA, 22 bp, Homo sapiens
gctgggagttactgtctccttt

SEQ ID NO: 8002261 - DNA, 22 bp, Homo sapiens
gctgggagttactgtctccttt

SEQ ID NO: 8002262 - DNA, 22 bp, Homo sapiens
gctgggagtttgatttgactgg

SEQ ID NO: 8002263 - DNA, 22 bp, Homo sapiens
gctgggatgcgtcttcccaggc

SEQ ID NO: 8002264 - DNA, 22 bp, Homo sapiens
gctgggatgcgtcttcccaggc

SEQ ID NO: 8002265 - DNA, 22 bp, Homo sapiens
gctgggatgcgtcttcccaggc

SEQ ID NO: 8002266 - DNA, 22 bp, Homo sapiens
gctgggatgcgtcttcccaggc

SEQ ID NO: 8002267 - DNA, 22 bp, Homo sapiens
gctgggatggagactgcagtga

SEQ ID NO: 8002268 - DNA, 22 bp, Homo sapiens
gctgggcaacggaagagagaaa

SEQ ID NO: 8002269 - DNA, 22 bp, Homo sapiens
gctgggcaacggaagagagaaa

SEQ ID NO: 8002270 - DNA, 22 bp, Homo sapiens
gctgggcaacggaagagagaaa

SEQ ID NO: 8002271 - DNA, 22 bp, Homo sapiens
gctggcctttgaggaagctgcg

SEQ ID NO: 8002272 - DNA, 22 bp, Homo sapiens
gctggcctttgaggaagctgcg

SEQ ID NO: 8002273 - DNA, 22 bp, Homo sapiens
gctggcctttgaggaagctgcg

SEQ ID NO: 8002274 - DNA, 22 bp, Homo sapiens
gctgggagtgggcaagatgaga

SEQ ID NO: 8002275 - DNA, 22 bp, Homo sapiens
gctgggagtgggcaagatgaga

SEQ ID NO: 8002276 - DNA, 22 bp, Homo sapiens
gctggcggcagtggtgtctctg

SEQ ID NO: 8002277 - DNA, 22 bp, Homo sapiens
gctggcggcagtggtgtctctg

SEQ ID NO: 8002278 - DNA, 22 bp, Homo sapiens
gctgggagtgggcaagatgaga

SEQ ID NO: 8002279 - DNA, 22 bp, Homo sapiens
gctgggagtgggcaagatgaga

SEQ ID NO: 8002280 - DNA, 22 bp, Homo sapiens
gctgggagtgggcaagatgaga

SEQ ID NO: 8002281 - DNA, 22 bp, Homo sapiens
gctgggagtgggcaagatgaga

SEQ ID NO: 8002282 - DNA, 22 bp, Homo sapiens
gctgggcactgtcccataggct

SEQ ID NO: 8002283 - DNA, 22 bp, Homo sapiens
gctgggcagcaggctctccggg

SEQ ID NO: 8002284 - DNA, 22 bp, Homo sapiens
gctgggcacctctcccagattg

SEQ ID NO: 8002285 - DNA, 22 bp, Homo sapiens
gctgggcaccggagagacccca

SEQ ID NO: 8002286 - DNA, 22 bp, Homo sapiens
gctgggcacctctcccagattg

SEQ ID NO: 8002287 - DNA, 22 bp, Homo sapiens
gctgggcactgtcccataggct

SEQ ID NO: 8002288 - DNA, 22 bp, Homo sapiens
gctgggcaatgccagagaggag

SEQ ID NO: 8002289 - DNA, 22 bp, Homo sapiens
gctgggcaccggagagacccca

SEQ ID NO: 8002290 - DNA, 22 bp, Homo sapiens
gctgggcaccggagagacccca

SEQ ID NO: 8002291 - DNA, 22 bp, Homo sapiens
gctgggcaccggagagacccca

SEQ ID NO: 8002292 - DNA, 22 bp, Homo sapiens
gctgggcaagtgccttgggttt

SEQ ID NO: 8002293 - DNA, 22 bp, Homo sapiens
gctgggcaagtgccttgggttt

SEQ ID NO: 8002294 - DNA, 22 bp, Homo sapiens
gctgggcaatgccagagaggag

SEQ ID NO: 8002295 - DNA, 22 bp, Homo sapiens
gctgggcaatgccagagaggag

SEQ ID NO: 8002296 - DNA, 22 bp, Homo sapiens
gctgggcaatgccagagaggag

SEQ ID NO: 8002297 - DNA, 22 bp, Homo sapiens
gctgggcaatgccagagaggag

SEQ ID NO: 8002298 - DNA, 22 bp, Homo sapiens
gctgggcaaggctgaagctacc

SEQ ID NO: 8002299 - DNA, 22 bp, Homo sapiens
gctgggcaacgggcagaaagat

SEQ ID NO: 8002300 - DNA, 22 bp, Homo sapiens
gctgggcaaggctgaagctacc

SEQ ID NO: 8002301 - DNA, 22 bp, Homo sapiens
gctgggcaacgggcagaaagat

SEQ ID NO: 8002302 - DNA, 22 bp, Homo sapiens
gctgggcaacgggcagaaagat

SEQ ID NO: 8002303 - DNA, 22 bp, Homo sapiens
gctgggcaggcctcgtgagggc

SEQ ID NO: 8002304 - DNA, 22 bp, Homo sapiens
gctgggcaggcctcgtgagggc

SEQ ID NO: 8002305 - DNA, 22 bp, Homo sapiens
gctgggcaggcctcgtgagggc

SEQ ID NO: 8002306 - DNA, 22 bp, Homo sapiens
gctgggcaggcctcgtgagggc

SEQ ID NO: 8002307 - DNA, 22 bp, Homo sapiens
gctgggcagtgagtgagtcctt

SEQ ID NO: 8002308 - DNA, 22 bp, Homo sapiens
gctgggcagtgagtgagtcctt

SEQ ID NO: 8002309 - DNA, 22 bp, Homo sapiens
gctgggcaggcctcgtgagggc

SEQ ID NO: 8002310 - DNA, 22 bp, Homo sapiens
gctgggcagctgaggcctctca

SEQ ID NO: 8002311 - DNA, 22 bp, Homo sapiens
gctgggcagctgaggcctctca

SEQ ID NO: 8002312 - DNA, 22 bp, Homo sapiens
gctgggcagctgaggcctctca

SEQ ID NO: 8002313 - DNA, 22 bp, Homo sapiens
gctgggcagctgaggcctctca

SEQ ID NO: 8002314 - DNA, 22 bp, Homo sapiens
gctgggcagctgaggcctctca

SEQ ID NO: 8002315 - DNA, 22 bp, Homo sapiens
gctgggcagctgaggcctctca

SEQ ID NO: 8002316 - DNA, 22 bp, Homo sapiens
gctgggcagcccctacagagag

SEQ ID NO: 8002317 - DNA, 22 bp, Homo sapiens
gctgggcagcccctacagagag

SEQ ID NO: 8002318 - DNA, 22 bp, Homo sapiens
gctgggcagcccctacagagag

SEQ ID NO: 8002319 - DNA, 22 bp, Homo sapiens
gctgggcagcaggctctccggg

SEQ ID NO: 8002320 - DNA, 22 bp, Homo sapiens
gctgggcagcaggctctccggg

SEQ ID NO: 8002321 - DNA, 22 bp, Homo sapiens
gctgggcagcaggctctccggg

SEQ ID NO: 8002322 - DNA, 22 bp, Homo sapiens
gctgggcagcaggctctccggg

SEQ ID NO: 8002323 - DNA, 22 bp, Homo sapiens
gctgggcagcccctacagagag

SEQ ID NO: 8002324 - DNA, 22 bp, Homo sapiens
gctgggcagcaggctctccggg

SEQ ID NO: 8002325 - DNA, 22 bp, Homo sapiens
gctgggcagcctggccgctgcc

SEQ ID NO: 8002326 - DNA, 22 bp, Homo sapiens
gctgggcagcctggccgctgcc

SEQ ID NO: 8002327 - DNA, 22 bp, Homo sapiens
gctgggcagcctggccgctgcc

SEQ ID NO: 8002328 - DNA, 22 bp, Homo sapiens
gctgggcagctgaggcctctca

SEQ ID NO: 8002329 - DNA, 22 bp, Homo sapiens
gccttaattttttataatctct

SEQ ID NO: 8002330 - DNA, 22 bp, Homo sapiens
gccttagaaaaataagatttta

SEQ ID NO: 8002331 - DNA, 22 bp, Homo sapiens
gctcactgcaacctctgcctcc

SEQ ID NO: 8002332 - DNA, 22 bp, Homo sapiens
gctcactgcaacctctgcctcc

SEQ ID NO: 8002333 - DNA, 22 bp, Homo sapiens
gccttagcctgcacttcctgtt

SEQ ID NO: 8002334 - DNA, 22 bp, Homo sapiens
gctcactgcaacctctgcttcc

SEQ ID NO: 8002335 - DNA, 22 bp, Homo sapiens
gctcactgcaacctctgcctcc

SEQ ID NO: 8002336 - DNA, 22 bp, Homo sapiens
gctcactgcaacctctgcttcc

SEQ ID NO: 8002337 - DNA, 22 bp, Homo sapiens
gctcactggcctgaagaggacg

SEQ ID NO: 8002338 - DNA, 22 bp, Homo sapiens
gctcactgccattctctagatg

SEQ ID NO: 8002339 - DNA, 22 bp, Homo sapiens
gctcactgcaagctctgcctcc

SEQ ID NO: 8002340 - DNA, 22 bp, Homo sapiens
gctcactgcaagctctgcctcc

SEQ ID NO: 8002341 - DNA, 22 bp, Homo sapiens
gctcactgcaagctctgcctcc

SEQ ID NO: 8002342 - DNA, 22 bp, Homo sapiens
gctcactgcaagctccgcctcc

SEQ ID NO: 8002343 - DNA, 22 bp, Homo sapiens
gcctgtttttgcttcgtttaag

SEQ ID NO: 8002344 - DNA, 19 bp, Homo sapiens
gccttaacctgttaagggg

SEQ ID NO: 8002345 - DNA, 22 bp, Homo sapiens
gccttaatacagatgggtggtg

SEQ ID NO: 8002346 - DNA, 22 bp, Homo sapiens
gccttaaacaattgcctgttaa

SEQ ID NO: 8002347 - DNA, 22 bp, Homo sapiens
gcctgttttcctgctgtggttg

SEQ ID NO: 8002348 - DNA, 22 bp, Homo sapiens
gcctgttttagatgcattgatg

SEQ ID NO: 8002349 - DNA, 22 bp, Homo sapiens
gcctgtttgtttgcaaaggagc

SEQ ID NO: 8002350 - DNA, 22 bp, Homo sapiens
gcctgtttgtttgcaaaggagc

SEQ ID NO: 8002351 - DNA, 22 bp, Homo sapiens
gcctgtttgtttgcaaaggagc

SEQ ID NO: 8002352 - DNA, 22 bp, Homo sapiens
gcctgttttagatgcattgatg

SEQ ID NO: 8002353 - DNA, 22 bp, Homo sapiens
gcctgtttgttatgtcatggta

SEQ ID NO: 8002354 - DNA, 22 bp, Homo sapiens
gcctgtttgtttgcaaaggagc

SEQ ID NO: 8002355 - DNA, 22 bp, Homo sapiens
gcctgtttggctgctgacattg

SEQ ID NO: 8002356 - DNA, 22 bp, Homo sapiens
gcctgtttggctgctgacattg

SEQ ID NO: 8002357 - DNA, 22 bp, Homo sapiens
gcctgtttgttatgtcatggta

SEQ ID NO: 8002358 - DNA, 22 bp, Homo sapiens
gcctgtttggcatcattggttg

SEQ ID NO: 8002359 - DNA, 22 bp, Homo sapiens
gcctgtttggaatctgtttaat

SEQ ID NO: 8002360 - DNA, 22 bp, Homo sapiens
gcctgtttggcatcattggttg

SEQ ID NO: 8002361 - DNA, 22 bp, Homo sapiens
gcctgtttggctgctgacattg

SEQ ID NO: 8002362 - DNA, 22 bp, Homo sapiens
gcctgtttgactggtctctgct

SEQ ID NO: 8002363 - DNA, 22 bp, Homo sapiens
gcctgtttgactggtctctgct

SEQ ID NO: 8002364 - DNA, 22 bp, Homo sapiens
gcctgtttgagaatagtcaggg

SEQ ID NO: 8002365 - DNA, 22 bp, Homo sapiens
gcctgtttgactggtctctgct

SEQ ID NO: 8002366 - DNA, 22 bp, Homo sapiens
gcctgtttgagaatagtcaggg

SEQ ID NO: 8002367 - DNA, 22 bp, Homo sapiens
gcctgtttctaatctcatttct

SEQ ID NO: 8002368 - DNA, 22 bp, Homo sapiens
gcctgtttctcctccttggccc

SEQ ID NO: 8002369 - DNA, 22 bp, Homo sapiens
gcctgtttctaatctcatttct

SEQ ID NO: 8002370 - DNA, 22 bp, Homo sapiens
gcctgtttctcctccttggccc

SEQ ID NO: 8002371 - DNA, 22 bp, Homo sapiens
gcctgtttctcctccttggccc

SEQ ID NO: 8002372 - DNA, 22 bp, Homo sapiens
gcctgtttctcctccttggccc

SEQ ID NO: 8002373 - DNA, 22 bp, Homo sapiens
gcctgtttccctgacgcttaca

SEQ ID NO: 8002374 - DNA, 22 bp, Homo sapiens
gcctgtttccatcaacacatgc

SEQ ID NO: 8002375 - DNA, 22 bp, Homo sapiens
gcctgtttctaatctcatttct

SEQ ID NO: 8002376 - DNA, 22 bp, Homo sapiens
gcctgtttccatcaacacatgc

SEQ ID NO: 8002377 - DNA, 22 bp, Homo sapiens
gcctgtttatctatcatgaact

SEQ ID NO: 8002378 - DNA, 22 bp, Homo sapiens
gcctgtttactttgccgcagga

SEQ ID NO: 8002379 - DNA, 22 bp, Homo sapiens
gcctgtttactttgccgcagga

SEQ ID NO: 8002380 - DNA, 22 bp, Homo sapiens
gcctgtttatctatcatgaact

SEQ ID NO: 8002381 - DNA, 22 bp, Homo sapiens
gcctgtttatctatcatgaact

SEQ ID NO: 8002382 - DNA, 22 bp, Homo sapiens
gctcatgactgtaatcccagca

SEQ ID NO: 8002383 - DNA, 22 bp, Homo sapiens
gctcatgactgtaatcccagca

SEQ ID NO: 8002384 - DNA, 22 bp, Homo sapiens
gctcatgactgtaatcccagca

SEQ ID NO: 8002385 - DNA, 22 bp, Homo sapiens
gctcatgactgtaatcccagca

SEQ ID NO: 8002386 - DNA, 22 bp, Homo sapiens
gctcatgactgtaatcccagca

SEQ ID NO: 8002387 - DNA, 22 bp, Homo sapiens
gctcatctggggctttcagctt

SEQ ID NO: 8002388 - DNA, 22 bp, Homo sapiens
gctcatctgtaaaacaggatta

SEQ ID NO: 8002389 - DNA, 22 bp, Homo sapiens
gctcatctgttttaactgtatt

SEQ ID NO: 8002390 - DNA, 22 bp, Homo sapiens
gctcatctcccttttgaagctg

SEQ ID NO: 8002391 - DNA, 23 bp, Homo sapiens
gctcatctagaatggtttcagct

SEQ ID NO: 8002392 - DNA, 22 bp, Homo sapiens
gctcatctgccatgatgagttt

SEQ ID NO: 8002393 - DNA, 22 bp, Homo sapiens
gctcatctgccccaggagatcc

SEQ ID NO: 8002394 - DNA, 22 bp, Homo sapiens
gctcatgggcccagagcagccc

SEQ ID NO: 8002395 - DNA, 22 bp, Homo sapiens
gctcatgggcccagagcagccc

SEQ ID NO: 8002396 - DNA, 22 bp, Homo sapiens
gctcatgactgtaatcccagca

SEQ ID NO: 8002397 - DNA, 22 bp, Homo sapiens
gctcatgactgtaatcccagca

SEQ ID NO: 8002398 - DNA, 22 bp, Homo sapiens
gctcagagcccgaggcttgcat

SEQ ID NO: 8002399 - DNA, 22 bp, Homo sapiens
gctcatgactgtaatcccagca

SEQ ID NO: 8002400 - DNA, 22 bp, Homo sapiens
gctcatgactgtaatcccagca

SEQ ID NO: 8002401 - DNA, 22 bp, Homo sapiens
gctcatgactgtaatcccagca

SEQ ID NO: 8002402 - DNA, 22 bp, Homo sapiens
gctcatgactgtaatcccagca

SEQ ID NO: 8002403 - DNA, 22 bp, Homo sapiens
gctcatgactgtaatcccagca

SEQ ID NO: 8002404 - DNA, 22 bp, Homo sapiens
gctcagagcatcccagtgaatg

SEQ ID NO: 8002405 - DNA, 22 bp, Homo sapiens
gctcagagcatcccagtgaatg

SEQ ID NO: 8002406 - DNA, 22 bp, Homo sapiens
gctcagagcatcccagtgaatg

SEQ ID NO: 8002407 - DNA, 22 bp, Homo sapiens
gctcagagcactcagactcagc

SEQ ID NO: 8002408 - DNA, 22 bp, Homo sapiens
gctcagagcactcagactcagc

SEQ ID NO: 8002409 - DNA, 22 bp, Homo sapiens
gctcagagcccgaggcttgcat

SEQ ID NO: 8002410 - DNA, 20 bp, Homo sapiens
gctcagagcctgaacttcat

SEQ ID NO: 8002411 - DNA, 19 bp, Homo sapiens
gctcagagccatgggggct

SEQ ID NO: 8002412 - DNA, 22 bp, Homo sapiens
gctcagagatgttcagtagctt

SEQ ID NO: 8002413 - DNA, 22 bp, Homo sapiens
gctcagagatgttcagtagctt

SEQ ID NO: 8002414 - DNA, 22 bp, Homo sapiens
gctcagagcactcagactcagc

SEQ ID NO: 8002415 - DNA, 22 bp, Homo sapiens
gctcagagatgtctgctgcctt

SEQ ID NO: 8002416 - DNA, 22 bp, Homo sapiens
gctcagagatgttcagtagctt

SEQ ID NO: 8002417 - DNA, 22 bp, Homo sapiens
gctcagagatgttcagtagctt

SEQ ID NO: 8002418 - DNA, 22 bp, Homo sapiens
gctcagagatgttcagtagctt

SEQ ID NO: 8002419 - DNA, 22 bp, Homo sapiens
gctcagagatggggaatgaaaa

SEQ ID NO: 8002420 - DNA, 22 bp, Homo sapiens
gctcagagatggggaatgaaaa

SEQ ID NO: 8002421 - DNA, 22 bp, Homo sapiens
gctcagaaaagtgaggctcagt

SEQ ID NO: 8002422 - DNA, 19 bp, Homo sapiens
gctcacttcaggttttcac

SEQ ID NO: 8002423 - DNA, 22 bp, Homo sapiens
gctcactggcctgaagaggacg

SEQ ID NO: 8002424 - DNA, 22 bp, Homo sapiens
gctcagaaatggcagatggaga

SEQ ID NO: 8002425 - DNA, 22 bp, Homo sapiens
gctcagaagatatttgatgctg

SEQ ID NO: 8002426 - DNA, 22 bp, Homo sapiens
gctcagaagatatttgatgctg

SEQ ID NO: 8002427 - DNA, 22 bp, Homo sapiens
gctcagacctgtaatcttagca

SEQ ID NO: 8002428 - DNA, 22 bp, Homo sapiens
gctcagactctggcctgatgat

SEQ ID NO: 8002429 - DNA, 22 bp, Homo sapiens
gctcagactctggcctgatgat

SEQ ID NO: 8002430 - DNA, 22 bp, Homo sapiens
gctcagaccccaccctggcaga

SEQ ID NO: 8002431 - DNA, 19 bp, Homo sapiens
gctcagacattaagcagct

SEQ ID NO: 8002432 - DNA, 22 bp, Homo sapiens
gctcagaccccaccctggcaga

SEQ ID NO: 8002433 - DNA, 19 bp, Homo sapiens
gctcagacattaagcagct

SEQ ID NO: 8002434 - DNA, 22 bp, Homo sapiens
gctcagacagatatttcgagat

SEQ ID NO: 8002435 - DNA, 22 bp, Homo sapiens
gctccaggaggatgaccttcct

SEQ ID NO: 8002436 - DNA, 22 bp, Homo sapiens
gctccaggaggatgaccttcct

SEQ ID NO: 8002437 - DNA, 22 bp, Homo sapiens
gctccaggagctcacagctcgc

SEQ ID NO: 8002438 - DNA, 22 bp, Homo sapiens
gctccaggagctcacagctcgc

SEQ ID NO: 8002439 - DNA, 22 bp, Homo sapiens
gctccaggagagggaagcagat

SEQ ID NO: 8002440 - DNA, 22 bp, Homo sapiens
gctccaggagagggaagcagat

SEQ ID NO: 8002441 - DNA, 22 bp, Homo sapiens
gctccaggagctcacagctcgc

SEQ ID NO: 8002442 - DNA, 22 bp, Homo sapiens
gctccaggagctcacagctcgc

SEQ ID NO: 8002443 - DNA, 22 bp, Homo sapiens
gctccaggagctcacagctcgc

SEQ ID NO: 8002444 - DNA, 22 bp, Homo sapiens
gctccaggagctcacagctcgc

SEQ ID NO: 8002445 - DNA, 22 bp, Homo sapiens
gctcctggcaggcagtgtgtgt

SEQ ID NO: 8002446 - DNA, 22 bp, Homo sapiens
gctcctggcaggcagtgtgtgt

SEQ ID NO: 8002447 - DNA, 22 bp, Homo sapiens
gctcctggcaggcagtgtgtgt

SEQ ID NO: 8002448 - DNA, 22 bp, Homo sapiens
gctcctcttatttcatcagggc

SEQ ID NO: 8002449 - DNA, 22 bp, Homo sapiens
gctcctctgtcaaatgagagtg

SEQ ID NO: 8002450 - DNA, 22 bp, Homo sapiens
gctcctcttatttcatcagggc

SEQ ID NO: 8002451 - DNA, 22 bp, Homo sapiens
gctcctctgtcaaatgagagtg

SEQ ID NO: 8002452 - DNA, 22 bp, Homo sapiens
gctcctctcctcggagtcgggg

SEQ ID NO: 8002453 - DNA, 22 bp, Homo sapiens
gctcctctcccagagctgcagg

SEQ ID NO: 8002454 - DNA, 22 bp, Homo sapiens
gctcctggctctctgagggctg

SEQ ID NO: 8002455 - DNA, 22 bp, Homo sapiens
gctcctggctctctgagggctg

SEQ ID NO: 8002456 - DNA, 22 bp, Homo sapiens
gctcctggctctctgagggctg

SEQ ID NO: 8002457 - DNA, 22 bp, Homo sapiens
gctcctggctctctgagggctg

SEQ ID NO: 8002458 - DNA, 22 bp, Homo sapiens
gctcctggctctctgagggctg

SEQ ID NO: 8002459 - DNA, 22 bp, Homo sapiens
gctcctggctctctgagggctg

SEQ ID NO: 8002460 - DNA, 22 bp, Homo sapiens
gctcctggctctctgagggctg

SEQ ID NO: 8002461 - DNA, 22 bp, Homo sapiens
gctcctggctctctgagggctg

SEQ ID NO: 8002462 - DNA, 22 bp, Homo sapiens
gctcctggctccaggcagccaa

SEQ ID NO: 8002463 - DNA, 22 bp, Homo sapiens
gctcctggctccaggcagccaa

SEQ ID NO: 8002464 - DNA, 22 bp, Homo sapiens
gctcctggctccaggcagccaa

SEQ ID NO: 8002465 - DNA, 22 bp, Homo sapiens
gctcctggctccaggcagccaa

SEQ ID NO: 8002466 - DNA, 22 bp, Homo sapiens
gctcctggctccaggcagccaa

SEQ ID NO: 8002467 - DNA, 22 bp, Homo sapiens
gctcctggctccaggcagccaa

SEQ ID NO: 8002468 - DNA, 22 bp, Homo sapiens
gctcctggctccaggcagccaa

SEQ ID NO: 8002469 - DNA, 22 bp, Homo sapiens
gctcctggcatcctgcttttaa

SEQ ID NO: 8002470 - DNA, 22 bp, Homo sapiens
gctcctggcaggcagtgtgtgt

SEQ ID NO: 8002471 - DNA, 22 bp, Homo sapiens
gctcctggcatcctgcttttaa

SEQ ID NO: 8002472 - DNA, 22 bp, Homo sapiens
gctcctggccagcacagggccc

SEQ ID NO: 8002473 - DNA, 22 bp, Homo sapiens
gctcctggccagcacagggccc

SEQ ID NO: 8002474 - DNA, 22 bp, Homo sapiens
gctcctggccagcacagggccc

SEQ ID NO: 8002475 - DNA, 22 bp, Homo sapiens
gctcctggccagcacagggccc

SEQ ID NO: 8002476 - DNA, 22 bp, Homo sapiens
gctcctggccagcacagggccc

SEQ ID NO: 8002477 - DNA, 22 bp, Homo sapiens
gctcctggccagcacagggccc

SEQ ID NO: 8002478 - DNA, 22 bp, Homo sapiens
gctcctggccagcacagggccc

SEQ ID NO: 8002479 - DNA, 22 bp, Homo sapiens
gctcctggccagcacagggccc

SEQ ID NO: 8002480 - DNA, 22 bp, Homo sapiens
gctcctggccagcacagggccc

SEQ ID NO: 8002481 - DNA, 22 bp, Homo sapiens
gctcctggctccaggcagccaa

SEQ ID NO: 8002482 - DNA, 22 bp, Homo sapiens
gctcctggctccaggcagccaa

SEQ ID NO: 8002483 - DNA, 22 bp, Homo sapiens
gctcatttctgtttcttgcaac

SEQ ID NO: 8002484 - DNA, 21 bp, Homo sapiens
gctcatggtggagaaaagcag

SEQ ID NO: 8002485 - DNA, 22 bp, Homo sapiens
gctcatgggcccagagcagccc

SEQ ID NO: 8002486 - DNA, 22 bp, Homo sapiens
gctcatttcttctttccacaat

SEQ ID NO: 8002487 - DNA, 22 bp, Homo sapiens
gctccactgcccctgggcaccg

SEQ ID NO: 8002488 - DNA, 22 bp, Homo sapiens
gctccactaggaatctgctctt

SEQ ID NO: 8002489 - DNA, 22 bp, Homo sapiens
gctccactgcccctgggcaccg

SEQ ID NO: 8002490 - DNA, 22 bp, Homo sapiens
gctccactaggaatctgctctt

SEQ ID NO: 8002491 - DNA, 22 bp, Homo sapiens
gctccactaggaatctgctctt

SEQ ID NO: 8002492 - DNA, 22 bp, Homo sapiens
gctccactaggaatctgctctt

SEQ ID NO: 8002493 - DNA, 22 bp, Homo sapiens
gctccaaggtatccaccagggt

SEQ ID NO: 8002494 - DNA, 22 bp, Homo sapiens
gctccaaggtatccaccagggt

SEQ ID NO: 8002495 - DNA, 22 bp, Homo sapiens
gctccaagccttctttgttact

SEQ ID NO: 8002496 - DNA, 22 bp, Homo sapiens
gctccaagccttctttgttact

SEQ ID NO: 8002497 - DNA, 22 bp, Homo sapiens
gctccaaggtatccaccagggt

SEQ ID NO: 8002498 - DNA, 22 bp, Homo sapiens
gctccaaggtatccaccagggt

SEQ ID NO: 8002499 - DNA, 22 bp, Homo sapiens
gctccacttccttctgccctca

SEQ ID NO: 8002500 - DNA, 22 bp, Homo sapiens
gctccacttccttctgccctca

SEQ ID NO: 8002501 - DNA, 22 bp, Homo sapiens
gctccacttgcagctaggcttg

SEQ ID NO: 8002502 - DNA, 22 bp, Homo sapiens
gctccactgtcccatgggactt

SEQ ID NO: 8002503 - DNA, 22 bp, Homo sapiens
gctccactgtttattggcagaa

SEQ ID NO: 8002504 - DNA, 22 bp, Homo sapiens
gctccacttccttctgccctca

SEQ ID NO: 8002505 - DNA, 22 bp, Homo sapiens
gctccagagcagagactaggtt

SEQ ID NO: 8002506 - DNA, 22 bp, Homo sapiens
gctccagagcagagactaggtt

SEQ ID NO: 8002507 - DNA, 22 bp, Homo sapiens
gctccagagtgtggcatctggg

SEQ ID NO: 8002508 - DNA, 22 bp, Homo sapiens
gctccagagtgtggcatctggg

SEQ ID NO: 8002509 - DNA, 22 bp, Homo sapiens
gctccagagcagagactaggtt

SEQ ID NO: 8002510 - DNA, 21 bp, Homo sapiens
gctccagaactctatgctaac

SEQ ID NO: 8002511 - DNA, 22 bp, Homo sapiens
gctccacttgcagctaggcttg

SEQ ID NO: 8002512 - DNA, 17 bp, Homo sapiens
gctccagaattctagtc

SEQ ID NO: 8002513 - DNA, 17 bp, Homo sapiens
gctccagaattctagtc

SEQ ID NO: 8002514 - DNA, 21 bp, Homo sapiens
gctccagaactctatgctaac

SEQ ID NO: 8002515 - DNA, 22 bp, Homo sapiens
gctccagctccggctccgaagc

SEQ ID NO: 8002516 - DNA, 22 bp, Homo sapiens
gctccagctccggctccgaagc

SEQ ID NO: 8002517 - DNA, 22 bp, Homo sapiens
gctccagcacctagagcaggtc

SEQ ID NO: 8002518 - DNA, 22 bp, Homo sapiens
gctccagatgaatgcacttgtt

SEQ ID NO: 8002519 - DNA, 22 bp, Homo sapiens
gctccagatgaatgcacttgtt

SEQ ID NO: 8002520 - DNA, 22 bp, Homo sapiens
gctccagcacctagagcaggtc

SEQ ID NO: 8002521 - DNA, 22 bp, Homo sapiens
gctccagatgaatgcacttgtt

SEQ ID NO: 8002522 - DNA, 22 bp, Homo sapiens
gctccagatgaatgcacttgtt

SEQ ID NO: 8002523 - DNA, 22 bp, Homo sapiens
gctccagatgaaaggccagagg

SEQ ID NO: 8002524 - DNA, 22 bp, Homo sapiens
gctccagatgaaaggccagagg

SEQ ID NO: 8002525 - DNA, 22 bp, Homo sapiens
gctccagatgaaaggccagagg

SEQ ID NO: 8002526 - DNA, 22 bp, Homo sapiens
gctccagagtgtggcatctggg

SEQ ID NO: 8002527 - DNA, 22 bp, Homo sapiens
gctccagatgaaaggccagagg

SEQ ID NO: 8002528 - DNA, 22 bp, Homo sapiens
gctccagagtgtggcatctggg

SEQ ID NO: 8002529 - DNA, 22 bp, Homo sapiens
gctccagagtgtggcatctggg

SEQ ID NO: 8002530 - DNA, 22 bp, Homo sapiens
gctccagagtgtggcatctggg

SEQ ID NO: 8002531 - DNA, 22 bp, Homo sapiens
gctccagctcgtggctcccagc

SEQ ID NO: 8002532 - DNA, 22 bp, Homo sapiens
gctccagctcgtggctcccagc

SEQ ID NO: 8002533 - DNA, 22 bp, Homo sapiens
gctccagctccggctccgaagc

SEQ ID NO: 8002534 - DNA, 22 bp, Homo sapiens
gctccaggaagggaaatctcca

SEQ ID NO: 8002535 - DNA, 22 bp, Homo sapiens
gctccagctctgttctggggaa

SEQ ID NO: 8002536 - DNA, 22 bp, Homo sapiens
gctccagctctgttctggggaa

SEQ ID NO: 8002537 - DNA, 22 bp, Homo sapiens
gctccaggagagggaagcagat

SEQ ID NO: 8002538 - DNA, 22 bp, Homo sapiens
gctccaggaagggaaatctcca

SEQ ID NO: 8002539 - DNA, 22 bp, Homo sapiens
gctccaggagagggaagcagat

SEQ ID NO: 8002540 - DNA, 22 bp, Homo sapiens
gctccaggagagggaagcagat

SEQ ID NO: 8002541 - DNA, 22 bp, Homo sapiens
gctccaggagagggaagcagat

SEQ ID NO: 8002542 - DNA, 22 bp, Homo sapiens
gctcttctcagattgtacactc

SEQ ID NO: 8002543 - DNA, 22 bp, Homo sapiens
gctcttgaaataatggctaatg

SEQ ID NO: 8002544 - DNA, 22 bp, Homo sapiens
gctcttgaaactggggtttcca

SEQ ID NO: 8002545 - DNA, 22 bp, Homo sapiens
gctcttgaaactggggtttcca

SEQ ID NO: 8002546 - DNA, 22 bp, Homo sapiens
gctcttgaaaatcaaaagggaa

SEQ ID NO: 8002547 - DNA, 22 bp, Homo sapiens
gctcttctcagattgtacactc

SEQ ID NO: 8002548 - DNA, 22 bp, Homo sapiens
gctcttctaaagaatgtacagg

SEQ ID NO: 8002549 - DNA, 22 bp, Homo sapiens
gctcttctaaagaatgtacagg

SEQ ID NO: 8002550 - DNA, 22 bp, Homo sapiens
gctcttccatttctcttgaact

SEQ ID NO: 8002551 - DNA, 22 bp, Homo sapiens
gctcttctaaagaatgtacagg

SEQ ID NO: 8002552 - DNA, 22 bp, Homo sapiens
gctcttcagacaacgactccat

SEQ ID NO: 8002553 - DNA, 22 bp, Homo sapiens
gctcttcattctcccaaatagg

SEQ ID NO: 8002554 - DNA, 22 bp, Homo sapiens
gctcttcattctcccaaatagg

SEQ ID NO: 8002555 - DNA, 22 bp, Homo sapiens
gctcttatgtatgtatacgatg

SEQ ID NO: 8002556 - DNA, 22 bp, Homo sapiens
gctctgtgttgtcagaggcacc

SEQ ID NO: 8002557 - DNA, 22 bp, Homo sapiens
gctctgtgttgtcagaggcacc

SEQ ID NO: 8002558 - DNA, 22 bp, Homo sapiens
gctctgtgttgtcagaggcacc

SEQ ID NO: 8002559 - DNA, 22 bp, Homo sapiens
gctctgtgttgtcagaggcacc

SEQ ID NO: 8002560 - DNA, 22 bp, Homo sapiens
gctctgtgttgtcagaggcacc

SEQ ID NO: 8002561 - DNA, 22 bp, Homo sapiens
gctctgtgttcctctggattgc

SEQ ID NO: 8002562 - DNA, 22 bp, Homo sapiens
gctctgttcatcagtttgttgg

SEQ ID NO: 8002563 - DNA, 22 bp, Homo sapiens
gctctgtttatccctgacaatt

SEQ ID NO: 8002564 - DNA, 17 bp, Homo sapiens
gctctgccaggaaagag

SEQ ID NO: 8002565 - DNA, 17 bp, Homo sapiens
gctctgccaggaaagag

SEQ ID NO: 8002566 - DNA, 22 bp, Homo sapiens
gctctgccagacactgtggcca

SEQ ID NO: 8002567 - DNA, 22 bp, Homo sapiens
gctctgccagacactgtggcca

SEQ ID NO: 8002568 - DNA, 20 bp, Homo sapiens
gctctgccacttagaagctg

SEQ ID NO: 8002569 - DNA, 20 bp, Homo sapiens
gctctgccacttagaagctg

SEQ ID NO: 8002570 - DNA, 22 bp, Homo sapiens
gctctgcccaaagctgtggctg

SEQ ID NO: 8002571 - DNA, 22 bp, Homo sapiens
gctctgcccaaagctgtggctg

SEQ ID NO: 8002572 - DNA, 22 bp, Homo sapiens
gctctgcccaatgtccctacac

SEQ ID NO: 8002573 - DNA, 22 bp, Homo sapiens
gctctgtgttccctccaggctc

SEQ ID NO: 8002574 - DNA, 22 bp, Homo sapiens
gctctgtgttccctccaggctc

SEQ ID NO: 8002575 - DNA, 22 bp, Homo sapiens
gctctgtgttccctccaggctc

SEQ ID NO: 8002576 - DNA, 22 bp, Homo sapiens
gctctgtgttccctccaggctc

SEQ ID NO: 8002577 - DNA, 22 bp, Homo sapiens
gctctgtgtccacagctggaaa

SEQ ID NO: 8002578 - DNA, 22 bp, Homo sapiens
gctctgtgtccacagctggaaa

SEQ ID NO: 8002579 - DNA, 22 bp, Homo sapiens
gctgaaatgggcactgaaggcc

SEQ ID NO: 8002580 - DNA, 22 bp, Homo sapiens
gctcttgatgttcattgacttg

SEQ ID NO: 8002581 - DNA, 22 bp, Homo sapiens
gctgaaatgccttgtaaatatt

SEQ ID NO: 8002582 - DNA, 22 bp, Homo sapiens
gctcttggaagacaggatgtgt

SEQ ID NO: 8002583 - DNA, 22 bp, Homo sapiens
gctgaaatgccttgtaaatatt

SEQ ID NO: 8002584 - DNA, 22 bp, Homo sapiens
gctcttgatgttcattgacttg

SEQ ID NO: 8002585 - DNA, 22 bp, Homo sapiens
gctcttgatttccaggagctag

SEQ ID NO: 8002586 - DNA, 22 bp, Homo sapiens
gctcttgaatatgggtttcatg

SEQ ID NO: 8002587 - DNA, 21 bp, Homo sapiens
gctcttgaataagcataataa

SEQ ID NO: 8002588 - DNA, 22 bp, Homo sapiens
gctcttgaagtactgggtgttg

SEQ ID NO: 8002589 - DNA, 22 bp, Homo sapiens
gctcttgaagtactgggtgttg

SEQ ID NO: 8002590 - DNA, 22 bp, Homo sapiens
gctcttgacagctacatctggc

SEQ ID NO: 8002591 - DNA, 22 bp, Homo sapiens
gctcttgacagctacatctggc

SEQ ID NO: 8002592 - DNA, 22 bp, Homo sapiens
gctcttgactcccagttctgtg

SEQ ID NO: 8002593 - DNA, 22 bp, Homo sapiens
gctcttgactcccagttctgtg

SEQ ID NO: 8002594 - DNA, 22 bp, Homo sapiens
gctcttgactcccagttctgtg

SEQ ID NO: 8002595 - DNA, 22 bp, Homo sapiens
gctcttgaccttggagaactcg

SEQ ID NO: 8002596 - DNA, 22 bp, Homo sapiens
gctcttgaggaagtgcagggca

SEQ ID NO: 8002597 - DNA, 22 bp, Homo sapiens
gctcttgatacatcaagaactt

SEQ ID NO: 8002598 - DNA, 22 bp, Homo sapiens
gctgaaatgtctttagcagtgt

SEQ ID NO: 8002599 - DNA, 22 bp, Homo sapiens
gctgaaatgtctttagcagtgt

SEQ ID NO: 8002600 - DNA, 22 bp, Homo sapiens
gctgaaattagactgcagaagt

SEQ ID NO: 8002601 - DNA, 22 bp, Homo sapiens
gctgaaatgtttaatttgggag

SEQ ID NO: 8002602 - DNA, 22 bp, Homo sapiens
gctgaaattcagattcctaggc

SEQ ID NO: 8002603 - DNA, 22 bp, Homo sapiens
gctgaaattagactgcagaagt

SEQ ID NO: 8002604 - DNA, 18 bp, Homo sapiens
gctgaaattctaaacaaa

SEQ ID NO: 8002605 - DNA, 22 bp, Homo sapiens
gctgaaattcagattcctaggc

SEQ ID NO: 8002606 - DNA, 18 bp, Homo sapiens
gctgaaattctaaacaaa

SEQ ID NO: 8002607 - DNA, 19 bp, Homo sapiens
gctgaacaagtcagcaacc

SEQ ID NO: 8002608 - DNA, 22 bp, Homo sapiens
gctgagagtgggtgcagtgctt

SEQ ID NO: 8002609 - DNA, 22 bp, Homo sapiens
gctgagagtgggtgcagtgctt

SEQ ID NO: 8002610 - DNA, 22 bp, Homo sapiens
gctgagagtgggtgcagtgctt

SEQ ID NO: 8002611 - DNA, 22 bp, Homo sapiens
gctgagagtgggtgcagtgctt

SEQ ID NO: 8002612 - DNA, 22 bp, Homo sapiens
gctgagagtgtgagatcagatt

SEQ ID NO: 8002613 - DNA, 22 bp, Homo sapiens
gctgagagtgtaggatgtttac

SEQ ID NO: 8002614 - DNA, 22 bp, Homo sapiens
gctgagagtgggtgcagtgctt

SEQ ID NO: 8002615 - DNA, 22 bp, Homo sapiens
gctgagcacacctagggtagag

SEQ ID NO: 8002616 - DNA, 22 bp, Homo sapiens
gctgagattacgggcatgagcc

SEQ ID NO: 8002617 - DNA, 22 bp, Homo sapiens
gctgagattacgggcatgagcc

SEQ ID NO: 8002618 - DNA, 22 bp, Homo sapiens
gctgagcacagcctgtgtcctc

SEQ ID NO: 8002619 - DNA, 22 bp, Homo sapiens
gctgagcacacctagggtagag

SEQ ID NO: 8002620 - DNA, 22 bp, Homo sapiens
gctcctgggtgtggctgcccct

SEQ ID NO: 8002621 - DNA, 22 bp, Homo sapiens
gctcctggtctggagcttcaag

SEQ ID NO: 8002622 - DNA, 22 bp, Homo sapiens
gctcctggtctggagcttcaag

SEQ ID NO: 8002623 - DNA, 22 bp, Homo sapiens
gctcctggtctggagcttcaag

SEQ ID NO: 8002624 - DNA, 22 bp, Homo sapiens
gctctctttaaactgcatggct

SEQ ID NO: 8002625 - DNA, 22 bp, Homo sapiens
gctctctttaaactgcatggct

SEQ ID NO: 8002626 - DNA, 22 bp, Homo sapiens
gctcctgggtgtggctgcccct

SEQ ID NO: 8002627 - DNA, 22 bp, Homo sapiens
gctcctgggtgtggctgcccct

SEQ ID NO: 8002628 - DNA, 22 bp, Homo sapiens
gctcctgggtgtggctgcccct

SEQ ID NO: 8002629 - DNA, 22 bp, Homo sapiens
gctcctgggtgtggctgcccct

SEQ ID NO: 8002630 - DNA, 22 bp, Homo sapiens
gctcctgggctctaccttgcta

SEQ ID NO: 8002631 - DNA, 22 bp, Homo sapiens
gctcctgggctctaccttgcta

SEQ ID NO: 8002632 - DNA, 22 bp, Homo sapiens
gctctgagcccccagaagcaga

SEQ ID NO: 8002633 - DNA, 22 bp, Homo sapiens
gctctgagcccccagaagcaga

SEQ ID NO: 8002634 - DNA, 22 bp, Homo sapiens
gctctgagcactgtgcggctgg

SEQ ID NO: 8002635 - DNA, 22 bp, Homo sapiens
gctctgagcactgtgcggctgg

SEQ ID NO: 8002636 - DNA, 22 bp, Homo sapiens
gctctgaaaaatggaggttggc

SEQ ID NO: 8002637 - DNA, 22 bp, Homo sapiens
gctctgagcagggagaaacagg

SEQ ID NO: 8002638 - DNA, 22 bp, Homo sapiens
gctctctttcacagaggtagga

SEQ ID NO: 8002639 - DNA, 22 bp, Homo sapiens
gctctctttccatgtggaggat

SEQ ID NO: 8002640 - DNA, 22 bp, Homo sapiens
gctctctttttccagtggtggt

SEQ ID NO: 8002641 - DNA, 22 bp, Homo sapiens
gctctgaaaaatggaggttggc

SEQ ID NO: 8002642 - DNA, 22 bp, Homo sapiens
gctctgaaaaatggaggttggc

SEQ ID NO: 8002643 - DNA, 22 bp, Homo sapiens
gctcctggctctggccaaggga

SEQ ID NO: 8002644 - DNA, 22 bp, Homo sapiens
gctcctggctctggccaaggga

SEQ ID NO: 8002645 - DNA, 22 bp, Homo sapiens
gctcctggctctggccaaggga

SEQ ID NO: 8002646 - DNA, 22 bp, Homo sapiens
gctcctggctctggccaaggga

SEQ ID NO: 8002647 - DNA, 22 bp, Homo sapiens
gctcctggctctggccaaggga

SEQ ID NO: 8002648 - DNA, 22 bp, Homo sapiens
gctcctggctctggccaaggga

SEQ ID NO: 8002649 - DNA, 22 bp, Homo sapiens
gctcctggctctggccaaggga

SEQ ID NO: 8002650 - DNA, 22 bp, Homo sapiens
gctcctggctctctgagggctg

SEQ ID NO: 8002651 - DNA, 22 bp, Homo sapiens
gctcctggctctggccaaggga

SEQ ID NO: 8002652 - DNA, 22 bp, Homo sapiens
gctcctggcttcactgacatca

SEQ ID NO: 8002653 - DNA, 22 bp, Homo sapiens
gctcctggcttcactgacatca

SEQ ID NO: 8002654 - DNA, 22 bp, Homo sapiens
gctcctggcttcactgacatca

SEQ ID NO: 8002655 - DNA, 22 bp, Homo sapiens
gctcctggctctggccaaggga

SEQ ID NO: 8002656 - DNA, 22 bp, Homo sapiens
gctcctggcttcactgacatca

SEQ ID NO: 8002657 - DNA, 22 bp, Homo sapiens
gctcctggcttcactgacatca

SEQ ID NO: 8002658 - DNA, 16 bp, Homo sapiens
gctcctgggccctcga

SEQ ID NO: 8002659 - DNA, 16 bp, Homo sapiens
gctcctgggccctcga

SEQ ID NO: 8002660 - DNA, 22 bp, Homo sapiens
gctcctggcttcactgacatca

SEQ ID NO: 8002661 - DNA, 19 bp, Homo sapiens
gctcctgggcctcactcat

SEQ ID NO: 8002662 - DNA, 19 bp, Homo sapiens
gctcctgggcctcactcat

SEQ ID NO: 8002663 - DNA, 19 bp, Homo sapiens
gctcctgggcctcactcat

SEQ ID NO: 8002664 - DNA, 19 bp, Homo sapiens
gctcctgggcctcactcat

SEQ ID NO: 8002665 - DNA, 22 bp, Homo sapiens
gctcctgggctctaccttgcta

SEQ ID NO: 8002666 - DNA, 22 bp, Homo sapiens
gctcctgggccctgggctaact

SEQ ID NO: 8002667 - DNA, 22 bp, Homo sapiens
gctcctgggccctgggctaact

SEQ ID NO: 8002668 - DNA, 19 bp, Homo sapiens
gctcctgggcctcactcat

SEQ ID NO: 8002669 - DNA, 16 bp, Homo sapiens
gctcctgggccctcga

SEQ ID NO: 8002670 - DNA, 16 bp, Homo sapiens
gctcctgggccctcga

SEQ ID NO: 8002671 - DNA, 22 bp, Homo sapiens
gctcctgggccctgggctaact

SEQ ID NO: 8002672 - DNA, 22 bp, Homo sapiens
gctctgagccgggggcctgtcc

SEQ ID NO: 8002673 - DNA, 22 bp, Homo sapiens
gctctgagccgggggcctgtcc

SEQ ID NO: 8002674 - DNA, 22 bp, Homo sapiens
gctctgagctgtcttgcaggtc

SEQ ID NO: 8002675 - DNA, 22 bp, Homo sapiens
gctctgaggctgggagcactct

SEQ ID NO: 8002676 - DNA, 22 bp, Homo sapiens
gctctgaggctgggagcactct

SEQ ID NO: 8002677 - DNA, 22 bp, Homo sapiens
gctctgaggctgggagcactct

SEQ ID NO: 8002678 - DNA, 22 bp, Homo sapiens
gctctgagtaaatgaaagcatt

SEQ ID NO: 8002679 - DNA, 22 bp, Homo sapiens
gctctgaggctgtgaggtgctg

SEQ ID NO: 8002680 - DNA, 23 bp, Homo sapiens
gctctgagggcttatccctccca

SEQ ID NO: 8002681 - DNA, 21 bp, Homo sapiens
gctctgccacttaccagattt

SEQ ID NO: 8002682 - DNA, 21 bp, Homo sapiens
gctctgccacttaccagattt

SEQ ID NO: 8002683 - DNA, 23 bp, Homo sapiens
gctctgccacttaatagctgtgt

SEQ ID NO: 8002684 - DNA, 23 bp, Homo sapiens
gctctgccacttaatagctgtgt

SEQ ID NO: 8002685 - DNA, 18 bp, Homo sapiens
gctctgcaggtgctcggt

SEQ ID NO: 8002686 - DNA, 18 bp, Homo sapiens
gctctgcagctgaggctt

SEQ ID NO: 8002687 - DNA, 22 bp, Homo sapiens
gctctgagtgcatgcttttggg

SEQ ID NO: 8002688 - DNA, 22 bp, Homo sapiens
gctctgagtgatcagctgggaa

SEQ ID NO: 8002689 - DNA, 22 bp, Homo sapiens
gctctgagtgatcagctgggaa

SEQ ID NO: 8002690 - DNA, 22 bp, Homo sapiens
gctctgagtgagactagattta

SEQ ID NO: 8002691 - DNA, 22 bp, Homo sapiens
gctctgagtgagactagattta

SEQ ID NO: 8002692 - DNA, 22 bp, Homo sapiens
gctctgagtcacactgccctgt

SEQ ID NO: 8002693 - DNA, 22 bp, Homo sapiens
gctctgagtcacactgccctgt

SEQ ID NO: 8002694 - DNA, 22 bp, Homo sapiens
gctctgagtgattaaggagctt

SEQ ID NO: 8002695 - DNA, 22 bp, Homo sapiens
gctctgagtgattaaggagctt

SEQ ID NO: 8002696 - DNA, 22 bp, Homo sapiens
gctctgagtgcacatttacaca

SEQ ID NO: 8002697 - DNA, 22 bp, Homo sapiens
ttggccagagaccagagcaggg

SEQ ID NO: 8002698 - DNA, 22 bp, Homo sapiens
ttggccagagaccagagcaggg

SEQ ID NO: 8002699 - DNA, 22 bp, Homo sapiens
ttggccagactgaggtgctggg

SEQ ID NO: 8002700 - DNA, 22 bp, Homo sapiens
ttggccagactgaggtgctggg

SEQ ID NO: 8002701 - DNA, 22 bp, Homo sapiens
ttggccagactgaggtgctggg

SEQ ID NO: 8002702 - DNA, 22 bp, Homo sapiens
ttggccagaggtttctctcatg

SEQ ID NO: 8002703 - DNA, 22 bp, Homo sapiens
ttggccagaggtttctctcatg

SEQ ID NO: 8002704 - DNA, 22 bp, Homo sapiens
ttggccagaggtttctctcatg

SEQ ID NO: 8002705 - DNA, 22 bp, Homo sapiens
ttggccagaggtttctctcatg

SEQ ID NO: 8002706 - DNA, 22 bp, Homo sapiens
ttggccacaatccaagccttgg

SEQ ID NO: 8002707 - DNA, 22 bp, Homo sapiens
ttggccacaatccaagccttgg

SEQ ID NO: 8002708 - DNA, 22 bp, Homo sapiens
ttggccacactcactagagccc

SEQ ID NO: 8002709 - DNA, 22 bp, Homo sapiens
ttggccagaatcttcctagtga

SEQ ID NO: 8002710 - DNA, 22 bp, Homo sapiens
ttggccagaatcttcctagtga

SEQ ID NO: 8002711 - DNA, 21 bp, Homo sapiens
ttggccacgtctctccttccc

SEQ ID NO: 8002712 - DNA, 22 bp, Homo sapiens
ttggccagacactacccccctt

SEQ ID NO: 8002713 - DNA, 22 bp, Homo sapiens
ttggccagacactacccccctt

SEQ ID NO: 8002714 - DNA, 22 bp, Homo sapiens
ttggccaaaggaaagactactg

SEQ ID NO: 8002715 - DNA, 22 bp, Homo sapiens
ttggccaagggctctttaggct

SEQ ID NO: 8002716 - DNA, 22 bp, Homo sapiens
ttggccaattccagaggatcat

SEQ ID NO: 8002717 - DNA, 22 bp, Homo sapiens
ctcataatgtgactgtatttga

SEQ ID NO: 8002718 - DNA, 22 bp, Homo sapiens
ctcataatgtgactgtatttga

SEQ ID NO: 8002719 - DNA, 22 bp, Homo sapiens
ctcataaagtgagaatatgacc

SEQ ID NO: 8002720 - DNA, 22 bp, Homo sapiens
ctcataaagtgagaatatgacc

SEQ ID NO: 8002721 - DNA, 22 bp, Homo sapiens
ctcataaacattattcattatt

SEQ ID NO: 8002722 - DNA, 22 bp, Homo sapiens
ttggccagatctgaggatactg

SEQ ID NO: 8002723 - DNA, 22 bp, Homo sapiens
ttggccagaggtttctctcatg

SEQ ID NO: 8002724 - DNA, 22 bp, Homo sapiens
ctcatcaccacatataacaaag

SEQ ID NO: 8002725 - DNA, 22 bp, Homo sapiens
ctcatattgctggtggtctaag

SEQ ID NO: 8002726 - DNA, 22 bp, Homo sapiens
ctcatcaccacatataacaaag

SEQ ID NO: 8002727 - DNA, 22 bp, Homo sapiens
ctcatattgctggtggtctaag

SEQ ID NO: 8002728 - DNA, 22 bp, Homo sapiens
ctcatccaccctcaacaaagat

SEQ ID NO: 8002729 - DNA, 22 bp, Homo sapiens
ctcatagacaagcctcttttaa

SEQ ID NO: 8002730 - DNA, 22 bp, Homo sapiens
ctcatagacaagcctcttttaa

SEQ ID NO: 8002731 - DNA, 22 bp, Homo sapiens
ctcatactcccagccagctgtc

SEQ ID NO: 8002732 - DNA, 22 bp, Homo sapiens
ctcataatgtgactgtatttga

SEQ ID NO: 8002733 - DNA, 22 bp, Homo sapiens
ctcatatatttctgcattcaat

SEQ ID NO: 8002734 - DNA, 22 bp, Homo sapiens
ctcatagatttagatagatcga

SEQ ID NO: 8002735 - DNA, 22 bp, Homo sapiens
ttgggaggtcataaatctgttc

SEQ ID NO: 8002736 - DNA, 22 bp, Homo sapiens
ttgggaggtcataaatctgttc

SEQ ID NO: 8002737 - DNA, 22 bp, Homo sapiens
ttgggaggtcataaatctgttc

SEQ ID NO: 8002738 - DNA, 22 bp, Homo sapiens
ttgggaggtaatggagccaagt

SEQ ID NO: 8002739 - DNA, 22 bp, Homo sapiens
ttggctgctctgtgtttagtat

SEQ ID NO: 8002740 - DNA, 22 bp, Homo sapiens
ttgggatctcaaatccagctat

SEQ ID NO: 8002741 - DNA, 21 bp, Homo sapiens
ttgggatctgagaagtgaaaa

SEQ ID NO: 8002742 - DNA, 23 bp, Homo sapiens
ttgggcaaatcactaacgtctcc

SEQ ID NO: 8002743 - DNA, 22 bp, Homo sapiens
ttgggcaaagtgtttctggagc

SEQ ID NO: 8002744 - DNA, 22 bp, Homo sapiens
ttgggagttcctactgcggttt

SEQ ID NO: 8002745 - DNA, 22 bp, Homo sapiens
ttgggagtaataaaaaattcca

SEQ ID NO: 8002746 - DNA, 22 bp, Homo sapiens
ttgggatctacatagctatgta

SEQ ID NO: 8002747 - DNA, 22 bp, Homo sapiens
ttgggaggtcataaatctgttc

SEQ ID NO: 8002748 - DNA, 22 bp, Homo sapiens
ctcatccatgtcgtaacatatg

SEQ ID NO: 8002749 - DNA, 20 bp, Homo sapiens
ctcatctctgagcctcctgg

SEQ ID NO: 8002750 - DNA, 22 bp, Homo sapiens
ctcatctcccacctgcgtgcag

SEQ ID NO: 8002751 - DNA, 22 bp, Homo sapiens
ctcatctcccacctgcgtgcag

SEQ ID NO: 8002752 - DNA, 22 bp, Homo sapiens
ctcatctgctcttattatctta

SEQ ID NO: 8002753 - DNA, 22 bp, Homo sapiens
ctcatctgataaatcactctta

SEQ ID NO: 8002754 - DNA, 22 bp, Homo sapiens
ttggctgctatttccatattta

SEQ ID NO: 8002755 - DNA, 22 bp, Homo sapiens
ctcatctggcttcagtaacagt

SEQ ID NO: 8002756 - DNA, 22 bp, Homo sapiens
ctcatctgataaatcactctta

SEQ ID NO: 8002757 - DNA, 22 bp, Homo sapiens
ttgggcaggctggcagactgct

SEQ ID NO: 8002758 - DNA, 22 bp, Homo sapiens
ttgggcaggctggcagactgct

SEQ ID NO: 8002759 - DNA, 22 bp, Homo sapiens
ttgggcaggctggcagactgct

SEQ ID NO: 8002760 - DNA, 22 bp, Homo sapiens
ttgggcagggaaaggacaggca

SEQ ID NO: 8002761 - DNA, 22 bp, Homo sapiens
ttgggcaggaacagatgcttga

SEQ ID NO: 8002762 - DNA, 23 bp, Homo sapiens
ttgggcaggagagtaatgtgatc

SEQ ID NO: 8002763 - DNA, 22 bp, Homo sapiens
ttgggcagatgtttcctgtgga

SEQ ID NO: 8002764 - DNA, 22 bp, Homo sapiens
ttgggcagcattgcagttccct

SEQ ID NO: 8002765 - DNA, 22 bp, Homo sapiens
ttgggcagaggctgtgcagagg

SEQ ID NO: 8002766 - DNA, 22 bp, Homo sapiens
ttgggcagaggctgtgcagagg

SEQ ID NO: 8002767 - DNA, 22 bp, Homo sapiens
ttgggcagaggctgtgcagagg

SEQ ID NO: 8002768 - DNA, 22 bp, Homo sapiens
ttgggcagaggccaggaggatg

SEQ ID NO: 8002769 - DNA, 22 bp, Homo sapiens
ttgggcactgtgggttgtctgt

SEQ ID NO: 8002770 - DNA, 22 bp, Homo sapiens
ttgggcacggacaggtggggat

SEQ ID NO: 8002771 - DNA, 22 bp, Homo sapiens
ttgggcaaagtgtttctggagc

SEQ ID NO: 8002772 - DNA, 22 bp, Homo sapiens
ttgggcaccagtgcactgacag

SEQ ID NO: 8002773 - DNA, 22 bp, Homo sapiens
ttgggcacggacaggtggggat

SEQ ID NO: 8002774 - DNA, 22 bp, Homo sapiens
ttgggcacactttgctggggag

SEQ ID NO: 8002775 - DNA, 22 bp, Homo sapiens
ttgggcagaggccaggaggatg

SEQ ID NO: 8002776 - DNA, 22 bp, Homo sapiens
ttgggcagaggccaggaggatg

SEQ ID NO: 8002777 - DNA, 22 bp, Homo sapiens
ttgggcagaggccaggaggatg

SEQ ID NO: 8002778 - DNA, 22 bp, Homo sapiens
ttgggcactgtgggttgtctgt

SEQ ID NO: 8002779 - DNA, 22 bp, Homo sapiens
ttgatattagagtatttgtttg

SEQ ID NO: 8002780 - DNA, 22 bp, Homo sapiens
ttgatattagagtatttgtttg

SEQ ID NO: 8002781 - DNA, 22 bp, Homo sapiens
ttgatattcccgatttaaggta

SEQ ID NO: 8002782 - DNA, 22 bp, Homo sapiens
ttgatattagagtatttgtttg

SEQ ID NO: 8002783 - DNA, 22 bp, Homo sapiens
ttgatatgttaggaagactgat

SEQ ID NO: 8002784 - DNA, 22 bp, Homo sapiens
ttgatacaggccttctagatga

SEQ ID NO: 8002785 - DNA, 22 bp, Homo sapiens
ttgatacaggctctatttcatc

SEQ ID NO: 8002786 - DNA, 22 bp, Homo sapiens
ttgatacatagcacagtttagg

SEQ ID NO: 8002787 - DNA, 22 bp, Homo sapiens
ttgatacaggctctatttcatc

SEQ ID NO: 8002788 - DNA, 22 bp, Homo sapiens
ttgatacaggctctatttcatc

SEQ ID NO: 8002789 - DNA, 22 bp, Homo sapiens
ttgatacatttttaggataaac

SEQ ID NO: 8002790 - DNA, 22 bp, Homo sapiens
ttgatacccaagtgttatgggt

SEQ ID NO: 8002791 - DNA, 22 bp, Homo sapiens
ttgatacatgctctagagttga

SEQ ID NO: 8002792 - DNA, 22 bp, Homo sapiens
ttgatacatagcacagtttagg

SEQ ID NO: 8002793 - DNA, 22 bp, Homo sapiens
ttgatacatgctctagagttga

SEQ ID NO: 8002794 - DNA, 22 bp, Homo sapiens
ctcagtgcttctagcttgatga

SEQ ID NO: 8002795 - DNA, 22 bp, Homo sapiens
ttgatattctgagaagctgaag

SEQ ID NO: 8002796 - DNA, 22 bp, Homo sapiens
ttgatattctgagaagctgaag

SEQ ID NO: 8002797 - DNA, 20 bp, Homo sapiens
ctcagtgctttcattgcctc

SEQ ID NO: 8002798 - DNA, 20 bp, Homo sapiens
ctcagtgctttcattgcctc

SEQ ID NO: 8002799 - DNA, 20 bp, Homo sapiens
ctcagtgctttcattgcctc

SEQ ID NO: 8002800 - DNA, 22 bp, Homo sapiens
ctcagtgctttggatcctggat

SEQ ID NO: 8002801 - DNA, 22 bp, Homo sapiens
ctcagtttccccggcctgggcg

SEQ ID NO: 8002802 - DNA, 22 bp, Homo sapiens
ctcagtttcctcttctgttgaa

SEQ ID NO: 8002803 - DNA, 22 bp, Homo sapiens
ctcagtttcctcttctgttgaa

SEQ ID NO: 8002804 - DNA, 22 bp, Homo sapiens
ctcagtttcctcaactgcaaaa

SEQ ID NO: 8002805 - DNA, 22 bp, Homo sapiens
ctcagtttcctcaactgcaaaa

SEQ ID NO: 8002806 - DNA, 22 bp, Homo sapiens
ctcagtttctgacattaaaatc

SEQ ID NO: 8002807 - DNA, 22 bp, Homo sapiens
ctcagtttctgacattaaaatc

SEQ ID NO: 8002808 - DNA, 22 bp, Homo sapiens
ctcagtttctgacattaaaatc

SEQ ID NO: 8002809 - DNA, 22 bp, Homo sapiens
ctcagtttctgacattaaaatc

SEQ ID NO: 8002810 - DNA, 22 bp, Homo sapiens
ctcagtttcttactctgtataa

SEQ ID NO: 8002811 - DNA, 22 bp, Homo sapiens
ctcagtttcttactctgtataa

SEQ ID NO: 8002812 - DNA, 22 bp, Homo sapiens
ctcagtttctggataagctggg

SEQ ID NO: 8002813 - DNA, 22 bp, Homo sapiens
ctcagtttgtgtgatattgtct

SEQ ID NO: 8002814 - DNA, 22 bp, Homo sapiens
ctcagtttgtgtgatattgtct

SEQ ID NO: 8002815 - DNA, 22 bp, Homo sapiens
ctcagtttgtgtgatattgtct

SEQ ID NO: 8002816 - DNA, 22 bp, Homo sapiens
ctcagtttgtgtgatattgtct

SEQ ID NO: 8002817 - DNA, 22 bp, Homo sapiens
ctcagtttgaggggtaggtgtt

SEQ ID NO: 8002818 - DNA, 22 bp, Homo sapiens
ctcagtttcttactctgtataa

SEQ ID NO: 8002819 - DNA, 22 bp, Homo sapiens
ctcagtttcttcatattgtagg

SEQ ID NO: 8002820 - DNA, 22 bp, Homo sapiens
ctcagtttcttcatattgtagg

SEQ ID NO: 8002821 - DNA, 22 bp, Homo sapiens
ctcagtttttgctgtctggttc

SEQ ID NO: 8002822 - DNA, 22 bp, Homo sapiens
ttgctttgccaccagaagtcta

SEQ ID NO: 8002823 - DNA, 22 bp, Homo sapiens
ctcagttttgctagctggagtt

SEQ ID NO: 8002824 - DNA, 22 bp, Homo sapiens
ttggaaaaacacgatagtggtt

SEQ ID NO: 8002825 - DNA, 22 bp, Homo sapiens
ttgctttttaattaggaggcag

SEQ ID NO: 8002826 - DNA, 22 bp, Homo sapiens
ttggaaaacttacacagagctg

SEQ ID NO: 8002827 - DNA, 22 bp, Homo sapiens
ttggaaaaattgcctgatgtct

SEQ ID NO: 8002828 - DNA, 22 bp, Homo sapiens
ttggatcttatgaaggtggcat

SEQ ID NO: 8002829 - DNA, 20 bp, Homo sapiens
ttggatctaaaatgtgggga

SEQ ID NO: 8002830 - DNA, 22 bp, Homo sapiens
ttggaaaagcgttctctgtagc

SEQ ID NO: 8002831 - DNA, 22 bp, Homo sapiens
ttggaaaagcgttctctgtagc

SEQ ID NO: 8002832 - DNA, 22 bp, Homo sapiens
ttggaaaacttacacagagctg

SEQ ID NO: 8002833 - DNA, 22 bp, Homo sapiens
ttggaaaagcgttctctgtagc

SEQ ID NO: 8002834 - DNA, 22 bp, Homo sapiens
ttggcattgaagtttcattggt

SEQ ID NO: 8002835 - DNA, 22 bp, Homo sapiens
ttggatgaggttgagaatcatt

SEQ ID NO: 8002836 - DNA, 22 bp, Homo sapiens
ttggcatttatctttaatcaaa

SEQ ID NO: 8002837 - DNA, 22 bp, Homo sapiens
ttggcattggagatgcaagaac

SEQ ID NO: 8002838 - DNA, 22 bp, Homo sapiens
ttggcatttattctaaggtcaa

SEQ ID NO: 8002839 - DNA, 22 bp, Homo sapiens
ttgcttttgggaaaacatgcct

SEQ ID NO: 8002840 - DNA, 22 bp, Homo sapiens
ttgcttttgtgtgctctctgga

SEQ ID NO: 8002841 - DNA, 22 bp, Homo sapiens
ttgcttttgtgtgctctctgga

SEQ ID NO: 8002842 - DNA, 22 bp, Homo sapiens
ttgcttttgggaaaacatgcct

SEQ ID NO: 8002843 - DNA, 22 bp, Homo sapiens
ttgcttttccctgtctctgatt

SEQ ID NO: 8002844 - DNA, 22 bp, Homo sapiens
ttgcttttaattaatcattgct

SEQ ID NO: 8002845 - DNA, 22 bp, Homo sapiens
ttgctttgttactgcagtttcc

SEQ ID NO: 8002846 - DNA, 22 bp, Homo sapiens
ttgcttttaatctttgtacatc

SEQ ID NO: 8002847 - DNA, 22 bp, Homo sapiens
ttgcttttaatctttgtacatc

SEQ ID NO: 8002848 - DNA, 22 bp, Homo sapiens
ttgcttttaatctttgtacatc

SEQ ID NO: 8002849 - DNA, 22 bp, Homo sapiens
ttgctttgtggtggttcttcca

SEQ ID NO: 8002850 - DNA, 22 bp, Homo sapiens
ttgctttgtggtggttcttcca

SEQ ID NO: 8002851 - DNA, 22 bp, Homo sapiens
ttgctttgtggtggttcttcca

SEQ ID NO: 8002852 - DNA, 18 bp, Homo sapiens
ttgctttgtaagcttgca

SEQ ID NO: 8002853 - DNA, 18 bp, Homo sapiens
ttgctttgtaagcttgca

SEQ ID NO: 8002854 - DNA, 22 bp, Homo sapiens
tttaaaaaactagtctgagtct

SEQ ID NO: 8002855 - DNA, 22 bp, Homo sapiens
tttaaaaaactagtctgagtct

SEQ ID NO: 8002856 - DNA, 22 bp, Homo sapiens
tttaaaaaactagtctgagtct

SEQ ID NO: 8002857 - DNA, 22 bp, Homo sapiens
tttaaaaaactagtctgagtct

SEQ ID NO: 8002858 - DNA, 22 bp, Homo sapiens
tttaaaaaactagtctgagtct

SEQ ID NO: 8002859 - DNA, 22 bp, Homo sapiens
tttaaaaaactagtctgagtct

SEQ ID NO: 8002860 - DNA, 22 bp, Homo sapiens
tttaaaaaactagtctgagtct

SEQ ID NO: 8002861 - DNA, 22 bp, Homo sapiens
tttaaaaaactagtctgagtct

SEQ ID NO: 8002862 - DNA, 22 bp, Homo sapiens
tttaaaaaactagtctgagtct

SEQ ID NO: 8002863 - DNA, 22 bp, Homo sapiens
tttaaaaaactagtctgagtct

SEQ ID NO: 8002864 - DNA, 22 bp, Homo sapiens
tttaaaaaactagtctgagtct

SEQ ID NO: 8002865 - DNA, 22 bp, Homo sapiens
tttaaaaaactagtctgagtct

SEQ ID NO: 8002866 - DNA, 22 bp, Homo sapiens
tttaaaaaactagtctgagtct

SEQ ID NO: 8002867 - DNA, 22 bp, Homo sapiens
ctccagtgcacccagaggattt

SEQ ID NO: 8002868 - DNA, 22 bp, Homo sapiens
ctccagtgccctccttgggggc

SEQ ID NO: 8002869 - DNA, 22 bp, Homo sapiens
ctccagtgccctccttgggggc

SEQ ID NO: 8002870 - DNA, 22 bp, Homo sapiens
ctccagtgcgcaggacagcccc

SEQ ID NO: 8002871 - DNA, 22 bp, Homo sapiens
tttaaaaaactagtctgagtct

SEQ ID NO: 8002872 - DNA, 22 bp, Homo sapiens
tttaaaaaactagtctgagtct

SEQ ID NO: 8002873 - DNA, 22 bp, Homo sapiens
ttgtttcatggggatgtttatt

SEQ ID NO: 8002874 - DNA, 22 bp, Homo sapiens
tttaaaaaactagtctgagtct

SEQ ID NO: 8002875 - DNA, 22 bp, Homo sapiens
ttgtttcaggatggtttgttac

SEQ ID NO: 8002876 - DNA, 22 bp, Homo sapiens
ttgtttcatggggatgtttatt

SEQ ID NO: 8002877 - DNA, 22 bp, Homo sapiens
ttgtttcatggggatgtttatt

SEQ ID NO: 8002878 - DNA, 22 bp, Homo sapiens
ctccagtcatagtctgtcttgt

SEQ ID NO: 8002879 - DNA, 22 bp, Homo sapiens
ctccagtcatagtctgtcttgt

SEQ ID NO: 8002880 - DNA, 22 bp, Homo sapiens
ctccagtcatgtttactgtgca

SEQ ID NO: 8002881 - DNA, 22 bp, Homo sapiens
ctccagtcatgtttactgtgca

SEQ ID NO: 8002882 - DNA, 22 bp, Homo sapiens
ctccagtcctagtctcttgctt

SEQ ID NO: 8002883 - DNA, 22 bp, Homo sapiens
ctccagtcatgtttactgtgca

SEQ ID NO: 8002884 - DNA, 22 bp, Homo sapiens
ctccagtcctagtctcttgctt

SEQ ID NO: 8002885 - DNA, 22 bp, Homo sapiens
ctccagtcctagtctcttgctt

SEQ ID NO: 8002886 - DNA, 22 bp, Homo sapiens
ctccagtcatagcctcttgagt

SEQ ID NO: 8002887 - DNA, 22 bp, Homo sapiens
ctccagtcatagcctcttgagt

SEQ ID NO: 8002888 - DNA, 22 bp, Homo sapiens
ctccaggtgcagaaggactcag

SEQ ID NO: 8002889 - DNA, 22 bp, Homo sapiens
ctccaggtagttatttcaagaa

SEQ ID NO: 8002890 - DNA, 22 bp, Homo sapiens
ctccaggttttacaaggtctat

SEQ ID NO: 8002891 - DNA, 22 bp, Homo sapiens
ctccaggttacttagcctagct

SEQ ID NO: 8002892 - DNA, 22 bp, Homo sapiens
ctccaggttacttagcctagct

SEQ ID NO: 8002893 - DNA, 22 bp, Homo sapiens
ctccaggttacttagcctagct

SEQ ID NO: 8002894 - DNA, 22 bp, Homo sapiens
ctccaggttacttagcctagct

SEQ ID NO: 8002895 - DNA, 22 bp, Homo sapiens
ctccagtctagtagagcctgct

SEQ ID NO: 8002896 - DNA, 22 bp, Homo sapiens
ctccagtctagtagagcctgct

SEQ ID NO: 8002897 - DNA, 22 bp, Homo sapiens
ctccagtctaggtcctacttat

SEQ ID NO: 8002898 - DNA, 22 bp, Homo sapiens
ctccagtctaggtcctacttat

SEQ ID NO: 8002899 - DNA, 22 bp, Homo sapiens
ctccagtctagtagagcctgct

SEQ ID NO: 8002900 - DNA, 22 bp, Homo sapiens
ctccagtctttcagatgtccct

SEQ ID NO: 8002901 - DNA, 22 bp, Homo sapiens
ctccagtgagcgcggggcatgg

SEQ ID NO: 8002902 - DNA, 22 bp, Homo sapiens
ctccagtctttcagatgtccct

SEQ ID NO: 8002903 - DNA, 22 bp, Homo sapiens
ctccagtcttctcatgtatccc

SEQ ID NO: 8002904 - DNA, 22 bp, Homo sapiens
ctccagtctctttcggagacac

SEQ ID NO: 8002905 - DNA, 22 bp, Homo sapiens
ctccagtgagtgagcaggcgac

SEQ ID NO: 8002906 - DNA, 22 bp, Homo sapiens
ctccagtgagtgagcaggcgac

SEQ ID NO: 8002907 - DNA, 22 bp, Homo sapiens
ctccagtgagcgcggggcatgg

SEQ ID NO: 8002908 - DNA, 22 bp, Homo sapiens
ctccagtgagcgcggggcatgg

SEQ ID NO: 8002909 - DNA, 22 bp, Homo sapiens
ctccagtgagtgagcaggcgac

SEQ ID NO: 8002910 - DNA, 22 bp, Homo sapiens
ctccagtgagtgagcaggcgac

SEQ ID NO: 8002911 - DNA, 22 bp, Homo sapiens
ctccagtgcacccagaggattt

SEQ ID NO: 8002912 - DNA, 22 bp, Homo sapiens
ctccagtgagtgagcaggcgac

SEQ ID NO: 8002913 - DNA, 22 bp, Homo sapiens
ctccagtgagtgagcaggcgac

SEQ ID NO: 8002914 - DNA, 22 bp, Homo sapiens
ttgtattttgttatgctactgc

SEQ ID NO: 8002915 - DNA, 22 bp, Homo sapiens
ttgtattttgttatgctactgc

SEQ ID NO: 8002916 - DNA, 22 bp, Homo sapiens
ttgtattttgttatgctactgc

SEQ ID NO: 8002917 - DNA, 22 bp, Homo sapiens
ttgtgtactacagtatgccaca

SEQ ID NO: 8002918 - DNA, 22 bp, Homo sapiens
ttgtgtacaggtgtttccaagt

SEQ ID NO: 8002919 - DNA, 22 bp, Homo sapiens
ttgtattttgttatgctactgc

SEQ ID NO: 8002920 - DNA, 22 bp, Homo sapiens
ttgtgtactgttggttgatatt

SEQ ID NO: 8002921 - DNA, 22 bp, Homo sapiens
ttgttaaaactccattggtttg

SEQ ID NO: 8002922 - DNA, 22 bp, Homo sapiens
ttgttaaaactccattggtttg

SEQ ID NO: 8002923 - DNA, 22 bp, Homo sapiens
ttgttaaaatgcatattctggt

SEQ ID NO: 8002924 - DNA, 22 bp, Homo sapiens
ttgttaaaatgcatattctggt

SEQ ID NO: 8002925 - DNA, 22 bp, Homo sapiens
ttgttaaaatgcatattctggt

SEQ ID NO: 8002926 - DNA, 22 bp, Homo sapiens
ttgttaaaatgcatattctggt

SEQ ID NO: 8002927 - DNA, 22 bp, Homo sapiens
ttgttaaaatgaggtcattctg

SEQ ID NO: 8002928 - DNA, 22 bp, Homo sapiens
ttgttaaaatgaggtcattctg

SEQ ID NO: 8002929 - DNA, 22 bp, Homo sapiens
ttgttaaaatgaggtcattctg

SEQ ID NO: 8002930 - DNA, 22 bp, Homo sapiens
ttgttaaaatgaggtcattctg

SEQ ID NO: 8002931 - DNA, 22 bp, Homo sapiens
ttgttaaaatgaggtcattctg

SEQ ID NO: 8002932 - DNA, 22 bp, Homo sapiens
ttgttaaaatattggagaaagg

SEQ ID NO: 8002933 - DNA, 22 bp, Homo sapiens
ttgttaaagatgcagattccat

SEQ ID NO: 8002934 - DNA, 22 bp, Homo sapiens
ttgttaaaggcaaaacaagcac

SEQ ID NO: 8002935 - DNA, 22 bp, Homo sapiens
ttgttaaaggcaaaacaagcac

SEQ ID NO: 8002936 - DNA, 22 bp, Homo sapiens
ttgttaaatggatgcagaataa

SEQ ID NO: 8002937 - DNA, 22 bp, Homo sapiens
ttgttaaatggatgcagaataa

SEQ ID NO: 8002938 - DNA, 22 bp, Homo sapiens
ttgttaagggttatgcagcttt

SEQ ID NO: 8002939 - DNA, 23 bp, Homo sapiens
ttgttaactttcctgcccctaca

SEQ ID NO: 8002940 - DNA, 21 bp, Homo sapiens
ttgttacaatgcaagagtatg

SEQ ID NO: 8002941 - DNA, 21 bp, Homo sapiens
ttgttacaatgcaagagtatg

SEQ ID NO: 8002942 - DNA, 22 bp, Homo sapiens
ttgttacagatcacatttctgc

SEQ ID NO: 8002943 - DNA, 22 bp, Homo sapiens
ttgttaaaggcaaaacaagcac

SEQ ID NO: 8002944 - DNA, 22 bp, Homo sapiens
ttgttacagatcacatttctgc

SEQ ID NO: 8002945 - DNA, 22 bp, Homo sapiens
ttgttacagcacttaacctttt

SEQ ID NO: 8002946 - DNA, 22 bp, Homo sapiens
ttgttacacataataacatttt

SEQ ID NO: 8002947 - DNA, 22 bp, Homo sapiens
ttgttacacataataacatttt

SEQ ID NO: 8002948 - DNA, 22 bp, Homo sapiens
ttgttacacataataacatttt

SEQ ID NO: 8002949 - DNA, 22 bp, Homo sapiens
ttgttacacataataacatttt

SEQ ID NO: 8002950 - DNA, 22 bp, Homo sapiens
ttgttacagcagcaatagaaaa

SEQ ID NO: 8002951 - DNA, 22 bp, Homo sapiens
ttgttacagcagcaatagaaaa

SEQ ID NO: 8002952 - DNA, 22 bp, Homo sapiens
ttgttacagcacttaacctttt

SEQ ID NO: 8002953 - DNA, 22 bp, Homo sapiens
ttgttacagcagcaatagaaaa

SEQ ID NO: 8002954 - DNA, 22 bp, Homo sapiens
ctccagggttccccgatccact

SEQ ID NO: 8002955 - DNA, 22 bp, Homo sapiens
ttgttacagcagcaatagaaaa

SEQ ID NO: 8002956 - DNA, 22 bp, Homo sapiens
ctccaggtagctaagtcctggg

SEQ ID NO: 8002957 - DNA, 22 bp, Homo sapiens
ctccaggtagctaagtcctggg

SEQ ID NO: 8002958 - DNA, 22 bp, Homo sapiens
ttgtatttgattgtcatatcgt

SEQ ID NO: 8002959 - DNA, 22 bp, Homo sapiens
ttgtatttgattgtcatatcgt

SEQ ID NO: 8002960 - DNA, 22 bp, Homo sapiens
ttgtatttgattgtcatatcgt

SEQ ID NO: 8002961 - DNA, 22 bp, Homo sapiens
ttgtatttgattgtcatatcgt

SEQ ID NO: 8002962 - DNA, 22 bp, Homo sapiens
ttgtatttgattgtcatatcgt

SEQ ID NO: 8002963 - DNA, 22 bp, Homo sapiens
ttgtatttgggtagtatagaga

SEQ ID NO: 8002964 - DNA, 22 bp, Homo sapiens
ttgtatttgggtagtatagaga

SEQ ID NO: 8002965 - DNA, 22 bp, Homo sapiens
ttgtatttgggtagtatagaga

SEQ ID NO: 8002966 - DNA, 22 bp, Homo sapiens
ttgtatttgggtagtatagaga

SEQ ID NO: 8002967 - DNA, 22 bp, Homo sapiens
ttgtatttgggtagtatagaga

SEQ ID NO: 8002968 - DNA, 22 bp, Homo sapiens
ttgtatttgggtagtatagaga

SEQ ID NO: 8002969 - DNA, 22 bp, Homo sapiens
ttgtatttgattgtcatatcgt

SEQ ID NO: 8002970 - DNA, 22 bp, Homo sapiens
ttgtatttgattgtcatatcgt

SEQ ID NO: 8002971 - DNA, 22 bp, Homo sapiens
ttgtatttgattgtcatatcgt

SEQ ID NO: 8002972 - DNA, 22 bp, Homo sapiens
ttgtatttcttccggtctcatt

SEQ ID NO: 8002973 - DNA, 22 bp, Homo sapiens
ttgtatttctccactttctgtt

SEQ ID NO: 8002974 - DNA, 22 bp, Homo sapiens
ttgtatttctccactttctgtt

SEQ ID NO: 8002975 - DNA, 22 bp, Homo sapiens
ttgtatttcttccggtctcatt

SEQ ID NO: 8002976 - DNA, 22 bp, Homo sapiens
ttgtatttctccactttctgtt

SEQ ID NO: 8002977 - DNA, 22 bp, Homo sapiens
ttgtatttctccactttctgtt

SEQ ID NO: 8002978 - DNA, 22 bp, Homo sapiens
ttgtatttctccactttctgtt

SEQ ID NO: 8002979 - DNA, 22 bp, Homo sapiens
ctccagggatgagacagagtag

SEQ ID NO: 8002980 - DNA, 22 bp, Homo sapiens
ctccagggatgagacagagtag

SEQ ID NO: 8002981 - DNA, 22 bp, Homo sapiens
ctccagggcagcatggcagtgg

SEQ ID NO: 8002982 - DNA, 22 bp, Homo sapiens
ctccagggcagcatggcagtgg

SEQ ID NO: 8002983 - DNA, 22 bp, Homo sapiens
ctccagggatgagacagagtag

SEQ ID NO: 8002984 - DNA, 22 bp, Homo sapiens
ctccagggaggtctgcaggact

SEQ ID NO: 8002985 - DNA, 22 bp, Homo sapiens
ctccagggaggtctgcaggact

SEQ ID NO: 8002986 - DNA, 22 bp, Homo sapiens
ctccagggaggtctgcaggact

SEQ ID NO: 8002987 - DNA, 22 bp, Homo sapiens
ctccagggaggtctgcaggact

SEQ ID NO: 8002988 - DNA, 22 bp, Homo sapiens
ctccagggaggtctgcaggact

SEQ ID NO: 8002989 - DNA, 22 bp, Homo sapiens
ctccagggaggagcacgggttc

SEQ ID NO: 8002990 - DNA, 22 bp, Homo sapiens
ctccagggaggtctgcaggact

SEQ ID NO: 8002991 - DNA, 22 bp, Homo sapiens
ctccagggaggtctgcaggact

SEQ ID NO: 8002992 - DNA, 22 bp, Homo sapiens
ctccaggggccagaagcctggc

SEQ ID NO: 8002993 - DNA, 22 bp, Homo sapiens
ctccaggggccagaagcctggc

SEQ ID NO: 8002994 - DNA, 22 bp, Homo sapiens
ctccaggggccagaagcctggc

SEQ ID NO: 8002995 - DNA, 22 bp, Homo sapiens
ctccagggcagcatggcagtgg

SEQ ID NO: 8002996 - DNA, 22 bp, Homo sapiens
ctccagggcagcatggcagtgg

SEQ ID NO: 8002997 - DNA, 20 bp, Homo sapiens
ctccaggggaagagccttcc

SEQ ID NO: 8002998 - DNA, 22 bp, Homo sapiens
ctccagggctaccaggttttag

SEQ ID NO: 8002999 - DNA, 22 bp, Homo sapiens
ttgggtctgtttagctgagaag

SEQ ID NO: 8003000 - DNA, 22 bp, Homo sapiens
ttgggtcttatggctggagtag

SEQ ID NO: 8003001 - DNA, 22 bp, Homo sapiens
ttgggtctacgtagaaagaaca

SEQ ID NO: 8003002 - DNA, 22 bp, Homo sapiens
ttgggtggtggggagagttcag

SEQ ID NO: 8003003 - DNA, 22 bp, Homo sapiens
ttgggtggtggggagagttcag

SEQ ID NO: 8003004 - DNA, 22 bp, Homo sapiens
ttgggtggtggggagagttcag

SEQ ID NO: 8003005 - DNA, 22 bp, Homo sapiens
ttgggtgctgtcatggggcacg

SEQ ID NO: 8003006 - DNA, 22 bp, Homo sapiens
ttgggtgggtcaggactcggag

SEQ ID NO: 8003007 - DNA, 22 bp, Homo sapiens
ttgggtgggtcaggactcggag

SEQ ID NO: 8003008 - DNA, 22 bp, Homo sapiens
ttgggtgggtcaggactcggag

SEQ ID NO: 8003009 - DNA, 22 bp, Homo sapiens
ttggtaaattatttcttccaat

SEQ ID NO: 8003010 - DNA, 22 bp, Homo sapiens
ttggtacatgcagatatttagt

SEQ ID NO: 8003011 - DNA, 22 bp, Homo sapiens
ttgggttttcccttgaaactga

SEQ ID NO: 8003012 - DNA, 22 bp, Homo sapiens
ttgggttttgatacatgtctaa

SEQ ID NO: 8003013 - DNA, 22 bp, Homo sapiens
ttgggttttgatacatgtctaa

SEQ ID NO: 8003014 - DNA, 22 bp, Homo sapiens
ttggtaaaatcatagtggtaac

SEQ ID NO: 8003015 - DNA, 22 bp, Homo sapiens
ttggtaaataacaatcacagtg

SEQ ID NO: 8003016 - DNA, 22 bp, Homo sapiens
ttggtaaacttgacagagaatc

SEQ ID NO: 8003017 - DNA, 22 bp, Homo sapiens
ttggtaaatccccttacacaaa

SEQ ID NO: 8003018 - DNA, 22 bp, Homo sapiens
ttggtagaagaatatgagtatt

SEQ ID NO: 8003019 - DNA, 22 bp, Homo sapiens
ttggtaggggactagagtccag

SEQ ID NO: 8003020 - DNA, 22 bp, Homo sapiens
ttggtacatgcagatatttagt

SEQ ID NO: 8003021 - DNA, 22 bp, Homo sapiens
ttggtagaatgaacattcattg

SEQ ID NO: 8003022 - DNA, 22 bp, Homo sapiens
ttggtatacaaatatttagcac

SEQ ID NO: 8003023 - DNA, 21 bp, Homo sapiens
ttggtatgactctgcaggtga

SEQ ID NO: 8003024 - DNA, 22 bp, Homo sapiens
ttggtattttacaatgtcagtg

SEQ ID NO: 8003025 - DNA, 22 bp, Homo sapiens
ttggtcacatgagtataaaacg

SEQ ID NO: 8003026 - DNA, 22 bp, Homo sapiens
ttggtcacatgagtataaaacg

SEQ ID NO: 8003027 - DNA, 22 bp, Homo sapiens
ttggtcacctgctgtcctttgt

SEQ ID NO: 8003028 - DNA, 22 bp, Homo sapiens
ttggtcaccataaagaagaaca

SEQ ID NO: 8003029 - DNA, 22 bp, Homo sapiens
ttggtcaagtcttaaagaaaaa

SEQ ID NO: 8003030 - DNA, 22 bp, Homo sapiens
ttggtcaagtcttaaagaaaaa

SEQ ID NO: 8003031 - DNA, 22 bp, Homo sapiens
ttggtcaaggacattacagttt

SEQ ID NO: 8003032 - DNA, 22 bp, Homo sapiens
ctccagggagctgcgggagcca

SEQ ID NO: 8003033 - DNA, 22 bp, Homo sapiens
ctccaggcgcttaccaagcgct

SEQ ID NO: 8003034 - DNA, 22 bp, Homo sapiens
ctccaggcgccgcttttgcagt

SEQ ID NO: 8003035 - DNA, 22 bp, Homo sapiens
ctccaggcgcttaccaagcgct

SEQ ID NO: 8003036 - DNA, 22 bp, Homo sapiens
ctccaggcgccgcttttgcagt

SEQ ID NO: 8003037 - DNA, 22 bp, Homo sapiens
ctccagggagcttggaaagacc

SEQ ID NO: 8003038 - DNA, 22 bp, Homo sapiens
ctccagggagcttggaaagacc

SEQ ID NO: 8003039 - DNA, 22 bp, Homo sapiens
ctccagggaggagcacgggttc

SEQ ID NO: 8003040 - DNA, 22 bp, Homo sapiens
ctccagggagctgtggaggttt

SEQ ID NO: 8003041 - DNA, 22 bp, Homo sapiens
ctccagggagcttggaaagacc

SEQ ID NO: 8003042 - DNA, 22 bp, Homo sapiens
ctccagggagctgtggaggttt

SEQ ID NO: 8003043 - DNA, 22 bp, Homo sapiens
ctctccagccaggggcttcctg

SEQ ID NO: 8003044 - DNA, 22 bp, Homo sapiens
ctctccagccaggggcttcctg

SEQ ID NO: 8003045 - DNA, 22 bp, Homo sapiens
ctctccagccaggggcttcctg

SEQ ID NO: 8003046 - DNA, 22 bp, Homo sapiens
ctctccagccaggggcttcctg

SEQ ID NO: 8003047 - DNA, 22 bp, Homo sapiens
ctctccagccacagaagctgct

SEQ ID NO: 8003048 - DNA, 22 bp, Homo sapiens
ctctccagccacagaagctgct

SEQ ID NO: 8003049 - DNA, 22 bp, Homo sapiens
ctctccagccacagaagctgct

SEQ ID NO: 8003050 - DNA, 22 bp, Homo sapiens
ctctccagccacagaagctgct

SEQ ID NO: 8003051 - DNA, 22 bp, Homo sapiens
ctctccagccaggggcttcctg

SEQ ID NO: 8003052 - DNA, 22 bp, Homo sapiens
ctctccagcctttagcccacgc

SEQ ID NO: 8003053 - DNA, 22 bp, Homo sapiens
ctctccagcctttagcccacgc

SEQ ID NO: 8003054 - DNA, 19 bp, Homo sapiens
ctctccagctccagtagct

SEQ ID NO: 8003055 - DNA, 19 bp, Homo sapiens
ctctccagctccagtagct

SEQ ID NO: 8003056 - DNA, 19 bp, Homo sapiens
ctctccagctccagtagct

SEQ ID NO: 8003057 - DNA, 19 bp, Homo sapiens
ctctccagctccagtagct

SEQ ID NO: 8003058 - DNA, 22 bp, Homo sapiens
ctctccagatctgctgagccag

SEQ ID NO: 8003059 - DNA, 22 bp, Homo sapiens
ctctccagatctgctgagccag

SEQ ID NO: 8003060 - DNA, 22 bp, Homo sapiens
ctctccagagcccttccggccc

SEQ ID NO: 8003061 - DNA, 22 bp, Homo sapiens
ctctccagagcccttccggccc

SEQ ID NO: 8003062 - DNA, 22 bp, Homo sapiens
ctctccagagcccttccggccc

SEQ ID NO: 8003063 - DNA, 22 bp, Homo sapiens
ctctccagatctgctgagccag

SEQ ID NO: 8003064 - DNA, 22 bp, Homo sapiens
ctctccagcagatgtagtctgt

SEQ ID NO: 8003065 - DNA, 22 bp, Homo sapiens
ctctccagccacagaagctgct

SEQ ID NO: 8003066 - DNA, 22 bp, Homo sapiens
ctctccagcagatgtagtctgt

SEQ ID NO: 8003067 - DNA, 22 bp, Homo sapiens
ctctccagatctgctgagccag

SEQ ID NO: 8003068 - DNA, 22 bp, Homo sapiens
ctctccagcagatgtagtctgt

SEQ ID NO: 8003069 - DNA, 22 bp, Homo sapiens
ctctccagcagatgtagtctgt

SEQ ID NO: 8003070 - DNA, 22 bp, Homo sapiens
ctctccagatctgctgagccag

SEQ ID NO: 8003071 - DNA, 22 bp, Homo sapiens
ctcctgggctgggaactcagcc

SEQ ID NO: 8003072 - DNA, 22 bp, Homo sapiens
ctcctgggctgggaactcagcc

SEQ ID NO: 8003073 - DNA, 18 bp, Homo sapiens
ctcctgggctgcagatgc

SEQ ID NO: 8003074 - DNA, 18 bp, Homo sapiens
ctcctgggctgcagatgc

SEQ ID NO: 8003075 - DNA, 18 bp, Homo sapiens
ctcctgggctgcagatgc

SEQ ID NO: 8003076 - DNA, 18 bp, Homo sapiens
ctcctgggctgcagatgc

SEQ ID NO: 8003077 - DNA, 22 bp, Homo sapiens
ctcctgggctgtcggcgctctg

SEQ ID NO: 8003078 - DNA, 22 bp, Homo sapiens
ctcctgggctgtcggcgctctg

SEQ ID NO: 8003079 - DNA, 22 bp, Homo sapiens
ctcctgggctgggaactcagcc

SEQ ID NO: 8003080 - DNA, 22 bp, Homo sapiens
ctcctgggctgtcggcgctctg

SEQ ID NO: 8003081 - DNA, 22 bp, Homo sapiens
ctcctgggctgtcggcgctctg

SEQ ID NO: 8003082 - DNA, 22 bp, Homo sapiens
ctcctgggctgtcggcgctctg

SEQ ID NO: 8003083 - DNA, 22 bp, Homo sapiens
ctcctgggctgtcggcgctctg

SEQ ID NO: 8003084 - DNA, 22 bp, Homo sapiens
ctcctgggctgggaactcagcc

SEQ ID NO: 8003085 - DNA, 22 bp, Homo sapiens
ctctccagaattattactatta

SEQ ID NO: 8003086 - DNA, 22 bp, Homo sapiens
ctctccagaattattactatta

SEQ ID NO: 8003087 - DNA, 22 bp, Homo sapiens
ctctccactgtcctttgctggt

SEQ ID NO: 8003088 - DNA, 22 bp, Homo sapiens
ctctccagaatatgccgccgtg

SEQ ID NO: 8003089 - DNA, 22 bp, Homo sapiens
ctctccagaatatgccgccgtg

SEQ ID NO: 8003090 - DNA, 22 bp, Homo sapiens
ctctccactgtcctttgctggt

SEQ ID NO: 8003091 - DNA, 22 bp, Homo sapiens
ctctccactgtcctttgctggt

SEQ ID NO: 8003092 - DNA, 19 bp, Homo sapiens
ctctcactcgccacatcct

SEQ ID NO: 8003093 - DNA, 20 bp, Homo sapiens
ctctcacagctccctcagcc

SEQ ID NO: 8003094 - DNA, 22 bp, Homo sapiens
ctcctgggctgtcggcgctctg

SEQ ID NO: 8003095 - DNA, 22 bp, Homo sapiens
ctcctgggctgtcggcgctctg

SEQ ID NO: 8003096 - DNA, 22 bp, Homo sapiens
ctctcagaagtagcacgtgggc

SEQ ID NO: 8003097 - DNA, 22 bp, Homo sapiens
ctctcagaagcttccagtatgg

SEQ ID NO: 8003098 - DNA, 22 bp, Homo sapiens
ctctcagaagcttccagtatgg

SEQ ID NO: 8003099 - DNA, 22 bp, Homo sapiens
ctctccactcagcgtcatgtcc

SEQ ID NO: 8003100 - DNA, 22 bp, Homo sapiens
ctctcagaagcttccagtatgg

SEQ ID NO: 8003101 - DNA, 22 bp, Homo sapiens
ctcctgggagcagggatggatg

SEQ ID NO: 8003102 - DNA, 22 bp, Homo sapiens
ctcctggctcgcccccagctga

SEQ ID NO: 8003103 - DNA, 22 bp, Homo sapiens
ctcctgggagcagggatggatg

SEQ ID NO: 8003104 - DNA, 22 bp, Homo sapiens
ctcctgggagcagggatggatg

SEQ ID NO: 8003105 - DNA, 22 bp, Homo sapiens
ctcctgggagctgtggcagagc

SEQ ID NO: 8003106 - DNA, 22 bp, Homo sapiens
ctcctgggagctgtggcagagc

SEQ ID NO: 8003107 - DNA, 22 bp, Homo sapiens
ctcctgggagctgtggcagagc

SEQ ID NO: 8003108 - DNA, 22 bp, Homo sapiens
ctcctgggagctgtggcagagc

SEQ ID NO: 8003109 - DNA, 22 bp, Homo sapiens
ctcctgggagctgtggcagagc

SEQ ID NO: 8003110 - DNA, 22 bp, Homo sapiens
ctcctgggaggatgcggacccg

SEQ ID NO: 8003111 - DNA, 22 bp, Homo sapiens
ctcctgggagctgtggcagagc

SEQ ID NO: 8003112 - DNA, 22 bp, Homo sapiens
ctcctgggaggatgcggacccg

SEQ ID NO: 8003113 - DNA, 22 bp, Homo sapiens
ctcctgggaggatgcggacccg

SEQ ID NO: 8003114 - DNA, 22 bp, Homo sapiens
ctcctgggaggatgcggacccg

SEQ ID NO: 8003115 - DNA, 22 bp, Homo sapiens
ctcctgggaggatgcggacccg

SEQ ID NO: 8003116 - DNA, 22 bp, Homo sapiens
ctcctgggaggatgcggacccg

SEQ ID NO: 8003117 - DNA, 22 bp, Homo sapiens
ctcctgggaggatgcggacccg

SEQ ID NO: 8003118 - DNA, 22 bp, Homo sapiens
ctcctgggagtcttcctggatg

SEQ ID NO: 8003119 - DNA, 22 bp, Homo sapiens
ctcctgggagtcttcctggatg

SEQ ID NO: 8003120 - DNA, 22 bp, Homo sapiens
ctcctgggagtcttcctggatg

SEQ ID NO: 8003121 - DNA, 22 bp, Homo sapiens
ctcctgggagtcttcctggatg

SEQ ID NO: 8003122 - DNA, 18 bp, Homo sapiens
ctcctgggctgcagatgc

SEQ ID NO: 8003123 - DNA, 22 bp, Homo sapiens
ctcctgggctcatatcattcag

SEQ ID NO: 8003124 - DNA, 18 bp, Homo sapiens
ctcctgggctgcagatgc

SEQ ID NO: 8003125 - DNA, 22 bp, Homo sapiens
ctcctgggctcaagtgatcctc

SEQ ID NO: 8003126 - DNA, 22 bp, Homo sapiens
ctcctgggctcaagtgatcctc

SEQ ID NO: 8003127 - DNA, 22 bp, Homo sapiens
ctcctgggctcaagtgatcctc

SEQ ID NO: 8003128 - DNA, 22 bp, Homo sapiens
ctcctgggctcatatcattcag

SEQ ID NO: 8003129 - DNA, 22 bp, Homo sapiens
ctcctgggctcaagtgatcctc

SEQ ID NO: 8003130 - DNA, 21 bp, Homo sapiens
ctcctgggctaagatatagtg

SEQ ID NO: 8003131 - DNA, 22 bp, Homo sapiens
ctcctgggatgactctttcttt

SEQ ID NO: 8003132 - DNA, 22 bp, Homo sapiens
ctcctgggatgactctttcttt

SEQ ID NO: 8003133 - DNA, 22 bp, Homo sapiens
ctcctgggagtcttcctggatg

SEQ ID NO: 8003134 - DNA, 21 bp, Homo sapiens
ctcctgggctaagatatagtg

SEQ ID NO: 8003135 - DNA, 21 bp, Homo sapiens
ctcctgggctaagatatagtg

SEQ ID NO: 8003136 - DNA, 21 bp, Homo sapiens
ctcctgggctaagatatagtg

SEQ ID NO: 8003137 - DNA, 22 bp, Homo sapiens
ctcctgggctatgtctgcttgg

SEQ ID NO: 8003138 - DNA, 22 bp, Homo sapiens
ctcctgggctatgtctgcttgg

SEQ ID NO: 8003139 - DNA, 22 bp, Homo sapiens
ctcctgggctcaagtgatcctc

SEQ ID NO: 8003140 - DNA, 22 bp, Homo sapiens
tttcagttgcagtggttgtcta

SEQ ID NO: 8003141 - DNA, 22 bp, Homo sapiens
tttcagttgattgcttgggtta

SEQ ID NO: 8003142 - DNA, 23 bp, Homo sapiens
tttcagttgagaatgcacggacc

SEQ ID NO: 8003143 - DNA, 22 bp, Homo sapiens
tttcagttgattgcttgggtta

SEQ ID NO: 8003144 - DNA, 22 bp, Homo sapiens
tttcagttgccaagctaattct

SEQ ID NO: 8003145 - DNA, 22 bp, Homo sapiens
tttcagttgcagtggttgtcta

SEQ ID NO: 8003146 - DNA, 20 bp, Homo sapiens
tttcagttggttaatggcat

SEQ ID NO: 8003147 - DNA, 23 bp, Homo sapiens
tttcagttccagaaaaggggagc

SEQ ID NO: 8003148 - DNA, 22 bp, Homo sapiens
ctctccagttacctaggtctga

SEQ ID NO: 8003149 - DNA, 22 bp, Homo sapiens
ctctccagttacctaggtctga

SEQ ID NO: 8003150 - DNA, 22 bp, Homo sapiens
ctctcccccacagcagccttct

SEQ ID NO: 8003151 - DNA, 22 bp, Homo sapiens
ctctccagttacctaggtctga

SEQ ID NO: 8003152 - DNA, 22 bp, Homo sapiens
ctctccagttacctaggtctga

SEQ ID NO: 8003153 - DNA, 21 bp, Homo sapiens
ctctccagtggttcctgattc

SEQ ID NO: 8003154 - DNA, 21 bp, Homo sapiens
ctctccagtggttcctgattc

SEQ ID NO: 8003155 - DNA, 22 bp, Homo sapiens
tttcagttgttttagctctgtg

SEQ ID NO: 8003156 - DNA, 22 bp, Homo sapiens
tttcagttgttttagctctgtg

SEQ ID NO: 8003157 - DNA, 22 bp, Homo sapiens
tttcagttaagtggctagtccc

SEQ ID NO: 8003158 - DNA, 22 bp, Homo sapiens
tttcagttaagtggctagtccc

SEQ ID NO: 8003159 - DNA, 22 bp, Homo sapiens
tttcagtgttatgactttcatt

SEQ ID NO: 8003160 - DNA, 22 bp, Homo sapiens
tttcagtgtgtaaattgaaata

SEQ ID NO: 8003161 - DNA, 22 bp, Homo sapiens
tttcagttactgctatatcatt

SEQ ID NO: 8003162 - DNA, 22 bp, Homo sapiens
tttcagtgtgtaaattgaaata

SEQ ID NO: 8003163 - DNA, 22 bp, Homo sapiens
ctctccaggactttggcccaat

SEQ ID NO: 8003164 - DNA, 22 bp, Homo sapiens
ctctccaggactttggcccaat

SEQ ID NO: 8003165 - DNA, 19 bp, Homo sapiens
ctctccagctccagtagct

SEQ ID NO: 8003166 - DNA, 22 bp, Homo sapiens
ctctccagcctttagcccacgc

SEQ ID NO: 8003167 - DNA, 19 bp, Homo sapiens
ctctccagctccagtagct

SEQ ID NO: 8003168 - DNA, 19 bp, Homo sapiens
ctctccagctccagtagct

SEQ ID NO: 8003169 - DNA, 22 bp, Homo sapiens
ctctccaggagagcactttgag

SEQ ID NO: 8003170 - DNA, 22 bp, Homo sapiens
ctctccaggactttggcccaat

SEQ ID NO: 8003171 - DNA, 22 bp, Homo sapiens
ctctccaggactttggcccaat

SEQ ID NO: 8003172 - DNA, 22 bp, Homo sapiens
ctctccaggagagcactttgag

SEQ ID NO: 8003173 - DNA, 22 bp, Homo sapiens
ctctccaggagagcactttgag

SEQ ID NO: 8003174 - DNA, 22 bp, Homo sapiens
ctctccaggagagcactttgag

SEQ ID NO: 8003175 - DNA, 22 bp, Homo sapiens
tttcagtgtgctcctgagggct

SEQ ID NO: 8003176 - DNA, 22 bp, Homo sapiens
tttcagtgtgctcctgagggct

SEQ ID NO: 8003177 - DNA, 22 bp, Homo sapiens
tttcagtgtgtaaattgaaata

SEQ ID NO: 8003178 - DNA, 22 bp, Homo sapiens
tttcagtgtgtaaattgaaata

SEQ ID NO: 8003179 - DNA, 22 bp, Homo sapiens
ctctcccccacagcagccttct

SEQ ID NO: 8003180 - DNA, 22 bp, Homo sapiens
ctctcccccacagcagccttct

SEQ ID NO: 8003181 - DNA, 23 bp, Homo sapiens
ctctccccctttgatgttagctc

SEQ ID NO: 8003182 - DNA, 23 bp, Homo sapiens
ctctccccctttgatgttagctc

SEQ ID NO: 8003183 - DNA, 22 bp, Homo sapiens
ctctcccccacagcagccttct

SEQ ID NO: 8003184 - DNA, 22 bp, Homo sapiens
ctctccccggtacgagcggccg

SEQ ID NO: 8003185 - DNA, 22 bp, Homo sapiens
ctctccccggtacgagcggccg

SEQ ID NO: 8003186 - DNA, 22 bp, Homo sapiens
ctctccccggtacgagcggccg

SEQ ID NO: 8003187 - DNA, 22 bp, Homo sapiens
ctctccctaggttagcggtcag

SEQ ID NO: 8003188 - DNA, 22 bp, Homo sapiens
ctctccctaggttagcggtcag

SEQ ID NO: 8003189 - DNA, 23 bp, Homo sapiens
ctctccccctttgatgttagctc

SEQ ID NO: 8003190 - DNA, 22 bp, Homo sapiens
ctctccccggtacgagcggccg

SEQ ID NO: 8003191 - DNA, 23 bp, Homo sapiens
ctctccccctttgatgttagctc

SEQ ID NO: 8003192 - DNA, 22 bp, Homo sapiens
ctctccccggtacgagcggccg

SEQ ID NO: 8003193 - DNA, 22 bp, Homo sapiens
ctctccctatgcctcccaggag

SEQ ID NO: 8003194 - DNA, 22 bp, Homo sapiens
ctctccctatgcctcccaggag

SEQ ID NO: 8003195 - DNA, 22 bp, Homo sapiens
ctctccctatgcctcccaggag

SEQ ID NO: 8003196 - DNA, 22 bp, Homo sapiens
ctctccctatgcctcccaggag

SEQ ID NO: 8003197 - DNA, 22 bp, Homo sapiens
ctctccctaggttagcggtcag

SEQ ID NO: 8003198 - DNA, 22 bp, Homo sapiens
ctctccctaggttagcggtcag

SEQ ID NO: 8003199 - DNA, 22 bp, Homo sapiens
ctctccctaggttagcggtcag

SEQ ID NO: 8003200 - DNA, 22 bp, Homo sapiens
ctctccctaggttagcggtcag

SEQ ID NO: 8003201 - DNA, 22 bp, Homo sapiens
ctctccctatgcctcccaggag

SEQ ID NO: 8003202 - DNA, 22 bp, Homo sapiens
ctctccctaggttagcggtcag

SEQ ID NO: 8003203 - DNA, 22 bp, Homo sapiens
ctctccctcattgggttccatt

SEQ ID NO: 8003204 - DNA, 22 bp, Homo sapiens
ctctccctggccagctgtgcag

SEQ ID NO: 8003205 - DNA, 22 bp, Homo sapiens
ctctccctggccagctgtgcag

SEQ ID NO: 8003206 - DNA, 22 bp, Homo sapiens
ctctccctatgcctcccaggag

SEQ ID NO: 8003207 - DNA, 22 bp, Homo sapiens
ctctccctatgcctcccaggag

SEQ ID NO: 8003208 - DNA, 22 bp, Homo sapiens
ctctcctccaacagccctgccg

SEQ ID NO: 8003209 - DNA, 22 bp, Homo sapiens
ctctcctccaacagccctgccg

SEQ ID NO: 8003210 - DNA, 22 bp, Homo sapiens
ctctcctccaacagccctgccg

SEQ ID NO: 8003211 - DNA, 22 bp, Homo sapiens
ctctcctccaacagccctgccg

SEQ ID NO: 8003212 - DNA, 22 bp, Homo sapiens
ctctcctccaacagccctgccg

SEQ ID NO: 8003213 - DNA, 22 bp, Homo sapiens
ctctcctccaggaactcacagt

SEQ ID NO: 8003214 - DNA, 22 bp, Homo sapiens
ctctcctccaggaactcacagt

SEQ ID NO: 8003215 - DNA, 22 bp, Homo sapiens
ctctcctccaggaactcacagt

SEQ ID NO: 8003216 - DNA, 22 bp, Homo sapiens
ctctcctccaggaactcacagt

SEQ ID NO: 8003217 - DNA, 22 bp, Homo sapiens
ctctcctccaggaactcacagt

SEQ ID NO: 8003218 - DNA, 22 bp, Homo sapiens
ctctcctccaggaactcacagt

SEQ ID NO: 8003219 - DNA, 22 bp, Homo sapiens
ctctcctcccatgtaggagatg

SEQ ID NO: 8003220 - DNA, 22 bp, Homo sapiens
ctctcccttgggtgggctttgg

SEQ ID NO: 8003221 - DNA, 22 bp, Homo sapiens
ctctccctggccagctgtgcag

SEQ ID NO: 8003222 - DNA, 22 bp, Homo sapiens
ctctccctggccagctgtgcag

SEQ ID NO: 8003223 - DNA, 22 bp, Homo sapiens
ctctccctggccagctgtgcag

SEQ ID NO: 8003224 - DNA, 22 bp, Homo sapiens
ctctccctcattgggttccatt

SEQ ID NO: 8003225 - DNA, 22 bp, Homo sapiens
ctctccctggccagctgtgcag

SEQ ID NO: 8003226 - DNA, 22 bp, Homo sapiens
ctctcctacatttcattcacaa

SEQ ID NO: 8003227 - DNA, 22 bp, Homo sapiens
ctctcccttgggtgggctttgg

SEQ ID NO: 8003228 - DNA, 20 bp, Homo sapiens
ctctcctcacccgtgtcagg

SEQ ID NO: 8003229 - DNA, 20 bp, Homo sapiens
ctctcctcacccgtgtcagg

SEQ ID NO: 8003230 - DNA, 22 bp, Homo sapiens
ctctcctattgtgtggtaagga

SEQ ID NO: 8003231 - DNA, 22 bp, Homo sapiens
ctctcctcagaacaggccctct

SEQ ID NO: 8003232 - DNA, 22 bp, Homo sapiens
ctctcctcagaacaggccctct

SEQ ID NO: 8003233 - DNA, 22 bp, Homo sapiens
tttaaatttgtgtttagagggt

SEQ ID NO: 8003234 - DNA, 22 bp, Homo sapiens
tttaaatttgtgtttagagggt

SEQ ID NO: 8003235 - DNA, 22 bp, Homo sapiens
tttaaatttgtgtttagagggt

SEQ ID NO: 8003236 - DNA, 22 bp, Homo sapiens
tttaaatttagaagaaacactg

SEQ ID NO: 8003237 - DNA, 22 bp, Homo sapiens
tttaaatttgtgtttagagggt

SEQ ID NO: 8003238 - DNA, 22 bp, Homo sapiens
tttaaatttagaagaaacactg

SEQ ID NO: 8003239 - DNA, 22 bp, Homo sapiens
tttaaatttagaagaaacactg

SEQ ID NO: 8003240 - DNA, 22 bp, Homo sapiens
tttaaatttagaagaaacactg

SEQ ID NO: 8003241 - DNA, 22 bp, Homo sapiens
tttaaatttgtgtttagagggt

SEQ ID NO: 8003242 - DNA, 22 bp, Homo sapiens
tttaacacctgtagcaggataa

SEQ ID NO: 8003243 - DNA, 22 bp, Homo sapiens
tttaaatttagaagaaacactg

SEQ ID NO: 8003244 - DNA, 22 bp, Homo sapiens
tttaaatttagaagaaacactg

SEQ ID NO: 8003245 - DNA, 22 bp, Homo sapiens
tttaaatttagaagaaacactg

SEQ ID NO: 8003246 - DNA, 22 bp, Homo sapiens
tttaaatttagaagaaacactg

SEQ ID NO: 8003247 - DNA, 22 bp, Homo sapiens
tttaaattatagttaatgtctg

SEQ ID NO: 8003248 - DNA, 22 bp, Homo sapiens
tttaaattatagttaatgtctg

SEQ ID NO: 8003249 - DNA, 22 bp, Homo sapiens
tttaaattctgtctgccgctta

SEQ ID NO: 8003250 - DNA, 22 bp, Homo sapiens
tttaaattctgtctgccgctta

SEQ ID NO: 8003251 - DNA, 22 bp, Homo sapiens
tttaaattctgtctgccgctta

SEQ ID NO: 8003252 - DNA, 22 bp, Homo sapiens
tttaaattctgtctgccgctta

SEQ ID NO: 8003253 - DNA, 22 bp, Homo sapiens
tttaaaaaactagtctgagtct

SEQ ID NO: 8003254 - DNA, 22 bp, Homo sapiens
tttaaaaaactagtctgagtct

SEQ ID NO: 8003255 - DNA, 22 bp, Homo sapiens
tttaaaaaactagtctgagtct

SEQ ID NO: 8003256 - DNA, 22 bp, Homo sapiens
tttaaaaaactagtctgagtct

SEQ ID NO: 8003257 - DNA, 22 bp, Homo sapiens
tttaaaaaactagtctgagtct

SEQ ID NO: 8003258 - DNA, 22 bp, Homo sapiens
tttaaaaaactagtctgagtct

SEQ ID NO: 8003259 - DNA, 22 bp, Homo sapiens
tttaaaaccaaagaaagcctct

SEQ ID NO: 8003260 - DNA, 22 bp, Homo sapiens
tttaaaaccaaagaaagcctct

SEQ ID NO: 8003261 - DNA, 22 bp, Homo sapiens
tttaaaaaactagtctgagtct

SEQ ID NO: 8003262 - DNA, 22 bp, Homo sapiens
tttaaaaaactagtctgagtct

SEQ ID NO: 8003263 - DNA, 22 bp, Homo sapiens
tttaaaaaactagtctgagtct

SEQ ID NO: 8003264 - DNA, 22 bp, Homo sapiens
tttaaaaggggtattaagtcca

SEQ ID NO: 8003265 - DNA, 22 bp, Homo sapiens
tttaaaaggggtattaagtcca

SEQ ID NO: 8003266 - DNA, 22 bp, Homo sapiens
tttaaaaggggtattaagtcca

SEQ ID NO: 8003267 - DNA, 22 bp, Homo sapiens
tttaaattatagttaatgtctg

SEQ ID NO: 8003268 - DNA, 22 bp, Homo sapiens
tttaaaaggggtattaagtcca

SEQ ID NO: 8003269 - DNA, 22 bp, Homo sapiens
tttaaaaggcagcttcttttgt

SEQ ID NO: 8003270 - DNA, 22 bp, Homo sapiens
tttaaaaggcagcttcttttgt

SEQ ID NO: 8003271 - DNA, 22 bp, Homo sapiens
tttaaaaggcagcttcttttgt

SEQ ID NO: 8003272 - DNA, 22 bp, Homo sapiens
tttaaaaggggtattaagtcca

SEQ ID NO: 8003273 - DNA, 22 bp, Homo sapiens
tttaaaaggggtattaagtcca

SEQ ID NO: 8003274 - DNA, 22 bp, Homo sapiens
tttaaaaggcagcttcttttgt

SEQ ID NO: 8003275 - DNA, 22 bp, Homo sapiens
tttaaaaggcagcttcttttgt

SEQ ID NO: 8003276 - DNA, 17 bp, Homo sapiens
tttagaatacaatgttt

SEQ ID NO: 8003277 - DNA, 17 bp, Homo sapiens
tttagaatacaatgttt

SEQ ID NO: 8003278 - DNA, 17 bp, Homo sapiens
tttagaatacaatgttt

SEQ ID NO: 8003279 - DNA, 22 bp, Homo sapiens
tttacatttccctctgtcagtt

SEQ ID NO: 8003280 - DNA, 22 bp, Homo sapiens
tttacatttccctctgtcagtt

SEQ ID NO: 8003281 - DNA, 17 bp, Homo sapiens
tttacattgctcgcagt

SEQ ID NO: 8003282 - DNA, 22 bp, Homo sapiens
tttacatttccctctgtcagtt

SEQ ID NO: 8003283 - DNA, 17 bp, Homo sapiens
tttacattgctcgcagt

SEQ ID NO: 8003284 - DNA, 22 bp, Homo sapiens
tttacattgcattaggtattat

SEQ ID NO: 8003285 - DNA, 22 bp, Homo sapiens
tttacattgcattaggtattat

SEQ ID NO: 8003286 - DNA, 22 bp, Homo sapiens
tttacattgcattaggtattat

SEQ ID NO: 8003287 - DNA, 22 bp, Homo sapiens
tttacatgtaatgttatacaaa

SEQ ID NO: 8003288 - DNA, 22 bp, Homo sapiens
tttacatgtaatgttatacaaa

SEQ ID NO: 8003289 - DNA, 22 bp, Homo sapiens
tttacatgtaatgttatacaaa

SEQ ID NO: 8003290 - DNA, 22 bp, Homo sapiens
tttacatgtaatgttatacaaa

SEQ ID NO: 8003291 - DNA, 22 bp, Homo sapiens
tttacatgtaatgttatacaaa

SEQ ID NO: 8003292 - DNA, 22 bp, Homo sapiens
tttacatgtaatgttatacaaa

SEQ ID NO: 8003293 - DNA, 22 bp, Homo sapiens
tttacatgtaatgttatacaaa

SEQ ID NO: 8003294 - DNA, 22 bp, Homo sapiens
tttacatgtaatgttatacaaa

SEQ ID NO: 8003295 - DNA, 22 bp, Homo sapiens
tttacatggaatattgtcttgt

SEQ ID NO: 8003296 - DNA, 22 bp, Homo sapiens
tttacatggaatattgtcttgt

SEQ ID NO: 8003297 - DNA, 22 bp, Homo sapiens
tttacatggaatattgtcttgt

SEQ ID NO: 8003298 - DNA, 22 bp, Homo sapiens
tttacatgagtagcagatgttc

SEQ ID NO: 8003299 - DNA, 22 bp, Homo sapiens
tttacatctcaccagattcata

SEQ ID NO: 8003300 - DNA, 20 bp, Homo sapiens
tttacatccccaccagcaat

SEQ ID NO: 8003301 - DNA, 22 bp, Homo sapiens
tttacagttccatgtgataggc

SEQ ID NO: 8003302 - DNA, 22 bp, Homo sapiens
tttacagttaagaaatgttacc

SEQ ID NO: 8003303 - DNA, 22 bp, Homo sapiens
tttacatagtgctttcccacta

SEQ ID NO: 8003304 - DNA, 22 bp, Homo sapiens
tttacagttccatgtgataggc

SEQ ID NO: 8003305 - DNA, 22 bp, Homo sapiens
tttaacagatgctatgtctacc

SEQ ID NO: 8003306 - DNA, 22 bp, Homo sapiens
tttacacatacctctttaaagt

SEQ ID NO: 8003307 - DNA, 22 bp, Homo sapiens
tttacacatacctctttaaagt

SEQ ID NO: 8003308 - DNA, 22 bp, Homo sapiens
tttacagttaagaaatgttacc

SEQ ID NO: 8003309 - DNA, 22 bp, Homo sapiens
tttacagttaagaaatgttacc

SEQ ID NO: 8003310 - DNA, 22 bp, Homo sapiens
tttacagtgtcttgttgactgt

SEQ ID NO: 8003311 - DNA, 22 bp, Homo sapiens
tttacagttaagaaatgttacc

SEQ ID NO: 8003312 - DNA, 17 bp, Homo sapiens
tttagaatacaatgttt

SEQ ID NO: 8003313 - DNA, 22 bp, Homo sapiens
tttagaatgtgactgtatttga

SEQ ID NO: 8003314 - DNA, 22 bp, Homo sapiens
tttagaatgttagcgttaaagg

SEQ ID NO: 8003315 - DNA, 22 bp, Homo sapiens
tttagaatgtgactgtatttga

SEQ ID NO: 8003316 - DNA, 22 bp, Homo sapiens
tttagaatgttagcgttaaagg

SEQ ID NO: 8003317 - DNA, 22 bp, Homo sapiens
tttagaattggctagtgggaat

SEQ ID NO: 8003318 - DNA, 22 bp, Homo sapiens
tttagacaagatccttctgaat

SEQ ID NO: 8003319 - DNA, 22 bp, Homo sapiens
tttagacaagatccttctgaat

SEQ ID NO: 8003320 - DNA, 22 bp, Homo sapiens
tttagacacactttgtatattt

SEQ ID NO: 8003321 - DNA, 22 bp, Homo sapiens
tttagacacactttgtatattt

SEQ ID NO: 8003322 - DNA, 22 bp, Homo sapiens
tttagacacactttgtatattt

SEQ ID NO: 8003323 - DNA, 22 bp, Homo sapiens
tttagacacactttgtatattt

SEQ ID NO: 8003324 - DNA, 22 bp, Homo sapiens
tttagacacactttgtatattt

SEQ ID NO: 8003325 - DNA, 22 bp, Homo sapiens
tttagacatctataattgctaa

SEQ ID NO: 8003326 - DNA, 22 bp, Homo sapiens
tttagacatagctgaaatcatt

SEQ ID NO: 8003327 - DNA, 22 bp, Homo sapiens
tttagacatagctgaaatcatt

SEQ ID NO: 8003328 - DNA, 22 bp, Homo sapiens
tttagacagcatctggtgactt

SEQ ID NO: 8003329 - DNA, 22 bp, Homo sapiens
tttagacagcatctggtgactt

SEQ ID NO: 8003330 - DNA, 22 bp, Homo sapiens
tttagacagatgtgaggtgggt

SEQ ID NO: 8003331 - DNA, 22 bp, Homo sapiens
tttagacactagggatgcagtg

SEQ ID NO: 8003332 - DNA, 22 bp, Homo sapiens
tttagacagcggctctgaacca

SEQ ID NO: 8003333 - DNA, 22 bp, Homo sapiens
tttagacagcggctctgaacca

SEQ ID NO: 8003334 - DNA, 22 bp, Homo sapiens
tttagacaggggcaaaataagg

SEQ ID NO: 8003335 - DNA, 22 bp, Homo sapiens
tttagacaggggcaaaataagg

SEQ ID NO: 8003336 - DNA, 22 bp, Homo sapiens
tttagacagcggctctgaacca

SEQ ID NO: 8003337 - DNA, 22 bp, Homo sapiens
ctcctctggaaattcctctgcc

SEQ ID NO: 8003338 - DNA, 22 bp, Homo sapiens
ctcctctggaaattcctctgcc

SEQ ID NO: 8003339 - DNA, 22 bp, Homo sapiens
ctcctctggaaattcctctgcc

SEQ ID NO: 8003340 - DNA, 22 bp, Homo sapiens
ctcctctgcccaaatttgtata

SEQ ID NO: 8003341 - DNA, 22 bp, Homo sapiens
ctcctctggaaattcctctgcc

SEQ ID NO: 8003342 - DNA, 22 bp, Homo sapiens
ctcctctggcttcctggaggca

SEQ ID NO: 8003343 - DNA, 22 bp, Homo sapiens
ctcctctggcttcctggaggca

SEQ ID NO: 8003344 - DNA, 15 bp, Homo sapiens
ctcctctggcctccc

SEQ ID NO: 8003345 - DNA, 22 bp, Homo sapiens
ctcctctggcttcctggaggca

SEQ ID NO: 8003346 - DNA, 22 bp, Homo sapiens
ctcctctggcttcctggaggca

SEQ ID NO: 8003347 - DNA, 22 bp, Homo sapiens
ctcctctggcttcctggaggca

SEQ ID NO: 8003348 - DNA, 22 bp, Homo sapiens
ctcctctggcttcctggaggca

SEQ ID NO: 8003349 - DNA, 22 bp, Homo sapiens
ctcctctggcttcctggaggca

SEQ ID NO: 8003350 - DNA, 22 bp, Homo sapiens
ctcctcccaattgccaagtgct

SEQ ID NO: 8003351 - DNA, 22 bp, Homo sapiens
ctcctcccaattgccaagtgct

SEQ ID NO: 8003352 - DNA, 22 bp, Homo sapiens
ctcctcccacggtctcaggaag

SEQ ID NO: 8003353 - DNA, 22 bp, Homo sapiens
ctcctctccatcagcgccaccc

SEQ ID NO: 8003354 - DNA, 22 bp, Homo sapiens
ctcctctccatcagcgccaccc

SEQ ID NO: 8003355 - DNA, 16 bp, Homo sapiens
ctcctctccttcagga

SEQ ID NO: 8003356 - DNA, 22 bp, Homo sapiens
ctcctctctggagttatgcaga

SEQ ID NO: 8003357 - DNA, 17 bp, Homo sapiens
ctcctctctgggttact

SEQ ID NO: 8003358 - DNA, 22 bp, Homo sapiens
ctcctggccctgagctcccagg

SEQ ID NO: 8003359 - DNA, 22 bp, Homo sapiens
ctcctggctatgactacatttc

SEQ ID NO: 8003360 - DNA, 22 bp, Homo sapiens
ctcctggctcgcccccagctga

SEQ ID NO: 8003361 - DNA, 22 bp, Homo sapiens
ctcctggctcgcccccagctga

SEQ ID NO: 8003362 - DNA, 22 bp, Homo sapiens
ctcctgagaggatctctgttgt

SEQ ID NO: 8003363 - DNA, 22 bp, Homo sapiens
ctcctgagaggatctctgttgt

SEQ ID NO: 8003364 - DNA, 22 bp, Homo sapiens
ctcctgagaggatctctgttgt

SEQ ID NO: 8003365 - DNA, 22 bp, Homo sapiens
ctcctgagaggatctctgttgt

SEQ ID NO: 8003366 - DNA, 22 bp, Homo sapiens
ctcctgagctctgaggaagctt

SEQ ID NO: 8003367 - DNA, 22 bp, Homo sapiens
ctcctgagaggatctctgttgt

SEQ ID NO: 8003368 - DNA, 22 bp, Homo sapiens
ctcctgagaggatctctgttgt

SEQ ID NO: 8003369 - DNA, 22 bp, Homo sapiens
ctcctgagaattttcagttgga

SEQ ID NO: 8003370 - DNA, 22 bp, Homo sapiens
ctcctgagaattttcagttgga

SEQ ID NO: 8003371 - DNA, 22 bp, Homo sapiens
ctcctgaattgtccctcacagc

SEQ ID NO: 8003372 - DNA, 22 bp, Homo sapiens
ctcctgagaattttcagttgga

SEQ ID NO: 8003373 - DNA, 22 bp, Homo sapiens
ctcctgagaaataagcaagtaa

SEQ ID NO: 8003374 - DNA, 22 bp, Homo sapiens
ctcctgagaaataagcaagtaa

SEQ ID NO: 8003375 - DNA, 22 bp, Homo sapiens
ctcctctttggggatttacaca

SEQ ID NO: 8003376 - DNA, 22 bp, Homo sapiens
ctcctctttggggatttacaca

SEQ ID NO: 8003377 - DNA, 22 bp, Homo sapiens
ctcctctttggggatttacaca

SEQ ID NO: 8003378 - DNA, 22 bp, Homo sapiens
ctcctctttagccccagctgga

SEQ ID NO: 8003379 - DNA, 22 bp, Homo sapiens
ctcctctttagccccagctgga

SEQ ID NO: 8003380 - DNA, 22 bp, Homo sapiens
ctcctctttacccgcatggtct

SEQ ID NO: 8003381 - DNA, 22 bp, Homo sapiens
ctcctcttggaatgcgtggctc

SEQ ID NO: 8003382 - DNA, 22 bp, Homo sapiens
ctcctctgtctggccctgagcc

SEQ ID NO: 8003383 - DNA, 22 bp, Homo sapiens
ctcctctgtctggccctgagcc

SEQ ID NO: 8003384 - DNA, 22 bp, Homo sapiens
ctcctctgtctaccacgagggt

SEQ ID NO: 8003385 - DNA, 22 bp, Homo sapiens
ctcctctgtctaccacgagggt

SEQ ID NO: 8003386 - DNA, 22 bp, Homo sapiens
ctcctctgggtcctggtggcca

SEQ ID NO: 8003387 - DNA, 22 bp, Homo sapiens
ctcctctgtctggccctgagcc

SEQ ID NO: 8003388 - DNA, 22 bp, Homo sapiens
ctcctctgtctggccctgagcc

SEQ ID NO: 8003389 - DNA, 22 bp, Homo sapiens
ctcctctgggtcctggtggcca

SEQ ID NO: 8003390 - DNA, 22 bp, Homo sapiens
ctcctctgtattgattgggact

SEQ ID NO: 8003391 - DNA, 22 bp, Homo sapiens
ctcctctgtattgattgggact

SEQ ID NO: 8003392 - DNA, 22 bp, Homo sapiens
ctcctctgtattgattgggact

SEQ ID NO: 8003393 - DNA, 22 bp, Homo sapiens
ctcctctgtctaccacgagggt

SEQ ID NO: 8003394 - DNA, 22 bp, Homo sapiens
ctcctctgtctaccacgagggt

SEQ ID NO: 8003395 - DNA, 22 bp, Homo sapiens
ctcctctgtctaccacgagggt

SEQ ID NO: 8003396 - DNA, 22 bp, Homo sapiens
ctcctctgtctaccacgagggt

SEQ ID NO: 8003397 - DNA, 22 bp, Homo sapiens
ctcctctggcttcctggaggca

SEQ ID NO: 8003398 - DNA, 22 bp, Homo sapiens
ctcctctgggtcctggtggcca

SEQ ID NO: 8003399 - DNA, 22 bp, Homo sapiens
ttccttttcttaaacatatgtg

SEQ ID NO: 8003400 - DNA, 22 bp, Homo sapiens
ttccttttcttaaacatatgtg

SEQ ID NO: 8003401 - DNA, 22 bp, Homo sapiens
ttccttttcttaaacatatgtg

SEQ ID NO: 8003402 - DNA, 22 bp, Homo sapiens
ttccttttcttaaacatatgtg

SEQ ID NO: 8003403 - DNA, 22 bp, Homo sapiens
ttccttttcttaaacatatgtg

SEQ ID NO: 8003404 - DNA, 22 bp, Homo sapiens
ttccttttcttaaacatatgtg

SEQ ID NO: 8003405 - DNA, 22 bp, Homo sapiens
ttccttttctcacggggatcca

SEQ ID NO: 8003406 - DNA, 22 bp, Homo sapiens
ttccttttctcacggggatcca

SEQ ID NO: 8003407 - DNA, 20 bp, Homo sapiens
ttccttttcgcctctctccc

SEQ ID NO: 8003408 - DNA, 20 bp, Homo sapiens
ttccttttcgcctctctccc

SEQ ID NO: 8003409 - DNA, 20 bp, Homo sapiens
ttccttttcgcctctctccc

SEQ ID NO: 8003410 - DNA, 22 bp, Homo sapiens
ttccttttcttctaccacatgt

SEQ ID NO: 8003411 - DNA, 22 bp, Homo sapiens
ttccttttcttctaccacatgt

SEQ ID NO: 8003412 - DNA, 22 bp, Homo sapiens
ttccttttcttctaccacatgt

SEQ ID NO: 8003413 - DNA, 22 bp, Homo sapiens
ttccttttcttctaccacatgt

SEQ ID NO: 8003414 - DNA, 22 bp, Homo sapiens
ttccttttcttctaccacatgt

SEQ ID NO: 8003415 - DNA, 22 bp, Homo sapiens
ttccttttcttaaacatatgtg

SEQ ID NO: 8003416 - DNA, 22 bp, Homo sapiens
ttccttttcttatgcatcatta

SEQ ID NO: 8003417 - DNA, 22 bp, Homo sapiens
ttccttttcttatgcatcatta

SEQ ID NO: 8003418 - DNA, 22 bp, Homo sapiens
ttccttttcttatgcatcatta

SEQ ID NO: 8003419 - DNA, 22 bp, Homo sapiens
ctaggcagatggagaagtggct

SEQ ID NO: 8003420 - DNA, 22 bp, Homo sapiens
ctaggcagatggagaagtggct

SEQ ID NO: 8003421 - DNA, 20 bp, Homo sapiens
ctaggcagcgagtgactgag

SEQ ID NO: 8003422 - DNA, 20 bp, Homo sapiens
ctaggcagcgagtgactgag

SEQ ID NO: 8003423 - DNA, 22 bp, Homo sapiens
ctaggcagctttgggtgtgaag

SEQ ID NO: 8003424 - DNA, 22 bp, Homo sapiens
ttccttttgcaaggtcctctag

SEQ ID NO: 8003425 - DNA, 22 bp, Homo sapiens
ctagccatgggcattaaaggta

SEQ ID NO: 8003426 - DNA, 22 bp, Homo sapiens
ctagcccaggaatgccgtggcc

SEQ ID NO: 8003427 - DNA, 22 bp, Homo sapiens
ctagcccaggaatgccgtggcc

SEQ ID NO: 8003428 - DNA, 21 bp, Homo sapiens
ctagcccctactccaagttga

SEQ ID NO: 8003429 - DNA, 22 bp, Homo sapiens
ttcctttccctcacagcctcgg

SEQ ID NO: 8003430 - DNA, 22 bp, Homo sapiens
ttcctttccctcacagcctcgg

SEQ ID NO: 8003431 - DNA, 22 bp, Homo sapiens
ttcctttccctcacagcctcgg

SEQ ID NO: 8003432 - DNA, 22 bp, Homo sapiens
ttcctttcccttgcttctgtgc

SEQ ID NO: 8003433 - DNA, 22 bp, Homo sapiens
ttcctttcacgttttaatgcac

SEQ ID NO: 8003434 - DNA, 22 bp, Homo sapiens
ttcctttcacgttttaatgcac

SEQ ID NO: 8003435 - DNA, 22 bp, Homo sapiens
ttccttctaatattctgcctgt

SEQ ID NO: 8003436 - DNA, 22 bp, Homo sapiens
ttccttcctctttcacaacagc

SEQ ID NO: 8003437 - DNA, 22 bp, Homo sapiens
ttccttcctgtcttccttactg

SEQ ID NO: 8003438 - DNA, 22 bp, Homo sapiens
ttccttctaatattctgcctgt

SEQ ID NO: 8003439 - DNA, 22 bp, Homo sapiens
ttccttctaatattctgcctgt

SEQ ID NO: 8003440 - DNA, 22 bp, Homo sapiens
ttccttctaattttacacctga

SEQ ID NO: 8003441 - DNA, 22 bp, Homo sapiens
ttccttctaattttacacctga

SEQ ID NO: 8003442 - DNA, 22 bp, Homo sapiens
ttcctttctctggactgcagcc

SEQ ID NO: 8003443 - DNA, 22 bp, Homo sapiens
ttccttttatttgtccaggctt

SEQ ID NO: 8003444 - DNA, 22 bp, Homo sapiens
ttccttttatttgtccaggctt

SEQ ID NO: 8003445 - DNA, 22 bp, Homo sapiens
ttccttttcatatgccccgcgt

SEQ ID NO: 8003446 - DNA, 22 bp, Homo sapiens
ttccttttatttgtccaggctt

SEQ ID NO: 8003447 - DNA, 22 bp, Homo sapiens
ttccttttagaatcatgaagac

SEQ ID NO: 8003448 - DNA, 22 bp, Homo sapiens
ttccttttagaatcatgaagac

SEQ ID NO: 8003449 - DNA, 22 bp, Homo sapiens
ttccttttacaaatagcctcct

SEQ ID NO: 8003450 - DNA, 22 bp, Homo sapiens
ttccttttacaaatagcctcct

SEQ ID NO: 8003451 - DNA, 23 bp, Homo sapiens
ctaggcaggattgtaggcgggta

SEQ ID NO: 8003452 - DNA, 22 bp, Homo sapiens
ctaggcagggtgctgtgccatg

SEQ ID NO: 8003453 - DNA, 22 bp, Homo sapiens
ctaggcagggtgctgtgccatg

SEQ ID NO: 8003454 - DNA, 22 bp, Homo sapiens
ctaggcagtcctgacggtacta

SEQ ID NO: 8003455 - DNA, 22 bp, Homo sapiens
ctaggccacttgctctcatgga

SEQ ID NO: 8003456 - DNA, 22 bp, Homo sapiens
ctaggccagagagacctcatga

SEQ ID NO: 8003457 - DNA, 22 bp, Homo sapiens
ctaggccagttaggaagagaag

SEQ ID NO: 8003458 - DNA, 22 bp, Homo sapiens
ctaggccagttaggaagagaag

SEQ ID NO: 8003459 - DNA, 22 bp, Homo sapiens
ctaggctcttctggaaggttgt

SEQ ID NO: 8003460 - DNA, 22 bp, Homo sapiens
ctaggctgagctgggctgagct

SEQ ID NO: 8003461 - DNA, 22 bp, Homo sapiens
ctaggctgagctgggctgagct

SEQ ID NO: 8003462 - DNA, 22 bp, Homo sapiens
ctaggctgagctgggctgagct

SEQ ID NO: 8003463 - DNA, 22 bp, Homo sapiens
ctaggctgagctgggctgagct

SEQ ID NO: 8003464 - DNA, 22 bp, Homo sapiens
ctaggctgagctgggctgagct

SEQ ID NO: 8003465 - DNA, 22 bp, Homo sapiens
ctaggctcttctggaaggttgt

SEQ ID NO: 8003466 - DNA, 22 bp, Homo sapiens
ctaggctctgccagcactgtcg

SEQ ID NO: 8003467 - DNA, 22 bp, Homo sapiens
ctaggctcttctggaaggttgt

SEQ ID NO: 8003468 - DNA, 22 bp, Homo sapiens
ctaggctcagtctctggtctgt

SEQ ID NO: 8003469 - DNA, 22 bp, Homo sapiens
ctaggctctgccagcactgtcg

SEQ ID NO: 8003470 - DNA, 22 bp, Homo sapiens
ctaggctctgccagcactgtcg

SEQ ID NO: 8003471 - DNA, 22 bp, Homo sapiens
ctaggccttcataggcatggaa

SEQ ID NO: 8003472 - DNA, 22 bp, Homo sapiens
ctaggcccatgaggtttgctgg

SEQ ID NO: 8003473 - DNA, 22 bp, Homo sapiens
ctaggctcagtctctggtctgt

SEQ ID NO: 8003474 - DNA, 22 bp, Homo sapiens
ctaggctcagtctctggtctgt

SEQ ID NO: 8003475 - DNA, 22 bp, Homo sapiens
ctaggccatattttgagaactg

SEQ ID NO: 8003476 - DNA, 22 bp, Homo sapiens
ctaggccagttaggaagagaag

SEQ ID NO: 8003477 - DNA, 22 bp, Homo sapiens
ctaggccatattttgagaactg

SEQ ID NO: 8003478 - DNA, 22 bp, Homo sapiens
ctaggcccatgaggtttgctgg

SEQ ID NO: 8003479 - DNA, 22 bp, Homo sapiens
ctaggccatattttgagaactg

SEQ ID NO: 8003480 - DNA, 22 bp, Homo sapiens
ctagggaatgagagactggatc

SEQ ID NO: 8003481 - DNA, 22 bp, Homo sapiens
ctagggaatgagagactggatc

SEQ ID NO: 8003482 - DNA, 22 bp, Homo sapiens
ctagggagactcgcaggactca

SEQ ID NO: 8003483 - DNA, 22 bp, Homo sapiens
ctagggagactcgcaggactca

SEQ ID NO: 8003484 - DNA, 22 bp, Homo sapiens
ctagggagactcgcaggactca

SEQ ID NO: 8003485 - DNA, 22 bp, Homo sapiens
ctagggagactcgcaggactca

SEQ ID NO: 8003486 - DNA, 22 bp, Homo sapiens
ctagggagactcgcaggactca

SEQ ID NO: 8003487 - DNA, 22 bp, Homo sapiens
ctaggcttgcagggtggacatg

SEQ ID NO: 8003488 - DNA, 22 bp, Homo sapiens
ctaggcttgcagggtggacatg

SEQ ID NO: 8003489 - DNA, 17 bp, Homo sapiens
ctaggcttggcagctcg

SEQ ID NO: 8003490 - DNA, 22 bp, Homo sapiens
ctagggaaagtggacatggctt

SEQ ID NO: 8003491 - DNA, 22 bp, Homo sapiens
ctagggaaagtggacatggctt

SEQ ID NO: 8003492 - DNA, 22 bp, Homo sapiens
ctagggaaataaactgagtggt

SEQ ID NO: 8003493 - DNA, 22 bp, Homo sapiens
ctagggaaataaactgagtggt

SEQ ID NO: 8003494 - DNA, 22 bp, Homo sapiens
ctagggaaataaactgagtggt

SEQ ID NO: 8003495 - DNA, 22 bp, Homo sapiens
ctagggaagtctgtattttgtg

SEQ ID NO: 8003496 - DNA, 22 bp, Homo sapiens
ctagggaatataatgtatgcca

SEQ ID NO: 8003497 - DNA, 22 bp, Homo sapiens
ctagggaacaagatgcccaggg

SEQ ID NO: 8003498 - DNA, 22 bp, Homo sapiens
ctagggaaggacaacctcttcc

SEQ ID NO: 8003499 - DNA, 22 bp, Homo sapiens
ctaggctgtgcattgcatgaca

SEQ ID NO: 8003500 - DNA, 22 bp, Homo sapiens
ctaggctgttcatgctcagacc

SEQ ID NO: 8003501 - DNA, 22 bp, Homo sapiens
ctaggctgttcatgctcagacc

SEQ ID NO: 8003502 - DNA, 22 bp, Homo sapiens
ctaggctgttcatgctcagacc

SEQ ID NO: 8003503 - DNA, 22 bp, Homo sapiens
ctaggctgtgcattgcatgaca

SEQ ID NO: 8003504 - DNA, 22 bp, Homo sapiens
ctaggctgtaaagagctaggag

SEQ ID NO: 8003505 - DNA, 22 bp, Homo sapiens
ctaggctgtaaagagctaggag

SEQ ID NO: 8003506 - DNA, 22 bp, Homo sapiens
ctaggctgtaaagagctaggag

SEQ ID NO: 8003507 - DNA, 22 bp, Homo sapiens
ctaggctggagtgcattggcgt

SEQ ID NO: 8003508 - DNA, 22 bp, Homo sapiens
ctaggctggagtgcattggcgt

SEQ ID NO: 8003509 - DNA, 22 bp, Homo sapiens
ctaggctggagtgcagtggcat

SEQ ID NO: 8003510 - DNA, 22 bp, Homo sapiens
ctaggctggagtgcagtggcat

SEQ ID NO: 8003511 - DNA, 22 bp, Homo sapiens
ctaggctggagtgcagtggcat

SEQ ID NO: 8003512 - DNA, 22 bp, Homo sapiens
ctaggctggagtgcagtggcac

SEQ ID NO: 8003513 - DNA, 22 bp, Homo sapiens
ctaggctggagtgcagtggcac

SEQ ID NO: 8003514 - DNA, 22 bp, Homo sapiens
ctaggctggagtgcagtggcac

SEQ ID NO: 8003515 - DNA, 22 bp, Homo sapiens
ctaggctgcagatgcatggaat

SEQ ID NO: 8003516 - DNA, 22 bp, Homo sapiens
ctaggctgcacctaggatggct

SEQ ID NO: 8003517 - DNA, 22 bp, Homo sapiens
ctaggctgcacctaggatggct

SEQ ID NO: 8003518 - DNA, 22 bp, Homo sapiens
ttctgtcaaatttgccatatgg

SEQ ID NO: 8003519 - DNA, 22 bp, Homo sapiens
ttctgtcacagtgctggtatca

SEQ ID NO: 8003520 - DNA, 22 bp, Homo sapiens
ttctgtcacagtgctggtatca

SEQ ID NO: 8003521 - DNA, 16 bp, Homo sapiens
ttctgtcacgtacggc

SEQ ID NO: 8003522 - DNA, 22 bp, Homo sapiens
ttctgtcacttaggaggtcata

SEQ ID NO: 8003523 - DNA, 22 bp, Homo sapiens
ttctgtcacttaggaggtcata

SEQ ID NO: 8003524 - DNA, 22 bp, Homo sapiens
ttctgtcacttgcaatcaagag

SEQ ID NO: 8003525 - DNA, 22 bp, Homo sapiens
ttctgtcacttttttggaatct

SEQ ID NO: 8003526 - DNA, 22 bp, Homo sapiens
ttctgtcatcctttctagatgt

SEQ ID NO: 8003527 - DNA, 22 bp, Homo sapiens
ttctgtcatcctttctagatgt

SEQ ID NO: 8003528 - DNA, 22 bp, Homo sapiens
ttctgtcatgctcatgtaattg

SEQ ID NO: 8003529 - DNA, 22 bp, Homo sapiens
ttctgtcatgctcatgtaattg

SEQ ID NO: 8003530 - DNA, 20 bp, Homo sapiens
ttctgtcagattatatggga

SEQ ID NO: 8003531 - DNA, 22 bp, Homo sapiens
ttctgtcacttttttggaatct

SEQ ID NO: 8003532 - DNA, 22 bp, Homo sapiens
ttctgtcagaagctagctcctg

SEQ ID NO: 8003533 - DNA, 22 bp, Homo sapiens
ttctgtcagaagctagctcctg

SEQ ID NO: 8003534 - DNA, 22 bp, Homo sapiens
ttctgtcagctgctttgtctca

SEQ ID NO: 8003535 - DNA, 22 bp, Homo sapiens
ttctgtcagcgtcagaaattct

SEQ ID NO: 8003536 - DNA, 22 bp, Homo sapiens
ttcttggaaatacattcaataa

SEQ ID NO: 8003537 - DNA, 22 bp, Homo sapiens
ttcttggaaatacattcaataa

SEQ ID NO: 8003538 - DNA, 22 bp, Homo sapiens
ttcttggatgccctcatgcctt

SEQ ID NO: 8003539 - DNA, 22 bp, Homo sapiens
ttcttggagataaattcttaca

SEQ ID NO: 8003540 - DNA, 22 bp, Homo sapiens
ttcttcctcacactctcaccca

SEQ ID NO: 8003541 - DNA, 22 bp, Homo sapiens
ttcttcctcacactctcaccca

SEQ ID NO: 8003542 - DNA, 22 bp, Homo sapiens
ttctgtccactgctggggcctc

SEQ ID NO: 8003543 - DNA, 22 bp, Homo sapiens
ttctgtcatttagcattgtcat

SEQ ID NO: 8003544 - DNA, 22 bp, Homo sapiens
ttctgtcatttagcattgtcat

SEQ ID NO: 8003545 - DNA, 21 bp, Homo sapiens
ttcttcctaaatacagatctc

SEQ ID NO: 8003546 - DNA, 21 bp, Homo sapiens
ttcttcctaaatacagatctc

SEQ ID NO: 8003547 - DNA, 22 bp, Homo sapiens
ttctgtccactgctggggcctc

SEQ ID NO: 8003548 - DNA, 22 bp, Homo sapiens
ttcttcccttcattccaccacc

SEQ ID NO: 8003549 - DNA, 22 bp, Homo sapiens
ttctgtatgtacatatgtgtat

SEQ ID NO: 8003550 - DNA, 22 bp, Homo sapiens
ttctgtcaaatgccagtagaga

SEQ ID NO: 8003551 - DNA, 22 bp, Homo sapiens
ttctgtcaaatgccagtagaga

SEQ ID NO: 8003552 - DNA, 22 bp, Homo sapiens
ttctgtatttcaatgtctttat

SEQ ID NO: 8003553 - DNA, 22 bp, Homo sapiens
ttctgtcaaactcacaggccga

SEQ ID NO: 8003554 - DNA, 22 bp, Homo sapiens
ttctgtcaaagactttttcagg

SEQ ID NO: 8003555 - DNA, 22 bp, Homo sapiens
ttctgtatctttcttcaagatt

SEQ ID NO: 8003556 - DNA, 22 bp, Homo sapiens
ttctgtatgctctgggtccaga

SEQ ID NO: 8003557 - DNA, 22 bp, Homo sapiens
ttctgtatctctgtgtttcttg

SEQ ID NO: 8003558 - DNA, 22 bp, Homo sapiens
ctattttaacttgattacctct

SEQ ID NO: 8003559 - DNA, 22 bp, Homo sapiens
ctattttaacttgattacctct

SEQ ID NO: 8003560 - DNA, 22 bp, Homo sapiens
ctattttaacttgattacctct

SEQ ID NO: 8003561 - DNA, 22 bp, Homo sapiens
ctattttaacttgattacctct

SEQ ID NO: 8003562 - DNA, 22 bp, Homo sapiens
ctattttaacttgattacctct

SEQ ID NO: 8003563 - DNA, 22 bp, Homo sapiens
ctattttaacttgattacctct

SEQ ID NO: 8003564 - DNA, 22 bp, Homo sapiens
ctatttgtacagcattcgagtt

SEQ ID NO: 8003565 - DNA, 22 bp, Homo sapiens
ctatttgtcacaactggtgttt

SEQ ID NO: 8003566 - DNA, 22 bp, Homo sapiens
ctatttgtcacaactggtgttt

SEQ ID NO: 8003567 - DNA, 22 bp, Homo sapiens
ctatttgtcagtttggctttaa

SEQ ID NO: 8003568 - DNA, 22 bp, Homo sapiens
ttctgtagtattcttttggtca

SEQ ID NO: 8003569 - DNA, 22 bp, Homo sapiens
ttctgtaggcatggaacaggga

SEQ ID NO: 8003570 - DNA, 22 bp, Homo sapiens
ttctgtaggacttctgccaact

SEQ ID NO: 8003571 - DNA, 22 bp, Homo sapiens
ttctgtaggcacacagtttcaa

SEQ ID NO: 8003572 - DNA, 22 bp, Homo sapiens
ctattttaacttgattacctct

SEQ ID NO: 8003573 - DNA, 22 bp, Homo sapiens
ctatttcagctgcctttgactg

SEQ ID NO: 8003574 - DNA, 22 bp, Homo sapiens
ctatttcagcagaagccggaga

SEQ ID NO: 8003575 - DNA, 15 bp, Homo sapiens
ctatttcatccttct

SEQ ID NO: 8003576 - DNA, 22 bp, Homo sapiens
ctatttcatgttcctatggccg

SEQ ID NO: 8003577 - DNA, 22 bp, Homo sapiens
ctatttcatgttcctatggccg

SEQ ID NO: 8003578 - DNA, 22 bp, Homo sapiens
ctatttcagctgcctttgactg

SEQ ID NO: 8003579 - DNA, 23 bp, Homo sapiens
ctatttctcatagttcaggtctt

SEQ ID NO: 8003580 - DNA, 22 bp, Homo sapiens
ctatttcattgtgctgagtctg

SEQ ID NO: 8003581 - DNA, 22 bp, Homo sapiens
ctatttcatgttcctatggccg

SEQ ID NO: 8003582 - DNA, 22 bp, Homo sapiens
ctatttggatgttagcctcagt

SEQ ID NO: 8003583 - DNA, 22 bp, Homo sapiens
ctatttgcttgtctagcatcta

SEQ ID NO: 8003584 - DNA, 22 bp, Homo sapiens
ctatttgagaacaatggctgaa

SEQ ID NO: 8003585 - DNA, 22 bp, Homo sapiens
ctatttgaattgtcacaggcta

SEQ ID NO: 8003586 - DNA, 22 bp, Homo sapiens
ctatttggccaagctgcccaca

SEQ ID NO: 8003587 - DNA, 22 bp, Homo sapiens
ctatttggggtagaagatggat

SEQ ID NO: 8003588 - DNA, 22 bp, Homo sapiens
ctatttgtaaagtgcctggtgt

SEQ ID NO: 8003589 - DNA, 22 bp, Homo sapiens
ctatttgtacagcattagtaat

SEQ ID NO: 8003590 - DNA, 22 bp, Homo sapiens
ctatttgtaagagccccacacc

SEQ ID NO: 8003591 - DNA, 22 bp, Homo sapiens
ctatttgtacagcattagtaat

SEQ ID NO: 8003592 - DNA, 22 bp, Homo sapiens
ctattcaattttgctattgtag

SEQ ID NO: 8003593 - DNA, 22 bp, Homo sapiens
ctattcaacttgactgtttcac

SEQ ID NO: 8003594 - DNA, 22 bp, Homo sapiens
ctattcaattttgctattgtag

SEQ ID NO: 8003595 - DNA, 22 bp, Homo sapiens
ctagggctcgcaagggctggag

SEQ ID NO: 8003596 - DNA, 22 bp, Homo sapiens
ctattcaattttgctattgtag

SEQ ID NO: 8003597 - DNA, 22 bp, Homo sapiens
ctattcaggtgtccattaatcc

SEQ ID NO: 8003598 - DNA, 22 bp, Homo sapiens
ctatttattgtgggtatccagg

SEQ ID NO: 8003599 - DNA, 22 bp, Homo sapiens
ctatttcaaggcccagatatga

SEQ ID NO: 8003600 - DNA, 22 bp, Homo sapiens
ctattccattccatagtagaaa

SEQ ID NO: 8003601 - DNA, 22 bp, Homo sapiens
ctagggagtggcagagctggga

SEQ ID NO: 8003602 - DNA, 22 bp, Homo sapiens
ctagggagtggcagagctggga

SEQ ID NO: 8003603 - DNA, 22 bp, Homo sapiens
ctagggagtggcagagctggga

SEQ ID NO: 8003604 - DNA, 22 bp, Homo sapiens
ctagggagggatgttggcatga

SEQ ID NO: 8003605 - DNA, 22 bp, Homo sapiens
ctagggctccaaagctgagaag

SEQ ID NO: 8003606 - DNA, 22 bp, Homo sapiens
ctagggctccaaagctgagaag

SEQ ID NO: 8003607 - DNA, 22 bp, Homo sapiens
ctagggctccaaagctgagaag

SEQ ID NO: 8003608 - DNA, 22 bp, Homo sapiens
ctagggctagacagacgcatgt

SEQ ID NO: 8003609 - DNA, 22 bp, Homo sapiens
ctagggccaaaggctgtgatgc

SEQ ID NO: 8003610 - DNA, 22 bp, Homo sapiens
ctagggccaaaggctgtgatgc

SEQ ID NO: 8003611 - DNA, 23 bp, Homo sapiens
ctagggcagtatttcacagacac

SEQ ID NO: 8003612 - DNA, 22 bp, Homo sapiens
ctagggcagggagtgtttgcgc

SEQ ID NO: 8003613 - DNA, 23 bp, Homo sapiens
ctagggcagtatttcacagacac

SEQ ID NO: 8003614 - DNA, 22 bp, Homo sapiens
ttcttggcatcatgaaaaatta

SEQ ID NO: 8003615 - DNA, 22 bp, Homo sapiens
ttcttgggctccaccccagact

SEQ ID NO: 8003616 - DNA, 22 bp, Homo sapiens
ttcttgtactggagatacatga

SEQ ID NO: 8003617 - DNA, 21 bp, Homo sapiens
ttcttggttacgctgtagtgc

SEQ ID NO: 8003618 - DNA, 22 bp, Homo sapiens
ttcttgggtgtgaccagtctga

SEQ ID NO: 8003619 - DNA, 22 bp, Homo sapiens
ttcttgttctggttctgttagc

SEQ ID NO: 8003620 - DNA, 22 bp, Homo sapiens
ttcttgttctcctcatttagag

SEQ ID NO: 8003621 - DNA, 22 bp, Homo sapiens
ttcttgttctcctcatttagag

SEQ ID NO: 8003622 - DNA, 22 bp, Homo sapiens
ttcttgttctggttctgttagc

SEQ ID NO: 8003623 - DNA, 22 bp, Homo sapiens
ttcttgttctggttctgttagc

SEQ ID NO: 8003624 - DNA, 22 bp, Homo sapiens
ttcttgttctggttctgttagc

SEQ ID NO: 8003625 - DNA, 22 bp, Homo sapiens
ttcttgttggcctcaggtttgc

SEQ ID NO: 8003626 - DNA, 22 bp, Homo sapiens
ttcttgttctcctcatttagag

SEQ ID NO: 8003627 - DNA, 22 bp, Homo sapiens
ttcttgttctcctcatttagag

SEQ ID NO: 8003628 - DNA, 22 bp, Homo sapiens
ttcttgttctcctcatttagag

SEQ ID NO: 8003629 - DNA, 22 bp, Homo sapiens
ttcttgttccatgaaagacaga

SEQ ID NO: 8003630 - DNA, 22 bp, Homo sapiens
ttcttgttccatgaaagacaga

SEQ ID NO: 8003631 - DNA, 22 bp, Homo sapiens
ttcttgtctttgttatgtagga

SEQ ID NO: 8003632 - DNA, 22 bp, Homo sapiens
ttcttgttccatgaaagacaga

SEQ ID NO: 8003633 - DNA, 22 bp, Homo sapiens
ttcttgtctttgttatgtagga

SEQ ID NO: 8003634 - DNA, 22 bp, Homo sapiens
ctattttctgtctctatagagt

SEQ ID NO: 8003635 - DNA, 22 bp, Homo sapiens
ctattttctgtctctatagagt

SEQ ID NO: 8003636 - DNA, 22 bp, Homo sapiens
ctattttgcctgcctagaaatc

SEQ ID NO: 8003637 - DNA, 22 bp, Homo sapiens
ctattttccgcagcaggaagta

SEQ ID NO: 8003638 - DNA, 22 bp, Homo sapiens
ctattttctgtctctatagagt

SEQ ID NO: 8003639 - DNA, 22 bp, Homo sapiens
ctattttctgtctctatagagt

SEQ ID NO: 8003640 - DNA, 22 bp, Homo sapiens
ctattttcattcttacattgtc

SEQ ID NO: 8003641 - DNA, 22 bp, Homo sapiens
ctattttcattcttacattgtc

SEQ ID NO: 8003642 - DNA, 22 bp, Homo sapiens
ctattttcccatatggttgaca

SEQ ID NO: 8003643 - DNA, 22 bp, Homo sapiens
ctattttaagaggccattaggt

SEQ ID NO: 8003644 - DNA, 22 bp, Homo sapiens
ctattttcattcttacattgtc

SEQ ID NO: 8003645 - DNA, 22 bp, Homo sapiens
ctattttcattcttacattgtc

SEQ ID NO: 8003646 - DNA, 22 bp, Homo sapiens
ttcttgttttgcccaagttgta

SEQ ID NO: 8003647 - DNA, 22 bp, Homo sapiens
ttctttaaaatagtgagaaaga

SEQ ID NO: 8003648 - DNA, 22 bp, Homo sapiens
ttcttgttttgcccaagttgta

SEQ ID NO: 8003649 - DNA, 22 bp, Homo sapiens
ttcttgtttattaagatataaa

SEQ ID NO: 8003650 - DNA, 22 bp, Homo sapiens
ttcttgtttattaagatataaa

SEQ ID NO: 8003651 - DNA, 22 bp, Homo sapiens
ttcttgtttattaagatataaa

SEQ ID NO: 8003652 - DNA, 22 bp, Homo sapiens
ctattttaacttgattacctct

SEQ ID NO: 8003653 - DNA, 22 bp, Homo sapiens
ctattttaacttgattacctct

SEQ ID NO: 8003654 - DNA, 22 bp, Homo sapiens
ctattttaacttgattacctct

SEQ ID NO: 8003655 - DNA, 22 bp, Homo sapiens
ttctttaaaatagtgagaaaga

SEQ ID NO: 8003656 - DNA, 22 bp, Homo sapiens
ctattttaagaggccattaggt

SEQ ID NO: 8003657 - DNA, 22 bp, Homo sapiens
ctattttaagaggccattaggt

SEQ ID NO: 8003658 - DNA, 22 bp, Homo sapiens
ctattttaagaggccattaggt

SEQ ID NO: 8003659 - DNA, 22 bp, Homo sapiens
ctcagcactttggaaggctgat

SEQ ID NO: 8003660 - DNA, 19 bp, Homo sapiens
ctcagcacttttacacagg

SEQ ID NO: 8003661 - DNA, 19 bp, Homo sapiens
ctcagcacttttacacagg

SEQ ID NO: 8003662 - DNA, 22 bp, Homo sapiens
ctcagcagagaccagggaggaa

SEQ ID NO: 8003663 - DNA, 22 bp, Homo sapiens
ctcagcactgacccaggagatg

SEQ ID NO: 8003664 - DNA, 22 bp, Homo sapiens
ctcagcactgacccaggagatg

SEQ ID NO: 8003665 - DNA, 22 bp, Homo sapiens
ctcagcacccgggcctttcctc

SEQ ID NO: 8003666 - DNA, 22 bp, Homo sapiens
ctcagcaccccgacaggacatt

SEQ ID NO: 8003667 - DNA, 22 bp, Homo sapiens
ctcagcaccccgacaggacatt

SEQ ID NO: 8003668 - DNA, 22 bp, Homo sapiens
ctcagcaccccgacaggacatt

SEQ ID NO: 8003669 - DNA, 22 bp, Homo sapiens
ctcagaggggatgcttggagaa

SEQ ID NO: 8003670 - DNA, 22 bp, Homo sapiens
ctcagagggaggactgggctgg

SEQ ID NO: 8003671 - DNA, 22 bp, Homo sapiens
ctcagaggggatgcaatcttgc

SEQ ID NO: 8003672 - DNA, 22 bp, Homo sapiens
ctcagaggggatgcttggagaa

SEQ ID NO: 8003673 - DNA, 17 bp, Homo sapiens
ctattttggagattaaa

SEQ ID NO: 8003674 - DNA, 17 bp, Homo sapiens
ctattttggagattaaa

SEQ ID NO: 8003675 - DNA, 22 bp, Homo sapiens
ctatttttctgtaccctaattt

SEQ ID NO: 8003676 - DNA, 22 bp, Homo sapiens
ctattttgtccttagtgcaggg

SEQ ID NO: 8003677 - DNA, 17 bp, Homo sapiens
ctattttggagattaaa

SEQ ID NO: 8003678 - DNA, 22 bp, Homo sapiens
ctatttttctgtaccctaattt

SEQ ID NO: 8003679 - DNA, 22 bp, Homo sapiens
ctatttttctgtaccctaattt

SEQ ID NO: 8003680 - DNA, 22 bp, Homo sapiens
ctatttttctgtaccctaattt

SEQ ID NO: 8003681 - DNA, 22 bp, Homo sapiens
ctatttttctgtaccctaattt

SEQ ID NO: 8003682 - DNA, 22 bp, Homo sapiens
ctatttttctgtaccctaattt

SEQ ID NO: 8003683 - DNA, 22 bp, Homo sapiens
ctcagagggaggactgggctgg

SEQ ID NO: 8003684 - DNA, 22 bp, Homo sapiens
ctatttttctgtaccctaattt

SEQ ID NO: 8003685 - DNA, 22 bp, Homo sapiens
ctatttttctgtaccctaattt

SEQ ID NO: 8003686 - DNA, 22 bp, Homo sapiens
ctatttttctgtaccctaattt

SEQ ID NO: 8003687 - DNA, 22 bp, Homo sapiens
ctcagcagcagggaagaggtca

SEQ ID NO: 8003688 - DNA, 22 bp, Homo sapiens
ctcagcagcagggaagaggtca

SEQ ID NO: 8003689 - DNA, 20 bp, Homo sapiens
ctcagcagattcttctagaa

SEQ ID NO: 8003690 - DNA, 22 bp, Homo sapiens
ctcagcagcagggaagaggtca

SEQ ID NO: 8003691 - DNA, 22 bp, Homo sapiens
ctcagcagcagggaagaggtca

SEQ ID NO: 8003692 - DNA, 22 bp, Homo sapiens
ctcagcagaggcagtattcagt

SEQ ID NO: 8003693 - DNA, 22 bp, Homo sapiens
ctcagcagaggcagtattcagt

SEQ ID NO: 8003694 - DNA, 20 bp, Homo sapiens
ctcagcagattcttctagaa

SEQ ID NO: 8003695 - DNA, 22 bp, Homo sapiens
ctcagcagctacaggattcggg

SEQ ID NO: 8003696 - DNA, 22 bp, Homo sapiens
ctcagcagctgctgctggtggg

SEQ ID NO: 8003697 - DNA, 22 bp, Homo sapiens
ctcagcagctgctgctggtggg

SEQ ID NO: 8003698 - DNA, 22 bp, Homo sapiens
ctcagcagctgctgctggtggg

SEQ ID NO: 8003699 - DNA, 22 bp, Homo sapiens
ctcagcagctacaggattcggg

SEQ ID NO: 8003700 - DNA, 22 bp, Homo sapiens
ctcagcagctacaggattcggg

SEQ ID NO: 8003701 - DNA, 22 bp, Homo sapiens
ctcagcagctgctgctggtggg

SEQ ID NO: 8003702 - DNA, 23 bp, Homo sapiens
ctcagcagcctgctgcagataag

SEQ ID NO: 8003703 - DNA, 23 bp, Homo sapiens
ctcagcagcctgctgcagataag

SEQ ID NO: 8003704 - DNA, 22 bp, Homo sapiens
ctcagcaggtaccacatgatct

SEQ ID NO: 8003705 - DNA, 17 bp, Homo sapiens
ctcagcagggctcactt

SEQ ID NO: 8003706 - DNA, 17 bp, Homo sapiens
ctcagcagggctcactt

SEQ ID NO: 8003707 - DNA, 17 bp, Homo sapiens
ctcagcagggctcactt

SEQ ID NO: 8003708 - DNA, 17 bp, Homo sapiens
ctcagcagggctcactt

SEQ ID NO: 8003709 - DNA, 17 bp, Homo sapiens
ctcagcagggctcactt

SEQ ID NO: 8003710 - DNA, 22 bp, Homo sapiens
ctcagcaggcactgtgccttac

SEQ ID NO: 8003711 - DNA, 22 bp, Homo sapiens
ctcagcaggcactgtgccttac

SEQ ID NO: 8003712 - DNA, 22 bp, Homo sapiens
ctcagcaggcactgtgccttac

SEQ ID NO: 8003713 - DNA, 22 bp, Homo sapiens
ctcagcaggcactgtgccttac

SEQ ID NO: 8003714 - DNA, 22 bp, Homo sapiens
ctcagcaggcactgtgccttac

SEQ ID NO: 8003715 - DNA, 22 bp, Homo sapiens
ctcagcagtaaacgtccggaac

SEQ ID NO: 8003716 - DNA, 22 bp, Homo sapiens
ctcagcagtaaacgtccggaac

SEQ ID NO: 8003717 - DNA, 22 bp, Homo sapiens
ctcagcaggtcttgggtagggg

SEQ ID NO: 8003718 - DNA, 22 bp, Homo sapiens
ctcagcaggtcttgggtagggg

SEQ ID NO: 8003719 - DNA, 22 bp, Homo sapiens
ctcagcaggtcttgggtagggg

SEQ ID NO: 8003720 - DNA, 23 bp, Homo sapiens
ctcagcaggtcaggccccttcct

SEQ ID NO: 8003721 - DNA, 23 bp, Homo sapiens
ctcagcaggtcaggccccttcct

SEQ ID NO: 8003722 - DNA, 23 bp, Homo sapiens
ctcagcaggtcaggccccttcct

SEQ ID NO: 8003723 - DNA, 22 bp, Homo sapiens
ctcagcaggtaccacatgatct

SEQ ID NO: 8003724 - DNA, 22 bp, Homo sapiens
ctcagcaggtaccacatgatct

SEQ ID NO: 8003725 - DNA, 22 bp, Homo sapiens
ttgagaaaatagttcgaatgtt

SEQ ID NO: 8003726 - DNA, 22 bp, Homo sapiens
ttgagaaacatctaatctttgt

SEQ ID NO: 8003727 - DNA, 22 bp, Homo sapiens
ttgagaaacatctaatctttgt

SEQ ID NO: 8003728 - DNA, 22 bp, Homo sapiens
ttgagaaacatctaatctttgt

SEQ ID NO: 8003729 - DNA, 22 bp, Homo sapiens
ttgagaaacatctaatctttgt

SEQ ID NO: 8003730 - DNA, 22 bp, Homo sapiens
ttgagaaacagattggcaccgt

SEQ ID NO: 8003731 - DNA, 22 bp, Homo sapiens
ttgagaaaagctgtgtaaggat

SEQ ID NO: 8003732 - DNA, 22 bp, Homo sapiens
ttgagaaaagctgtgtaaggat

SEQ ID NO: 8003733 - DNA, 22 bp, Homo sapiens
ttgacttttcttggtcacatga

SEQ ID NO: 8003734 - DNA, 22 bp, Homo sapiens
ttgagaaaacacagagtttatt

SEQ ID NO: 8003735 - DNA, 22 bp, Homo sapiens
ttgagaaaaccatcgtaagaat

SEQ ID NO: 8003736 - DNA, 22 bp, Homo sapiens
ttgagaaaaccatcgtaagaat

SEQ ID NO: 8003737 - DNA, 22 bp, Homo sapiens
ttgagaaaaccatcgtaagaat

SEQ ID NO: 8003738 - DNA, 22 bp, Homo sapiens
ttgagaaaacacagagtttatt

SEQ ID NO: 8003739 - DNA, 22 bp, Homo sapiens
ttgagaaaacattgagggccat

SEQ ID NO: 8003740 - DNA, 22 bp, Homo sapiens
ttgagctgtaaggtgggatgtg

SEQ ID NO: 8003741 - DNA, 20 bp, Homo sapiens
ttgagcttccaagtctttgt

SEQ ID NO: 8003742 - DNA, 22 bp, Homo sapiens
ttgagcttgaggagttatttga

SEQ ID NO: 8003743 - DNA, 22 bp, Homo sapiens
ttgagctgtatacctatgactg

SEQ ID NO: 8003744 - DNA, 22 bp, Homo sapiens
ttgagctgtaaggtgggatgtg

SEQ ID NO: 8003745 - DNA, 22 bp, Homo sapiens
ttgagctttacaacagctgtta

SEQ ID NO: 8003746 - DNA, 20 bp, Homo sapiens
ttgagcttttagtacagaca

SEQ ID NO: 8003747 - DNA, 22 bp, Homo sapiens
ttgagcttgctggccttcagct

SEQ ID NO: 8003748 - DNA, 22 bp, Homo sapiens
ttgagaaacctggcagtagaga

SEQ ID NO: 8003749 - DNA, 22 bp, Homo sapiens
ttgagctgcctggctgtggctc

SEQ ID NO: 8003750 - DNA, 22 bp, Homo sapiens
ttgagaaacctggcagtagaga

SEQ ID NO: 8003751 - DNA, 22 bp, Homo sapiens
ttgagctcccgcttcttctttg

SEQ ID NO: 8003752 - DNA, 23 bp, Homo sapiens
ttgaccttatcaagggcatttgc

SEQ ID NO: 8003753 - DNA, 22 bp, Homo sapiens
ttgacctttgtttttacagagt

SEQ ID NO: 8003754 - DNA, 22 bp, Homo sapiens
ttgactctaaatttacttttcc

SEQ ID NO: 8003755 - DNA, 22 bp, Homo sapiens
ttgactgtacaaccttttgtag

SEQ ID NO: 8003756 - DNA, 22 bp, Homo sapiens
ttgactctaaatttacttttcc

SEQ ID NO: 8003757 - DNA, 22 bp, Homo sapiens
ttgacctatgtttcttcatctg

SEQ ID NO: 8003758 - DNA, 22 bp, Homo sapiens
ctcagcagtatactctgaagat

SEQ ID NO: 8003759 - DNA, 22 bp, Homo sapiens
ctcagcagtaaacgtccggaac

SEQ ID NO: 8003760 - DNA, 22 bp, Homo sapiens
ttgacccagctttccccacaat

SEQ ID NO: 8003761 - DNA, 22 bp, Homo sapiens
ttgacccagctttccccacaat

SEQ ID NO: 8003762 - DNA, 22 bp, Homo sapiens
ttgactttacagttttcttagg

SEQ ID NO: 8003763 - DNA, 22 bp, Homo sapiens
ttgactttacagttttcttagg

SEQ ID NO: 8003764 - DNA, 22 bp, Homo sapiens
ttgactttatgtcaacttgcct

SEQ ID NO: 8003765 - DNA, 22 bp, Homo sapiens
ttgactttacagttttcttagg

SEQ ID NO: 8003766 - DNA, 22 bp, Homo sapiens
ttgacttcccagacttgtgttt

SEQ ID NO: 8003767 - DNA, 22 bp, Homo sapiens
ttgacttcagcctgtacttgta

SEQ ID NO: 8003768 - DNA, 22 bp, Homo sapiens
ttgactgtgatgggctcagctg

SEQ ID NO: 8003769 - DNA, 22 bp, Homo sapiens
ttgactgtgaatctaagttact

SEQ ID NO: 8003770 - DNA, 22 bp, Homo sapiens
ttgactgttgctgccattctgg

SEQ ID NO: 8003771 - DNA, 22 bp, Homo sapiens
ttgataaaatgatgaaatcact

SEQ ID NO: 8003772 - DNA, 22 bp, Homo sapiens
ttgataaaatgatgaaatcact

SEQ ID NO: 8003773 - DNA, 22 bp, Homo sapiens
ttgataaaatgatatcttcttt

SEQ ID NO: 8003774 - DNA, 22 bp, Homo sapiens
ttgaggagtggcgctggactta

SEQ ID NO: 8003775 - DNA, 22 bp, Homo sapiens
ttgaggagtcaggggcacggaa

SEQ ID NO: 8003776 - DNA, 18 bp, Homo sapiens
ttgataaacaatttcatt

SEQ ID NO: 8003777 - DNA, 18 bp, Homo sapiens
ttgataaacaatttcatt

SEQ ID NO: 8003778 - DNA, 18 bp, Homo sapiens
ttgataaacaatttcatt

SEQ ID NO: 8003779 - DNA, 22 bp, Homo sapiens
ttgatacacaatggaacaatgt

SEQ ID NO: 8003780 - DNA, 23 bp, Homo sapiens
ttgatacagaagaatcagtttgt

SEQ ID NO: 8003781 - DNA, 23 bp, Homo sapiens
ttgatacagaagaatcagtttgt

SEQ ID NO: 8003782 - DNA, 22 bp, Homo sapiens
ttgatacacaatggaacaatgt

SEQ ID NO: 8003783 - DNA, 22 bp, Homo sapiens
ttgatacacaatggaacaatgt

SEQ ID NO: 8003784 - DNA, 22 bp, Homo sapiens
ttgatacaggccttctagatga

SEQ ID NO: 8003785 - DNA, 22 bp, Homo sapiens
ttgatacagcagcctgtgatcc

SEQ ID NO: 8003786 - DNA, 23 bp, Homo sapiens
ttgatacagaagaatcagtttgt

SEQ ID NO: 8003787 - DNA, 22 bp, Homo sapiens
ttgatacaggccttctagatga

SEQ ID NO: 8003788 - DNA, 22 bp, Homo sapiens
ttgatacaggctctatttcatc

SEQ ID NO: 8003789 - DNA, 22 bp, Homo sapiens
ttgaggacagtgcttggggccc

SEQ ID NO: 8003790 - DNA, 22 bp, Homo sapiens
ttgaggacagtgcttggggccc

SEQ ID NO: 8003791 - DNA, 22 bp, Homo sapiens
ttgaggacaggctgattgtata

SEQ ID NO: 8003792 - DNA, 22 bp, Homo sapiens
ttgaggaaagagtgcaaagagg

SEQ ID NO: 8003793 - DNA, 22 bp, Homo sapiens
ttgaggaaaggaatttatttta

SEQ ID NO: 8003794 - DNA, 23 bp, Homo sapiens
ttgaggacaatttacatggtgtt

SEQ ID NO: 8003795 - DNA, 22 bp, Homo sapiens
ttgaggaaaggaatttatttta

SEQ ID NO: 8003796 - DNA, 23 bp, Homo sapiens
ttgaggacaatttacatggtgtt

SEQ ID NO: 8003797 - DNA, 20 bp, Homo sapiens
ttgagcttttagtacagaca

SEQ ID NO: 8003798 - DNA, 20 bp, Homo sapiens
ttgagcttttagtacagaca

SEQ ID NO: 8003799 - DNA, 20 bp, Homo sapiens
ttgagcttttagtacagaca

SEQ ID NO: 8003800 - DNA, 22 bp, Homo sapiens
ttgaggagtacaaagcatgctt

SEQ ID NO: 8003801 - DNA, 22 bp, Homo sapiens
ttgaggaggcctttcagggctt

SEQ ID NO: 8003802 - DNA, 22 bp, Homo sapiens
ttgaggaggcctttcagggctt

SEQ ID NO: 8003803 - DNA, 22 bp, Homo sapiens
ttgaggaggacagaaacattta

SEQ ID NO: 8003804 - DNA, 22 bp, Homo sapiens
ttcacatataatgtctttaaaa

SEQ ID NO: 8003805 - DNA, 17 bp, Homo sapiens
ttcacatccgagaacaa

SEQ ID NO: 8003806 - DNA, 22 bp, Homo sapiens
ttcacatctataacttagataa

SEQ ID NO: 8003807 - DNA, 22 bp, Homo sapiens
ttcacataggagcatggttttt

SEQ ID NO: 8003808 - DNA, 22 bp, Homo sapiens
ttcacataatgatacaaagctt

SEQ ID NO: 8003809 - DNA, 22 bp, Homo sapiens
ttcacataatctgcagcaagcg

SEQ ID NO: 8003810 - DNA, 22 bp, Homo sapiens
ttcacataaatagatcacatca

SEQ ID NO: 8003811 - DNA, 22 bp, Homo sapiens
ttcacataatctgcagcaagcg

SEQ ID NO: 8003812 - DNA, 22 bp, Homo sapiens
ttcacataaatagatcacatca

SEQ ID NO: 8003813 - DNA, 22 bp, Homo sapiens
ttcacataaatagatcacatca

SEQ ID NO: 8003814 - DNA, 22 bp, Homo sapiens
ttcacataaaagctccaaagaa

SEQ ID NO: 8003815 - DNA, 22 bp, Homo sapiens
ttcacagtttgctgggacagga

SEQ ID NO: 8003816 - DNA, 22 bp, Homo sapiens
ttcacagtttgctgggacagga

SEQ ID NO: 8003817 - DNA, 22 bp, Homo sapiens
ttcacagtttaatggcaaggat

SEQ ID NO: 8003818 - DNA, 22 bp, Homo sapiens
ttcacagtttaatggcaaggat

SEQ ID NO: 8003819 - DNA, 22 bp, Homo sapiens
ttcacagttgggcaggttgtgt

SEQ ID NO: 8003820 - DNA, 22 bp, Homo sapiens
ttcacagttcctgggaaaacag

SEQ ID NO: 8003821 - DNA, 22 bp, Homo sapiens
ttcacagttcctgggaaaacag

SEQ ID NO: 8003822 - DNA, 22 bp, Homo sapiens
cctgggtggttccggcaaggag

SEQ ID NO: 8003823 - DNA, 22 bp, Homo sapiens
cctgggtggttccggcaaggag

SEQ ID NO: 8003824 - DNA, 22 bp, Homo sapiens
cctgggtggttccggcaaggag

SEQ ID NO: 8003825 - DNA, 21 bp, Homo sapiens
cctgggtgggacccctcttcc

SEQ ID NO: 8003826 - DNA, 21 bp, Homo sapiens
cctgggtgggacccctcttcc

SEQ ID NO: 8003827 - DNA, 21 bp, Homo sapiens
cctgggtgggacccctcttcc

SEQ ID NO: 8003828 - DNA, 22 bp, Homo sapiens
cctgggtggcagaggttgcagt

SEQ ID NO: 8003829 - DNA, 22 bp, Homo sapiens
cctgggtggctgcctgcctttc

SEQ ID NO: 8003830 - DNA, 22 bp, Homo sapiens
cctgggtggctgcctgcctttc

SEQ ID NO: 8003831 - DNA, 22 bp, Homo sapiens
cctgggtggctgcctgcctttc

SEQ ID NO: 8003832 - DNA, 22 bp, Homo sapiens
ttcacagaccaggaggctgtga

SEQ ID NO: 8003833 - DNA, 22 bp, Homo sapiens
ttcacagaccaggaggctgtga

SEQ ID NO: 8003834 - DNA, 22 bp, Homo sapiens
ttcacagacattgcagactgaa

SEQ ID NO: 8003835 - DNA, 22 bp, Homo sapiens
cctgggtgtcatgggcagctgg

SEQ ID NO: 8003836 - DNA, 22 bp, Homo sapiens
cctgggtggttccggcaaggag

SEQ ID NO: 8003837 - DNA, 22 bp, Homo sapiens
cctgggtggttccggcaaggag

SEQ ID NO: 8003838 - DNA, 22 bp, Homo sapiens
ttcacagtggtagtgcatttag

SEQ ID NO: 8003839 - DNA, 22 bp, Homo sapiens
ttcacagtggtagtgcatttag

SEQ ID NO: 8003840 - DNA, 22 bp, Homo sapiens
ttcacagtggtagtgcatttag

SEQ ID NO: 8003841 - DNA, 22 bp, Homo sapiens
ttcacagtgtgatctatgggca

SEQ ID NO: 8003842 - DNA, 22 bp, Homo sapiens
ttcacagtgtgatctatgggca

SEQ ID NO: 8003843 - DNA, 22 bp, Homo sapiens
ttcacagtgtttctcacggtta

SEQ ID NO: 8003844 - DNA, 22 bp, Homo sapiens
ttcacagtgttgtgccttttgt

SEQ ID NO: 8003845 - DNA, 22 bp, Homo sapiens
ttcacagtggcttaggctatgg

SEQ ID NO: 8003846 - DNA, 22 bp, Homo sapiens
ttcacagtggcttaggctatgg

SEQ ID NO: 8003847 - DNA, 22 bp, Homo sapiens
ttcacagtggtaagggttgtga

SEQ ID NO: 8003848 - DNA, 22 bp, Homo sapiens
ttcacagtggtagtgcatttag

SEQ ID NO: 8003849 - DNA, 22 bp, Homo sapiens
ttcacagaccaggaggctgtga

SEQ ID NO: 8003850 - DNA, 22 bp, Homo sapiens
ttcacagactgcagactttttg

SEQ ID NO: 8003851 - DNA, 22 bp, Homo sapiens
ttcacagactgcagactttttg

SEQ ID NO: 8003852 - DNA, 22 bp, Homo sapiens
cggcatccccacttcctcctgc

SEQ ID NO: 8003853 - DNA, 22 bp, Homo sapiens
cggcatccccacttcctcctgc

SEQ ID NO: 8003854 - DNA, 22 bp, Homo sapiens
cggcatccccacttcctcctgc

SEQ ID NO: 8003855 - DNA, 22 bp, Homo sapiens
cggcatccccacttcctcctgc

SEQ ID NO: 8003856 - DNA, 22 bp, Homo sapiens
cggcatgggcgtccccctcact

SEQ ID NO: 8003857 - DNA, 22 bp, Homo sapiens
cggcatccccacttcctcctgc

SEQ ID NO: 8003858 - DNA, 22 bp, Homo sapiens
cggcatgggcgtccccctcact

SEQ ID NO: 8003859 - DNA, 22 bp, Homo sapiens
cggctcaggccacaggacggca

SEQ ID NO: 8003860 - DNA, 22 bp, Homo sapiens
cggctcaggccacaggacggca

SEQ ID NO: 8003861 - DNA, 21 bp, Homo sapiens
cggctcagtgcctgctccttc

SEQ ID NO: 8003862 - DNA, 22 bp, Homo sapiens
cggacaggctcctggagctcct

SEQ ID NO: 8003863 - DNA, 22 bp, Homo sapiens
cggaatgtcccaggtcctgatc

SEQ ID NO: 8003864 - DNA, 22 bp, Homo sapiens
cggaagagggacagcgccagcc

SEQ ID NO: 8003865 - DNA, 22 bp, Homo sapiens
cggaatgtccttcttaaggtgt

SEQ ID NO: 8003866 - DNA, 22 bp, Homo sapiens
cggacaggctcctggagctcct

SEQ ID NO: 8003867 - DNA, 21 bp, Homo sapiens
cggaaaggactagggctcaga

SEQ ID NO: 8003868 - DNA, 22 bp, Homo sapiens
cggaaacttgagaaccagccag

SEQ ID NO: 8003869 - DNA, 22 bp, Homo sapiens
cggaagacagtccgctctttca

SEQ ID NO: 8003870 - DNA, 21 bp, Homo sapiens
cggaaactcggctctggttcc

SEQ ID NO: 8003871 - DNA, 22 bp, Homo sapiens
cggaaactacgtgacacccgtt

SEQ ID NO: 8003872 - DNA, 22 bp, Homo sapiens
cgctttaacgtgagaagaaggg

SEQ ID NO: 8003873 - DNA, 22 bp, Homo sapiens
cgcttgttagatgccgttagcc

SEQ ID NO: 8003874 - DNA, 20 bp, Homo sapiens
cgctttcctcaaactctgtt

SEQ ID NO: 8003875 - DNA, 22 bp, Homo sapiens
cgctgggggaacttcagccaat

SEQ ID NO: 8003876 - DNA, 22 bp, Homo sapiens
cgctggtcaccatggcgtcctg

SEQ ID NO: 8003877 - DNA, 22 bp, Homo sapiens
cgctgggggaacttcagccaat

SEQ ID NO: 8003878 - DNA, 21 bp, Homo sapiens
cgcttgtccccgttatcgccc

SEQ ID NO: 8003879 - DNA, 22 bp, Homo sapiens
cgcttctctactcccagccagt

SEQ ID NO: 8003880 - DNA, 22 bp, Homo sapiens
cgctgtgtttacatcattgctg

SEQ ID NO: 8003881 - DNA, 22 bp, Homo sapiens
cgctgtgtgcagactgaaaatg

SEQ ID NO: 8003882 - DNA, 22 bp, Homo sapiens
cgctggtcaccatggcgtcctg

SEQ ID NO: 8003883 - DNA, 22 bp, Homo sapiens
cgctggtgaaggctaggctagc

SEQ ID NO: 8003884 - DNA, 22 bp, Homo sapiens
cgctggggctttttgcttgaga

SEQ ID NO: 8003885 - DNA, 22 bp, Homo sapiens
cgctgggggaacagcgagggtg

SEQ ID NO: 8003886 - DNA, 22 bp, Homo sapiens
cgctgggggaacagcgagggtg

SEQ ID NO: 8003887 - DNA, 22 bp, Homo sapiens
cgctggggctttttgcttgaga

SEQ ID NO: 8003888 - DNA, 22 bp, Homo sapiens
cgctgggcgcgctccgaacccg

SEQ ID NO: 8003889 - DNA, 22 bp, Homo sapiens
cgctgggcgcgctccgaacccg

SEQ ID NO: 8003890 - DNA, 22 bp, Homo sapiens
cgctgggcgcgctccgaacccg

SEQ ID NO: 8003891 - DNA, 22 bp, Homo sapiens
cgctgggggaacagcgagggtg

SEQ ID NO: 8003892 - DNA, 22 bp, Homo sapiens
cgctgggggaacagcgagggtg

SEQ ID NO: 8003893 - DNA, 22 bp, Homo sapiens
cgctgggggaacagcgagggtg

SEQ ID NO: 8003894 - DNA, 22 bp, Homo sapiens
cgctgggggaacagcgagggtg

SEQ ID NO: 8003895 - DNA, 22 bp, Homo sapiens
ttcacatgttggacatagagga

SEQ ID NO: 8003896 - DNA, 22 bp, Homo sapiens
ttcacatgttggacatagagga

SEQ ID NO: 8003897 - DNA, 22 bp, Homo sapiens
ttcacattaagcctcctcctac

SEQ ID NO: 8003898 - DNA, 22 bp, Homo sapiens
ttcacattaagcctcctcctac

SEQ ID NO: 8003899 - DNA, 22 bp, Homo sapiens
ttcacattacaaggccatattt

SEQ ID NO: 8003900 - DNA, 22 bp, Homo sapiens
cgctgggcgccgacctgctggc

SEQ ID NO: 8003901 - DNA, 22 bp, Homo sapiens
cgctgggcgccgacctgctggc

SEQ ID NO: 8003902 - DNA, 22 bp, Homo sapiens
cgctgggcgccgacctgctggc

SEQ ID NO: 8003903 - DNA, 22 bp, Homo sapiens
cgctgggcgccgacctgctggc

SEQ ID NO: 8003904 - DNA, 22 bp, Homo sapiens
cgctgggcgccgacctgctggc

SEQ ID NO: 8003905 - DNA, 22 bp, Homo sapiens
cgctgggcgccgacctgctggc

SEQ ID NO: 8003906 - DNA, 22 bp, Homo sapiens
cgctgggcatggtgccttattt

SEQ ID NO: 8003907 - DNA, 22 bp, Homo sapiens
cgctgggcatggtgccttattt

SEQ ID NO: 8003908 - DNA, 22 bp, Homo sapiens
cggctgggtagaggtgccgggt

SEQ ID NO: 8003909 - DNA, 22 bp, Homo sapiens
cggctgggtagaggtgccgggt

SEQ ID NO: 8003910 - DNA, 22 bp, Homo sapiens
cggctgggtagaggtgccgggt

SEQ ID NO: 8003911 - DNA, 22 bp, Homo sapiens
cggctgggtagaggtgccgggt

SEQ ID NO: 8003912 - DNA, 22 bp, Homo sapiens
cggctggggctgtccccatgac

SEQ ID NO: 8003913 - DNA, 22 bp, Homo sapiens
cggctggggctgtccccatgac

SEQ ID NO: 8003914 - DNA, 22 bp, Homo sapiens
cggctgctgcctgagtcgctgt

SEQ ID NO: 8003915 - DNA, 22 bp, Homo sapiens
cggctgcttctgagccccggcg

SEQ ID NO: 8003916 - DNA, 22 bp, Homo sapiens
cggctgcttctgagccccggcg

SEQ ID NO: 8003917 - DNA, 22 bp, Homo sapiens
cggctggagctgagaaaggagc

SEQ ID NO: 8003918 - DNA, 22 bp, Homo sapiens
cggctggaagctggacaggccg

SEQ ID NO: 8003919 - DNA, 22 bp, Homo sapiens
cggctggggctgtccccatgac

SEQ ID NO: 8003920 - DNA, 22 bp, Homo sapiens
cggctggagctttgaacctgat

SEQ ID NO: 8003921 - DNA, 23 bp, Homo sapiens
cggctgctcggccgagtcctcgg

SEQ ID NO: 8003922 - DNA, 22 bp, Homo sapiens
cggctgaggatctccaggcctg

SEQ ID NO: 8003923 - DNA, 22 bp, Homo sapiens
cggctgagcagtgctgatggaa

SEQ ID NO: 8003924 - DNA, 22 bp, Homo sapiens
cggctgaggatctccaggcctg

SEQ ID NO: 8003925 - DNA, 22 bp, Homo sapiens
cggctgagcagtgctgatggaa

SEQ ID NO: 8003926 - DNA, 22 bp, Homo sapiens
cggctgagacggccatagacac

SEQ ID NO: 8003927 - DNA, 22 bp, Homo sapiens
cggctgagacggccatagacac

SEQ ID NO: 8003928 - DNA, 22 bp, Homo sapiens
cggctctgtcctcagcactgct

SEQ ID NO: 8003929 - DNA, 22 bp, Homo sapiens
cggctctgtcctcagcactgct

SEQ ID NO: 8003930 - DNA, 21 bp, Homo sapiens
cggctcagtgcctgctccttc

SEQ ID NO: 8003931 - DNA, 22 bp, Homo sapiens
ttcagaaaaagaccattgcaat

SEQ ID NO: 8003932 - DNA, 22 bp, Homo sapiens
ttcagaaaaagaccattgcaat

SEQ ID NO: 8003933 - DNA, 22 bp, Homo sapiens
ttcagaaaaagaccattgcaat

SEQ ID NO: 8003934 - DNA, 22 bp, Homo sapiens
ttcagaaaaagaccattgcaat

SEQ ID NO: 8003935 - DNA, 22 bp, Homo sapiens
ttcagaaacagagtgagtgagt

SEQ ID NO: 8003936 - DNA, 22 bp, Homo sapiens
ttcagaaacagagtgagtgagt

SEQ ID NO: 8003937 - DNA, 22 bp, Homo sapiens
ttcagaaaaagaccattgcaat

SEQ ID NO: 8003938 - DNA, 22 bp, Homo sapiens
ttcagaaacatcagtggatgga

SEQ ID NO: 8003939 - DNA, 22 bp, Homo sapiens
ttcagaaacatcagtggatgga

SEQ ID NO: 8003940 - DNA, 22 bp, Homo sapiens
ttcagaaacatcagtggatgga

SEQ ID NO: 8003941 - DNA, 22 bp, Homo sapiens
ttcagaaaggataattggaagg

SEQ ID NO: 8003942 - DNA, 22 bp, Homo sapiens
ttcagaaaggataattggaagg

SEQ ID NO: 8003943 - DNA, 22 bp, Homo sapiens
ttcacttaacatcatatcatga

SEQ ID NO: 8003944 - DNA, 22 bp, Homo sapiens
ttcactgtttcatcctacttct

SEQ ID NO: 8003945 - DNA, 22 bp, Homo sapiens
ttcacttaacatttaccaagga

SEQ ID NO: 8003946 - DNA, 22 bp, Homo sapiens
ttcacttatagggatgttattg

SEQ ID NO: 8003947 - DNA, 22 bp, Homo sapiens
ttcacttaacatcatatcatga

SEQ ID NO: 8003948 - DNA, 22 bp, Homo sapiens
ttcagaaaaaacttcaataagt

SEQ ID NO: 8003949 - DNA, 22 bp, Homo sapiens
ttcagaaaaaacttcaataagt

SEQ ID NO: 8003950 - DNA, 22 bp, Homo sapiens
ttcacttatttcttgagtagca

SEQ ID NO: 8003951 - DNA, 22 bp, Homo sapiens
ttcagaaaaaacttcaataagt

SEQ ID NO: 8003952 - DNA, 22 bp, Homo sapiens
ttcattctgggctctaaggaac

SEQ ID NO: 8003953 - DNA, 22 bp, Homo sapiens
ttcattctgtttggaaaggtgg

SEQ ID NO: 8003954 - DNA, 22 bp, Homo sapiens
ttcattctgggctctaaggaac

SEQ ID NO: 8003955 - DNA, 22 bp, Homo sapiens
ttcattctgcagttctcagctc

SEQ ID NO: 8003956 - DNA, 22 bp, Homo sapiens
ttcattctgcagttctcagctc

SEQ ID NO: 8003957 - DNA, 22 bp, Homo sapiens
ttcattctgcagttctcagctc

SEQ ID NO: 8003958 - DNA, 19 bp, Homo sapiens
ttcattctcttattgttgt

SEQ ID NO: 8003959 - DNA, 22 bp, Homo sapiens
ttcattctcttagcatagtcct

SEQ ID NO: 8003960 - DNA, 22 bp, Homo sapiens
ttcattcttgggatcagagagt

SEQ ID NO: 8003961 - DNA, 22 bp, Homo sapiens
ttcattcttgggatcagagagt

SEQ ID NO: 8003962 - DNA, 22 bp, Homo sapiens
ttcattcttcagagctgcgctt

SEQ ID NO: 8003963 - DNA, 22 bp, Homo sapiens
ttcattcttatttgtgatctgg

SEQ ID NO: 8003964 - DNA, 22 bp, Homo sapiens
ttcattctgtttggaaaggtgg

SEQ ID NO: 8003965 - DNA, 22 bp, Homo sapiens
ttcattcttgtctttgtatagt

SEQ ID NO: 8003966 - DNA, 22 bp, Homo sapiens
ttccaaactgccaattcagaag

SEQ ID NO: 8003967 - DNA, 22 bp, Homo sapiens
ttccaaactcatagtatggtgt

SEQ ID NO: 8003968 - DNA, 22 bp, Homo sapiens
ttccaaacctcaaataattaat

SEQ ID NO: 8003969 - DNA, 22 bp, Homo sapiens
ttccaaaatgccttgatatgat

SEQ ID NO: 8003970 - DNA, 22 bp, Homo sapiens
ttccaaaatgccttgatatgat

SEQ ID NO: 8003971 - DNA, 22 bp, Homo sapiens
ttccaaaatgccttgatatgat

SEQ ID NO: 8003972 - DNA, 22 bp, Homo sapiens
ttcagaaaggataattggaagg

SEQ ID NO: 8003973 - DNA, 22 bp, Homo sapiens
ttcagaaaggataattggaagg

SEQ ID NO: 8003974 - DNA, 22 bp, Homo sapiens
ttcagaaaggtaaatggatttc

SEQ ID NO: 8003975 - DNA, 22 bp, Homo sapiens
ttcagaaaggtaaatggatttc

SEQ ID NO: 8003976 - DNA, 22 bp, Homo sapiens
ttcagaaaggtaaatggatttc

SEQ ID NO: 8003977 - DNA, 22 bp, Homo sapiens
ttcagaaaggttaatctggatt

SEQ ID NO: 8003978 - DNA, 22 bp, Homo sapiens
ttcagaaaggttaatctggatt

SEQ ID NO: 8003979 - DNA, 22 bp, Homo sapiens
ttcagaaaggttaatctggatt

SEQ ID NO: 8003980 - DNA, 22 bp, Homo sapiens
ttcagaaaggttaatctggatt

SEQ ID NO: 8003981 - DNA, 21 bp, Homo sapiens
ttcatgagataaccagctgta

SEQ ID NO: 8003982 - DNA, 22 bp, Homo sapiens
ttcagaaaggttaatctggatt

SEQ ID NO: 8003983 - DNA, 22 bp, Homo sapiens
ttcatgaggtacctgtgatcat

SEQ ID NO: 8003984 - DNA, 22 bp, Homo sapiens
ttcattccttccctaagcaact

SEQ ID NO: 8003985 - DNA, 22 bp, Homo sapiens
ttcattcctgagcccatattta

SEQ ID NO: 8003986 - DNA, 22 bp, Homo sapiens
ttcattccttctgtaccttgcc

SEQ ID NO: 8003987 - DNA, 22 bp, Homo sapiens
ttcattcctgagcccatattta

SEQ ID NO: 8003988 - DNA, 22 bp, Homo sapiens
ttcattctcttagcatagtcct

SEQ ID NO: 8003989 - DNA, 22 bp, Homo sapiens
ttcattcccaagagtaaacata

SEQ ID NO: 8003990 - DNA, 22 bp, Homo sapiens
ttcattcccttatattagcatt

SEQ ID NO: 8003991 - DNA, 22 bp, Homo sapiens
ttcatgatagtatctattcaat

SEQ ID NO: 8003992 - DNA, 23 bp, Homo sapiens
ttcatgagttggacaagactggg

SEQ ID NO: 8003993 - DNA, 20 bp, Homo sapiens
ttcattcattccacaacttc

SEQ ID NO: 8003994 - DNA, 22 bp, Homo sapiens
ttccaaagtgctggaattacat

SEQ ID NO: 8003995 - DNA, 22 bp, Homo sapiens
ttccaaagtcatgttgctgata

SEQ ID NO: 8003996 - DNA, 22 bp, Homo sapiens
ttccaaatgagttccatcgaat

SEQ ID NO: 8003997 - DNA, 22 bp, Homo sapiens
ttccaaatgcccatctacacag

SEQ ID NO: 8003998 - DNA, 22 bp, Homo sapiens
ttccaaatggagaagatgagtt

SEQ ID NO: 8003999 - DNA, 22 bp, Homo sapiens
ttccaaatgcccatctacacag

SEQ ID NO: 8004000 - DNA, 22 bp, Homo sapiens
ttccaaatgagttccatcgaat

SEQ ID NO: 8004001 - DNA, 22 bp, Homo sapiens
ttccaaatgagttccatcgaat

SEQ ID NO: 8004002 - DNA, 22 bp, Homo sapiens
ttccaaagttattcaagcagta

SEQ ID NO: 8004003 - DNA, 22 bp, Homo sapiens
ttccaaagctgctttatttagt

SEQ ID NO: 8004004 - DNA, 22 bp, Homo sapiens
ttccaaagaaattgaccaagac

SEQ ID NO: 8004005 - DNA, 22 bp, Homo sapiens
ttccaaagaaattgaccaagac

SEQ ID NO: 8004006 - DNA, 22 bp, Homo sapiens
ttccaaagaagttcacatttac

SEQ ID NO: 8004007 - DNA, 22 bp, Homo sapiens
ttccaaagaagttcacatttac

SEQ ID NO: 8004008 - DNA, 22 bp, Homo sapiens
ttcccaagtctccaatgtggga

SEQ ID NO: 8004009 - DNA, 22 bp, Homo sapiens
ttcccaaagctttgtctgtgaa

SEQ ID NO: 8004010 - DNA, 22 bp, Homo sapiens
ttcccaaagctttgtctgtgaa

SEQ ID NO: 8004011 - DNA, 22 bp, Homo sapiens
ttcccaaagctttgtctgtgaa

SEQ ID NO: 8004012 - DNA, 22 bp, Homo sapiens
ttcccacaacagatctgtatta

SEQ ID NO: 8004013 - DNA, 22 bp, Homo sapiens
ttccatttttctaactctcaga

SEQ ID NO: 8004014 - DNA, 22 bp, Homo sapiens
ttccatttggcacttcactgag

SEQ ID NO: 8004015 - DNA, 22 bp, Homo sapiens
ttccatttttctaactctcaga

SEQ ID NO: 8004016 - DNA, 22 bp, Homo sapiens
ttccatttttctaactctcaga

SEQ ID NO: 8004017 - DNA, 22 bp, Homo sapiens
ttcccaaaatataacagttaac

SEQ ID NO: 8004018 - DNA, 22 bp, Homo sapiens
ttcccaaaatataacagttaac

SEQ ID NO: 8004019 - DNA, 22 bp, Homo sapiens
ttccatttggcacttcactgag

SEQ ID NO: 8004020 - DNA, 22 bp, Homo sapiens
ttccatttggcacttcactgag

SEQ ID NO: 8004021 - DNA, 22 bp, Homo sapiens
ttccaggcacatcccaactcca

SEQ ID NO: 8004022 - DNA, 22 bp, Homo sapiens
ttccaggcacatcccaactcca

SEQ ID NO: 8004023 - DNA, 22 bp, Homo sapiens
ttccatttattcttgtccagat

SEQ ID NO: 8004024 - DNA, 22 bp, Homo sapiens
ttccaggatgggctgtcctact

SEQ ID NO: 8004025 - DNA, 21 bp, Homo sapiens
ttccaggattgcttattttta

SEQ ID NO: 8004026 - DNA, 22 bp, Homo sapiens
ttccaaatgttggacaactgta

SEQ ID NO: 8004027 - DNA, 22 bp, Homo sapiens
ttccaggcaaaggaagcagctt

SEQ ID NO: 8004028 - DNA, 22 bp, Homo sapiens
ttccaggcaaaggaagcagctt

SEQ ID NO: 8004029 - DNA, 22 bp, Homo sapiens
ttccaggcaaaggaagcagctt

SEQ ID NO: 8004030 - DNA, 22 bp, Homo sapiens
ttccaggcaaaggaagcagctt

SEQ ID NO: 8004031 - DNA, 22 bp, Homo sapiens
ttccaaatgttggacaactgta

SEQ ID NO: 8004032 - DNA, 22 bp, Homo sapiens
ttccaaatggagaagatgagtt

SEQ ID NO: 8004033 - DNA, 22 bp, Homo sapiens
ttccaggatgggctgtcctact

SEQ ID NO: 8004034 - DNA, 22 bp, Homo sapiens
ttccaaatgttggacaactgta

SEQ ID NO: 8004035 - DNA, 22 bp, Homo sapiens
ttcccacagtgttgaatcctct

SEQ ID NO: 8004036 - DNA, 23 bp, Homo sapiens
ttcccacatcttccacagctatg

SEQ ID NO: 8004037 - DNA, 22 bp, Homo sapiens
ttcccacattctttacattcat

SEQ ID NO: 8004038 - DNA, 22 bp, Homo sapiens
ttcccactgtggcagagcctcg

SEQ ID NO: 8004039 - DNA, 22 bp, Homo sapiens
ttcccactgtggcagagcctcg

SEQ ID NO: 8004040 - DNA, 22 bp, Homo sapiens
ttcccacagagattacattgaa

SEQ ID NO: 8004041 - DNA, 22 bp, Homo sapiens
ttcccacaggatgagagctgag

SEQ ID NO: 8004042 - DNA, 22 bp, Homo sapiens
ttcccacacccatattgtgatt

SEQ ID NO: 8004043 - DNA, 22 bp, Homo sapiens
ttcccacacaattaagtcattt

SEQ ID NO: 8004044 - DNA, 22 bp, Homo sapiens
ttcccttcaaggtggcctaaag

SEQ ID NO: 8004045 - DNA, 22 bp, Homo sapiens
ttcccttcaaggtggcctaaag

SEQ ID NO: 8004046 - DNA, 22 bp, Homo sapiens
ttcccttcctcactctacttgt

SEQ ID NO: 8004047 - DNA, 22 bp, Homo sapiens
ttcccttcctcactctacttgt

SEQ ID NO: 8004048 - DNA, 22 bp, Homo sapiens
ttcccttaaattatggcatcta

SEQ ID NO: 8004049 - DNA, 22 bp, Homo sapiens
ttcccttaaattatggcatcta

SEQ ID NO: 8004050 - DNA, 22 bp, Homo sapiens
ttcccttaaattatggcatcta

SEQ ID NO: 8004051 - DNA, 22 bp, Homo sapiens
ttcccttaaattatggcatcta

SEQ ID NO: 8004052 - DNA, 22 bp, Homo sapiens
ttcccttaaattatggcatcta

SEQ ID NO: 8004053 - DNA, 22 bp, Homo sapiens
ttcccttaaattatggcatcta

SEQ ID NO: 8004054 - DNA, 22 bp, Homo sapiens
ttccctggttaaccattttctg

SEQ ID NO: 8004055 - DNA, 22 bp, Homo sapiens
ttccctggttaaccattttctg

SEQ ID NO: 8004056 - DNA, 22 bp, Homo sapiens
ttcccagaatgaatggatggag

SEQ ID NO: 8004057 - DNA, 22 bp, Homo sapiens
ttcccacttttacagttgtctg

SEQ ID NO: 8004058 - DNA, 22 bp, Homo sapiens
ttcccacttttacagttgtctg

SEQ ID NO: 8004059 - DNA, 22 bp, Homo sapiens
ttccctggtgggtgagaacctg

SEQ ID NO: 8004060 - DNA, 22 bp, Homo sapiens
ttccctggtctatcctggttca

SEQ ID NO: 8004061 - DNA, 22 bp, Homo sapiens
ttcccagaatgaatggatggag

SEQ ID NO: 8004062 - DNA, 22 bp, Homo sapiens
ctaagaaaatagaagcatgcta

SEQ ID NO: 8004063 - DNA, 22 bp, Homo sapiens
ctaagaaaatagaagcatgcta

SEQ ID NO: 8004064 - DNA, 22 bp, Homo sapiens
ctaagaaaatagaagcatgcta

SEQ ID NO: 8004065 - DNA, 22 bp, Homo sapiens
ctaaggcaccgaggcaggagcg

SEQ ID NO: 8004066 - DNA, 22 bp, Homo sapiens
ctaaggatgcatatgttttgtt

SEQ ID NO: 8004067 - DNA, 22 bp, Homo sapiens
ctaagaaagtattgttttgtgg

SEQ ID NO: 8004068 - DNA, 22 bp, Homo sapiens
ctaagaaagtattgttttgtgg

SEQ ID NO: 8004069 - DNA, 22 bp, Homo sapiens
ctaaggatgcatatgttttgtt

SEQ ID NO: 8004070 - DNA, 22 bp, Homo sapiens
ttccgctgtttagttgaagttt

SEQ ID NO: 8004071 - DNA, 22 bp, Homo sapiens
ttccggaaggttctctagaatt

SEQ ID NO: 8004072 - DNA, 22 bp, Homo sapiens
ttccgctgtttagttgaagttt

SEQ ID NO: 8004073 - DNA, 22 bp, Homo sapiens
ttccggacgcccgtcttccagc

SEQ ID NO: 8004074 - DNA, 22 bp, Homo sapiens
ttccggaaggttctctagaatt

SEQ ID NO: 8004075 - DNA, 22 bp, Homo sapiens
ttcccttcctcactctacttgt

SEQ ID NO: 8004076 - DNA, 22 bp, Homo sapiens
ttcccttctagttttgagagac

SEQ ID NO: 8004077 - DNA, 22 bp, Homo sapiens
ttcccttctagttttgagagac

SEQ ID NO: 8004078 - DNA, 22 bp, Homo sapiens
ttcccttctagttttgagagac

SEQ ID NO: 8004079 - DNA, 22 bp, Homo sapiens
ttcccttgaccccagaccctgg

SEQ ID NO: 8004080 - DNA, 22 bp, Homo sapiens
ttccctttcttaaagagttagg

SEQ ID NO: 8004081 - DNA, 22 bp, Homo sapiens
ttccctttcttaaagagttagg

SEQ ID NO: 8004082 - DNA, 22 bp, Homo sapiens
ttcccttctagttttgagagac

SEQ ID NO: 8004083 - DNA, 21 bp, Homo sapiens
ttcccttctggttttgagaga

SEQ ID NO: 8004084 - DNA, 21 bp, Homo sapiens
ttcccttctggttttgagaga

SEQ ID NO: 8004085 - DNA, 22 bp, Homo sapiens
ttccgaacccggatctgctgct

SEQ ID NO: 8004086 - DNA, 22 bp, Homo sapiens
ttccctttgttaaattggaaga

SEQ ID NO: 8004087 - DNA, 22 bp, Homo sapiens
ttccgagggctcggcggccgcc

SEQ ID NO: 8004088 - DNA, 22 bp, Homo sapiens
ttccgagtctccaaggggttgt

SEQ ID NO: 8004089 - DNA, 22 bp, Homo sapiens
ttccgctggggccgcctggcgg

SEQ ID NO: 8004090 - DNA, 22 bp, Homo sapiens
ttccctttgttaaattggaaga

SEQ ID NO: 8004091 - DNA, 22 bp, Homo sapiens
ttccctttgttaaattggaaga

SEQ ID NO: 8004092 - DNA, 22 bp, Homo sapiens
ttcccttttttctagtaggtag

SEQ ID NO: 8004093 - DNA, 22 bp, Homo sapiens
ttcccttttttctagtaggtag

SEQ ID NO: 8004094 - DNA, 22 bp, Homo sapiens
ttccctttggcagccttctcct

SEQ ID NO: 8004095 - DNA, 22 bp, Homo sapiens
ttccctttggcagccttctcct

SEQ ID NO: 8004096 - DNA, 22 bp, Homo sapiens
ttccctttggcagccttctcct

SEQ ID NO: 8004097 - DNA, 22 bp, Homo sapiens
ctacaaaagtaattgtggtttt

SEQ ID NO: 8004098 - DNA, 22 bp, Homo sapiens
ctacaaaagtaattgtggtttt

SEQ ID NO: 8004099 - DNA, 22 bp, Homo sapiens
ctacaaaagtaattgtggtttt

SEQ ID NO: 8004100 - DNA, 22 bp, Homo sapiens
ctacaaaagtaattgtggtttt

SEQ ID NO: 8004101 - DNA, 22 bp, Homo sapiens
ctacaaaagtaattgtggtttt

SEQ ID NO: 8004102 - DNA, 22 bp, Homo sapiens
ctaattttcccaaggccttcta

SEQ ID NO: 8004103 - DNA, 22 bp, Homo sapiens
ctacaaaagtaattgtggtttt

SEQ ID NO: 8004104 - DNA, 22 bp, Homo sapiens
ctacaaaagtaattgtggtttt

SEQ ID NO: 8004105 - DNA, 22 bp, Homo sapiens
ctacaaaagtaattgtggtttt

SEQ ID NO: 8004106 - DNA, 22 bp, Homo sapiens
ctaattttcccaaggccttcta

SEQ ID NO: 8004107 - DNA, 22 bp, Homo sapiens
ctaatttttgttctgcattgaa

SEQ ID NO: 8004108 - DNA, 22 bp, Homo sapiens
ctaatttaatgaatgagtctta

SEQ ID NO: 8004109 - DNA, 22 bp, Homo sapiens
ctaattctgtatttggtcattg

SEQ ID NO: 8004110 - DNA, 22 bp, Homo sapiens
ctaattgtaagctccttgaggg

SEQ ID NO: 8004111 - DNA, 22 bp, Homo sapiens
ctaattctgtatttggtcattg

SEQ ID NO: 8004112 - DNA, 22 bp, Homo sapiens
ctaattctgtatttggtcattg

SEQ ID NO: 8004113 - DNA, 22 bp, Homo sapiens
ctaattctttggagacaatctg

SEQ ID NO: 8004114 - DNA, 22 bp, Homo sapiens
ctaattctttggagacaatctg

SEQ ID NO: 8004115 - DNA, 22 bp, Homo sapiens
ctaatgtatcatggctctcagc

SEQ ID NO: 8004116 - DNA, 22 bp, Homo sapiens
ctaattatgttgttataatcaa

SEQ ID NO: 8004117 - DNA, 22 bp, Homo sapiens
ctaattatgttgttataatcaa

SEQ ID NO: 8004118 - DNA, 22 bp, Homo sapiens
ctaattctcagcatgaactggt

SEQ ID NO: 8004119 - DNA, 22 bp, Homo sapiens
ctaattctgaaacagtgtcaat

SEQ ID NO: 8004120 - DNA, 22 bp, Homo sapiens
ctaattctcagcatgaactggt

SEQ ID NO: 8004121 - DNA, 22 bp, Homo sapiens
ctaattctgtacctggcacata

SEQ ID NO: 8004122 - DNA, 22 bp, Homo sapiens
ctaattctgaaacagtgtcaat

SEQ ID NO: 8004123 - DNA, 22 bp, Homo sapiens
ctaatgaagctgctttctatga

SEQ ID NO: 8004124 - DNA, 22 bp, Homo sapiens
ctaatcatctttctcttaaagc

SEQ ID NO: 8004125 - DNA, 22 bp, Homo sapiens
ctaatcttgcctcatcaagtct

SEQ ID NO: 8004126 - DNA, 22 bp, Homo sapiens
ctaatagagcttcggaactctg

SEQ ID NO: 8004127 - DNA, 22 bp, Homo sapiens
ctaatacaccctattgcttgtt

SEQ ID NO: 8004128 - DNA, 22 bp, Homo sapiens
ctaatacaccctattgcttgtt

SEQ ID NO: 8004129 - DNA, 22 bp, Homo sapiens
ctaaggttggcagtggaattgg

SEQ ID NO: 8004130 - DNA, 22 bp, Homo sapiens
ctaaggtgtccctcttgctgga

SEQ ID NO: 8004131 - DNA, 22 bp, Homo sapiens
ctaagttaagttagagtgaatt

SEQ ID NO: 8004132 - DNA, 22 bp, Homo sapiens
ctaataacatgaactactttct

SEQ ID NO: 8004133 - DNA, 22 bp, Homo sapiens
ctaataacatgaactactttct

SEQ ID NO: 8004134 - DNA, 22 bp, Homo sapiens
ctaataacatgaactactttct

SEQ ID NO: 8004135 - DNA, 22 bp, Homo sapiens
ctaagtttatgtagttctttca

SEQ ID NO: 8004136 - DNA, 22 bp, Homo sapiens
ctaagtttatgtagttctttca

SEQ ID NO: 8004137 - DNA, 22 bp, Homo sapiens
ctaagggttgaaacagcaagaa

SEQ ID NO: 8004138 - DNA, 22 bp, Homo sapiens
ctaaggcaggtccattccagga

SEQ ID NO: 8004139 - DNA, 22 bp, Homo sapiens
ctaaggcaggtccattccagga

SEQ ID NO: 8004140 - DNA, 22 bp, Homo sapiens
ttccttcctctttcacaacagc

SEQ ID NO: 8004141 - DNA, 22 bp, Homo sapiens
ttccttcctctttcacaacagc

SEQ ID NO: 8004142 - DNA, 22 bp, Homo sapiens
ttccttcctcctccagttctgg

SEQ ID NO: 8004143 - DNA, 22 bp, Homo sapiens
ttccttcctcctccagttctgg

SEQ ID NO: 8004144 - DNA, 22 bp, Homo sapiens
ttccttcctcctccagttctgg

SEQ ID NO: 8004145 - DNA, 22 bp, Homo sapiens
ttccttcctcctccagttctgg

SEQ ID NO: 8004146 - DNA, 22 bp, Homo sapiens
ttccttcctggggatttatcat

SEQ ID NO: 8004147 - DNA, 22 bp, Homo sapiens
ttccttctaatattctgcctgt

SEQ ID NO: 8004148 - DNA, 22 bp, Homo sapiens
ttccttcctgtcttccttactg

SEQ ID NO: 8004149 - DNA, 22 bp, Homo sapiens
ttccttcctgtcttccttactg

SEQ ID NO: 8004150 - DNA, 22 bp, Homo sapiens
ttccttccgggcaccaggcact

SEQ ID NO: 8004151 - DNA, 22 bp, Homo sapiens
ttccttccgggcaccaggcact

SEQ ID NO: 8004152 - DNA, 22 bp, Homo sapiens
ttccttccgggcaccaggcact

SEQ ID NO: 8004153 - DNA, 22 bp, Homo sapiens
ttccttccctcagtggctgaag

SEQ ID NO: 8004154 - DNA, 22 bp, Homo sapiens
ttccttccgggcaccaggcact

SEQ ID NO: 8004155 - DNA, 22 bp, Homo sapiens
ttccttcccctagctgagaaac

SEQ ID NO: 8004156 - DNA, 22 bp, Homo sapiens
ttccttcccctagctgagaaac

SEQ ID NO: 8004157 - DNA, 22 bp, Homo sapiens
ttccttcccctagctgagaaac

SEQ ID NO: 8004158 - DNA, 22 bp, Homo sapiens
ttccttccacttcaggattttg

SEQ ID NO: 8004159 - DNA, 22 bp, Homo sapiens
ttccttccacttcaggattttg

SEQ ID NO: 8004160 - DNA, 22 bp, Homo sapiens
ttccttccagcttgtgacagtc

SEQ ID NO: 8004161 - DNA, 22 bp, Homo sapiens
ttccttccagcttgtgacagtc

SEQ ID NO: 8004162 - DNA, 22 bp, Homo sapiens
ttccttccagcttgtgacagtc

SEQ ID NO: 8004163 - DNA, 22 bp, Homo sapiens
ttccttccagcttgtgacagtc

SEQ ID NO: 8004164 - DNA, 22 bp, Homo sapiens
ttccttccatagcaaaacatgc

SEQ ID NO: 8004165 - DNA, 22 bp, Homo sapiens
ttccttccatagcaaaacatgc

SEQ ID NO: 8004166 - DNA, 22 bp, Homo sapiens
ttccttccatagcaaaacatgc

SEQ ID NO: 8004167 - DNA, 22 bp, Homo sapiens
ttccttccagcttgtgacagtc

SEQ ID NO: 8004168 - DNA, 22 bp, Homo sapiens
ttccttccagcttgtgacagtc

SEQ ID NO: 8004169 - DNA, 22 bp, Homo sapiens
ctacaaaagtaattgtggtttt

SEQ ID NO: 8004170 - DNA, 22 bp, Homo sapiens
ctacaaaagtaattgtggtttt

SEQ ID NO: 8004171 - DNA, 22 bp, Homo sapiens
ctacaaaagtaattgtggtttt

SEQ ID NO: 8004172 - DNA, 22 bp, Homo sapiens
ctacaaagtaccacagactggg

SEQ ID NO: 8004173 - DNA, 22 bp, Homo sapiens
ctacaaagctcttctacaggca

SEQ ID NO: 8004174 - DNA, 22 bp, Homo sapiens
ctacaaatataaaacacagata

SEQ ID NO: 8004175 - DNA, 22 bp, Homo sapiens
ctacaaatataaaacacagata

SEQ ID NO: 8004176 - DNA, 22 bp, Homo sapiens
ctacaaatataaaacacagata

SEQ ID NO: 8004177 - DNA, 22 bp, Homo sapiens
ctacaaatataaaacacagata

SEQ ID NO: 8004178 - DNA, 22 bp, Homo sapiens
ctacaaatataaaacacagata

SEQ ID NO: 8004179 - DNA, 22 bp, Homo sapiens
ctacaaatataaaacacagata

SEQ ID NO: 8004180 - DNA, 22 bp, Homo sapiens
ctacaaatatgttaaggtgttt

SEQ ID NO: 8004181 - DNA, 22 bp, Homo sapiens
ctacaaatataaaacacagata

SEQ ID NO: 8004182 - DNA, 22 bp, Homo sapiens
ctacaaatataaaacacagata

SEQ ID NO: 8004183 - DNA, 21 bp, Homo sapiens
ttcctggggaaggagctgcct

SEQ ID NO: 8004184 - DNA, 22 bp, Homo sapiens
ctacaaatccacaaggcacttt

SEQ ID NO: 8004185 - DNA, 22 bp, Homo sapiens
ctacaaatatgttaaggtgttt

SEQ ID NO: 8004186 - DNA, 22 bp, Homo sapiens
ctacaaatccacaaggcacttt

SEQ ID NO: 8004187 - DNA, 22 bp, Homo sapiens
ctacaaatccacaaggcacttt

SEQ ID NO: 8004188 - DNA, 22 bp, Homo sapiens
ctacaaatccacaaggcacttt

SEQ ID NO: 8004189 - DNA, 22 bp, Homo sapiens
ttccttcagcaagtcctgagca

SEQ ID NO: 8004190 - DNA, 22 bp, Homo sapiens
ttccttccacttcaggattttg

SEQ ID NO: 8004191 - DNA, 22 bp, Homo sapiens
ctgccatctgagggtccagcct

SEQ ID NO: 8004192 - DNA, 22 bp, Homo sapiens
ctgccatctgagggtccagcct

SEQ ID NO: 8004193 - DNA, 22 bp, Homo sapiens
ctgccatctgagggtccagcct

SEQ ID NO: 8004194 - DNA, 22 bp, Homo sapiens
ctgccatctgagggtccagcct

SEQ ID NO: 8004195 - DNA, 22 bp, Homo sapiens
ctgccatctgagccaaaagtgc

SEQ ID NO: 8004196 - DNA, 22 bp, Homo sapiens
ctgccatctgagccaaaagtgc

SEQ ID NO: 8004197 - DNA, 22 bp, Homo sapiens
ctgccatcgggggccccactgc

SEQ ID NO: 8004198 - DNA, 22 bp, Homo sapiens
ctgccatcctcaccagagcagc

SEQ ID NO: 8004199 - DNA, 22 bp, Homo sapiens
ctgccatcctcaccagagcagc

SEQ ID NO: 8004200 - DNA, 22 bp, Homo sapiens
ctgccatcctcaccagagcagc

SEQ ID NO: 8004201 - DNA, 22 bp, Homo sapiens
ctgccatccacggcccactcat

SEQ ID NO: 8004202 - DNA, 17 bp, Homo sapiens
ctgccagtggggaggca

SEQ ID NO: 8004203 - DNA, 22 bp, Homo sapiens
ctgccagtctatgctgctcggc

SEQ ID NO: 8004204 - DNA, 22 bp, Homo sapiens
ctgccaggttggcgctcgctct

SEQ ID NO: 8004205 - DNA, 22 bp, Homo sapiens
ctgccaggttggcgctcgctct

SEQ ID NO: 8004206 - DNA, 22 bp, Homo sapiens
ctgccaggttggcgctcgctct

SEQ ID NO: 8004207 - DNA, 22 bp, Homo sapiens
ctgccaggtgccagggcgcggc

SEQ ID NO: 8004208 - DNA, 22 bp, Homo sapiens
ctgccaggtgccagggcgcggc

SEQ ID NO: 8004209 - DNA, 22 bp, Homo sapiens
ctgccaggtgagctccaggcct

SEQ ID NO: 8004210 - DNA, 22 bp, Homo sapiens
ctgccaggtaaactgcaggaat

SEQ ID NO: 8004211 - DNA, 22 bp, Homo sapiens
ctgccaggtaaactgcaggaat

SEQ ID NO: 8004212 - DNA, 22 bp, Homo sapiens
ctgccaggtaaactgcaggaat

SEQ ID NO: 8004213 - DNA, 22 bp, Homo sapiens
ctgccaggtgagctccaggcct

SEQ ID NO: 8004214 - DNA, 22 bp, Homo sapiens
ctgccatgctcaagaagtcttt

SEQ ID NO: 8004215 - DNA, 22 bp, Homo sapiens
ctgccatgctcaagaagtcttt

SEQ ID NO: 8004216 - DNA, 22 bp, Homo sapiens
ctgccatgcagttagtccctca

SEQ ID NO: 8004217 - DNA, 22 bp, Homo sapiens
ctgccctggggggcctccttgc

SEQ ID NO: 8004218 - DNA, 18 bp, Homo sapiens
ctgccatgtcctactgtc

SEQ ID NO: 8004219 - DNA, 22 bp, Homo sapiens
ctgccctggggggcctccttgc

SEQ ID NO: 8004220 - DNA, 22 bp, Homo sapiens
ctgccctgggtgctggggatcc

SEQ ID NO: 8004221 - DNA, 22 bp, Homo sapiens
ctgccctgggtgctggggatcc

SEQ ID NO: 8004222 - DNA, 22 bp, Homo sapiens
ctgccctgggttttatgggagt

SEQ ID NO: 8004223 - DNA, 22 bp, Homo sapiens
ctgccctggggggcctccttgc

SEQ ID NO: 8004224 - DNA, 22 bp, Homo sapiens
ctgcctagaaaaccaggctcct

SEQ ID NO: 8004225 - DNA, 22 bp, Homo sapiens
ctgccgttgtgaagctcttaga

SEQ ID NO: 8004226 - DNA, 22 bp, Homo sapiens
ctgccgtgtttttcatgttaaa

SEQ ID NO: 8004227 - DNA, 22 bp, Homo sapiens
ctgccgttgtgaagctcttaga

SEQ ID NO: 8004228 - DNA, 22 bp, Homo sapiens
ctgccgttgtgaagctcttaga

SEQ ID NO: 8004229 - DNA, 22 bp, Homo sapiens
ctgccgtccatctacgtctcag

SEQ ID NO: 8004230 - DNA, 22 bp, Homo sapiens
ctgccgtgtttttcatgttaaa

SEQ ID NO: 8004231 - DNA, 22 bp, Homo sapiens
ctgccgtgtttttcatgttaaa

SEQ ID NO: 8004232 - DNA, 22 bp, Homo sapiens
ctgccgggccctggatttggca

SEQ ID NO: 8004233 - DNA, 22 bp, Homo sapiens
ctgccgagtgggtcatgaggca

SEQ ID NO: 8004234 - DNA, 22 bp, Homo sapiens
ctgccctgggttttatgggagt

SEQ ID NO: 8004235 - DNA, 22 bp, Homo sapiens
ctgcctcatgctgcctgcagcc

SEQ ID NO: 8004236 - DNA, 22 bp, Homo sapiens
ctgcctcatgctgcctgcagcc

SEQ ID NO: 8004237 - DNA, 22 bp, Homo sapiens
ctgcctcatgctgcctgcagcc

SEQ ID NO: 8004238 - DNA, 22 bp, Homo sapiens
ctgcctcatgctgcctgcagcc

SEQ ID NO: 8004239 - DNA, 22 bp, Homo sapiens
ctgcctcagcgttgtggcccta

SEQ ID NO: 8004240 - DNA, 22 bp, Homo sapiens
ctgcctcatgctgcctgcagcc

SEQ ID NO: 8004241 - DNA, 22 bp, Homo sapiens
ctgcctccaggctcaccttgac

SEQ ID NO: 8004242 - DNA, 22 bp, Homo sapiens
ctgcctccaggctcaccttgac

SEQ ID NO: 8004243 - DNA, 22 bp, Homo sapiens
ctgcctccaggctcaccttgac

SEQ ID NO: 8004244 - DNA, 22 bp, Homo sapiens
ctgcctccaggctcaccttgac

SEQ ID NO: 8004245 - DNA, 22 bp, Homo sapiens
ctgcctcatgctgcctgcagcc

SEQ ID NO: 8004246 - DNA, 22 bp, Homo sapiens
ctgcctcatgctgcctgcagcc

SEQ ID NO: 8004247 - DNA, 22 bp, Homo sapiens
ctgcctcatgctgcctgcagcc

SEQ ID NO: 8004248 - DNA, 22 bp, Homo sapiens
ctgcctcatgctgcctgcagcc

SEQ ID NO: 8004249 - DNA, 22 bp, Homo sapiens
ctgcctcagcgttgtggcccta

SEQ ID NO: 8004250 - DNA, 22 bp, Homo sapiens
ctgcctcagccttctgggtgac

SEQ ID NO: 8004251 - DNA, 22 bp, Homo sapiens
ctgcctcagccttctgggtgac

SEQ ID NO: 8004252 - DNA, 22 bp, Homo sapiens
ctgcctcagccttctgggtgac

SEQ ID NO: 8004253 - DNA, 22 bp, Homo sapiens
ctgcctcagcgttgtggcccta

SEQ ID NO: 8004254 - DNA, 22 bp, Homo sapiens
ctgcctcagcgttgtggcccta

SEQ ID NO: 8004255 - DNA, 22 bp, Homo sapiens
ctgcctcagcgttgtggcccta

SEQ ID NO: 8004256 - DNA, 22 bp, Homo sapiens
ctgcctcagccttctgggtgac

SEQ ID NO: 8004257 - DNA, 22 bp, Homo sapiens
ctgcctcagccttctgggtgac

SEQ ID NO: 8004258 - DNA, 22 bp, Homo sapiens
ctgcctcacattggctgtgtga

SEQ ID NO: 8004259 - DNA, 22 bp, Homo sapiens
ctgcctcagccttctgggtgac

SEQ ID NO: 8004260 - DNA, 22 bp, Homo sapiens
ctgcctcacattggctgtgtga

SEQ ID NO: 8004261 - DNA, 22 bp, Homo sapiens
ctgcctcagccttctgggtgac

SEQ ID NO: 8004262 - DNA, 22 bp, Homo sapiens
ctgcctagatttgaatcctggc

SEQ ID NO: 8004263 - DNA, 22 bp, Homo sapiens
ctgccgttgaggagctgtcgat

SEQ ID NO: 8004264 - DNA, 22 bp, Homo sapiens
ctgcctcacattggctgtgtga

SEQ ID NO: 8004265 - DNA, 22 bp, Homo sapiens
ctgcctcacattggctgtgtga

SEQ ID NO: 8004266 - DNA, 22 bp, Homo sapiens
ctgcctatcaaatggggagggc

SEQ ID NO: 8004267 - DNA, 22 bp, Homo sapiens
ctgcctatctacaaagtgggat

SEQ ID NO: 8004268 - DNA, 22 bp, Homo sapiens
ctgcctattccctgggccgaga

SEQ ID NO: 8004269 - DNA, 22 bp, Homo sapiens
ctgcctcctgccgtgcagcttc

SEQ ID NO: 8004270 - DNA, 22 bp, Homo sapiens
ctgcctcctgccgtgcagcttc

SEQ ID NO: 8004271 - DNA, 22 bp, Homo sapiens
ctgcctcctgccgtgcagcttc

SEQ ID NO: 8004272 - DNA, 22 bp, Homo sapiens
ctgcctcctggctgatgggtag

SEQ ID NO: 8004273 - DNA, 22 bp, Homo sapiens
ctgcctcctgccgtgcagcttc

SEQ ID NO: 8004274 - DNA, 22 bp, Homo sapiens
ctgcctcctgccgtgcagcttc

SEQ ID NO: 8004275 - DNA, 22 bp, Homo sapiens
ctgcctcctgccgtgcagcttc

SEQ ID NO: 8004276 - DNA, 22 bp, Homo sapiens
ctgcctctataggagtccacca

SEQ ID NO: 8004277 - DNA, 22 bp, Homo sapiens
ctgcctgcgttgcctcgtgcct

SEQ ID NO: 8004278 - DNA, 22 bp, Homo sapiens
ctgcctcctggctgatgggtag

SEQ ID NO: 8004279 - DNA, 22 bp, Homo sapiens
ctgcctcctggctgatgggtag

SEQ ID NO: 8004280 - DNA, 22 bp, Homo sapiens
ctgcctcctggctgatgggtag

SEQ ID NO: 8004281 - DNA, 22 bp, Homo sapiens
ctgcctcctggctgatgggtag

SEQ ID NO: 8004282 - DNA, 22 bp, Homo sapiens
ctgcctcctggctgatgggtag

SEQ ID NO: 8004283 - DNA, 22 bp, Homo sapiens
ctgcctctataggagtccacca

SEQ ID NO: 8004284 - DNA, 22 bp, Homo sapiens
ctgcctcctcacgtccacagtg

SEQ ID NO: 8004285 - DNA, 22 bp, Homo sapiens
ctgcctcctcacgtccacagtg

SEQ ID NO: 8004286 - DNA, 22 bp, Homo sapiens
ctgcctcctcacgtccacagtg

SEQ ID NO: 8004287 - DNA, 22 bp, Homo sapiens
ctgcctcctcacgtccacagtg

SEQ ID NO: 8004288 - DNA, 22 bp, Homo sapiens
ctgcctcctgccgtgcagcttc

SEQ ID NO: 8004289 - DNA, 22 bp, Homo sapiens
ctgcctcctgccgtgcagcttc

SEQ ID NO: 8004290 - DNA, 22 bp, Homo sapiens
ctgcctccaggctcaccttgac

SEQ ID NO: 8004291 - DNA, 22 bp, Homo sapiens
ctgcctccaggctcaccttgac

SEQ ID NO: 8004292 - DNA, 22 bp, Homo sapiens
ctgcctcctcacgtccacagtg

SEQ ID NO: 8004293 - DNA, 22 bp, Homo sapiens
ctgcctcctcacgtccacagtg

SEQ ID NO: 8004294 - DNA, 22 bp, Homo sapiens
ctgcctcctcacgtccacagtg

SEQ ID NO: 8004295 - DNA, 22 bp, Homo sapiens
ctgcctcctcacgtccacagtg

SEQ ID NO: 8004296 - DNA, 22 bp, Homo sapiens
ctgcctcctcacgtccacagtg

SEQ ID NO: 8004297 - DNA, 22 bp, Homo sapiens
ctgcctcctcacgtccacagtg

SEQ ID NO: 8004298 - DNA, 22 bp, Homo sapiens
ctgcctcctcacgtccacagtg

SEQ ID NO: 8004299 - DNA, 22 bp, Homo sapiens
ctgccaggcctccgctgtcccc

SEQ ID NO: 8004300 - DNA, 22 bp, Homo sapiens
ctgccaggcctccgctgtcccc

SEQ ID NO: 8004301 - DNA, 22 bp, Homo sapiens
ctgccaggcctccgctgtcccc

SEQ ID NO: 8004302 - DNA, 22 bp, Homo sapiens
ctgccaggcctccgctgtcccc

SEQ ID NO: 8004303 - DNA, 22 bp, Homo sapiens
ctgccaggcctccgctgtcccc

SEQ ID NO: 8004304 - DNA, 22 bp, Homo sapiens
ctgccagctggagaccaaggaa

SEQ ID NO: 8004305 - DNA, 22 bp, Homo sapiens
ctgccagctctctggaggctct

SEQ ID NO: 8004306 - DNA, 22 bp, Homo sapiens
ctgccaggactgacgtcttcag

SEQ ID NO: 8004307 - DNA, 22 bp, Homo sapiens
ctgccagctggagaccaaggaa

SEQ ID NO: 8004308 - DNA, 22 bp, Homo sapiens
ctgccagctggagaccaaggaa

SEQ ID NO: 8004309 - DNA, 22 bp, Homo sapiens
ctgccaggcctggggtgctgtc

SEQ ID NO: 8004310 - DNA, 22 bp, Homo sapiens
ctgccaggcctggggtgctgtc

SEQ ID NO: 8004311 - DNA, 22 bp, Homo sapiens
ctgccaggcctggggtgctgtc

SEQ ID NO: 8004312 - DNA, 22 bp, Homo sapiens
ctgccaggcctggggtgctgtc

SEQ ID NO: 8004313 - DNA, 22 bp, Homo sapiens
ctgccaggcctccgctgtcccc

SEQ ID NO: 8004314 - DNA, 22 bp, Homo sapiens
ctgccaggcctccgctgtcccc

SEQ ID NO: 8004315 - DNA, 22 bp, Homo sapiens
ctgccaggcctccgctgtcccc

SEQ ID NO: 8004316 - DNA, 22 bp, Homo sapiens
ctgcagccacgagtcacagccc

SEQ ID NO: 8004317 - DNA, 22 bp, Homo sapiens
ctgcagccacgagtcacagccc

SEQ ID NO: 8004318 - DNA, 23 bp, Homo sapiens
ctgcagccgcgtggggacgtgga

SEQ ID NO: 8004319 - DNA, 23 bp, Homo sapiens
ctgcagccgcgtggggacgtgga

SEQ ID NO: 8004320 - DNA, 22 bp, Homo sapiens
ctgccagctctctggaggctct

SEQ ID NO: 8004321 - DNA, 22 bp, Homo sapiens
ctgcagcatcctagggtctgtg

SEQ ID NO: 8004322 - DNA, 22 bp, Homo sapiens
ctgcagcatcctagggtctgtg

SEQ ID NO: 8004323 - DNA, 22 bp, Homo sapiens
ctgcagcagtgtgtctcatttt

SEQ ID NO: 8004324 - DNA, 22 bp, Homo sapiens
ctgcagcagtactcagcagcca

SEQ ID NO: 8004325 - DNA, 22 bp, Homo sapiens
ctgcagcagtactcagcagcca

SEQ ID NO: 8004326 - DNA, 22 bp, Homo sapiens
ctgcagcagtgtgtctcatttt

SEQ ID NO: 8004327 - DNA, 22 bp, Homo sapiens
ctgcagccacgagtcacagccc

SEQ ID NO: 8004328 - DNA, 22 bp, Homo sapiens
ctgcagcatcgccacctgcctc

SEQ ID NO: 8004329 - DNA, 22 bp, Homo sapiens
ctgcagcatcgccacctgcctc

SEQ ID NO: 8004330 - DNA, 22 bp, Homo sapiens
ctgcagcatcctagggtctgtg

SEQ ID NO: 8004331 - DNA, 22 bp, Homo sapiens
ctgccagggccctactcagttt

SEQ ID NO: 8004332 - DNA, 22 bp, Homo sapiens
ctgccagggccctactcagttt

SEQ ID NO: 8004333 - DNA, 22 bp, Homo sapiens
ctgccagggccctactcagttt

SEQ ID NO: 8004334 - DNA, 22 bp, Homo sapiens
ctgccagggccctactcagttt

SEQ ID NO: 8004335 - DNA, 22 bp, Homo sapiens
ctgccagggcatcctgtggtgg

SEQ ID NO: 8004336 - DNA, 22 bp, Homo sapiens
ctgccagggcatcctgtggtgg

SEQ ID NO: 8004337 - DNA, 22 bp, Homo sapiens
ctgccagggcatcctgtggtgg

SEQ ID NO: 8004338 - DNA, 22 bp, Homo sapiens
ctgccagggcatcctgtggtgg

SEQ ID NO: 8004339 - DNA, 22 bp, Homo sapiens
ctgccagggcatcctgtggtgg

SEQ ID NO: 8004340 - DNA, 22 bp, Homo sapiens
ctgccaggggcctcacaggcca

SEQ ID NO: 8004341 - DNA, 22 bp, Homo sapiens
ctgccaggggcctcacaggcca

SEQ ID NO: 8004342 - DNA, 22 bp, Homo sapiens
ctgccaggggcctcacaggcca

SEQ ID NO: 8004343 - DNA, 22 bp, Homo sapiens
ctgccaggggcctcacaggcca

SEQ ID NO: 8004344 - DNA, 22 bp, Homo sapiens
ctgccaggggcctcacaggcca

SEQ ID NO: 8004345 - DNA, 22 bp, Homo sapiens
ctgccaggtaaactgcaggaat

SEQ ID NO: 8004346 - DNA, 22 bp, Homo sapiens
ctgccaggggcctcacaggcca

SEQ ID NO: 8004347 - DNA, 22 bp, Homo sapiens
ctgccaggggcctcacaggcca

SEQ ID NO: 8004348 - DNA, 22 bp, Homo sapiens
ctgccaggcgatggattggctg

SEQ ID NO: 8004349 - DNA, 22 bp, Homo sapiens
ctgccaggcgatggattggctg

SEQ ID NO: 8004350 - DNA, 22 bp, Homo sapiens
ctgccaggcgatggattggctg

SEQ ID NO: 8004351 - DNA, 22 bp, Homo sapiens
ctgccaggctgtcccaggtccg

SEQ ID NO: 8004352 - DNA, 22 bp, Homo sapiens
ctgccaggcgatggattggctg

SEQ ID NO: 8004353 - DNA, 22 bp, Homo sapiens
ctgccaggcctggggtgctgtc

SEQ ID NO: 8004354 - DNA, 22 bp, Homo sapiens
ctgccaggcgatggattggctg

SEQ ID NO: 8004355 - DNA, 22 bp, Homo sapiens
ctgccagggaggctgggaagtt

SEQ ID NO: 8004356 - DNA, 22 bp, Homo sapiens
ctgccagggaggctgggaagtt

SEQ ID NO: 8004357 - DNA, 22 bp, Homo sapiens
ctgccagggaggctgggaagtt

SEQ ID NO: 8004358 - DNA, 22 bp, Homo sapiens
ctgccagggaggctgggaagtt

SEQ ID NO: 8004359 - DNA, 22 bp, Homo sapiens
ctgccaggctgtcccaggtccg

SEQ ID NO: 8004360 - DNA, 22 bp, Homo sapiens
ctgccaggctgtcccaggtccg

SEQ ID NO: 8004361 - DNA, 22 bp, Homo sapiens
ctgccagggaggctgggaagtt

SEQ ID NO: 8004362 - DNA, 22 bp, Homo sapiens
ctgcagcaagagaagtgctgac

SEQ ID NO: 8004363 - DNA, 22 bp, Homo sapiens
ctgcagcaagagaagtgctgac

SEQ ID NO: 8004364 - DNA, 22 bp, Homo sapiens
ctgcagcagaataatctgctca

SEQ ID NO: 8004365 - DNA, 22 bp, Homo sapiens
ctgcagcagcctccagccttgg

SEQ ID NO: 8004366 - DNA, 22 bp, Homo sapiens
ctgcagcagcctccagccttgg

SEQ ID NO: 8004367 - DNA, 22 bp, Homo sapiens
ctgcagcagaataatctgctca

SEQ ID NO: 8004368 - DNA, 22 bp, Homo sapiens
ctgcagcaaatgttaagtgact

SEQ ID NO: 8004369 - DNA, 22 bp, Homo sapiens
ctgcagcaagagaagtgctgac

SEQ ID NO: 8004370 - DNA, 21 bp, Homo sapiens
ctgcagcaaaactttgctcct

SEQ ID NO: 8004371 - DNA, 21 bp, Homo sapiens
ctgcagcaaaactttgctcct

SEQ ID NO: 8004372 - DNA, 22 bp, Homo sapiens
ctgcagatttggtgtctggtga

SEQ ID NO: 8004373 - DNA, 22 bp, Homo sapiens
ctgcagcagcctccagccttgg

SEQ ID NO: 8004374 - DNA, 22 bp, Homo sapiens
ctgcagcaggaggctcctgcag

SEQ ID NO: 8004375 - DNA, 22 bp, Homo sapiens
ctgcagcaggaggctcctgcag

SEQ ID NO: 8004376 - DNA, 22 bp, Homo sapiens
ctgcagcaggaggctcctgcag

SEQ ID NO: 8004377 - DNA, 22 bp, Homo sapiens
ctgcagcaggaggctcctgcag

SEQ ID NO: 8004378 - DNA, 22 bp, Homo sapiens
ctgcagcagtactcagcagcca

SEQ ID NO: 8004379 - DNA, 22 bp, Homo sapiens
ctgcagcaggaggctcctgcag

SEQ ID NO: 8004380 - DNA, 22 bp, Homo sapiens
ctgcagcagtactcagcagcca

SEQ ID NO: 8004381 - DNA, 22 bp, Homo sapiens
ctgcagcagtactcagcagcca

SEQ ID NO: 8004382 - DNA, 22 bp, Homo sapiens
ctgcagagtggagcctcggctg

SEQ ID NO: 8004383 - DNA, 22 bp, Homo sapiens
ctgcagagtggagcctcggctg

SEQ ID NO: 8004384 - DNA, 22 bp, Homo sapiens
ctgcagagtggagcctcggctg

SEQ ID NO: 8004385 - DNA, 22 bp, Homo sapiens
ctgcagagtggagcctcggctg

SEQ ID NO: 8004386 - DNA, 22 bp, Homo sapiens
ctgcagagtatagcgagttggg

SEQ ID NO: 8004387 - DNA, 22 bp, Homo sapiens
ctgcagagtatagcgagttggg

SEQ ID NO: 8004388 - DNA, 22 bp, Homo sapiens
ctgcagaggttggttctaagat

SEQ ID NO: 8004389 - DNA, 22 bp, Homo sapiens
ctgcagagtatagcgagttggg

SEQ ID NO: 8004390 - DNA, 22 bp, Homo sapiens
ctgcagaggtcttgctgatggt

SEQ ID NO: 8004391 - DNA, 22 bp, Homo sapiens
ctgcagaggttggttctaagat

SEQ ID NO: 8004392 - DNA, 22 bp, Homo sapiens
ctgcagatgtctcaattttatt

SEQ ID NO: 8004393 - DNA, 22 bp, Homo sapiens
ctgcagattcagtgagaagccc

SEQ ID NO: 8004394 - DNA, 22 bp, Homo sapiens
ctgcagattggcctgatgttca

SEQ ID NO: 8004395 - DNA, 22 bp, Homo sapiens
ctgcagattggcctgatgttca

SEQ ID NO: 8004396 - DNA, 22 bp, Homo sapiens
ctgcagatggctcagtggggca

SEQ ID NO: 8004397 - DNA, 22 bp, Homo sapiens
ctgcagatggctcagtggggca

SEQ ID NO: 8004398 - DNA, 22 bp, Homo sapiens
ctgcagatggctcagtggggca

SEQ ID NO: 8004399 - DNA, 22 bp, Homo sapiens
ctgcagatggtattgttctggt

SEQ ID NO: 8004400 - DNA, 22 bp, Homo sapiens
ctgcagatgggcgatggggcct

SEQ ID NO: 8004401 - DNA, 22 bp, Homo sapiens
ctgcagatgggcgatggggcct

SEQ ID NO: 8004402 - DNA, 22 bp, Homo sapiens
ctgcagatcttgtgtacttgtc

SEQ ID NO: 8004403 - DNA, 22 bp, Homo sapiens
ctgcagagggtttgagcatcct

SEQ ID NO: 8004404 - DNA, 22 bp, Homo sapiens
ctgcagagggtttgagcatcct

SEQ ID NO: 8004405 - DNA, 22 bp, Homo sapiens
ctgcagagggtttgagcatcct

SEQ ID NO: 8004406 - DNA, 22 bp, Homo sapiens
ctgcagaggtcttgctgatggt

SEQ ID NO: 8004407 - DNA, 22 bp, Homo sapiens
ctgcagagggtttgagcatcct

SEQ ID NO: 8004408 - DNA, 22 bp, Homo sapiens
ctgcagagggtttgagcatcct

SEQ ID NO: 8004409 - DNA, 22 bp, Homo sapiens
ctgcagaggggttgaagggtcc

SEQ ID NO: 8004410 - DNA, 22 bp, Homo sapiens
ctgcagaggggttgaagggtcc

SEQ ID NO: 8004411 - DNA, 22 bp, Homo sapiens
ctgcagaggggttgaagggtcc

SEQ ID NO: 8004412 - DNA, 22 bp, Homo sapiens
ctgcagaggcctcgcctcctct

SEQ ID NO: 8004413 - DNA, 22 bp, Homo sapiens
ctgcagaggcctcgcctcctct

SEQ ID NO: 8004414 - DNA, 22 bp, Homo sapiens
ctgcagaggggttgaagggtcc

SEQ ID NO: 8004415 - DNA, 22 bp, Homo sapiens
ctgcagaggggttgaagggtcc

SEQ ID NO: 8004416 - DNA, 22 bp, Homo sapiens
ctgcagagcttgtctggatgtg

SEQ ID NO: 8004417 - DNA, 22 bp, Homo sapiens
ctgcagagcttgtctggatgtg

SEQ ID NO: 8004418 - DNA, 22 bp, Homo sapiens
ctgcagagcttgtctggatgtg

SEQ ID NO: 8004419 - DNA, 22 bp, Homo sapiens
ctgcagagcttgtctggatgtg

SEQ ID NO: 8004420 - DNA, 22 bp, Homo sapiens
ctgcagagcttgtctggatgtg

SEQ ID NO: 8004421 - DNA, 22 bp, Homo sapiens
ctgcagagctttctgaatgaag

SEQ ID NO: 8004422 - DNA, 22 bp, Homo sapiens
ctgcagagctttctgaatgaag

SEQ ID NO: 8004423 - DNA, 22 bp, Homo sapiens
ctgcagagctttctgaatgaag

SEQ ID NO: 8004424 - DNA, 22 bp, Homo sapiens
ctgcagagctaggctgagtgaa

SEQ ID NO: 8004425 - DNA, 22 bp, Homo sapiens
ctgcagagctaggctgagtgaa

SEQ ID NO: 8004426 - DNA, 22 bp, Homo sapiens
ctgcagagctaggctgagtgaa

SEQ ID NO: 8004427 - DNA, 22 bp, Homo sapiens
ctgcagagctaggctgagtgaa

SEQ ID NO: 8004428 - DNA, 22 bp, Homo sapiens
ctgcagagcttgtctggatgtg

SEQ ID NO: 8004429 - DNA, 22 bp, Homo sapiens
ctgcagagcttgtctggatgtg

SEQ ID NO: 8004430 - DNA, 22 bp, Homo sapiens
ctgagtccttgggcttagagtg

SEQ ID NO: 8004431 - DNA, 22 bp, Homo sapiens
ctgagtccttgggcttagagtg

SEQ ID NO: 8004432 - DNA, 22 bp, Homo sapiens
ctgatcctcctttaagtagctg

SEQ ID NO: 8004433 - DNA, 22 bp, Homo sapiens
ctgatcctcctttaagtagctg

SEQ ID NO: 8004434 - DNA, 22 bp, Homo sapiens
ctgatcctcctttaagtagctg

SEQ ID NO: 8004435 - DNA, 22 bp, Homo sapiens
ctgatcctcctttaagtagctg

SEQ ID NO: 8004436 - DNA, 22 bp, Homo sapiens
ctgatcttaagtaacattattt

SEQ ID NO: 8004437 - DNA, 22 bp, Homo sapiens
ctgatgaccttggcaagtcaca

SEQ ID NO: 8004438 - DNA, 22 bp, Homo sapiens
ctgatctcaagtgatccaccca

SEQ ID NO: 8004439 - DNA, 22 bp, Homo sapiens
ctgatcttaagtaacattattt

SEQ ID NO: 8004440 - DNA, 22 bp, Homo sapiens
ctgagtccagggacagaggcgt

SEQ ID NO: 8004441 - DNA, 22 bp, Homo sapiens
ctgagtccagggacagaggcgt

SEQ ID NO: 8004442 - DNA, 22 bp, Homo sapiens
ctgagtactatagaggaaaatg

SEQ ID NO: 8004443 - DNA, 22 bp, Homo sapiens
ctgagtccagggacagaggcgt

SEQ ID NO: 8004444 - DNA, 22 bp, Homo sapiens
ctgagtccagggacagaggcgt

SEQ ID NO: 8004445 - DNA, 22 bp, Homo sapiens
ctgagtccagggacagaggcgt

SEQ ID NO: 8004446 - DNA, 19 bp, Homo sapiens
ctgagtcaaaggttgtggg

SEQ ID NO: 8004447 - DNA, 22 bp, Homo sapiens
ctgagtcattgcagatgtggag

SEQ ID NO: 8004448 - DNA, 22 bp, Homo sapiens
ctgaggcagaaaaagcaagggt

SEQ ID NO: 8004449 - DNA, 22 bp, Homo sapiens
ctgaggcagagaatgagtttgt

SEQ ID NO: 8004450 - DNA, 22 bp, Homo sapiens
ctgaggcagaaaaagcaagggt

SEQ ID NO: 8004451 - DNA, 22 bp, Homo sapiens
ctgaggcagaaaaagcaagggt

SEQ ID NO: 8004452 - DNA, 22 bp, Homo sapiens
ctgaggcagagagaacccgggc

SEQ ID NO: 8004453 - DNA, 22 bp, Homo sapiens
ctgaggcagagaatgagtttgt

SEQ ID NO: 8004454 - DNA, 22 bp, Homo sapiens
ctgaggcagagaatgagtttgt

SEQ ID NO: 8004455 - DNA, 19 bp, Homo sapiens
ctgatgttccagagaagct

SEQ ID NO: 8004456 - DNA, 22 bp, Homo sapiens
ctgatgtcccaagcattcgcag

SEQ ID NO: 8004457 - DNA, 17 bp, Homo sapiens
ctgatggattttttcca

SEQ ID NO: 8004458 - DNA, 22 bp, Homo sapiens
ctgatggatggacaggggtagt

SEQ ID NO: 8004459 - DNA, 22 bp, Homo sapiens
ctgatggatgctacgtaagagg

SEQ ID NO: 8004460 - DNA, 22 bp, Homo sapiens
ctgattaactgaactgaattta

SEQ ID NO: 8004461 - DNA, 22 bp, Homo sapiens
ctgattaaaaacaggttctgag

SEQ ID NO: 8004462 - DNA, 19 bp, Homo sapiens
ctgatgttccagagaagct

SEQ ID NO: 8004463 - DNA, 22 bp, Homo sapiens
ctgattaggctaagcaagaggg

SEQ ID NO: 8004464 - DNA, 22 bp, Homo sapiens
ctgattattactttccaggcgg

SEQ ID NO: 8004465 - DNA, 22 bp, Homo sapiens
ctgattagagtgttaatgagga

SEQ ID NO: 8004466 - DNA, 22 bp, Homo sapiens
ctgattaattagctataaaact

SEQ ID NO: 8004467 - DNA, 22 bp, Homo sapiens
ctgatgcaggtggtttaaaaac

SEQ ID NO: 8004468 - DNA, 22 bp, Homo sapiens
ctgatgcccctggacctgtgac

SEQ ID NO: 8004469 - DNA, 22 bp, Homo sapiens
ctgatgcatggttacatataca

SEQ ID NO: 8004470 - DNA, 22 bp, Homo sapiens
ctgatgctataagccacagtgg

SEQ ID NO: 8004471 - DNA, 22 bp, Homo sapiens
ctgatgctataagccacagtgg

SEQ ID NO: 8004472 - DNA, 22 bp, Homo sapiens
ctgatgcccctggacctgtgac

SEQ ID NO: 8004473 - DNA, 22 bp, Homo sapiens
ctgatggagagtgtgatttggg

SEQ ID NO: 8004474 - DNA, 22 bp, Homo sapiens
ctgatggagtgatggagaaatt

SEQ ID NO: 8004475 - DNA, 22 bp, Homo sapiens
ctgatgcttgcaacaaagaacc

SEQ ID NO: 8004476 - DNA, 22 bp, Homo sapiens
ctgatgctctggatgtagtcaa

SEQ ID NO: 8004477 - DNA, 22 bp, Homo sapiens
ctgatggagactccactgtgat

SEQ ID NO: 8004478 - DNA, 22 bp, Homo sapiens
ctgatgcttgcaacaaagaacc

SEQ ID NO: 8004479 - DNA, 22 bp, Homo sapiens
ctgcagagcatgaggaggtctg

SEQ ID NO: 8004480 - DNA, 22 bp, Homo sapiens
ctgcagagcatgaggaggtctg

SEQ ID NO: 8004481 - DNA, 22 bp, Homo sapiens
ctgcagagcatgaggaggtctg

SEQ ID NO: 8004482 - DNA, 22 bp, Homo sapiens
ctgcagagcatgaggaggtctg

SEQ ID NO: 8004483 - DNA, 22 bp, Homo sapiens
ctgcagagcataaatctgaata

SEQ ID NO: 8004484 - DNA, 23 bp, Homo sapiens
ctgcagagaactgagggacagcc

SEQ ID NO: 8004485 - DNA, 23 bp, Homo sapiens
ctgcagagaactgagggacagcc

SEQ ID NO: 8004486 - DNA, 22 bp, Homo sapiens
ctgcagagcataaatctgaata

SEQ ID NO: 8004487 - DNA, 22 bp, Homo sapiens
ctgcagagctaggctgagtgaa

SEQ ID NO: 8004488 - DNA, 22 bp, Homo sapiens
ctgcagagctaggctgagtgaa

SEQ ID NO: 8004489 - DNA, 22 bp, Homo sapiens
ctgcagagctaggctgagtgaa

SEQ ID NO: 8004490 - DNA, 21 bp, Homo sapiens
ctgcagagcatgcaaaatgtt

SEQ ID NO: 8004491 - DNA, 22 bp, Homo sapiens
ctgcagagctaggctgagtgaa

SEQ ID NO: 8004492 - DNA, 22 bp, Homo sapiens
ctgcagagcatgaggaggtctg

SEQ ID NO: 8004493 - DNA, 22 bp, Homo sapiens
ctgcagagcatgaggaggtctg

SEQ ID NO: 8004494 - DNA, 22 bp, Homo sapiens
ctgcagagcatgaggaggtctg

SEQ ID NO: 8004495 - DNA, 22 bp, Homo sapiens
ctgcacttgacatgctctcaga

SEQ ID NO: 8004496 - DNA, 22 bp, Homo sapiens
ctgcagaaacctttcctgattt

SEQ ID NO: 8004497 - DNA, 22 bp, Homo sapiens
ctgcacttgacatgctctcaga

SEQ ID NO: 8004498 - DNA, 22 bp, Homo sapiens
ctgcaaaagtcattgtggtttt

SEQ ID NO: 8004499 - DNA, 22 bp, Homo sapiens
ctgcaaaagtcattgtggtttt

SEQ ID NO: 8004500 - DNA, 22 bp, Homo sapiens
ctgcaaaagtaattggggcttt

SEQ ID NO: 8004501 - DNA, 22 bp, Homo sapiens
ctgcaaaagtaattgcaggttt

SEQ ID NO: 8004502 - DNA, 22 bp, Homo sapiens
ctgcaaaagtaattgcaggttt

SEQ ID NO: 8004503 - DNA, 22 bp, Homo sapiens
ctgcagacctctgaggtccatg

SEQ ID NO: 8004504 - DNA, 22 bp, Homo sapiens
ctgcagacctctgaggtccatg

SEQ ID NO: 8004505 - DNA, 22 bp, Homo sapiens
ctgcagaatggggccaagtgga

SEQ ID NO: 8004506 - DNA, 22 bp, Homo sapiens
ctgcagaacaattcctgctgtt

SEQ ID NO: 8004507 - DNA, 22 bp, Homo sapiens
ctgcagaaagctgagatgatta

SEQ ID NO: 8004508 - DNA, 17 bp, Homo sapiens
ctgatttattagcagac

SEQ ID NO: 8004509 - DNA, 17 bp, Homo sapiens
ctgatttattagcagac

SEQ ID NO: 8004510 - DNA, 22 bp, Homo sapiens
ctgatttagatttcacacgtga

SEQ ID NO: 8004511 - DNA, 22 bp, Homo sapiens
ctgatttacatatacaaaagat

SEQ ID NO: 8004512 - DNA, 22 bp, Homo sapiens
ctgatttagatttcacacgtga

SEQ ID NO: 8004513 - DNA, 22 bp, Homo sapiens
ctgatttacatatacaaaagat

SEQ ID NO: 8004514 - DNA, 22 bp, Homo sapiens
ctgattgtgttcctgggagctg

SEQ ID NO: 8004515 - DNA, 22 bp, Homo sapiens
ctgattttcaaaatgtgttaaa

SEQ ID NO: 8004516 - DNA, 23 bp, Homo sapiens
ctgatttgagcagaataaaatag

SEQ ID NO: 8004517 - DNA, 23 bp, Homo sapiens
ctgatttgagcagaataaaatag

SEQ ID NO: 8004518 - DNA, 22 bp, Homo sapiens
ctgcaaaagtaattgcaggttt

SEQ ID NO: 8004519 - DNA, 22 bp, Homo sapiens
ctgcaaaagtaattgcaggttt

SEQ ID NO: 8004520 - DNA, 22 bp, Homo sapiens
ctgattttcaaaatgtgttaaa

SEQ ID NO: 8004521 - DNA, 22 bp, Homo sapiens
ctgattttcaaaatgtgttaaa

SEQ ID NO: 8004522 - DNA, 23 bp, Homo sapiens
ctgatttgagcagaataaaatag

SEQ ID NO: 8004523 - DNA, 21 bp, Homo sapiens
ctgattgtgaaagtcatcatt

SEQ ID NO: 8004524 - DNA, 22 bp, Homo sapiens
ctgattgtcttggcacttgaag

SEQ ID NO: 8004525 - DNA, 22 bp, Homo sapiens
ctgattgtcagctgagctgaag

SEQ ID NO: 8004526 - DNA, 22 bp, Homo sapiens
ctgattgtagctcacactattt

SEQ ID NO: 8004527 - DNA, 22 bp, Homo sapiens
ctgattgagaaggaaggggatc

SEQ ID NO: 8004528 - DNA, 22 bp, Homo sapiens
ctgattctgtctctcgggcctt

SEQ ID NO: 8004529 - DNA, 22 bp, Homo sapiens
ctgattattactttccaggcgg

SEQ ID NO: 8004530 - DNA, 22 bp, Homo sapiens
ctgattctcctcaagactttcg

SEQ ID NO: 8004531 - DNA, 22 bp, Homo sapiens
ctgagagagtaaagtagaatta

SEQ ID NO: 8004532 - DNA, 22 bp, Homo sapiens
ctgagagactgtttgtaatatt

SEQ ID NO: 8004533 - DNA, 22 bp, Homo sapiens
ctgagagaatcatgctgcaggt

SEQ ID NO: 8004534 - DNA, 22 bp, Homo sapiens
ctgagagaatcatgctgcaggt

SEQ ID NO: 8004535 - DNA, 22 bp, Homo sapiens
ctgagagaatcatgctgcaggt

SEQ ID NO: 8004536 - DNA, 22 bp, Homo sapiens
ctgaggagaaagatggtccaag

SEQ ID NO: 8004537 - DNA, 22 bp, Homo sapiens
ctgaggaccccacaggaggccc

SEQ ID NO: 8004538 - DNA, 22 bp, Homo sapiens
ctgaggaccccacaggaggccc

SEQ ID NO: 8004539 - DNA, 22 bp, Homo sapiens
ctgaggaccccacaggaggccc

SEQ ID NO: 8004540 - DNA, 22 bp, Homo sapiens
ctgagagatcaagccacaggat

SEQ ID NO: 8004541 - DNA, 22 bp, Homo sapiens
ctgaggagggaagtccccaaag

SEQ ID NO: 8004542 - DNA, 22 bp, Homo sapiens
ctgaggaggggcctgagtgaga

SEQ ID NO: 8004543 - DNA, 22 bp, Homo sapiens
ctgaggagaaatgggatggttc

SEQ ID NO: 8004544 - DNA, 22 bp, Homo sapiens
ctgaggagaaagatggtccaag

SEQ ID NO: 8004545 - DNA, 22 bp, Homo sapiens
ctgaggagaaatgggatggttc

SEQ ID NO: 8004546 - DNA, 22 bp, Homo sapiens
ctgaggagaacaatgagatcaa

SEQ ID NO: 8004547 - DNA, 22 bp, Homo sapiens
ctgagagaatcatgctgcaggt

SEQ ID NO: 8004548 - DNA, 22 bp, Homo sapiens
ctgagagaatcatgctgcaggt

SEQ ID NO: 8004549 - DNA, 22 bp, Homo sapiens
ctgagagaaacatgactcagga

SEQ ID NO: 8004550 - DNA, 22 bp, Homo sapiens
ctgagagaaacatgactcagga

SEQ ID NO: 8004551 - DNA, 22 bp, Homo sapiens
ctgagagaaacatgactcagga

SEQ ID NO: 8004552 - DNA, 22 bp, Homo sapiens
ctgagagaaacatgactcagga

SEQ ID NO: 8004553 - DNA, 22 bp, Homo sapiens
ctgagacattatgacaagtgga

SEQ ID NO: 8004554 - DNA, 22 bp, Homo sapiens
ctgagacattatgacaagtgga

SEQ ID NO: 8004555 - DNA, 22 bp, Homo sapiens
ctgagacattatgacaagtgga

SEQ ID NO: 8004556 - DNA, 22 bp, Homo sapiens
ctgagactttcatgtgctttta

SEQ ID NO: 8004557 - DNA, 22 bp, Homo sapiens
ctgagactttcatgtgctttta

SEQ ID NO: 8004558 - DNA, 22 bp, Homo sapiens
ctgagactgtaccacttcctcc

SEQ ID NO: 8004559 - DNA, 22 bp, Homo sapiens
ctgagacatggtttgactggca

SEQ ID NO: 8004560 - DNA, 22 bp, Homo sapiens
ctgagacaggagaatggcgtga

SEQ ID NO: 8004561 - DNA, 22 bp, Homo sapiens
ctgagacatggtttgactggca

SEQ ID NO: 8004562 - DNA, 22 bp, Homo sapiens
ctgagacatggtttgactggca

SEQ ID NO: 8004563 - DNA, 22 bp, Homo sapiens
ctgagacatggtttgactggca

SEQ ID NO: 8004564 - DNA, 22 bp, Homo sapiens
ctgagacacggagaggctgtgt

SEQ ID NO: 8004565 - DNA, 22 bp, Homo sapiens
ctgagacacggagaggctgtgt

SEQ ID NO: 8004566 - DNA, 22 bp, Homo sapiens
ctgagacacggagaggctgtgt

SEQ ID NO: 8004567 - DNA, 22 bp, Homo sapiens
ctgagaattactctgatgagta

SEQ ID NO: 8004568 - DNA, 22 bp, Homo sapiens
ctgagaatgttttctgattgat

SEQ ID NO: 8004569 - DNA, 22 bp, Homo sapiens
ctgagaatggacagcagggcag

SEQ ID NO: 8004570 - DNA, 22 bp, Homo sapiens
ctgagaattactctgatgagta

SEQ ID NO: 8004571 - DNA, 22 bp, Homo sapiens
ctgagaattactctgatgagta

SEQ ID NO: 8004572 - DNA, 22 bp, Homo sapiens
ctgaggatctaattattgggtc

SEQ ID NO: 8004573 - DNA, 22 bp, Homo sapiens
ctgaggatctactgtgggctca

SEQ ID NO: 8004574 - DNA, 22 bp, Homo sapiens
ctgaggatctactgtgggctca

SEQ ID NO: 8004575 - DNA, 17 bp, Homo sapiens
ctgaggattatggttgt

SEQ ID NO: 8004576 - DNA, 19 bp, Homo sapiens
ctgaggcaagtggtggtca

SEQ ID NO: 8004577 - DNA, 19 bp, Homo sapiens
ctgaggcaagtggtggtca

SEQ ID NO: 8004578 - DNA, 19 bp, Homo sapiens
ctgaggcaagtggtggtca

SEQ ID NO: 8004579 - DNA, 19 bp, Homo sapiens
ctgaggcaagtggtggtca

SEQ ID NO: 8004580 - DNA, 22 bp, Homo sapiens
ctgaggcacagtgaacttctcc

SEQ ID NO: 8004581 - DNA, 19 bp, Homo sapiens
ctgaggcaagtggtggtca

SEQ ID NO: 8004582 - DNA, 22 bp, Homo sapiens
ctgaggcacagtgaacttctcc

SEQ ID NO: 8004583 - DNA, 22 bp, Homo sapiens
ctgaggagtgggtgggcagtga

SEQ ID NO: 8004584 - DNA, 22 bp, Homo sapiens
ctgaggagtgggtgggcagtga

SEQ ID NO: 8004585 - DNA, 22 bp, Homo sapiens
ctgaggagtgggtgggcagtga

SEQ ID NO: 8004586 - DNA, 22 bp, Homo sapiens
ctgaggagttggtgaataagcc

SEQ ID NO: 8004587 - DNA, 22 bp, Homo sapiens
ctgaggaggggcctgagtgaga

SEQ ID NO: 8004588 - DNA, 22 bp, Homo sapiens
ctgaggaggggcctgagtgaga

SEQ ID NO: 8004589 - DNA, 22 bp, Homo sapiens
ctgaggcactgtcagctgaggc

SEQ ID NO: 8004590 - DNA, 22 bp, Homo sapiens
ctgaggcactgtcagctgaggc

SEQ ID NO: 8004591 - DNA, 22 bp, Homo sapiens
ctgaggcactgtcagctgaggc

SEQ ID NO: 8004592 - DNA, 22 bp, Homo sapiens
ctgaggcactgtcagctgaggc

SEQ ID NO: 8004593 - DNA, 22 bp, Homo sapiens
ctgaggcactgtcagctgaggc

SEQ ID NO: 8004594 - DNA, 22 bp, Homo sapiens
ctgaggcactggtaatgggcat

SEQ ID NO: 8004595 - DNA, 22 bp, Homo sapiens
ctgaggcactggtaatgggcat

SEQ ID NO: 8004596 - DNA, 22 bp, Homo sapiens
ctgaggcactggtaatgggcat

SEQ ID NO: 8004597 - DNA, 22 bp, Homo sapiens
ctgaggcactggtaatgggcat

SEQ ID NO: 8004598 - DNA, 22 bp, Homo sapiens
ctgaggcactgtcagctgaggc

SEQ ID NO: 8004599 - DNA, 22 bp, Homo sapiens
ctgaggcactgtcagctgaggc

SEQ ID NO: 8004600 - DNA, 22 bp, Homo sapiens
ctgaggcagaaaaagcaagggt

SEQ ID NO: 8004601 - DNA, 22 bp, Homo sapiens
ctgaggcagaaaaagcaagggt

SEQ ID NO: 8004602 - DNA, 22 bp, Homo sapiens
ctgaggcagaaaaagcaagggt

SEQ ID NO: 8004603 - DNA, 22 bp, Homo sapiens
ctgaggcagaaaaagcaagggt

SEQ ID NO: 8004604 - DNA, 22 bp, Homo sapiens
ctgaggcaccggcaatgttctg

SEQ ID NO: 8004605 - DNA, 22 bp, Homo sapiens
ctgaggcacctacagtctcggg

SEQ ID NO: 8004606 - DNA, 22 bp, Homo sapiens
ctgaggcacctacagtctcggg

SEQ ID NO: 8004607 - DNA, 22 bp, Homo sapiens
ctgaggcacccatcttctcctg

SEQ ID NO: 8004608 - DNA, 22 bp, Homo sapiens
ctgaggcacagtgaacttctcc

SEQ ID NO: 8004609 - DNA, 22 bp, Homo sapiens
ctgaggcaccggcaatgttctg

SEQ ID NO: 8004610 - DNA, 22 bp, Homo sapiens
ctgaggcacccatcttctcctg

SEQ ID NO: 8004611 - DNA, 22 bp, Homo sapiens
ctgaggcacccatcttctcctg

SEQ ID NO: 8004612 - DNA, 22 bp, Homo sapiens
ctgaggcacccatcttctcctg

SEQ ID NO: 8004613 - DNA, 22 bp, Homo sapiens
ctgaggcactaacaaggacaag

SEQ ID NO: 8004614 - DNA, 22 bp, Homo sapiens
ctgaggcactggtaatgggcat

SEQ ID NO: 8004615 - DNA, 22 bp, Homo sapiens
ctgaggcactaacaaggacaag

SEQ ID NO: 8004616 - DNA, 22 bp, Homo sapiens
ctgaggcactaacaaggacaag

SEQ ID NO: 8004617 - DNA, 22 bp, Homo sapiens
ctgaggcacctacagtctcggg

SEQ ID NO: 8004618 - DNA, 22 bp, Homo sapiens
ctgaggcactaacaaggacaag

SEQ ID NO: 8004619 - DNA, 22 bp, Homo sapiens
ctgaggcactaacaaggacaag

SEQ ID NO: 8004620 - DNA, 22 bp, Homo sapiens
ctgaggcacctacagtctcggg

SEQ ID NO: 8004621 - DNA, 19 bp, Homo sapiens
ctctggcttccaaagcatc

SEQ ID NO: 8004622 - DNA, 19 bp, Homo sapiens
ctctggcttccaaagcatc

SEQ ID NO: 8004623 - DNA, 19 bp, Homo sapiens
ctctggcttccaaagcatc

SEQ ID NO: 8004624 - DNA, 19 bp, Homo sapiens
ctctggcttccaaagcatc

SEQ ID NO: 8004625 - DNA, 19 bp, Homo sapiens
ctctggcttccaaagcatc

SEQ ID NO: 8004626 - DNA, 22 bp, Homo sapiens
ctctggcttctaccttgcagtt

SEQ ID NO: 8004627 - DNA, 22 bp, Homo sapiens
ctctggcttctaccttgcagtt

SEQ ID NO: 8004628 - DNA, 22 bp, Homo sapiens
ctctggcttctaccttgcagtt

SEQ ID NO: 8004629 - DNA, 22 bp, Homo sapiens
ctctggcttctaccttgcagtt

SEQ ID NO: 8004630 - DNA, 22 bp, Homo sapiens
ctctggcttagtatgctccaaa

SEQ ID NO: 8004631 - DNA, 22 bp, Homo sapiens
ctctggcttagtatgctccaaa

SEQ ID NO: 8004632 - DNA, 22 bp, Homo sapiens
ctctggctgtttgcagctcaag

SEQ ID NO: 8004633 - DNA, 22 bp, Homo sapiens
ctctggcttagtatgctccaaa

SEQ ID NO: 8004634 - DNA, 22 bp, Homo sapiens
ctctggcttagtatgctccaaa

SEQ ID NO: 8004635 - DNA, 22 bp, Homo sapiens
ctctggcttagtatgctccaaa

SEQ ID NO: 8004636 - DNA, 22 bp, Homo sapiens
ctctggcttagtatgctccaaa

SEQ ID NO: 8004637 - DNA, 22 bp, Homo sapiens
ctctggctggcattgctggact

SEQ ID NO: 8004638 - DNA, 22 bp, Homo sapiens
ctctggctggcacctgatctga

SEQ ID NO: 8004639 - DNA, 22 bp, Homo sapiens
ctctggctggctgggcctcagt

SEQ ID NO: 8004640 - DNA, 22 bp, Homo sapiens
ctctggctggctgggcctcagt

SEQ ID NO: 8004641 - DNA, 22 bp, Homo sapiens
ctctggctggcattgctggact

SEQ ID NO: 8004642 - DNA, 22 bp, Homo sapiens
ctctggctggcattgctggact

SEQ ID NO: 8004643 - DNA, 22 bp, Homo sapiens
ctctggctggcattgctggact

SEQ ID NO: 8004644 - DNA, 22 bp, Homo sapiens
ctctggctgtcccgatgagcag

SEQ ID NO: 8004645 - DNA, 22 bp, Homo sapiens
ctctggctgtcccgatgagcag

SEQ ID NO: 8004646 - DNA, 22 bp, Homo sapiens
ctctggctggctgggcctcagt

SEQ ID NO: 8004647 - DNA, 22 bp, Homo sapiens
ctctggctggctgggcctcagt

SEQ ID NO: 8004648 - DNA, 22 bp, Homo sapiens
ctctggctgtcccgatgagcag

SEQ ID NO: 8004649 - DNA, 22 bp, Homo sapiens
ctctggctgcctctcaggcctg

SEQ ID NO: 8004650 - DNA, 22 bp, Homo sapiens
ctctggctgcggggcgcgtgga

SEQ ID NO: 8004651 - DNA, 22 bp, Homo sapiens
ctctggctgcggggcgcgtgga

SEQ ID NO: 8004652 - DNA, 22 bp, Homo sapiens
ctctggctgcggggcgcgtgga

SEQ ID NO: 8004653 - DNA, 22 bp, Homo sapiens
ctctggctgcggggcgcgtgga

SEQ ID NO: 8004654 - DNA, 22 bp, Homo sapiens
ctctggctggcacctgatctga

SEQ ID NO: 8004655 - DNA, 22 bp, Homo sapiens
ctctggctggcacctgatctga

SEQ ID NO: 8004656 - DNA, 22 bp, Homo sapiens
ctctggctggcacctgatctga

SEQ ID NO: 8004657 - DNA, 22 bp, Homo sapiens
ctctggctgcctctcaggcctg

SEQ ID NO: 8004658 - DNA, 22 bp, Homo sapiens
ctctggctgcctctcaggcctg

SEQ ID NO: 8004659 - DNA, 22 bp, Homo sapiens
ctctggctcttgggaaacaggt

SEQ ID NO: 8004660 - DNA, 22 bp, Homo sapiens
ctctggctcttgggaaacaggt

SEQ ID NO: 8004661 - DNA, 22 bp, Homo sapiens
ctctggctgcctctcaggcctg

SEQ ID NO: 8004662 - DNA, 22 bp, Homo sapiens
ctctggctctgacagttgatcc

SEQ ID NO: 8004663 - DNA, 22 bp, Homo sapiens
ctctggctctgttgagatttgt

SEQ ID NO: 8004664 - DNA, 22 bp, Homo sapiens
tttgtgaataggttggcttcca

SEQ ID NO: 8004665 - DNA, 22 bp, Homo sapiens
tttgtgaataggttggcttcca

SEQ ID NO: 8004666 - DNA, 22 bp, Homo sapiens
tttgtgaataggttggcttcca

SEQ ID NO: 8004667 - DNA, 22 bp, Homo sapiens
tttgtgaataggttggcttcca

SEQ ID NO: 8004668 - DNA, 22 bp, Homo sapiens
tttgtgaataggttggcttcca

SEQ ID NO: 8004669 - DNA, 22 bp, Homo sapiens
tttgtgaatgccttataagcat

SEQ ID NO: 8004670 - DNA, 22 bp, Homo sapiens
tttgtgaatgccttataagcat

SEQ ID NO: 8004671 - DNA, 19 bp, Homo sapiens
ctctggctcctgggctgcc

SEQ ID NO: 8004672 - DNA, 19 bp, Homo sapiens
ctctggctcctgggctgcc

SEQ ID NO: 8004673 - DNA, 20 bp, Homo sapiens
ctctggctccgcgtgaccgc

SEQ ID NO: 8004674 - DNA, 22 bp, Homo sapiens
tttgtgaatggaatccacagac

SEQ ID NO: 8004675 - DNA, 22 bp, Homo sapiens
tttgtgaatggaatccacagac

SEQ ID NO: 8004676 - DNA, 22 bp, Homo sapiens
tttgtgaatggaatccacagac

SEQ ID NO: 8004677 - DNA, 22 bp, Homo sapiens
tttgtgaattcttggaagattg

SEQ ID NO: 8004678 - DNA, 22 bp, Homo sapiens
tttgtcttgtaagttaaattca

SEQ ID NO: 8004679 - DNA, 22 bp, Homo sapiens
tttgtcttgtgtccttaggacc

SEQ ID NO: 8004680 - DNA, 22 bp, Homo sapiens
tttgtcttgtaagttaaattca

SEQ ID NO: 8004681 - DNA, 22 bp, Homo sapiens
tttgtctttcccctcctcattg

SEQ ID NO: 8004682 - DNA, 22 bp, Homo sapiens
tttgtctttcccctcctcattg

SEQ ID NO: 8004683 - DNA, 22 bp, Homo sapiens
tttgtcttgtgtccttaggacc

SEQ ID NO: 8004684 - DNA, 22 bp, Homo sapiens
tttgtctttcccctcctcattg

SEQ ID NO: 8004685 - DNA, 22 bp, Homo sapiens
tttgtgaacaaacatgaagatg

SEQ ID NO: 8004686 - DNA, 22 bp, Homo sapiens
tttgtgaaatgaagtcacaact

SEQ ID NO: 8004687 - DNA, 23 bp, Homo sapiens
tttgtgaaagtgttgagaggaga

SEQ ID NO: 8004688 - DNA, 22 bp, Homo sapiens
tttgtcttgtgtccttaggacc

SEQ ID NO: 8004689 - DNA, 22 bp, Homo sapiens
tttgtctttcccctcctcattg

SEQ ID NO: 8004690 - DNA, 22 bp, Homo sapiens
tttgtctttcccctcctcattg

SEQ ID NO: 8004691 - DNA, 23 bp, Homo sapiens
tttgtgaaagtgttgagaggaga

SEQ ID NO: 8004692 - DNA, 22 bp, Homo sapiens
tttgtgaataagagaatgacag

SEQ ID NO: 8004693 - DNA, 22 bp, Homo sapiens
tttgtgaataggttggcttcca

SEQ ID NO: 8004694 - DNA, 22 bp, Homo sapiens
tttgtgaataggttggcttcca

SEQ ID NO: 8004695 - DNA, 22 bp, Homo sapiens
tttgtgaataggttggcttcca

SEQ ID NO: 8004696 - DNA, 22 bp, Homo sapiens
tttgtgaagggaacagaagtgt

SEQ ID NO: 8004697 - DNA, 22 bp, Homo sapiens
tttgtgaagggaacagaagtgt

SEQ ID NO: 8004698 - DNA, 22 bp, Homo sapiens
tttgtgaacaaacatgaagatg

SEQ ID NO: 8004699 - DNA, 23 bp, Homo sapiens
tttgtgaaagtgttgagaggaga

SEQ ID NO: 8004700 - DNA, 22 bp, Homo sapiens
tttgtgaacactgcgcagaact

SEQ ID NO: 8004701 - DNA, 22 bp, Homo sapiens
tttgtgaacactgcgcagaact

SEQ ID NO: 8004702 - DNA, 22 bp, Homo sapiens
tttgtgaacttaggcaattagg

SEQ ID NO: 8004703 - DNA, 22 bp, Homo sapiens
tttgtgaacttaggcaattagg

SEQ ID NO: 8004704 - DNA, 22 bp, Homo sapiens
tttgtgaacttaggcaattagg

SEQ ID NO: 8004705 - DNA, 19 bp, Homo sapiens
tttgtgaagaaaatgatgc

SEQ ID NO: 8004706 - DNA, 22 bp, Homo sapiens
tttgtacatcctaattctgagt

SEQ ID NO: 8004707 - DNA, 22 bp, Homo sapiens
tttgtacatcctaattctgagt

SEQ ID NO: 8004708 - DNA, 22 bp, Homo sapiens
tttgtacatcctaattctgagt

SEQ ID NO: 8004709 - DNA, 22 bp, Homo sapiens
tttgtacatcctaattctgagt

SEQ ID NO: 8004710 - DNA, 22 bp, Homo sapiens
tttgtacatcctaattctgagt

SEQ ID NO: 8004711 - DNA, 22 bp, Homo sapiens
ctctcctggggagcacacacac

SEQ ID NO: 8004712 - DNA, 22 bp, Homo sapiens
ctctcctggggagcacacacac

SEQ ID NO: 8004713 - DNA, 22 bp, Homo sapiens
tttgtcttggcctcagttttct

SEQ ID NO: 8004714 - DNA, 22 bp, Homo sapiens
tttgtcttggcctcagttttct

SEQ ID NO: 8004715 - DNA, 22 bp, Homo sapiens
tttgtcttgtaagttaaattca

SEQ ID NO: 8004716 - DNA, 22 bp, Homo sapiens
tttgtcttggccaaggttctga

SEQ ID NO: 8004717 - DNA, 22 bp, Homo sapiens
tttgtcttgaggctggggaagt

SEQ ID NO: 8004718 - DNA, 22 bp, Homo sapiens
tttgtcttggcctcagttttct

SEQ ID NO: 8004719 - DNA, 22 bp, Homo sapiens
ctctcctctgaagtggtgaccc

SEQ ID NO: 8004720 - DNA, 22 bp, Homo sapiens
ctctcctctgaagtggtgaccc

SEQ ID NO: 8004721 - DNA, 22 bp, Homo sapiens
ctctcctcccatgtaggagatg

SEQ ID NO: 8004722 - DNA, 22 bp, Homo sapiens
ctctcctcccatgtaggagatg

SEQ ID NO: 8004723 - DNA, 22 bp, Homo sapiens
ctctcctctgaagtggtgaccc

SEQ ID NO: 8004724 - DNA, 23 bp, Homo sapiens
ctctcctgaaggacaagctgccg

SEQ ID NO: 8004725 - DNA, 23 bp, Homo sapiens
ctctcctgaaggacaagctgccg

SEQ ID NO: 8004726 - DNA, 18 bp, Homo sapiens
ctctgggagaggcataca

SEQ ID NO: 8004727 - DNA, 18 bp, Homo sapiens
ctctgggagaggcataca

SEQ ID NO: 8004728 - DNA, 22 bp, Homo sapiens
ctctgggatgaggcctaggcac

SEQ ID NO: 8004729 - DNA, 22 bp, Homo sapiens
ctctgggatgaggcctaggcac

SEQ ID NO: 8004730 - DNA, 22 bp, Homo sapiens
ctctgggcaaagatgcctcatc

SEQ ID NO: 8004731 - DNA, 22 bp, Homo sapiens
ctctgggcaaagatgcctcatc

SEQ ID NO: 8004732 - DNA, 22 bp, Homo sapiens
ctctgggcaagtttcttcatga

SEQ ID NO: 8004733 - DNA, 19 bp, Homo sapiens
ctctgggcaagtcacttaa

SEQ ID NO: 8004734 - DNA, 22 bp, Homo sapiens
ctctgggcaagtttcttcatga

SEQ ID NO: 8004735 - DNA, 22 bp, Homo sapiens
ctctgggcacattttccaggac

SEQ ID NO: 8004736 - DNA, 22 bp, Homo sapiens
ctctgggcaaagatgcctcatc

SEQ ID NO: 8004737 - DNA, 22 bp, Homo sapiens
ctctgggcaaagatgcctcatc

SEQ ID NO: 8004738 - DNA, 22 bp, Homo sapiens
ctctgggcaaagatgcctcatc

SEQ ID NO: 8004739 - DNA, 22 bp, Homo sapiens
ctctgggcaaagatgcctcatc

SEQ ID NO: 8004740 - DNA, 22 bp, Homo sapiens
ctctgggcaagtatgatagaaa

SEQ ID NO: 8004741 - DNA, 22 bp, Homo sapiens
ctctgggcaagtatgatagaaa

SEQ ID NO: 8004742 - DNA, 22 bp, Homo sapiens
ctctgggcaagtatgatagaaa

SEQ ID NO: 8004743 - DNA, 22 bp, Homo sapiens
ctctgggcaaagatgcctcatc

SEQ ID NO: 8004744 - DNA, 22 bp, Homo sapiens
ctctgggcaggacgccaggcct

SEQ ID NO: 8004745 - DNA, 22 bp, Homo sapiens
ctctgggcaggacgccaggcct

SEQ ID NO: 8004746 - DNA, 22 bp, Homo sapiens
ctctgggcaggacgccaggcct

SEQ ID NO: 8004747 - DNA, 22 bp, Homo sapiens
ctctgggcaggacgccaggcct

SEQ ID NO: 8004748 - DNA, 22 bp, Homo sapiens
ctctgggcaggacgccaggcct

SEQ ID NO: 8004749 - DNA, 22 bp, Homo sapiens
ctctgggcaggacgccaggcct

SEQ ID NO: 8004750 - DNA, 22 bp, Homo sapiens
ctctgggccaccgctggtgtat

SEQ ID NO: 8004751 - DNA, 22 bp, Homo sapiens
ctctgggccaccgctggtgtat

SEQ ID NO: 8004752 - DNA, 22 bp, Homo sapiens
ctctgggcaggaccagtggacc

SEQ ID NO: 8004753 - DNA, 22 bp, Homo sapiens
ctctgggcaggaccagtggacc

SEQ ID NO: 8004754 - DNA, 22 bp, Homo sapiens
ctctgggcaggaccagtggacc

SEQ ID NO: 8004755 - DNA, 22 bp, Homo sapiens
ctctgggcaggaccagtggacc

SEQ ID NO: 8004756 - DNA, 22 bp, Homo sapiens
ctctgggcaggaccagtggacc

SEQ ID NO: 8004757 - DNA, 22 bp, Homo sapiens
ctctgggcaggacgccaggcct

SEQ ID NO: 8004758 - DNA, 22 bp, Homo sapiens
ctctgggcaccaaagagcagct

SEQ ID NO: 8004759 - DNA, 22 bp, Homo sapiens
ctctgggcaccaaagagcagct

SEQ ID NO: 8004760 - DNA, 22 bp, Homo sapiens
ctctgggcaccaaagagcagct

SEQ ID NO: 8004761 - DNA, 22 bp, Homo sapiens
ctctgggcacattttccaggac

SEQ ID NO: 8004762 - DNA, 22 bp, Homo sapiens
ctctgggcaccaaagagcagct

SEQ ID NO: 8004763 - DNA, 22 bp, Homo sapiens
ctctgggcaccaaagagcagct

SEQ ID NO: 8004764 - DNA, 22 bp, Homo sapiens
ctctgggcactgtatgggttct

SEQ ID NO: 8004765 - DNA, 17 bp, Homo sapiens
ctctgggcagcctgggg

SEQ ID NO: 8004766 - DNA, 17 bp, Homo sapiens
ctctgggcagcctgggg

SEQ ID NO: 8004767 - DNA, 23 bp, Homo sapiens
ttttattgatatgtagctgttgt

SEQ ID NO: 8004768 - DNA, 23 bp, Homo sapiens
ttttattgatatgtagctgttgt

SEQ ID NO: 8004769 - DNA, 23 bp, Homo sapiens
ttttattgatatgtagctgttgt

SEQ ID NO: 8004770 - DNA, 23 bp, Homo sapiens
ttttattgatatgtagctgttgt

SEQ ID NO: 8004771 - DNA, 23 bp, Homo sapiens
ttttattgatatgtagctgttgt

SEQ ID NO: 8004772 - DNA, 23 bp, Homo sapiens
ttttattgatatgtagctgttgt

SEQ ID NO: 8004773 - DNA, 23 bp, Homo sapiens
ttttattgatatgtagctgttgt

SEQ ID NO: 8004774 - DNA, 22 bp, Homo sapiens
ttttattctcagctccagagag

SEQ ID NO: 8004775 - DNA, 22 bp, Homo sapiens
ttttattctcaagacaatggga

SEQ ID NO: 8004776 - DNA, 22 bp, Homo sapiens
ttttattctcaagacaatggga

SEQ ID NO: 8004777 - DNA, 22 bp, Homo sapiens
ttttattctcagctccagagag

SEQ ID NO: 8004778 - DNA, 22 bp, Homo sapiens
ttttattctcagctccagagag

SEQ ID NO: 8004779 - DNA, 22 bp, Homo sapiens
ttttattcatagggatggagag

SEQ ID NO: 8004780 - DNA, 22 bp, Homo sapiens
ttttattcaaatagttcacact

SEQ ID NO: 8004781 - DNA, 22 bp, Homo sapiens
ttttattcaaatagttcacact

SEQ ID NO: 8004782 - DNA, 22 bp, Homo sapiens
ttttattcatagggatggagag

SEQ ID NO: 8004783 - DNA, 22 bp, Homo sapiens
ttttattctaagtatgatggga

SEQ ID NO: 8004784 - DNA, 22 bp, Homo sapiens
ttttattatctttgaatgggac

SEQ ID NO: 8004785 - DNA, 22 bp, Homo sapiens
ttttagttgtagttggtgagga

SEQ ID NO: 8004786 - DNA, 22 bp, Homo sapiens
ttttagttgtactgtcaacagt

SEQ ID NO: 8004787 - DNA, 22 bp, Homo sapiens
ttttagttactgcagtagcaaa

SEQ ID NO: 8004788 - DNA, 22 bp, Homo sapiens
ctctgggctccttcagcccttt

SEQ ID NO: 8004789 - DNA, 22 bp, Homo sapiens
ctctgggctccttcagcccttt

SEQ ID NO: 8004790 - DNA, 22 bp, Homo sapiens
ctctgggctgaatggctgaacc

SEQ ID NO: 8004791 - DNA, 22 bp, Homo sapiens
ctctgggctgaatggctgaacc

SEQ ID NO: 8004792 - DNA, 22 bp, Homo sapiens
ctctgggcccacttaaatctgg

SEQ ID NO: 8004793 - DNA, 21 bp, Homo sapiens
ctctgggccattttcttccac

SEQ ID NO: 8004794 - DNA, 22 bp, Homo sapiens
ctctgggccatgctactgctct

SEQ ID NO: 8004795 - DNA, 22 bp, Homo sapiens
ctctgggcggcccaggccaacc

SEQ ID NO: 8004796 - DNA, 22 bp, Homo sapiens
ctctgggcggcccaggccaacc

SEQ ID NO: 8004797 - DNA, 22 bp, Homo sapiens
ctctgggcggcccaggccaacc

SEQ ID NO: 8004798 - DNA, 22 bp, Homo sapiens
ctctgggcggcccaggccaacc

SEQ ID NO: 8004799 - DNA, 23 bp, Homo sapiens
ctctgggcgggcaggtcagcctc

SEQ ID NO: 8004800 - DNA, 23 bp, Homo sapiens
ctctgggcgggcaggtcagcctc

SEQ ID NO: 8004801 - DNA, 22 bp, Homo sapiens
ctctgggctccttcagcccttt

SEQ ID NO: 8004802 - DNA, 22 bp, Homo sapiens
ctctgggctccttcagcccttt

SEQ ID NO: 8004803 - DNA, 22 bp, Homo sapiens
ctctgggctccttcagcccttt

SEQ ID NO: 8004804 - DNA, 23 bp, Homo sapiens
ctctgggcgggcaggtcagcctc

SEQ ID NO: 8004805 - DNA, 22 bp, Homo sapiens
ctgaaagcaaatacatgaatct

SEQ ID NO: 8004806 - DNA, 19 bp, Homo sapiens
tttttaatgggctggagca

SEQ ID NO: 8004807 - DNA, 19 bp, Homo sapiens
tttttaatgggctggagca

SEQ ID NO: 8004808 - DNA, 19 bp, Homo sapiens
tttttaatgggctggagca

SEQ ID NO: 8004809 - DNA, 22 bp, Homo sapiens
ctgaaattctgcctctgcacaa

SEQ ID NO: 8004810 - DNA, 22 bp, Homo sapiens
ctgaaattgatgacagggatgg

SEQ ID NO: 8004811 - DNA, 20 bp, Homo sapiens
ctgaaccaaggctttctcag

SEQ ID NO: 8004812 - DNA, 22 bp, Homo sapiens
ctgaacattcttgaacatctgt

SEQ ID NO: 8004813 - DNA, 22 bp, Homo sapiens
ctgaaccactaatattttgatt

SEQ ID NO: 8004814 - DNA, 22 bp, Homo sapiens
ctgaaccatctctgttctgtat

SEQ ID NO: 8004815 - DNA, 22 bp, Homo sapiens
ctgaactatcctgcaactgcag

SEQ ID NO: 8004816 - DNA, 20 bp, Homo sapiens
ctgaacacagaataagcaca

SEQ ID NO: 8004817 - DNA, 20 bp, Homo sapiens
ctgaacacagaataagcaca

SEQ ID NO: 8004818 - DNA, 22 bp, Homo sapiens
ctgaaattgatgacagggatgg

SEQ ID NO: 8004819 - DNA, 22 bp, Homo sapiens
ctgaacagtacttggccagttt

SEQ ID NO: 8004820 - DNA, 22 bp, Homo sapiens
ctgaagaaatatgattgcttaa

SEQ ID NO: 8004821 - DNA, 22 bp, Homo sapiens
ctgaagaaatatgattgcttaa

SEQ ID NO: 8004822 - DNA, 22 bp, Homo sapiens
ctgaacttattgagtgcttgct

SEQ ID NO: 8004823 - DNA, 22 bp, Homo sapiens
ctgaacttattgagtgcttgct

SEQ ID NO: 8004824 - DNA, 22 bp, Homo sapiens
ctgaacttattgagtgcttgct

SEQ ID NO: 8004825 - DNA, 22 bp, Homo sapiens
ctgaacttattgagtgcttgct

SEQ ID NO: 8004826 - DNA, 22 bp, Homo sapiens
ctgaactgacagactgcctgct

SEQ ID NO: 8004827 - DNA, 22 bp, Homo sapiens
ctgaagaatgacagtgctttga

SEQ ID NO: 8004828 - DNA, 18 bp, Homo sapiens
ctgaagacaaaatgtcca

SEQ ID NO: 8004829 - DNA, 22 bp, Homo sapiens
ctgaagagaaagggagctcttc

SEQ ID NO: 8004830 - DNA, 22 bp, Homo sapiens
ctgaagagactggagggggcat

SEQ ID NO: 8004831 - DNA, 22 bp, Homo sapiens
ctgaagagatgtcaatattggc

SEQ ID NO: 8004832 - DNA, 22 bp, Homo sapiens
ctgaagagactggagggggcat

SEQ ID NO: 8004833 - DNA, 22 bp, Homo sapiens
ctgaagagactggagggggcat

SEQ ID NO: 8004834 - DNA, 20 bp, Homo sapiens
ctgaagagactggaggggca

SEQ ID NO: 8004835 - DNA, 20 bp, Homo sapiens
ctgaagagactggaggggca

SEQ ID NO: 8004836 - DNA, 20 bp, Homo sapiens
ctgaagagactggaggggca

SEQ ID NO: 8004837 - DNA, 22 bp, Homo sapiens
ctgaagagatgtcaatattggc

SEQ ID NO: 8004838 - DNA, 22 bp, Homo sapiens
ctgaagagatgtcaatattggc

SEQ ID NO: 8004839 - DNA, 22 bp, Homo sapiens
ctgaagagcaaaccaactggac

SEQ ID NO: 8004840 - DNA, 22 bp, Homo sapiens
ctgaagagcaaaccaactggac

SEQ ID NO: 8004841 - DNA, 22 bp, Homo sapiens
ctgaagagcaaaccaactggac

SEQ ID NO: 8004842 - DNA, 22 bp, Homo sapiens
ctgaagagaaagggagctcttc

SEQ ID NO: 8004843 - DNA, 22 bp, Homo sapiens
ctgaagagaaagggagctcttc

SEQ ID NO: 8004844 - DNA, 22 bp, Homo sapiens
ctgaagagaaagggagctcttc

SEQ ID NO: 8004845 - DNA, 20 bp, Homo sapiens
ctgaagagactggaggggca

SEQ ID NO: 8004846 - DNA, 20 bp, Homo sapiens
ctgaagagactggaggggca

SEQ ID NO: 8004847 - DNA, 22 bp, Homo sapiens
ctgaagagaaatgtacacatgg

SEQ ID NO: 8004848 - DNA, 22 bp, Homo sapiens
ctgaagagaaatgtacacatgg

SEQ ID NO: 8004849 - DNA, 22 bp, Homo sapiens
ctgaagaggacgcagcagcaag

SEQ ID NO: 8004850 - DNA, 22 bp, Homo sapiens
ctgaagaggactgggttggagg

SEQ ID NO: 8004851 - DNA, 22 bp, Homo sapiens
ctgaagaggagaccgcgcccac

SEQ ID NO: 8004852 - DNA, 22 bp, Homo sapiens
ctgaagaggactgggttggagg

SEQ ID NO: 8004853 - DNA, 22 bp, Homo sapiens
ctgaagaggactgggttggagg

SEQ ID NO: 8004854 - DNA, 22 bp, Homo sapiens
ctgaagaggctccgcccacaag

SEQ ID NO: 8004855 - DNA, 22 bp, Homo sapiens
ctgaagaggagaccgcgcccac

SEQ ID NO: 8004856 - DNA, 22 bp, Homo sapiens
ctgaagaggctccgcccacaag

SEQ ID NO: 8004857 - DNA, 22 bp, Homo sapiens
ctgaagaggttgttgaggaata

SEQ ID NO: 8004858 - DNA, 22 bp, Homo sapiens
ctgaagaggttgttgaggaata

SEQ ID NO: 8004859 - DNA, 22 bp, Homo sapiens
ctgaagaggttgttgaggaata

SEQ ID NO: 8004860 - DNA, 17 bp, Homo sapiens
ctgaagagtcctggcta

SEQ ID NO: 8004861 - DNA, 22 bp, Homo sapiens
ctgaagagcactgtggccagtt

SEQ ID NO: 8004862 - DNA, 22 bp, Homo sapiens
ctgaagagcactgtggccagtt

SEQ ID NO: 8004863 - DNA, 22 bp, Homo sapiens
ctgaagagctctcctgtcccct

SEQ ID NO: 8004864 - DNA, 23 bp, Homo sapiens
ctgaagagccaacaaaaagcttg

SEQ ID NO: 8004865 - DNA, 23 bp, Homo sapiens
ctgaagagccaacaaaaagcttg

SEQ ID NO: 8004866 - DNA, 22 bp, Homo sapiens
ctgaagaggacgcagcagcaag

SEQ ID NO: 8004867 - DNA, 22 bp, Homo sapiens
ctgaagagctctcctgtcccct

SEQ ID NO: 8004868 - DNA, 22 bp, Homo sapiens
ctgaagaggacgcagcagcaag

SEQ ID NO: 8004869 - DNA, 22 bp, Homo sapiens
ctgaagatgtctgagatgctca

SEQ ID NO: 8004870 - DNA, 22 bp, Homo sapiens
ctgaagatgctggagcatgggt

SEQ ID NO: 8004871 - DNA, 22 bp, Homo sapiens
ctgaagatgctggagcatgggt

SEQ ID NO: 8004872 - DNA, 22 bp, Homo sapiens
ctgaagatgatgatactaagga

SEQ ID NO: 8004873 - DNA, 22 bp, Homo sapiens
ctgactgtaattctgttcttaa

SEQ ID NO: 8004874 - DNA, 22 bp, Homo sapiens
ctgactgtctcttctcccatga

SEQ ID NO: 8004875 - DNA, 20 bp, Homo sapiens
ctgaagagtggcctgatctg

SEQ ID NO: 8004876 - DNA, 17 bp, Homo sapiens
ctgaagataatggcaac

SEQ ID NO: 8004877 - DNA, 17 bp, Homo sapiens
ctgaagataatggcaac

SEQ ID NO: 8004878 - DNA, 20 bp, Homo sapiens
ctgaagagtggcctgatctg

SEQ ID NO: 8004879 - DNA, 20 bp, Homo sapiens
ctgaagagtggcctgatctg

SEQ ID NO: 8004880 - DNA, 17 bp, Homo sapiens
ctgaagagtcctggcta

SEQ ID NO: 8004881 - DNA, 17 bp, Homo sapiens
ctgaagagtcctggcta

SEQ ID NO: 8004882 - DNA, 22 bp, Homo sapiens
ctgaagatagtgtctgatcatg

SEQ ID NO: 8004883 - DNA, 22 bp, Homo sapiens
ctgaagatgaggctgctggggg

SEQ ID NO: 8004884 - DNA, 22 bp, Homo sapiens
ctgaagatagtgtctgatcatg

SEQ ID NO: 8004885 - DNA, 22 bp, Homo sapiens
ctgaagatagtgtctgatcatg

SEQ ID NO: 8004886 - DNA, 17 bp, Homo sapiens
ctgaagataatggcaac

SEQ ID NO: 8004887 - DNA, 22 bp, Homo sapiens
ctgactgtttgctgaaaggtct

SEQ ID NO: 8004888 - DNA, 22 bp, Homo sapiens
ctgactgttgctgttgatgagg

SEQ ID NO: 8004889 - DNA, 22 bp, Homo sapiens
ctgagaaagtttatgtttattt

SEQ ID NO: 8004890 - DNA, 22 bp, Homo sapiens
ctgagaaatacccaagtctggt

SEQ ID NO: 8004891 - DNA, 22 bp, Homo sapiens
ctgagaaatacccaagtctggt

SEQ ID NO: 8004892 - DNA, 22 bp, Homo sapiens
ctgagaaatacccaagtctggt

SEQ ID NO: 8004893 - DNA, 22 bp, Homo sapiens
ctgagaaatgcatttttccagc

SEQ ID NO: 8004894 - DNA, 22 bp, Homo sapiens
ctgagaaatacccaagtctggt

SEQ ID NO: 8004895 - DNA, 22 bp, Homo sapiens
ctgagaaattctttctttcact

SEQ ID NO: 8004896 - DNA, 22 bp, Homo sapiens
ctgagaagcactgtctgcaaga

SEQ ID NO: 8004897 - DNA, 22 bp, Homo sapiens
ctgagaagcactgtctgcaaga

SEQ ID NO: 8004898 - DNA, 22 bp, Homo sapiens
ctgagaagcaaagaactgcact

SEQ ID NO: 8004899 - DNA, 22 bp, Homo sapiens
ctgagaagagggtatgtggcgc

SEQ ID NO: 8004900 - DNA, 22 bp, Homo sapiens
ctgagaaatttattggttggaa

SEQ ID NO: 8004901 - DNA, 20 bp, Homo sapiens
ctgagaactatgactgtctt

SEQ ID NO: 8004902 - DNA, 22 bp, Homo sapiens
ctgagaaggaagcctccactct

SEQ ID NO: 8004903 - DNA, 22 bp, Homo sapiens
ctgagaaggtgtggagatgggc

SEQ ID NO: 8004904 - DNA, 22 bp, Homo sapiens
ctgagaataaagccagcaggag

SEQ ID NO: 8004905 - DNA, 19 bp, Homo sapiens
ctgagaatcctacttattt

SEQ ID NO: 8004906 - DNA, 21 bp, Homo sapiens
ttttattgatgaatggccact

SEQ ID NO: 8004907 - DNA, 21 bp, Homo sapiens
ttttattgatgaatggccact

SEQ ID NO: 8004908 - DNA, 21 bp, Homo sapiens
ttttattgatgaatggccact

SEQ ID NO: 8004909 - DNA, 23 bp, Homo sapiens
ttttattgatatgtagctgttgt

SEQ ID NO: 8004910 - DNA, 23 bp, Homo sapiens
ttttattgatatgtagctgttgt

SEQ ID NO: 8004911 - DNA, 21 bp, Homo sapiens
ttttattgatgaatggccact

SEQ ID NO: 8004912 - DNA, 22 bp, Homo sapiens
ctctgggttcactgaggctctg

SEQ ID NO: 8004913 - DNA, 22 bp, Homo sapiens
ctctgggttcactgaggctctg

SEQ ID NO: 8004914 - DNA, 22 bp, Homo sapiens
ctctgggttcactgaggctctg

SEQ ID NO: 8004915 - DNA, 22 bp, Homo sapiens
ctctgggttcactgaggctctg

SEQ ID NO: 8004916 - DNA, 22 bp, Homo sapiens
ctctgggttcactgaggctctg

SEQ ID NO: 8004917 - DNA, 21 bp, Homo sapiens
ttttattgatgaatggccact

SEQ ID NO: 8004918 - DNA, 22 bp, Homo sapiens
ctctggtcagtgaattcctagt

SEQ ID NO: 8004919 - DNA, 22 bp, Homo sapiens
ctctggtcatttggaagagcat

SEQ ID NO: 8004920 - DNA, 22 bp, Homo sapiens
ctctggtcagtgaattcctagt

SEQ ID NO: 8004921 - DNA, 22 bp, Homo sapiens
ctctggtcatttggaagagcat

SEQ ID NO: 8004922 - DNA, 22 bp, Homo sapiens
ctctggtcaagcaaagaggttt

SEQ ID NO: 8004923 - DNA, 22 bp, Homo sapiens
ctctgggttttgtcagctgagg

SEQ ID NO: 8004924 - DNA, 22 bp, Homo sapiens
ctctgggttcagccccggccct

SEQ ID NO: 8004925 - DNA, 22 bp, Homo sapiens
ctctgggttcagccccggccct

SEQ ID NO: 8004926 - DNA, 22 bp, Homo sapiens
ctctgggttctggcctgcaccc

SEQ ID NO: 8004927 - DNA, 22 bp, Homo sapiens
ctctgggttctggcctgcaccc

SEQ ID NO: 8004928 - DNA, 22 bp, Homo sapiens
ctctggtcatttggaagagcat

SEQ ID NO: 8004929 - DNA, 22 bp, Homo sapiens
ctctggtcccctgtcaccagtt

SEQ ID NO: 8004930 - DNA, 22 bp, Homo sapiens
ctctggtcccctgtcaccagtt

SEQ ID NO: 8004931 - DNA, 21 bp, Homo sapiens
ctctggtcctgtctggcaggc

SEQ ID NO: 8004932 - DNA, 21 bp, Homo sapiens
ctctggtcctgtctggcaggc

SEQ ID NO: 8004933 - DNA, 22 bp, Homo sapiens
ctctggtccttctgacaacctg

SEQ ID NO: 8004934 - DNA, 21 bp, Homo sapiens
ctctggtcctgtctggcaggc

SEQ ID NO: 8004935 - DNA, 21 bp, Homo sapiens
ctctggtcctgtctggcaggc

SEQ ID NO: 8004936 - DNA, 21 bp, Homo sapiens
ctctggtcctgtctggcaggc

SEQ ID NO: 8004937 - DNA, 22 bp, Homo sapiens
ctctggttcagggctccctggc

SEQ ID NO: 8004938 - DNA, 22 bp, Homo sapiens
ctctttggcccccgatgattca

SEQ ID NO: 8004939 - DNA, 22 bp, Homo sapiens
ctctttggcccccgatgattca

SEQ ID NO: 8004940 - DNA, 22 bp, Homo sapiens
ctctttggccagaaaatgtttt

SEQ ID NO: 8004941 - DNA, 22 bp, Homo sapiens
ctctggtcttcaaggccacctc

SEQ ID NO: 8004942 - DNA, 22 bp, Homo sapiens
ctctggtgtctcccctaagcta

SEQ ID NO: 8004943 - DNA, 22 bp, Homo sapiens
ctctggtgtctcccctaagcta

SEQ ID NO: 8004944 - DNA, 22 bp, Homo sapiens
ctctggtcctttatggtttcca

SEQ ID NO: 8004945 - DNA, 22 bp, Homo sapiens
ctctggtcttcaaggccacctc

SEQ ID NO: 8004946 - DNA, 22 bp, Homo sapiens
ctctggtctcctgtagctacag

SEQ ID NO: 8004947 - DNA, 22 bp, Homo sapiens
ctctttggttaatcacacagat

SEQ ID NO: 8004948 - DNA, 22 bp, Homo sapiens
ctctttggttaatcacacagat

SEQ ID NO: 8004949 - DNA, 22 bp, Homo sapiens
ctctttgtagcctttgcatatt

SEQ ID NO: 8004950 - DNA, 22 bp, Homo sapiens
ctctttggcgttggcagagcca

SEQ ID NO: 8004951 - DNA, 22 bp, Homo sapiens
ctctttgtatttctttgggcca

SEQ ID NO: 8004952 - DNA, 22 bp, Homo sapiens
ctctttgtcactcatacagtca

SEQ ID NO: 8004953 - DNA, 22 bp, Homo sapiens
ctctttgtgctattatgatcct

SEQ ID NO: 8004954 - DNA, 22 bp, Homo sapiens
ctctttgtggaacggcagtgtc

SEQ ID NO: 8004955 - DNA, 21 bp, Homo sapiens
ctctttgtggcaatgtatttt

SEQ ID NO: 8004956 - DNA, 22 bp, Homo sapiens
ctcttttaattgtcataacaac

SEQ ID NO: 8004957 - DNA, 22 bp, Homo sapiens
ctcttttaattgtcataacaac

SEQ ID NO: 8004958 - DNA, 22 bp, Homo sapiens
ctctttgtggccacctaatctt

SEQ ID NO: 8004959 - DNA, 20 bp, Homo sapiens
ctctttgttggcaaactctt

SEQ ID NO: 8004960 - DNA, 19 bp, Homo sapiens
ctgaaaaacattctcagga

SEQ ID NO: 8004961 - DNA, 19 bp, Homo sapiens
ctgaaaaacattctcagga

SEQ ID NO: 8004962 - DNA, 22 bp, Homo sapiens
ctctttttcagccttaccaaag

SEQ ID NO: 8004963 - DNA, 22 bp, Homo sapiens
ctctttttcagccttaccaaag

SEQ ID NO: 8004964 - DNA, 22 bp, Homo sapiens
ctctttttcagccttaccaaag

SEQ ID NO: 8004965 - DNA, 22 bp, Homo sapiens
ctctttttcagccttaccaaag

SEQ ID NO: 8004966 - DNA, 22 bp, Homo sapiens
ctctttttcagccttaccaaag

SEQ ID NO: 8004967 - DNA, 22 bp, Homo sapiens
ctctttttcagccttaccaaag

SEQ ID NO: 8004968 - DNA, 22 bp, Homo sapiens
ctctttttcacctctgtcagcg

SEQ ID NO: 8004969 - DNA, 22 bp, Homo sapiens
ctctttttcacctctgtcagcg

SEQ ID NO: 8004970 - DNA, 22 bp, Homo sapiens
ctctttttcacctctgtcagcg

SEQ ID NO: 8004971 - DNA, 22 bp, Homo sapiens
ctctttttcacctctgtcagcg

SEQ ID NO: 8004972 - DNA, 22 bp, Homo sapiens
ctcttttagagatgaaaattgg

SEQ ID NO: 8004973 - DNA, 22 bp, Homo sapiens
ctcttttcaaaatttcactgca

SEQ ID NO: 8004974 - DNA, 22 bp, Homo sapiens
ctcttttcaaaatttcactgca

SEQ ID NO: 8004975 - DNA, 22 bp, Homo sapiens
ctcttttcaaacctgtttatgg

SEQ ID NO: 8004976 - DNA, 20 bp, Homo sapiens
ctcttttgactctttgcaag

SEQ ID NO: 8004977 - DNA, 20 bp, Homo sapiens
ctcttttcactctcagtggt

SEQ ID NO: 8004978 - DNA, 20 bp, Homo sapiens
ctcttttcactctcagtggt

SEQ ID NO: 8004979 - DNA, 17 bp, Homo sapiens
ctcttttgtcttcttcc

SEQ ID NO: 8004980 - DNA, 17 bp, Homo sapiens
ctcttttgtcttcttcc

SEQ ID NO: 8004981 - DNA, 22 bp, Homo sapiens
tttttaatgcagtctgagacat

SEQ ID NO: 8004982 - DNA, 22 bp, Homo sapiens
tttttaatgcagtctgagacat

SEQ ID NO: 8004983 - DNA, 22 bp, Homo sapiens
tttttaagctcctttgatgtca

SEQ ID NO: 8004984 - DNA, 22 bp, Homo sapiens
tttttaagctcctttgatgtca

SEQ ID NO: 8004985 - DNA, 22 bp, Homo sapiens
tttttaagctcctttgatgtca

SEQ ID NO: 8004986 - DNA, 22 bp, Homo sapiens
tttttaagagtctggaaatagt

SEQ ID NO: 8004987 - DNA, 22 bp, Homo sapiens
tttttaagagtctggaaatagt

SEQ ID NO: 8004988 - DNA, 22 bp, Homo sapiens
tttttaagagtctggaaatagt

SEQ ID NO: 8004989 - DNA, 22 bp, Homo sapiens
tttttaagagattctccagtct

SEQ ID NO: 8004990 - DNA, 22 bp, Homo sapiens
tttttaagagtctggaaatagt

SEQ ID NO: 8004991 - DNA, 22 bp, Homo sapiens
tttttaagagtctggaaatagt

SEQ ID NO: 8004992 - DNA, 22 bp, Homo sapiens
tttttaagagattctccagtct

SEQ ID NO: 8004993 - DNA, 22 bp, Homo sapiens
tttttaagagattctccagtct

SEQ ID NO: 8004994 - DNA, 22 bp, Homo sapiens
tttttaacctaccttaagagca

SEQ ID NO: 8004995 - DNA, 22 bp, Homo sapiens
tttttaacctaccttaagagca

SEQ ID NO: 8004996 - DNA, 22 bp, Homo sapiens
ttttgttttcttagaaacctgg

SEQ ID NO: 8004997 - DNA, 19 bp, Homo sapiens
ctgaaaaacattctcagga

SEQ ID NO: 8004998 - DNA, 22 bp, Homo sapiens
ttttgtttgtgtccactgcagt

SEQ ID NO: 8004999 - DNA, 19 bp, Homo sapiens
ctgaaaaacattctcagga

SEQ ID NO: 8005000 - DNA, 22 bp, Homo sapiens
ttttgttttcttagaaacctgg

SEQ ID NO: 8005001 - DNA, 22 bp, Homo sapiens
ttttgttttcttagaaacctgg

SEQ ID NO: 8005002 - DNA, 22 bp, Homo sapiens
ctggccacccatgcctccctga

SEQ ID NO: 8005003 - DNA, 22 bp, Homo sapiens
ctggccacccatgcctccctga

SEQ ID NO: 8005004 - DNA, 22 bp, Homo sapiens
ctggccaggcggcccctgcatg

SEQ ID NO: 8005005 - DNA, 22 bp, Homo sapiens
ctggccaggcggcccctgcatg

SEQ ID NO: 8005006 - DNA, 22 bp, Homo sapiens
ctggccacccatgcctccctga

SEQ ID NO: 8005007 - DNA, 22 bp, Homo sapiens
ctggccacccatgcctccctga

SEQ ID NO: 8005008 - DNA, 22 bp, Homo sapiens
ctggccaggcggcccctgcatg

SEQ ID NO: 8005009 - DNA, 22 bp, Homo sapiens
ctggccaggcggcccctgcatg

SEQ ID NO: 8005010 - DNA, 22 bp, Homo sapiens
ctggccaggcggcccctgcatg

SEQ ID NO: 8005011 - DNA, 22 bp, Homo sapiens
ctggccaggctctcacgtggtc

SEQ ID NO: 8005012 - DNA, 22 bp, Homo sapiens
ctggccaggctctcacgtggtc

SEQ ID NO: 8005013 - DNA, 22 bp, Homo sapiens
ctggccaggctctcacgtggtc

SEQ ID NO: 8005014 - DNA, 22 bp, Homo sapiens
ctggccaggcggcccctgcatg

SEQ ID NO: 8005015 - DNA, 22 bp, Homo sapiens
ctggccagtgcctgtgggcccc

SEQ ID NO: 8005016 - DNA, 17 bp, Homo sapiens
ctggccagtgtacttgg

SEQ ID NO: 8005017 - DNA, 22 bp, Homo sapiens
ctggccaggctctcacgtggtc

SEQ ID NO: 8005018 - DNA, 19 bp, Homo sapiens
ctggccacacctgctggtt

SEQ ID NO: 8005019 - DNA, 22 bp, Homo sapiens
ctggccacaactagcccaggac

SEQ ID NO: 8005020 - DNA, 19 bp, Homo sapiens
ctggccacacctgctggtt

SEQ ID NO: 8005021 - DNA, 19 bp, Homo sapiens
ctggccacacctgctggtt

SEQ ID NO: 8005022 - DNA, 19 bp, Homo sapiens
ctggccacacctgctggtt

SEQ ID NO: 8005023 - DNA, 22 bp, Homo sapiens
ctggccacatgtgtgctgagca

SEQ ID NO: 8005024 - DNA, 22 bp, Homo sapiens
ctggccacatgtgtgctgagca

SEQ ID NO: 8005025 - DNA, 19 bp, Homo sapiens
ctggccacacctgctggtt

SEQ ID NO: 8005026 - DNA, 19 bp, Homo sapiens
ctggccacacctgctggtt

SEQ ID NO: 8005027 - DNA, 22 bp, Homo sapiens
ctggccacatgtgtgctgagca

SEQ ID NO: 8005028 - DNA, 22 bp, Homo sapiens
ctggccacatgtgtgctgagca

SEQ ID NO: 8005029 - DNA, 23 bp, Homo sapiens
ctggccaccatctttctggcttc

SEQ ID NO: 8005030 - DNA, 23 bp, Homo sapiens
ctggccaccatctttctggcttc

SEQ ID NO: 8005031 - DNA, 23 bp, Homo sapiens
ctggccaccatctttctggcttc

SEQ ID NO: 8005032 - DNA, 22 bp, Homo sapiens
ctggccaccaagagcttgctca

SEQ ID NO: 8005033 - DNA, 22 bp, Homo sapiens
ctggccaccaagagcttgctca

SEQ ID NO: 8005034 - DNA, 22 bp, Homo sapiens
ctggccaccaagagcttgctca

SEQ ID NO: 8005035 - DNA, 22 bp, Homo sapiens
ctggcatgtgtttggctcctgt

SEQ ID NO: 8005036 - DNA, 22 bp, Homo sapiens
ctggcattcttgtttctggaaa

SEQ ID NO: 8005037 - DNA, 18 bp, Homo sapiens
ctggcattcttccctgga

SEQ ID NO: 8005038 - DNA, 22 bp, Homo sapiens
ctggcatgtgtttggctcctgt

SEQ ID NO: 8005039 - DNA, 22 bp, Homo sapiens
ctggcatgtgtttggctcctgt

SEQ ID NO: 8005040 - DNA, 22 bp, Homo sapiens
ctggcatgccttgggtgcctct

SEQ ID NO: 8005041 - DNA, 22 bp, Homo sapiens
ctggcatgccttgggtgcctct

SEQ ID NO: 8005042 - DNA, 22 bp, Homo sapiens
ctggcatgctaatacagcctgt

SEQ ID NO: 8005043 - DNA, 22 bp, Homo sapiens
ctggcatgctaatacagcctgt

SEQ ID NO: 8005044 - DNA, 22 bp, Homo sapiens
ctggccaacatctggggcacat

SEQ ID NO: 8005045 - DNA, 22 bp, Homo sapiens
ctggcatttttggaaagaagaa

SEQ ID NO: 8005046 - DNA, 22 bp, Homo sapiens
ctggcatttttggaaagaagaa

SEQ ID NO: 8005047 - DNA, 22 bp, Homo sapiens
ctggcattgagggtcacaaggc

SEQ ID NO: 8005048 - DNA, 22 bp, Homo sapiens
ctggcatttagacccacagcaa

SEQ ID NO: 8005049 - DNA, 22 bp, Homo sapiens
ctggccaagcactggggtcaaa

SEQ ID NO: 8005050 - DNA, 22 bp, Homo sapiens
ctggccacaactagcccaggac

SEQ ID NO: 8005051 - DNA, 22 bp, Homo sapiens
ctggccacaactagcccaggac

SEQ ID NO: 8005052 - DNA, 22 bp, Homo sapiens
ctggccacaactagcccaggac

SEQ ID NO: 8005053 - DNA, 19 bp, Homo sapiens
ctggccacacctgctggtt

SEQ ID NO: 8005054 - DNA, 22 bp, Homo sapiens
ctggccaatatagggaaatctt

SEQ ID NO: 8005055 - DNA, 22 bp, Homo sapiens
ctggccaatatagggaaatctt

SEQ ID NO: 8005056 - DNA, 22 bp, Homo sapiens
ctggccacaactagcccaggac

SEQ ID NO: 8005057 - DNA, 22 bp, Homo sapiens
ctggccacaactagcccaggac

SEQ ID NO: 8005058 - DNA, 22 bp, Homo sapiens
ctggcaggtccagctggactca

SEQ ID NO: 8005059 - DNA, 22 bp, Homo sapiens
ctggcagtcacggccatgtgct

SEQ ID NO: 8005060 - DNA, 22 bp, Homo sapiens
ctggcaggtatctaaagttgtc

SEQ ID NO: 8005061 - DNA, 22 bp, Homo sapiens
ctggcagggtgggctttgcttt

SEQ ID NO: 8005062 - DNA, 22 bp, Homo sapiens
ctggcagggctggtattcaaaa

SEQ ID NO: 8005063 - DNA, 22 bp, Homo sapiens
ctggcagggctggtattcaaaa

SEQ ID NO: 8005064 - DNA, 22 bp, Homo sapiens
ctggcagggtgggctttgcttt

SEQ ID NO: 8005065 - DNA, 22 bp, Homo sapiens
ctggcagcattaacagagagca

SEQ ID NO: 8005066 - DNA, 22 bp, Homo sapiens
ctggcagcattaacagagagca

SEQ ID NO: 8005067 - DNA, 22 bp, Homo sapiens
ctggcagcattaacagagagca

SEQ ID NO: 8005068 - DNA, 22 bp, Homo sapiens
ctggcagcattaacagagagca

SEQ ID NO: 8005069 - DNA, 22 bp, Homo sapiens
ctggcagcattaacagagagca

SEQ ID NO: 8005070 - DNA, 22 bp, Homo sapiens
ctggcagggctctttgggtgct

SEQ ID NO: 8005071 - DNA, 22 bp, Homo sapiens
ctggcagggctctttgggtgct

SEQ ID NO: 8005072 - DNA, 22 bp, Homo sapiens
ctggcagcaggtcacacgcaga

SEQ ID NO: 8005073 - DNA, 22 bp, Homo sapiens
ctggcagcaggtcacacgcaga

SEQ ID NO: 8005074 - DNA, 22 bp, Homo sapiens
ctggcagcagttatgaaacaat

SEQ ID NO: 8005075 - DNA, 22 bp, Homo sapiens
ctggcagcatggagcctgtgct

SEQ ID NO: 8005076 - DNA, 22 bp, Homo sapiens
ctggcagcatggagcctgtgct

SEQ ID NO: 8005077 - DNA, 22 bp, Homo sapiens
ctggcagcatggagcctgtgct

SEQ ID NO: 8005078 - DNA, 22 bp, Homo sapiens
ctggcagcatggagcctgtgct

SEQ ID NO: 8005079 - DNA, 22 bp, Homo sapiens
ctggcagcattaacagagagca

SEQ ID NO: 8005080 - DNA, 22 bp, Homo sapiens
ctggcagcattaacagagagca

SEQ ID NO: 8005081 - DNA, 22 bp, Homo sapiens
ctggcagcattaacagagagca

SEQ ID NO: 8005082 - DNA, 22 bp, Homo sapiens
ctggcagcattaacagagagca

SEQ ID NO: 8005083 - DNA, 22 bp, Homo sapiens
ctggcatgaaatggcatctcat

SEQ ID NO: 8005084 - DNA, 22 bp, Homo sapiens
ctggcatgaaatggcatctcat

SEQ ID NO: 8005085 - DNA, 22 bp, Homo sapiens
ctggcagtttgccaggagctcg

SEQ ID NO: 8005086 - DNA, 22 bp, Homo sapiens
ctggcagttggcattggcatct

SEQ ID NO: 8005087 - DNA, 22 bp, Homo sapiens
ctggcagtttgccaggagctcg

SEQ ID NO: 8005088 - DNA, 22 bp, Homo sapiens
ctggcagtggggcctcagtgtt

SEQ ID NO: 8005089 - DNA, 22 bp, Homo sapiens
ctggcagtggggcctcagtgtt

SEQ ID NO: 8005090 - DNA, 22 bp, Homo sapiens
ctggcagtggggcctcagtgtt

SEQ ID NO: 8005091 - DNA, 22 bp, Homo sapiens
ctggcagtgtgaccctggacag

SEQ ID NO: 8005092 - DNA, 22 bp, Homo sapiens
ctggcagtgtccagctcgtgat

SEQ ID NO: 8005093 - DNA, 22 bp, Homo sapiens
ctggcagtgacattgcaggtgc

SEQ ID NO: 8005094 - DNA, 22 bp, Homo sapiens
ctggcagtcacggccatgtgct

SEQ ID NO: 8005095 - DNA, 22 bp, Homo sapiens
ctggcagtctggtggaaggcct

SEQ ID NO: 8005096 - DNA, 22 bp, Homo sapiens
ctggcagtctgcctcttcactg

SEQ ID NO: 8005097 - DNA, 22 bp, Homo sapiens
ctggcagtgcccagtcactgtt

SEQ ID NO: 8005098 - DNA, 22 bp, Homo sapiens
ctggcagtgacattgcaggtgc

SEQ ID NO: 8005099 - DNA, 22 bp, Homo sapiens
ctggcagtgacattgcaggtgc

SEQ ID NO: 8005100 - DNA, 22 bp, Homo sapiens
ctggcagtggggcctcagtgtt

SEQ ID NO: 8005101 - DNA, 22 bp, Homo sapiens
ctggcagtgccctcagccccca

SEQ ID NO: 8005102 - DNA, 22 bp, Homo sapiens
ctggcagtgcccagtcactgtt

SEQ ID NO: 8005103 - DNA, 22 bp, Homo sapiens
ctggcagtgcccagtcactgtt

SEQ ID NO: 8005104 - DNA, 22 bp, Homo sapiens
ctggcagtgagctggccactca

SEQ ID NO: 8005105 - DNA, 22 bp, Homo sapiens
ctggcagtgcccagtcactgtt

SEQ ID NO: 8005106 - DNA, 18 bp, Homo sapiens
ctggattaagacagtgct

SEQ ID NO: 8005107 - DNA, 22 bp, Homo sapiens
ctggatgtttatgaaggaccca

SEQ ID NO: 8005108 - DNA, 22 bp, Homo sapiens
ctggattaagtaaaatagagga

SEQ ID NO: 8005109 - DNA, 18 bp, Homo sapiens
ctggattaagacagtgct

SEQ ID NO: 8005110 - DNA, 22 bp, Homo sapiens
ctggattaagtaaaatagagga

SEQ ID NO: 8005111 - DNA, 22 bp, Homo sapiens
ctggattcatgccaggccaccc

SEQ ID NO: 8005112 - DNA, 22 bp, Homo sapiens
ctggattctcatcagagccaga

SEQ ID NO: 8005113 - DNA, 22 bp, Homo sapiens
ctggattcatgccaggccaccc

SEQ ID NO: 8005114 - DNA, 22 bp, Homo sapiens
ctggattctcatcagagccaga

SEQ ID NO: 8005115 - DNA, 22 bp, Homo sapiens
ctggattctggattcttctcat

SEQ ID NO: 8005116 - DNA, 22 bp, Homo sapiens
ctggatttaattaactgttgct

SEQ ID NO: 8005117 - DNA, 22 bp, Homo sapiens
ctggatttactgagttttatca

SEQ ID NO: 8005118 - DNA, 22 bp, Homo sapiens
ctggatgtaacgaaggtttcac

SEQ ID NO: 8005119 - DNA, 22 bp, Homo sapiens
ctggatgtccaggtagaagttt

SEQ ID NO: 8005120 - DNA, 22 bp, Homo sapiens
ctggatgtccttcccctgaagc

SEQ ID NO: 8005121 - DNA, 22 bp, Homo sapiens
ctggatgtcttggggactcctg

SEQ ID NO: 8005122 - DNA, 22 bp, Homo sapiens
ctggatgtggtaatgactttga

SEQ ID NO: 8005123 - DNA, 22 bp, Homo sapiens
ctggatgtcttggggactcctg

SEQ ID NO: 8005124 - DNA, 22 bp, Homo sapiens
ctggatgttcttctgcaattat

SEQ ID NO: 8005125 - DNA, 22 bp, Homo sapiens
ctggatgtttatgaaggaccca

SEQ ID NO: 8005126 - DNA, 22 bp, Homo sapiens
ctggatgttttgctaaggactc

SEQ ID NO: 8005127 - DNA, 22 bp, Homo sapiens
ctggcaagaaatatatatctta

SEQ ID NO: 8005128 - DNA, 22 bp, Homo sapiens
ctggcaagaaatatatatctta

SEQ ID NO: 8005129 - DNA, 22 bp, Homo sapiens
ctggcacatagtaggtgcacag

SEQ ID NO: 8005130 - DNA, 22 bp, Homo sapiens
ctggcaagaaatatatatctta

SEQ ID NO: 8005131 - DNA, 22 bp, Homo sapiens
ctggcaagaaatatatatctta

SEQ ID NO: 8005132 - DNA, 22 bp, Homo sapiens
ctggcaagaaatatatatctta

SEQ ID NO: 8005133 - DNA, 22 bp, Homo sapiens
ctggcaagaaatatatatctta

SEQ ID NO: 8005134 - DNA, 22 bp, Homo sapiens
ctggattttatcattgtagttt

SEQ ID NO: 8005135 - DNA, 22 bp, Homo sapiens
ctggattttgatgagcagtttt

SEQ ID NO: 8005136 - DNA, 19 bp, Homo sapiens
ctggcaaatgctttggcca

SEQ ID NO: 8005137 - DNA, 22 bp, Homo sapiens
ctggattttaaattttctctgt

SEQ ID NO: 8005138 - DNA, 22 bp, Homo sapiens
ctggattttagaaggcttccta

SEQ ID NO: 8005139 - DNA, 22 bp, Homo sapiens
ctggatttgcctatggtgcttt

SEQ ID NO: 8005140 - DNA, 23 bp, Homo sapiens
ctggatttggaagcttaaataac

SEQ ID NO: 8005141 - DNA, 22 bp, Homo sapiens
ctggatttaggactagtccaag

SEQ ID NO: 8005142 - DNA, 22 bp, Homo sapiens
ctggatttaggactagtccaag

SEQ ID NO: 8005143 - DNA, 22 bp, Homo sapiens
ctggatgctgagaggtaccaag

SEQ ID NO: 8005144 - DNA, 22 bp, Homo sapiens
ctggatgctgagaggtaccaag

SEQ ID NO: 8005145 - DNA, 22 bp, Homo sapiens
ctggatcttcagagatcaccag

SEQ ID NO: 8005146 - DNA, 22 bp, Homo sapiens
ctggatcttgctgcattgagaa

SEQ ID NO: 8005147 - DNA, 22 bp, Homo sapiens
ctggatctgtttgtgcttgtgg

SEQ ID NO: 8005148 - DNA, 22 bp, Homo sapiens
ctggatcttcagagatcaccag

SEQ ID NO: 8005149 - DNA, 22 bp, Homo sapiens
ctggatgcaactgcttctctca

SEQ ID NO: 8005150 - DNA, 22 bp, Homo sapiens
ctggatgcttcctctctgctag

SEQ ID NO: 8005151 - DNA, 22 bp, Homo sapiens
ctggatggtcccatgagcagct

SEQ ID NO: 8005152 - DNA, 22 bp, Homo sapiens
ctggatggtcccatgagcagct

SEQ ID NO: 8005153 - DNA, 22 bp, Homo sapiens
ctggatggaaggaggatagtat

SEQ ID NO: 8005154 - DNA, 22 bp, Homo sapiens
ctggatggaaggaggatagtat

SEQ ID NO: 8005155 - DNA, 22 bp, Homo sapiens
ctggatggaaggaggatagtat

SEQ ID NO: 8005156 - DNA, 22 bp, Homo sapiens
ctggatgtaaagggtgaagaaa

SEQ ID NO: 8005157 - DNA, 22 bp, Homo sapiens
ctggatgtaaagggtgaagaaa

SEQ ID NO: 8005158 - DNA, 22 bp, Homo sapiens
ctggatggtcccatgagcagct

SEQ ID NO: 8005159 - DNA, 22 bp, Homo sapiens
ctggatccatcgggtcccgagt

SEQ ID NO: 8005160 - DNA, 22 bp, Homo sapiens
ctggatccatcgggtcccgagt

SEQ ID NO: 8005161 - DNA, 21 bp, Homo sapiens
ctggatctgtcatcgagtttt

SEQ ID NO: 8005162 - DNA, 22 bp, Homo sapiens
ctggatctgtcccctttttgtt

SEQ ID NO: 8005163 - DNA, 22 bp, Homo sapiens
ctggatctgtttgtgcttgtgg

SEQ ID NO: 8005164 - DNA, 22 bp, Homo sapiens
ctggatctgtcttttggatccc

SEQ ID NO: 8005165 - DNA, 22 bp, Homo sapiens
ctggatctgaacatcggtatca

SEQ ID NO: 8005166 - DNA, 22 bp, Homo sapiens
ctggatctaaaggtggatgtag

SEQ ID NO: 8005167 - DNA, 22 bp, Homo sapiens
ctggcactcataggccagttca

SEQ ID NO: 8005168 - DNA, 22 bp, Homo sapiens
ctggcactgagtggcttatgac

SEQ ID NO: 8005169 - DNA, 22 bp, Homo sapiens
ctggcactcataggccagttca

SEQ ID NO: 8005170 - DNA, 22 bp, Homo sapiens
ctggcactggatcgtgcatatc

SEQ ID NO: 8005171 - DNA, 22 bp, Homo sapiens
ctggcacttggcacccatgaaa

SEQ ID NO: 8005172 - DNA, 22 bp, Homo sapiens
ctggcactgtgtctgcggaggg

SEQ ID NO: 8005173 - DNA, 22 bp, Homo sapiens
ctggcaccaggcatgctgggag

SEQ ID NO: 8005174 - DNA, 22 bp, Homo sapiens
ctggcacattgtaatatataca

SEQ ID NO: 8005175 - DNA, 22 bp, Homo sapiens
ctggcacctccagctcatggcc

SEQ ID NO: 8005176 - DNA, 22 bp, Homo sapiens
ctggcacctccagctcatggcc

SEQ ID NO: 8005177 - DNA, 22 bp, Homo sapiens
ctggcacctccagctcatggcc

SEQ ID NO: 8005178 - DNA, 22 bp, Homo sapiens
ctggcaccccacactgtccacg

SEQ ID NO: 8005179 - DNA, 22 bp, Homo sapiens
ctggcacatagtaggtgcacag

SEQ ID NO: 8005180 - DNA, 22 bp, Homo sapiens
ctggcaagtactgggccagctc

SEQ ID NO: 8005181 - DNA, 22 bp, Homo sapiens
ctggcacatagtcagcactcaa

SEQ ID NO: 8005182 - DNA, 22 bp, Homo sapiens
ctggcacatagtcagcactcaa

SEQ ID NO: 8005183 - DNA, 22 bp, Homo sapiens
ctggcacatagtcagcactcaa

SEQ ID NO: 8005184 - DNA, 22 bp, Homo sapiens
ctggcacatcactcctagttta

SEQ ID NO: 8005185 - DNA, 22 bp, Homo sapiens
ctggcacatagtcagcactcaa

SEQ ID NO: 8005186 - DNA, 22 bp, Homo sapiens
ctggcacatagtcagcactcaa

SEQ ID NO: 8005187 - DNA, 22 bp, Homo sapiens
ctggcacatgtgagccacatca

SEQ ID NO: 8005188 - DNA, 22 bp, Homo sapiens
ctggcacatgtgagccacatca

SEQ ID NO: 8005189 - DNA, 22 bp, Homo sapiens
ctggcacatgtgagccacatca

SEQ ID NO: 8005190 - DNA, 22 bp, Homo sapiens
ctggcacatcactcctagttta

SEQ ID NO: 8005191 - DNA, 22 bp, Homo sapiens
ctggcacatcactcctagttta

SEQ ID NO: 8005192 - DNA, 22 bp, Homo sapiens
ctggcacatgctccctgagtgg

SEQ ID NO: 8005193 - DNA, 22 bp, Homo sapiens
ctggcacatgctccctgagtgg

SEQ ID NO: 8005194 - DNA, 22 bp, Homo sapiens
ctggcacatgctccctgagtgg

SEQ ID NO: 8005195 - DNA, 22 bp, Homo sapiens
ctggcacatgctccctgagtgg

SEQ ID NO: 8005196 - DNA, 22 bp, Homo sapiens
ctggcagattggggtcagcagt

SEQ ID NO: 8005197 - DNA, 22 bp, Homo sapiens
ctggcagattggggtcagcagt

SEQ ID NO: 8005198 - DNA, 22 bp, Homo sapiens
ctggcagattggggtcagcagt

SEQ ID NO: 8005199 - DNA, 22 bp, Homo sapiens
ctggcagcagagctcaacatag

SEQ ID NO: 8005200 - DNA, 22 bp, Homo sapiens
ctggcagcagctggtaccttat

SEQ ID NO: 8005201 - DNA, 22 bp, Homo sapiens
ctggcagcagcttctggatcga

SEQ ID NO: 8005202 - DNA, 22 bp, Homo sapiens
ctggcagcagcttctggatcga

SEQ ID NO: 8005203 - DNA, 22 bp, Homo sapiens
ctggcagcagcttctggatcga

SEQ ID NO: 8005204 - DNA, 22 bp, Homo sapiens
ctggcagcagcttctggatcga

SEQ ID NO: 8005205 - DNA, 22 bp, Homo sapiens
ctggcagcaggtcacacgcaga

SEQ ID NO: 8005206 - DNA, 22 bp, Homo sapiens
ctggcagcaggtcacacgcaga

SEQ ID NO: 8005207 - DNA, 22 bp, Homo sapiens
ctggcagcaggtcacacgcaga

SEQ ID NO: 8005208 - DNA, 22 bp, Homo sapiens
ctggcagaggatggggacccag

SEQ ID NO: 8005209 - DNA, 22 bp, Homo sapiens
ctggcagaggatggggacccag

SEQ ID NO: 8005210 - DNA, 22 bp, Homo sapiens
ctggcagagtctgctgtctgca

SEQ ID NO: 8005211 - DNA, 22 bp, Homo sapiens
ctggcagagtctgctgtctgca

SEQ ID NO: 8005212 - DNA, 22 bp, Homo sapiens
ctggcagagttgggtctcaaat

SEQ ID NO: 8005213 - DNA, 22 bp, Homo sapiens
ctggcagagttgggtctcaaat

SEQ ID NO: 8005214 - DNA, 22 bp, Homo sapiens
ctggcagatagccacgcctgtc

SEQ ID NO: 8005215 - DNA, 22 bp, Homo sapiens
ctggcagatagccacgcctgtc

SEQ ID NO: 8005216 - DNA, 22 bp, Homo sapiens
ctggcagatagccacgcctgtc

SEQ ID NO: 8005217 - DNA, 22 bp, Homo sapiens
ctggcagatagtaagtgatcaa

SEQ ID NO: 8005218 - DNA, 22 bp, Homo sapiens
ctggcagatagtaagtgatcaa

SEQ ID NO: 8005219 - DNA, 22 bp, Homo sapiens
ctggcagatatttgcagacatg

SEQ ID NO: 8005220 - DNA, 22 bp, Homo sapiens
ctggcagatatttgcagacatg

SEQ ID NO: 8005221 - DNA, 22 bp, Homo sapiens
ctggcagatatttgcagacatg

SEQ ID NO: 8005222 - DNA, 22 bp, Homo sapiens
ctggctctgagcccacctccag

SEQ ID NO: 8005223 - DNA, 22 bp, Homo sapiens
ctggctctgagcccacctccag

SEQ ID NO: 8005224 - DNA, 22 bp, Homo sapiens
ctggctctgagtggctctaatt

SEQ ID NO: 8005225 - DNA, 22 bp, Homo sapiens
ctggctctgagtggctctaatt

SEQ ID NO: 8005226 - DNA, 22 bp, Homo sapiens
ctggctctgggctaagctccca

SEQ ID NO: 8005227 - DNA, 22 bp, Homo sapiens
ctggctctgggcctcagacact

SEQ ID NO: 8005228 - DNA, 22 bp, Homo sapiens
ctggctctgggcctcagacact

SEQ ID NO: 8005229 - DNA, 22 bp, Homo sapiens
ctggctctgagtggtatcttga

SEQ ID NO: 8005230 - DNA, 22 bp, Homo sapiens
ctggctctgagtggctctaatt

SEQ ID NO: 8005231 - DNA, 22 bp, Homo sapiens
ctggctctgcaacccccacaca

SEQ ID NO: 8005232 - DNA, 23 bp, Homo sapiens
ctggctctgtaggtggcatcctt

SEQ ID NO: 8005233 - DNA, 22 bp, Homo sapiens
ctggctctgggctaagctccca

SEQ ID NO: 8005234 - DNA, 23 bp, Homo sapiens
ctggctctgtaggtggcatcctt

SEQ ID NO: 8005235 - DNA, 22 bp, Homo sapiens
ctggctctgtcaccctttctcc

SEQ ID NO: 8005236 - DNA, 23 bp, Homo sapiens
ctggctctgtaggtggcatcctt

SEQ ID NO: 8005237 - DNA, 22 bp, Homo sapiens
ctggctctgtcaccctttctcc

SEQ ID NO: 8005238 - DNA, 22 bp, Homo sapiens
ctggctctgtggcttccttcat

SEQ ID NO: 8005239 - DNA, 22 bp, Homo sapiens
ctggctctgtcaccctttctcc

SEQ ID NO: 8005240 - DNA, 22 bp, Homo sapiens
ctggctctgtggcttccttcat

SEQ ID NO: 8005241 - DNA, 22 bp, Homo sapiens
ctggctctgtgggacctggcct

SEQ ID NO: 8005242 - DNA, 22 bp, Homo sapiens
ctggctctgtgggacctggcct

SEQ ID NO: 8005243 - DNA, 22 bp, Homo sapiens
ctggctctgtgggacctggcct

SEQ ID NO: 8005244 - DNA, 22 bp, Homo sapiens
ctggctctgtgggacctggcct

SEQ ID NO: 8005245 - DNA, 22 bp, Homo sapiens
ctggctctgggcctcagacact

SEQ ID NO: 8005246 - DNA, 22 bp, Homo sapiens
ctggctctattccctaaggatg

SEQ ID NO: 8005247 - DNA, 22 bp, Homo sapiens
ctggctctattccctaaggatg

SEQ ID NO: 8005248 - DNA, 22 bp, Homo sapiens
ctggctctattccctaaggatg

SEQ ID NO: 8005249 - DNA, 22 bp, Homo sapiens
ctggctctcaggctggtcccca

SEQ ID NO: 8005250 - DNA, 22 bp, Homo sapiens
ctggctctcaggctggtcccca

SEQ ID NO: 8005251 - DNA, 22 bp, Homo sapiens
ctggctctcaggctggtcccca

SEQ ID NO: 8005252 - DNA, 22 bp, Homo sapiens
ctggctctattccctaaggatg

SEQ ID NO: 8005253 - DNA, 22 bp, Homo sapiens
ctggctctcgctgggagtactt

SEQ ID NO: 8005254 - DNA, 22 bp, Homo sapiens
ctggctctcgctgggagtactt

SEQ ID NO: 8005255 - DNA, 22 bp, Homo sapiens
ctggctctctgatttcacattc

SEQ ID NO: 8005256 - DNA, 22 bp, Homo sapiens
ctggctctctgatttcacattc

SEQ ID NO: 8005257 - DNA, 22 bp, Homo sapiens
ctggctctcgctgggagtactt

SEQ ID NO: 8005258 - DNA, 22 bp, Homo sapiens
ctggctctcgctgggagtactt

SEQ ID NO: 8005259 - DNA, 22 bp, Homo sapiens
ctggctctgaccgcgctggcct

SEQ ID NO: 8005260 - DNA, 22 bp, Homo sapiens
ctggctctgaccgcgctggcct

SEQ ID NO: 8005261 - DNA, 22 bp, Homo sapiens
ctggctctctgatttcacattc

SEQ ID NO: 8005262 - DNA, 22 bp, Homo sapiens
ctggctctctgatttcacattc

SEQ ID NO: 8005263 - DNA, 22 bp, Homo sapiens
ctggctctctgagatattgagt

SEQ ID NO: 8005264 - DNA, 22 bp, Homo sapiens
ctggctctatctccaaggctgg

SEQ ID NO: 8005265 - DNA, 22 bp, Homo sapiens
ctggctctatctccaaggctgg

SEQ ID NO: 8005266 - DNA, 22 bp, Homo sapiens
ctggctctaagtgtcagctccc

SEQ ID NO: 8005267 - DNA, 22 bp, Homo sapiens
ctggctctaagtgtcagctccc

SEQ ID NO: 8005268 - DNA, 22 bp, Homo sapiens
ctggctcgcattatattttggg

SEQ ID NO: 8005269 - DNA, 22 bp, Homo sapiens
ctggctctaagtgtcagctccc

SEQ ID NO: 8005270 - DNA, 22 bp, Homo sapiens
ctggctcctctacacacccaaa

SEQ ID NO: 8005271 - DNA, 22 bp, Homo sapiens
ctggctcctctacacacccaaa

SEQ ID NO: 8005272 - DNA, 22 bp, Homo sapiens
ctggctcctgaggcttggcccc

SEQ ID NO: 8005273 - DNA, 22 bp, Homo sapiens
ctggctcctgaggcttggcccc

SEQ ID NO: 8005274 - DNA, 22 bp, Homo sapiens
ctggctcctgaggcttggcccc

SEQ ID NO: 8005275 - DNA, 22 bp, Homo sapiens
ctggctcctgaggcttggcccc

SEQ ID NO: 8005276 - DNA, 22 bp, Homo sapiens
ctggctccctggacatggggcc

SEQ ID NO: 8005277 - DNA, 22 bp, Homo sapiens
ctggctccctggacatggggcc

SEQ ID NO: 8005278 - DNA, 22 bp, Homo sapiens
ctggctccctggacatggggcc

SEQ ID NO: 8005279 - DNA, 22 bp, Homo sapiens
ctggctccctggacatggggcc

SEQ ID NO: 8005280 - DNA, 23 bp, Homo sapiens
ctggctccgaagactccaggatc

SEQ ID NO: 8005281 - DNA, 22 bp, Homo sapiens
ctggctccctggacatggggcc

SEQ ID NO: 8005282 - DNA, 23 bp, Homo sapiens
ctggctccgaagactccaggatc

SEQ ID NO: 8005283 - DNA, 23 bp, Homo sapiens
ctggctccgaagactccaggatc

SEQ ID NO: 8005284 - DNA, 23 bp, Homo sapiens
ctggctccgaagactccaggatc

SEQ ID NO: 8005285 - DNA, 22 bp, Homo sapiens
ctggctcctcagtattccactt

SEQ ID NO: 8005286 - DNA, 22 bp, Homo sapiens
ctggctcctcagtattccactt

SEQ ID NO: 8005287 - DNA, 22 bp, Homo sapiens
ctggctcctcagtattccactt

SEQ ID NO: 8005288 - DNA, 22 bp, Homo sapiens
ctggctcctccaaggcctggag

SEQ ID NO: 8005289 - DNA, 22 bp, Homo sapiens
ctggctcctccaaggcctggag

SEQ ID NO: 8005290 - DNA, 22 bp, Homo sapiens
ctggctcctcaggactgcggga

SEQ ID NO: 8005291 - DNA, 22 bp, Homo sapiens
ctggctcctcaggactgcggga

SEQ ID NO: 8005292 - DNA, 22 bp, Homo sapiens
ctggctcctcaggactgcggga

SEQ ID NO: 8005293 - DNA, 22 bp, Homo sapiens
ctggctccaggtcatgcactca

SEQ ID NO: 8005294 - DNA, 22 bp, Homo sapiens
ctggctccaggtcatgcactca

SEQ ID NO: 8005295 - DNA, 22 bp, Homo sapiens
ctggctccctctccctgagtca

SEQ ID NO: 8005296 - DNA, 22 bp, Homo sapiens
ctggctccctcgctgaggtgct

SEQ ID NO: 8005297 - DNA, 22 bp, Homo sapiens
ctggctccctctccctgagtca

SEQ ID NO: 8005298 - DNA, 22 bp, Homo sapiens
ctggctccctctccctgagtca

SEQ ID NO: 8005299 - DNA, 22 bp, Homo sapiens
ctggctccactccctgcctgac

SEQ ID NO: 8005300 - DNA, 22 bp, Homo sapiens
ctggctccactccctgcctgac

SEQ ID NO: 8005301 - DNA, 22 bp, Homo sapiens
ctggctccactccctgcctgac

SEQ ID NO: 8005302 - DNA, 22 bp, Homo sapiens
ctggctccactccctgcctgac

SEQ ID NO: 8005303 - DNA, 22 bp, Homo sapiens
ctggctccactccctgcctgac

SEQ ID NO: 8005304 - DNA, 22 bp, Homo sapiens
ctggctccaggtcatgcactca

SEQ ID NO: 8005305 - DNA, 22 bp, Homo sapiens
ctggctccaggtcatgcactca

SEQ ID NO: 8005306 - DNA, 22 bp, Homo sapiens
ctggctccaggtcatgcactca

SEQ ID NO: 8005307 - DNA, 22 bp, Homo sapiens
ctggctccactccctgcctgac

SEQ ID NO: 8005308 - DNA, 22 bp, Homo sapiens
ctggctccaggtcatgcactca

SEQ ID NO: 8005309 - DNA, 22 bp, Homo sapiens
ctggcctggggcctcagctgct

SEQ ID NO: 8005310 - DNA, 22 bp, Homo sapiens
ctggcctggggcctcagctgct

SEQ ID NO: 8005311 - DNA, 22 bp, Homo sapiens
ctggcctggggcctcagctgct

SEQ ID NO: 8005312 - DNA, 22 bp, Homo sapiens
ctggcctggggcctcagctgct

SEQ ID NO: 8005313 - DNA, 22 bp, Homo sapiens
ctggcctggggcctcagctgct

SEQ ID NO: 8005314 - DNA, 22 bp, Homo sapiens
ctggcctggggcctcagctgct

SEQ ID NO: 8005315 - DNA, 22 bp, Homo sapiens
ctggcctggggcctcagctgct

SEQ ID NO: 8005316 - DNA, 22 bp, Homo sapiens
ctggcctggggcctcagctgct

SEQ ID NO: 8005317 - DNA, 22 bp, Homo sapiens
ctggcctggggcctcagctgct

SEQ ID NO: 8005318 - DNA, 22 bp, Homo sapiens
ctggctccaccccaggaggatg

SEQ ID NO: 8005319 - DNA, 22 bp, Homo sapiens
ctggctccaccccaggaggatg

SEQ ID NO: 8005320 - DNA, 22 bp, Homo sapiens
ctggcctggtctggcctctcca

SEQ ID NO: 8005321 - DNA, 22 bp, Homo sapiens
ctggcctggtctggcctctcca

SEQ ID NO: 8005322 - DNA, 22 bp, Homo sapiens
ctggcctggtctggcctctcca

SEQ ID NO: 8005323 - DNA, 22 bp, Homo sapiens
ctggcctggggggacacatccc

SEQ ID NO: 8005324 - DNA, 22 bp, Homo sapiens
ctggcctggggggacacatccc

SEQ ID NO: 8005325 - DNA, 22 bp, Homo sapiens
ctggcctggggggacacatccc

SEQ ID NO: 8005326 - DNA, 22 bp, Homo sapiens
ctggcctggtctggcctctcca

SEQ ID NO: 8005327 - DNA, 22 bp, Homo sapiens
ctggcctggggggacacatccc

SEQ ID NO: 8005328 - DNA, 22 bp, Homo sapiens
ctggcctggtctggcctctcca

SEQ ID NO: 8005329 - DNA, 22 bp, Homo sapiens
ctggcctggtctggcctctcca

SEQ ID NO: 8005330 - DNA, 22 bp, Homo sapiens
ctggcctggcgcagtggctcac

SEQ ID NO: 8005331 - DNA, 22 bp, Homo sapiens
ctggcctgggagctgctagcgt

SEQ ID NO: 8005332 - DNA, 22 bp, Homo sapiens
ctggcctgggagctgctagcgt

SEQ ID NO: 8005333 - DNA, 22 bp, Homo sapiens
ctggcctgggagctgctagcgt

SEQ ID NO: 8005334 - DNA, 22 bp, Homo sapiens
ctggcctgggagctgctagcgt

SEQ ID NO: 8005335 - DNA, 22 bp, Homo sapiens
ctggcctggcaggggacctcta

SEQ ID NO: 8005336 - DNA, 22 bp, Homo sapiens
ctggcctggcaggggacctcta

SEQ ID NO: 8005337 - DNA, 22 bp, Homo sapiens
ctggcctggcgcagtggctcac

SEQ ID NO: 8005338 - DNA, 22 bp, Homo sapiens
ctggcctggcgcagtggctcac

SEQ ID NO: 8005339 - DNA, 22 bp, Homo sapiens
ctggcctggcgcagtggctcac

SEQ ID NO: 8005340 - DNA, 22 bp, Homo sapiens
ctggcctggcgcagtggctcac

SEQ ID NO: 8005341 - DNA, 22 bp, Homo sapiens
ctggccctgtggcctaaggact

SEQ ID NO: 8005342 - DNA, 22 bp, Homo sapiens
ctggcccttaggaaaacaaagt

SEQ ID NO: 8005343 - DNA, 22 bp, Homo sapiens
ctggccctgtggcctaaggact

SEQ ID NO: 8005344 - DNA, 22 bp, Homo sapiens
ctggccctgtggaggcaggaac

SEQ ID NO: 8005345 - DNA, 22 bp, Homo sapiens
ctggcccttctcttgcttcctg

SEQ ID NO: 8005346 - DNA, 22 bp, Homo sapiens
ctggcctctgtgttcaccatag

SEQ ID NO: 8005347 - DNA, 22 bp, Homo sapiens
ctggcctctgtgttcaccatag

SEQ ID NO: 8005348 - DNA, 22 bp, Homo sapiens
ctggcctgagaatgctaccctt

SEQ ID NO: 8005349 - DNA, 22 bp, Homo sapiens
ctggcctgagaatgctaccctt

SEQ ID NO: 8005350 - DNA, 22 bp, Homo sapiens
ctggcctgagaatgctaccctt

SEQ ID NO: 8005351 - DNA, 22 bp, Homo sapiens
ctggcctgagaatgctaccctt

SEQ ID NO: 8005352 - DNA, 22 bp, Homo sapiens
ctggcctgaggtcggctgtagg

SEQ ID NO: 8005353 - DNA, 22 bp, Homo sapiens
ctggcctgaggtcggctgtagg

SEQ ID NO: 8005354 - DNA, 22 bp, Homo sapiens
ctggcctgaggccgccttcaga

SEQ ID NO: 8005355 - DNA, 22 bp, Homo sapiens
ctggcctgaggccgccttcaga

SEQ ID NO: 8005356 - DNA, 22 bp, Homo sapiens
ctggcctgaggccgccttcaga

SEQ ID NO: 8005357 - DNA, 22 bp, Homo sapiens
ctggcctgaggccgccttcaga

SEQ ID NO: 8005358 - DNA, 22 bp, Homo sapiens
ctggcctgaggccgccttcaga

SEQ ID NO: 8005359 - DNA, 22 bp, Homo sapiens
ctggcctgaggccgccttcaga

SEQ ID NO: 8005360 - DNA, 22 bp, Homo sapiens
ctggcctgaggccgccttcaga

SEQ ID NO: 8005361 - DNA, 22 bp, Homo sapiens
ctggcctgagcacagcggctgc

SEQ ID NO: 8005362 - DNA, 22 bp, Homo sapiens
ctggcctgagcacagcggctgc

SEQ ID NO: 8005363 - DNA, 22 bp, Homo sapiens
ctggcctgagcacagcggctgc

SEQ ID NO: 8005364 - DNA, 22 bp, Homo sapiens
ctggcctgagcacagcggctgc

SEQ ID NO: 8005365 - DNA, 22 bp, Homo sapiens
ctggcctgagcacagcggctgc

SEQ ID NO: 8005366 - DNA, 22 bp, Homo sapiens
ctggcctgagaatgctaccctt

SEQ ID NO: 8005367 - DNA, 22 bp, Homo sapiens
ctggcctggcaggggacctcta

SEQ ID NO: 8005368 - DNA, 22 bp, Homo sapiens
ctggcctggcaggggacctcta

SEQ ID NO: 8005369 - DNA, 22 bp, Homo sapiens
ctggcctggcaggggacctcta

SEQ ID NO: 8005370 - DNA, 22 bp, Homo sapiens
ctggcctggcaggggacctcta

SEQ ID NO: 8005371 - DNA, 22 bp, Homo sapiens
ctggcctggcagggagggcatg

SEQ ID NO: 8005372 - DNA, 22 bp, Homo sapiens
ctggcctggagcctctgggtgg

SEQ ID NO: 8005373 - DNA, 22 bp, Homo sapiens
ctggcctggagcctctgggtgg

SEQ ID NO: 8005374 - DNA, 22 bp, Homo sapiens
ctggcctggcagggagggcatg

SEQ ID NO: 8005375 - DNA, 22 bp, Homo sapiens
ctggcctggcagggagggcatg

SEQ ID NO: 8005376 - DNA, 22 bp, Homo sapiens
ctggcctggagcctctgggtgg

SEQ ID NO: 8005377 - DNA, 22 bp, Homo sapiens
ctggcctggagcctctgggtgg

SEQ ID NO: 8005378 - DNA, 22 bp, Homo sapiens
ctggcctggagcctctgggtgg

SEQ ID NO: 8005379 - DNA, 22 bp, Homo sapiens
ctggcctgatctcatgctgtcc

SEQ ID NO: 8005380 - DNA, 22 bp, Homo sapiens
ctggcctgatctcatgctgtcc

SEQ ID NO: 8005381 - DNA, 22 bp, Homo sapiens
ctggcctgcagatcccagggtc

SEQ ID NO: 8005382 - DNA, 22 bp, Homo sapiens
ctggcctgcagatcccagggtc

SEQ ID NO: 8005383 - DNA, 22 bp, Homo sapiens
ctggcctgctgggtgaggtcct

SEQ ID NO: 8005384 - DNA, 22 bp, Homo sapiens
ctggcctgctgggtgaggtcct

SEQ ID NO: 8005385 - DNA, 22 bp, Homo sapiens
ctggcctgctgggtgaggtcct

SEQ ID NO: 8005386 - DNA, 22 bp, Homo sapiens
ctggcctgcctgccggttgtcg

SEQ ID NO: 8005387 - DNA, 22 bp, Homo sapiens
ctggcctgctgggtgaggtcct

SEQ ID NO: 8005388 - DNA, 22 bp, Homo sapiens
ctggcctgctgggtgaggtcct

SEQ ID NO: 8005389 - DNA, 22 bp, Homo sapiens
ctggcctgcagatcccagggtc

SEQ ID NO: 8005390 - DNA, 22 bp, Homo sapiens
ctggcctgcagatcccagggtc

SEQ ID NO: 8005391 - DNA, 22 bp, Homo sapiens
ctggcctgcagatcccagggtc

SEQ ID NO: 8005392 - DNA, 22 bp, Homo sapiens
ctggcccagagagcagagctta

SEQ ID NO: 8005393 - DNA, 22 bp, Homo sapiens
ctggcccagagagcagagctta

SEQ ID NO: 8005394 - DNA, 22 bp, Homo sapiens
ctggcccagagagcagagctta

SEQ ID NO: 8005395 - DNA, 22 bp, Homo sapiens
ctggcccagagagcagagctta

SEQ ID NO: 8005396 - DNA, 22 bp, Homo sapiens
ctggcccagagagcagagctta

SEQ ID NO: 8005397 - DNA, 22 bp, Homo sapiens
ctggcccagagagcagagctta

SEQ ID NO: 8005398 - DNA, 22 bp, Homo sapiens
ctggcccagagagcagagctta

SEQ ID NO: 8005399 - DNA, 22 bp, Homo sapiens
ctggccatgttgcctctgagac

SEQ ID NO: 8005400 - DNA, 22 bp, Homo sapiens
ctggccatgttgcctctgagac

SEQ ID NO: 8005401 - DNA, 22 bp, Homo sapiens
ctggccatggagaaggtgaagc

SEQ ID NO: 8005402 - DNA, 22 bp, Homo sapiens
ctggccataggttctcagtgtg

SEQ ID NO: 8005403 - DNA, 22 bp, Homo sapiens
ctggccataggttctcagtgtg

SEQ ID NO: 8005404 - DNA, 22 bp, Homo sapiens
ctggccagttgtcctggcttgg

SEQ ID NO: 8005405 - DNA, 22 bp, Homo sapiens
ctggccagttgtcctggcttgg

SEQ ID NO: 8005406 - DNA, 22 bp, Homo sapiens
ctggccagttgtcctggcttgg

SEQ ID NO: 8005407 - DNA, 22 bp, Homo sapiens
ctggccagttgccttcctgggt

SEQ ID NO: 8005408 - DNA, 22 bp, Homo sapiens
ctggccagttgccttcctgggt

SEQ ID NO: 8005409 - DNA, 22 bp, Homo sapiens
ctggccagttgccttcctgggt

SEQ ID NO: 8005410 - DNA, 22 bp, Homo sapiens
ctggccagttgccttcctgggt

SEQ ID NO: 8005411 - DNA, 17 bp, Homo sapiens
ctggccagtgtacttgg

SEQ ID NO: 8005412 - DNA, 22 bp, Homo sapiens
ctggccagtgtggctctgatct

SEQ ID NO: 8005413 - DNA, 22 bp, Homo sapiens
ctggccagtgtggctctgatct

SEQ ID NO: 8005414 - DNA, 22 bp, Homo sapiens
ctggccagtgtggctctgatct

SEQ ID NO: 8005415 - DNA, 22 bp, Homo sapiens
ctggccagtgtggctctgatct

SEQ ID NO: 8005416 - DNA, 22 bp, Homo sapiens
ctggccagtgtggctctgatct

SEQ ID NO: 8005417 - DNA, 22 bp, Homo sapiens
ctggcccaggaagacgtgtccc

SEQ ID NO: 8005418 - DNA, 22 bp, Homo sapiens
ctggcccaggaagacgtgtccc

SEQ ID NO: 8005419 - DNA, 22 bp, Homo sapiens
ctggcccaggaagacgtgtccc

SEQ ID NO: 8005420 - DNA, 22 bp, Homo sapiens
ctggcccaggagagcaggcatt

SEQ ID NO: 8005421 - DNA, 22 bp, Homo sapiens
ctggcccaggagagcaggcatt

SEQ ID NO: 8005422 - DNA, 22 bp, Homo sapiens
ctggcccaggagagcaggcatt

SEQ ID NO: 8005423 - DNA, 22 bp, Homo sapiens
ctggcccaggagagcaggcatt

SEQ ID NO: 8005424 - DNA, 22 bp, Homo sapiens
ctggcccaggagagcaggcatt

SEQ ID NO: 8005425 - DNA, 22 bp, Homo sapiens
ctggcccaggagagcaggcatt

SEQ ID NO: 8005426 - DNA, 22 bp, Homo sapiens
ctggcccaggagagcaggcatt

SEQ ID NO: 8005427 - DNA, 20 bp, Homo sapiens
ctggcccaggatgatggcgc

SEQ ID NO: 8005428 - DNA, 20 bp, Homo sapiens
ctggcccaggatgatggcgc

SEQ ID NO: 8005429 - DNA, 20 bp, Homo sapiens
ctggcccaggatgatggcgc

SEQ ID NO: 8005430 - DNA, 22 bp, Homo sapiens
ctggcccagagctctggccttt

SEQ ID NO: 8005431 - DNA, 22 bp, Homo sapiens
ctggcccagagctctggccttt

SEQ ID NO: 8005432 - DNA, 22 bp, Homo sapiens
ctggcccagagctctggccttt

SEQ ID NO: 8005433 - DNA, 22 bp, Homo sapiens
ctggcccagagctctggccttt

SEQ ID NO: 8005434 - DNA, 22 bp, Homo sapiens
ctggcccagagagcagagctta

SEQ ID NO: 8005435 - DNA, 22 bp, Homo sapiens
ctggcccagagctctggccttt

SEQ ID NO: 8005436 - DNA, 22 bp, Homo sapiens
ctggcccagagctctggccttt

SEQ ID NO: 8005437 - DNA, 22 bp, Homo sapiens
ctggcccaggaagacgtgtccc

SEQ ID NO: 8005438 - DNA, 21 bp, Homo sapiens
ctggcccagggatctgcattt

SEQ ID NO: 8005439 - DNA, 21 bp, Homo sapiens
ctggcccagggatctgcattt

SEQ ID NO: 8005440 - DNA, 22 bp, Homo sapiens
ctggcccaggctcctggggcac

SEQ ID NO: 8005441 - DNA, 21 bp, Homo sapiens
ctggcccagggatctgcattt

SEQ ID NO: 8005442 - DNA, 21 bp, Homo sapiens
ctggcccagggatctgcattt

SEQ ID NO: 8005443 - DNA, 23 bp, Homo sapiens
ctggcccaggtgagaggttggtg

SEQ ID NO: 8005444 - DNA, 23 bp, Homo sapiens
ctggcccaggtgagaggttggtg

SEQ ID NO: 8005445 - DNA, 23 bp, Homo sapiens
ctggcccaggtgagaggttggtg

SEQ ID NO: 8005446 - DNA, 21 bp, Homo sapiens
ctggcccagggatctgcattt

SEQ ID NO: 8005447 - DNA, 23 bp, Homo sapiens
ctggcccaggtgagaggttggtg

SEQ ID NO: 8005448 - DNA, 22 bp, Homo sapiens
ctggcccaggctcctggggcac

SEQ ID NO: 8005449 - DNA, 22 bp, Homo sapiens
ctggcccaggctcctggggcac

SEQ ID NO: 8005450 - DNA, 22 bp, Homo sapiens
ctggcccaggctcctggggcac

SEQ ID NO: 8005451 - DNA, 22 bp, Homo sapiens
ctggcccaggctcctggggcac

SEQ ID NO: 8005452 - DNA, 22 bp, Homo sapiens
ctggcccaggctcctggggcac

SEQ ID NO: 8005453 - DNA, 20 bp, Homo sapiens
ctggcccaggatgatggcgc

SEQ ID NO: 8005454 - DNA, 20 bp, Homo sapiens
ctggcccaggatgatggcgc

SEQ ID NO: 8005455 - DNA, 20 bp, Homo sapiens
ctggcccaggatgatggcgc

SEQ ID NO: 8005456 - DNA, 22 bp, Homo sapiens
ctggcccaggctcctggggcac

SEQ ID NO: 8005457 - DNA, 22 bp, Homo sapiens
ctggcccaggctcctggggcac

SEQ ID NO: 8005458 - DNA, 22 bp, Homo sapiens
ctggagtagccggacgggtctg

SEQ ID NO: 8005459 - DNA, 22 bp, Homo sapiens
ctggaggtttattattttagat

SEQ ID NO: 8005460 - DNA, 22 bp, Homo sapiens
ctggagtagccggacgggtctg

SEQ ID NO: 8005461 - DNA, 22 bp, Homo sapiens
ctggagtagccggacgggtctg

SEQ ID NO: 8005462 - DNA, 22 bp, Homo sapiens
ctggaggtgggggcaagagtgt

SEQ ID NO: 8005463 - DNA, 22 bp, Homo sapiens
ctggaggtgggggcaagagtgt

SEQ ID NO: 8005464 - DNA, 22 bp, Homo sapiens
ctggaggttgggtccaggccag

SEQ ID NO: 8005465 - DNA, 22 bp, Homo sapiens
ctggaggtgcctagatgagctc

SEQ ID NO: 8005466 - DNA, 22 bp, Homo sapiens
ctggaggtgcctagatgagctc

SEQ ID NO: 8005467 - DNA, 22 bp, Homo sapiens
ctggaggtctacagtggtagct

SEQ ID NO: 8005468 - DNA, 22 bp, Homo sapiens
ctggaggtgcctagatgagctc

SEQ ID NO: 8005469 - DNA, 22 bp, Homo sapiens
ctggaggtgcctagatgagctc

SEQ ID NO: 8005470 - DNA, 22 bp, Homo sapiens
ctggaggtgcttcgctggccac

SEQ ID NO: 8005471 - DNA, 22 bp, Homo sapiens
ctggaggtgcttcgctggccac

SEQ ID NO: 8005472 - DNA, 22 bp, Homo sapiens
ctggaggtgggggcaagagtgt

SEQ ID NO: 8005473 - DNA, 18 bp, Homo sapiens
ctggagtcacagtgggga

SEQ ID NO: 8005474 - DNA, 18 bp, Homo sapiens
ctggagtcacagtgggga

SEQ ID NO: 8005475 - DNA, 22 bp, Homo sapiens
ctggagtcacacacaccaaggt

SEQ ID NO: 8005476 - DNA, 22 bp, Homo sapiens
ctggagtcacacacaccaaggt

SEQ ID NO: 8005477 - DNA, 22 bp, Homo sapiens
ctggagtcactcatgtagctgc

SEQ ID NO: 8005478 - DNA, 22 bp, Homo sapiens
ctggagtcagcaaggacgaggc

SEQ ID NO: 8005479 - DNA, 22 bp, Homo sapiens
ctggagtcactcatgtagctgc

SEQ ID NO: 8005480 - DNA, 22 bp, Homo sapiens
ctggagtcactcatgtagctgc

SEQ ID NO: 8005481 - DNA, 22 bp, Homo sapiens
ctggagtcagcaaggacgaggc

SEQ ID NO: 8005482 - DNA, 21 bp, Homo sapiens
ctggagtcattttctgagtag

SEQ ID NO: 8005483 - DNA, 22 bp, Homo sapiens
ctggagtctccccaggagcgtg

SEQ ID NO: 8005484 - DNA, 20 bp, Homo sapiens
ctggagtctaggagtactgg

SEQ ID NO: 8005485 - DNA, 21 bp, Homo sapiens
ctggagtcattttctgagtag

SEQ ID NO: 8005486 - DNA, 22 bp, Homo sapiens
ctggagtcggcgccccaacaga

SEQ ID NO: 8005487 - DNA, 22 bp, Homo sapiens
ctggagtgttatggtcaagtca

SEQ ID NO: 8005488 - DNA, 22 bp, Homo sapiens
ctggagttctatgtgcttgtga

SEQ ID NO: 8005489 - DNA, 22 bp, Homo sapiens
ctggagttagagtagacactga

SEQ ID NO: 8005490 - DNA, 22 bp, Homo sapiens
ctggagttcgactgagttgaat

SEQ ID NO: 8005491 - DNA, 22 bp, Homo sapiens
ctggagtttgtggcttgctcaa

SEQ ID NO: 8005492 - DNA, 22 bp, Homo sapiens
ctggagttttggaaaaatgctt

SEQ ID NO: 8005493 - DNA, 22 bp, Homo sapiens
ctggagttgggatgtgcctgga

SEQ ID NO: 8005494 - DNA, 22 bp, Homo sapiens
ctggagttcttgttttgcctac

SEQ ID NO: 8005495 - DNA, 22 bp, Homo sapiens
ctggagttgggatgtgcctgga

SEQ ID NO: 8005496 - DNA, 22 bp, Homo sapiens
ctggagtttgtggcttgctcaa

SEQ ID NO: 8005497 - DNA, 20 bp, Homo sapiens
ctggagtgtagcagtggctg

SEQ ID NO: 8005498 - DNA, 20 bp, Homo sapiens
ctggagtgtagcagtggctg

SEQ ID NO: 8005499 - DNA, 20 bp, Homo sapiens
ctggagtgtagcagtggctg

SEQ ID NO: 8005500 - DNA, 20 bp, Homo sapiens
ctggagtgtagcagtggctg

SEQ ID NO: 8005501 - DNA, 20 bp, Homo sapiens
ctggagtgtagcagtggctg

SEQ ID NO: 8005502 - DNA, 22 bp, Homo sapiens
ctggagtgtaaagagcatagaa

SEQ ID NO: 8005503 - DNA, 20 bp, Homo sapiens
ctggagtgtagcagtggctg

SEQ ID NO: 8005504 - DNA, 20 bp, Homo sapiens
ctggagtgtagcagtggctg

SEQ ID NO: 8005505 - DNA, 22 bp, Homo sapiens
ctggagtgttatggtcaagtca

SEQ ID NO: 8005506 - DNA, 20 bp, Homo sapiens
ctggagtgtagcagtggctg

SEQ ID NO: 8005507 - DNA, 20 bp, Homo sapiens
ctggagtgtagcagtggctg

SEQ ID NO: 8005508 - DNA, 22 bp, Homo sapiens
ctggagtgtaaagagcatagaa

SEQ ID NO: 8005509 - DNA, 22 bp, Homo sapiens
ctggagtgtaaagagcatagaa

SEQ ID NO: 8005510 - DNA, 22 bp, Homo sapiens
ctggagtctcttctgtagctac

SEQ ID NO: 8005511 - DNA, 22 bp, Homo sapiens
ctggagtgtaaagagcatagaa

SEQ ID NO: 8005512 - DNA, 22 bp, Homo sapiens
ctggagtctcttctgtagctac

SEQ ID NO: 8005513 - DNA, 22 bp, Homo sapiens
ctggagtctccccaggagcgtg

SEQ ID NO: 8005514 - DNA, 22 bp, Homo sapiens
ctggagtctccccaggagcgtg

SEQ ID NO: 8005515 - DNA, 22 bp, Homo sapiens
ctggagggagattcaaaggagg

SEQ ID NO: 8005516 - DNA, 22 bp, Homo sapiens
ctggagggctggactaaggaaa

SEQ ID NO: 8005517 - DNA, 22 bp, Homo sapiens
ctggagggactttctcacggat

SEQ ID NO: 8005518 - DNA, 22 bp, Homo sapiens
ctggagggactttctcacggat

SEQ ID NO: 8005519 - DNA, 22 bp, Homo sapiens
ctggagggactttctcacggat

SEQ ID NO: 8005520 - DNA, 22 bp, Homo sapiens
ctggagggactttctcacggat

SEQ ID NO: 8005521 - DNA, 22 bp, Homo sapiens
ctggagggcttctgcaggttac

SEQ ID NO: 8005522 - DNA, 22 bp, Homo sapiens
ctggaggggctggcatggtagc

SEQ ID NO: 8005523 - DNA, 22 bp, Homo sapiens
ctggaggggctggcatggtagc

SEQ ID NO: 8005524 - DNA, 22 bp, Homo sapiens
ctggaggggctggcatggtagc

SEQ ID NO: 8005525 - DNA, 22 bp, Homo sapiens
ctggagggggaaatgttcattg

SEQ ID NO: 8005526 - DNA, 22 bp, Homo sapiens
ctggaggtctacagtggtagct

SEQ ID NO: 8005527 - DNA, 22 bp, Homo sapiens
ctggaggtctacagtggtagct

SEQ ID NO: 8005528 - DNA, 22 bp, Homo sapiens
ctggaggtcatgtaatatggaa

SEQ ID NO: 8005529 - DNA, 22 bp, Homo sapiens
ctggaggtcacccttagaacat

SEQ ID NO: 8005530 - DNA, 22 bp, Homo sapiens
ctggaggtcacccttagaacat

SEQ ID NO: 8005531 - DNA, 22 bp, Homo sapiens
ctggaggtcacccttagaacat

SEQ ID NO: 8005532 - DNA, 22 bp, Homo sapiens
ctggaggtcaagtccccccttg

SEQ ID NO: 8005533 - DNA, 19 bp, Homo sapiens
ctggaggtagagggttagt

SEQ ID NO: 8005534 - DNA, 22 bp, Homo sapiens
ctggaggtagatggtggtaatg

SEQ ID NO: 8005535 - DNA, 22 bp, Homo sapiens
ctggaggtagatggtggtaatg

SEQ ID NO: 8005536 - DNA, 19 bp, Homo sapiens
ctggaggtagagggttagt

SEQ ID NO: 8005537 - DNA, 22 bp, Homo sapiens
ctggaggtaatgttatttttgt

SEQ ID NO: 8005538 - DNA, 22 bp, Homo sapiens
ctggagggtggagagaagtctc

SEQ ID NO: 8005539 - DNA, 22 bp, Homo sapiens
ctggaggtaagaggccctgggc

SEQ ID NO: 8005540 - DNA, 22 bp, Homo sapiens
ctggagggtgagcctcatctct

SEQ ID NO: 8005541 - DNA, 22 bp, Homo sapiens
ctggagggggaaatgttcattg

SEQ ID NO: 8005542 - DNA, 21 bp, Homo sapiens
ctggagggtagagttgggctg

SEQ ID NO: 8005543 - DNA, 21 bp, Homo sapiens
ctggagggtagagttgggctg

SEQ ID NO: 8005544 - DNA, 21 bp, Homo sapiens
ctggagggtagagttgggctg

SEQ ID NO: 8005545 - DNA, 21 bp, Homo sapiens
ctggagggtagagttgggctg

SEQ ID NO: 8005546 - DNA, 21 bp, Homo sapiens
ctggagggtagagttgggctg

SEQ ID NO: 8005547 - DNA, 22 bp, Homo sapiens
ctggaggagcatggactggagt

SEQ ID NO: 8005548 - DNA, 22 bp, Homo sapiens
ctggaggagcatggactggagt

SEQ ID NO: 8005549 - DNA, 22 bp, Homo sapiens
ctggaggagcatggactggagt

SEQ ID NO: 8005550 - DNA, 22 bp, Homo sapiens
ctggaggcaaagcagaggcatg

SEQ ID NO: 8005551 - DNA, 22 bp, Homo sapiens
ctggaggcaaagcagaggcatg

SEQ ID NO: 8005552 - DNA, 22 bp, Homo sapiens
ctggaggaggaagtctacaatg

SEQ ID NO: 8005553 - DNA, 22 bp, Homo sapiens
ctggaggcaaagcagaggcatg

SEQ ID NO: 8005554 - DNA, 22 bp, Homo sapiens
ctggaggcaaagcagaggcatg

SEQ ID NO: 8005555 - DNA, 22 bp, Homo sapiens
ctggaggcacccttagagaggc

SEQ ID NO: 8005556 - DNA, 22 bp, Homo sapiens
ctggaggcacccttagagaggc

SEQ ID NO: 8005557 - DNA, 22 bp, Homo sapiens
ctggaggcacccttagagaggc

SEQ ID NO: 8005558 - DNA, 22 bp, Homo sapiens
ctggaggcaaagcagaggcatg

SEQ ID NO: 8005559 - DNA, 22 bp, Homo sapiens
ctggaggcaaagcagaggcatg

SEQ ID NO: 8005560 - DNA, 22 bp, Homo sapiens
ctggaggacccctgcctggaag

SEQ ID NO: 8005561 - DNA, 22 bp, Homo sapiens
ctggaggagaacttgaggaagg

SEQ ID NO: 8005562 - DNA, 22 bp, Homo sapiens
ctggaggagaacttgaggaagg

SEQ ID NO: 8005563 - DNA, 22 bp, Homo sapiens
ctggaggacccctgcctggaag

SEQ ID NO: 8005564 - DNA, 22 bp, Homo sapiens
ctggaggagcaatatggttagg

SEQ ID NO: 8005565 - DNA, 22 bp, Homo sapiens
ctggaggagagtctgaatgaca

SEQ ID NO: 8005566 - DNA, 21 bp, Homo sapiens
ctggaggcaggtggtgccagg

SEQ ID NO: 8005567 - DNA, 21 bp, Homo sapiens
ctggaggcaggtggtgccagg

SEQ ID NO: 8005568 - DNA, 21 bp, Homo sapiens
ctggaggcaggtggtgccagg

SEQ ID NO: 8005569 - DNA, 21 bp, Homo sapiens
ctggaggcaggtggtgccagg

SEQ ID NO: 8005570 - DNA, 21 bp, Homo sapiens
ctggaggcaggtggtgccagg

SEQ ID NO: 8005571 - DNA, 21 bp, Homo sapiens
ctggaggcaggtggtgccagg

SEQ ID NO: 8005572 - DNA, 21 bp, Homo sapiens
ctggaggcaggtggtgccagg

SEQ ID NO: 8005573 - DNA, 21 bp, Homo sapiens
ctggaggcaggtggtgccagg

SEQ ID NO: 8005574 - DNA, 21 bp, Homo sapiens
ctggaggcaggtggtgccagg

SEQ ID NO: 8005575 - DNA, 22 bp, Homo sapiens
ctggaggcacccttagagaggc

SEQ ID NO: 8005576 - DNA, 22 bp, Homo sapiens
ctggaggcacccttagagaggc

SEQ ID NO: 8005577 - DNA, 22 bp, Homo sapiens
ctggaggctggcttcccctggc

SEQ ID NO: 8005578 - DNA, 22 bp, Homo sapiens
ctggaggctggcttcccctggc

SEQ ID NO: 8005579 - DNA, 22 bp, Homo sapiens
ctggaggctgagttgggtctcc

SEQ ID NO: 8005580 - DNA, 22 bp, Homo sapiens
ctggaggctggcttcccctggc

SEQ ID NO: 8005581 - DNA, 22 bp, Homo sapiens
ctggaggctggcttcccctggc

SEQ ID NO: 8005582 - DNA, 22 bp, Homo sapiens
ctggaggctggcttcccctggc

SEQ ID NO: 8005583 - DNA, 22 bp, Homo sapiens
ctggaggctgagttgggtctcc

SEQ ID NO: 8005584 - DNA, 22 bp, Homo sapiens
ctggaggccactgtacagattg

SEQ ID NO: 8005585 - DNA, 22 bp, Homo sapiens
ctggaggcagttgccccagtca

SEQ ID NO: 8005586 - DNA, 22 bp, Homo sapiens
ctggaggctgagttgggtctcc

SEQ ID NO: 8005587 - DNA, 22 bp, Homo sapiens
ctggaggctgagttgggtctcc

SEQ ID NO: 8005588 - DNA, 22 bp, Homo sapiens
ctggaggctgagttgggtctcc

SEQ ID NO: 8005589 - DNA, 22 bp, Homo sapiens
ctggaccctgtttccctaggtc

SEQ ID NO: 8005590 - DNA, 19 bp, Homo sapiens
ctggacctggaggcccgga

SEQ ID NO: 8005591 - DNA, 19 bp, Homo sapiens
ctggacctggaggcccgga

SEQ ID NO: 8005592 - DNA, 22 bp, Homo sapiens
ctggaccctgtttccctaggtc

SEQ ID NO: 8005593 - DNA, 22 bp, Homo sapiens
ctggactcactatggcttcaga

SEQ ID NO: 8005594 - DNA, 22 bp, Homo sapiens
ctggacatttcgcacccttcca

SEQ ID NO: 8005595 - DNA, 22 bp, Homo sapiens
ctggacatcagtgtgcctggct

SEQ ID NO: 8005596 - DNA, 22 bp, Homo sapiens
ctggaccagaaaggacatggct

SEQ ID NO: 8005597 - DNA, 22 bp, Homo sapiens
ctggaccagaaaggacatggct

SEQ ID NO: 8005598 - DNA, 22 bp, Homo sapiens
ctggacagtgggcagaggagac

SEQ ID NO: 8005599 - DNA, 22 bp, Homo sapiens
ctggacagtgggcagaggagac

SEQ ID NO: 8005600 - DNA, 21 bp, Homo sapiens
ctggactgaggagacagtcgc

SEQ ID NO: 8005601 - DNA, 22 bp, Homo sapiens
ctggacttacttgctgaggact

SEQ ID NO: 8005602 - DNA, 21 bp, Homo sapiens
ctggactgaggagacagtcgc

SEQ ID NO: 8005603 - DNA, 22 bp, Homo sapiens
ctggacttaggcaggcaccccg

SEQ ID NO: 8005604 - DNA, 22 bp, Homo sapiens
ctggacttctcttcaaagacag

SEQ ID NO: 8005605 - DNA, 20 bp, Homo sapiens
ctggacttgctgctcacctg

SEQ ID NO: 8005606 - DNA, 22 bp, Homo sapiens
ctggacttggagtcagaaaact

SEQ ID NO: 8005607 - DNA, 22 bp, Homo sapiens
ctggacttggggaggctagatt

SEQ ID NO: 8005608 - DNA, 22 bp, Homo sapiens
ctggactcagggtgctccagcg

SEQ ID NO: 8005609 - DNA, 22 bp, Homo sapiens
ctggactcagggtgctccagcg

SEQ ID NO: 8005610 - DNA, 22 bp, Homo sapiens
ctggactcagggtgctccagcg

SEQ ID NO: 8005611 - DNA, 23 bp, Homo sapiens
ctggactcaggggatgtgaagga

SEQ ID NO: 8005612 - DNA, 22 bp, Homo sapiens
ctggactcatccatagaggtga

SEQ ID NO: 8005613 - DNA, 22 bp, Homo sapiens
ctggactcatccatagaggtga

SEQ ID NO: 8005614 - DNA, 22 bp, Homo sapiens
ctggactcatccatagaggtga

SEQ ID NO: 8005615 - DNA, 22 bp, Homo sapiens
ctggaggaatcacagaaggctt

SEQ ID NO: 8005616 - DNA, 22 bp, Homo sapiens
ctggaggaatcacagaaggctt

SEQ ID NO: 8005617 - DNA, 22 bp, Homo sapiens
ctggaggaataatggcatcttg

SEQ ID NO: 8005618 - DNA, 22 bp, Homo sapiens
ctggaggaatcacagaaggctt

SEQ ID NO: 8005619 - DNA, 22 bp, Homo sapiens
ctggaggaatcacagaaggctt

SEQ ID NO: 8005620 - DNA, 22 bp, Homo sapiens
ctggaggacagaggccatgtct

SEQ ID NO: 8005621 - DNA, 22 bp, Homo sapiens
ctggaggaccacagaagctggt

SEQ ID NO: 8005622 - DNA, 22 bp, Homo sapiens
ctggaggaccacagaagctggt

SEQ ID NO: 8005623 - DNA, 22 bp, Homo sapiens
ctggaggaataatggcatcttg

SEQ ID NO: 8005624 - DNA, 22 bp, Homo sapiens
ctggaggaataatctcctaccc

SEQ ID NO: 8005625 - DNA, 22 bp, Homo sapiens
ctggaggaataatggcatcttg

SEQ ID NO: 8005626 - DNA, 22 bp, Homo sapiens
ctggaggaataatggcatcttg

SEQ ID NO: 8005627 - DNA, 22 bp, Homo sapiens
ctggagctcttctgagtgtgct

SEQ ID NO: 8005628 - DNA, 22 bp, Homo sapiens
ctggagctcttctgagtgtgct

SEQ ID NO: 8005629 - DNA, 22 bp, Homo sapiens
ctggagctgccagacgggcaca

SEQ ID NO: 8005630 - DNA, 22 bp, Homo sapiens
ctggagctcttctgagtgtgct

SEQ ID NO: 8005631 - DNA, 22 bp, Homo sapiens
ctggagctctgtgtgttcctga

SEQ ID NO: 8005632 - DNA, 22 bp, Homo sapiens
ctggagctctgtgtgttcctga

SEQ ID NO: 8005633 - DNA, 22 bp, Homo sapiens
ctggagctctgtgtgttcctga

SEQ ID NO: 8005634 - DNA, 22 bp, Homo sapiens
ctggagctctgtgtgttcctga

SEQ ID NO: 8005635 - DNA, 22 bp, Homo sapiens
ctggagctcttctgagtgtgct

SEQ ID NO: 8005636 - DNA, 22 bp, Homo sapiens
ctggagctcttctgagtgtgct

SEQ ID NO: 8005637 - DNA, 22 bp, Homo sapiens
ctggagctcttctgagtgtgct

SEQ ID NO: 8005638 - DNA, 22 bp, Homo sapiens
ctggagctcttctgagtgtgct

SEQ ID NO: 8005639 - DNA, 22 bp, Homo sapiens
ctggagctctccagagccccgt

SEQ ID NO: 8005640 - DNA, 22 bp, Homo sapiens
ctggaaagacagagggcatggg

SEQ ID NO: 8005641 - DNA, 22 bp, Homo sapiens
ctggaaagacagagggcatggg

SEQ ID NO: 8005642 - DNA, 22 bp, Homo sapiens
ctggaaagatttctttggagtc

SEQ ID NO: 8005643 - DNA, 22 bp, Homo sapiens
ctggaaagatttctttggagtc

SEQ ID NO: 8005644 - DNA, 22 bp, Homo sapiens
ctggaaagggtcctcattctgt

SEQ ID NO: 8005645 - DNA, 22 bp, Homo sapiens
ctggaaaatgaagaagcagagg

SEQ ID NO: 8005646 - DNA, 22 bp, Homo sapiens
ctggaaagacagagggcatggg

SEQ ID NO: 8005647 - DNA, 22 bp, Homo sapiens
ctggaaaatgaagaagcagagg

SEQ ID NO: 8005648 - DNA, 22 bp, Homo sapiens
ctggaaaatgaagaagcagagg

SEQ ID NO: 8005649 - DNA, 22 bp, Homo sapiens
ctgcttttgagcccagtgctca

SEQ ID NO: 8005650 - DNA, 22 bp, Homo sapiens
ctgctttttgtaggtcccagag

SEQ ID NO: 8005651 - DNA, 22 bp, Homo sapiens
ctgctttttctaggaggacaat

SEQ ID NO: 8005652 - DNA, 22 bp, Homo sapiens
ctgctttgtaaaatagacataa

SEQ ID NO: 8005653 - DNA, 22 bp, Homo sapiens
ctgctttgggcagctttgtggc

SEQ ID NO: 8005654 - DNA, 22 bp, Homo sapiens
ctgctttgtaaaatagacataa

SEQ ID NO: 8005655 - DNA, 22 bp, Homo sapiens
ctgctttgtggaatcacactgg

SEQ ID NO: 8005656 - DNA, 22 bp, Homo sapiens
ctgctttgcatagctgccagag

SEQ ID NO: 8005657 - DNA, 22 bp, Homo sapiens
ctgctttgcatagctgccagag

SEQ ID NO: 8005658 - DNA, 22 bp, Homo sapiens
ctgctttggctcagtgacatca

SEQ ID NO: 8005659 - DNA, 22 bp, Homo sapiens
ctgctttggcagaagtcagcta

SEQ ID NO: 8005660 - DNA, 22 bp, Homo sapiens
ctgctttggacaactattcttg

SEQ ID NO: 8005661 - DNA, 22 bp, Homo sapiens
ctgctttgactgttaagaacca

SEQ ID NO: 8005662 - DNA, 22 bp, Homo sapiens
ctgctttgactgttaagaacca

SEQ ID NO: 8005663 - DNA, 22 bp, Homo sapiens
ctgctttgcatagctgccagag

SEQ ID NO: 8005664 - DNA, 22 bp, Homo sapiens
ctgctttgattagaagagtaca

SEQ ID NO: 8005665 - DNA, 22 bp, Homo sapiens
ctgctttgattagaagagtaca

SEQ ID NO: 8005666 - DNA, 22 bp, Homo sapiens
ctgctttcttgttgcatcttaa

SEQ ID NO: 8005667 - DNA, 22 bp, Homo sapiens
ctgctttcttgttgcatcttaa

SEQ ID NO: 8005668 - DNA, 22 bp, Homo sapiens
ctgctttgaaaataaacttgtc

SEQ ID NO: 8005669 - DNA, 22 bp, Homo sapiens
ctggaattgcataatatgtcct

SEQ ID NO: 8005670 - DNA, 22 bp, Homo sapiens
ctggaattgcataatatgtcct

SEQ ID NO: 8005671 - DNA, 22 bp, Homo sapiens
ctggaatgttctccagcatggc

SEQ ID NO: 8005672 - DNA, 22 bp, Homo sapiens
ctggaatgttctccagcatggc

SEQ ID NO: 8005673 - DNA, 22 bp, Homo sapiens
ctggaagtggcagtggaaaaga

SEQ ID NO: 8005674 - DNA, 22 bp, Homo sapiens
ctggaattgatagaagggagct

SEQ ID NO: 8005675 - DNA, 22 bp, Homo sapiens
ctggacacactggagtctggca

SEQ ID NO: 8005676 - DNA, 22 bp, Homo sapiens
ctggacactggggatgcgcagt

SEQ ID NO: 8005677 - DNA, 22 bp, Homo sapiens
ctggacacaaacatctcctctg

SEQ ID NO: 8005678 - DNA, 22 bp, Homo sapiens
ctggacacaaacatctcctctg

SEQ ID NO: 8005679 - DNA, 22 bp, Homo sapiens
ctggacaaccacaaggccaata

SEQ ID NO: 8005680 - DNA, 22 bp, Homo sapiens
ctggacagaaaaggccactgga

SEQ ID NO: 8005681 - DNA, 22 bp, Homo sapiens
ctggacagaaaaggccactgga

SEQ ID NO: 8005682 - DNA, 22 bp, Homo sapiens
ctggaaagtacagtgtgtcaca

SEQ ID NO: 8005683 - DNA, 22 bp, Homo sapiens
ctggaaggttctttgtgtgcct

SEQ ID NO: 8005684 - DNA, 23 bp, Homo sapiens
ctggaagtgcttttatagctttg

SEQ ID NO: 8005685 - DNA, 23 bp, Homo sapiens
ctggaagtgcttttatagctttg

SEQ ID NO: 8005686 - DNA, 22 bp, Homo sapiens
ctggaagtggagagtggccctc

SEQ ID NO: 8005687 - DNA, 19 bp, Homo sapiens
ctggaatgtggctggtgca

SEQ ID NO: 8005688 - DNA, 19 bp, Homo sapiens
ctggaatgtggctggtgca

SEQ ID NO: 8005689 - DNA, 22 bp, Homo sapiens
ctggaagtataggggagatgat

SEQ ID NO: 8005690 - DNA, 22 bp, Homo sapiens
ctggaagtataggggagatgat

SEQ ID NO: 8005691 - DNA, 22 bp, Homo sapiens
ctggaagtataggggagatgat

SEQ ID NO: 8005692 - DNA, 22 bp, Homo sapiens
ctggacaggctggggactgcaa

SEQ ID NO: 8005693 - DNA, 22 bp, Homo sapiens
ctggacagtgctgcttgagatg

SEQ ID NO: 8005694 - DNA, 22 bp, Homo sapiens
ctggacagtgggcagaggagac

SEQ ID NO: 8005695 - DNA, 22 bp, Homo sapiens
ctggacagtgctgcttgagatg

SEQ ID NO: 8005696 - DNA, 22 bp, Homo sapiens
ctggacagaagtggctgggcag

SEQ ID NO: 8005697 - DNA, 22 bp, Homo sapiens
ctggacagccctcactgtgtgc

SEQ ID NO: 8005698 - DNA, 22 bp, Homo sapiens
ctggacagccctcactgtgtgc

SEQ ID NO: 8005699 - DNA, 22 bp, Homo sapiens
ctggacaggctggggactgcaa

SEQ ID NO: 8005700 - DNA, 22 bp, Homo sapiens
ctggacagaagtggctgggcag

SEQ ID NO: 8005701 - DNA, 22 bp, Homo sapiens
ctggacagaaagggctgctgtg

SEQ ID NO: 8005702 - DNA, 22 bp, Homo sapiens
ctggacagaagtggctgggcag

SEQ ID NO: 8005703 - DNA, 22 bp, Homo sapiens
ctggacagaagtggctgggcag

SEQ ID NO: 8005704 - DNA, 22 bp, Homo sapiens
ctggacagaaaccagtcctggg

SEQ ID NO: 8005705 - DNA, 22 bp, Homo sapiens
ctggacagaaagggctgctgtg

SEQ ID NO: 8005706 - DNA, 22 bp, Homo sapiens
ctggacagaaagggctgctgtg

SEQ ID NO: 8005707 - DNA, 22 bp, Homo sapiens
ctgcctgctcaccagggctctg

SEQ ID NO: 8005708 - DNA, 22 bp, Homo sapiens
ctgcctgctcaccagggctctg

SEQ ID NO: 8005709 - DNA, 22 bp, Homo sapiens
ctgcctgctcaccagggctctg

SEQ ID NO: 8005710 - DNA, 22 bp, Homo sapiens
ctgcctctataggagtccacca

SEQ ID NO: 8005711 - DNA, 22 bp, Homo sapiens
ctgcctgcgttgcctcgtgcct

SEQ ID NO: 8005712 - DNA, 22 bp, Homo sapiens
ctgcctgcgttgcctcgtgcct

SEQ ID NO: 8005713 - DNA, 22 bp, Homo sapiens
ctgcctggaatgccagcttctc

SEQ ID NO: 8005714 - DNA, 22 bp, Homo sapiens
ctgcctggaatgccagcttctc

SEQ ID NO: 8005715 - DNA, 22 bp, Homo sapiens
ctgcctgctcaccagggctctg

SEQ ID NO: 8005716 - DNA, 22 bp, Homo sapiens
ctgcctggaccggcagccctcc

SEQ ID NO: 8005717 - DNA, 22 bp, Homo sapiens
ctgcctggaccggcagccctcc

SEQ ID NO: 8005718 - DNA, 22 bp, Homo sapiens
ctgcctggagcattctgaaggt

SEQ ID NO: 8005719 - DNA, 22 bp, Homo sapiens
ctgcctggagcattctgaaggt

SEQ ID NO: 8005720 - DNA, 22 bp, Homo sapiens
ctgcctggaccggcagccctcc

SEQ ID NO: 8005721 - DNA, 22 bp, Homo sapiens
ctgcctggaccggcagccctcc

SEQ ID NO: 8005722 - DNA, 22 bp, Homo sapiens
ctgcctggacagctcttacctt

SEQ ID NO: 8005723 - DNA, 22 bp, Homo sapiens
ctgcctggaatgccagcttctc

SEQ ID NO: 8005724 - DNA, 22 bp, Homo sapiens
ctgcctggaatgccagcttctc

SEQ ID NO: 8005725 - DNA, 22 bp, Homo sapiens
ctgcctggacagctcttacctt

SEQ ID NO: 8005726 - DNA, 22 bp, Homo sapiens
ctgcctggccacaacccagggt

SEQ ID NO: 8005727 - DNA, 22 bp, Homo sapiens
ctgcctggccacaacccagggt

SEQ ID NO: 8005728 - DNA, 22 bp, Homo sapiens
ctgcctggccacaacccagggt

SEQ ID NO: 8005729 - DNA, 22 bp, Homo sapiens
ctgcctggccacaacccagggt

SEQ ID NO: 8005730 - DNA, 22 bp, Homo sapiens
ctgcctggcatggagaagagaa

SEQ ID NO: 8005731 - DNA, 22 bp, Homo sapiens
ctgcctggcatggagaagagaa

SEQ ID NO: 8005732 - DNA, 22 bp, Homo sapiens
ctgcctggccacaacccagggt

SEQ ID NO: 8005733 - DNA, 22 bp, Homo sapiens
ctgcctggcatagtctggtcga

SEQ ID NO: 8005734 - DNA, 22 bp, Homo sapiens
ctgcctggcatagtctggtcga

SEQ ID NO: 8005735 - DNA, 22 bp, Homo sapiens
ctgcctggcatagtctggtcga

SEQ ID NO: 8005736 - DNA, 22 bp, Homo sapiens
ctgcctggcatagtctggtcga

SEQ ID NO: 8005737 - DNA, 22 bp, Homo sapiens
ctgcctggcatggagaagagaa

SEQ ID NO: 8005738 - DNA, 22 bp, Homo sapiens
ctgcctggcatggagaagagaa

SEQ ID NO: 8005739 - DNA, 22 bp, Homo sapiens
ctgcctggcatggagaagagaa

SEQ ID NO: 8005740 - DNA, 17 bp, Homo sapiens
ctgcctggagtcccatc

SEQ ID NO: 8005741 - DNA, 17 bp, Homo sapiens
ctgcctggagtcccatc

SEQ ID NO: 8005742 - DNA, 17 bp, Homo sapiens
ctgcctggagtcccatc

SEQ ID NO: 8005743 - DNA, 22 bp, Homo sapiens
ctgcctggatgaatggcgcctt

SEQ ID NO: 8005744 - DNA, 22 bp, Homo sapiens
ctgcctggatgaatggcgcctt

SEQ ID NO: 8005745 - DNA, 22 bp, Homo sapiens
ctgcctggatgaatggcgcctt

SEQ ID NO: 8005746 - DNA, 22 bp, Homo sapiens
ctgcctggatgaatggcgcctt

SEQ ID NO: 8005747 - DNA, 22 bp, Homo sapiens
ctgcctggatgaatggcgcctt

SEQ ID NO: 8005748 - DNA, 22 bp, Homo sapiens
ctgcctggatgaatggcgcctt

SEQ ID NO: 8005749 - DNA, 17 bp, Homo sapiens
ctgcctggagtcccatc

SEQ ID NO: 8005750 - DNA, 17 bp, Homo sapiens
ctgcctggagtcccatc

SEQ ID NO: 8005751 - DNA, 17 bp, Homo sapiens
ctgcctggagtcccatc

SEQ ID NO: 8005752 - DNA, 20 bp, Homo sapiens
ctgcctggaggcctctacct

SEQ ID NO: 8005753 - DNA, 20 bp, Homo sapiens
ctgcctggaggcctctacct

SEQ ID NO: 8005754 - DNA, 20 bp, Homo sapiens
ctgcctggaggcctctacct

SEQ ID NO: 8005755 - DNA, 20 bp, Homo sapiens
ctgcctggaggcctctacct

SEQ ID NO: 8005756 - DNA, 22 bp, Homo sapiens
ctgcctggagcattctgaaggt

SEQ ID NO: 8005757 - DNA, 20 bp, Homo sapiens
ctgcctggaggcctctacct

SEQ ID NO: 8005758 - DNA, 22 bp, Homo sapiens
ctgctttagacaactgctggga

SEQ ID NO: 8005759 - DNA, 22 bp, Homo sapiens
ctgctttagctagtgctcttag

SEQ ID NO: 8005760 - DNA, 22 bp, Homo sapiens
ctgctttagagctgagcctcag

SEQ ID NO: 8005761 - DNA, 22 bp, Homo sapiens
ctgctttagacggctttcgctg

SEQ ID NO: 8005762 - DNA, 21 bp, Homo sapiens
ctgctttacttcagaggatct

SEQ ID NO: 8005763 - DNA, 21 bp, Homo sapiens
ctgctttacttcagaggatct

SEQ ID NO: 8005764 - DNA, 22 bp, Homo sapiens
ctgctttactcatagggtttca

SEQ ID NO: 8005765 - DNA, 22 bp, Homo sapiens
ctgcttctaagaacctgcagct

SEQ ID NO: 8005766 - DNA, 22 bp, Homo sapiens
ctgcttctaagaacctgcagct

SEQ ID NO: 8005767 - DNA, 22 bp, Homo sapiens
ctgcttctaagaacctgcagct

SEQ ID NO: 8005768 - DNA, 22 bp, Homo sapiens
ctgctttagtgtggtgttagag

SEQ ID NO: 8005769 - DNA, 22 bp, Homo sapiens
ctgctttatagggcttccatgt

SEQ ID NO: 8005770 - DNA, 22 bp, Homo sapiens
ctgctttaggtggaatgttcta

SEQ ID NO: 8005771 - DNA, 19 bp, Homo sapiens
ctgctttaggccttaaaag

SEQ ID NO: 8005772 - DNA, 23 bp, Homo sapiens
ctgctttcccactccatgctctt

SEQ ID NO: 8005773 - DNA, 23 bp, Homo sapiens
ctgctttcccactccatgctctt

SEQ ID NO: 8005774 - DNA, 23 bp, Homo sapiens
ctgctttcccactccatgctctt

SEQ ID NO: 8005775 - DNA, 23 bp, Homo sapiens
ctgctttcccactccatgctctt

SEQ ID NO: 8005776 - DNA, 22 bp, Homo sapiens
ctgctttatctgagacaagtca

SEQ ID NO: 8005777 - DNA, 22 bp, Homo sapiens
ctgctttatctgagacaagtca

SEQ ID NO: 8005778 - DNA, 22 bp, Homo sapiens
ctgctttatattgagcttgaaa

SEQ ID NO: 8005779 - DNA, 22 bp, Homo sapiens
ctgcctggctaaactcaagtcg

SEQ ID NO: 8005780 - DNA, 22 bp, Homo sapiens
ctgcctgggccatgcccagtcc

SEQ ID NO: 8005781 - DNA, 22 bp, Homo sapiens
ctgcctggctaaactcaagtcg

SEQ ID NO: 8005782 - DNA, 22 bp, Homo sapiens
ctgcctggcctgatctccacgc

SEQ ID NO: 8005783 - DNA, 22 bp, Homo sapiens
ctgcctggcctgatctccacgc

SEQ ID NO: 8005784 - DNA, 22 bp, Homo sapiens
ctgcctggcctgatctccacgc

SEQ ID NO: 8005785 - DNA, 22 bp, Homo sapiens
ctgcctggcccagggatgggcc

SEQ ID NO: 8005786 - DNA, 22 bp, Homo sapiens
ctgcctggcccagggatgggcc

SEQ ID NO: 8005787 - DNA, 22 bp, Homo sapiens
ctgcctggcccagggatgggcc

SEQ ID NO: 8005788 - DNA, 22 bp, Homo sapiens
ctgcctggcccagggatgggcc

SEQ ID NO: 8005789 - DNA, 22 bp, Homo sapiens
ctgcctggcccagggatgggcc

SEQ ID NO: 8005790 - DNA, 22 bp, Homo sapiens
ctgcctggcccagggatgggcc

SEQ ID NO: 8005791 - DNA, 22 bp, Homo sapiens
ctgcctggcccagggatgggcc

SEQ ID NO: 8005792 - DNA, 22 bp, Homo sapiens
ctgcctgggccggccaccctct

SEQ ID NO: 8005793 - DNA, 22 bp, Homo sapiens
ctgcctgggccatgcccagtcc

SEQ ID NO: 8005794 - DNA, 22 bp, Homo sapiens
ctgcctgggccatgcccagtcc

SEQ ID NO: 8005795 - DNA, 22 bp, Homo sapiens
ctgcctgggccatgcccagtcc

SEQ ID NO: 8005796 - DNA, 22 bp, Homo sapiens
ctgcctggggaatgtgaggatt

SEQ ID NO: 8005797 - DNA, 22 bp, Homo sapiens
ctgcctgggccggccaccctct

SEQ ID NO: 8005798 - DNA, 22 bp, Homo sapiens
ctgcctgggccggccaccctct

SEQ ID NO: 8005799 - DNA, 22 bp, Homo sapiens
ctgcttctaagaacctgcagct

SEQ ID NO: 8005800 - DNA, 22 bp, Homo sapiens
ctgcttctaagaacctgcagct

SEQ ID NO: 8005801 - DNA, 19 bp, Homo sapiens
ctgcttccttccctcactg

SEQ ID NO: 8005802 - DNA, 22 bp, Homo sapiens
ctgcctgggccggccaccctct

SEQ ID NO: 8005803 - DNA, 19 bp, Homo sapiens
ctgcttccttccctcactg

SEQ ID NO: 8005804 - DNA, 22 bp, Homo sapiens
ccctggctcaggcagctttgtt

SEQ ID NO: 8005805 - DNA, 22 bp, Homo sapiens
ccctggctcaggcagctttgtt

SEQ ID NO: 8005806 - DNA, 23 bp, Homo sapiens
ccctggccttggggcacaggctg

SEQ ID NO: 8005807 - DNA, 22 bp, Homo sapiens
ccctggctatttttacgcaagg

SEQ ID NO: 8005808 - DNA, 23 bp, Homo sapiens
ccctggccttggggcacaggctg

SEQ ID NO: 8005809 - DNA, 23 bp, Homo sapiens
ccctggccttggggcacaggctg

SEQ ID NO: 8005810 - DNA, 17 bp, Homo sapiens
ccctggctctaggtgga

SEQ ID NO: 8005811 - DNA, 17 bp, Homo sapiens
ccctggctctaggtgga

SEQ ID NO: 8005812 - DNA, 17 bp, Homo sapiens
ccctggctctaggtgga

SEQ ID NO: 8005813 - DNA, 17 bp, Homo sapiens
ccctggctctaggtgga

SEQ ID NO: 8005814 - DNA, 22 bp, Homo sapiens
ccctggctctgcctcagagccc

SEQ ID NO: 8005815 - DNA, 22 bp, Homo sapiens
ccctggctctgcctcagagccc

SEQ ID NO: 8005816 - DNA, 17 bp, Homo sapiens
ccctggctctaggtgga

SEQ ID NO: 8005817 - DNA, 22 bp, Homo sapiens
ccctggctgccagtcaccagac

SEQ ID NO: 8005818 - DNA, 22 bp, Homo sapiens
ccctggctgccagtcaccagac

SEQ ID NO: 8005819 - DNA, 22 bp, Homo sapiens
ccctggctgataccggaaaggc

SEQ ID NO: 8005820 - DNA, 22 bp, Homo sapiens
ccctggctgataccggaaaggc

SEQ ID NO: 8005821 - DNA, 22 bp, Homo sapiens
ccctggctcttcaccacctgcc

SEQ ID NO: 8005822 - DNA, 22 bp, Homo sapiens
ccctggctcttcaccacctgcc

SEQ ID NO: 8005823 - DNA, 22 bp, Homo sapiens
ccctggctcttcaccacctgcc

SEQ ID NO: 8005824 - DNA, 22 bp, Homo sapiens
ccctggctctgcctcagagccc

SEQ ID NO: 8005825 - DNA, 22 bp, Homo sapiens
ccctggctcttcaccacctgcc

SEQ ID NO: 8005826 - DNA, 20 bp, Homo sapiens
ccctggcctgtttcatgccc

SEQ ID NO: 8005827 - DNA, 20 bp, Homo sapiens
ccctggcctgtttcatgccc

SEQ ID NO: 8005828 - DNA, 22 bp, Homo sapiens
ccctggcctccaggcagtcctg

SEQ ID NO: 8005829 - DNA, 20 bp, Homo sapiens
ccctggcctgtttcatgccc

SEQ ID NO: 8005830 - DNA, 20 bp, Homo sapiens
ccctggcctgtttcatgccc

SEQ ID NO: 8005831 - DNA, 23 bp, Homo sapiens
ccctggccttggggcacaggctg

SEQ ID NO: 8005832 - DNA, 22 bp, Homo sapiens
ccctggcctacaggcccagaga

SEQ ID NO: 8005833 - DNA, 22 bp, Homo sapiens
ccctggcctccaggcagtcctg

SEQ ID NO: 8005834 - DNA, 22 bp, Homo sapiens
ccctggcctccaggcagtcctg

SEQ ID NO: 8005835 - DNA, 18 bp, Homo sapiens
tggagctgagggcaatgc

SEQ ID NO: 8005836 - DNA, 22 bp, Homo sapiens
ccctggatttacatcattctga

SEQ ID NO: 8005837 - DNA, 18 bp, Homo sapiens
tggagctgagggcaatgc

SEQ ID NO: 8005838 - DNA, 18 bp, Homo sapiens
tggagctgagggcaatgc

SEQ ID NO: 8005839 - DNA, 22 bp, Homo sapiens
ccctggcaaaatccctggtaca

SEQ ID NO: 8005840 - DNA, 22 bp, Homo sapiens
ccctggcctacaggcccagaga

SEQ ID NO: 8005841 - DNA, 22 bp, Homo sapiens
tggagctgagcacctccagggc

SEQ ID NO: 8005842 - DNA, 22 bp, Homo sapiens
tggagctgagcacctccagggc

SEQ ID NO: 8005843 - DNA, 22 bp, Homo sapiens
tggagctgagcacctccagggc

SEQ ID NO: 8005844 - DNA, 22 bp, Homo sapiens
tggagctgagcacctccagggc

SEQ ID NO: 8005845 - DNA, 22 bp, Homo sapiens
tggagctgagagccaggctggc

SEQ ID NO: 8005846 - DNA, 18 bp, Homo sapiens
tggagctgagggcaatgc

SEQ ID NO: 8005847 - DNA, 18 bp, Homo sapiens
tggagctgagggcaatgc

SEQ ID NO: 8005848 - DNA, 18 bp, Homo sapiens
tggagctgagggcaatgc

SEQ ID NO: 8005849 - DNA, 18 bp, Homo sapiens
tggagctgagggcaatgc

SEQ ID NO: 8005850 - DNA, 17 bp, Homo sapiens
tggcaagaatggaaatg

SEQ ID NO: 8005851 - DNA, 17 bp, Homo sapiens
tggcaagaatggaaatg

SEQ ID NO: 8005852 - DNA, 22 bp, Homo sapiens
tggcaagaatattggaccagaa

SEQ ID NO: 8005853 - DNA, 22 bp, Homo sapiens
tggcaagaatattggaccagaa

SEQ ID NO: 8005854 - DNA, 22 bp, Homo sapiens
tggcaagaatattggaccagaa

SEQ ID NO: 8005855 - DNA, 22 bp, Homo sapiens
tggcaagaaactgaggcctgct

SEQ ID NO: 8005856 - DNA, 22 bp, Homo sapiens
tggcaagaaactgaggcctgct

SEQ ID NO: 8005857 - DNA, 22 bp, Homo sapiens
tggcaactcctgactctactca

SEQ ID NO: 8005858 - DNA, 22 bp, Homo sapiens
tggcaaggaagagcctggtgca

SEQ ID NO: 8005859 - DNA, 23 bp, Homo sapiens
tggcaaggaatgggatggagact

SEQ ID NO: 8005860 - DNA, 22 bp, Homo sapiens
tggcaagctgggttgggtagcc

SEQ ID NO: 8005861 - DNA, 22 bp, Homo sapiens
tggcaagagggatgcaaggttt

SEQ ID NO: 8005862 - DNA, 22 bp, Homo sapiens
tggcaagagcaaaatgtacagt

SEQ ID NO: 8005863 - DNA, 22 bp, Homo sapiens
tggcaagagggatgcaaggttt

SEQ ID NO: 8005864 - DNA, 22 bp, Homo sapiens
tggcaagagggatgcaaggttt

SEQ ID NO: 8005865 - DNA, 22 bp, Homo sapiens
tggcaagagggatgcaaggttt

SEQ ID NO: 8005866 - DNA, 17 bp, Homo sapiens
tggcaagacagctcagg

SEQ ID NO: 8005867 - DNA, 17 bp, Homo sapiens
tggcaagacagctcagg

SEQ ID NO: 8005868 - DNA, 17 bp, Homo sapiens
tggcaagacagctcagg

SEQ ID NO: 8005869 - DNA, 17 bp, Homo sapiens
tggcaagacagctcagg

SEQ ID NO: 8005870 - DNA, 22 bp, Homo sapiens
tggatctcggcaatgcgggact

SEQ ID NO: 8005871 - DNA, 22 bp, Homo sapiens
tggatctcggcaatgcgggact

SEQ ID NO: 8005872 - DNA, 22 bp, Homo sapiens
tggatctatctccaggggtcct

SEQ ID NO: 8005873 - DNA, 22 bp, Homo sapiens
tggatcatgtgatgtcaggagt

SEQ ID NO: 8005874 - DNA, 22 bp, Homo sapiens
tggatcatcttaagaagtgatt

SEQ ID NO: 8005875 - DNA, 22 bp, Homo sapiens
tggatctgactggcttttcttc

SEQ ID NO: 8005876 - DNA, 22 bp, Homo sapiens
tggatctgctctatgaactgct

SEQ ID NO: 8005877 - DNA, 22 bp, Homo sapiens
tggatctgacaaggacgggaaa

SEQ ID NO: 8005878 - DNA, 21 bp, Homo sapiens
tggatctgtgatctggggcac

SEQ ID NO: 8005879 - DNA, 22 bp, Homo sapiens
tggatctgattaggggagccag

SEQ ID NO: 8005880 - DNA, 22 bp, Homo sapiens
tggatctggttccctgagcctt

SEQ ID NO: 8005881 - DNA, 22 bp, Homo sapiens
tggatctggttccctgagcctt

SEQ ID NO: 8005882 - DNA, 22 bp, Homo sapiens
tggatgaacagttttggagaga

SEQ ID NO: 8005883 - DNA, 22 bp, Homo sapiens
tggatgagattaaagtgaggtt

SEQ ID NO: 8005884 - DNA, 18 bp, Homo sapiens
tggatctttatgaggctg

SEQ ID NO: 8005885 - DNA, 18 bp, Homo sapiens
tggatctttatgaggctg

SEQ ID NO: 8005886 - DNA, 22 bp, Homo sapiens
tggatcttgatgctccaagagt

SEQ ID NO: 8005887 - DNA, 22 bp, Homo sapiens
tggatcttcacaagagagggcg

SEQ ID NO: 8005888 - DNA, 22 bp, Homo sapiens
tggatgagggctgagcactggg

SEQ ID NO: 8005889 - DNA, 22 bp, Homo sapiens
tggatgagggctgagcactggg

SEQ ID NO: 8005890 - DNA, 19 bp, Homo sapiens
ccctcattcacttattctc

SEQ ID NO: 8005891 - DNA, 22 bp, Homo sapiens
ccctcattgcctcctgcgtgca

SEQ ID NO: 8005892 - DNA, 22 bp, Homo sapiens
ccctccacagacaggacttgtc

SEQ ID NO: 8005893 - DNA, 22 bp, Homo sapiens
ccctccacagacaggacttgtc

SEQ ID NO: 8005894 - DNA, 22 bp, Homo sapiens
ccctccaccaagcagggcgcca

SEQ ID NO: 8005895 - DNA, 22 bp, Homo sapiens
ccctccagagcctggacattct

SEQ ID NO: 8005896 - DNA, 22 bp, Homo sapiens
ccctccaccaagcagggcgcca

SEQ ID NO: 8005897 - DNA, 22 bp, Homo sapiens
ccctccagagcttgacctgctg

SEQ ID NO: 8005898 - DNA, 22 bp, Homo sapiens
ccctccagagcctggacattct

SEQ ID NO: 8005899 - DNA, 22 bp, Homo sapiens
ccctccagagcctggacattct

SEQ ID NO: 8005900 - DNA, 22 bp, Homo sapiens
ccctcagtctggctgggaagac

SEQ ID NO: 8005901 - DNA, 22 bp, Homo sapiens
ccctcaggtgaaaggaaaaatt

SEQ ID NO: 8005902 - DNA, 22 bp, Homo sapiens
ccctcaggtgaaaggaaaaatt

SEQ ID NO: 8005903 - DNA, 19 bp, Homo sapiens
ccctcaggtctgagcagtc

SEQ ID NO: 8005904 - DNA, 22 bp, Homo sapiens
ccctcagttttccagtgtgggc

SEQ ID NO: 8005905 - DNA, 22 bp, Homo sapiens
ccctcatgccagacagcatgca

SEQ ID NO: 8005906 - DNA, 22 bp, Homo sapiens
ccctcagtctggctgggaagac

SEQ ID NO: 8005907 - DNA, 22 bp, Homo sapiens
ccctcatgtcagtccctgccca

SEQ ID NO: 8005908 - DNA, 22 bp, Homo sapiens
ccctccagagcttgacctgctg

SEQ ID NO: 8005909 - DNA, 22 bp, Homo sapiens
ccctccagagcttgacctgctg

SEQ ID NO: 8005910 - DNA, 22 bp, Homo sapiens
ccctccagagcttgacctgctg

SEQ ID NO: 8005911 - DNA, 20 bp, Homo sapiens
ccctccagcaaccaggactt

SEQ ID NO: 8005912 - DNA, 22 bp, Homo sapiens
ccctccagagcttgacctgctg

SEQ ID NO: 8005913 - DNA, 22 bp, Homo sapiens
ccctccagccatggacccaggt

SEQ ID NO: 8005914 - DNA, 22 bp, Homo sapiens
ccctccagccatggacccaggt

SEQ ID NO: 8005915 - DNA, 20 bp, Homo sapiens
ccctccagcaaccaggactt

SEQ ID NO: 8005916 - DNA, 22 bp, Homo sapiens
ccctccagggagccatgctggg

SEQ ID NO: 8005917 - DNA, 22 bp, Homo sapiens
ccctccagggagccatgctggg

SEQ ID NO: 8005918 - DNA, 22 bp, Homo sapiens
ccctccagggagccatgctggg

SEQ ID NO: 8005919 - DNA, 22 bp, Homo sapiens
ccctccagggagccatgctggg

SEQ ID NO: 8005920 - DNA, 22 bp, Homo sapiens
ccctccaggcactgccctcttc

SEQ ID NO: 8005921 - DNA, 22 bp, Homo sapiens
ccctccaggcctgtcatgttcc

SEQ ID NO: 8005922 - DNA, 22 bp, Homo sapiens
ccctccaggcctgtcatgttcc

SEQ ID NO: 8005923 - DNA, 22 bp, Homo sapiens
ccctccaggcctgtcatgttcc

SEQ ID NO: 8005924 - DNA, 22 bp, Homo sapiens
ccctccagccatggacccaggt

SEQ ID NO: 8005925 - DNA, 22 bp, Homo sapiens
ccctccagctcaaagcaaccgg

SEQ ID NO: 8005926 - DNA, 22 bp, Homo sapiens
ccctccaggcactgccctcttc

SEQ ID NO: 8005927 - DNA, 22 bp, Homo sapiens
ccctccaggcactgccctcttc

SEQ ID NO: 8005928 - DNA, 22 bp, Homo sapiens
ccctccagctcaaagcaaccgg

SEQ ID NO: 8005929 - DNA, 22 bp, Homo sapiens
ccctgctgatgccttgattttg

SEQ ID NO: 8005930 - DNA, 22 bp, Homo sapiens
ccctgctgacaacttgattttg

SEQ ID NO: 8005931 - DNA, 22 bp, Homo sapiens
ccctccagggagccatgctggg

SEQ ID NO: 8005932 - DNA, 22 bp, Homo sapiens
ccctccagggagccatgctggg

SEQ ID NO: 8005933 - DNA, 22 bp, Homo sapiens
ccctccagggagccatgctggg

SEQ ID NO: 8005934 - DNA, 22 bp, Homo sapiens
ccctggactgttcagggcctga

SEQ ID NO: 8005935 - DNA, 22 bp, Homo sapiens
ccctggactgttcagggcctga

SEQ ID NO: 8005936 - DNA, 22 bp, Homo sapiens
ccctggagaaggggacgcggag

SEQ ID NO: 8005937 - DNA, 19 bp, Homo sapiens
ccctggagaataccctgga

SEQ ID NO: 8005938 - DNA, 22 bp, Homo sapiens
ccctgctgcagagagctttcca

SEQ ID NO: 8005939 - DNA, 22 bp, Homo sapiens
tggagctgagagccaggctggc

SEQ ID NO: 8005940 - DNA, 22 bp, Homo sapiens
tggagctgagagccaggctggc

SEQ ID NO: 8005941 - DNA, 22 bp, Homo sapiens
tggagctgagagttaataagga

SEQ ID NO: 8005942 - DNA, 22 bp, Homo sapiens
tggagctgagagccaggctggc

SEQ ID NO: 8005943 - DNA, 22 bp, Homo sapiens
tggagctgagagccaggctggc

SEQ ID NO: 8005944 - DNA, 22 bp, Homo sapiens
tggagctgagagccaggctggc

SEQ ID NO: 8005945 - DNA, 22 bp, Homo sapiens
tggagctgagagccaggctggc

SEQ ID NO: 8005946 - DNA, 22 bp, Homo sapiens
tggagctgagaagtggagctct

SEQ ID NO: 8005947 - DNA, 22 bp, Homo sapiens
tggagctgagagccaggctggc

SEQ ID NO: 8005948 - DNA, 22 bp, Homo sapiens
tggagctgagagccaggctggc

SEQ ID NO: 8005949 - DNA, 22 bp, Homo sapiens
tggagctgagagccaggctggc

SEQ ID NO: 8005950 - DNA, 22 bp, Homo sapiens
tggagctgagagccaggctggc

SEQ ID NO: 8005951 - DNA, 22 bp, Homo sapiens
tggagctgagagccaggctggc

SEQ ID NO: 8005952 - DNA, 22 bp, Homo sapiens
tggagctgactcacaccagcta

SEQ ID NO: 8005953 - DNA, 22 bp, Homo sapiens
tggagctgagaagtggagctct

SEQ ID NO: 8005954 - DNA, 22 bp, Homo sapiens
tggagctgagaagtggagctct

SEQ ID NO: 8005955 - DNA, 22 bp, Homo sapiens
tggagctgagaagtggagctct

SEQ ID NO: 8005956 - DNA, 22 bp, Homo sapiens
tggagctgagaagtggagctct

SEQ ID NO: 8005957 - DNA, 22 bp, Homo sapiens
tggagctgagaagtggagctct

SEQ ID NO: 8005958 - DNA, 22 bp, Homo sapiens
tggagctgagaagtggagctct

SEQ ID NO: 8005959 - DNA, 22 bp, Homo sapiens
tggagctgagaagtggagctct

SEQ ID NO: 8005960 - DNA, 22 bp, Homo sapiens
tggagctgactcacaccagcta

SEQ ID NO: 8005961 - DNA, 22 bp, Homo sapiens
tggagctgactcacaccagcta

SEQ ID NO: 8005962 - DNA, 23 bp, Homo sapiens
tggagctgacagtcagagggagg

SEQ ID NO: 8005963 - DNA, 22 bp, Homo sapiens
ccctggagctagtctgagcaga

SEQ ID NO: 8005964 - DNA, 22 bp, Homo sapiens
ccctggagaggactcacccctg

SEQ ID NO: 8005965 - DNA, 22 bp, Homo sapiens
ccctggagatcgggagaggaag

SEQ ID NO: 8005966 - DNA, 22 bp, Homo sapiens
ccctggagaggactcacccctg

SEQ ID NO: 8005967 - DNA, 20 bp, Homo sapiens
ccctggagagaagctccacg

SEQ ID NO: 8005968 - DNA, 20 bp, Homo sapiens
ccctggagagaagctccacg

SEQ ID NO: 8005969 - DNA, 20 bp, Homo sapiens
ccctggagagaagctccacg

SEQ ID NO: 8005970 - DNA, 20 bp, Homo sapiens
ccctggagagaagctccacg

SEQ ID NO: 8005971 - DNA, 20 bp, Homo sapiens
ccctggagagaagctccacg

SEQ ID NO: 8005972 - DNA, 20 bp, Homo sapiens
ccctggagagaagctccacg

SEQ ID NO: 8005973 - DNA, 20 bp, Homo sapiens
ccctggagagaagctccacg

SEQ ID NO: 8005974 - DNA, 19 bp, Homo sapiens
ccctggagaataccctgga

SEQ ID NO: 8005975 - DNA, 22 bp, Homo sapiens
ccctggagatcgggagaggaag

SEQ ID NO: 8005976 - DNA, 22 bp, Homo sapiens
ccctggagcatctctgctgtct

SEQ ID NO: 8005977 - DNA, 22 bp, Homo sapiens
ccctggagcatctctgctgtct

SEQ ID NO: 8005978 - DNA, 22 bp, Homo sapiens
ccctggagatcgggagaggaag

SEQ ID NO: 8005979 - DNA, 22 bp, Homo sapiens
ccctggagatcgggagaggaag

SEQ ID NO: 8005980 - DNA, 22 bp, Homo sapiens
ccctggagatcgggagaggaag

SEQ ID NO: 8005981 - DNA, 22 bp, Homo sapiens
ccctggagctagtctgagcaga

SEQ ID NO: 8005982 - DNA, 22 bp, Homo sapiens
ccctggagctagtctgagcaga

SEQ ID NO: 8005983 - DNA, 22 bp, Homo sapiens
ccctggagcatctctgctgtct

SEQ ID NO: 8005984 - DNA, 22 bp, Homo sapiens
ccctggagcatctctgctgtct

SEQ ID NO: 8005985 - DNA, 22 bp, Homo sapiens
tggcagcaattagctagagctg

SEQ ID NO: 8005986 - DNA, 22 bp, Homo sapiens
tggcagcaattagctagagctg

SEQ ID NO: 8005987 - DNA, 22 bp, Homo sapiens
tggcagcaagttcttgggaggt

SEQ ID NO: 8005988 - DNA, 22 bp, Homo sapiens
tggcagcaagttcttgggaggt

SEQ ID NO: 8005989 - DNA, 22 bp, Homo sapiens
tggcagcaatagaaatataatc

SEQ ID NO: 8005990 - DNA, 22 bp, Homo sapiens
tggcagcaattagctagagctg

SEQ ID NO: 8005991 - DNA, 22 bp, Homo sapiens
tggcagcaaaaccagaatcaga

SEQ ID NO: 8005992 - DNA, 22 bp, Homo sapiens
tggcagcaagttcttgggaggt

SEQ ID NO: 8005993 - DNA, 22 bp, Homo sapiens
tggcagcaaaaccagaatcaga

SEQ ID NO: 8005994 - DNA, 22 bp, Homo sapiens
tggcagcaagttcttgggaggt

SEQ ID NO: 8005995 - DNA, 22 bp, Homo sapiens
tggcagattttgaagacagaga

SEQ ID NO: 8005996 - DNA, 22 bp, Homo sapiens
tggcagcaaaaccagaatcaga

SEQ ID NO: 8005997 - DNA, 22 bp, Homo sapiens
tggcagcaaaaccagaatcaga

SEQ ID NO: 8005998 - DNA, 22 bp, Homo sapiens
tggcagatgagccgcgctccaa

SEQ ID NO: 8005999 - DNA, 22 bp, Homo sapiens
tggcagaggtatattgggagga

SEQ ID NO: 8006000 - DNA, 22 bp, Homo sapiens
tggcagaggtatattgggagga

SEQ ID NO: 8006001 - DNA, 22 bp, Homo sapiens
tggcagatggcctggaaccaaa

SEQ ID NO: 8006002 - DNA, 22 bp, Homo sapiens
tggcagatgtatatcacagctt

SEQ ID NO: 8006003 - DNA, 22 bp, Homo sapiens
tggcagattttctctggaggag

SEQ ID NO: 8006004 - DNA, 22 bp, Homo sapiens
tggcagattttctctggaggag

SEQ ID NO: 8006005 - DNA, 22 bp, Homo sapiens
tggcagatttaacattggaact

SEQ ID NO: 8006006 - DNA, 22 bp, Homo sapiens
tggcagatttaacattggaact

SEQ ID NO: 8006007 - DNA, 22 bp, Homo sapiens
tggcagatgtggcatagagcat

SEQ ID NO: 8006008 - DNA, 22 bp, Homo sapiens
tggcagatgtggcatagagcat

SEQ ID NO: 8006009 - DNA, 22 bp, Homo sapiens
tggcagatgtggtttgagacag

SEQ ID NO: 8006010 - DNA, 22 bp, Homo sapiens
tggcagcacaaggtggcccatg

SEQ ID NO: 8006011 - DNA, 22 bp, Homo sapiens
tggcagcacaaggtggcccatg

SEQ ID NO: 8006012 - DNA, 22 bp, Homo sapiens
tggcagcaatttgtgatgttga

SEQ ID NO: 8006013 - DNA, 22 bp, Homo sapiens
tggcagcacaaggtggcccatg

SEQ ID NO: 8006014 - DNA, 22 bp, Homo sapiens
tggcagcacaaggtggcccatg

SEQ ID NO: 8006015 - DNA, 22 bp, Homo sapiens
tggcagcaatttgtgatgttga

SEQ ID NO: 8006016 - DNA, 22 bp, Homo sapiens
tggcagcaatttgtgatgttga

SEQ ID NO: 8006017 - DNA, 22 bp, Homo sapiens
tggcagcaccagcagtgtcctt

SEQ ID NO: 8006018 - DNA, 22 bp, Homo sapiens
tggcagcacattgacccgggct

SEQ ID NO: 8006019 - DNA, 22 bp, Homo sapiens
tggcagcacattgacccgggct

SEQ ID NO: 8006020 - DNA, 21 bp, Homo sapiens
tggcagcacccacaccctctg

SEQ ID NO: 8006021 - DNA, 21 bp, Homo sapiens
tggcagcacccacaccctctg

SEQ ID NO: 8006022 - DNA, 22 bp, Homo sapiens
tggcagcaccagcagtgtcctt

SEQ ID NO: 8006023 - DNA, 22 bp, Homo sapiens
tggcagcacggcatccactctc

SEQ ID NO: 8006024 - DNA, 22 bp, Homo sapiens
tggcagcactaggtactgagct

SEQ ID NO: 8006025 - DNA, 22 bp, Homo sapiens
tggcagcactaggtactgagct

SEQ ID NO: 8006026 - DNA, 22 bp, Homo sapiens
tggcagcacggcatccactctc

SEQ ID NO: 8006027 - DNA, 22 bp, Homo sapiens
tggcagcacggcatccactctc

SEQ ID NO: 8006028 - DNA, 21 bp, Homo sapiens
tggcagcacccacaccctctg

SEQ ID NO: 8006029 - DNA, 22 bp, Homo sapiens
tggcagcacggcatccactctc

SEQ ID NO: 8006030 - DNA, 22 bp, Homo sapiens
tggcagcacggcatccactctc

SEQ ID NO: 8006031 - DNA, 22 bp, Homo sapiens
tggcagctggctctgcgcaggc

SEQ ID NO: 8006032 - DNA, 22 bp, Homo sapiens
tggcagctggctctgcgcaggc

SEQ ID NO: 8006033 - DNA, 22 bp, Homo sapiens
tggcagctggatcccaaggcag

SEQ ID NO: 8006034 - DNA, 22 bp, Homo sapiens
tggcagctggatcccaaggcag

SEQ ID NO: 8006035 - DNA, 22 bp, Homo sapiens
tggcagctggatcccaaggcag

SEQ ID NO: 8006036 - DNA, 22 bp, Homo sapiens
tggcagctggatcccaaggcag

SEQ ID NO: 8006037 - DNA, 22 bp, Homo sapiens
tggcagctggagggcaatggcc

SEQ ID NO: 8006038 - DNA, 22 bp, Homo sapiens
tggcagctggagggcaatggcc

SEQ ID NO: 8006039 - DNA, 22 bp, Homo sapiens
tggcagctggagggcaatggcc

SEQ ID NO: 8006040 - DNA, 22 bp, Homo sapiens
tggcaaggccacaggtgcagtt

SEQ ID NO: 8006041 - DNA, 22 bp, Homo sapiens
tggcaaggccacaggtgcagtt

SEQ ID NO: 8006042 - DNA, 22 bp, Homo sapiens
tggcaaggccacaggtgcagtt

SEQ ID NO: 8006043 - DNA, 22 bp, Homo sapiens
tggcaaggccacaggtgcagtt

SEQ ID NO: 8006044 - DNA, 23 bp, Homo sapiens
tggcaaggaatgggatggagact

SEQ ID NO: 8006045 - DNA, 23 bp, Homo sapiens
tggcaaggaatgggatggagact

SEQ ID NO: 8006046 - DNA, 23 bp, Homo sapiens
tggcaaggaatgggatggagact

SEQ ID NO: 8006047 - DNA, 22 bp, Homo sapiens
tggcaaggctgtgggggcagag

SEQ ID NO: 8006048 - DNA, 22 bp, Homo sapiens
tggcaaggctgtgggggcagag

SEQ ID NO: 8006049 - DNA, 22 bp, Homo sapiens
tggcaaggccacaggtgcagtt

SEQ ID NO: 8006050 - DNA, 22 bp, Homo sapiens
tggcaaggctgtgggggcagag

SEQ ID NO: 8006051 - DNA, 22 bp, Homo sapiens
tggcaaggctgtgggggcagag

SEQ ID NO: 8006052 - DNA, 22 bp, Homo sapiens
tggcacaggaatttagatgcag

SEQ ID NO: 8006053 - DNA, 22 bp, Homo sapiens
tggcacaggagcactgccctgg

SEQ ID NO: 8006054 - DNA, 22 bp, Homo sapiens
tggcacaggagcactgccctgg

SEQ ID NO: 8006055 - DNA, 22 bp, Homo sapiens
tggcacaggagcactgccctgg

SEQ ID NO: 8006056 - DNA, 22 bp, Homo sapiens
tggcacaggagcactgccctgg

SEQ ID NO: 8006057 - DNA, 22 bp, Homo sapiens
tggcacaggatctcagcggcca

SEQ ID NO: 8006058 - DNA, 22 bp, Homo sapiens
tggcacaggatctcagcggcca

SEQ ID NO: 8006059 - DNA, 22 bp, Homo sapiens
tggcacaggatctcagcggcca

SEQ ID NO: 8006060 - DNA, 22 bp, Homo sapiens
tggcacaggatctcagcggcca

SEQ ID NO: 8006061 - DNA, 22 bp, Homo sapiens
tggcacaggatctcagcggcca

SEQ ID NO: 8006062 - DNA, 22 bp, Homo sapiens
tggcacaggatctcagcggcca

SEQ ID NO: 8006063 - DNA, 22 bp, Homo sapiens
tggcacaggatctcagcggcca

SEQ ID NO: 8006064 - DNA, 22 bp, Homo sapiens
tggcacaggcggtaagggtgtg

SEQ ID NO: 8006065 - DNA, 22 bp, Homo sapiens
tggcacaggcggtaagggtgtg

SEQ ID NO: 8006066 - DNA, 22 bp, Homo sapiens
tggcacaggcggtaagggtgtg

SEQ ID NO: 8006067 - DNA, 22 bp, Homo sapiens
tggcacaggatctcagcggcca

SEQ ID NO: 8006068 - DNA, 22 bp, Homo sapiens
tggcacaggatctcagcggcca

SEQ ID NO: 8006069 - DNA, 22 bp, Homo sapiens
tggcacagggcttggtcgctca

SEQ ID NO: 8006070 - DNA, 22 bp, Homo sapiens
tggcacagggcttggtcgctca

SEQ ID NO: 8006071 - DNA, 22 bp, Homo sapiens
tggcacagtcctgggtgcctgc

SEQ ID NO: 8006072 - DNA, 22 bp, Homo sapiens
tggcacagggcttggtcgctca

SEQ ID NO: 8006073 - DNA, 22 bp, Homo sapiens
tggcacagggcttggtcgctca

SEQ ID NO: 8006074 - DNA, 22 bp, Homo sapiens
tggcacagggcttggtcgctca

SEQ ID NO: 8006075 - DNA, 22 bp, Homo sapiens
tggcacagtcctgggtgcctgc

SEQ ID NO: 8006076 - DNA, 22 bp, Homo sapiens
tggcacagtcctgggtgcctgc

SEQ ID NO: 8006077 - DNA, 22 bp, Homo sapiens
tggcacagtcctgggtgcctgc

SEQ ID NO: 8006078 - DNA, 22 bp, Homo sapiens
tggcacagtcctgggtgcctgc

SEQ ID NO: 8006079 - DNA, 22 bp, Homo sapiens
tggcacagtcctgggtgcctgc

SEQ ID NO: 8006080 - DNA, 22 bp, Homo sapiens
tggcacagtcctgggtgcctgc

SEQ ID NO: 8006081 - DNA, 22 bp, Homo sapiens
tggcacagtcctgggtgcctgc

SEQ ID NO: 8006082 - DNA, 22 bp, Homo sapiens
tggcagaggtatattgggagga

SEQ ID NO: 8006083 - DNA, 22 bp, Homo sapiens
tggcagaggtaattcaaatccc

SEQ ID NO: 8006084 - DNA, 22 bp, Homo sapiens
cctatattcagggaactgaccc

SEQ ID NO: 8006085 - DNA, 22 bp, Homo sapiens
cctatgcctgtcactctgcgct

SEQ ID NO: 8006086 - DNA, 22 bp, Homo sapiens
cctagtccccaggaggtcagtg

SEQ ID NO: 8006087 - DNA, 22 bp, Homo sapiens
cctaggtcccaagtcatgtttc

SEQ ID NO: 8006088 - DNA, 22 bp, Homo sapiens
cctagtcttccgcgtccccacc

SEQ ID NO: 8006089 - DNA, 21 bp, Homo sapiens
cctagtgttaaaacagtttaa

SEQ ID NO: 8006090 - DNA, 22 bp, Homo sapiens
cctagtcttccgcgtccccacc

SEQ ID NO: 8006091 - DNA, 22 bp, Homo sapiens
cctagttttcattcagcagcct

SEQ ID NO: 8006092 - DNA, 22 bp, Homo sapiens
cctagtttcttaattttgagaa

SEQ ID NO: 8006093 - DNA, 22 bp, Homo sapiens
cctagttttcattcagcagcct

SEQ ID NO: 8006094 - DNA, 22 bp, Homo sapiens
cctagtttttcacttgtgctgt

SEQ ID NO: 8006095 - DNA, 22 bp, Homo sapiens
cctagttttggacattcctgca

SEQ ID NO: 8006096 - DNA, 20 bp, Homo sapiens
cctagttttctgagcgtgac

SEQ ID NO: 8006097 - DNA, 22 bp, Homo sapiens
cctaggtcccaagtcatgtttc

SEQ ID NO: 8006098 - DNA, 22 bp, Homo sapiens
cctagggatacagcagagtaca

SEQ ID NO: 8006099 - DNA, 22 bp, Homo sapiens
cctagggatgtgttagccagat

SEQ ID NO: 8006100 - DNA, 22 bp, Homo sapiens
cctagggagcctgagagcagtg

SEQ ID NO: 8006101 - DNA, 22 bp, Homo sapiens
cctagggagcctgagagcagtg

SEQ ID NO: 8006102 - DNA, 22 bp, Homo sapiens
cctagggaaacagagtccacac

SEQ ID NO: 8006103 - DNA, 22 bp, Homo sapiens
cctagggaccaggatccccacc

SEQ ID NO: 8006104 - DNA, 22 bp, Homo sapiens
cctaggctaattcagtccagta

SEQ ID NO: 8006105 - DNA, 22 bp, Homo sapiens
cctaggccttactttcctgtgc

SEQ ID NO: 8006106 - DNA, 22 bp, Homo sapiens
cctaggccgcccggtgcgtggg

SEQ ID NO: 8006107 - DNA, 22 bp, Homo sapiens
cctaggctggctgtcttcaggt

SEQ ID NO: 8006108 - DNA, 22 bp, Homo sapiens
cctaggctaattcagtccagta

SEQ ID NO: 8006109 - DNA, 22 bp, Homo sapiens
cctaggctaattcagtccagta

SEQ ID NO: 8006110 - DNA, 22 bp, Homo sapiens
cctaggcttgttttcatcagct

SEQ ID NO: 8006111 - DNA, 22 bp, Homo sapiens
cctaggctggctgtcttcaggt

SEQ ID NO: 8006112 - DNA, 22 bp, Homo sapiens
cctaggctggctgtcttcaggt

SEQ ID NO: 8006113 - DNA, 22 bp, Homo sapiens
cctaggctaattcagtccagta

SEQ ID NO: 8006114 - DNA, 23 bp, Homo sapiens
tggccaggcataaaggtgggtgg

SEQ ID NO: 8006115 - DNA, 23 bp, Homo sapiens
tggccaggcataaaggtgggtgg

SEQ ID NO: 8006116 - DNA, 23 bp, Homo sapiens
tggccaggcataaaggtgggtgg

SEQ ID NO: 8006117 - DNA, 23 bp, Homo sapiens
tggccaggcataaaggtgggtgg

SEQ ID NO: 8006118 - DNA, 23 bp, Homo sapiens
tggccaggcataaaggtgggtgg

SEQ ID NO: 8006119 - DNA, 23 bp, Homo sapiens
tggccaggcataaaggtgggtgg

SEQ ID NO: 8006120 - DNA, 22 bp, Homo sapiens
tggccaggcaggtagaacggcc

SEQ ID NO: 8006121 - DNA, 22 bp, Homo sapiens
tggccaggcaggtagaacggcc

SEQ ID NO: 8006122 - DNA, 22 bp, Homo sapiens
tggccaggcaggtagaacggcc

SEQ ID NO: 8006123 - DNA, 22 bp, Homo sapiens
tggccaggcaggtagaacggcc

SEQ ID NO: 8006124 - DNA, 22 bp, Homo sapiens
tggccaggcaggtagaacggcc

SEQ ID NO: 8006125 - DNA, 22 bp, Homo sapiens
tggccaggcaggtagaacggcc

SEQ ID NO: 8006126 - DNA, 22 bp, Homo sapiens
tggccaggcaggtagaacggcc

SEQ ID NO: 8006127 - DNA, 23 bp, Homo sapiens
tggccaggcataaaggtgggtgg

SEQ ID NO: 8006128 - DNA, 23 bp, Homo sapiens
tggccaggcataaaggtgggtgg

SEQ ID NO: 8006129 - DNA, 22 bp, Homo sapiens
tggccaggcattcagataagac

SEQ ID NO: 8006130 - DNA, 22 bp, Homo sapiens
tggccaggcattcagataagac

SEQ ID NO: 8006131 - DNA, 22 bp, Homo sapiens
tggccaggcattcagataagac

SEQ ID NO: 8006132 - DNA, 22 bp, Homo sapiens
tggccaggcattcagataagac

SEQ ID NO: 8006133 - DNA, 22 bp, Homo sapiens
tggccaggcattcagataagac

SEQ ID NO: 8006134 - DNA, 22 bp, Homo sapiens
cctaggccctcaaagagcataa

SEQ ID NO: 8006135 - DNA, 20 bp, Homo sapiens
cctaggccctccggctgccc

SEQ ID NO: 8006136 - DNA, 20 bp, Homo sapiens
cctaggccctccggctgccc

SEQ ID NO: 8006137 - DNA, 22 bp, Homo sapiens
cctaggccgcccggtgcgtggg

SEQ ID NO: 8006138 - DNA, 22 bp, Homo sapiens
tggccaggcattcagataagac

SEQ ID NO: 8006139 - DNA, 22 bp, Homo sapiens
cctaggccctaggcttccatca

SEQ ID NO: 8006140 - DNA, 22 bp, Homo sapiens
cctaggccctcaaagagcataa

SEQ ID NO: 8006141 - DNA, 22 bp, Homo sapiens
cctaggccctcaaagagcataa

SEQ ID NO: 8006142 - DNA, 22 bp, Homo sapiens
tggccaggaggctgcttctgac

SEQ ID NO: 8006143 - DNA, 22 bp, Homo sapiens
tggccaggaggctgcttctgac

SEQ ID NO: 8006144 - DNA, 22 bp, Homo sapiens
tggccagctttttgtagtgctc

SEQ ID NO: 8006145 - DNA, 22 bp, Homo sapiens
tggccagctttttgtagtgctc

SEQ ID NO: 8006146 - DNA, 22 bp, Homo sapiens
tggccagctttttgtagtgctc

SEQ ID NO: 8006147 - DNA, 22 bp, Homo sapiens
tggccagctttgactgtaaacc

SEQ ID NO: 8006148 - DNA, 22 bp, Homo sapiens
tggccagctttgactgtaaacc

SEQ ID NO: 8006149 - DNA, 22 bp, Homo sapiens
tggccagctttttgtagtgctc

SEQ ID NO: 8006150 - DNA, 22 bp, Homo sapiens
tggccaggcaggtagaacggcc

SEQ ID NO: 8006151 - DNA, 22 bp, Homo sapiens
tggccaggcaggtagaacggcc

SEQ ID NO: 8006152 - DNA, 22 bp, Homo sapiens
tggccaggcaggtagaacggcc

SEQ ID NO: 8006153 - DNA, 22 bp, Homo sapiens
tggccaggcaggtagaacggcc

SEQ ID NO: 8006154 - DNA, 22 bp, Homo sapiens
tggccaggaggctgcttctgac

SEQ ID NO: 8006155 - DNA, 21 bp, Homo sapiens
tggccagctggagtctccaca

SEQ ID NO: 8006156 - DNA, 21 bp, Homo sapiens
tggccagctggagtctccaca

SEQ ID NO: 8006157 - DNA, 22 bp, Homo sapiens
tggccagctgtaggttgtgcag

SEQ ID NO: 8006158 - DNA, 22 bp, Homo sapiens
tggccagctgtaggttgtgcag

SEQ ID NO: 8006159 - DNA, 22 bp, Homo sapiens
tggccacacccacctagaggag

SEQ ID NO: 8006160 - DNA, 22 bp, Homo sapiens
tggccacacccacctagaggag

SEQ ID NO: 8006161 - DNA, 22 bp, Homo sapiens
tggccacacccacctagaggag

SEQ ID NO: 8006162 - DNA, 22 bp, Homo sapiens
tggccacacccacctagaggag

SEQ ID NO: 8006163 - DNA, 22 bp, Homo sapiens
tggccacacccacctagaggag

SEQ ID NO: 8006164 - DNA, 22 bp, Homo sapiens
tggccacaaagagaacgaggtc

SEQ ID NO: 8006165 - DNA, 22 bp, Homo sapiens
tggccacaaagagaacgaggtc

SEQ ID NO: 8006166 - DNA, 22 bp, Homo sapiens
tggcagctttttgtttcaggct

SEQ ID NO: 8006167 - DNA, 15 bp, Homo sapiens
tggcagcttgttaag

SEQ ID NO: 8006168 - DNA, 22 bp, Homo sapiens
tggcagcttgaatgcagtcttt

SEQ ID NO: 8006169 - DNA, 22 bp, Homo sapiens
tggcagcttgaatgcagtcttt

SEQ ID NO: 8006170 - DNA, 22 bp, Homo sapiens
tggcagcttgaatgcagtcttt

SEQ ID NO: 8006171 - DNA, 23 bp, Homo sapiens
tggcagctgtgtaagagaaagca

SEQ ID NO: 8006172 - DNA, 22 bp, Homo sapiens
tggcagctgtgtccaggtagaa

SEQ ID NO: 8006173 - DNA, 22 bp, Homo sapiens
tggcagctgtgtccaggtagaa

SEQ ID NO: 8006174 - DNA, 22 bp, Homo sapiens
tggcagctgtgtccaggtagaa

SEQ ID NO: 8006175 - DNA, 22 bp, Homo sapiens
tggcagctgtgtccaggtagaa

SEQ ID NO: 8006176 - DNA, 22 bp, Homo sapiens
tggcagctgtgtccaggtagaa

SEQ ID NO: 8006177 - DNA, 22 bp, Homo sapiens
tggcagctgttaatgttttgtt

SEQ ID NO: 8006178 - DNA, 22 bp, Homo sapiens
tggcagcttgaatgcagtcttt

SEQ ID NO: 8006179 - DNA, 22 bp, Homo sapiens
tggcagcttgaatgcagtcttt

SEQ ID NO: 8006180 - DNA, 22 bp, Homo sapiens
tggcagcttcctgctcatagga

SEQ ID NO: 8006181 - DNA, 22 bp, Homo sapiens
tggcagcttcctgctcatagga

SEQ ID NO: 8006182 - DNA, 22 bp, Homo sapiens
tggcagcttcctgctcatagga

SEQ ID NO: 8006183 - DNA, 22 bp, Homo sapiens
tggcagctgtctgtggggtctc

SEQ ID NO: 8006184 - DNA, 22 bp, Homo sapiens
tggcagctgtctgtggggtctc

SEQ ID NO: 8006185 - DNA, 22 bp, Homo sapiens
tggcagctgtctgtggggtctc

SEQ ID NO: 8006186 - DNA, 22 bp, Homo sapiens
tggcagctgtctgtggggtctc

SEQ ID NO: 8006187 - DNA, 23 bp, Homo sapiens
tggcagctgtgtaagagaaagca

SEQ ID NO: 8006188 - DNA, 22 bp, Homo sapiens
tggcagctgtgcttcattcttt

SEQ ID NO: 8006189 - DNA, 22 bp, Homo sapiens
tggcagctgtgcttcattcttt

SEQ ID NO: 8006190 - DNA, 22 bp, Homo sapiens
tggcagctggtacagtgggtct

SEQ ID NO: 8006191 - DNA, 22 bp, Homo sapiens
tggcagctggtacagtgggtct

SEQ ID NO: 8006192 - DNA, 22 bp, Homo sapiens
tggcagctgtcagaatgcaaat

SEQ ID NO: 8006193 - DNA, 22 bp, Homo sapiens
tggcagctggctctgcgcaggc

SEQ ID NO: 8006194 - DNA, 22 bp, Homo sapiens
tggcagctggtacagtgggtct

SEQ ID NO: 8006195 - DNA, 22 bp, Homo sapiens
tggcagctggctctgcgcaggc

SEQ ID NO: 8006196 - DNA, 22 bp, Homo sapiens
tggcagctggctctgcgcaggc

SEQ ID NO: 8006197 - DNA, 22 bp, Homo sapiens
tggcagctggctctgcgcaggc

SEQ ID NO: 8006198 - DNA, 22 bp, Homo sapiens
cctctcagcgattcctcttgga

SEQ ID NO: 8006199 - DNA, 22 bp, Homo sapiens
cctctcagcgattcctcttgga

SEQ ID NO: 8006200 - DNA, 22 bp, Homo sapiens
cctctcagcgattcctcttgga

SEQ ID NO: 8006201 - DNA, 22 bp, Homo sapiens
cctctcagccggactgtcaggc

SEQ ID NO: 8006202 - DNA, 22 bp, Homo sapiens
cctctcagcgattcctcttgga

SEQ ID NO: 8006203 - DNA, 22 bp, Homo sapiens
cctctcagtattgaactttata

SEQ ID NO: 8006204 - DNA, 22 bp, Homo sapiens
cctctcagtattgaactttata

SEQ ID NO: 8006205 - DNA, 23 bp, Homo sapiens
cctctccagacactgggccttgt

SEQ ID NO: 8006206 - DNA, 23 bp, Homo sapiens
cctctccagacactgggccttgt

SEQ ID NO: 8006207 - DNA, 22 bp, Homo sapiens
cctctcatagtctgtatccttt

SEQ ID NO: 8006208 - DNA, 23 bp, Homo sapiens
cctctccagacactgggccttgt

SEQ ID NO: 8006209 - DNA, 22 bp, Homo sapiens
cctctccagcggcctcagggcc

SEQ ID NO: 8006210 - DNA, 22 bp, Homo sapiens
cctctccagcggcctcagggcc

SEQ ID NO: 8006211 - DNA, 22 bp, Homo sapiens
cctctccagcggcctcagggcc

SEQ ID NO: 8006212 - DNA, 22 bp, Homo sapiens
cctctcagccggactgtcaggc

SEQ ID NO: 8006213 - DNA, 22 bp, Homo sapiens
cctctcagccggactgtcaggc

SEQ ID NO: 8006214 - DNA, 23 bp, Homo sapiens
cctctaggagattagggggcttc

SEQ ID NO: 8006215 - DNA, 22 bp, Homo sapiens
cctctaggatgtggctggagga

SEQ ID NO: 8006216 - DNA, 22 bp, Homo sapiens
cctctaggatgtggctggagga

SEQ ID NO: 8006217 - DNA, 22 bp, Homo sapiens
cctctacttaccactcagccag

SEQ ID NO: 8006218 - DNA, 18 bp, Homo sapiens
cctctacctacccctaga

SEQ ID NO: 8006219 - DNA, 22 bp, Homo sapiens
cctctacagggcatagcccaaa

SEQ ID NO: 8006220 - DNA, 22 bp, Homo sapiens
cctctaaattgtttgaagttgg

SEQ ID NO: 8006221 - DNA, 21 bp, Homo sapiens
tggctgcctggctctgtggtt

SEQ ID NO: 8006222 - DNA, 22 bp, Homo sapiens
tggctgcctgatcgagcaggtg

SEQ ID NO: 8006223 - DNA, 22 bp, Homo sapiens
tggctgccttccctgctggagg

SEQ ID NO: 8006224 - DNA, 21 bp, Homo sapiens
tggctgcctggctctgtggtt

SEQ ID NO: 8006225 - DNA, 22 bp, Homo sapiens
tggctgcctagtgtctgagcag

SEQ ID NO: 8006226 - DNA, 22 bp, Homo sapiens
tggctgcctagtgtctgagcag

SEQ ID NO: 8006227 - DNA, 22 bp, Homo sapiens
tggctgcctagtgtctgagcag

SEQ ID NO: 8006228 - DNA, 22 bp, Homo sapiens
tggctgcctgatcgagcaggtg

SEQ ID NO: 8006229 - DNA, 22 bp, Homo sapiens
tggctgcctgaatgcaagacag

SEQ ID NO: 8006230 - DNA, 22 bp, Homo sapiens
tggctgcctgaatgcaagacag

SEQ ID NO: 8006231 - DNA, 22 bp, Homo sapiens
tggctgcctcagtgtccctgca

SEQ ID NO: 8006232 - DNA, 22 bp, Homo sapiens
tggctgcctagtccctcagcct

SEQ ID NO: 8006233 - DNA, 22 bp, Homo sapiens
tggctgcctagtccctcagcct

SEQ ID NO: 8006234 - DNA, 21 bp, Homo sapiens
tggctgcctacatgctgcagg

SEQ ID NO: 8006235 - DNA, 21 bp, Homo sapiens
tggctgcctacatgctgcagg

SEQ ID NO: 8006236 - DNA, 22 bp, Homo sapiens
tggctgccgactggctcttggc

SEQ ID NO: 8006237 - DNA, 21 bp, Homo sapiens
tggctgcctacatgctgcagg

SEQ ID NO: 8006238 - DNA, 21 bp, Homo sapiens
tggctgcctacatgctgcagg

SEQ ID NO: 8006239 - DNA, 22 bp, Homo sapiens
tggctgccctcatgggcctgat

SEQ ID NO: 8006240 - DNA, 22 bp, Homo sapiens
tggctgccctcatgggcctgat

SEQ ID NO: 8006241 - DNA, 22 bp, Homo sapiens
tggctgccctcatgggcctgat

SEQ ID NO: 8006242 - DNA, 20 bp, Homo sapiens
cctctctgcatgctccctga

SEQ ID NO: 8006243 - DNA, 20 bp, Homo sapiens
cctctctgcatgctccctga

SEQ ID NO: 8006244 - DNA, 20 bp, Homo sapiens
cctctctgcatgctccctga

SEQ ID NO: 8006245 - DNA, 20 bp, Homo sapiens
cctctctgcatgctccctga

SEQ ID NO: 8006246 - DNA, 20 bp, Homo sapiens
cctctctgcatgctccctga

SEQ ID NO: 8006247 - DNA, 20 bp, Homo sapiens
cctctctgcatgctccctga

SEQ ID NO: 8006248 - DNA, 22 bp, Homo sapiens
cctctctcttgtagtccctgcc

SEQ ID NO: 8006249 - DNA, 20 bp, Homo sapiens
cctctctgaagaggtcatct

SEQ ID NO: 8006250 - DNA, 20 bp, Homo sapiens
cctctctgaagaggtcatct

SEQ ID NO: 8006251 - DNA, 22 bp, Homo sapiens
tggctgccttccctgctggagg

SEQ ID NO: 8006252 - DNA, 22 bp, Homo sapiens
tggctgccttccctgctggagg

SEQ ID NO: 8006253 - DNA, 22 bp, Homo sapiens
tggctgcctttcacctcatctc

SEQ ID NO: 8006254 - DNA, 22 bp, Homo sapiens
tggctgctactgagggggtctg

SEQ ID NO: 8006255 - DNA, 22 bp, Homo sapiens
tggctgcctttcacctcatctc

SEQ ID NO: 8006256 - DNA, 22 bp, Homo sapiens
tggctgctactgagggggtctg

SEQ ID NO: 8006257 - DNA, 22 bp, Homo sapiens
cctctcccgggtgccgctgggc

SEQ ID NO: 8006258 - DNA, 22 bp, Homo sapiens
cctctcccgggtgccgctgggc

SEQ ID NO: 8006259 - DNA, 22 bp, Homo sapiens
cctctctcttgtagtccctgcc

SEQ ID NO: 8006260 - DNA, 22 bp, Homo sapiens
cctctctcttgtagtccctgcc

SEQ ID NO: 8006261 - DNA, 22 bp, Homo sapiens
cctctcctggctgtaggacctc

SEQ ID NO: 8006262 - DNA, 20 bp, Homo sapiens
cctctctgccctgcaaggcc

SEQ ID NO: 8006263 - DNA, 20 bp, Homo sapiens
cctctctgccctgcaaggcc

SEQ ID NO: 8006264 - DNA, 20 bp, Homo sapiens
cctctctgccctgcaaggcc

SEQ ID NO: 8006265 - DNA, 22 bp, Homo sapiens
cctctctgtaagggtccctccc

SEQ ID NO: 8006266 - DNA, 22 bp, Homo sapiens
cctctctgtaagggtccctccc

SEQ ID NO: 8006267 - DNA, 22 bp, Homo sapiens
cctctctgtaagggtccctccc

SEQ ID NO: 8006268 - DNA, 22 bp, Homo sapiens
cctctctgtaagggtccctccc

SEQ ID NO: 8006269 - DNA, 22 bp, Homo sapiens
cctctctgtagcagcccccagt

SEQ ID NO: 8006270 - DNA, 22 bp, Homo sapiens
cctctctgtagcagcccccagt

SEQ ID NO: 8006271 - DNA, 22 bp, Homo sapiens
cctctctgtagcagcccccagt

SEQ ID NO: 8006272 - DNA, 22 bp, Homo sapiens
cctctctgtagcagcccccagt

SEQ ID NO: 8006273 - DNA, 22 bp, Homo sapiens
cctctctgtaagggtccctccc

SEQ ID NO: 8006274 - DNA, 22 bp, Homo sapiens
cctctctgtaagggtccctccc

SEQ ID NO: 8006275 - DNA, 22 bp, Homo sapiens
cctctctgtgtggcctctccat

SEQ ID NO: 8006276 - DNA, 22 bp, Homo sapiens
cctctctgtgtggcctctccat

SEQ ID NO: 8006277 - DNA, 16 bp, Homo sapiens
cctctcttattcctcc

SEQ ID NO: 8006278 - DNA, 22 bp, Homo sapiens
cctctctgtcacaccagtggcc

SEQ ID NO: 8006279 - DNA, 22 bp, Homo sapiens
cctctctgtcacaccagtggcc

SEQ ID NO: 8006280 - DNA, 22 bp, Homo sapiens
cctctctgtcacaccagtggcc

SEQ ID NO: 8006281 - DNA, 22 bp, Homo sapiens
cctctctgtgtggcctctccat

SEQ ID NO: 8006282 - DNA, 22 bp, Homo sapiens
cctctctgtgtggcctctccat

SEQ ID NO: 8006283 - DNA, 22 bp, Homo sapiens
cctctggtcccagctctgctgc

SEQ ID NO: 8006284 - DNA, 22 bp, Homo sapiens
cctctgggttagtttagggagc

SEQ ID NO: 8006285 - DNA, 22 bp, Homo sapiens
cctctgggttagtttagggagc

SEQ ID NO: 8006286 - DNA, 22 bp, Homo sapiens
cctctgggtgggaggccgggcg

SEQ ID NO: 8006287 - DNA, 22 bp, Homo sapiens
cctctgggttagtttagggagc

SEQ ID NO: 8006288 - DNA, 18 bp, Homo sapiens
cctctgggttttgttccc

SEQ ID NO: 8006289 - DNA, 22 bp, Homo sapiens
cctctgtgatttctgagccaat

SEQ ID NO: 8006290 - DNA, 22 bp, Homo sapiens
cctctgtgacttctaccttcac

SEQ ID NO: 8006291 - DNA, 22 bp, Homo sapiens
cctctgtgcaggaaatacatgt

SEQ ID NO: 8006292 - DNA, 22 bp, Homo sapiens
cctctgtgatttctgagccaat

SEQ ID NO: 8006293 - DNA, 22 bp, Homo sapiens
cctctgtgcaggaaatacatgt

SEQ ID NO: 8006294 - DNA, 22 bp, Homo sapiens
cctctgtccccagtgcaggcct

SEQ ID NO: 8006295 - DNA, 22 bp, Homo sapiens
cctctgtccccagtgcaggcct

SEQ ID NO: 8006296 - DNA, 22 bp, Homo sapiens
cctctgtcctggggagtggagc

SEQ ID NO: 8006297 - DNA, 22 bp, Homo sapiens
cctctgtcctggggagtggagc

SEQ ID NO: 8006298 - DNA, 22 bp, Homo sapiens
cctctgtgacaaacagtcctgg

SEQ ID NO: 8006299 - DNA, 22 bp, Homo sapiens
cctctgtgacaaacagtcctgg

SEQ ID NO: 8006300 - DNA, 22 bp, Homo sapiens
cctctgggtgggaggccgggcg

SEQ ID NO: 8006301 - DNA, 22 bp, Homo sapiens
cctctgggtgggaggccgggcg

SEQ ID NO: 8006302 - DNA, 22 bp, Homo sapiens
cctctgggtgggaggccgggcg

SEQ ID NO: 8006303 - DNA, 22 bp, Homo sapiens
cctctgggtgggaggccgggcg

SEQ ID NO: 8006304 - DNA, 22 bp, Homo sapiens
cctctgggtgggaggccgggcg

SEQ ID NO: 8006305 - DNA, 22 bp, Homo sapiens
cctctgggtgacagactcttgg

SEQ ID NO: 8006306 - DNA, 22 bp, Homo sapiens
cctctgggtgacagactcttgg

SEQ ID NO: 8006307 - DNA, 22 bp, Homo sapiens
cctctgggtgacagactcttgg

SEQ ID NO: 8006308 - DNA, 22 bp, Homo sapiens
cctctgggtgacagactcttgg

SEQ ID NO: 8006309 - DNA, 22 bp, Homo sapiens
cctctgggtatctgtggaagta

SEQ ID NO: 8006310 - DNA, 22 bp, Homo sapiens
cctctgggtatctgtggaagta

SEQ ID NO: 8006311 - DNA, 22 bp, Homo sapiens
cctctgggtatctgtggaagta

SEQ ID NO: 8006312 - DNA, 22 bp, Homo sapiens
cctctgggggtcctcagagtct

SEQ ID NO: 8006313 - DNA, 22 bp, Homo sapiens
cctctgggggtcctcagagtct

SEQ ID NO: 8006314 - DNA, 22 bp, Homo sapiens
cctctggggtctagcaatagca

SEQ ID NO: 8006315 - DNA, 22 bp, Homo sapiens
cctctgggggtcctcagagtct

SEQ ID NO: 8006316 - DNA, 22 bp, Homo sapiens
cctctgggggtcctcagagtct

SEQ ID NO: 8006317 - DNA, 22 bp, Homo sapiens
cctctggggtgagtgggccact

SEQ ID NO: 8006318 - DNA, 22 bp, Homo sapiens
cctctggggtctagcaatagca

SEQ ID NO: 8006319 - DNA, 22 bp, Homo sapiens
cctctggggtgagtgggccact

SEQ ID NO: 8006320 - DNA, 22 bp, Homo sapiens
cctctggggtgagtgggccact

SEQ ID NO: 8006321 - DNA, 22 bp, Homo sapiens
cctctggggtgagtgggccact

SEQ ID NO: 8006322 - DNA, 22 bp, Homo sapiens
cctctggggtgagtgggccact

SEQ ID NO: 8006323 - DNA, 22 bp, Homo sapiens
cctctgactccagaaactccag

SEQ ID NO: 8006324 - DNA, 22 bp, Homo sapiens
cctctgacacttgtcccacaca

SEQ ID NO: 8006325 - DNA, 22 bp, Homo sapiens
cctctgaattttggctatgtag

SEQ ID NO: 8006326 - DNA, 22 bp, Homo sapiens
cctctgacacttgtcccacaca

SEQ ID NO: 8006327 - DNA, 22 bp, Homo sapiens
cctctcttggccgcagtcttct

SEQ ID NO: 8006328 - DNA, 22 bp, Homo sapiens
cctctcttggccgcagtcttct

SEQ ID NO: 8006329 - DNA, 22 bp, Homo sapiens
cctctctttcctacaccttgga

SEQ ID NO: 8006330 - DNA, 22 bp, Homo sapiens
cctctctttcctacaccttgga

SEQ ID NO: 8006331 - DNA, 23 bp, Homo sapiens
cctctctttttaggtggtgtttg

SEQ ID NO: 8006332 - DNA, 22 bp, Homo sapiens
cctctctttcctacaccttgga

SEQ ID NO: 8006333 - DNA, 22 bp, Homo sapiens
cctctgagaccagctctgcacc

SEQ ID NO: 8006334 - DNA, 22 bp, Homo sapiens
cctctgagaccagctctgcacc

SEQ ID NO: 8006335 - DNA, 22 bp, Homo sapiens
cctctgagaccagctctgcacc

SEQ ID NO: 8006336 - DNA, 22 bp, Homo sapiens
cctctgagaccagctctgcacc

SEQ ID NO: 8006337 - DNA, 22 bp, Homo sapiens
cctctgagaccagctctgcacc

SEQ ID NO: 8006338 - DNA, 22 bp, Homo sapiens
cctctgagccagcgtcttctct

SEQ ID NO: 8006339 - DNA, 22 bp, Homo sapiens
cctctgagaggccatctctcct

SEQ ID NO: 8006340 - DNA, 22 bp, Homo sapiens
cctctgagcctgtgtgcggcac

SEQ ID NO: 8006341 - DNA, 22 bp, Homo sapiens
cctctgagcctgtgtgcggcac

SEQ ID NO: 8006342 - DNA, 22 bp, Homo sapiens
cctctgagcctgtgtgcggcac

SEQ ID NO: 8006343 - DNA, 22 bp, Homo sapiens
cctctgagctggcctgtggggc

SEQ ID NO: 8006344 - DNA, 22 bp, Homo sapiens
cctctgaggtgagcccagctgg

SEQ ID NO: 8006345 - DNA, 22 bp, Homo sapiens
cctctggctgtaccactggcac

SEQ ID NO: 8006346 - DNA, 22 bp, Homo sapiens
cctctggctgtaccactggcac

SEQ ID NO: 8006347 - DNA, 22 bp, Homo sapiens
cctctggctgtaccactggcac

SEQ ID NO: 8006348 - DNA, 22 bp, Homo sapiens
cctctggctcacagcaccaact

SEQ ID NO: 8006349 - DNA, 22 bp, Homo sapiens
cctctgaggtgagcccagctgg

SEQ ID NO: 8006350 - DNA, 22 bp, Homo sapiens
cctctgggctggaaaattaatg

SEQ ID NO: 8006351 - DNA, 22 bp, Homo sapiens
cctctgggctgcctgcacgggt

SEQ ID NO: 8006352 - DNA, 22 bp, Homo sapiens
cctctgggctgcctgcacgggt

SEQ ID NO: 8006353 - DNA, 22 bp, Homo sapiens
cctctgggctgcctgcacgggt

SEQ ID NO: 8006354 - DNA, 22 bp, Homo sapiens
cctctggcttactgttgggttt

SEQ ID NO: 8006355 - DNA, 22 bp, Homo sapiens
cctctgggctgcctgcacgggt

SEQ ID NO: 8006356 - DNA, 22 bp, Homo sapiens
cctctgggctgcctgcacgggt

SEQ ID NO: 8006357 - DNA, 22 bp, Homo sapiens
cctctggggcatcagacaaagg

SEQ ID NO: 8006358 - DNA, 22 bp, Homo sapiens
cctctgggggcttccttaccct

SEQ ID NO: 8006359 - DNA, 22 bp, Homo sapiens
cctctgggggcttccttaccct

SEQ ID NO: 8006360 - DNA, 22 bp, Homo sapiens
cctctggggcatcagacaaagg

SEQ ID NO: 8006361 - DNA, 22 bp, Homo sapiens
cctctgggggcttccttaccct

SEQ ID NO: 8006362 - DNA, 22 bp, Homo sapiens
tggctgaggtaactatgaataa

SEQ ID NO: 8006363 - DNA, 22 bp, Homo sapiens
tggctgaggtaactatgaataa

SEQ ID NO: 8006364 - DNA, 23 bp, Homo sapiens
tggctgaggtccaggtagtttca

SEQ ID NO: 8006365 - DNA, 23 bp, Homo sapiens
tggctgaggtccaggtagtttca

SEQ ID NO: 8006366 - DNA, 23 bp, Homo sapiens
tggctgaggtccaggtagtttca

SEQ ID NO: 8006367 - DNA, 23 bp, Homo sapiens
tggctgaggtccaggtagtttca

SEQ ID NO: 8006368 - DNA, 23 bp, Homo sapiens
tggctgaggtccaggtagtttca

SEQ ID NO: 8006369 - DNA, 22 bp, Homo sapiens
tggctgaggtctggggcttctg

SEQ ID NO: 8006370 - DNA, 23 bp, Homo sapiens
tggctgaggtccaggtagtttca

SEQ ID NO: 8006371 - DNA, 22 bp, Homo sapiens
tggctgagggggctctgctcag

SEQ ID NO: 8006372 - DNA, 22 bp, Homo sapiens
tggctgagggggctctgctcag

SEQ ID NO: 8006373 - DNA, 22 bp, Homo sapiens
tggctgagggggcagttcagga

SEQ ID NO: 8006374 - DNA, 22 bp, Homo sapiens
tggctgaggtaactatgaataa

SEQ ID NO: 8006375 - DNA, 22 bp, Homo sapiens
tggctgaggtaactatgaataa

SEQ ID NO: 8006376 - DNA, 22 bp, Homo sapiens
tggctgagggggctctgctcag

SEQ ID NO: 8006377 - DNA, 22 bp, Homo sapiens
tggctgagggggctctgctcag

SEQ ID NO: 8006378 - DNA, 22 bp, Homo sapiens
cctccagcgcgatccactccgg

SEQ ID NO: 8006379 - DNA, 22 bp, Homo sapiens
cctccagcgcgatccactccgg

SEQ ID NO: 8006380 - DNA, 22 bp, Homo sapiens
cctccagcgcgatccactccgg

SEQ ID NO: 8006381 - DNA, 22 bp, Homo sapiens
cctccagcgcgatccactccgg

SEQ ID NO: 8006382 - DNA, 22 bp, Homo sapiens
cctccagccttcctgaagagcc

SEQ ID NO: 8006383 - DNA, 22 bp, Homo sapiens
cctccagcgcgatccactccgg

SEQ ID NO: 8006384 - DNA, 22 bp, Homo sapiens
cctccagcgcgatccactccgg

SEQ ID NO: 8006385 - DNA, 22 bp, Homo sapiens
cctccagccttcctgaagagcc

SEQ ID NO: 8006386 - DNA, 22 bp, Homo sapiens
cctccagccttcctgaagagcc

SEQ ID NO: 8006387 - DNA, 22 bp, Homo sapiens
tggctgagagcaattgactctg

SEQ ID NO: 8006388 - DNA, 22 bp, Homo sapiens
tggctgagagcaattgactctg

SEQ ID NO: 8006389 - DNA, 22 bp, Homo sapiens
tggctgagggggcagttcagga

SEQ ID NO: 8006390 - DNA, 22 bp, Homo sapiens
tggctgagggggcagttcagga

SEQ ID NO: 8006391 - DNA, 22 bp, Homo sapiens
tggctgagggggcagttcagga

SEQ ID NO: 8006392 - DNA, 22 bp, Homo sapiens
tggctgagagcaattgactctg

SEQ ID NO: 8006393 - DNA, 22 bp, Homo sapiens
tggctgagggggcagttcagga

SEQ ID NO: 8006394 - DNA, 22 bp, Homo sapiens
tggctgagggggcagttcagga

SEQ ID NO: 8006395 - DNA, 22 bp, Homo sapiens
cctccagcattactggcccatg

SEQ ID NO: 8006396 - DNA, 22 bp, Homo sapiens
cctccagcattactggcccatg

SEQ ID NO: 8006397 - DNA, 22 bp, Homo sapiens
cctccagcattactggcccatg

SEQ ID NO: 8006398 - DNA, 22 bp, Homo sapiens
cctccagactttggccatcctc

SEQ ID NO: 8006399 - DNA, 22 bp, Homo sapiens
cctccagcattactggcccatg

SEQ ID NO: 8006400 - DNA, 22 bp, Homo sapiens
cctccagcattactggcccatg

SEQ ID NO: 8006401 - DNA, 20 bp, Homo sapiens
cctccactgtcactgacctg

SEQ ID NO: 8006402 - DNA, 22 bp, Homo sapiens
cctccagactttggccatcctc

SEQ ID NO: 8006403 - DNA, 22 bp, Homo sapiens
cctccagactttggccatcctc

SEQ ID NO: 8006404 - DNA, 22 bp, Homo sapiens
cctccagactttggccatcctc

SEQ ID NO: 8006405 - DNA, 22 bp, Homo sapiens
cctccagactttggccatcctc

SEQ ID NO: 8006406 - DNA, 22 bp, Homo sapiens
cctccagagggtttcccatgaa

SEQ ID NO: 8006407 - DNA, 22 bp, Homo sapiens
cctccagagggtttcccatgaa

SEQ ID NO: 8006408 - DNA, 22 bp, Homo sapiens
cctccagagggtttcccatgaa

SEQ ID NO: 8006409 - DNA, 22 bp, Homo sapiens
cctccaagtttgactcaggaca

SEQ ID NO: 8006410 - DNA, 22 bp, Homo sapiens
tggctcatctttttagacttat

SEQ ID NO: 8006411 - DNA, 22 bp, Homo sapiens
cctccaagtgagagatggtaca

SEQ ID NO: 8006412 - DNA, 22 bp, Homo sapiens
cctccacaggagctgcagtgct

SEQ ID NO: 8006413 - DNA, 22 bp, Homo sapiens
cctccacaggagctgcagtgct

SEQ ID NO: 8006414 - DNA, 22 bp, Homo sapiens
cctccactgcttcccagctttg

SEQ ID NO: 8006415 - DNA, 22 bp, Homo sapiens
cctccaagtttgactcaggaca

SEQ ID NO: 8006416 - DNA, 22 bp, Homo sapiens
cctccactctggcctctcaggt

SEQ ID NO: 8006417 - DNA, 22 bp, Homo sapiens
cctccactctggcctctcaggt

SEQ ID NO: 8006418 - DNA, 22 bp, Homo sapiens
cctccacaggagctgcagtgct

SEQ ID NO: 8006419 - DNA, 22 bp, Homo sapiens
cctccacaggagctgcagtgct

SEQ ID NO: 8006420 - DNA, 22 bp, Homo sapiens
cctccactctggcctctcaggt

SEQ ID NO: 8006421 - DNA, 22 bp, Homo sapiens
cctccctgtctacctgttgtgg

SEQ ID NO: 8006422 - DNA, 22 bp, Homo sapiens
cctccctgtctacctgttgtgg

SEQ ID NO: 8006423 - DNA, 22 bp, Homo sapiens
cctccctgtctacctgttgtgg

SEQ ID NO: 8006424 - DNA, 22 bp, Homo sapiens
cctccctgtctacctgttgtgg

SEQ ID NO: 8006425 - DNA, 22 bp, Homo sapiens
cctccctgtctacctgttgtgg

SEQ ID NO: 8006426 - DNA, 22 bp, Homo sapiens
cctccctgtctacctgttgtgg

SEQ ID NO: 8006427 - DNA, 22 bp, Homo sapiens
cctcccttccccagtagtcaag

SEQ ID NO: 8006428 - DNA, 22 bp, Homo sapiens
cctcccttggccatagccagcc

SEQ ID NO: 8006429 - DNA, 22 bp, Homo sapiens
cctcccttttggtgtctgcata

SEQ ID NO: 8006430 - DNA, 22 bp, Homo sapiens
cctcccttttggtgtctgcata

SEQ ID NO: 8006431 - DNA, 22 bp, Homo sapiens
cctcccttttggtgtctgcata

SEQ ID NO: 8006432 - DNA, 22 bp, Homo sapiens
cctccctggccagagcagcagc

SEQ ID NO: 8006433 - DNA, 22 bp, Homo sapiens
tggctgaggtctggggcttctg

SEQ ID NO: 8006434 - DNA, 22 bp, Homo sapiens
tggctgaggtctggggcttctg

SEQ ID NO: 8006435 - DNA, 22 bp, Homo sapiens
cctccctggccagagcagcagc

SEQ ID NO: 8006436 - DNA, 22 bp, Homo sapiens
cctccctgggtgctgggattgc

SEQ ID NO: 8006437 - DNA, 22 bp, Homo sapiens
cctccctggtggctctggtcta

SEQ ID NO: 8006438 - DNA, 22 bp, Homo sapiens
cctccctgggtgctgggattgc

SEQ ID NO: 8006439 - DNA, 22 bp, Homo sapiens
cctccctgggtgacgggctcct

SEQ ID NO: 8006440 - DNA, 22 bp, Homo sapiens
cctcctggtccagcatctcttt

SEQ ID NO: 8006441 - DNA, 22 bp, Homo sapiens
cctcctggtccagcatctcttt

SEQ ID NO: 8006442 - DNA, 22 bp, Homo sapiens
cctcctccttatggtggcccag

SEQ ID NO: 8006443 - DNA, 22 bp, Homo sapiens
cctcctctgggaagattcagag

SEQ ID NO: 8006444 - DNA, 22 bp, Homo sapiens
cctcctggtccagcatctcttt

SEQ ID NO: 8006445 - DNA, 22 bp, Homo sapiens
cctcctctggtgctgccaaccc

SEQ ID NO: 8006446 - DNA, 23 bp, Homo sapiens
cctcctcatatctttgactagtg

SEQ ID NO: 8006447 - DNA, 23 bp, Homo sapiens
cctcctcatatctttgactagtg

SEQ ID NO: 8006448 - DNA, 23 bp, Homo sapiens
cctcctcatatctttgactagtg

SEQ ID NO: 8006449 - DNA, 23 bp, Homo sapiens
cctcctcatatctttgactagtg

SEQ ID NO: 8006450 - DNA, 22 bp, Homo sapiens
cctcctccttatggtggcccag

SEQ ID NO: 8006451 - DNA, 22 bp, Homo sapiens
cctcggctgggccttggccact

SEQ ID NO: 8006452 - DNA, 22 bp, Homo sapiens
cctcggctgggccttggccact

SEQ ID NO: 8006453 - DNA, 22 bp, Homo sapiens
cctcggctgggccttggccact

SEQ ID NO: 8006454 - DNA, 22 bp, Homo sapiens
cctcggggcaccgcggcctgct

SEQ ID NO: 8006455 - DNA, 22 bp, Homo sapiens
cctcgggctgaggctcccaggc

SEQ ID NO: 8006456 - DNA, 22 bp, Homo sapiens
cctcggctgggccttggccact

SEQ ID NO: 8006457 - DNA, 22 bp, Homo sapiens
cctcgtgtgctaggatccaggt

SEQ ID NO: 8006458 - DNA, 22 bp, Homo sapiens
cctcggtttccacatctgtaca

SEQ ID NO: 8006459 - DNA, 22 bp, Homo sapiens
cctcggaggcggaggctgcagt

SEQ ID NO: 8006460 - DNA, 23 bp, Homo sapiens
cctcctcatatctttgactagtg

SEQ ID NO: 8006461 - DNA, 18 bp, Homo sapiens
cctcggagcctccgtgtc

SEQ ID NO: 8006462 - DNA, 22 bp, Homo sapiens
cctcggagcacgccggccgccc

SEQ ID NO: 8006463 - DNA, 22 bp, Homo sapiens
cctcggagaaaggcagctccac

SEQ ID NO: 8006464 - DNA, 22 bp, Homo sapiens
tggctcagtttagcagctcagt

SEQ ID NO: 8006465 - DNA, 22 bp, Homo sapiens
tggctcagtttagcagctcagt

SEQ ID NO: 8006466 - DNA, 22 bp, Homo sapiens
tggctcagtttcagtcctggtt

SEQ ID NO: 8006467 - DNA, 22 bp, Homo sapiens
tggctcagtttagcagctcagt

SEQ ID NO: 8006468 - DNA, 22 bp, Homo sapiens
tggctcagtttcagtcctggtt

SEQ ID NO: 8006469 - DNA, 22 bp, Homo sapiens
tggctcagtttcagtcctggtt

SEQ ID NO: 8006470 - DNA, 22 bp, Homo sapiens
tggctcagtttcagtcctggtt

SEQ ID NO: 8006471 - DNA, 22 bp, Homo sapiens
tggctcagtttctgcccagctg

SEQ ID NO: 8006472 - DNA, 22 bp, Homo sapiens
tggctcagtttctgcccagctg

SEQ ID NO: 8006473 - DNA, 22 bp, Homo sapiens
tggctcagtttctgcccagctg

SEQ ID NO: 8006474 - DNA, 22 bp, Homo sapiens
tggctcagtttcagtcctggtt

SEQ ID NO: 8006475 - DNA, 22 bp, Homo sapiens
tggctcagtttcagtcctggtt

SEQ ID NO: 8006476 - DNA, 22 bp, Homo sapiens
tggctcagtttcagtcctggtt

SEQ ID NO: 8006477 - DNA, 22 bp, Homo sapiens
tggctcagtttgggggattgaa

SEQ ID NO: 8006478 - DNA, 22 bp, Homo sapiens
tggctcagtttgggggattgaa

SEQ ID NO: 8006479 - DNA, 22 bp, Homo sapiens
tggctcagtttgggggattgaa

SEQ ID NO: 8006480 - DNA, 22 bp, Homo sapiens
tggctcagtttgggggattgaa

SEQ ID NO: 8006481 - DNA, 22 bp, Homo sapiens
tggctcagtttctgcccagctg

SEQ ID NO: 8006482 - DNA, 22 bp, Homo sapiens
tggctcagtttctgcccagctg

SEQ ID NO: 8006483 - DNA, 22 bp, Homo sapiens
tggctcagtttctgcccagctg

SEQ ID NO: 8006484 - DNA, 22 bp, Homo sapiens
tggctcagtttctgcccagctg

SEQ ID NO: 8006485 - DNA, 22 bp, Homo sapiens
tggctcagtttgggggattgaa

SEQ ID NO: 8006486 - DNA, 22 bp, Homo sapiens
tggctcatctttttagacttat

SEQ ID NO: 8006487 - DNA, 22 bp, Homo sapiens
tggctcatgcatcttttctaca

SEQ ID NO: 8006488 - DNA, 22 bp, Homo sapiens
tggctcatgcctgtaatcttag

SEQ ID NO: 8006489 - DNA, 22 bp, Homo sapiens
tggctcagtttgggggattgaa

SEQ ID NO: 8006490 - DNA, 22 bp, Homo sapiens
tggctcagtttgggggattgaa

SEQ ID NO: 8006491 - DNA, 22 bp, Homo sapiens
tggctcatctatcagaaagtcc

SEQ ID NO: 8006492 - DNA, 22 bp, Homo sapiens
tggctcatattgagtgatttct

SEQ ID NO: 8006493 - DNA, 22 bp, Homo sapiens
tggctcatattgagtgatttct

SEQ ID NO: 8006494 - DNA, 22 bp, Homo sapiens
tggccctgctgtatcatctgct

SEQ ID NO: 8006495 - DNA, 22 bp, Homo sapiens
tggccctgcttatgtctctctt

SEQ ID NO: 8006496 - DNA, 22 bp, Homo sapiens
tggccctgctgtatcatctgct

SEQ ID NO: 8006497 - DNA, 22 bp, Homo sapiens
tggccctgctggccaaaggcta

SEQ ID NO: 8006498 - DNA, 22 bp, Homo sapiens
tggccctgctgggtcagagctg

SEQ ID NO: 8006499 - DNA, 22 bp, Homo sapiens
tggccctgctgggtcagagctg

SEQ ID NO: 8006500 - DNA, 22 bp, Homo sapiens
tggccctgctgggtcagagctg

SEQ ID NO: 8006501 - DNA, 22 bp, Homo sapiens
tggccctgctgggtcagagctg

SEQ ID NO: 8006502 - DNA, 22 bp, Homo sapiens
tggctcagctgactcggcttct

SEQ ID NO: 8006503 - DNA, 22 bp, Homo sapiens
tggctcagctgactcggcttct

SEQ ID NO: 8006504 - DNA, 22 bp, Homo sapiens
tggctcagctgtcacagcctgg

SEQ ID NO: 8006505 - DNA, 22 bp, Homo sapiens
tggctcagctgactcggcttct

SEQ ID NO: 8006506 - DNA, 22 bp, Homo sapiens
tggctcagctgtcacagcctgg

SEQ ID NO: 8006507 - DNA, 22 bp, Homo sapiens
tggctcagctgtcacagcctgg

SEQ ID NO: 8006508 - DNA, 22 bp, Homo sapiens
tggccctgcttatgtctctctt

SEQ ID NO: 8006509 - DNA, 21 bp, Homo sapiens
tggctcagttgctgggcacag

SEQ ID NO: 8006510 - DNA, 21 bp, Homo sapiens
tggctcagttgctgggcacag

SEQ ID NO: 8006511 - DNA, 22 bp, Homo sapiens
tggctcagctgtcacagcctgg

SEQ ID NO: 8006512 - DNA, 22 bp, Homo sapiens
tggctcagtttagcagctcagt

SEQ ID NO: 8006513 - DNA, 22 bp, Homo sapiens
tggctcagtttagcagctcagt

SEQ ID NO: 8006514 - DNA, 22 bp, Homo sapiens
tggctcagtttagcagctcagt

SEQ ID NO: 8006515 - DNA, 22 bp, Homo sapiens
tggctcagtttagcagctcagt

SEQ ID NO: 8006516 - DNA, 22 bp, Homo sapiens
tggccctgctggacacgcctgc

SEQ ID NO: 8006517 - DNA, 22 bp, Homo sapiens
tggccctgctggacacgcctgc

SEQ ID NO: 8006518 - DNA, 22 bp, Homo sapiens
tggccctgctggacacgcctgc

SEQ ID NO: 8006519 - DNA, 22 bp, Homo sapiens
tggccctgctggccaaaggcta

SEQ ID NO: 8006520 - DNA, 22 bp, Homo sapiens
tggccctgctggccaaaggcta

SEQ ID NO: 8006521 - DNA, 22 bp, Homo sapiens
tggccctgccgccacgacgtct

SEQ ID NO: 8006522 - DNA, 22 bp, Homo sapiens
tggccctgctatgatcctgcaa

SEQ ID NO: 8006523 - DNA, 22 bp, Homo sapiens
tggcccgcagcacgcgcaccat

SEQ ID NO: 8006524 - DNA, 22 bp, Homo sapiens
tggccctgctatgatcctgcaa

SEQ ID NO: 8006525 - DNA, 22 bp, Homo sapiens
tggccctgctatgatcctgcaa

SEQ ID NO: 8006526 - DNA, 22 bp, Homo sapiens
tggccctgctatgatcctgcaa

SEQ ID NO: 8006527 - DNA, 22 bp, Homo sapiens
tggccctgctatgatcctgcaa

SEQ ID NO: 8006528 - DNA, 22 bp, Homo sapiens
tggcccctggcacacggaggat

SEQ ID NO: 8006529 - DNA, 18 bp, Homo sapiens
tggccccttatcagtcct

SEQ ID NO: 8006530 - DNA, 22 bp, Homo sapiens
tggcccgacctctgctcatgca

SEQ ID NO: 8006531 - DNA, 22 bp, Homo sapiens
tggcccgaagatccgagggtca

SEQ ID NO: 8006532 - DNA, 22 bp, Homo sapiens
tggcccgaagatccgagggtca

SEQ ID NO: 8006533 - DNA, 22 bp, Homo sapiens
tggcccctgaggagcgtcagcc

SEQ ID NO: 8006534 - DNA, 22 bp, Homo sapiens
tggcccctgaggagcatcagcc

SEQ ID NO: 8006535 - DNA, 22 bp, Homo sapiens
tggccccccagagctggaggac

SEQ ID NO: 8006536 - DNA, 20 bp, Homo sapiens
tggcccagtggggcagggtg

SEQ ID NO: 8006537 - DNA, 20 bp, Homo sapiens
tggcccagtggggcagggtg

SEQ ID NO: 8006538 - DNA, 20 bp, Homo sapiens
tggcccagtggggcagggtg

SEQ ID NO: 8006539 - DNA, 20 bp, Homo sapiens
tggcccagtggggcagggtg

SEQ ID NO: 8006540 - DNA, 20 bp, Homo sapiens
tggcccagtggggcagggtg

SEQ ID NO: 8006541 - DNA, 20 bp, Homo sapiens
tggcccagtggggcagggtg

SEQ ID NO: 8006542 - DNA, 20 bp, Homo sapiens
tggcccagtggggcagggtg

SEQ ID NO: 8006543 - DNA, 20 bp, Homo sapiens
tggcccagtggggcagggtg

SEQ ID NO: 8006544 - DNA, 22 bp, Homo sapiens
tggccccattttacagatgaaa

SEQ ID NO: 8006545 - DNA, 20 bp, Homo sapiens
tggcccagtggggcagggtg

SEQ ID NO: 8006546 - DNA, 22 bp, Homo sapiens
tggcccatcatggaaaataaag

SEQ ID NO: 8006547 - DNA, 20 bp, Homo sapiens
tggcccagtggggcagggtg

SEQ ID NO: 8006548 - DNA, 22 bp, Homo sapiens
tggccccacagggccttttcag

SEQ ID NO: 8006549 - DNA, 22 bp, Homo sapiens
tggcccagtgcttatgctctga

SEQ ID NO: 8006550 - DNA, 22 bp, Homo sapiens
tggcccagtgcttatgctctga

SEQ ID NO: 8006551 - DNA, 22 bp, Homo sapiens
tggcccagtgcttatgctctga

SEQ ID NO: 8006552 - DNA, 22 bp, Homo sapiens
tggcccagtgcttatgctctga

SEQ ID NO: 8006553 - DNA, 22 bp, Homo sapiens
tggcccagtgcttatgctctga

SEQ ID NO: 8006554 - DNA, 22 bp, Homo sapiens
tggcccagtgcttatgctctga

SEQ ID NO: 8006555 - DNA, 22 bp, Homo sapiens
tggcccagtgcttatgctctga

SEQ ID NO: 8006556 - DNA, 22 bp, Homo sapiens
tggcccagcagttctgccccag

SEQ ID NO: 8006557 - DNA, 21 bp, Homo sapiens
cctatgtcgcactcctaggat

SEQ ID NO: 8006558 - DNA, 22 bp, Homo sapiens
cctatggctcctgccctggagt

SEQ ID NO: 8006559 - DNA, 22 bp, Homo sapiens
tggcccagcagttctgccccag

SEQ ID NO: 8006560 - DNA, 22 bp, Homo sapiens
tggcccagccctgctctagggc

SEQ ID NO: 8006561 - DNA, 22 bp, Homo sapiens
tggcccagccctgctctagggc

SEQ ID NO: 8006562 - DNA, 22 bp, Homo sapiens
cccaggaaagagactgctgggt

SEQ ID NO: 8006563 - DNA, 22 bp, Homo sapiens
cccaggaaagaatttagagcca

SEQ ID NO: 8006564 - DNA, 22 bp, Homo sapiens
cccaggaaagaatttagagcca

SEQ ID NO: 8006565 - DNA, 22 bp, Homo sapiens
cccaggaaagtggaggcggctg

SEQ ID NO: 8006566 - DNA, 22 bp, Homo sapiens
cccaggaaagtggaggcggctg

SEQ ID NO: 8006567 - DNA, 22 bp, Homo sapiens
cccaggaaagtgaatctaattg

SEQ ID NO: 8006568 - DNA, 22 bp, Homo sapiens
cccaggaaaggaaatgaatggg

SEQ ID NO: 8006569 - DNA, 22 bp, Homo sapiens
cccaggaaaagcagtgccagca

SEQ ID NO: 8006570 - DNA, 22 bp, Homo sapiens
cccaggaaaagcagtgccagca

SEQ ID NO: 8006571 - DNA, 22 bp, Homo sapiens
cccaggaaaagcagtgccagca

SEQ ID NO: 8006572 - DNA, 22 bp, Homo sapiens
cccaggaaaagcagtgccagca

SEQ ID NO: 8006573 - DNA, 22 bp, Homo sapiens
cccaggaaacccgaaggcgacc

SEQ ID NO: 8006574 - DNA, 22 bp, Homo sapiens
cccaggaaagaaagtatatggt

SEQ ID NO: 8006575 - DNA, 22 bp, Homo sapiens
cccaggaaacccgaaggcgacc

SEQ ID NO: 8006576 - DNA, 22 bp, Homo sapiens
cccaggaaaagcagtgccagca

SEQ ID NO: 8006577 - DNA, 22 bp, Homo sapiens
cccagcttgctcaccattccca

SEQ ID NO: 8006578 - DNA, 22 bp, Homo sapiens
cccagcttgctcaccattccca

SEQ ID NO: 8006579 - DNA, 22 bp, Homo sapiens
cccagcttgtctgattcagcct

SEQ ID NO: 8006580 - DNA, 22 bp, Homo sapiens
cccagctttccacttcctctgg

SEQ ID NO: 8006581 - DNA, 22 bp, Homo sapiens
cccagcttgcccaggactgagg

SEQ ID NO: 8006582 - DNA, 19 bp, Homo sapiens
cccagctgttcttccacca

SEQ ID NO: 8006583 - DNA, 22 bp, Homo sapiens
tgcattaaaatgatggagaaat

SEQ ID NO: 8006584 - DNA, 22 bp, Homo sapiens
tgcattaaaaccatcgaccatc

SEQ ID NO: 8006585 - DNA, 22 bp, Homo sapiens
tgcatcacttagctgcacaact

SEQ ID NO: 8006586 - DNA, 22 bp, Homo sapiens
tgcatcacttagctgcacaact

SEQ ID NO: 8006587 - DNA, 22 bp, Homo sapiens
tgcatcacaggcaagcaaggct

SEQ ID NO: 8006588 - DNA, 22 bp, Homo sapiens
tgcatcaagaagtctaagtttg

SEQ ID NO: 8006589 - DNA, 22 bp, Homo sapiens
tgcatgtttgtgtctgagaact

SEQ ID NO: 8006590 - DNA, 22 bp, Homo sapiens
tgcatgtttctgtatgttaatg

SEQ ID NO: 8006591 - DNA, 22 bp, Homo sapiens
tgcatcagaggatagctgcagt

SEQ ID NO: 8006592 - DNA, 22 bp, Homo sapiens
tgcatcagaggatagctgcagt

SEQ ID NO: 8006593 - DNA, 22 bp, Homo sapiens
tgcatcagaggatagctgcagt

SEQ ID NO: 8006594 - DNA, 22 bp, Homo sapiens
tgcattaaggccattgaaattt

SEQ ID NO: 8006595 - DNA, 22 bp, Homo sapiens
tgcattaagggcctggagatac

SEQ ID NO: 8006596 - DNA, 22 bp, Homo sapiens
tgcattaaatataatctgttga

SEQ ID NO: 8006597 - DNA, 22 bp, Homo sapiens
tgcattaaggccattgaaattt

SEQ ID NO: 8006598 - DNA, 22 bp, Homo sapiens
tgcattaagtgtctgcatatgg

SEQ ID NO: 8006599 - DNA, 20 bp, Homo sapiens
tgcattaagtggcattgagc

SEQ ID NO: 8006600 - DNA, 22 bp, Homo sapiens
tgcattaagtgtctgcatatgg

SEQ ID NO: 8006601 - DNA, 22 bp, Homo sapiens
tgcattaagtgtctgcatatgg

SEQ ID NO: 8006602 - DNA, 22 bp, Homo sapiens
tgcattaagtgtctgcatatgg

SEQ ID NO: 8006603 - DNA, 22 bp, Homo sapiens
tgcattaaggtaattgtataat

SEQ ID NO: 8006604 - DNA, 20 bp, Homo sapiens
tgcattaagtggcattgagc

SEQ ID NO: 8006605 - DNA, 23 bp, Homo sapiens
cccagctggaagttagaggacca

SEQ ID NO: 8006606 - DNA, 17 bp, Homo sapiens
cccagctggcagtgccg

SEQ ID NO: 8006607 - DNA, 17 bp, Homo sapiens
cccagctggcagtgccg

SEQ ID NO: 8006608 - DNA, 23 bp, Homo sapiens
cccagctggaagttagaggacca

SEQ ID NO: 8006609 - DNA, 23 bp, Homo sapiens
cccagctgcagacaagggagggt

SEQ ID NO: 8006610 - DNA, 17 bp, Homo sapiens
cccagctgcgtctgagg

SEQ ID NO: 8006611 - DNA, 17 bp, Homo sapiens
cccagctgcgtctgagg

SEQ ID NO: 8006612 - DNA, 17 bp, Homo sapiens
cccagctgcgtctgagg

SEQ ID NO: 8006613 - DNA, 23 bp, Homo sapiens
cccagctgcagacaagggagggt

SEQ ID NO: 8006614 - DNA, 23 bp, Homo sapiens
cccagctgcagacaagggagggt

SEQ ID NO: 8006615 - DNA, 23 bp, Homo sapiens
cccagctgcagacaagggagggt

SEQ ID NO: 8006616 - DNA, 23 bp, Homo sapiens
cccagctgcagacaagggagggt

SEQ ID NO: 8006617 - DNA, 22 bp, Homo sapiens
cccagctgtaacgggtctgcac

SEQ ID NO: 8006618 - DNA, 22 bp, Homo sapiens
cccagctgtaacgggtctgcac

SEQ ID NO: 8006619 - DNA, 22 bp, Homo sapiens
cccagctgtaacgggtctgcac

SEQ ID NO: 8006620 - DNA, 22 bp, Homo sapiens
cccagctgtggcagaggccggg

SEQ ID NO: 8006621 - DNA, 22 bp, Homo sapiens
cccagctgtggcagaggccggg

SEQ ID NO: 8006622 - DNA, 22 bp, Homo sapiens
cccagctgtaacgggtctgcac

SEQ ID NO: 8006623 - DNA, 18 bp, Homo sapiens
cccagctggtgggtcagt

SEQ ID NO: 8006624 - DNA, 18 bp, Homo sapiens
cccagctggtgggtcagt

SEQ ID NO: 8006625 - DNA, 18 bp, Homo sapiens
cccagctggtgggtcagt

SEQ ID NO: 8006626 - DNA, 18 bp, Homo sapiens
cccagctggtgggtcagt

SEQ ID NO: 8006627 - DNA, 22 bp, Homo sapiens
cccagctggccaggtggctttg

SEQ ID NO: 8006628 - DNA, 22 bp, Homo sapiens
cccagctggccaggtggctttg

SEQ ID NO: 8006629 - DNA, 22 bp, Homo sapiens
cccagctggccaggtggctttg

SEQ ID NO: 8006630 - DNA, 22 bp, Homo sapiens
cccagctggccaggtggctttg

SEQ ID NO: 8006631 - DNA, 17 bp, Homo sapiens
cccagctggcagtgccg

SEQ ID NO: 8006632 - DNA, 17 bp, Homo sapiens
cccagctggcagtgccg

SEQ ID NO: 8006633 - DNA, 22 bp, Homo sapiens
cccagctcttcctgggagctaa

SEQ ID NO: 8006634 - DNA, 22 bp, Homo sapiens
cccagctcttcctgggagctaa

SEQ ID NO: 8006635 - DNA, 22 bp, Homo sapiens
cccagctcttttagcggcatct

SEQ ID NO: 8006636 - DNA, 22 bp, Homo sapiens
cccagctcttttagcggcatct

SEQ ID NO: 8006637 - DNA, 22 bp, Homo sapiens
cccagctgaacttgcattccaa

SEQ ID NO: 8006638 - DNA, 22 bp, Homo sapiens
cccagctgaacttgcattccaa

SEQ ID NO: 8006639 - DNA, 22 bp, Homo sapiens
cccagctcttcaagtcaccccc

SEQ ID NO: 8006640 - DNA, 22 bp, Homo sapiens
cccagctcttcaagtcaccccc

SEQ ID NO: 8006641 - DNA, 22 bp, Homo sapiens
cccagctcttcaagtcaccccc

SEQ ID NO: 8006642 - DNA, 23 bp, Homo sapiens
cccagctgagacttcctgaactc

SEQ ID NO: 8006643 - DNA, 23 bp, Homo sapiens
cccagctgagacttcctgaactc

SEQ ID NO: 8006644 - DNA, 23 bp, Homo sapiens
cccagctgagacttcctgaactc

SEQ ID NO: 8006645 - DNA, 22 bp, Homo sapiens
cccagctgaacttgcattccaa

SEQ ID NO: 8006646 - DNA, 23 bp, Homo sapiens
cccagctgagacttcctgaactc

SEQ ID NO: 8006647 - DNA, 22 bp, Homo sapiens
cccagctgatttttgcagagat

SEQ ID NO: 8006648 - DNA, 22 bp, Homo sapiens
cccagctgatttttgcagagat

SEQ ID NO: 8006649 - DNA, 22 bp, Homo sapiens
cccagctgatttttgcagagat

SEQ ID NO: 8006650 - DNA, 22 bp, Homo sapiens
cccagctgatttttgcagagat

SEQ ID NO: 8006651 - DNA, 22 bp, Homo sapiens
cccagctgatttttgcagagat

SEQ ID NO: 8006652 - DNA, 22 bp, Homo sapiens
cccagctgatttttgcagagat

SEQ ID NO: 8006653 - DNA, 22 bp, Homo sapiens
cccagctgcacctctatggcct

SEQ ID NO: 8006654 - DNA, 22 bp, Homo sapiens
cccagctgatttttgcagagat

SEQ ID NO: 8006655 - DNA, 22 bp, Homo sapiens
cccagctgcacctctatggcct

SEQ ID NO: 8006656 - DNA, 22 bp, Homo sapiens
cccagctgcacctctatggcct

SEQ ID NO: 8006657 - DNA, 22 bp, Homo sapiens
cccagctgcacctctatggcct

SEQ ID NO: 8006658 - DNA, 22 bp, Homo sapiens
cccagctgatttttgcagagat

SEQ ID NO: 8006659 - DNA, 22 bp, Homo sapiens
cccagcctgtgacagccgtcct

SEQ ID NO: 8006660 - DNA, 22 bp, Homo sapiens
cccagcctgtgacagccgtcct

SEQ ID NO: 8006661 - DNA, 22 bp, Homo sapiens
cccagcctgtgacagccgtcct

SEQ ID NO: 8006662 - DNA, 22 bp, Homo sapiens
cccagcctggtgcactgtgggg

SEQ ID NO: 8006663 - DNA, 22 bp, Homo sapiens
cccagcctgtgacagccgtcct

SEQ ID NO: 8006664 - DNA, 22 bp, Homo sapiens
cccagcctttgcttcctggttc

SEQ ID NO: 8006665 - DNA, 22 bp, Homo sapiens
cccagcctttgcttcctggttc

SEQ ID NO: 8006666 - DNA, 22 bp, Homo sapiens
cccagccttccaccctggacta

SEQ ID NO: 8006667 - DNA, 22 bp, Homo sapiens
cccagcctttgcttcctggttc

SEQ ID NO: 8006668 - DNA, 22 bp, Homo sapiens
cccagccttccaccctggacta

SEQ ID NO: 8006669 - DNA, 22 bp, Homo sapiens
cccagcctttgcttcctggttc

SEQ ID NO: 8006670 - DNA, 22 bp, Homo sapiens
cccagccttccaccctggacta

SEQ ID NO: 8006671 - DNA, 22 bp, Homo sapiens
cccagccttccaccctggacta

SEQ ID NO: 8006672 - DNA, 22 bp, Homo sapiens
cccagccttccaccctggacta

SEQ ID NO: 8006673 - DNA, 22 bp, Homo sapiens
cccagcctactctgccatagca

SEQ ID NO: 8006674 - DNA, 21 bp, Homo sapiens
tctgtggcggactctaggccc

SEQ ID NO: 8006675 - DNA, 22 bp, Homo sapiens
cccagcctactctgccatagca

SEQ ID NO: 8006676 - DNA, 22 bp, Homo sapiens
cccagcctactctgccatagca

SEQ ID NO: 8006677 - DNA, 22 bp, Homo sapiens
cccagcctactctgccatagca

SEQ ID NO: 8006678 - DNA, 21 bp, Homo sapiens
tctgtggcggactctaggccc

SEQ ID NO: 8006679 - DNA, 22 bp, Homo sapiens
tctgtggcctgtgtccaagtgc

SEQ ID NO: 8006680 - DNA, 22 bp, Homo sapiens
tctgtggcatgttgcacttgta

SEQ ID NO: 8006681 - DNA, 22 bp, Homo sapiens
tctgtggcatgttgcacttgta

SEQ ID NO: 8006682 - DNA, 22 bp, Homo sapiens
tctgtggcccaagtgatggctg

SEQ ID NO: 8006683 - DNA, 22 bp, Homo sapiens
tgcagggagggcccagcaatct

SEQ ID NO: 8006684 - DNA, 22 bp, Homo sapiens
tgcagggaggccccgcagccct

SEQ ID NO: 8006685 - DNA, 22 bp, Homo sapiens
tgcagggaggccccgcagccct

SEQ ID NO: 8006686 - DNA, 22 bp, Homo sapiens
tgcagggaggccccgcagccct

SEQ ID NO: 8006687 - DNA, 22 bp, Homo sapiens
tgcagggaggccccgcagccct

SEQ ID NO: 8006688 - DNA, 22 bp, Homo sapiens
tgcagggagggcccagcaatct

SEQ ID NO: 8006689 - DNA, 22 bp, Homo sapiens
tgcagggagggcccagcaatct

SEQ ID NO: 8006690 - DNA, 22 bp, Homo sapiens
tgcagggagggcccagcaatct

SEQ ID NO: 8006691 - DNA, 22 bp, Homo sapiens
tgcagggatcctagctgaagag

SEQ ID NO: 8006692 - DNA, 22 bp, Homo sapiens
cccagctctggaaggtggggga

SEQ ID NO: 8006693 - DNA, 22 bp, Homo sapiens
cccagctcttcaagtcaccccc

SEQ ID NO: 8006694 - DNA, 22 bp, Homo sapiens
tgcagggacaggctctggggat

SEQ ID NO: 8006695 - DNA, 22 bp, Homo sapiens
tgcagggacaggctctggggat

SEQ ID NO: 8006696 - DNA, 22 bp, Homo sapiens
tgcagggacacgaagacaaata

SEQ ID NO: 8006697 - DNA, 22 bp, Homo sapiens
tgcagggaccccgaggctctct

SEQ ID NO: 8006698 - DNA, 22 bp, Homo sapiens
tgcagggaccccgaggctctct

SEQ ID NO: 8006699 - DNA, 22 bp, Homo sapiens
tgcagggagctctggggtgcag

SEQ ID NO: 8006700 - DNA, 22 bp, Homo sapiens
tgcagggagctctggggtgcag

SEQ ID NO: 8006701 - DNA, 22 bp, Homo sapiens
tgcagggaccccgaggctctct

SEQ ID NO: 8006702 - DNA, 22 bp, Homo sapiens
tgcagggaggccccgcagccct

SEQ ID NO: 8006703 - DNA, 22 bp, Homo sapiens
tgcagggagctctggggtgcag

SEQ ID NO: 8006704 - DNA, 22 bp, Homo sapiens
tgcagggaatgcttgcagcatg

SEQ ID NO: 8006705 - DNA, 22 bp, Homo sapiens
tgcagggaatgcttgcagcatg

SEQ ID NO: 8006706 - DNA, 22 bp, Homo sapiens
tgcagggaatgcttgcagcatg

SEQ ID NO: 8006707 - DNA, 22 bp, Homo sapiens
tgcagggaatctgtggctggac

SEQ ID NO: 8006708 - DNA, 22 bp, Homo sapiens
tgcagggaatctgtggctggac

SEQ ID NO: 8006709 - DNA, 22 bp, Homo sapiens
tgcagggaatctgtggctggac

SEQ ID NO: 8006710 - DNA, 22 bp, Homo sapiens
tgcagggaatgcttgcagcatg

SEQ ID NO: 8006711 - DNA, 22 bp, Homo sapiens
tgcagggaatgcttgcagcatg

SEQ ID NO: 8006712 - DNA, 22 bp, Homo sapiens
tgcagggaatgcttgcagcatg

SEQ ID NO: 8006713 - DNA, 22 bp, Homo sapiens
tgcagggaatgcttgcagcatg

SEQ ID NO: 8006714 - DNA, 22 bp, Homo sapiens
tgcagggaatgcttgcagcatg

SEQ ID NO: 8006715 - DNA, 22 bp, Homo sapiens
tgcagggacacgaagacaaata

SEQ ID NO: 8006716 - DNA, 22 bp, Homo sapiens
tgcagggacacgaagacaaata

SEQ ID NO: 8006717 - DNA, 22 bp, Homo sapiens
tgcagggacacgaagacaaata

SEQ ID NO: 8006718 - DNA, 22 bp, Homo sapiens
cccagctacctctgctaggaga

SEQ ID NO: 8006719 - DNA, 23 bp, Homo sapiens
cccagcgctgagccctgcaggca

SEQ ID NO: 8006720 - DNA, 22 bp, Homo sapiens
cccagctcaagcagagagctaa

SEQ ID NO: 8006721 - DNA, 22 bp, Homo sapiens
cccagctcaagcagagagctaa

SEQ ID NO: 8006722 - DNA, 23 bp, Homo sapiens
cccagcgctgagccctgcaggca

SEQ ID NO: 8006723 - DNA, 23 bp, Homo sapiens
cccagcgctgagccctgcaggca

SEQ ID NO: 8006724 - DNA, 23 bp, Homo sapiens
cccagcgctgagccctgcaggca

SEQ ID NO: 8006725 - DNA, 23 bp, Homo sapiens
cccagcgctgagccctgcaggca

SEQ ID NO: 8006726 - DNA, 22 bp, Homo sapiens
cccagcgagtttgccggtgaac

SEQ ID NO: 8006727 - DNA, 22 bp, Homo sapiens
cccagcgagtttgccggtgaac

SEQ ID NO: 8006728 - DNA, 22 bp, Homo sapiens
cccagcgagtttgccggtgaac

SEQ ID NO: 8006729 - DNA, 22 bp, Homo sapiens
tgccaagatgtaggcaggcata

SEQ ID NO: 8006730 - DNA, 22 bp, Homo sapiens
tgccaagaggtccaggtgggaa

SEQ ID NO: 8006731 - DNA, 22 bp, Homo sapiens
tgccaagataacacagctagta

SEQ ID NO: 8006732 - DNA, 22 bp, Homo sapiens
tgcattcatcatttgaaagccc

SEQ ID NO: 8006733 - DNA, 22 bp, Homo sapiens
tgccaaggagctggatcagggc

SEQ ID NO: 8006734 - DNA, 22 bp, Homo sapiens
tgccaaggagctggatcagggc

SEQ ID NO: 8006735 - DNA, 22 bp, Homo sapiens
tgccaagattatcgaagtctta

SEQ ID NO: 8006736 - DNA, 20 bp, Homo sapiens
tgccaagctctttagatcga

SEQ ID NO: 8006737 - DNA, 22 bp, Homo sapiens
tgcattcagttggtcagctttt

SEQ ID NO: 8006738 - DNA, 22 bp, Homo sapiens
tgcattcaatgtgccagggaaa

SEQ ID NO: 8006739 - DNA, 22 bp, Homo sapiens
tgccaagaggtccaggtgggaa

SEQ ID NO: 8006740 - DNA, 22 bp, Homo sapiens
tgcattcaatgtgccagggaaa

SEQ ID NO: 8006741 - DNA, 22 bp, Homo sapiens
tgcattcaaatcctgatcctgc

SEQ ID NO: 8006742 - DNA, 22 bp, Homo sapiens
tgcattcaaatctccaggctca

SEQ ID NO: 8006743 - DNA, 22 bp, Homo sapiens
tgcattatacttttagaaattt

SEQ ID NO: 8006744 - DNA, 22 bp, Homo sapiens
tgcattatacatggatctaaag

SEQ ID NO: 8006745 - DNA, 23 bp, Homo sapiens
tgcattatcctctctgaagacca

SEQ ID NO: 8006746 - DNA, 22 bp, Homo sapiens
tgcattatctttaatgttctca

SEQ ID NO: 8006747 - DNA, 22 bp, Homo sapiens
tgcattatctttaatgttctca

SEQ ID NO: 8006748 - DNA, 22 bp, Homo sapiens
tgccacagacaggacagaacag

SEQ ID NO: 8006749 - DNA, 22 bp, Homo sapiens
tgccacagacaggacagaacag

SEQ ID NO: 8006750 - DNA, 22 bp, Homo sapiens
tgccacactcccctgctgcagt

SEQ ID NO: 8006751 - DNA, 22 bp, Homo sapiens
tgccacagacaggacagaacag

SEQ ID NO: 8006752 - DNA, 22 bp, Homo sapiens
tgccacagagactttcattgta

SEQ ID NO: 8006753 - DNA, 22 bp, Homo sapiens
tgccacagagactttcattgta

SEQ ID NO: 8006754 - DNA, 22 bp, Homo sapiens
tgccacagagactttcattgta

SEQ ID NO: 8006755 - DNA, 22 bp, Homo sapiens
tgccacacaattactgctgcta

SEQ ID NO: 8006756 - DNA, 22 bp, Homo sapiens
tgccaagtggagctcaggaatc

SEQ ID NO: 8006757 - DNA, 22 bp, Homo sapiens
tgccaagggtatgggcaagata

SEQ ID NO: 8006758 - DNA, 22 bp, Homo sapiens
tgccaagggtatgggcaagata

SEQ ID NO: 8006759 - DNA, 22 bp, Homo sapiens
tgccaagggtatgggcaagata

SEQ ID NO: 8006760 - DNA, 22 bp, Homo sapiens
tgccaagtggagctcaggaatc

SEQ ID NO: 8006761 - DNA, 22 bp, Homo sapiens
tgccaagggtatgggcaagata

SEQ ID NO: 8006762 - DNA, 22 bp, Homo sapiens
tgccaagggtatgggcaagata

SEQ ID NO: 8006763 - DNA, 22 bp, Homo sapiens
tgccaagtttctctcagggact

SEQ ID NO: 8006764 - DNA, 22 bp, Homo sapiens
tgccaagtggagctcaggaatc

SEQ ID NO: 8006765 - DNA, 22 bp, Homo sapiens
tgccaagttacacaatcagaaa

SEQ ID NO: 8006766 - DNA, 22 bp, Homo sapiens
tgccaatctggtgggtgcaaat

SEQ ID NO: 8006767 - DNA, 22 bp, Homo sapiens
tgccaatcagctttgcaacttg

SEQ ID NO: 8006768 - DNA, 22 bp, Homo sapiens
tgccaatccactgcagccacag

SEQ ID NO: 8006769 - DNA, 22 bp, Homo sapiens
tgccaatctttgtgataattgc

SEQ ID NO: 8006770 - DNA, 22 bp, Homo sapiens
tgccaattagagacatccatct

SEQ ID NO: 8006771 - DNA, 22 bp, Homo sapiens
tgccacacaattactgctgcta

SEQ ID NO: 8006772 - DNA, 22 bp, Homo sapiens
cccaggaggtgtagctgcgtgg

SEQ ID NO: 8006773 - DNA, 22 bp, Homo sapiens
cccaggaggtgtagctgcgtgg

SEQ ID NO: 8006774 - DNA, 22 bp, Homo sapiens
cccaggaggtgtagctgcgtgg

SEQ ID NO: 8006775 - DNA, 22 bp, Homo sapiens
cccaggaggtggaggttgcggt

SEQ ID NO: 8006776 - DNA, 22 bp, Homo sapiens
cccaggaggtggaggttgcggt

SEQ ID NO: 8006777 - DNA, 22 bp, Homo sapiens
cccaggaggtggaggttgcagt

SEQ ID NO: 8006778 - DNA, 22 bp, Homo sapiens
cccaggaggtggagttcacagt

SEQ ID NO: 8006779 - DNA, 22 bp, Homo sapiens
cccaggaggtggaggttgcggt

SEQ ID NO: 8006780 - DNA, 22 bp, Homo sapiens
cccaggaggtggagttcacagt

SEQ ID NO: 8006781 - DNA, 22 bp, Homo sapiens
tgccaggcctcaggagtctcca

SEQ ID NO: 8006782 - DNA, 22 bp, Homo sapiens
tgccaggcctcaggagtctcca

SEQ ID NO: 8006783 - DNA, 22 bp, Homo sapiens
tgccaggcctcaggagtctcca

SEQ ID NO: 8006784 - DNA, 22 bp, Homo sapiens
tgccaggcctcaggagtctcca

SEQ ID NO: 8006785 - DNA, 22 bp, Homo sapiens
tgccaggcctcaggagtctcca

SEQ ID NO: 8006786 - DNA, 22 bp, Homo sapiens
tgccaggcctcaggagtctcca

SEQ ID NO: 8006787 - DNA, 22 bp, Homo sapiens
cccaggaggttgaggctgcagt

SEQ ID NO: 8006788 - DNA, 22 bp, Homo sapiens
cccaggaggttgaggctgcagt

SEQ ID NO: 8006789 - DNA, 22 bp, Homo sapiens
cccaggaggttgaggctgcagt

SEQ ID NO: 8006790 - DNA, 22 bp, Homo sapiens
cccaggaggttgaggctgcagt

SEQ ID NO: 8006791 - DNA, 22 bp, Homo sapiens
cccaggaggttgaggctgcagt

SEQ ID NO: 8006792 - DNA, 22 bp, Homo sapiens
cccaggaggttgaggctgcagt

SEQ ID NO: 8006793 - DNA, 22 bp, Homo sapiens
cccaggaggttgaggctgcagt

SEQ ID NO: 8006794 - DNA, 22 bp, Homo sapiens
cccaggaggtggaggctgcagt

SEQ ID NO: 8006795 - DNA, 22 bp, Homo sapiens
cccaggaggtggaggctgcagt

SEQ ID NO: 8006796 - DNA, 22 bp, Homo sapiens
cccaggaggtggaggctgcagt

SEQ ID NO: 8006797 - DNA, 22 bp, Homo sapiens
cccaggaggtggaggctgcagt

SEQ ID NO: 8006798 - DNA, 22 bp, Homo sapiens
cccaggaggtggaggctgcagt

SEQ ID NO: 8006799 - DNA, 22 bp, Homo sapiens
cccaggaggtggaggttgcagc

SEQ ID NO: 8006800 - DNA, 22 bp, Homo sapiens
cccaggaggtggaggttgcagc

SEQ ID NO: 8006801 - DNA, 22 bp, Homo sapiens
cccaggaggtggaggttgcagc

SEQ ID NO: 8006802 - DNA, 22 bp, Homo sapiens
cccaggaggtggaggttgcagc

SEQ ID NO: 8006803 - DNA, 22 bp, Homo sapiens
cccaggaggtggaggttgcagt

SEQ ID NO: 8006804 - DNA, 22 bp, Homo sapiens
cccaggaggtggaggttgcagt

SEQ ID NO: 8006805 - DNA, 22 bp, Homo sapiens
cccaggaggtggaggttgcagt

SEQ ID NO: 8006806 - DNA, 22 bp, Homo sapiens
cccaggaggtggaggctgcagt

SEQ ID NO: 8006807 - DNA, 22 bp, Homo sapiens
cccaggaggtggaggctgcagt

SEQ ID NO: 8006808 - DNA, 22 bp, Homo sapiens
cccaggaggtggaggctgcagt

SEQ ID NO: 8006809 - DNA, 22 bp, Homo sapiens
cccaggaggtggaggctgcagt

SEQ ID NO: 8006810 - DNA, 22 bp, Homo sapiens
cccaggaggtggaggctgcagt

SEQ ID NO: 8006811 - DNA, 22 bp, Homo sapiens
tgccacagagcaattctgctga

SEQ ID NO: 8006812 - DNA, 22 bp, Homo sapiens
cccaggaggtggaggctgcagt

SEQ ID NO: 8006813 - DNA, 22 bp, Homo sapiens
cccaggaggtggaggctgcagt

SEQ ID NO: 8006814 - DNA, 22 bp, Homo sapiens
tgccacagagcaattctgctga

SEQ ID NO: 8006815 - DNA, 22 bp, Homo sapiens
tgccacagagcaattctgctga

SEQ ID NO: 8006816 - DNA, 22 bp, Homo sapiens
tgccacagagcaattctgctga

SEQ ID NO: 8006817 - DNA, 22 bp, Homo sapiens
tgccacagagcaattctgctga

SEQ ID NO: 8006818 - DNA, 22 bp, Homo sapiens
tgccacagagcaattctgctga

SEQ ID NO: 8006819 - DNA, 22 bp, Homo sapiens
cccaggagggtggcctctgccc

SEQ ID NO: 8006820 - DNA, 22 bp, Homo sapiens
cccaggagggtggcctctgccc

SEQ ID NO: 8006821 - DNA, 22 bp, Homo sapiens
cccaggagggtggcctctgccc

SEQ ID NO: 8006822 - DNA, 21 bp, Homo sapiens
cccaggaggctgagaagagca

SEQ ID NO: 8006823 - DNA, 22 bp, Homo sapiens
cccaggcagccccagaagcttg

SEQ ID NO: 8006824 - DNA, 22 bp, Homo sapiens
cccaggcagccccagaagcttg

SEQ ID NO: 8006825 - DNA, 22 bp, Homo sapiens
cccaggcagccccagaagcttg

SEQ ID NO: 8006826 - DNA, 22 bp, Homo sapiens
cccaggcagccccagaagcttg

SEQ ID NO: 8006827 - DNA, 22 bp, Homo sapiens
cccaggcagcccttctgacgca

SEQ ID NO: 8006828 - DNA, 22 bp, Homo sapiens
cccaggcagccccagaagcttg

SEQ ID NO: 8006829 - DNA, 22 bp, Homo sapiens
cccaggcagcccttctgacgca

SEQ ID NO: 8006830 - DNA, 20 bp, Homo sapiens
cccaggcagagctagcggca

SEQ ID NO: 8006831 - DNA, 20 bp, Homo sapiens
cccaggcagagctagcggca

SEQ ID NO: 8006832 - DNA, 20 bp, Homo sapiens
cccaggcagagctagcggca

SEQ ID NO: 8006833 - DNA, 20 bp, Homo sapiens
cccaggcagagctagcggca

SEQ ID NO: 8006834 - DNA, 22 bp, Homo sapiens
cccaggcagccccagaagcttg

SEQ ID NO: 8006835 - DNA, 22 bp, Homo sapiens
cccaggcagccccagaagcttg

SEQ ID NO: 8006836 - DNA, 22 bp, Homo sapiens
cccaggcagccccagaagcttg

SEQ ID NO: 8006837 - DNA, 22 bp, Homo sapiens
cccaggcagcctgcagggaagg

SEQ ID NO: 8006838 - DNA, 22 bp, Homo sapiens
cccaggcagcctgcagggaagg

SEQ ID NO: 8006839 - DNA, 22 bp, Homo sapiens
cccaggcagcctgcagggaagg

SEQ ID NO: 8006840 - DNA, 22 bp, Homo sapiens
cccaggcagcctgcagggaagg

SEQ ID NO: 8006841 - DNA, 22 bp, Homo sapiens
cccaggcagcctgcagggaagg

SEQ ID NO: 8006842 - DNA, 22 bp, Homo sapiens
cccaggcagcctgcagggaagg

SEQ ID NO: 8006843 - DNA, 22 bp, Homo sapiens
cccaggcagcggggtctccttg

SEQ ID NO: 8006844 - DNA, 22 bp, Homo sapiens
cccaggcagcctgcagggaagg

SEQ ID NO: 8006845 - DNA, 22 bp, Homo sapiens
cccaggcagcctgcagggaagg

SEQ ID NO: 8006846 - DNA, 22 bp, Homo sapiens
cccaggcagcggggtctccttg

SEQ ID NO: 8006847 - DNA, 22 bp, Homo sapiens
cccaggcagcggggtctccttg

SEQ ID NO: 8006848 - DNA, 22 bp, Homo sapiens
cccaggcagcggggtctccttg

SEQ ID NO: 8006849 - DNA, 22 bp, Homo sapiens
cccaggcagcggggtctccttg

SEQ ID NO: 8006850 - DNA, 22 bp, Homo sapiens
cccaggcagcggggtctccttg

SEQ ID NO: 8006851 - DNA, 22 bp, Homo sapiens
cccaggcagcggggtctccttg

SEQ ID NO: 8006852 - DNA, 22 bp, Homo sapiens
cccaggcagcggggtctccttg

SEQ ID NO: 8006853 - DNA, 22 bp, Homo sapiens
cccaggcaggagtgtggtggct

SEQ ID NO: 8006854 - DNA, 22 bp, Homo sapiens
cccaggcagcggggtctccttg

SEQ ID NO: 8006855 - DNA, 22 bp, Homo sapiens
cccaggcagtctggctctaaag

SEQ ID NO: 8006856 - DNA, 22 bp, Homo sapiens
cccaggcagtctggctctaaag

SEQ ID NO: 8006857 - DNA, 22 bp, Homo sapiens
cccaggcagtctggctctaaag

SEQ ID NO: 8006858 - DNA, 22 bp, Homo sapiens
cccaggcagtgctgatccctca

SEQ ID NO: 8006859 - DNA, 22 bp, Homo sapiens
cccaggcagtgctgatccctca

SEQ ID NO: 8006860 - DNA, 22 bp, Homo sapiens
cccaggcagtgctgatccctca

SEQ ID NO: 8006861 - DNA, 22 bp, Homo sapiens
cccaggcagtgtgtgcatgcgt

SEQ ID NO: 8006862 - DNA, 22 bp, Homo sapiens
cccaggcagtgtgtgcatgcgt

SEQ ID NO: 8006863 - DNA, 22 bp, Homo sapiens
cccaggcagtgtgtgcatgcgt

SEQ ID NO: 8006864 - DNA, 22 bp, Homo sapiens
cccaggcagtgtgtgcatgcgt

SEQ ID NO: 8006865 - DNA, 22 bp, Homo sapiens
cccaggcagtgctgatccctca

SEQ ID NO: 8006866 - DNA, 22 bp, Homo sapiens
cccaggcagtgctgatccctca

SEQ ID NO: 8006867 - DNA, 22 bp, Homo sapiens
cccaggcagtagaaagaagagg

SEQ ID NO: 8006868 - DNA, 22 bp, Homo sapiens
cccaggcagtagaaagaagagg

SEQ ID NO: 8006869 - DNA, 22 bp, Homo sapiens
cccaggcagtagaaagaagagg

SEQ ID NO: 8006870 - DNA, 22 bp, Homo sapiens
cccaggcagtagaaagaagagg

SEQ ID NO: 8006871 - DNA, 22 bp, Homo sapiens
cccaggcagggacgtgctctgg

SEQ ID NO: 8006872 - DNA, 22 bp, Homo sapiens
cccaggcagggacgtgctctgg

SEQ ID NO: 8006873 - DNA, 22 bp, Homo sapiens
cccaggcagggacgtgctctgg

SEQ ID NO: 8006874 - DNA, 22 bp, Homo sapiens
cccaggcagggacgtgctctgg

SEQ ID NO: 8006875 - DNA, 22 bp, Homo sapiens
cccaggcagggacgtgctctgg

SEQ ID NO: 8006876 - DNA, 22 bp, Homo sapiens
cccaggcagggacgtgctctgg

SEQ ID NO: 8006877 - DNA, 22 bp, Homo sapiens
cccaggcagggacgtgctctgg

SEQ ID NO: 8006878 - DNA, 22 bp, Homo sapiens
cccaggcagggacgtgctctgg

SEQ ID NO: 8006879 - DNA, 22 bp, Homo sapiens
cccaggcagggacgtgctctgg

SEQ ID NO: 8006880 - DNA, 22 bp, Homo sapiens
cccaggcaggagtgtggtggct

SEQ ID NO: 8006881 - DNA, 22 bp, Homo sapiens
cccaggcaggagtgtggtggct

SEQ ID NO: 8006882 - DNA, 22 bp, Homo sapiens
cccaggcagggacgtgctctgg

SEQ ID NO: 8006883 - DNA, 22 bp, Homo sapiens
cccaggcactcttggtcatttt

SEQ ID NO: 8006884 - DNA, 22 bp, Homo sapiens
cccaggcagaattagtgtttca

SEQ ID NO: 8006885 - DNA, 22 bp, Homo sapiens
cccaggcactcttggtcatttt

SEQ ID NO: 8006886 - DNA, 22 bp, Homo sapiens
cccaggcactcttggtcatttt

SEQ ID NO: 8006887 - DNA, 22 bp, Homo sapiens
cccaggcactcttggtcatttt

SEQ ID NO: 8006888 - DNA, 22 bp, Homo sapiens
cccaggcacatccactctgtga

SEQ ID NO: 8006889 - DNA, 22 bp, Homo sapiens
cccaggcactcttggtcatttt

SEQ ID NO: 8006890 - DNA, 22 bp, Homo sapiens
cccaggcagagagctggtgagc

SEQ ID NO: 8006891 - DNA, 22 bp, Homo sapiens
cccaggcagagagctggtgagc

SEQ ID NO: 8006892 - DNA, 22 bp, Homo sapiens
cccaggcagaattagtgtttca

SEQ ID NO: 8006893 - DNA, 22 bp, Homo sapiens
cccaggcagagagctggtgagc

SEQ ID NO: 8006894 - DNA, 22 bp, Homo sapiens
cccaggcagagagctggtgagc

SEQ ID NO: 8006895 - DNA, 22 bp, Homo sapiens
cccaggcagagagctggtgagc

SEQ ID NO: 8006896 - DNA, 22 bp, Homo sapiens
cccaggcagagagctggtgagc

SEQ ID NO: 8006897 - DNA, 22 bp, Homo sapiens
cccaggcagagagctggtgagc

SEQ ID NO: 8006898 - DNA, 20 bp, Homo sapiens
cccaggcagagctagcggca

SEQ ID NO: 8006899 - DNA, 22 bp, Homo sapiens
cccaggcacagattatcccaat

SEQ ID NO: 8006900 - DNA, 22 bp, Homo sapiens
cccaggcacagattatcccaat

SEQ ID NO: 8006901 - DNA, 22 bp, Homo sapiens
cccaggcacactgaagtgacat

SEQ ID NO: 8006902 - DNA, 22 bp, Homo sapiens
cccaggcacatccactctgtga

SEQ ID NO: 8006903 - DNA, 22 bp, Homo sapiens
cccaggcacatccactctgtga

SEQ ID NO: 8006904 - DNA, 22 bp, Homo sapiens
cccaggcacatccactctgtga

SEQ ID NO: 8006905 - DNA, 22 bp, Homo sapiens
cccaggcacatccactctgtga

SEQ ID NO: 8006906 - DNA, 22 bp, Homo sapiens
cccaggcacactgaagtgacat

SEQ ID NO: 8006907 - DNA, 22 bp, Homo sapiens
cccaggcacactgaagtgacat

SEQ ID NO: 8006908 - DNA, 22 bp, Homo sapiens
cccaggcacaccccgaacggaa

SEQ ID NO: 8006909 - DNA, 22 bp, Homo sapiens
cccaggatgtcgaggctgcagt

SEQ ID NO: 8006910 - DNA, 22 bp, Homo sapiens
cccaggcacactgaagtgacat

SEQ ID NO: 8006911 - DNA, 22 bp, Homo sapiens
cccaggcacaccccgaacggaa

SEQ ID NO: 8006912 - DNA, 22 bp, Homo sapiens
cccaggcacaccccgaacggaa

SEQ ID NO: 8006913 - DNA, 22 bp, Homo sapiens
tgccaggcgtggtggtgcgcac

SEQ ID NO: 8006914 - DNA, 22 bp, Homo sapiens
tgccaggcgattgctatcagca

SEQ ID NO: 8006915 - DNA, 22 bp, Homo sapiens
tgccaggcgattgctatcagca

SEQ ID NO: 8006916 - DNA, 22 bp, Homo sapiens
tgccaggcgtggtggtgcgcac

SEQ ID NO: 8006917 - DNA, 22 bp, Homo sapiens
tgccaggcgtggtggtgcgcac

SEQ ID NO: 8006918 - DNA, 22 bp, Homo sapiens
tgccaggcgtggtggtgcgcac

SEQ ID NO: 8006919 - DNA, 22 bp, Homo sapiens
tgccaggctaagtggaggactt

SEQ ID NO: 8006920 - DNA, 22 bp, Homo sapiens
cccaggagttagaggttgtggt

SEQ ID NO: 8006921 - DNA, 22 bp, Homo sapiens
cccaggatgtcgaggctgcagt

SEQ ID NO: 8006922 - DNA, 22 bp, Homo sapiens
cccaggatgtcgaggctgcagt

SEQ ID NO: 8006923 - DNA, 22 bp, Homo sapiens
cccaggatgtcgaggctgcagt

SEQ ID NO: 8006924 - DNA, 22 bp, Homo sapiens
cccaggagttcgaggctgtagt

SEQ ID NO: 8006925 - DNA, 22 bp, Homo sapiens
cccaggagttcgaggctgtagt

SEQ ID NO: 8006926 - DNA, 22 bp, Homo sapiens
cccaggagttcgaggctgtagt

SEQ ID NO: 8006927 - DNA, 22 bp, Homo sapiens
cccaggagttcgaggctgtagt

SEQ ID NO: 8006928 - DNA, 22 bp, Homo sapiens
cccaggagttcgaggctgtagt

SEQ ID NO: 8006929 - DNA, 22 bp, Homo sapiens
cccaggagttcgaggctgtagt

SEQ ID NO: 8006930 - DNA, 22 bp, Homo sapiens
cccaggagttcgaggctgtagt

SEQ ID NO: 8006931 - DNA, 21 bp, Homo sapiens
tgccaggcctgagctggggtc

SEQ ID NO: 8006932 - DNA, 21 bp, Homo sapiens
tgccaggcctgagctggggtc

SEQ ID NO: 8006933 - DNA, 21 bp, Homo sapiens
tgccaggcctgagctggggtc

SEQ ID NO: 8006934 - DNA, 21 bp, Homo sapiens
tgccaggcctgagctggggtc

SEQ ID NO: 8006935 - DNA, 21 bp, Homo sapiens
tgccaggcctgagctggggtc

SEQ ID NO: 8006936 - DNA, 21 bp, Homo sapiens
tgccaggcctgagctggggtc

SEQ ID NO: 8006937 - DNA, 22 bp, Homo sapiens
tgccaggcgattgctatcagca

SEQ ID NO: 8006938 - DNA, 22 bp, Homo sapiens
tgccaggcgattgctatcagca

SEQ ID NO: 8006939 - DNA, 22 bp, Homo sapiens
tgccaggcgattgctatcagca

SEQ ID NO: 8006940 - DNA, 22 bp, Homo sapiens
tgccaggcgtggtggtgcgcac

SEQ ID NO: 8006941 - DNA, 22 bp, Homo sapiens
tgccaggcgtggtggtgcgcac

SEQ ID NO: 8006942 - DNA, 17 bp, Homo sapiens
cccctacctccgtttga

SEQ ID NO: 8006943 - DNA, 16 bp, Homo sapiens
cccctcaggaagtaca

SEQ ID NO: 8006944 - DNA, 22 bp, Homo sapiens
ccccctggcaggctggcctctc

SEQ ID NO: 8006945 - DNA, 22 bp, Homo sapiens
cccctcaggtacccgtgcagca

SEQ ID NO: 8006946 - DNA, 22 bp, Homo sapiens
cccctcaggtacccgtgcagca

SEQ ID NO: 8006947 - DNA, 21 bp, Homo sapiens
cccctcatacactctccttgc

SEQ ID NO: 8006948 - DNA, 22 bp, Homo sapiens
cccccggagctggggctcagct

SEQ ID NO: 8006949 - DNA, 22 bp, Homo sapiens
ccccctctgccggggtccttca

SEQ ID NO: 8006950 - DNA, 22 bp, Homo sapiens
cccccaggggctccgcctcgtg

SEQ ID NO: 8006951 - DNA, 22 bp, Homo sapiens
cccccatccatgtcaggagagg

SEQ ID NO: 8006952 - DNA, 22 bp, Homo sapiens
cccccaggggctccgcctcgtg

SEQ ID NO: 8006953 - DNA, 22 bp, Homo sapiens
cccccagtctgaacagcagctg

SEQ ID NO: 8006954 - DNA, 22 bp, Homo sapiens
cccccaggctctgacacaggag

SEQ ID NO: 8006955 - DNA, 22 bp, Homo sapiens
cccccaggggctccgcctcgtg

SEQ ID NO: 8006956 - DNA, 22 bp, Homo sapiens
cccccaggctctgacacaggag

SEQ ID NO: 8006957 - DNA, 22 bp, Homo sapiens
cccccaggctctgacacaggag

SEQ ID NO: 8006958 - DNA, 22 bp, Homo sapiens
cccccaccgtgttcctgctcgg

SEQ ID NO: 8006959 - DNA, 22 bp, Homo sapiens
cccccaccgtgttcctgctcgg

SEQ ID NO: 8006960 - DNA, 22 bp, Homo sapiens
cccccaccgtgttcctgctcgg

SEQ ID NO: 8006961 - DNA, 22 bp, Homo sapiens
ccccagggaagctttgcttact

SEQ ID NO: 8006962 - DNA, 22 bp, Homo sapiens
cccccaaagtttgcacggataa

SEQ ID NO: 8006963 - DNA, 22 bp, Homo sapiens
cccccacctgaggacagtctta

SEQ ID NO: 8006964 - DNA, 22 bp, Homo sapiens
cccccacctgaggacagtctta

SEQ ID NO: 8006965 - DNA, 22 bp, Homo sapiens
cccccaccgtgttcctgctcgg

SEQ ID NO: 8006966 - DNA, 22 bp, Homo sapiens
cccccaccgtgttcctgctcgg

SEQ ID NO: 8006967 - DNA, 22 bp, Homo sapiens
cccccactaagttgagggccct

SEQ ID NO: 8006968 - DNA, 22 bp, Homo sapiens
cccccacctgaggacagtctta

SEQ ID NO: 8006969 - DNA, 18 bp, Homo sapiens
cccccagccaaattctct

SEQ ID NO: 8006970 - DNA, 22 bp, Homo sapiens
cccccagccagcagtgctcagc

SEQ ID NO: 8006971 - DNA, 22 bp, Homo sapiens
cccccagccagcagtgctcagc

SEQ ID NO: 8006972 - DNA, 22 bp, Homo sapiens
cccccagctctgctgggtcccg

SEQ ID NO: 8006973 - DNA, 19 bp, Homo sapiens
ccctcaggtctgagcagtc

SEQ ID NO: 8006974 - DNA, 19 bp, Homo sapiens
ccctcaggtctgagcagtc

SEQ ID NO: 8006975 - DNA, 19 bp, Homo sapiens
ccctcaggtctgagcagtc

SEQ ID NO: 8006976 - DNA, 19 bp, Homo sapiens
ccctcaggtctgagcagtc

SEQ ID NO: 8006977 - DNA, 22 bp, Homo sapiens
ccctcagggaccactgacttca

SEQ ID NO: 8006978 - DNA, 22 bp, Homo sapiens
ccctcagggaccactgacttca

SEQ ID NO: 8006979 - DNA, 22 bp, Homo sapiens
ccctcagggaccactgacttca

SEQ ID NO: 8006980 - DNA, 22 bp, Homo sapiens
ccctcagggaccactgacttca

SEQ ID NO: 8006981 - DNA, 22 bp, Homo sapiens
ccctcaggatgcagtggaagtg

SEQ ID NO: 8006982 - DNA, 22 bp, Homo sapiens
ccctcaggatgcagtggaagtg

SEQ ID NO: 8006983 - DNA, 22 bp, Homo sapiens
ccctcaggatgcagtggaagtg

SEQ ID NO: 8006984 - DNA, 22 bp, Homo sapiens
ccctcaggagatgtcagctgga

SEQ ID NO: 8006985 - DNA, 22 bp, Homo sapiens
ccctcaggagatgtcagctgga

SEQ ID NO: 8006986 - DNA, 22 bp, Homo sapiens
ccctaggcccaaagggtgacat

SEQ ID NO: 8006987 - DNA, 22 bp, Homo sapiens
ccctcagctccaccctcagcag

SEQ ID NO: 8006988 - DNA, 22 bp, Homo sapiens
ccctcagcttctccctgcagct

SEQ ID NO: 8006989 - DNA, 22 bp, Homo sapiens
ccctcagcttctccctgcagct

SEQ ID NO: 8006990 - DNA, 22 bp, Homo sapiens
ccctcagcttctccctgcagct

SEQ ID NO: 8006991 - DNA, 21 bp, Homo sapiens
ccctcaggaaacagaatgcac

SEQ ID NO: 8006992 - DNA, 21 bp, Homo sapiens
ccctcaggaaacagaatgcac

SEQ ID NO: 8006993 - DNA, 21 bp, Homo sapiens
ccctcaggaaacagaatgcac

SEQ ID NO: 8006994 - DNA, 22 bp, Homo sapiens
ccctcagcttctccctgcagct

SEQ ID NO: 8006995 - DNA, 22 bp, Homo sapiens
ccctcagcttctccctgcagct

SEQ ID NO: 8006996 - DNA, 22 bp, Homo sapiens
ccctcaggagatgtcagctgga

SEQ ID NO: 8006997 - DNA, 22 bp, Homo sapiens
ccctcaggagatgtcagctgga

SEQ ID NO: 8006998 - DNA, 22 bp, Homo sapiens
ccctcaggagatgtcagctgga

SEQ ID NO: 8006999 - DNA, 22 bp, Homo sapiens
cccctcctggccacactgtcag

SEQ ID NO: 8007000 - DNA, 22 bp, Homo sapiens
cccctcctggccacactgtcag

SEQ ID NO: 8007001 - DNA, 22 bp, Homo sapiens
cccctcctggccacactgtcag

SEQ ID NO: 8007002 - DNA, 22 bp, Homo sapiens
cccctcctggccacactgtcag

SEQ ID NO: 8007003 - DNA, 22 bp, Homo sapiens
cccctccctgacctggttgggc

SEQ ID NO: 8007004 - DNA, 22 bp, Homo sapiens
cccctccctgacctggttgggc

SEQ ID NO: 8007005 - DNA, 22 bp, Homo sapiens
cccctccctgacctggttgggc

SEQ ID NO: 8007006 - DNA, 22 bp, Homo sapiens
cccctccctgacctggttgggc

SEQ ID NO: 8007007 - DNA, 22 bp, Homo sapiens
cccctccctgacctggttgggc

SEQ ID NO: 8007008 - DNA, 22 bp, Homo sapiens
cccctctccctcacttatcaat

SEQ ID NO: 8007009 - DNA, 22 bp, Homo sapiens
cccctctccctcacttatcaat

SEQ ID NO: 8007010 - DNA, 22 bp, Homo sapiens
cccctctgcaaatagccaggct

SEQ ID NO: 8007011 - DNA, 22 bp, Homo sapiens
cccctcctggccacactgtcag

SEQ ID NO: 8007012 - DNA, 22 bp, Homo sapiens
cccctctggtcaaccagtcaca

SEQ ID NO: 8007013 - DNA, 22 bp, Homo sapiens
cccctctccctcacttatcaat

SEQ ID NO: 8007014 - DNA, 20 bp, Homo sapiens
ccctaggaacgcagcaggag

SEQ ID NO: 8007015 - DNA, 23 bp, Homo sapiens
cccctctggtggctcagctcctg

SEQ ID NO: 8007016 - DNA, 20 bp, Homo sapiens
ccctaggaacgcagcaggag

SEQ ID NO: 8007017 - DNA, 20 bp, Homo sapiens
ccctaggaacgcagcaggag

SEQ ID NO: 8007018 - DNA, 22 bp, Homo sapiens
ccctaggaattctatggccaag

SEQ ID NO: 8007019 - DNA, 22 bp, Homo sapiens
ccccagcagcacctggggcagt

SEQ ID NO: 8007020 - DNA, 22 bp, Homo sapiens
ccccagcagcacctggggcagt

SEQ ID NO: 8007021 - DNA, 22 bp, Homo sapiens
ccccagcagactcagggcaggt

SEQ ID NO: 8007022 - DNA, 22 bp, Homo sapiens
ccccagcagcacctggggcagt

SEQ ID NO: 8007023 - DNA, 22 bp, Homo sapiens
ccccagcaggaatacaggggtc

SEQ ID NO: 8007024 - DNA, 22 bp, Homo sapiens
ccccagcagcacctggggcagt

SEQ ID NO: 8007025 - DNA, 22 bp, Homo sapiens
ccccagcaggaatacaggggtc

SEQ ID NO: 8007026 - DNA, 22 bp, Homo sapiens
ccccagccagcaggacctctga

SEQ ID NO: 8007027 - DNA, 18 bp, Homo sapiens
ccccagcagtgtggtgcc

SEQ ID NO: 8007028 - DNA, 22 bp, Homo sapiens
ccccagccagcaggacctctga

SEQ ID NO: 8007029 - DNA, 22 bp, Homo sapiens
ccccagccagcaggacctctga

SEQ ID NO: 8007030 - DNA, 22 bp, Homo sapiens
ccccagccagcaggacctctga

SEQ ID NO: 8007031 - DNA, 22 bp, Homo sapiens
ccccagccagcaggacctctga

SEQ ID NO: 8007032 - DNA, 22 bp, Homo sapiens
ccccagccagcaggacctctga

SEQ ID NO: 8007033 - DNA, 22 bp, Homo sapiens
ccccagccagcaggacctctga

SEQ ID NO: 8007034 - DNA, 22 bp, Homo sapiens
ccccagccagcttgtagtagaa

SEQ ID NO: 8007035 - DNA, 22 bp, Homo sapiens
ccccagccagcttgtagtagaa

SEQ ID NO: 8007036 - DNA, 22 bp, Homo sapiens
ccccagccagcttgtagtagaa

SEQ ID NO: 8007037 - DNA, 22 bp, Homo sapiens
ccccagccagcaggacctctga

SEQ ID NO: 8007038 - DNA, 22 bp, Homo sapiens
ccccagccagcaggacctctga

SEQ ID NO: 8007039 - DNA, 22 bp, Homo sapiens
ccccagccagcaggacctctga

SEQ ID NO: 8007040 - DNA, 22 bp, Homo sapiens
ccccagccagcttgtagtagaa

SEQ ID NO: 8007041 - DNA, 22 bp, Homo sapiens
tgctgcaggaattctcaaggga

SEQ ID NO: 8007042 - DNA, 19 bp, Homo sapiens
tgctgcaggatgctgctgg

SEQ ID NO: 8007043 - DNA, 19 bp, Homo sapiens
tgctgcaggatgctgctgg

SEQ ID NO: 8007044 - DNA, 22 bp, Homo sapiens
ccccactctcggccagataggc

SEQ ID NO: 8007045 - DNA, 22 bp, Homo sapiens
tgctgcagctaaggtgaggtgc

SEQ ID NO: 8007046 - DNA, 22 bp, Homo sapiens
tgctgcagctttgtcacatgca

SEQ ID NO: 8007047 - DNA, 22 bp, Homo sapiens
tgctgcagctttgtcacatgca

SEQ ID NO: 8007048 - DNA, 22 bp, Homo sapiens
tgctgcagctttgtcacatgca

SEQ ID NO: 8007049 - DNA, 22 bp, Homo sapiens
tgctgcaggaacttaagaagct

SEQ ID NO: 8007050 - DNA, 22 bp, Homo sapiens
tgctgcagctttgtcacatgca

SEQ ID NO: 8007051 - DNA, 22 bp, Homo sapiens
tgctgcaggaacttaagaagct

SEQ ID NO: 8007052 - DNA, 22 bp, Homo sapiens
tgctgcagatcagctgagtcct

SEQ ID NO: 8007053 - DNA, 22 bp, Homo sapiens
tgctgcagatcagctgagtcct

SEQ ID NO: 8007054 - DNA, 22 bp, Homo sapiens
tgctgcagatcagctgagtcct

SEQ ID NO: 8007055 - DNA, 22 bp, Homo sapiens
tgctgcagatcagctgagtcct

SEQ ID NO: 8007056 - DNA, 22 bp, Homo sapiens
tgctgcagacgaagcccatgcc

SEQ ID NO: 8007057 - DNA, 22 bp, Homo sapiens
tgctgcagacgaagcccatgcc

SEQ ID NO: 8007058 - DNA, 22 bp, Homo sapiens
tgctgcagacgaagcccatgcc

SEQ ID NO: 8007059 - DNA, 22 bp, Homo sapiens
tgctgcagcagtgcgggcagct

SEQ ID NO: 8007060 - DNA, 22 bp, Homo sapiens
tgctgcagctaaggtgaggtgc

SEQ ID NO: 8007061 - DNA, 22 bp, Homo sapiens
tgctgcagctaaggtgaggtgc

SEQ ID NO: 8007062 - DNA, 22 bp, Homo sapiens
tgctgcagctaaggtgaggtgc

SEQ ID NO: 8007063 - DNA, 22 bp, Homo sapiens
tgctgcagcggcatggtctttg

SEQ ID NO: 8007064 - DNA, 22 bp, Homo sapiens
tgctggagaggaaggtggggtc

SEQ ID NO: 8007065 - DNA, 22 bp, Homo sapiens
tgctggagaggaaggtggggtc

SEQ ID NO: 8007066 - DNA, 22 bp, Homo sapiens
tgctggagatcattaatgttca

SEQ ID NO: 8007067 - DNA, 22 bp, Homo sapiens
tgctggagatgaaagggccctg

SEQ ID NO: 8007068 - DNA, 22 bp, Homo sapiens
tgctggagatgaaagggccctg

SEQ ID NO: 8007069 - DNA, 22 bp, Homo sapiens
tgctggagatgaaagggccctg

SEQ ID NO: 8007070 - DNA, 22 bp, Homo sapiens
tgctggagatcattaatgttca

SEQ ID NO: 8007071 - DNA, 22 bp, Homo sapiens
tgctggagatgaaagggccctg

SEQ ID NO: 8007072 - DNA, 22 bp, Homo sapiens
tgctggagagctagttctgcag

SEQ ID NO: 8007073 - DNA, 22 bp, Homo sapiens
tgctggagaggaaggtggggtc

SEQ ID NO: 8007074 - DNA, 22 bp, Homo sapiens
tgctggagaggaaggtggggtc

SEQ ID NO: 8007075 - DNA, 22 bp, Homo sapiens
tgctggagaggaaggtggggtc

SEQ ID NO: 8007076 - DNA, 22 bp, Homo sapiens
tgctggagaggaaggtggggtc

SEQ ID NO: 8007077 - DNA, 22 bp, Homo sapiens
tgctggagagccttggccaagg

SEQ ID NO: 8007078 - DNA, 22 bp, Homo sapiens
tgctggagagccttggccaagg

SEQ ID NO: 8007079 - DNA, 22 bp, Homo sapiens
tgctggagagctagttctgcag

SEQ ID NO: 8007080 - DNA, 22 bp, Homo sapiens
tgctggagagccttggccaagg

SEQ ID NO: 8007081 - DNA, 22 bp, Homo sapiens
tgctggagagctagttctgcag

SEQ ID NO: 8007082 - DNA, 22 bp, Homo sapiens
tgctggagcatctgagagcatc

SEQ ID NO: 8007083 - DNA, 22 bp, Homo sapiens
tgctggagcaacattattgtgc

SEQ ID NO: 8007084 - DNA, 22 bp, Homo sapiens
tgctggagcatctgagagcatc

SEQ ID NO: 8007085 - DNA, 22 bp, Homo sapiens
tgctggagcaacattattgtgc

SEQ ID NO: 8007086 - DNA, 22 bp, Homo sapiens
tgctggagatgaaagggccctg

SEQ ID NO: 8007087 - DNA, 22 bp, Homo sapiens
tgctggagcaacattattgtgc

SEQ ID NO: 8007088 - DNA, 22 bp, Homo sapiens
tgctggagcatctgagagcatc

SEQ ID NO: 8007089 - DNA, 22 bp, Homo sapiens
tgctggagcatctgagagcatc

SEQ ID NO: 8007090 - DNA, 22 bp, Homo sapiens
ccccaggcagggcctaacagag

SEQ ID NO: 8007091 - DNA, 22 bp, Homo sapiens
tgctggagcccaggcggccttt

SEQ ID NO: 8007092 - DNA, 22 bp, Homo sapiens
tgctggagcccaggcggccttt

SEQ ID NO: 8007093 - DNA, 22 bp, Homo sapiens
tgctggagcccaggcggccttt

SEQ ID NO: 8007094 - DNA, 22 bp, Homo sapiens
tgctggagcccaggcggccttt

SEQ ID NO: 8007095 - DNA, 22 bp, Homo sapiens
ccccaggcctgttggatggcgc

SEQ ID NO: 8007096 - DNA, 22 bp, Homo sapiens
ccccagccttccatgggaattg

SEQ ID NO: 8007097 - DNA, 22 bp, Homo sapiens
ccccagccttccatgggaattg

SEQ ID NO: 8007098 - DNA, 22 bp, Homo sapiens
ccccagcccacaagcatattaa

SEQ ID NO: 8007099 - DNA, 22 bp, Homo sapiens
ccccagcccacaagcatattaa

SEQ ID NO: 8007100 - DNA, 22 bp, Homo sapiens
tgctggagacatagcaggcagc

SEQ ID NO: 8007101 - DNA, 22 bp, Homo sapiens
ccccagctcagtgcagggacat

SEQ ID NO: 8007102 - DNA, 22 bp, Homo sapiens
ccccagctcagtgcagggacat

SEQ ID NO: 8007103 - DNA, 23 bp, Homo sapiens
tgctggagacaagtgtgagaagg

SEQ ID NO: 8007104 - DNA, 23 bp, Homo sapiens
tgctggagacaagtgtgagaagg

SEQ ID NO: 8007105 - DNA, 22 bp, Homo sapiens
ccccagccttccatgggaattg

SEQ ID NO: 8007106 - DNA, 22 bp, Homo sapiens
tgctggagacatagcaggcagc

SEQ ID NO: 8007107 - DNA, 22 bp, Homo sapiens
tgctggagacatagcaggcagc

SEQ ID NO: 8007108 - DNA, 22 bp, Homo sapiens
tgctggagacatagcaggcagc

SEQ ID NO: 8007109 - DNA, 22 bp, Homo sapiens
tgctggagacatagcaggcagc

SEQ ID NO: 8007110 - DNA, 22 bp, Homo sapiens
tgctggagacatagcaggcagc

SEQ ID NO: 8007111 - DNA, 22 bp, Homo sapiens
tgctggagacctgcttgcacca

SEQ ID NO: 8007112 - DNA, 22 bp, Homo sapiens
tgctggagacctgcttgcacca

SEQ ID NO: 8007113 - DNA, 22 bp, Homo sapiens
tgctggagacctgcttgcacca

SEQ ID NO: 8007114 - DNA, 22 bp, Homo sapiens
tgctggagacctgcttgcacca

SEQ ID NO: 8007115 - DNA, 22 bp, Homo sapiens
tgctggagacctgcttgcacca

SEQ ID NO: 8007116 - DNA, 22 bp, Homo sapiens
tgctggagacctgcttgcacca

SEQ ID NO: 8007117 - DNA, 22 bp, Homo sapiens
tgctggagactcactcaggtgc

SEQ ID NO: 8007118 - DNA, 22 bp, Homo sapiens
tgctggagactcactcaggtgc

SEQ ID NO: 8007119 - DNA, 22 bp, Homo sapiens
tgctggagactcactcaggtgc

SEQ ID NO: 8007120 - DNA, 22 bp, Homo sapiens
tgctggagagccttggccaagg

SEQ ID NO: 8007121 - DNA, 22 bp, Homo sapiens
tgctggagactcactcaggtgc

SEQ ID NO: 8007122 - DNA, 22 bp, Homo sapiens
tgctggagactcactcaggtgc

SEQ ID NO: 8007123 - DNA, 22 bp, Homo sapiens
tgctccagtgagctggccatcc

SEQ ID NO: 8007124 - DNA, 22 bp, Homo sapiens
tgctccagtgagctggccatcc

SEQ ID NO: 8007125 - DNA, 22 bp, Homo sapiens
tgctccagtgagctggccatcc

SEQ ID NO: 8007126 - DNA, 22 bp, Homo sapiens
tgctccaggtgtgcctctcatg

SEQ ID NO: 8007127 - DNA, 22 bp, Homo sapiens
tgctccaggtgtgcctctcatg

SEQ ID NO: 8007128 - DNA, 22 bp, Homo sapiens
tgctcagtagcagtgtgctgct

SEQ ID NO: 8007129 - DNA, 22 bp, Homo sapiens
tgctccagggctgccagaccct

SEQ ID NO: 8007130 - DNA, 23 bp, Homo sapiens
tgctccaggtacagaactccagg

SEQ ID NO: 8007131 - DNA, 22 bp, Homo sapiens
tgctccagtgcctgccccacag

SEQ ID NO: 8007132 - DNA, 22 bp, Homo sapiens
tgctccagtgcctgccccacag

SEQ ID NO: 8007133 - DNA, 22 bp, Homo sapiens
tgctccatctctcgtggttcca

SEQ ID NO: 8007134 - DNA, 22 bp, Homo sapiens
tgctccatgcgctcggccggcg

SEQ ID NO: 8007135 - DNA, 22 bp, Homo sapiens
tgctccatgcgctcggccggcg

SEQ ID NO: 8007136 - DNA, 22 bp, Homo sapiens
tgctccatctagagctctgcag

SEQ ID NO: 8007137 - DNA, 19 bp, Homo sapiens
tgctccattgaggtgtctc

SEQ ID NO: 8007138 - DNA, 22 bp, Homo sapiens
tgctccatgcgctcggccggcg

SEQ ID NO: 8007139 - DNA, 22 bp, Homo sapiens
tgctccatgcgctcggccggcg

SEQ ID NO: 8007140 - DNA, 22 bp, Homo sapiens
tgctccatgcgctcggccggcg

SEQ ID NO: 8007141 - DNA, 22 bp, Homo sapiens
cccaggctcctgactcattcta

SEQ ID NO: 8007142 - DNA, 22 bp, Homo sapiens
cccaggctcctgactcattcta

SEQ ID NO: 8007143 - DNA, 22 bp, Homo sapiens
cccaggctcctgactcattcta

SEQ ID NO: 8007144 - DNA, 22 bp, Homo sapiens
cccaggctcctagaggcccaga

SEQ ID NO: 8007145 - DNA, 22 bp, Homo sapiens
cccaggctcctgactcattcta

SEQ ID NO: 8007146 - DNA, 22 bp, Homo sapiens
cccaggctcctgactcattcta

SEQ ID NO: 8007147 - DNA, 22 bp, Homo sapiens
cccaggctcctgactcattcta

SEQ ID NO: 8007148 - DNA, 22 bp, Homo sapiens
cccaggctcctgctgtgttgac

SEQ ID NO: 8007149 - DNA, 22 bp, Homo sapiens
cccaggctcctgctgtgttgac

SEQ ID NO: 8007150 - DNA, 22 bp, Homo sapiens
cccaggctcctgctgtgttgac

SEQ ID NO: 8007151 - DNA, 22 bp, Homo sapiens
cccaggctcctgactcattcta

SEQ ID NO: 8007152 - DNA, 21 bp, Homo sapiens
tgctcagtaaatgctgagtga

SEQ ID NO: 8007153 - DNA, 21 bp, Homo sapiens
tgctcagtaaatgctgagtga

SEQ ID NO: 8007154 - DNA, 22 bp, Homo sapiens
tgctcagtaagtaaacagtaac

SEQ ID NO: 8007155 - DNA, 22 bp, Homo sapiens
tgctcagtagcagtgtgctgct

SEQ ID NO: 8007156 - DNA, 22 bp, Homo sapiens
cccaggctcttatgtgacttgc

SEQ ID NO: 8007157 - DNA, 22 bp, Homo sapiens
cccaggctcttatgtgacttgc

SEQ ID NO: 8007158 - DNA, 22 bp, Homo sapiens
cccaggctcttatgtgacttgc

SEQ ID NO: 8007159 - DNA, 21 bp, Homo sapiens
cccaggctgaattaaaaatat

SEQ ID NO: 8007160 - DNA, 21 bp, Homo sapiens
cccaggctgaattaaaaatat

SEQ ID NO: 8007161 - DNA, 21 bp, Homo sapiens
cccaggctgaattaaaaatat

SEQ ID NO: 8007162 - DNA, 20 bp, Homo sapiens
tgcctgggaaggcgtggagg

SEQ ID NO: 8007163 - DNA, 22 bp, Homo sapiens
tgcctgggacatgctgtggact

SEQ ID NO: 8007164 - DNA, 22 bp, Homo sapiens
tgcctgggacatgctgtggact

SEQ ID NO: 8007165 - DNA, 22 bp, Homo sapiens
tgcctgggacatgctgtggact

SEQ ID NO: 8007166 - DNA, 20 bp, Homo sapiens
tgcctgggaaggcgtggagg

SEQ ID NO: 8007167 - DNA, 20 bp, Homo sapiens
tgcctgggaaggcgtggagg

SEQ ID NO: 8007168 - DNA, 20 bp, Homo sapiens
tgcctgggaaggcgtggagg

SEQ ID NO: 8007169 - DNA, 20 bp, Homo sapiens
tgcctgggaaggcgtggagg

SEQ ID NO: 8007170 - DNA, 20 bp, Homo sapiens
tgcctgggaaggcgtggagg

SEQ ID NO: 8007171 - DNA, 22 bp, Homo sapiens
tgcctgggaaccaatcctggct

SEQ ID NO: 8007172 - DNA, 20 bp, Homo sapiens
tgcctgggaaggcgtggagg

SEQ ID NO: 8007173 - DNA, 22 bp, Homo sapiens
tgcctgctcttaccactctccc

SEQ ID NO: 8007174 - DNA, 22 bp, Homo sapiens
tgcctgctctttattttatgat

SEQ ID NO: 8007175 - DNA, 22 bp, Homo sapiens
tgcctgggaaccaatcctggct

SEQ ID NO: 8007176 - DNA, 22 bp, Homo sapiens
tgcctgctcttgagacttacaa

SEQ ID NO: 8007177 - DNA, 22 bp, Homo sapiens
tgcctgggactgtactaaattt

SEQ ID NO: 8007178 - DNA, 22 bp, Homo sapiens
tgcctgggagtgaccaagactc

SEQ ID NO: 8007179 - DNA, 22 bp, Homo sapiens
tgcctgggagtgaccaagactc

SEQ ID NO: 8007180 - DNA, 22 bp, Homo sapiens
tgcctgggagtgaccaagactc

SEQ ID NO: 8007181 - DNA, 22 bp, Homo sapiens
tgcctgggagtgaccaagactc

SEQ ID NO: 8007182 - DNA, 22 bp, Homo sapiens
tgcctgggagtgaccaagactc

SEQ ID NO: 8007183 - DNA, 22 bp, Homo sapiens
tgcctgggagtgaccaagactc

SEQ ID NO: 8007184 - DNA, 22 bp, Homo sapiens
tgcctgggacatgctgtggact

SEQ ID NO: 8007185 - DNA, 22 bp, Homo sapiens
tgcctgggacatgctgtggact

SEQ ID NO: 8007186 - DNA, 22 bp, Homo sapiens
tgcctgggacatgctgtggact

SEQ ID NO: 8007187 - DNA, 22 bp, Homo sapiens
tgcctgggacatgctgtggact

SEQ ID NO: 8007188 - DNA, 22 bp, Homo sapiens
tgcctgggactgtactaaattt

SEQ ID NO: 8007189 - DNA, 22 bp, Homo sapiens
tgcctgggactctgttatcttg

SEQ ID NO: 8007190 - DNA, 22 bp, Homo sapiens
tgcctgggccttcccacctctg

SEQ ID NO: 8007191 - DNA, 22 bp, Homo sapiens
tgcctgggctcaccgcctcttt

SEQ ID NO: 8007192 - DNA, 22 bp, Homo sapiens
tgcctgggccttcccacctctg

SEQ ID NO: 8007193 - DNA, 22 bp, Homo sapiens
tgcctgggccttcccacctctg

SEQ ID NO: 8007194 - DNA, 22 bp, Homo sapiens
tgcctgggctcaccgcctcttt

SEQ ID NO: 8007195 - DNA, 22 bp, Homo sapiens
tgcctgggctcaccgcctcttt

SEQ ID NO: 8007196 - DNA, 22 bp, Homo sapiens
cccaggctcctagaggcccaga

SEQ ID NO: 8007197 - DNA, 22 bp, Homo sapiens
cccaggctcctagaggcccaga

SEQ ID NO: 8007198 - DNA, 22 bp, Homo sapiens
cccaggctcctagaggcccaga

SEQ ID NO: 8007199 - DNA, 22 bp, Homo sapiens
cccaggctcctagaggcccaga

SEQ ID NO: 8007200 - DNA, 22 bp, Homo sapiens
cccaggctcctagaggcccaga

SEQ ID NO: 8007201 - DNA, 22 bp, Homo sapiens
cccaggctcctagaggcccaga

SEQ ID NO: 8007202 - DNA, 22 bp, Homo sapiens
cccaggctcctagaggcccaga

SEQ ID NO: 8007203 - DNA, 22 bp, Homo sapiens
cccaggctcctactgtattctg

SEQ ID NO: 8007204 - DNA, 22 bp, Homo sapiens
tgcctgggagtgaccaagactc

SEQ ID NO: 8007205 - DNA, 22 bp, Homo sapiens
tgcctgggatctgtgccctttg

SEQ ID NO: 8007206 - DNA, 22 bp, Homo sapiens
tgcctgggatctgtgccctttg

SEQ ID NO: 8007207 - DNA, 22 bp, Homo sapiens
tgcctgggcctctgaggaaggc

SEQ ID NO: 8007208 - DNA, 22 bp, Homo sapiens
tgcctgggcctctgaggaaggc

SEQ ID NO: 8007209 - DNA, 22 bp, Homo sapiens
tgcctgggcctctgaggaaggc

SEQ ID NO: 8007210 - DNA, 22 bp, Homo sapiens
tgcctgggatctgtgccctttg

SEQ ID NO: 8007211 - DNA, 22 bp, Homo sapiens
tgcctgggccttcccacctctg

SEQ ID NO: 8007212 - DNA, 22 bp, Homo sapiens
tgcctgggccttcccacctctg

SEQ ID NO: 8007213 - DNA, 22 bp, Homo sapiens
tgcctgggccttcccacctctg

SEQ ID NO: 8007214 - DNA, 22 bp, Homo sapiens
tgcctgggccttcccacctctg

SEQ ID NO: 8007215 - DNA, 22 bp, Homo sapiens
tgcctgggcctctgaggaaggc

SEQ ID NO: 8007216 - DNA, 22 bp, Homo sapiens
tgcctgggcctctgaggaaggc

SEQ ID NO: 8007217 - DNA, 22 bp, Homo sapiens
tgcctgggcctctgaggaaggc

SEQ ID NO: 8007218 - DNA, 22 bp, Homo sapiens
tgctgagacagtggataggggc

SEQ ID NO: 8007219 - DNA, 22 bp, Homo sapiens
tgctgagacagtggataggggc

SEQ ID NO: 8007220 - DNA, 22 bp, Homo sapiens
tgctgagacaacaggaaacaag

SEQ ID NO: 8007221 - DNA, 22 bp, Homo sapiens
tgctgagagccagggctggcat

SEQ ID NO: 8007222 - DNA, 22 bp, Homo sapiens
tgctgagagccagggctggcat

SEQ ID NO: 8007223 - DNA, 22 bp, Homo sapiens
tgctgagaggaaagaatgcaca

SEQ ID NO: 8007224 - DNA, 22 bp, Homo sapiens
tgctgagagccagggctggcat

SEQ ID NO: 8007225 - DNA, 22 bp, Homo sapiens
tgctgagaggaaagaatgcaca

SEQ ID NO: 8007226 - DNA, 22 bp, Homo sapiens
tgctgagaggaaggtgcactgg

SEQ ID NO: 8007227 - DNA, 22 bp, Homo sapiens
tgctgagaggaaggtgcactgg

SEQ ID NO: 8007228 - DNA, 22 bp, Homo sapiens
tgctgagataagctatgaccag

SEQ ID NO: 8007229 - DNA, 22 bp, Homo sapiens
tgctgacctaaattgaggaaga

SEQ ID NO: 8007230 - DNA, 21 bp, Homo sapiens
tgctgacatcaggtctgctat

SEQ ID NO: 8007231 - DNA, 22 bp, Homo sapiens
tgctgacctaaattgaggaaga

SEQ ID NO: 8007232 - DNA, 22 bp, Homo sapiens
tgctgaccttgttctgtgagga

SEQ ID NO: 8007233 - DNA, 22 bp, Homo sapiens
tgctgacctagaagctgatgtt

SEQ ID NO: 8007234 - DNA, 22 bp, Homo sapiens
tgctgagaagagggccgaccca

SEQ ID NO: 8007235 - DNA, 19 bp, Homo sapiens
tgctgactgagctgcaaaa

SEQ ID NO: 8007236 - DNA, 22 bp, Homo sapiens
tgctgagatagctgactaggca

SEQ ID NO: 8007237 - DNA, 22 bp, Homo sapiens
tgctgcaagtatttattctggg

SEQ ID NO: 8007238 - DNA, 22 bp, Homo sapiens
tgctgcacaattggaaagtatc

SEQ ID NO: 8007239 - DNA, 22 bp, Homo sapiens
tgctgcacagcccgctggccca

SEQ ID NO: 8007240 - DNA, 22 bp, Homo sapiens
tgctgcactcaccaacagataa

SEQ ID NO: 8007241 - DNA, 22 bp, Homo sapiens
tgctgcactcaccaacagataa

SEQ ID NO: 8007242 - DNA, 22 bp, Homo sapiens
tgctgcagaaattctgtgagga

SEQ ID NO: 8007243 - DNA, 22 bp, Homo sapiens
tgctgcagaaattctgtgagga

SEQ ID NO: 8007244 - DNA, 22 bp, Homo sapiens
tgctgcacttatggctctgagg

SEQ ID NO: 8007245 - DNA, 22 bp, Homo sapiens
tgctgcagaaattctgtgagga

SEQ ID NO: 8007246 - DNA, 22 bp, Homo sapiens
tgctgcagaaattctgtgagga

SEQ ID NO: 8007247 - DNA, 22 bp, Homo sapiens
tgctgcagaaattctgtgagga

SEQ ID NO: 8007248 - DNA, 22 bp, Homo sapiens
tgctgcagaaattctgtgagga

SEQ ID NO: 8007249 - DNA, 20 bp, Homo sapiens
tgctgcagacagggccattg

SEQ ID NO: 8007250 - DNA, 22 bp, Homo sapiens
tgctgacaaaggaacaatactc

SEQ ID NO: 8007251 - DNA, 19 bp, Homo sapiens
tgctgacactagatgtgca

SEQ ID NO: 8007252 - DNA, 21 bp, Homo sapiens
tgctgacatcaggtctgctat

SEQ ID NO: 8007253 - DNA, 21 bp, Homo sapiens
tgctgacatcaggtctgctat

SEQ ID NO: 8007254 - DNA, 22 bp, Homo sapiens
tgctgacactattctaaaaagc

SEQ ID NO: 8007255 - DNA, 17 bp, Homo sapiens
tgctgacagctgtgtgt

SEQ ID NO: 8007256 - DNA, 17 bp, Homo sapiens
tgctgacagctgtgtgt

SEQ ID NO: 8007257 - DNA, 22 bp, Homo sapiens
tgctgaatggtaaagaagtata

SEQ ID NO: 8007258 - DNA, 22 bp, Homo sapiens
tgctgaataataagattactca

SEQ ID NO: 8007259 - DNA, 22 bp, Homo sapiens
tgctgaagttactagagactat

SEQ ID NO: 8007260 - DNA, 22 bp, Homo sapiens
tgctgaatcaaaacaaaggttt

SEQ ID NO: 8007261 - DNA, 22 bp, Homo sapiens
tgctgaatatagagcaagaagt

SEQ ID NO: 8007262 - DNA, 22 bp, Homo sapiens
tgctctggagtggcttgtgcac

SEQ ID NO: 8007263 - DNA, 22 bp, Homo sapiens
tgctctggagtggcttgtgcac

SEQ ID NO: 8007264 - DNA, 22 bp, Homo sapiens
cccagggattataaaggtgaaa

SEQ ID NO: 8007265 - DNA, 22 bp, Homo sapiens
tgctgaagtccaagagctccaa

SEQ ID NO: 8007266 - DNA, 23 bp, Homo sapiens
tgctgaagtgttggccctgccca

SEQ ID NO: 8007267 - DNA, 22 bp, Homo sapiens
tgctgaagtccatctgtttgac

SEQ ID NO: 8007268 - DNA, 22 bp, Homo sapiens
cccagggatgtggcagatgtta

SEQ ID NO: 8007269 - DNA, 22 bp, Homo sapiens
cccagggatgtggcagatgtta

SEQ ID NO: 8007270 - DNA, 22 bp, Homo sapiens
cccagggaggtagcaggagaaa

SEQ ID NO: 8007271 - DNA, 22 bp, Homo sapiens
cccagggaggtagcaggagaaa

SEQ ID NO: 8007272 - DNA, 22 bp, Homo sapiens
cccagggatgtggcagatgtta

SEQ ID NO: 8007273 - DNA, 22 bp, Homo sapiens
cccagggatgtggcagatgtta

SEQ ID NO: 8007274 - DNA, 22 bp, Homo sapiens
cccagggaggtagcaggagaaa

SEQ ID NO: 8007275 - DNA, 22 bp, Homo sapiens
cccagggaggtagcaggagaaa

SEQ ID NO: 8007276 - DNA, 22 bp, Homo sapiens
cccagggaggtagcaggagaaa

SEQ ID NO: 8007277 - DNA, 22 bp, Homo sapiens
cccagggaggtagcaggagaaa

SEQ ID NO: 8007278 - DNA, 22 bp, Homo sapiens
cccagggaggtagcaggagaaa

SEQ ID NO: 8007279 - DNA, 22 bp, Homo sapiens
cccagggaggtagcaggagaaa

SEQ ID NO: 8007280 - DNA, 22 bp, Homo sapiens
cccagggaggtagcaggagaaa

SEQ ID NO: 8007281 - DNA, 22 bp, Homo sapiens
cccagggaggcccaggctctgc

SEQ ID NO: 8007282 - DNA, 22 bp, Homo sapiens
cccagggaggcccaggctctgc

SEQ ID NO: 8007283 - DNA, 22 bp, Homo sapiens
cccagggaggcccaggctctgc

SEQ ID NO: 8007284 - DNA, 22 bp, Homo sapiens
cccagggaggcccaggctctgc

SEQ ID NO: 8007285 - DNA, 22 bp, Homo sapiens
cccagggaggcccaggctctgc

SEQ ID NO: 8007286 - DNA, 22 bp, Homo sapiens
cccagggagcttggagaacggg

SEQ ID NO: 8007287 - DNA, 22 bp, Homo sapiens
cccagggagcttggagaacggg

SEQ ID NO: 8007288 - DNA, 22 bp, Homo sapiens
cccagggagcttggagaacggg

SEQ ID NO: 8007289 - DNA, 22 bp, Homo sapiens
cccagggagagcgcggaggcgg

SEQ ID NO: 8007290 - DNA, 22 bp, Homo sapiens
cccagggagagcgcggaggcgg

SEQ ID NO: 8007291 - DNA, 22 bp, Homo sapiens
cccagggagagcgcggaggcgg

SEQ ID NO: 8007292 - DNA, 22 bp, Homo sapiens
cccagggagagcgcggaggcgg

SEQ ID NO: 8007293 - DNA, 22 bp, Homo sapiens
cccagggagagcgcggaggcgg

SEQ ID NO: 8007294 - DNA, 22 bp, Homo sapiens
cccagggactcgggattctagg

SEQ ID NO: 8007295 - DNA, 22 bp, Homo sapiens
cccagggagagcgcggaggcgg

SEQ ID NO: 8007296 - DNA, 22 bp, Homo sapiens
cccagggactcgggattctagg

SEQ ID NO: 8007297 - DNA, 22 bp, Homo sapiens
cccagggactcgggattctagg

SEQ ID NO: 8007298 - DNA, 22 bp, Homo sapiens
tgctcccacactactcggaggc

SEQ ID NO: 8007299 - DNA, 22 bp, Homo sapiens
tgctcccagctcctgcagcaac

SEQ ID NO: 8007300 - DNA, 22 bp, Homo sapiens
tgctcccagctcctgcagcaac

SEQ ID NO: 8007301 - DNA, 22 bp, Homo sapiens
tgctcccaaacgacctactgtg

SEQ ID NO: 8007302 - DNA, 22 bp, Homo sapiens
tgctcccaaacgacctactgtg

SEQ ID NO: 8007303 - DNA, 22 bp, Homo sapiens
tgctcccacactactcggaggc

SEQ ID NO: 8007304 - DNA, 22 bp, Homo sapiens
tgctcccacactactcggaggc

SEQ ID NO: 8007305 - DNA, 20 bp, Homo sapiens
cccagggacctgagctccat

SEQ ID NO: 8007306 - DNA, 20 bp, Homo sapiens
cccagggacctgagctccat

SEQ ID NO: 8007307 - DNA, 20 bp, Homo sapiens
cccagggacctgagctccat

SEQ ID NO: 8007308 - DNA, 22 bp, Homo sapiens
tgctcccagctgtaggaatgtt

SEQ ID NO: 8007309 - DNA, 22 bp, Homo sapiens
tgctcccagctcctgcagcaac

SEQ ID NO: 8007310 - DNA, 22 bp, Homo sapiens
tggtccctaggaaagcagtgtt

SEQ ID NO: 8007311 - DNA, 22 bp, Homo sapiens
tggtccctagtgtgggagcttg

SEQ ID NO: 8007312 - DNA, 22 bp, Homo sapiens
tggtccctaggaaagcagtgtt

SEQ ID NO: 8007313 - DNA, 22 bp, Homo sapiens
tggtccctagcacagctgtcct

SEQ ID NO: 8007314 - DNA, 22 bp, Homo sapiens
tggtccctgagacctttgggag

SEQ ID NO: 8007315 - DNA, 22 bp, Homo sapiens
tggtccctgaagagagaccttg

SEQ ID NO: 8007316 - DNA, 22 bp, Homo sapiens
tggtccctttctactgagcaca

SEQ ID NO: 8007317 - DNA, 22 bp, Homo sapiens
tggtccctttgactgcccgcca

SEQ ID NO: 8007318 - DNA, 22 bp, Homo sapiens
tggtccctgcctgccaagtgct

SEQ ID NO: 8007319 - DNA, 22 bp, Homo sapiens
tggtccctgatctaatgtctca

SEQ ID NO: 8007320 - DNA, 22 bp, Homo sapiens
tggtccctgcctgccaagtgct

SEQ ID NO: 8007321 - DNA, 22 bp, Homo sapiens
tggtccctgcctgccaagtgct

SEQ ID NO: 8007322 - DNA, 22 bp, Homo sapiens
tggtcccattgttctgcccagg

SEQ ID NO: 8007323 - DNA, 19 bp, Homo sapiens
tggtcccatactgctggcc

SEQ ID NO: 8007324 - DNA, 22 bp, Homo sapiens
tggtccctagaagttctgaatc

SEQ ID NO: 8007325 - DNA, 22 bp, Homo sapiens
tggtccctagcacagctgtcct

SEQ ID NO: 8007326 - DNA, 22 bp, Homo sapiens
tggtccctaaagatgtctacat

SEQ ID NO: 8007327 - DNA, 19 bp, Homo sapiens
tggtcccatactgctggcc

SEQ ID NO: 8007328 - DNA, 22 bp, Homo sapiens
tggtccagtttagcattgagtg

SEQ ID NO: 8007329 - DNA, 22 bp, Homo sapiens
tggtccatgtcctccatctctc

SEQ ID NO: 8007330 - DNA, 22 bp, Homo sapiens
tggtccatgcccacggaatgtg

SEQ ID NO: 8007331 - DNA, 22 bp, Homo sapiens
tggtccatgttcccagaagaca

SEQ ID NO: 8007332 - DNA, 22 bp, Homo sapiens
cctctgtgctttgtccagcctc

SEQ ID NO: 8007333 - DNA, 22 bp, Homo sapiens
cctctgtggccctgactctctt

SEQ ID NO: 8007334 - DNA, 21 bp, Homo sapiens
cctctgtgctaaagggctccc

SEQ ID NO: 8007335 - DNA, 21 bp, Homo sapiens
cctctgtgctaaagggctccc

SEQ ID NO: 8007336 - DNA, 22 bp, Homo sapiens
cctctgtgctttgtccagcctc

SEQ ID NO: 8007337 - DNA, 22 bp, Homo sapiens
cctctgtgcctcgtgtcctctg

SEQ ID NO: 8007338 - DNA, 22 bp, Homo sapiens
cctctgtgcctcgtgtcctctg

SEQ ID NO: 8007339 - DNA, 22 bp, Homo sapiens
cctctgtgcctcagtttcatgt

SEQ ID NO: 8007340 - DNA, 22 bp, Homo sapiens
cctctgtgcctcgtgtcctctg

SEQ ID NO: 8007341 - DNA, 22 bp, Homo sapiens
cctctgtgcctcgtgtcctctg

SEQ ID NO: 8007342 - DNA, 22 bp, Homo sapiens
cctctgtgcctcgtgtcctctg

SEQ ID NO: 8007343 - DNA, 22 bp, Homo sapiens
tggtccagtaagggtggagaga

SEQ ID NO: 8007344 - DNA, 22 bp, Homo sapiens
tggtccagtaagggtggagaga

SEQ ID NO: 8007345 - DNA, 22 bp, Homo sapiens
tggtccagtcgttcctttcctt

SEQ ID NO: 8007346 - DNA, 18 bp, Homo sapiens
tggtccagttcagatata

SEQ ID NO: 8007347 - DNA, 22 bp, Homo sapiens
tggtccagtcgttcctttcctt

SEQ ID NO: 8007348 - DNA, 17 bp, Homo sapiens
tggtccaggtggagcca

SEQ ID NO: 8007349 - DNA, 21 bp, Homo sapiens
tggtaggatccaggaatctgc

SEQ ID NO: 8007350 - DNA, 22 bp, Homo sapiens
tggtaggagatatggtctccga

SEQ ID NO: 8007351 - DNA, 22 bp, Homo sapiens
tggtaggagggaaatgcgggtt

SEQ ID NO: 8007352 - DNA, 22 bp, Homo sapiens
cctgccagtgcctcccactggt

SEQ ID NO: 8007353 - DNA, 22 bp, Homo sapiens
cctgccagtgaagctgacgggc

SEQ ID NO: 8007354 - DNA, 22 bp, Homo sapiens
cctgccagtgcctcccactggt

SEQ ID NO: 8007355 - DNA, 22 bp, Homo sapiens
cctgccagtgcctcccactggt

SEQ ID NO: 8007356 - DNA, 22 bp, Homo sapiens
cctgccagtgaagctgacgggc

SEQ ID NO: 8007357 - DNA, 20 bp, Homo sapiens
tggtcctcacaggtcctccc

SEQ ID NO: 8007358 - DNA, 22 bp, Homo sapiens
cctgccagtgaagctgacgggc

SEQ ID NO: 8007359 - DNA, 22 bp, Homo sapiens
cctgccagtgaagctgacgggc

SEQ ID NO: 8007360 - DNA, 22 bp, Homo sapiens
cctgccagtgaagctgacgggc

SEQ ID NO: 8007361 - DNA, 20 bp, Homo sapiens
tggtcctcacatgccatctt

SEQ ID NO: 8007362 - DNA, 22 bp, Homo sapiens
cctgcccactccaggagcaact

SEQ ID NO: 8007363 - DNA, 22 bp, Homo sapiens
cctgcccactccaggagcaact

SEQ ID NO: 8007364 - DNA, 22 bp, Homo sapiens
cctgcccacagagagggtgcat

SEQ ID NO: 8007365 - DNA, 22 bp, Homo sapiens
cctgccatgccagcatgcccgt

SEQ ID NO: 8007366 - DNA, 22 bp, Homo sapiens
cctgcccacagagagggtgcat

SEQ ID NO: 8007367 - DNA, 22 bp, Homo sapiens
cctgccatggtagacttccagg

SEQ ID NO: 8007368 - DNA, 22 bp, Homo sapiens
cctgccatggtagacttccagg

SEQ ID NO: 8007369 - DNA, 17 bp, Homo sapiens
cctgcccagagacagat

SEQ ID NO: 8007370 - DNA, 17 bp, Homo sapiens
cctgcccagagacagat

SEQ ID NO: 8007371 - DNA, 22 bp, Homo sapiens
cctgcccactgcccggtcagcc

SEQ ID NO: 8007372 - DNA, 17 bp, Homo sapiens
cctgcccagagacagat

SEQ ID NO: 8007373 - DNA, 17 bp, Homo sapiens
cctgcccagagacagat

SEQ ID NO: 8007374 - DNA, 22 bp, Homo sapiens
tggtcttagctggaaggaggga

SEQ ID NO: 8007375 - DNA, 22 bp, Homo sapiens
tggtcttccatgaggagttcat

SEQ ID NO: 8007376 - DNA, 22 bp, Homo sapiens
tggtcttctaaccctcagtcca

SEQ ID NO: 8007377 - DNA, 22 bp, Homo sapiens
tggtcttctttgttgctattat

SEQ ID NO: 8007378 - DNA, 23 bp, Homo sapiens
tggtcttgaactcctgtccctgc

SEQ ID NO: 8007379 - DNA, 22 bp, Homo sapiens
tggtcttgtactatgttgcatt

SEQ ID NO: 8007380 - DNA, 22 bp, Homo sapiens
tggtctttaaggtagctgtcat

SEQ ID NO: 8007381 - DNA, 22 bp, Homo sapiens
tggtgctgataatggcaggatt

SEQ ID NO: 8007382 - DNA, 22 bp, Homo sapiens
tggtgctgataatggcaggatt

SEQ ID NO: 8007383 - DNA, 22 bp, Homo sapiens
tggtgctgataatggcaggatt

SEQ ID NO: 8007384 - DNA, 22 bp, Homo sapiens
tggtgctgataatggcaggatt

SEQ ID NO: 8007385 - DNA, 22 bp, Homo sapiens
tggtgctgagatgaagtgctcc

SEQ ID NO: 8007386 - DNA, 22 bp, Homo sapiens
tggtgctgagatgaagtgctcc

SEQ ID NO: 8007387 - DNA, 22 bp, Homo sapiens
tggtgctgacagttctgagtgc

SEQ ID NO: 8007388 - DNA, 22 bp, Homo sapiens
tggtgctgacagttctgagtgc

SEQ ID NO: 8007389 - DNA, 22 bp, Homo sapiens
tggtgccttgggcctacagcgc

SEQ ID NO: 8007390 - DNA, 22 bp, Homo sapiens
tggtgccttgggcctacagcgc

SEQ ID NO: 8007391 - DNA, 22 bp, Homo sapiens
tggtgctcttatgttttcatca

SEQ ID NO: 8007392 - DNA, 18 bp, Homo sapiens
tggtgcctttcactcttc

SEQ ID NO: 8007393 - DNA, 22 bp, Homo sapiens
tggtggcttctgaggatggcga

SEQ ID NO: 8007394 - DNA, 22 bp, Homo sapiens
tggtggcttctgaggatggcga

SEQ ID NO: 8007395 - DNA, 22 bp, Homo sapiens
tggtggcttctgaggatggcga

SEQ ID NO: 8007396 - DNA, 22 bp, Homo sapiens
tggtggcttctgaggatggcga

SEQ ID NO: 8007397 - DNA, 22 bp, Homo sapiens
tggtggcttctgaggatggcga

SEQ ID NO: 8007398 - DNA, 23 bp, Homo sapiens
tggtggcttgtggtggccaccag

SEQ ID NO: 8007399 - DNA, 23 bp, Homo sapiens
tggtggcttgtggtggccaccag

SEQ ID NO: 8007400 - DNA, 23 bp, Homo sapiens
tggtggcttgtggtggccaccag

SEQ ID NO: 8007401 - DNA, 23 bp, Homo sapiens
tggtggcttgtggtggccaccag

SEQ ID NO: 8007402 - DNA, 23 bp, Homo sapiens
tggtggcttgtggtggccaccag

SEQ ID NO: 8007403 - DNA, 17 bp, Homo sapiens
tggtggctggagtcagg

SEQ ID NO: 8007404 - DNA, 17 bp, Homo sapiens
tggtggctggagtcagg

SEQ ID NO: 8007405 - DNA, 22 bp, Homo sapiens
tggtggctgtaagggagagaag

SEQ ID NO: 8007406 - DNA, 22 bp, Homo sapiens
tggtggctgtaagggagagaag

SEQ ID NO: 8007407 - DNA, 22 bp, Homo sapiens
tggtggctgtaagggagagaag

SEQ ID NO: 8007408 - DNA, 22 bp, Homo sapiens
tggtggctgttgcagaactgag

SEQ ID NO: 8007409 - DNA, 22 bp, Homo sapiens
tggtggctgttgcagaactgag

SEQ ID NO: 8007410 - DNA, 22 bp, Homo sapiens
tggtggctgtaagggagagaag

SEQ ID NO: 8007411 - DNA, 17 bp, Homo sapiens
tggtggctggagtcagg

SEQ ID NO: 8007412 - DNA, 17 bp, Homo sapiens
tggtggctggagtcagg

SEQ ID NO: 8007413 - DNA, 17 bp, Homo sapiens
tggtggctggagtcagg

SEQ ID NO: 8007414 - DNA, 17 bp, Homo sapiens
tggtggctggagtcagg

SEQ ID NO: 8007415 - DNA, 17 bp, Homo sapiens
tggtggctggagtcagg

SEQ ID NO: 8007416 - DNA, 22 bp, Homo sapiens
tggtggctcacgtctgtaatct

SEQ ID NO: 8007417 - DNA, 22 bp, Homo sapiens
tggtggctcacacctgtaatcc

SEQ ID NO: 8007418 - DNA, 22 bp, Homo sapiens
tggtggctcacgtctgtaatct

SEQ ID NO: 8007419 - DNA, 22 bp, Homo sapiens
tggtggctgctccctgccttga

SEQ ID NO: 8007420 - DNA, 22 bp, Homo sapiens
tggtggctaccaggtcctgggg

SEQ ID NO: 8007421 - DNA, 22 bp, Homo sapiens
tggtggctaccaggtcctgggg

SEQ ID NO: 8007422 - DNA, 22 bp, Homo sapiens
tggtggctcacacctgtaatcc

SEQ ID NO: 8007423 - DNA, 22 bp, Homo sapiens
tggtggctaccaggtcctgggg

SEQ ID NO: 8007424 - DNA, 22 bp, Homo sapiens
tggtggctaccaggtcctgggg

SEQ ID NO: 8007425 - DNA, 22 bp, Homo sapiens
tggtggctaccaggtcctgggg

SEQ ID NO: 8007426 - DNA, 22 bp, Homo sapiens
tggtggccttgatggcatctgc

SEQ ID NO: 8007427 - DNA, 22 bp, Homo sapiens
tggtggcgggcagggccgtcac

SEQ ID NO: 8007428 - DNA, 22 bp, Homo sapiens
tggtggccttgatggcatctgc

SEQ ID NO: 8007429 - DNA, 22 bp, Homo sapiens
tggtggccgaagccctctctca

SEQ ID NO: 8007430 - DNA, 22 bp, Homo sapiens
tggtggccgaagccctctctca

SEQ ID NO: 8007431 - DNA, 22 bp, Homo sapiens
tggtggccttgatggcatctgc

SEQ ID NO: 8007432 - DNA, 22 bp, Homo sapiens
tggtggccttgatggcatctgc

SEQ ID NO: 8007433 - DNA, 22 bp, Homo sapiens
tggtggccttgatggcatctgc

SEQ ID NO: 8007434 - DNA, 22 bp, Homo sapiens
tggtggccccctcaagtctttg

SEQ ID NO: 8007435 - DNA, 22 bp, Homo sapiens
tggtgctgtgatacgaggcact

SEQ ID NO: 8007436 - DNA, 22 bp, Homo sapiens
tggtgctgtgatacgaggcact

SEQ ID NO: 8007437 - DNA, 22 bp, Homo sapiens
tggtgctgtggaggggcagaag

SEQ ID NO: 8007438 - DNA, 22 bp, Homo sapiens
tggtgctgtggaggggcagaag

SEQ ID NO: 8007439 - DNA, 22 bp, Homo sapiens
tggtgctgtggaggggcagaag

SEQ ID NO: 8007440 - DNA, 22 bp, Homo sapiens
tggtgctgtggaggggcagaag

SEQ ID NO: 8007441 - DNA, 22 bp, Homo sapiens
tggtggccccctcaagtctttg

SEQ ID NO: 8007442 - DNA, 22 bp, Homo sapiens
tggtggccgaagccctctctca

SEQ ID NO: 8007443 - DNA, 22 bp, Homo sapiens
tggtgctgcctcagatgcctta

SEQ ID NO: 8007444 - DNA, 19 bp, Homo sapiens
tggtgctggcctcccatgg

SEQ ID NO: 8007445 - DNA, 19 bp, Homo sapiens
tggtgctggcctcccatgg

SEQ ID NO: 8007446 - DNA, 22 bp, Homo sapiens
tggtgctgtgatacgaggcact

SEQ ID NO: 8007447 - DNA, 22 bp, Homo sapiens
tggtgctgtgatacgaggcact

SEQ ID NO: 8007448 - DNA, 19 bp, Homo sapiens
tggtgctggcctcccatgg

SEQ ID NO: 8007449 - DNA, 22 bp, Homo sapiens
tggtgctgtctactttgtgcag

SEQ ID NO: 8007450 - DNA, 22 bp, Homo sapiens
tggtgctgcaggtgggcacagt

SEQ ID NO: 8007451 - DNA, 22 bp, Homo sapiens
tggtgctgccacctcctctgct

SEQ ID NO: 8007452 - DNA, 22 bp, Homo sapiens
tggtgctgccacctcctctgct

SEQ ID NO: 8007453 - DNA, 22 bp, Homo sapiens
tggtgctgataatggcaggatt

SEQ ID NO: 8007454 - DNA, 22 bp, Homo sapiens
tggtgctgccacctcctctgct

SEQ ID NO: 8007455 - DNA, 22 bp, Homo sapiens
tggtgctgcaggtgggcacagt

SEQ ID NO: 8007456 - DNA, 22 bp, Homo sapiens
tggtgctgcaggtgggcacagt

SEQ ID NO: 8007457 - DNA, 22 bp, Homo sapiens
tggtgctgcaggtgggcacagt

SEQ ID NO: 8007458 - DNA, 22 bp, Homo sapiens
tggtgctgcaggtgggcacagt

SEQ ID NO: 8007459 - DNA, 22 bp, Homo sapiens
tggtgctgccaggctcctgcca

SEQ ID NO: 8007460 - DNA, 22 bp, Homo sapiens
tggtgctgcctcagatgcctta

SEQ ID NO: 8007461 - DNA, 22 bp, Homo sapiens
tggtgctgccaggctcctgcca

SEQ ID NO: 8007462 - DNA, 22 bp, Homo sapiens
tggtgctgccaggctcctgcca

SEQ ID NO: 8007463 - DNA, 22 bp, Homo sapiens
tggtgctgccaggctcctgcca

SEQ ID NO: 8007464 - DNA, 22 bp, Homo sapiens
tggtgctgccacctcctctgct

SEQ ID NO: 8007465 - DNA, 22 bp, Homo sapiens
tggtgctgccaggctcctgcca

SEQ ID NO: 8007466 - DNA, 22 bp, Homo sapiens
tggtgctgccacctcctctgct

SEQ ID NO: 8007467 - DNA, 22 bp, Homo sapiens
tggtgctgccacctcctctgct

SEQ ID NO: 8007468 - DNA, 22 bp, Homo sapiens
tggtgctgccacctcctctgct

SEQ ID NO: 8007469 - DNA, 22 bp, Homo sapiens
cctggagacctgatggcagcgg

SEQ ID NO: 8007470 - DNA, 22 bp, Homo sapiens
cctggagacctgatggcagcgg

SEQ ID NO: 8007471 - DNA, 22 bp, Homo sapiens
cctggagacctgatggcagcgg

SEQ ID NO: 8007472 - DNA, 22 bp, Homo sapiens
cctggagacctgatggcagcgg

SEQ ID NO: 8007473 - DNA, 22 bp, Homo sapiens
cctggagacctgatggcagcgg

SEQ ID NO: 8007474 - DNA, 22 bp, Homo sapiens
cctggagacgaggctggaccat

SEQ ID NO: 8007475 - DNA, 22 bp, Homo sapiens
cctggagacgaggctggaccat

SEQ ID NO: 8007476 - DNA, 22 bp, Homo sapiens
cctggagacgaggctggaccat

SEQ ID NO: 8007477 - DNA, 22 bp, Homo sapiens
cctggagacgaggctggaccat

SEQ ID NO: 8007478 - DNA, 22 bp, Homo sapiens
cctggagacgaggctggaccat

SEQ ID NO: 8007479 - DNA, 22 bp, Homo sapiens
cctggagagctcgggccaggca

SEQ ID NO: 8007480 - DNA, 22 bp, Homo sapiens
cctggagagctcgggccaggca

SEQ ID NO: 8007481 - DNA, 22 bp, Homo sapiens
cctggagagagaggccaactgc

SEQ ID NO: 8007482 - DNA, 22 bp, Homo sapiens
tgtaaacagccccatggagagc

SEQ ID NO: 8007483 - DNA, 22 bp, Homo sapiens
cctggagagctcgggccaggca

SEQ ID NO: 8007484 - DNA, 22 bp, Homo sapiens
tgtaaacagccccatggagagc

SEQ ID NO: 8007485 - DNA, 22 bp, Homo sapiens
cctggagagctcgggccaggca

SEQ ID NO: 8007486 - DNA, 22 bp, Homo sapiens
tgtaaacataccagagccaagt

SEQ ID NO: 8007487 - DNA, 22 bp, Homo sapiens
tgtaaacataccagagccaagt

SEQ ID NO: 8007488 - DNA, 22 bp, Homo sapiens
tgtaaacagtaggactaaagag

SEQ ID NO: 8007489 - DNA, 21 bp, Homo sapiens
cctggagacaaagacagggtg

SEQ ID NO: 8007490 - DNA, 22 bp, Homo sapiens
cctggagaccagaggatacttc

SEQ ID NO: 8007491 - DNA, 22 bp, Homo sapiens
cctggagacccacttctgccaa

SEQ ID NO: 8007492 - DNA, 21 bp, Homo sapiens
cctggagacaaagacagggtg

SEQ ID NO: 8007493 - DNA, 21 bp, Homo sapiens
cctggagacaaagacagggtg

SEQ ID NO: 8007494 - DNA, 21 bp, Homo sapiens
cctggagacaaagacagggtg

SEQ ID NO: 8007495 - DNA, 21 bp, Homo sapiens
cctggagacaaagacagggtg

SEQ ID NO: 8007496 - DNA, 22 bp, Homo sapiens
cctggaaacacatgatgatgaa

SEQ ID NO: 8007497 - DNA, 22 bp, Homo sapiens
cctggaaacacatgatgatgaa

SEQ ID NO: 8007498 - DNA, 22 bp, Homo sapiens
cctggaaagagaatgaatgagc

SEQ ID NO: 8007499 - DNA, 22 bp, Homo sapiens
cctggaaagagaatgaatgagc

SEQ ID NO: 8007500 - DNA, 22 bp, Homo sapiens
cctggactcaggctgtgggcac

SEQ ID NO: 8007501 - DNA, 22 bp, Homo sapiens
cctggaaaatgccactttcaca

SEQ ID NO: 8007502 - DNA, 23 bp, Homo sapiens
tggtggcttgtggtggccaccag

SEQ ID NO: 8007503 - DNA, 22 bp, Homo sapiens
tggtgggacatctgaggagagg

SEQ ID NO: 8007504 - DNA, 22 bp, Homo sapiens
tggtgggacatctgaggagagg

SEQ ID NO: 8007505 - DNA, 22 bp, Homo sapiens
tggtgggacatctgaggagagg

SEQ ID NO: 8007506 - DNA, 22 bp, Homo sapiens
cctggaaaatgccactttcaca

SEQ ID NO: 8007507 - DNA, 22 bp, Homo sapiens
cctggaaacacatgatgatgaa

SEQ ID NO: 8007508 - DNA, 22 bp, Homo sapiens
cctggaaactgttgtcaaatct

SEQ ID NO: 8007509 - DNA, 22 bp, Homo sapiens
cctggaaactgttgtcaaatct

SEQ ID NO: 8007510 - DNA, 22 bp, Homo sapiens
tgtaaacatatgtatgtatgta

SEQ ID NO: 8007511 - DNA, 22 bp, Homo sapiens
tgtaaacatatgtatgtatgta

SEQ ID NO: 8007512 - DNA, 22 bp, Homo sapiens
tgtaaacatatgtatgtatgta

SEQ ID NO: 8007513 - DNA, 23 bp, Homo sapiens
tgtaaacatcaccccctggagtt

SEQ ID NO: 8007514 - DNA, 22 bp, Homo sapiens
tgtaaacatgctgaggctggag

SEQ ID NO: 8007515 - DNA, 22 bp, Homo sapiens
tgtaaactcagtatgttttact

SEQ ID NO: 8007516 - DNA, 22 bp, Homo sapiens
tgtaaactcagtatgttttact

SEQ ID NO: 8007517 - DNA, 22 bp, Homo sapiens
tgtaaaccagggtcatccttag

SEQ ID NO: 8007518 - DNA, 23 bp, Homo sapiens
tgtaaaccattttgcatcccatg

SEQ ID NO: 8007519 - DNA, 22 bp, Homo sapiens
tgtaaactagggctgataaggg

SEQ ID NO: 8007520 - DNA, 22 bp, Homo sapiens
tgtaaagaaatagcatttgtag

SEQ ID NO: 8007521 - DNA, 22 bp, Homo sapiens
tgtaaagaaatagcatttgtag

SEQ ID NO: 8007522 - DNA, 22 bp, Homo sapiens
tgtaaagaaagacgcagagtta

SEQ ID NO: 8007523 - DNA, 22 bp, Homo sapiens
tgtaaagaaagacgcagagtta

SEQ ID NO: 8007524 - DNA, 22 bp, Homo sapiens
tgtaccaggaggaggacaaatt

SEQ ID NO: 8007525 - DNA, 23 bp, Homo sapiens
tgtaccaggagtttcagcagact

SEQ ID NO: 8007526 - DNA, 22 bp, Homo sapiens
tgtaggaatggattctagaagg

SEQ ID NO: 8007527 - DNA, 22 bp, Homo sapiens
tgtaccagatgtctaaagccat

SEQ ID NO: 8007528 - DNA, 22 bp, Homo sapiens
tgtaccagatgtctaaagccat

SEQ ID NO: 8007529 - DNA, 22 bp, Homo sapiens
tgtaccagatggaaaacgtgag

SEQ ID NO: 8007530 - DNA, 22 bp, Homo sapiens
tgtaccaaacccatcataacta

SEQ ID NO: 8007531 - DNA, 22 bp, Homo sapiens
tgtaccaagacaaatcagaaac

SEQ ID NO: 8007532 - DNA, 22 bp, Homo sapiens
tgtaggaatgtttttaagttgg

SEQ ID NO: 8007533 - DNA, 21 bp, Homo sapiens
tgtaggaggcatctggggctg

SEQ ID NO: 8007534 - DNA, 22 bp, Homo sapiens
tgtaggactgagaatgattttt

SEQ ID NO: 8007535 - DNA, 22 bp, Homo sapiens
tgtaggagtccaatcaggagac

SEQ ID NO: 8007536 - DNA, 22 bp, Homo sapiens
tgtagggactgaggctggagag

SEQ ID NO: 8007537 - DNA, 22 bp, Homo sapiens
tgtaggcacatgtatatatccc

SEQ ID NO: 8007538 - DNA, 20 bp, Homo sapiens
tgtaggtgtacagtaaggag

SEQ ID NO: 8007539 - DNA, 22 bp, Homo sapiens
tgtaggtctcagtgtctgagct

SEQ ID NO: 8007540 - DNA, 23 bp, Homo sapiens
tgtaggtctgccttatctgctgc

SEQ ID NO: 8007541 - DNA, 22 bp, Homo sapiens
tgtaggtcagtttgttcatgtt

SEQ ID NO: 8007542 - DNA, 22 bp, Homo sapiens
tgtaggtaaaagcatctagtgt

SEQ ID NO: 8007543 - DNA, 22 bp, Homo sapiens
tgtagggacttggcgatcactt

SEQ ID NO: 8007544 - DNA, 22 bp, Homo sapiens
tgtagggagaagagaggcacct

SEQ ID NO: 8007545 - DNA, 22 bp, Homo sapiens
tgtagggaggaagggttggaaa

SEQ ID NO: 8007546 - DNA, 22 bp, Homo sapiens
tgtataaaccatggacagcttt

SEQ ID NO: 8007547 - DNA, 22 bp, Homo sapiens
tgtataaaccatggacagcttt

SEQ ID NO: 8007548 - DNA, 22 bp, Homo sapiens
tgtagttaggctgggaattggc

SEQ ID NO: 8007549 - DNA, 22 bp, Homo sapiens
tgtataaaccatggacagcttt

SEQ ID NO: 8007550 - DNA, 22 bp, Homo sapiens
tgtagtgaggaaagactggttg

SEQ ID NO: 8007551 - DNA, 22 bp, Homo sapiens
tgtagtgtagcagggtgggaca

SEQ ID NO: 8007552 - DNA, 22 bp, Homo sapiens
tgtagtagcattcacgaagtgt

SEQ ID NO: 8007553 - DNA, 22 bp, Homo sapiens
tgtagtaagtgcgcaataaata

SEQ ID NO: 8007554 - DNA, 22 bp, Homo sapiens
tgtagtaagtgcgcaataaata

SEQ ID NO: 8007555 - DNA, 22 bp, Homo sapiens
tgtagtaagtgcgcaataaata

SEQ ID NO: 8007556 - DNA, 22 bp, Homo sapiens
tgtagtagcattcacgaagtgt

SEQ ID NO: 8007557 - DNA, 22 bp, Homo sapiens
tgtagtccaggaattgtgtctg

SEQ ID NO: 8007558 - DNA, 22 bp, Homo sapiens
cctggagaggcgctgcagagga

SEQ ID NO: 8007559 - DNA, 22 bp, Homo sapiens
cctggagaggcgctgcagagga

SEQ ID NO: 8007560 - DNA, 22 bp, Homo sapiens
cctggagaggcgctgcagagga

SEQ ID NO: 8007561 - DNA, 22 bp, Homo sapiens
cctggagattatttggtccaat

SEQ ID NO: 8007562 - DNA, 22 bp, Homo sapiens
cctggagaggcgctgcagagga

SEQ ID NO: 8007563 - DNA, 22 bp, Homo sapiens
cctggagaggcgctgcagagga

SEQ ID NO: 8007564 - DNA, 22 bp, Homo sapiens
cctggagagctcgggccaggca

SEQ ID NO: 8007565 - DNA, 22 bp, Homo sapiens
tgtataaaccatggacagcttt

SEQ ID NO: 8007566 - DNA, 22 bp, Homo sapiens
cctggagaggagaaagggccca

SEQ ID NO: 8007567 - DNA, 22 bp, Homo sapiens
cctggagaggagaaagggccca

SEQ ID NO: 8007568 - DNA, 22 bp, Homo sapiens
cctggagaggagaaagggccca

SEQ ID NO: 8007569 - DNA, 22 bp, Homo sapiens
cctggagaggagaaagggccca

SEQ ID NO: 8007570 - DNA, 22 bp, Homo sapiens
cctggagaggcgctgcagagga

SEQ ID NO: 8007571 - DNA, 22 bp, Homo sapiens
cctggaggtggaggttgcagtg

SEQ ID NO: 8007572 - DNA, 22 bp, Homo sapiens
cctggaggtggaggttgcagtg

SEQ ID NO: 8007573 - DNA, 22 bp, Homo sapiens
cctggcacatagcaacccctcc

SEQ ID NO: 8007574 - DNA, 22 bp, Homo sapiens
cctggcacatagtgggcatgca

SEQ ID NO: 8007575 - DNA, 22 bp, Homo sapiens
cctggcacatagtaagtactag

SEQ ID NO: 8007576 - DNA, 22 bp, Homo sapiens
cctggcacatagtgggcatgca

SEQ ID NO: 8007577 - DNA, 22 bp, Homo sapiens
cctggcacatagcaacccctcc

SEQ ID NO: 8007578 - DNA, 22 bp, Homo sapiens
cctggcacatagtaagtactag

SEQ ID NO: 8007579 - DNA, 22 bp, Homo sapiens
cctggagcacatggcaggaggc

SEQ ID NO: 8007580 - DNA, 22 bp, Homo sapiens
cctggagcacatggcaggaggc

SEQ ID NO: 8007581 - DNA, 22 bp, Homo sapiens
cctggagcacatggcaggaggc

SEQ ID NO: 8007582 - DNA, 22 bp, Homo sapiens
cctggagcacatggcaggaggc

SEQ ID NO: 8007583 - DNA, 19 bp, Homo sapiens
cctggaggtgaaggttctc

SEQ ID NO: 8007584 - DNA, 22 bp, Homo sapiens
cctggaggtggaggttgcagtg

SEQ ID NO: 8007585 - DNA, 22 bp, Homo sapiens
cctggagcaaaaatctaaggag

SEQ ID NO: 8007586 - DNA, 22 bp, Homo sapiens
cctggagcacagcccagtccca

SEQ ID NO: 8007587 - DNA, 22 bp, Homo sapiens
cctggagcacagcccagtccca

SEQ ID NO: 8007588 - DNA, 22 bp, Homo sapiens
cctggagcacagcccagtccca

SEQ ID NO: 8007589 - DNA, 22 bp, Homo sapiens
cctggagcacatggcaggaggc

SEQ ID NO: 8007590 - DNA, 22 bp, Homo sapiens
cctggagcacatggcaggaggc

SEQ ID NO: 8007591 - DNA, 22 bp, Homo sapiens
cctggagatttcttcaagcttt

SEQ ID NO: 8007592 - DNA, 22 bp, Homo sapiens
cctggagcaaaaatctaaggag

SEQ ID NO: 8007593 - DNA, 22 bp, Homo sapiens
cctggagattatttggtccaat

SEQ ID NO: 8007594 - DNA, 22 bp, Homo sapiens
tgtatgttgggtcaaagtacat

SEQ ID NO: 8007595 - DNA, 22 bp, Homo sapiens
tgtatgtgtggatagatgtata

SEQ ID NO: 8007596 - DNA, 22 bp, Homo sapiens
tgtatgtgtggatagatgtata

SEQ ID NO: 8007597 - DNA, 17 bp, Homo sapiens
tgtatgtggatacacta

SEQ ID NO: 8007598 - DNA, 22 bp, Homo sapiens
tgtatgtgcttgagaaggtggg

SEQ ID NO: 8007599 - DNA, 22 bp, Homo sapiens
tgtatgtgcaatgtttatatgt

SEQ ID NO: 8007600 - DNA, 22 bp, Homo sapiens
tgtatgtattttgctaggctga

SEQ ID NO: 8007601 - DNA, 22 bp, Homo sapiens
tgtatgtattggtcagggttct

SEQ ID NO: 8007602 - DNA, 22 bp, Homo sapiens
tgtatgtctgtgaattcatatt

SEQ ID NO: 8007603 - DNA, 22 bp, Homo sapiens
tgtatgtctgtgaattcatatt

SEQ ID NO: 8007604 - DNA, 22 bp, Homo sapiens
tgtatgtatgcatcttttatgt

SEQ ID NO: 8007605 - DNA, 22 bp, Homo sapiens
cctggcagacagcactgaagct

SEQ ID NO: 8007606 - DNA, 22 bp, Homo sapiens
cctggcagacagcactgaagct

SEQ ID NO: 8007607 - DNA, 22 bp, Homo sapiens
cctggcagactgtgagggcagg

SEQ ID NO: 8007608 - DNA, 22 bp, Homo sapiens
tgtatgtatacactgatcatca

SEQ ID NO: 8007609 - DNA, 22 bp, Homo sapiens
tgtatgtatgcatcttttatgt

SEQ ID NO: 8007610 - DNA, 22 bp, Homo sapiens
cctggcagacagcactgaagct

SEQ ID NO: 8007611 - DNA, 22 bp, Homo sapiens
cctggcagaatattaaagtgca

SEQ ID NO: 8007612 - DNA, 22 bp, Homo sapiens
cctggcagacagcactgaagct

SEQ ID NO: 8007613 - DNA, 22 bp, Homo sapiens
cctggcagacagcactgaagct

SEQ ID NO: 8007614 - DNA, 22 bp, Homo sapiens
cctggcagacagcactgaagct

SEQ ID NO: 8007615 - DNA, 22 bp, Homo sapiens
cctggcagacagcactgaagct

SEQ ID NO: 8007616 - DNA, 22 bp, Homo sapiens
cctggcacatctaactcactct

SEQ ID NO: 8007617 - DNA, 22 bp, Homo sapiens
cctggcacatctaactcactct

SEQ ID NO: 8007618 - DNA, 22 bp, Homo sapiens
cctggcacatgatagatgctca

SEQ ID NO: 8007619 - DNA, 22 bp, Homo sapiens
cctggcacatgatagatgctca

SEQ ID NO: 8007620 - DNA, 22 bp, Homo sapiens
cctggcacgaagggctgaggtt

SEQ ID NO: 8007621 - DNA, 22 bp, Homo sapiens
cctggcacgaagggctgaggtt

SEQ ID NO: 8007622 - DNA, 22 bp, Homo sapiens
cctggcacgaagggctgaggtt

SEQ ID NO: 8007623 - DNA, 22 bp, Homo sapiens
cctggcacgaagggctgaggtt

SEQ ID NO: 8007624 - DNA, 22 bp, Homo sapiens
cctggcaccttcacagactact

SEQ ID NO: 8007625 - DNA, 22 bp, Homo sapiens
cctggcaccttcacagactact

SEQ ID NO: 8007626 - DNA, 22 bp, Homo sapiens
cctggcaccttcacagactact

SEQ ID NO: 8007627 - DNA, 22 bp, Homo sapiens
cctggcaccttcacagactact

SEQ ID NO: 8007628 - DNA, 22 bp, Homo sapiens
cctggcactgaccaggcactga

SEQ ID NO: 8007629 - DNA, 22 bp, Homo sapiens
cctggcactgaccaggcactga

SEQ ID NO: 8007630 - DNA, 22 bp, Homo sapiens
cctggcactgaccaggcactga

SEQ ID NO: 8007631 - DNA, 22 bp, Homo sapiens
cctggcagaaagagttacacct

SEQ ID NO: 8007632 - DNA, 22 bp, Homo sapiens
cctggcagaaagagttacacct

SEQ ID NO: 8007633 - DNA, 21 bp, Homo sapiens
cctggcactggcctgctgagc

SEQ ID NO: 8007634 - DNA, 22 bp, Homo sapiens
cctggcactgctgaagtcctgg

SEQ ID NO: 8007635 - DNA, 22 bp, Homo sapiens
cctggcactgctgaagtcctgg

SEQ ID NO: 8007636 - DNA, 21 bp, Homo sapiens
cctggcagaagcctgatatgc

SEQ ID NO: 8007637 - DNA, 22 bp, Homo sapiens
cctggcagaatattaaagtgca

SEQ ID NO: 8007638 - DNA, 21 bp, Homo sapiens
cctggcagaagcctgatatgc

SEQ ID NO: 8007639 - DNA, 21 bp, Homo sapiens
cctggcagaagcctgatatgc

SEQ ID NO: 8007640 - DNA, 22 bp, Homo sapiens
tgtattaacattaataaaatgg

SEQ ID NO: 8007641 - DNA, 22 bp, Homo sapiens
tgtattaacattaataaaatgg

SEQ ID NO: 8007642 - DNA, 22 bp, Homo sapiens
tgtattaacattaataaaatgg

SEQ ID NO: 8007643 - DNA, 22 bp, Homo sapiens
tgtattaacattaataaaatgg

SEQ ID NO: 8007644 - DNA, 22 bp, Homo sapiens
tgtattaacattaataaaatgg

SEQ ID NO: 8007645 - DNA, 22 bp, Homo sapiens
tgtattaacattaataaaatgg

SEQ ID NO: 8007646 - DNA, 22 bp, Homo sapiens
tgtattaggagattccatgttt

SEQ ID NO: 8007647 - DNA, 22 bp, Homo sapiens
tgtattaggttgatgcgaaagt

SEQ ID NO: 8007648 - DNA, 22 bp, Homo sapiens
tgtattaacattaataaaatgg

SEQ ID NO: 8007649 - DNA, 23 bp, Homo sapiens
tgtattacagatgcatcagtgat

SEQ ID NO: 8007650 - DNA, 22 bp, Homo sapiens
tgtattagagcagtagaattat

SEQ ID NO: 8007651 - DNA, 22 bp, Homo sapiens
tgtattagagcatataatttga

SEQ ID NO: 8007652 - DNA, 22 bp, Homo sapiens
tgtattatgattgttgttcatg

SEQ ID NO: 8007653 - DNA, 22 bp, Homo sapiens
tgtattcaacttcttaaaaatt

SEQ ID NO: 8007654 - DNA, 22 bp, Homo sapiens
tgtattatcaagtaaatacatg

SEQ ID NO: 8007655 - DNA, 22 bp, Homo sapiens
tgtattatcaagtaaatacatg

SEQ ID NO: 8007656 - DNA, 22 bp, Homo sapiens
tgtattatcaagtaaatacatg

SEQ ID NO: 8007657 - DNA, 22 bp, Homo sapiens
tgtattatcaagtaaatacatg

SEQ ID NO: 8007658 - DNA, 22 bp, Homo sapiens
tgtattatcaagtaaatacatg

SEQ ID NO: 8007659 - DNA, 22 bp, Homo sapiens
tgtattatcaagtaaatacatg

SEQ ID NO: 8007660 - DNA, 22 bp, Homo sapiens
tgtattatcaagtaaatacatg

SEQ ID NO: 8007661 - DNA, 22 bp, Homo sapiens
tgtcagctggagatggcatggg

SEQ ID NO: 8007662 - DNA, 22 bp, Homo sapiens
tgtcaggacacagctttctgtg

SEQ ID NO: 8007663 - DNA, 22 bp, Homo sapiens
tgtcaggacattttatgaatca

SEQ ID NO: 8007664 - DNA, 22 bp, Homo sapiens
tgtattcaacttcttaaaaatt

SEQ ID NO: 8007665 - DNA, 22 bp, Homo sapiens
tgtattcaacttcttaaaaatt

SEQ ID NO: 8007666 - DNA, 22 bp, Homo sapiens
tgtattcagggacatatatgta

SEQ ID NO: 8007667 - DNA, 22 bp, Homo sapiens
tgtattcagtgatttcacaata

SEQ ID NO: 8007668 - DNA, 22 bp, Homo sapiens
tgtcatgtctgtaaatacacca

SEQ ID NO: 8007669 - DNA, 22 bp, Homo sapiens
tgtcatgtctgtaaatacacca

SEQ ID NO: 8007670 - DNA, 22 bp, Homo sapiens
tgtcatgtgagggaacttgttc

SEQ ID NO: 8007671 - DNA, 22 bp, Homo sapiens
tgtcatgtaacctttctgagcc

SEQ ID NO: 8007672 - DNA, 22 bp, Homo sapiens
tgtcatgtagcattttatgtct

SEQ ID NO: 8007673 - DNA, 22 bp, Homo sapiens
tgtcatgtataagacactgtgt

SEQ ID NO: 8007674 - DNA, 22 bp, Homo sapiens
tgtcatgtataagacactgtgt

SEQ ID NO: 8007675 - DNA, 22 bp, Homo sapiens
tgtcatggtatttgtgagctgc

SEQ ID NO: 8007676 - DNA, 22 bp, Homo sapiens
tgtcatggtctgtaaggagccc

SEQ ID NO: 8007677 - DNA, 22 bp, Homo sapiens
tgtcatgtaaagagtaaatggt

SEQ ID NO: 8007678 - DNA, 22 bp, Homo sapiens
tgtcatggtagctgaaggatgt

SEQ ID NO: 8007679 - DNA, 22 bp, Homo sapiens
tgtcatggacagattagatgag

SEQ ID NO: 8007680 - DNA, 22 bp, Homo sapiens
tgtcatgcccaggagcaaggta

SEQ ID NO: 8007681 - DNA, 22 bp, Homo sapiens
tgtcatgcccaggagcaaggta

SEQ ID NO: 8007682 - DNA, 20 bp, Homo sapiens
tgtcatgcattagatgaaga

SEQ ID NO: 8007683 - DNA, 22 bp, Homo sapiens
tgtcatgccaccgtttcccaga

SEQ ID NO: 8007684 - DNA, 22 bp, Homo sapiens
tgtcaggagccaccagcactcc

SEQ ID NO: 8007685 - DNA, 22 bp, Homo sapiens
tgtcatgtttcatgtttgtagg

SEQ ID NO: 8007686 - DNA, 22 bp, Homo sapiens
tgtcatgtgttcttaaatacat

SEQ ID NO: 8007687 - DNA, 22 bp, Homo sapiens
tgtcattatttgcctactgact

SEQ ID NO: 8007688 - DNA, 22 bp, Homo sapiens
tgtcattatgaggattacaata

SEQ ID NO: 8007689 - DNA, 22 bp, Homo sapiens
cctggcagactgtgagggcagg

SEQ ID NO: 8007690 - DNA, 22 bp, Homo sapiens
cctggcagactgtgagggcagg

SEQ ID NO: 8007691 - DNA, 22 bp, Homo sapiens
cctggcagactgtgagggcagg

SEQ ID NO: 8007692 - DNA, 22 bp, Homo sapiens
cctggcagactgtgagggcagg

SEQ ID NO: 8007693 - DNA, 22 bp, Homo sapiens
cctggcagactgtgagggcagg

SEQ ID NO: 8007694 - DNA, 22 bp, Homo sapiens
cctggcagactgtgagggcagg

SEQ ID NO: 8007695 - DNA, 23 bp, Homo sapiens
cctggcagcaaacgaggaggtta

SEQ ID NO: 8007696 - DNA, 23 bp, Homo sapiens
cctggcagcaaacgaggaggtta

SEQ ID NO: 8007697 - DNA, 22 bp, Homo sapiens
cctggcagactgtgagggcagg

SEQ ID NO: 8007698 - DNA, 23 bp, Homo sapiens
cctggcagcaaacgaggaggtta

SEQ ID NO: 8007699 - DNA, 23 bp, Homo sapiens
cctggcagcaaacgaggaggtta

SEQ ID NO: 8007700 - DNA, 22 bp, Homo sapiens
cctggcagactgtgagggcagg

SEQ ID NO: 8007701 - DNA, 22 bp, Homo sapiens
cctggcagcattggtagagatt

SEQ ID NO: 8007702 - DNA, 22 bp, Homo sapiens
cctggcagcattggtagagatt

SEQ ID NO: 8007703 - DNA, 22 bp, Homo sapiens
cctggcagcattggtagagatt

SEQ ID NO: 8007704 - DNA, 22 bp, Homo sapiens
cctggcagcaggtgggcccgtg

SEQ ID NO: 8007705 - DNA, 22 bp, Homo sapiens
cctggcagcattggtagagatt

SEQ ID NO: 8007706 - DNA, 22 bp, Homo sapiens
cctggcagcattggtagagatt

SEQ ID NO: 8007707 - DNA, 18 bp, Homo sapiens
cctggcagccatgcgcgc

SEQ ID NO: 8007708 - DNA, 18 bp, Homo sapiens
cctggcagccatgcgcgc

SEQ ID NO: 8007709 - DNA, 18 bp, Homo sapiens
cctggcagccatgcgcgc

SEQ ID NO: 8007710 - DNA, 18 bp, Homo sapiens
cctggcagccatgcgcgc

SEQ ID NO: 8007711 - DNA, 22 bp, Homo sapiens
cctggcagcccagagcgccgct

SEQ ID NO: 8007712 - DNA, 23 bp, Homo sapiens
cctggcagcaaacgaggaggtta

SEQ ID NO: 8007713 - DNA, 23 bp, Homo sapiens
cctggcagcaaacgaggaggtta

SEQ ID NO: 8007714 - DNA, 22 bp, Homo sapiens
cctggcagcagcacatgccttc

SEQ ID NO: 8007715 - DNA, 22 bp, Homo sapiens
cctggcagcagcacatgccttc

SEQ ID NO: 8007716 - DNA, 22 bp, Homo sapiens
cctggcagcagcacatgccttc

SEQ ID NO: 8007717 - DNA, 23 bp, Homo sapiens
cctggcagcaaacgaggaggtta

SEQ ID NO: 8007718 - DNA, 22 bp, Homo sapiens
cctggcagcaggtgggcccgtg

SEQ ID NO: 8007719 - DNA, 22 bp, Homo sapiens
cctggcagcaggtgggcccgtg

SEQ ID NO: 8007720 - DNA, 22 bp, Homo sapiens
cctggcaggctggggacagtgc

SEQ ID NO: 8007721 - DNA, 22 bp, Homo sapiens
cctggcaggctggggacagtgc

SEQ ID NO: 8007722 - DNA, 22 bp, Homo sapiens
cctggcaggctggggacagtgc

SEQ ID NO: 8007723 - DNA, 22 bp, Homo sapiens
cctggcaggctggggacagtgc

SEQ ID NO: 8007724 - DNA, 22 bp, Homo sapiens
cctggcaggctggggacagtgc

SEQ ID NO: 8007725 - DNA, 20 bp, Homo sapiens
cctggcaggcgggttactta

SEQ ID NO: 8007726 - DNA, 20 bp, Homo sapiens
cctggcaggcgggttactta

SEQ ID NO: 8007727 - DNA, 20 bp, Homo sapiens
cctggcaggcgggttactta

SEQ ID NO: 8007728 - DNA, 22 bp, Homo sapiens
cctggcaggctggggacagtgc

SEQ ID NO: 8007729 - DNA, 22 bp, Homo sapiens
cctggcaggctggggacagtgc

SEQ ID NO: 8007730 - DNA, 20 bp, Homo sapiens
cctggcaggcgggttactta

SEQ ID NO: 8007731 - DNA, 22 bp, Homo sapiens
cctggcaggctggggacagtgc

SEQ ID NO: 8007732 - DNA, 22 bp, Homo sapiens
cctggcaggcaagaggaaggga

SEQ ID NO: 8007733 - DNA, 22 bp, Homo sapiens
cctggcaggcaagaggaaggga

SEQ ID NO: 8007734 - DNA, 22 bp, Homo sapiens
cctggcaggcaagaggaaggga

SEQ ID NO: 8007735 - DNA, 22 bp, Homo sapiens
cctggcaggactgttgtaagaa

SEQ ID NO: 8007736 - DNA, 22 bp, Homo sapiens
cctggcaggactgttgtaagaa

SEQ ID NO: 8007737 - DNA, 22 bp, Homo sapiens
cctggcaggactgttgtaagaa

SEQ ID NO: 8007738 - DNA, 22 bp, Homo sapiens
cctggcaggcaagaggaaggga

SEQ ID NO: 8007739 - DNA, 22 bp, Homo sapiens
cctggcaggcaagaggaaggga

SEQ ID NO: 8007740 - DNA, 22 bp, Homo sapiens
cctggcaggcccctcctggatt

SEQ ID NO: 8007741 - DNA, 22 bp, Homo sapiens
cctggcaggcccctcctggatt

SEQ ID NO: 8007742 - DNA, 22 bp, Homo sapiens
cctggcaggcccctcctggatt

SEQ ID NO: 8007743 - DNA, 22 bp, Homo sapiens
cctggcaggtggcgccctcggc

SEQ ID NO: 8007744 - DNA, 22 bp, Homo sapiens
cctggcaggtggcgccctcggc

SEQ ID NO: 8007745 - DNA, 22 bp, Homo sapiens
cctggcaggttacaaccagtta

SEQ ID NO: 8007746 - DNA, 22 bp, Homo sapiens
cctggcagtcaggggagtcctt

SEQ ID NO: 8007747 - DNA, 22 bp, Homo sapiens
cctggcagtcaggggagtcctt

SEQ ID NO: 8007748 - DNA, 22 bp, Homo sapiens
cctggcagtcaggggagtcctt

SEQ ID NO: 8007749 - DNA, 22 bp, Homo sapiens
cctggcagtcaggggagtcctt

SEQ ID NO: 8007750 - DNA, 22 bp, Homo sapiens
cctggcagtcaggggagtcctt

SEQ ID NO: 8007751 - DNA, 22 bp, Homo sapiens
cctggcaggtggaggttgcagt

SEQ ID NO: 8007752 - DNA, 22 bp, Homo sapiens
cctggcagggctgcagtaatgg

SEQ ID NO: 8007753 - DNA, 22 bp, Homo sapiens
cctggcaggtagcattgaggag

SEQ ID NO: 8007754 - DNA, 22 bp, Homo sapiens
cctggcaggtagcattgaggag

SEQ ID NO: 8007755 - DNA, 22 bp, Homo sapiens
cctggcaggtggaggttgcagt

SEQ ID NO: 8007756 - DNA, 22 bp, Homo sapiens
cctggcaggtggaggttgcagt

SEQ ID NO: 8007757 - DNA, 22 bp, Homo sapiens
cctggcaggtggcgccctcggc

SEQ ID NO: 8007758 - DNA, 22 bp, Homo sapiens
cctggcaggtggcgccctcggc

SEQ ID NO: 8007759 - DNA, 22 bp, Homo sapiens
cctggcaggtggcgccctcggc

SEQ ID NO: 8007760 - DNA, 22 bp, Homo sapiens
tgtccataaattcacaagtgta

SEQ ID NO: 8007761 - DNA, 22 bp, Homo sapiens
tgtccataaattcacaagtgta

SEQ ID NO: 8007762 - DNA, 22 bp, Homo sapiens
tgtccagtgattctcatgagcc

SEQ ID NO: 8007763 - DNA, 22 bp, Homo sapiens
tgtccagtgattctcatgagcc

SEQ ID NO: 8007764 - DNA, 22 bp, Homo sapiens
cctggccatagggcccaggaaa

SEQ ID NO: 8007765 - DNA, 22 bp, Homo sapiens
cctggccatagggcccaggaaa

SEQ ID NO: 8007766 - DNA, 22 bp, Homo sapiens
cctggccatttgaacttcagac

SEQ ID NO: 8007767 - DNA, 22 bp, Homo sapiens
cctggccatttgaacttcagac

SEQ ID NO: 8007768 - DNA, 22 bp, Homo sapiens
cctggccatttgaacttcagac

SEQ ID NO: 8007769 - DNA, 22 bp, Homo sapiens
cctggcccacatggcttctccc

SEQ ID NO: 8007770 - DNA, 22 bp, Homo sapiens
tgtccaggttagcttcaaacac

SEQ ID NO: 8007771 - DNA, 22 bp, Homo sapiens
cctggcccacatggcttctccc

SEQ ID NO: 8007772 - DNA, 22 bp, Homo sapiens
cctggcccacatggcttctccc

SEQ ID NO: 8007773 - DNA, 22 bp, Homo sapiens
tgtccatggagaagctcagggc

SEQ ID NO: 8007774 - DNA, 22 bp, Homo sapiens
tgtccatggagaagctcagggc

SEQ ID NO: 8007775 - DNA, 22 bp, Homo sapiens
tgtccatggagaagctcagggc

SEQ ID NO: 8007776 - DNA, 22 bp, Homo sapiens
tgtccatgcgtatccagggagc

SEQ ID NO: 8007777 - DNA, 22 bp, Homo sapiens
tgtccatctccatcgagtcctc

SEQ ID NO: 8007778 - DNA, 22 bp, Homo sapiens
tgtccatggatagagctgctcg

SEQ ID NO: 8007779 - DNA, 22 bp, Homo sapiens
tgtccatggggaaggggaagtg

SEQ ID NO: 8007780 - DNA, 18 bp, Homo sapiens
tgtccatgttgttcctga

SEQ ID NO: 8007781 - DNA, 22 bp, Homo sapiens
tgtcccaaccctgagaagattc

SEQ ID NO: 8007782 - DNA, 22 bp, Homo sapiens
tgtcccagacataagtggacat

SEQ ID NO: 8007783 - DNA, 22 bp, Homo sapiens
tgtcccagacataagtggacat

SEQ ID NO: 8007784 - DNA, 19 bp, Homo sapiens
tgtcccagactccgtgtct

SEQ ID NO: 8007785 - DNA, 22 bp, Homo sapiens
tgtcccactgacttcacatcca

SEQ ID NO: 8007786 - DNA, 22 bp, Homo sapiens
tgtcccagacataagtggacat

SEQ ID NO: 8007787 - DNA, 22 bp, Homo sapiens
tgtcccagacataagtggacat

SEQ ID NO: 8007788 - DNA, 23 bp, Homo sapiens
tgtcccagagggagggataggct

SEQ ID NO: 8007789 - DNA, 22 bp, Homo sapiens
tgtcctcgtccgcctcgaactc

SEQ ID NO: 8007790 - DNA, 22 bp, Homo sapiens
tgtcctccagcagcatggtatg

SEQ ID NO: 8007791 - DNA, 22 bp, Homo sapiens
tgtcctccagcagcatggtatg

SEQ ID NO: 8007792 - DNA, 22 bp, Homo sapiens
tgtcctcatcctccagtctgtc

SEQ ID NO: 8007793 - DNA, 22 bp, Homo sapiens
tgtcctcatcctccagtctgtc

SEQ ID NO: 8007794 - DNA, 22 bp, Homo sapiens
tgtcctcatcctccagtctgtc

SEQ ID NO: 8007795 - DNA, 22 bp, Homo sapiens
tgtcccagcactttgggagtct

SEQ ID NO: 8007796 - DNA, 22 bp, Homo sapiens
tgtcccagcactttgggagtct

SEQ ID NO: 8007797 - DNA, 22 bp, Homo sapiens
cctggcagttcatcaaatggca

SEQ ID NO: 8007798 - DNA, 22 bp, Homo sapiens
cctggcagttcatcaaatggca

SEQ ID NO: 8007799 - DNA, 22 bp, Homo sapiens
cctggcagttcatcaaatggca

SEQ ID NO: 8007800 - DNA, 22 bp, Homo sapiens
cctggcagtggtgaagaagagg

SEQ ID NO: 8007801 - DNA, 22 bp, Homo sapiens
cctggcagtggtgaagaagagg

SEQ ID NO: 8007802 - DNA, 22 bp, Homo sapiens
cctggcagtggtgaagaagagg

SEQ ID NO: 8007803 - DNA, 22 bp, Homo sapiens
cctggcagttttgcccaggatt

SEQ ID NO: 8007804 - DNA, 22 bp, Homo sapiens
cctggcagttttgcccaggatt

SEQ ID NO: 8007805 - DNA, 22 bp, Homo sapiens
cctggcagttttgcccaggatt

SEQ ID NO: 8007806 - DNA, 22 bp, Homo sapiens
cctggccagcgccggctgctcg

SEQ ID NO: 8007807 - DNA, 22 bp, Homo sapiens
cctggccagcgccggctgctcg

SEQ ID NO: 8007808 - DNA, 22 bp, Homo sapiens
cctggccagcgccggctgctcg

SEQ ID NO: 8007809 - DNA, 22 bp, Homo sapiens
cctggccagcgccggctgctcg

SEQ ID NO: 8007810 - DNA, 22 bp, Homo sapiens
cctggccagcgccggctgctcg

SEQ ID NO: 8007811 - DNA, 22 bp, Homo sapiens
cctggccagccagggctggggt

SEQ ID NO: 8007812 - DNA, 22 bp, Homo sapiens
cctggcatggggtctccagcca

SEQ ID NO: 8007813 - DNA, 22 bp, Homo sapiens
cctggcatggggtctccagcca

SEQ ID NO: 8007814 - DNA, 22 bp, Homo sapiens
cctggcattctctccagagaga

SEQ ID NO: 8007815 - DNA, 22 bp, Homo sapiens
cctggcatgaggagcatgaggt

SEQ ID NO: 8007816 - DNA, 22 bp, Homo sapiens
cctggcatctgagcctggcctg

SEQ ID NO: 8007817 - DNA, 22 bp, Homo sapiens
cctggccagctaattgcccatc

SEQ ID NO: 8007818 - DNA, 22 bp, Homo sapiens
cctggccagctaattgcccatc

SEQ ID NO: 8007819 - DNA, 22 bp, Homo sapiens
cctggccagcgccggctgctcg

SEQ ID NO: 8007820 - DNA, 22 bp, Homo sapiens
cctggccagctaattgcccatc

SEQ ID NO: 8007821 - DNA, 22 bp, Homo sapiens
cctggccagctaattgcccatc

SEQ ID NO: 8007822 - DNA, 22 bp, Homo sapiens
cctggccaggcatggagtcaca

SEQ ID NO: 8007823 - DNA, 22 bp, Homo sapiens
cctggccaggcatggagtcaca

SEQ ID NO: 8007824 - DNA, 22 bp, Homo sapiens
cctggccaggcatggagtcaca

SEQ ID NO: 8007825 - DNA, 22 bp, Homo sapiens
cctggccaggcatggagtcaca

SEQ ID NO: 8007826 - DNA, 22 bp, Homo sapiens
cctggccaggctccaagtactg

SEQ ID NO: 8007827 - DNA, 22 bp, Homo sapiens
cctggccaggctccaagtactg

SEQ ID NO: 8007828 - DNA, 22 bp, Homo sapiens
cctggccaggctccaagtactg

SEQ ID NO: 8007829 - DNA, 22 bp, Homo sapiens
cctggccaggctccaagtactg

SEQ ID NO: 8007830 - DNA, 22 bp, Homo sapiens
cctggccaggctctcagcactg

SEQ ID NO: 8007831 - DNA, 22 bp, Homo sapiens
cctggccagggtctgggctgct

SEQ ID NO: 8007832 - DNA, 22 bp, Homo sapiens
cctggccaggctctcagcactg

SEQ ID NO: 8007833 - DNA, 22 bp, Homo sapiens
cctggccaggctctcagcactg

SEQ ID NO: 8007834 - DNA, 22 bp, Homo sapiens
cctggccagggtctgggctgct

SEQ ID NO: 8007835 - DNA, 22 bp, Homo sapiens
cctggccagtttccaggccctg

SEQ ID NO: 8007836 - DNA, 22 bp, Homo sapiens
cctggccagtttccaggccctg

SEQ ID NO: 8007837 - DNA, 22 bp, Homo sapiens
cctggccagtttccaggccctg

SEQ ID NO: 8007838 - DNA, 22 bp, Homo sapiens
cctggccagtttccaggccctg

SEQ ID NO: 8007839 - DNA, 22 bp, Homo sapiens
cctggccagggtctgggctgct

SEQ ID NO: 8007840 - DNA, 22 bp, Homo sapiens
cctggccagggtctgggctgct

SEQ ID NO: 8007841 - DNA, 22 bp, Homo sapiens
cctggccagggtctgggctgct

SEQ ID NO: 8007842 - DNA, 22 bp, Homo sapiens
cctggccagggtctgggctgct

SEQ ID NO: 8007843 - DNA, 22 bp, Homo sapiens
cctggccatagggcccaggaaa

SEQ ID NO: 8007844 - DNA, 22 bp, Homo sapiens
cctggccatagggcccaggaaa

SEQ ID NO: 8007845 - DNA, 22 bp, Homo sapiens
cctggccatagggcccaggaaa

SEQ ID NO: 8007846 - DNA, 22 bp, Homo sapiens
cctggccatagggcccaggaaa

SEQ ID NO: 8007847 - DNA, 22 bp, Homo sapiens
cctggccagtttccaggccctg

SEQ ID NO: 8007848 - DNA, 22 bp, Homo sapiens
cctggccagtttccaggccctg

SEQ ID NO: 8007849 - DNA, 22 bp, Homo sapiens
cctggctcgctgacctcagggg

SEQ ID NO: 8007850 - DNA, 22 bp, Homo sapiens
cctggctcgctgacctcagggg

SEQ ID NO: 8007851 - DNA, 22 bp, Homo sapiens
cctggctcgctgacctcagggg

SEQ ID NO: 8007852 - DNA, 22 bp, Homo sapiens
cctggctcgctgacctcagggg

SEQ ID NO: 8007853 - DNA, 22 bp, Homo sapiens
cctggctctagaggccactcct

SEQ ID NO: 8007854 - DNA, 22 bp, Homo sapiens
cctggctctagaggccactcct

SEQ ID NO: 8007855 - DNA, 22 bp, Homo sapiens
cctggctctagaggccactcct

SEQ ID NO: 8007856 - DNA, 22 bp, Homo sapiens
cctggctctagaggccactcct

SEQ ID NO: 8007857 - DNA, 22 bp, Homo sapiens
cctggctcctgcctctgcaggg

SEQ ID NO: 8007858 - DNA, 22 bp, Homo sapiens
cctggctcctgcctctgcaggg

SEQ ID NO: 8007859 - DNA, 22 bp, Homo sapiens
cctggctcctgcctctgcaggg

SEQ ID NO: 8007860 - DNA, 22 bp, Homo sapiens
cctggctcctgcctctgcaggg

SEQ ID NO: 8007861 - DNA, 22 bp, Homo sapiens
cctggctcgctgacctcagggg

SEQ ID NO: 8007862 - DNA, 22 bp, Homo sapiens
cctggctcgctgacctcagggg

SEQ ID NO: 8007863 - DNA, 22 bp, Homo sapiens
cctggctcgctgacctcagggg

SEQ ID NO: 8007864 - DNA, 22 bp, Homo sapiens
cctggctcgctgacctcagggg

SEQ ID NO: 8007865 - DNA, 22 bp, Homo sapiens
cctggctctctgcagatcctgg

SEQ ID NO: 8007866 - DNA, 22 bp, Homo sapiens
cctggctctctgcagatcctgg

SEQ ID NO: 8007867 - DNA, 22 bp, Homo sapiens
cctggctctctgcagatcctgg

SEQ ID NO: 8007868 - DNA, 22 bp, Homo sapiens
cctggctctctgcagatcctgg

SEQ ID NO: 8007869 - DNA, 22 bp, Homo sapiens
cctggctctgaagtccacatca

SEQ ID NO: 8007870 - DNA, 22 bp, Homo sapiens
cctggctctgaagtccacatca

SEQ ID NO: 8007871 - DNA, 22 bp, Homo sapiens
cctggctctgaagtccacatca

SEQ ID NO: 8007872 - DNA, 22 bp, Homo sapiens
cctggctctgaagtccacatca

SEQ ID NO: 8007873 - DNA, 22 bp, Homo sapiens
cctggctctgaagtccacatca

SEQ ID NO: 8007874 - DNA, 22 bp, Homo sapiens
cctggctctagaggccactcct

SEQ ID NO: 8007875 - DNA, 22 bp, Homo sapiens
cctggctctagaggccactcct

SEQ ID NO: 8007876 - DNA, 22 bp, Homo sapiens
cctggctctagaggccactcct

SEQ ID NO: 8007877 - DNA, 22 bp, Homo sapiens
cctggctctctgcagatcctgg

SEQ ID NO: 8007878 - DNA, 22 bp, Homo sapiens
cctggctctctgcagatcctgg

SEQ ID NO: 8007879 - DNA, 22 bp, Homo sapiens
cctggctcctgcctctgcaggg

SEQ ID NO: 8007880 - DNA, 22 bp, Homo sapiens
cctggctcctgcctctgcaggg

SEQ ID NO: 8007881 - DNA, 22 bp, Homo sapiens
cctggctcctgcctctgcaggg

SEQ ID NO: 8007882 - DNA, 22 bp, Homo sapiens
cctggctcctgcctctgcaggg

SEQ ID NO: 8007883 - DNA, 22 bp, Homo sapiens
cctggctcctgcctctgcaggg

SEQ ID NO: 8007884 - DNA, 22 bp, Homo sapiens
cctggctcctgcctctgcaggg

SEQ ID NO: 8007885 - DNA, 22 bp, Homo sapiens
cctggctcctgcctctgcaggg

SEQ ID NO: 8007886 - DNA, 22 bp, Homo sapiens
cctggctcctgcctctgcaggg

SEQ ID NO: 8007887 - DNA, 22 bp, Homo sapiens
cctggctcctgcctctgcaggg

SEQ ID NO: 8007888 - DNA, 22 bp, Homo sapiens
cctggctccgtgtcacgtgccc

SEQ ID NO: 8007889 - DNA, 22 bp, Homo sapiens
cctggctccgtgtcacgtgccc

SEQ ID NO: 8007890 - DNA, 22 bp, Homo sapiens
cctggctccgtgtcacgtgccc

SEQ ID NO: 8007891 - DNA, 22 bp, Homo sapiens
cctggctcctacgggtattttg

SEQ ID NO: 8007892 - DNA, 22 bp, Homo sapiens
cctggctccgtgtcacgtgccc

SEQ ID NO: 8007893 - DNA, 22 bp, Homo sapiens
cctggctcctgcacagatcttt

SEQ ID NO: 8007894 - DNA, 22 bp, Homo sapiens
cctggctcctgcacagatcttt

SEQ ID NO: 8007895 - DNA, 22 bp, Homo sapiens
cctggctcctgcacagatcttt

SEQ ID NO: 8007896 - DNA, 22 bp, Homo sapiens
cctggctcctgcacagatcttt

SEQ ID NO: 8007897 - DNA, 22 bp, Homo sapiens
cctggctcctgcacagatcttt

SEQ ID NO: 8007898 - DNA, 22 bp, Homo sapiens
cctggctccctgcacagggctc

SEQ ID NO: 8007899 - DNA, 22 bp, Homo sapiens
cctggctccctgcacagggctc

SEQ ID NO: 8007900 - DNA, 22 bp, Homo sapiens
cctggctccctgcacagggctc

SEQ ID NO: 8007901 - DNA, 22 bp, Homo sapiens
cctggctcccggaacagggtct

SEQ ID NO: 8007902 - DNA, 22 bp, Homo sapiens
cctggctcccggaacagggtct

SEQ ID NO: 8007903 - DNA, 22 bp, Homo sapiens
cctggctccctgcacagggctc

SEQ ID NO: 8007904 - DNA, 22 bp, Homo sapiens
cctggctccctgcacagggctc

SEQ ID NO: 8007905 - DNA, 22 bp, Homo sapiens
cctggctccgtgtcacgtgccc

SEQ ID NO: 8007906 - DNA, 22 bp, Homo sapiens
cctggctccgtgtcacgtgccc

SEQ ID NO: 8007907 - DNA, 22 bp, Homo sapiens
cctggctccgtgtcacgtgccc

SEQ ID NO: 8007908 - DNA, 22 bp, Homo sapiens
cctggctccggttcaagggaaa

SEQ ID NO: 8007909 - DNA, 22 bp, Homo sapiens
cctggctccggttcaagggaaa

SEQ ID NO: 8007910 - DNA, 22 bp, Homo sapiens
cctggctccggttcaagggaaa

SEQ ID NO: 8007911 - DNA, 22 bp, Homo sapiens
cctggctccctggacctcatta

SEQ ID NO: 8007912 - DNA, 22 bp, Homo sapiens
cctggctccctggacctcatta

SEQ ID NO: 8007913 - DNA, 22 bp, Homo sapiens
cctggctccctgcacagggctc

SEQ ID NO: 8007914 - DNA, 22 bp, Homo sapiens
cctggctccggttcaagggaaa

SEQ ID NO: 8007915 - DNA, 22 bp, Homo sapiens
cctggccctggaatagggcagg

SEQ ID NO: 8007916 - DNA, 22 bp, Homo sapiens
cctggccctggaatagggcagg

SEQ ID NO: 8007917 - DNA, 22 bp, Homo sapiens
cctggccctggaatagggcagg

SEQ ID NO: 8007918 - DNA, 19 bp, Homo sapiens
cctggccctgctgcgcggg

SEQ ID NO: 8007919 - DNA, 19 bp, Homo sapiens
cctggccctgctgcgcggg

SEQ ID NO: 8007920 - DNA, 19 bp, Homo sapiens
cctggccctgctgcgcggg

SEQ ID NO: 8007921 - DNA, 22 bp, Homo sapiens
cctggcccagggactttcgcct

SEQ ID NO: 8007922 - DNA, 22 bp, Homo sapiens
cctggcccagggactttcgcct

SEQ ID NO: 8007923 - DNA, 22 bp, Homo sapiens
cctggcccacatggcttctccc

SEQ ID NO: 8007924 - DNA, 22 bp, Homo sapiens
cctggcccagggactttcgcct

SEQ ID NO: 8007925 - DNA, 22 bp, Homo sapiens
cctggcccagggactttcgcct

SEQ ID NO: 8007926 - DNA, 16 bp, Homo sapiens
cctggcccggcttcct

SEQ ID NO: 8007927 - DNA, 19 bp, Homo sapiens
cctggccctgctgcgcggg

SEQ ID NO: 8007928 - DNA, 19 bp, Homo sapiens
cctggccctgctgcgcggg

SEQ ID NO: 8007929 - DNA, 22 bp, Homo sapiens
cctggcctcctggccttctcat

SEQ ID NO: 8007930 - DNA, 22 bp, Homo sapiens
cctggcctcgtgctcacggctc

SEQ ID NO: 8007931 - DNA, 22 bp, Homo sapiens
cctggcctcagacagagggtgg

SEQ ID NO: 8007932 - DNA, 22 bp, Homo sapiens
cctggcctcagacagagggtgg

SEQ ID NO: 8007933 - DNA, 22 bp, Homo sapiens
cctggcctcagcctagggctga

SEQ ID NO: 8007934 - DNA, 22 bp, Homo sapiens
cctggcctcagacagagggtgg

SEQ ID NO: 8007935 - DNA, 22 bp, Homo sapiens
cctggccgcggagcccttccag

SEQ ID NO: 8007936 - DNA, 22 bp, Homo sapiens
cctggccggtatcccacctcct

SEQ ID NO: 8007937 - DNA, 22 bp, Homo sapiens
cctggccgacatggtgaaacgc

SEQ ID NO: 8007938 - DNA, 22 bp, Homo sapiens
cctggctcccggaacagggtct

SEQ ID NO: 8007939 - DNA, 22 bp, Homo sapiens
cctggctcccggaacagggtct

SEQ ID NO: 8007940 - DNA, 22 bp, Homo sapiens
cctggctcccccatcatagctg

SEQ ID NO: 8007941 - DNA, 22 bp, Homo sapiens
cctggctcccggaacagggtct

SEQ ID NO: 8007942 - DNA, 22 bp, Homo sapiens
cctggctcccccatcatagctg

SEQ ID NO: 8007943 - DNA, 22 bp, Homo sapiens
cctggctcccccatcatagctg

SEQ ID NO: 8007944 - DNA, 22 bp, Homo sapiens
cctggctccagctgcctgtcct

SEQ ID NO: 8007945 - DNA, 22 bp, Homo sapiens
cctggctccagctgcctgtcct

SEQ ID NO: 8007946 - DNA, 22 bp, Homo sapiens
cctggctccaaagctgtgactc

SEQ ID NO: 8007947 - DNA, 21 bp, Homo sapiens
cctggctccagaacttccggt

SEQ ID NO: 8007948 - DNA, 21 bp, Homo sapiens
cctggctccagaacttccggt

SEQ ID NO: 8007949 - DNA, 21 bp, Homo sapiens
cctggctccagaacttccggt

SEQ ID NO: 8007950 - DNA, 22 bp, Homo sapiens
cctggctccagctgcctgtcct

SEQ ID NO: 8007951 - DNA, 22 bp, Homo sapiens
cctggctccagctgcctgtcct

SEQ ID NO: 8007952 - DNA, 22 bp, Homo sapiens
cctggctccagctgcctgtcct

SEQ ID NO: 8007953 - DNA, 22 bp, Homo sapiens
cctggctccagctgcctgtcct

SEQ ID NO: 8007954 - DNA, 22 bp, Homo sapiens
cctggctccagctgcctgtcct

SEQ ID NO: 8007955 - DNA, 22 bp, Homo sapiens
cctggctccagctgcctgtcct

SEQ ID NO: 8007956 - DNA, 22 bp, Homo sapiens
cctggcctctccgagtaacctg

SEQ ID NO: 8007957 - DNA, 22 bp, Homo sapiens
cctggcctgctcggctcttaag

SEQ ID NO: 8007958 - DNA, 22 bp, Homo sapiens
cctggcctgctcggctcttaag

SEQ ID NO: 8007959 - DNA, 22 bp, Homo sapiens
cctggcctggcactccctctgc

SEQ ID NO: 8007960 - DNA, 22 bp, Homo sapiens
cctggcctggcactccctctgc

SEQ ID NO: 8007961 - DNA, 22 bp, Homo sapiens
cctggcctgtgaatctgagagc

SEQ ID NO: 8007962 - DNA, 22 bp, Homo sapiens
cctggctccaaagctgtgactc

SEQ ID NO: 8007963 - DNA, 22 bp, Homo sapiens
cctggctccaaagctgtgactc

SEQ ID NO: 8007964 - DNA, 22 bp, Homo sapiens
cctggccttaagggcagggagc

SEQ ID NO: 8007965 - DNA, 22 bp, Homo sapiens
cctggcctgtgaatctgagagc

SEQ ID NO: 8007966 - DNA, 22 bp, Homo sapiens
cctggccttaagggcagggagc

SEQ ID NO: 8007967 - DNA, 22 bp, Homo sapiens
cctggcctgtgaatctgagagc

SEQ ID NO: 8007968 - DNA, 22 bp, Homo sapiens
cctggcctgtgaatctgagagc

SEQ ID NO: 8007969 - DNA, 22 bp, Homo sapiens
cctggcctgtgaatctgagagc

SEQ ID NO: 8007970 - DNA, 22 bp, Homo sapiens
cctggcctgtgaatctgagagc

SEQ ID NO: 8007971 - DNA, 22 bp, Homo sapiens
cctggcctgtgaatctgagagc

SEQ ID NO: 8007972 - DNA, 22 bp, Homo sapiens
tgtcctggaaaaatggagagtt

SEQ ID NO: 8007973 - DNA, 22 bp, Homo sapiens
tgtcctggaaaaatggagagtt

SEQ ID NO: 8007974 - DNA, 22 bp, Homo sapiens
tgtcctgccatttccatagcct

SEQ ID NO: 8007975 - DNA, 22 bp, Homo sapiens
tgtcctgcaagccctaatgaat

SEQ ID NO: 8007976 - DNA, 22 bp, Homo sapiens
tgtcctcttccagtgctccttc

SEQ ID NO: 8007977 - DNA, 22 bp, Homo sapiens
tgtcctcttccagtgctccttc

SEQ ID NO: 8007978 - DNA, 22 bp, Homo sapiens
tgtcctgcaattaaggaagaca

SEQ ID NO: 8007979 - DNA, 22 bp, Homo sapiens
tgtcctcttccagtgctccttc

SEQ ID NO: 8007980 - DNA, 22 bp, Homo sapiens
tgtcctcttccagtgctccttc

SEQ ID NO: 8007981 - DNA, 22 bp, Homo sapiens
tgtcctggagacacaaggtggt

SEQ ID NO: 8007982 - DNA, 22 bp, Homo sapiens
tgtcctggacaacagcccctag

SEQ ID NO: 8007983 - DNA, 22 bp, Homo sapiens
tgtcctggacaacagcccctag

SEQ ID NO: 8007984 - DNA, 22 bp, Homo sapiens
tgtcctggaaaaatggagagtt

SEQ ID NO: 8007985 - DNA, 22 bp, Homo sapiens
tgtcctggaaaaatggagagtt

SEQ ID NO: 8007986 - DNA, 22 bp, Homo sapiens
tgtcctggaaaaatggagagtt

SEQ ID NO: 8007987 - DNA, 22 bp, Homo sapiens
tgtcctggagttataatgcctg

SEQ ID NO: 8007988 - DNA, 22 bp, Homo sapiens
tgtcctggatcatgcctctgaa

SEQ ID NO: 8007989 - DNA, 22 bp, Homo sapiens
tgtcctggatcatgcctctgaa

SEQ ID NO: 8007990 - DNA, 22 bp, Homo sapiens
tgtcctggatcatgcctctgaa

SEQ ID NO: 8007991 - DNA, 22 bp, Homo sapiens
tgtcctggagacacaaggtggt

SEQ ID NO: 8007992 - DNA, 22 bp, Homo sapiens
tgtcctggagacacaaggtggt

SEQ ID NO: 8007993 - DNA, 22 bp, Homo sapiens
tgtcctggagtgcttgggggaa

SEQ ID NO: 8007994 - DNA, 22 bp, Homo sapiens
tgtcctggccaaggccttgctt

SEQ ID NO: 8007995 - DNA, 22 bp, Homo sapiens
tgtctattaattccacataaaa

SEQ ID NO: 8007996 - DNA, 22 bp, Homo sapiens
tgtctattaacacaagaaagga

SEQ ID NO: 8007997 - DNA, 22 bp, Homo sapiens
tgtctattcaatatccatttct

SEQ ID NO: 8007998 - DNA, 22 bp, Homo sapiens
tgtctatttgaattatcctaat

SEQ ID NO: 8007999 - DNA, 22 bp, Homo sapiens
tgtctattcccccacctccgtt

SEQ ID NO: 8008000 - DNA, 22 bp, Homo sapiens
tgtctattttacagcatacatt

SEQ ID NO: 8008001 - DNA, 22 bp, Homo sapiens
tgtctattcccccacctccgtt

SEQ ID NO: 8008002 - DNA, 22 bp, Homo sapiens
tgtctattcccccacctccgtt

SEQ ID NO: 8008003 - DNA, 22 bp, Homo sapiens
tgtctcaaggttactctatgat

SEQ ID NO: 8008004 - DNA, 22 bp, Homo sapiens
tgtctcagaggcaggaagagcc

SEQ ID NO: 8008005 - DNA, 22 bp, Homo sapiens
tgtctcagaatggctcataata

SEQ ID NO: 8008006 - DNA, 22 bp, Homo sapiens
tgtctcagaatggctcataata

SEQ ID NO: 8008007 - DNA, 23 bp, Homo sapiens
tgtctcagactgaggggtttccc

SEQ ID NO: 8008008 - DNA, 22 bp, Homo sapiens
tgtctcagaggcaggaagagcc

SEQ ID NO: 8008009 - DNA, 22 bp, Homo sapiens
tgtctcagagtgttgtattaga

SEQ ID NO: 8008010 - DNA, 22 bp, Homo sapiens
tgtctcagagtgttgtattaga

SEQ ID NO: 8008011 - DNA, 22 bp, Homo sapiens
tgtctcagctgtgcttcattgg

SEQ ID NO: 8008012 - DNA, 22 bp, Homo sapiens
tgtctcagatacgccatcaagg

SEQ ID NO: 8008013 - DNA, 18 bp, Homo sapiens
tgtctcaggctgaaacag

SEQ ID NO: 8008014 - DNA, 22 bp, Homo sapiens
tgtctctgggtgattcagtcct

SEQ ID NO: 8008015 - DNA, 22 bp, Homo sapiens
tgtctctggcccatgagcagag

SEQ ID NO: 8008016 - DNA, 22 bp, Homo sapiens
tgtctctggcccatgagcagag

SEQ ID NO: 8008017 - DNA, 22 bp, Homo sapiens
tgtctctggctgcagcctgttc

SEQ ID NO: 8008018 - DNA, 22 bp, Homo sapiens
tgtctctgtgagatctgacgat

SEQ ID NO: 8008019 - DNA, 22 bp, Homo sapiens
tgtctctgtgagatctgacgat

SEQ ID NO: 8008020 - DNA, 22 bp, Homo sapiens
tgtctctgtcttccagggctgt

SEQ ID NO: 8008021 - DNA, 22 bp, Homo sapiens
tgtctctgtcttccagggctgt

SEQ ID NO: 8008022 - DNA, 22 bp, Homo sapiens
tgtctctgggtgattcagtcct

SEQ ID NO: 8008023 - DNA, 22 bp, Homo sapiens
tgtctctgtctcccaggttgtg

SEQ ID NO: 8008024 - DNA, 22 bp, Homo sapiens
tgtctcagtacactccgatgtt

SEQ ID NO: 8008025 - DNA, 22 bp, Homo sapiens
tgtctcagtatacgaaacactt

SEQ ID NO: 8008026 - DNA, 22 bp, Homo sapiens
tgtctcagttcccttctctgga

SEQ ID NO: 8008027 - DNA, 19 bp, Homo sapiens
tgtctcagtgtcccttcct

SEQ ID NO: 8008028 - DNA, 22 bp, Homo sapiens
tgtctcagttcccttctctgga

SEQ ID NO: 8008029 - DNA, 18 bp, Homo sapiens
tgtctcagttctgctatg

SEQ ID NO: 8008030 - DNA, 18 bp, Homo sapiens
tgtctcagttctgctatg

SEQ ID NO: 8008031 - DNA, 22 bp, Homo sapiens
tgtctcatctcttaaccccact

SEQ ID NO: 8008032 - DNA, 22 bp, Homo sapiens
tgtctcatctcttaaccccact

SEQ ID NO: 8008033 - DNA, 22 bp, Homo sapiens
tgtctcatctcttaaccccact

SEQ ID NO: 8008034 - DNA, 22 bp, Homo sapiens
cctggcccacatggcttctccc

SEQ ID NO: 8008035 - DNA, 22 bp, Homo sapiens
tgtctcttggctctatcactta

SEQ ID NO: 8008036 - DNA, 22 bp, Homo sapiens
tgtctcttggctctatcactta

SEQ ID NO: 8008037 - DNA, 22 bp, Homo sapiens
tgtctcttctgcctccagctgt

SEQ ID NO: 8008038 - DNA, 22 bp, Homo sapiens
tgtctcttgagctgcctgatgc

SEQ ID NO: 8008039 - DNA, 22 bp, Homo sapiens
tgtctctgtgcatttgtgcttc

SEQ ID NO: 8008040 - DNA, 22 bp, Homo sapiens
tgtctctgtgcatttgtgcttc

SEQ ID NO: 8008041 - DNA, 22 bp, Homo sapiens
tgtctcttactttgattcttgg

SEQ ID NO: 8008042 - DNA, 22 bp, Homo sapiens
tgtctctgtgcatttgtgcttc

SEQ ID NO: 8008043 - DNA, 22 bp, Homo sapiens
tgtctctgtgcatttgtgcttc

SEQ ID NO: 8008044 - DNA, 22 bp, Homo sapiens
tgtctctgtgagatctgacgat

SEQ ID NO: 8008045 - DNA, 22 bp, Homo sapiens
tgtctctgtgcatttgtgcttc

SEQ ID NO: 8008046 - DNA, 22 bp, Homo sapiens
tgtctcttactttgattcttgg

SEQ ID NO: 8008047 - DNA, 22 bp, Homo sapiens
tgtctcttcccactcagacccc

SEQ ID NO: 8008048 - DNA, 22 bp, Homo sapiens
tgtctcttctgcctccagctgt

SEQ ID NO: 8008049 - DNA, 22 bp, Homo sapiens
tgtctcttcccactcagacccc

SEQ ID NO: 8008050 - DNA, 22 bp, Homo sapiens
tgtgtctgtcctcggttgatgc

SEQ ID NO: 8008051 - DNA, 22 bp, Homo sapiens
tgtgtctgtcctcggttgatgc

SEQ ID NO: 8008052 - DNA, 23 bp, Homo sapiens
tgtgtctgtttagggaggatgtg

SEQ ID NO: 8008053 - DNA, 22 bp, Homo sapiens
tgtgtctgtgtatacacggcat

SEQ ID NO: 8008054 - DNA, 23 bp, Homo sapiens
tgtgtctgtttagggaggatgtg

SEQ ID NO: 8008055 - DNA, 23 bp, Homo sapiens
tgtgtctgtttagggaggatgtg

SEQ ID NO: 8008056 - DNA, 22 bp, Homo sapiens
tgtgtctgtgtatacacggcat

SEQ ID NO: 8008057 - DNA, 22 bp, Homo sapiens
tgtgtgggtggtaaggaaggcc

SEQ ID NO: 8008058 - DNA, 22 bp, Homo sapiens
tgtggggtgtggtccaggcatc

SEQ ID NO: 8008059 - DNA, 22 bp, Homo sapiens
tgtggggtgtggtccaggcatc

SEQ ID NO: 8008060 - DNA, 22 bp, Homo sapiens
tgtgtctgtcctcggttgatgc

SEQ ID NO: 8008061 - DNA, 22 bp, Homo sapiens
tgtgggggtacacgtacacatg

SEQ ID NO: 8008062 - DNA, 22 bp, Homo sapiens
tgtgggggtacacgtacacatg

SEQ ID NO: 8008063 - DNA, 22 bp, Homo sapiens
tgtgggggtacacgtacacatg

SEQ ID NO: 8008064 - DNA, 22 bp, Homo sapiens
tgtggggctgtggtgttcttct

SEQ ID NO: 8008065 - DNA, 22 bp, Homo sapiens
tgtggggctgtggtgttcttct

SEQ ID NO: 8008066 - DNA, 22 bp, Homo sapiens
tgtggggctccctggcagcctg

SEQ ID NO: 8008067 - DNA, 22 bp, Homo sapiens
tgtggggctgtggtgttcttct

SEQ ID NO: 8008068 - DNA, 22 bp, Homo sapiens
tgtggggcttacaaaggcagat

SEQ ID NO: 8008069 - DNA, 22 bp, Homo sapiens
tgtggggcttacaaaggcagat

SEQ ID NO: 8008070 - DNA, 22 bp, Homo sapiens
tgtggggcagctagccggcctg

SEQ ID NO: 8008071 - DNA, 22 bp, Homo sapiens
tgtggggccaaagcccagccac

SEQ ID NO: 8008072 - DNA, 22 bp, Homo sapiens
tgtggggcctcgtgctagctgg

SEQ ID NO: 8008073 - DNA, 22 bp, Homo sapiens
tgtggggctccctggcagcctg

SEQ ID NO: 8008074 - DNA, 22 bp, Homo sapiens
tgtggggctccctggcagcctg

SEQ ID NO: 8008075 - DNA, 22 bp, Homo sapiens
tgtggggctgtcaggcaactgg

SEQ ID NO: 8008076 - DNA, 22 bp, Homo sapiens
tgtggggctccctggcagcctg

SEQ ID NO: 8008077 - DNA, 22 bp, Homo sapiens
cctgggcctcacccagctcttg

SEQ ID NO: 8008078 - DNA, 22 bp, Homo sapiens
cctgggcctcacccagctcttg

SEQ ID NO: 8008079 - DNA, 22 bp, Homo sapiens
cctgggcctcacccagctcttg

SEQ ID NO: 8008080 - DNA, 22 bp, Homo sapiens
cctgggcctcacccagctcttg

SEQ ID NO: 8008081 - DNA, 22 bp, Homo sapiens
cctgggcctcacccagctcttg

SEQ ID NO: 8008082 - DNA, 22 bp, Homo sapiens
cctgggcctcacccagctcttg

SEQ ID NO: 8008083 - DNA, 22 bp, Homo sapiens
cctgggcctcacccagctcttg

SEQ ID NO: 8008084 - DNA, 22 bp, Homo sapiens
cctgggcctatcctagaaccaa

SEQ ID NO: 8008085 - DNA, 22 bp, Homo sapiens
cctgggcctcacccagctcttg

SEQ ID NO: 8008086 - DNA, 22 bp, Homo sapiens
cctgggcctatcctagaaccaa

SEQ ID NO: 8008087 - DNA, 22 bp, Homo sapiens
cctgggcctatcctagaaccaa

SEQ ID NO: 8008088 - DNA, 22 bp, Homo sapiens
cctgggcctatcctagaaccaa

SEQ ID NO: 8008089 - DNA, 22 bp, Homo sapiens
cctgggcctatcctagaaccaa

SEQ ID NO: 8008090 - DNA, 22 bp, Homo sapiens
cctgggcctcacccagctcttg

SEQ ID NO: 8008091 - DNA, 22 bp, Homo sapiens
cctgggcctcacccagctcttg

SEQ ID NO: 8008092 - DNA, 19 bp, Homo sapiens
tgtggggagtcagggggct

SEQ ID NO: 8008093 - DNA, 22 bp, Homo sapiens
cctgggcctcacccagctcttg

SEQ ID NO: 8008094 - DNA, 19 bp, Homo sapiens
cctgggaggcggaggttgc

SEQ ID NO: 8008095 - DNA, 22 bp, Homo sapiens
cctgggaggcggaggttgcagg

SEQ ID NO: 8008096 - DNA, 22 bp, Homo sapiens
cctgggaggcggaggttgcagg

SEQ ID NO: 8008097 - DNA, 22 bp, Homo sapiens
cctgggaggcggaggttgcagt

SEQ ID NO: 8008098 - DNA, 22 bp, Homo sapiens
cctgggcatcaacaagcagaga

SEQ ID NO: 8008099 - DNA, 22 bp, Homo sapiens
cctgggcatcaacaagcagaga

SEQ ID NO: 8008100 - DNA, 22 bp, Homo sapiens
cctgggcatcaacaagcagaga

SEQ ID NO: 8008101 - DNA, 22 bp, Homo sapiens
cctgggcatcaacaagcagaga

SEQ ID NO: 8008102 - DNA, 22 bp, Homo sapiens
cctgggcataaatcactccaag

SEQ ID NO: 8008103 - DNA, 22 bp, Homo sapiens
cctgggcatcaacaagcagaga

SEQ ID NO: 8008104 - DNA, 22 bp, Homo sapiens
cctgggcatcaacaagcagaga

SEQ ID NO: 8008105 - DNA, 22 bp, Homo sapiens
cctgggcagcctgctcaaggac

SEQ ID NO: 8008106 - DNA, 22 bp, Homo sapiens
cctgggcagcctgctcaaggac

SEQ ID NO: 8008107 - DNA, 22 bp, Homo sapiens
cctgggcaatatagtgaggccc

SEQ ID NO: 8008108 - DNA, 22 bp, Homo sapiens
cctgggcaatatagtgaggccc

SEQ ID NO: 8008109 - DNA, 22 bp, Homo sapiens
cctgggcaatatagtgaggccc

SEQ ID NO: 8008110 - DNA, 22 bp, Homo sapiens
cctgggcaatatagtgaggccc

SEQ ID NO: 8008111 - DNA, 22 bp, Homo sapiens
cctgggaggcggaggttgcagt

SEQ ID NO: 8008112 - DNA, 22 bp, Homo sapiens
cctgggccaggcttgggaatgc

SEQ ID NO: 8008113 - DNA, 22 bp, Homo sapiens
cctgggccaggcttgggaatgc

SEQ ID NO: 8008114 - DNA, 22 bp, Homo sapiens
cctgggccaggcttgggaatgc

SEQ ID NO: 8008115 - DNA, 22 bp, Homo sapiens
cctgggccaggcttgggaatgc

SEQ ID NO: 8008116 - DNA, 21 bp, Homo sapiens
cctgggccaaattccctggac

SEQ ID NO: 8008117 - DNA, 21 bp, Homo sapiens
cctgggccaaattccctggac

SEQ ID NO: 8008118 - DNA, 21 bp, Homo sapiens
cctgggccaaattccctggac

SEQ ID NO: 8008119 - DNA, 22 bp, Homo sapiens
cctgggccctcaccgccggtgg

SEQ ID NO: 8008120 - DNA, 22 bp, Homo sapiens
cctgggccctcaccgccggtgg

SEQ ID NO: 8008121 - DNA, 22 bp, Homo sapiens
cctgggccaggcttgggaatgc

SEQ ID NO: 8008122 - DNA, 22 bp, Homo sapiens
cctgggccctcaccgccggtgg

SEQ ID NO: 8008123 - DNA, 22 bp, Homo sapiens
cctgggccctcaccgccggtgg

SEQ ID NO: 8008124 - DNA, 22 bp, Homo sapiens
cctgggccctcaccgccggtgg

SEQ ID NO: 8008125 - DNA, 22 bp, Homo sapiens
cctgggcctatcctagaaccaa

SEQ ID NO: 8008126 - DNA, 21 bp, Homo sapiens
cctgggccaaattccctggac

SEQ ID NO: 8008127 - DNA, 21 bp, Homo sapiens
cctgggccaaattccctggac

SEQ ID NO: 8008128 - DNA, 21 bp, Homo sapiens
cctgggccaaattccctggac

SEQ ID NO: 8008129 - DNA, 23 bp, Homo sapiens
cctgggcattggctgcagcttct

SEQ ID NO: 8008130 - DNA, 23 bp, Homo sapiens
cctgggcattggctgcagcttct

SEQ ID NO: 8008131 - DNA, 22 bp, Homo sapiens
cctgggcatctcatgcacctgc

SEQ ID NO: 8008132 - DNA, 22 bp, Homo sapiens
cctgggcatctcatgcacctgc

SEQ ID NO: 8008133 - DNA, 22 bp, Homo sapiens
cctgggcatctcatgcacctgc

SEQ ID NO: 8008134 - DNA, 22 bp, Homo sapiens
cctgggcatctcatgcacctgc

SEQ ID NO: 8008135 - DNA, 22 bp, Homo sapiens
cctgggcattctttgagttctc

SEQ ID NO: 8008136 - DNA, 22 bp, Homo sapiens
tgtgcttgtcgtggagccaggc

SEQ ID NO: 8008137 - DNA, 22 bp, Homo sapiens
tgtgcttgaaattcagttttga

SEQ ID NO: 8008138 - DNA, 22 bp, Homo sapiens
tgtgcttggggttgactagtgt

SEQ ID NO: 8008139 - DNA, 22 bp, Homo sapiens
tgtgcttggggttgactagtgt

SEQ ID NO: 8008140 - DNA, 22 bp, Homo sapiens
tgtgctttggttttacaggatg

SEQ ID NO: 8008141 - DNA, 22 bp, Homo sapiens
tgtgctttggttttacaggatg

SEQ ID NO: 8008142 - DNA, 22 bp, Homo sapiens
tgtgcttttctctgctcctgga

SEQ ID NO: 8008143 - DNA, 20 bp, Homo sapiens
tgtggaaaaacagaagcaga

SEQ ID NO: 8008144 - DNA, 20 bp, Homo sapiens
tgtggaaaaacagaagcaga

SEQ ID NO: 8008145 - DNA, 22 bp, Homo sapiens
tgtggcaggaagagcttctgag

SEQ ID NO: 8008146 - DNA, 22 bp, Homo sapiens
tgtggcaggaagagcttctgag

SEQ ID NO: 8008147 - DNA, 20 bp, Homo sapiens
tgtggcaggatgagggcgga

SEQ ID NO: 8008148 - DNA, 20 bp, Homo sapiens
tgtggcaggatgagggcgga

SEQ ID NO: 8008149 - DNA, 20 bp, Homo sapiens
tgtggcaggatgagggcgga

SEQ ID NO: 8008150 - DNA, 20 bp, Homo sapiens
tgtggcaggatgagggcgga

SEQ ID NO: 8008151 - DNA, 22 bp, Homo sapiens
tgtggcagctggaggtggagaa

SEQ ID NO: 8008152 - DNA, 22 bp, Homo sapiens
tgtggcagctggaggtggagaa

SEQ ID NO: 8008153 - DNA, 22 bp, Homo sapiens
tgtggcagctggaggtggagaa

SEQ ID NO: 8008154 - DNA, 22 bp, Homo sapiens
tgtggcagctggaggtggagaa

SEQ ID NO: 8008155 - DNA, 22 bp, Homo sapiens
tgtggcagctggaggtggagaa

SEQ ID NO: 8008156 - DNA, 22 bp, Homo sapiens
tgtggcagctggaggtggagaa

SEQ ID NO: 8008157 - DNA, 22 bp, Homo sapiens
tgtggcaggaagagcttctgag

SEQ ID NO: 8008158 - DNA, 22 bp, Homo sapiens
tgtggcagctggaggtggagaa

SEQ ID NO: 8008159 - DNA, 22 bp, Homo sapiens
tgtggcagggatactgaggcag

SEQ ID NO: 8008160 - DNA, 22 bp, Homo sapiens
tgtggcagggatactgaggcag

SEQ ID NO: 8008161 - DNA, 22 bp, Homo sapiens
tgtggcagggatactgaggcag

SEQ ID NO: 8008162 - DNA, 22 bp, Homo sapiens
tgtggcagggatactgaggcag

SEQ ID NO: 8008163 - DNA, 22 bp, Homo sapiens
tgtggcagggatactgaggcag

SEQ ID NO: 8008164 - DNA, 22 bp, Homo sapiens
tgtggcagggatactgaggcag

SEQ ID NO: 8008165 - DNA, 18 bp, Homo sapiens
tgtggcaggggtgggaga

SEQ ID NO: 8008166 - DNA, 18 bp, Homo sapiens
tgtggcaggggtgggaga

SEQ ID NO: 8008167 - DNA, 18 bp, Homo sapiens
tgtggcaggggtgggaga

SEQ ID NO: 8008168 - DNA, 22 bp, Homo sapiens
tgtggcagggcgtgacatttgg

SEQ ID NO: 8008169 - DNA, 22 bp, Homo sapiens
tgtggcagggcgtgacatttgg

SEQ ID NO: 8008170 - DNA, 22 bp, Homo sapiens
tgtggctgctcaggtgcagacc

SEQ ID NO: 8008171 - DNA, 22 bp, Homo sapiens
tgtggctgctcaggtgcagacc

SEQ ID NO: 8008172 - DNA, 22 bp, Homo sapiens
tgtggctgctcaggtgcagacc

SEQ ID NO: 8008173 - DNA, 22 bp, Homo sapiens
tgtggctgctcaggtgcagacc

SEQ ID NO: 8008174 - DNA, 18 bp, Homo sapiens
tgtggcaggggtgggaga

SEQ ID NO: 8008175 - DNA, 18 bp, Homo sapiens
tgtggcaggggtgggaga

SEQ ID NO: 8008176 - DNA, 21 bp, Homo sapiens
tgtggctgcctctggccctgg

SEQ ID NO: 8008177 - DNA, 21 bp, Homo sapiens
tgtggctgcctctggccctgg

SEQ ID NO: 8008178 - DNA, 22 bp, Homo sapiens
tgtggcaggcattctgaggctg

SEQ ID NO: 8008179 - DNA, 22 bp, Homo sapiens
tgtggcaggcattctgaggctg

SEQ ID NO: 8008180 - DNA, 22 bp, Homo sapiens
tgtggcaggcattctgaggctg

SEQ ID NO: 8008181 - DNA, 22 bp, Homo sapiens
tgtggcaggcattctgaggctg

SEQ ID NO: 8008182 - DNA, 22 bp, Homo sapiens
tgtggcaggcattctgaggctg

SEQ ID NO: 8008183 - DNA, 22 bp, Homo sapiens
tgtggcaggcaagatgtacaga

SEQ ID NO: 8008184 - DNA, 22 bp, Homo sapiens
tgtggcaggcattctgaggctg

SEQ ID NO: 8008185 - DNA, 22 bp, Homo sapiens
tgtggcaggcattctgaggctg

SEQ ID NO: 8008186 - DNA, 22 bp, Homo sapiens
tgtggcagggatactgaggcag

SEQ ID NO: 8008187 - DNA, 22 bp, Homo sapiens
tgtggcaggctaggctttttgg

SEQ ID NO: 8008188 - DNA, 22 bp, Homo sapiens
tgtggcaggcaagatgtacaga

SEQ ID NO: 8008189 - DNA, 22 bp, Homo sapiens
tgtggcaggcaagatgtacaga

SEQ ID NO: 8008190 - DNA, 22 bp, Homo sapiens
tgtggcaggatgcggaagatgc

SEQ ID NO: 8008191 - DNA, 22 bp, Homo sapiens
tgtggcaggcaagatgtacaga

SEQ ID NO: 8008192 - DNA, 22 bp, Homo sapiens
tgtggcaggcaagatgtacaga

SEQ ID NO: 8008193 - DNA, 22 bp, Homo sapiens
tgtggcaggatgcggaagatgc

SEQ ID NO: 8008194 - DNA, 22 bp, Homo sapiens
tgtggcaggatgcggaagatgc

SEQ ID NO: 8008195 - DNA, 22 bp, Homo sapiens
tgtggcaggatgcggaagatgc

SEQ ID NO: 8008196 - DNA, 20 bp, Homo sapiens
tgtggcaggatgagggcgga

SEQ ID NO: 8008197 - DNA, 22 bp, Homo sapiens
cctgggagctgtggaaaggctg

SEQ ID NO: 8008198 - DNA, 22 bp, Homo sapiens
cctgggagctgtggaaaggctg

SEQ ID NO: 8008199 - DNA, 22 bp, Homo sapiens
cctgggagctgtggaaaggctg

SEQ ID NO: 8008200 - DNA, 22 bp, Homo sapiens
cctgggagctgtggaaaggctg

SEQ ID NO: 8008201 - DNA, 22 bp, Homo sapiens
tgtgggaaatgggagtggaaga

SEQ ID NO: 8008202 - DNA, 22 bp, Homo sapiens
tgtgggaaatgggagtggaaga

SEQ ID NO: 8008203 - DNA, 22 bp, Homo sapiens
tgtggcttttgctagctttgca

SEQ ID NO: 8008204 - DNA, 22 bp, Homo sapiens
tgtggcttccacgatggtcacc

SEQ ID NO: 8008205 - DNA, 22 bp, Homo sapiens
tgtggctgtgtccacctgctgc

SEQ ID NO: 8008206 - DNA, 22 bp, Homo sapiens
tgtggctgttgaggaccccaag

SEQ ID NO: 8008207 - DNA, 22 bp, Homo sapiens
cctgggaggcagaggttgcagt

SEQ ID NO: 8008208 - DNA, 22 bp, Homo sapiens
cctgggagctgtggaaaggctg

SEQ ID NO: 8008209 - DNA, 19 bp, Homo sapiens
cctgggaggcggaggttgc

SEQ ID NO: 8008210 - DNA, 19 bp, Homo sapiens
cctgggaggcggaggttgc

SEQ ID NO: 8008211 - DNA, 19 bp, Homo sapiens
cctgggaggcggaggttgc

SEQ ID NO: 8008212 - DNA, 19 bp, Homo sapiens
cctgggaggcggaggttgc

SEQ ID NO: 8008213 - DNA, 19 bp, Homo sapiens
cctgggaggcggaggttgc

SEQ ID NO: 8008214 - DNA, 22 bp, Homo sapiens
cctgggaggcagaggttgcagt

SEQ ID NO: 8008215 - DNA, 18 bp, Homo sapiens
tgtggctggtccacactg

SEQ ID NO: 8008216 - DNA, 18 bp, Homo sapiens
tgtggctggtccacactg

SEQ ID NO: 8008217 - DNA, 22 bp, Homo sapiens
tgtggctgggctaataggcaaa

SEQ ID NO: 8008218 - DNA, 22 bp, Homo sapiens
tgtggctgggaagaaggtaact

SEQ ID NO: 8008219 - DNA, 22 bp, Homo sapiens
tgtggctgggaagaaggtaact

SEQ ID NO: 8008220 - DNA, 22 bp, Homo sapiens
tgtggctgggaagaaggtaact

SEQ ID NO: 8008221 - DNA, 22 bp, Homo sapiens
tgtggctgggaagaaggtaact

SEQ ID NO: 8008222 - DNA, 22 bp, Homo sapiens
tgtggctgggaagaaggtaact

SEQ ID NO: 8008223 - DNA, 15 bp, Homo sapiens
tgtggctggctcctg

SEQ ID NO: 8008224 - DNA, 22 bp, Homo sapiens
tgtggctggattgattttacct

SEQ ID NO: 8008225 - DNA, 22 bp, Homo sapiens
tgtggctggattgattttacct

SEQ ID NO: 8008226 - DNA, 22 bp, Homo sapiens
tgtggctgctcctgggtggtca

SEQ ID NO: 8008227 - DNA, 22 bp, Homo sapiens
tgtggctgctcctgggtggtca

SEQ ID NO: 8008228 - DNA, 22 bp, Homo sapiens
tgtggctgctcctgggtggtca

SEQ ID NO: 8008229 - DNA, 22 bp, Homo sapiens
tgtggctgctcctgggtggtca

SEQ ID NO: 8008230 - DNA, 22 bp, Homo sapiens
tgtggctgtgccgtcacacgtg

SEQ ID NO: 8008231 - DNA, 22 bp, Homo sapiens
tgtggctgtctgttctcctagg

SEQ ID NO: 8008232 - DNA, 22 bp, Homo sapiens
tgtggctgtctgttctcctagg

SEQ ID NO: 8008233 - DNA, 22 bp, Homo sapiens
tgtggctggtctccgagcgtcg

SEQ ID NO: 8008234 - DNA, 22 bp, Homo sapiens
tgtggctggtctccgagcgtcg

SEQ ID NO: 8008235 - DNA, 22 bp, Homo sapiens
tgtggctggtctccgagcgtcg

SEQ ID NO: 8008236 - DNA, 22 bp, Homo sapiens
tgtggctgtctgttctcctagg

SEQ ID NO: 8008237 - DNA, 22 bp, Homo sapiens
tgtggctgtgtccacctgctgc

SEQ ID NO: 8008238 - DNA, 22 bp, Homo sapiens
tgtggctgtgtccacctgctgc

SEQ ID NO: 8008239 - DNA, 22 bp, Homo sapiens
tgtggctgtgtccacctgctgc

SEQ ID NO: 8008240 - DNA, 22 bp, Homo sapiens
tgtggctgtggttttcataaat

SEQ ID NO: 8008241 - DNA, 22 bp, Homo sapiens
tgtggctgtggatgctttccag

SEQ ID NO: 8008242 - DNA, 22 bp, Homo sapiens
tgtggctgtggatgctttccag

SEQ ID NO: 8008243 - DNA, 22 bp, Homo sapiens
tgtggctgtggatgctttccag

SEQ ID NO: 8008244 - DNA, 22 bp, Homo sapiens
tgtggctgtggatgctttccag

SEQ ID NO: 8008245 - DNA, 22 bp, Homo sapiens
tgtgtgtctgcacatgtataat

SEQ ID NO: 8008246 - DNA, 22 bp, Homo sapiens
tgtgtgtctgcacatgtataat

SEQ ID NO: 8008247 - DNA, 22 bp, Homo sapiens
tgtgtgtcatttagggtggagc

SEQ ID NO: 8008248 - DNA, 22 bp, Homo sapiens
tgtgtgtccttgacctcagtgg

SEQ ID NO: 8008249 - DNA, 22 bp, Homo sapiens
tgtgtgtcatttagggtggagc

SEQ ID NO: 8008250 - DNA, 22 bp, Homo sapiens
cctgggcctcacccagctcttg

SEQ ID NO: 8008251 - DNA, 19 bp, Homo sapiens
cctgggcctccatcacccc

SEQ ID NO: 8008252 - DNA, 19 bp, Homo sapiens
cctgggcctccatcacccc

SEQ ID NO: 8008253 - DNA, 22 bp, Homo sapiens
tgtgtgtctggaagctcaggga

SEQ ID NO: 8008254 - DNA, 22 bp, Homo sapiens
cctgggcctcacccagctcttg

SEQ ID NO: 8008255 - DNA, 22 bp, Homo sapiens
tgtgtgtctggaagctcaggga

SEQ ID NO: 8008256 - DNA, 19 bp, Homo sapiens
cctgggcctccatcacccc

SEQ ID NO: 8008257 - DNA, 19 bp, Homo sapiens
cctgggcctccatcacccc

SEQ ID NO: 8008258 - DNA, 19 bp, Homo sapiens
cctgggcctccatcacccc

SEQ ID NO: 8008259 - DNA, 19 bp, Homo sapiens
cctgggcctccatcacccc

SEQ ID NO: 8008260 - DNA, 22 bp, Homo sapiens
cctgggcctctcaaagtgctgg

SEQ ID NO: 8008261 - DNA, 22 bp, Homo sapiens
cctgggcctctcaaagtgctgg

SEQ ID NO: 8008262 - DNA, 22 bp, Homo sapiens
cctgggcctctcaaagtgctgg

SEQ ID NO: 8008263 - DNA, 22 bp, Homo sapiens
cctgggcctctcaaagtgctgg

SEQ ID NO: 8008264 - DNA, 22 bp, Homo sapiens
cctgggcctctcaaagtgctgg

SEQ ID NO: 8008265 - DNA, 22 bp, Homo sapiens
cctgggcctctcaaagtgctgg

SEQ ID NO: 8008266 - DNA, 22 bp, Homo sapiens
cctgggcctctcaaagtgctgg

SEQ ID NO: 8008267 - DNA, 22 bp, Homo sapiens
cctgggcctctcaaagtgctgg

SEQ ID NO: 8008268 - DNA, 22 bp, Homo sapiens
cctgggcctctcaaagtgctgg

SEQ ID NO: 8008269 - DNA, 22 bp, Homo sapiens
cctgggcctgaaaacatttctc

SEQ ID NO: 8008270 - DNA, 22 bp, Homo sapiens
cctgggcctgaaaacatttctc

SEQ ID NO: 8008271 - DNA, 22 bp, Homo sapiens
cctgggcctggcgggtcggctc

SEQ ID NO: 8008272 - DNA, 22 bp, Homo sapiens
cctgggcctggcgggtcggctc

SEQ ID NO: 8008273 - DNA, 22 bp, Homo sapiens
cctgggcctggcgggtcggctc

SEQ ID NO: 8008274 - DNA, 22 bp, Homo sapiens
cctgggcctggcgggtcggctc

SEQ ID NO: 8008275 - DNA, 22 bp, Homo sapiens
cctgggcctggcgggtcggctc

SEQ ID NO: 8008276 - DNA, 22 bp, Homo sapiens
cctgggcctgaaaacatttctc

SEQ ID NO: 8008277 - DNA, 22 bp, Homo sapiens
cctgggcctggcgggtcggctc

SEQ ID NO: 8008278 - DNA, 22 bp, Homo sapiens
cctgggcctggcgggtcggctc

SEQ ID NO: 8008279 - DNA, 22 bp, Homo sapiens
cctgggcctggcgggtcggctc

SEQ ID NO: 8008280 - DNA, 22 bp, Homo sapiens
tgtgtgtcactgaaagaaatct

SEQ ID NO: 8008281 - DNA, 22 bp, Homo sapiens
tgtgtgtatatgcatttatcta

SEQ ID NO: 8008282 - DNA, 21 bp, Homo sapiens
tgtgtgtatgcacacacatgc

SEQ ID NO: 8008283 - DNA, 22 bp, Homo sapiens
tgtgtgtcagtcttgtttaggg

SEQ ID NO: 8008284 - DNA, 22 bp, Homo sapiens
tgtgtgtcagtcttgtttaggg

SEQ ID NO: 8008285 - DNA, 22 bp, Homo sapiens
tgtgtgtcagtcttgtttaggg

SEQ ID NO: 8008286 - DNA, 22 bp, Homo sapiens
tgtgtgtcagcccaagggcctt

SEQ ID NO: 8008287 - DNA, 22 bp, Homo sapiens
tgtgtgtcagagtctccatggt

SEQ ID NO: 8008288 - DNA, 22 bp, Homo sapiens
tgtgtgtataataatgtctgca

SEQ ID NO: 8008289 - DNA, 22 bp, Homo sapiens
tgtgtgtataataatgtctgca

SEQ ID NO: 8008290 - DNA, 22 bp, Homo sapiens
tgtgtgtataataatgtctgca

SEQ ID NO: 8008291 - DNA, 22 bp, Homo sapiens
tgtgtgtataataatgtctgca

SEQ ID NO: 8008292 - DNA, 22 bp, Homo sapiens
tgtgtggtgaagcagagatgct

SEQ ID NO: 8008293 - DNA, 22 bp, Homo sapiens
cctgggctttgctggcaaggcc

SEQ ID NO: 8008294 - DNA, 22 bp, Homo sapiens
cctgggctttgctggcaaggcc

SEQ ID NO: 8008295 - DNA, 22 bp, Homo sapiens
cctgggctttgctggcaaggcc

SEQ ID NO: 8008296 - DNA, 22 bp, Homo sapiens
cctgggctttgctggcaaggcc

SEQ ID NO: 8008297 - DNA, 22 bp, Homo sapiens
cctgggctttgctggcaaggcc

SEQ ID NO: 8008298 - DNA, 22 bp, Homo sapiens
cctgggcttccacgagcagagg

SEQ ID NO: 8008299 - DNA, 22 bp, Homo sapiens
cctgggcttccacgagcagagg

SEQ ID NO: 8008300 - DNA, 22 bp, Homo sapiens
cctgggctcaagcgatcttgtc

SEQ ID NO: 8008301 - DNA, 22 bp, Homo sapiens
cctgggctcaagcgatcttgtc

SEQ ID NO: 8008302 - DNA, 22 bp, Homo sapiens
cctgggctcaagtgatcctcct

SEQ ID NO: 8008303 - DNA, 22 bp, Homo sapiens
cctgggctcaagcgatcttgtc

SEQ ID NO: 8008304 - DNA, 22 bp, Homo sapiens
cctgggcttccacgagcagagg

SEQ ID NO: 8008305 - DNA, 22 bp, Homo sapiens
cctgggcttccacgagcagagg

SEQ ID NO: 8008306 - DNA, 22 bp, Homo sapiens
cctgggcttccacgagcagagg

SEQ ID NO: 8008307 - DNA, 22 bp, Homo sapiens
cctgggcttccacgagcagagg

SEQ ID NO: 8008308 - DNA, 22 bp, Homo sapiens
cctgggccttgacctcgtgggc

SEQ ID NO: 8008309 - DNA, 22 bp, Homo sapiens
cctgggcctctcaaagtgctgg

SEQ ID NO: 8008310 - DNA, 22 bp, Homo sapiens
cctgggccttgacctcgtgggc

SEQ ID NO: 8008311 - DNA, 22 bp, Homo sapiens
cctgggccttgacctcgtgggc

SEQ ID NO: 8008312 - DNA, 22 bp, Homo sapiens
cctgggccttgacctcgtgggc

SEQ ID NO: 8008313 - DNA, 22 bp, Homo sapiens
cctgggccttgacctcgtgggc

SEQ ID NO: 8008314 - DNA, 22 bp, Homo sapiens
cctgggccttgacctcgtgggc

SEQ ID NO: 8008315 - DNA, 22 bp, Homo sapiens
cctgggccttgacctcgtgggc

SEQ ID NO: 8008316 - DNA, 22 bp, Homo sapiens
cctgggccttgacctcgtgggc

SEQ ID NO: 8008317 - DNA, 22 bp, Homo sapiens
cctgggccttgacctcgtgggc

SEQ ID NO: 8008318 - DNA, 20 bp, Homo sapiens
cctgggctcaaagcatcctc

SEQ ID NO: 8008319 - DNA, 20 bp, Homo sapiens
cctgggctcaaagcatcctc

SEQ ID NO: 8008320 - DNA, 20 bp, Homo sapiens
cctgggctcaaagcatcctc

SEQ ID NO: 8008321 - DNA, 20 bp, Homo sapiens
cctgggctcaaagcatcctc

SEQ ID NO: 8008322 - DNA, 20 bp, Homo sapiens
cctgggctcaaagcatcctc

SEQ ID NO: 8008323 - DNA, 22 bp, Homo sapiens
cctggggaatcttgcaggggaa

SEQ ID NO: 8008324 - DNA, 22 bp, Homo sapiens
cctggggaatcttgcaggggaa

SEQ ID NO: 8008325 - DNA, 22 bp, Homo sapiens
cctggggaatcttgcaggggaa

SEQ ID NO: 8008326 - DNA, 22 bp, Homo sapiens
cctggggaatcttgcaggggaa

SEQ ID NO: 8008327 - DNA, 22 bp, Homo sapiens
cctggggaatcttgcaggggaa

SEQ ID NO: 8008328 - DNA, 22 bp, Homo sapiens
cctggggaatcttgcaggggaa

SEQ ID NO: 8008329 - DNA, 22 bp, Homo sapiens
cctggggaatagagtcaagggg

SEQ ID NO: 8008330 - DNA, 22 bp, Homo sapiens
cctggggaatagagtcaagggg

SEQ ID NO: 8008331 - DNA, 22 bp, Homo sapiens
cctggggaatagagtcaagggg

SEQ ID NO: 8008332 - DNA, 22 bp, Homo sapiens
cctggggaatcttgcaggggaa

SEQ ID NO: 8008333 - DNA, 22 bp, Homo sapiens
cctggggaatagagtcaagggg

SEQ ID NO: 8008334 - DNA, 22 bp, Homo sapiens
cctggggaatagagtcaagggg

SEQ ID NO: 8008335 - DNA, 22 bp, Homo sapiens
cctggggaatagagtcaagggg

SEQ ID NO: 8008336 - DNA, 22 bp, Homo sapiens
cctggggaatagagtcaagggg

SEQ ID NO: 8008337 - DNA, 22 bp, Homo sapiens
cctggggaatagagtcaagggg

SEQ ID NO: 8008338 - DNA, 22 bp, Homo sapiens
cctggggaagtcacttctcttt

SEQ ID NO: 8008339 - DNA, 22 bp, Homo sapiens
cctggggaatagagtcaagggg

SEQ ID NO: 8008340 - DNA, 22 bp, Homo sapiens
cctgggctttggaacagtactt

SEQ ID NO: 8008341 - DNA, 22 bp, Homo sapiens
cctgggctttggaacagtactt

SEQ ID NO: 8008342 - DNA, 22 bp, Homo sapiens
cctgggctttggaacagtactt

SEQ ID NO: 8008343 - DNA, 22 bp, Homo sapiens
cctgggctttggaacagtactt

SEQ ID NO: 8008344 - DNA, 22 bp, Homo sapiens
cctgggctttggaacagtactt

SEQ ID NO: 8008345 - DNA, 22 bp, Homo sapiens
cctgggctttgctggcaaggcc

SEQ ID NO: 8008346 - DNA, 22 bp, Homo sapiens
cctgggctttgctggcaaggcc

SEQ ID NO: 8008347 - DNA, 22 bp, Homo sapiens
cctggggaagtcacttctcttt

SEQ ID NO: 8008348 - DNA, 22 bp, Homo sapiens
cctggggaagtcacttctcttt

SEQ ID NO: 8008349 - DNA, 22 bp, Homo sapiens
cctggggaaaagcaggcattta

SEQ ID NO: 8008350 - DNA, 22 bp, Homo sapiens
cctggggaaaagcaggcattta

SEQ ID NO: 8008351 - DNA, 22 bp, Homo sapiens
cctggggaaaagcaggcattta

SEQ ID NO: 8008352 - DNA, 22 bp, Homo sapiens
cctggggaaaagcaggcattta

SEQ ID NO: 8008353 - DNA, 22 bp, Homo sapiens
cctggggaaaagcaggcattta

SEQ ID NO: 8008354 - DNA, 22 bp, Homo sapiens
cctggggaaaagcaggcattta

SEQ ID NO: 8008355 - DNA, 22 bp, Homo sapiens
cctgggctttggaacagtactt

SEQ ID NO: 8008356 - DNA, 22 bp, Homo sapiens
cctgggtctgtattggtaggta

SEQ ID NO: 8008357 - DNA, 22 bp, Homo sapiens
cctgggtctgtattggtaggta

SEQ ID NO: 8008358 - DNA, 22 bp, Homo sapiens
cctgggtctgtattggtaggta

SEQ ID NO: 8008359 - DNA, 19 bp, Homo sapiens
cctgggtctgcagcattca

SEQ ID NO: 8008360 - DNA, 19 bp, Homo sapiens
cctgggtctgcagcattca

SEQ ID NO: 8008361 - DNA, 22 bp, Homo sapiens
cctgggtctggtcactaagtca

SEQ ID NO: 8008362 - DNA, 22 bp, Homo sapiens
cctgggtctggtcactaagtca

SEQ ID NO: 8008363 - DNA, 22 bp, Homo sapiens
cctgggtcttcagtctgctggt

SEQ ID NO: 8008364 - DNA, 22 bp, Homo sapiens
cctgggtcttcagtctgctggt

SEQ ID NO: 8008365 - DNA, 22 bp, Homo sapiens
cctgggtcttcagtctgctggt

SEQ ID NO: 8008366 - DNA, 22 bp, Homo sapiens
cctgggtcttggttcatgctct

SEQ ID NO: 8008367 - DNA, 22 bp, Homo sapiens
cctgggtcttggttcatgctct

SEQ ID NO: 8008368 - DNA, 22 bp, Homo sapiens
cctgggtcccatcccagagtga

SEQ ID NO: 8008369 - DNA, 22 bp, Homo sapiens
cctgggtcctggcagcctcctg

SEQ ID NO: 8008370 - DNA, 22 bp, Homo sapiens
cctgggtccctgagagatgatt

SEQ ID NO: 8008371 - DNA, 22 bp, Homo sapiens
cctgggtcccatcccagagtga

SEQ ID NO: 8008372 - DNA, 22 bp, Homo sapiens
cctgggtcccatcccagagtga

SEQ ID NO: 8008373 - DNA, 22 bp, Homo sapiens
cctgggtcccagccaggctttg

SEQ ID NO: 8008374 - DNA, 22 bp, Homo sapiens
cctgggtcccagccaggctttg

SEQ ID NO: 8008375 - DNA, 22 bp, Homo sapiens
cctgggtctcctcctgctggct

SEQ ID NO: 8008376 - DNA, 22 bp, Homo sapiens
cctgggtctcctcctgctggct

SEQ ID NO: 8008377 - DNA, 22 bp, Homo sapiens
cctgggtctcctcctgctggct

SEQ ID NO: 8008378 - DNA, 22 bp, Homo sapiens
cctgggtctatagacttcaaga

SEQ ID NO: 8008379 - DNA, 22 bp, Homo sapiens
cctgggtcctggcagcctcctg

SEQ ID NO: 8008380 - DNA, 19 bp, Homo sapiens
cctgggtccactcagacta

SEQ ID NO: 8008381 - DNA, 22 bp, Homo sapiens
cctgggtgaaatagtcctcaag

SEQ ID NO: 8008382 - DNA, 22 bp, Homo sapiens
cctgggtgaaatagtcctcaag

SEQ ID NO: 8008383 - DNA, 22 bp, Homo sapiens
cctgggtgaaatagtcctcaag

SEQ ID NO: 8008384 - DNA, 22 bp, Homo sapiens
cctgggtgaaatagtcctcaag

SEQ ID NO: 8008385 - DNA, 22 bp, Homo sapiens
cctgggtgaaatagtcctcaag

SEQ ID NO: 8008386 - DNA, 22 bp, Homo sapiens
cctgggtgaaatctctcctgca

SEQ ID NO: 8008387 - DNA, 22 bp, Homo sapiens
cctgggtgaaatctctcctgca

SEQ ID NO: 8008388 - DNA, 22 bp, Homo sapiens
cctgggtgacagagtgagacct

SEQ ID NO: 8008389 - DNA, 22 bp, Homo sapiens
cctgggtgaatgatattctaaa

SEQ ID NO: 8008390 - DNA, 22 bp, Homo sapiens
cctgggtgaaatctctcctgca

SEQ ID NO: 8008391 - DNA, 22 bp, Homo sapiens
cctgggtgacagagtgagacct

SEQ ID NO: 8008392 - DNA, 22 bp, Homo sapiens
cctgggtgacagagtgagacct

SEQ ID NO: 8008393 - DNA, 22 bp, Homo sapiens
cctgggtgacagagtgagacct

SEQ ID NO: 8008394 - DNA, 22 bp, Homo sapiens
cctgggtgcccggcccttctct

SEQ ID NO: 8008395 - DNA, 22 bp, Homo sapiens
cctgggtggcagaggttgcagt

SEQ ID NO: 8008396 - DNA, 22 bp, Homo sapiens
cctgggtgcccggcccttctct

SEQ ID NO: 8008397 - DNA, 22 bp, Homo sapiens
cctgggtgcccggcccttctct

SEQ ID NO: 8008398 - DNA, 22 bp, Homo sapiens
cctgggtgacccgtgagcgtcc

SEQ ID NO: 8008399 - DNA, 22 bp, Homo sapiens
cctgggtgacagagtgagacct

SEQ ID NO: 8008400 - DNA, 22 bp, Homo sapiens
cctgggtgacccgtgagcgtcc

SEQ ID NO: 8008401 - DNA, 22 bp, Homo sapiens
cctgggtgacagagtgagacct

SEQ ID NO: 8008402 - DNA, 22 bp, Homo sapiens
cctgggtcccagccaggctttg

SEQ ID NO: 8008403 - DNA, 19 bp, Homo sapiens
cctgggtccactcagacta

SEQ ID NO: 8008404 - DNA, 22 bp, Homo sapiens
cctgggtccaccctgtgaagta

SEQ ID NO: 8008405 - DNA, 19 bp, Homo sapiens
cctgggtccactcagacta

SEQ ID NO: 8008406 - DNA, 22 bp, Homo sapiens
cctggggctccagagcagcgga

SEQ ID NO: 8008407 - DNA, 22 bp, Homo sapiens
cctggggctccagagcagcgga

SEQ ID NO: 8008408 - DNA, 22 bp, Homo sapiens
cctggggctcaagatggcgccg

SEQ ID NO: 8008409 - DNA, 22 bp, Homo sapiens
cctggggctccagagcagcgga

SEQ ID NO: 8008410 - DNA, 23 bp, Homo sapiens
tgtgttctcacacagatgcagta

SEQ ID NO: 8008411 - DNA, 22 bp, Homo sapiens
tgtgttctccaactgtagattt

SEQ ID NO: 8008412 - DNA, 23 bp, Homo sapiens
tgtgttctcacacagatgcagta

SEQ ID NO: 8008413 - DNA, 22 bp, Homo sapiens
tgtgttcatttctctctgctgt

SEQ ID NO: 8008414 - DNA, 19 bp, Homo sapiens
tgtgttccatccaccaccc

SEQ ID NO: 8008415 - DNA, 23 bp, Homo sapiens
tgtgttctcacacagatgcagta

SEQ ID NO: 8008416 - DNA, 23 bp, Homo sapiens
tgtgttctcacacagatgcagta

SEQ ID NO: 8008417 - DNA, 22 bp, Homo sapiens
tgtgttctatggttcagggtgg

SEQ ID NO: 8008418 - DNA, 22 bp, Homo sapiens
tgtgttcatttaactgttcttt

SEQ ID NO: 8008419 - DNA, 22 bp, Homo sapiens
tgtgttcatttaactgttcttt

SEQ ID NO: 8008420 - DNA, 22 bp, Homo sapiens
tgtgttcatttaactgttcttt

SEQ ID NO: 8008421 - DNA, 19 bp, Homo sapiens
tgtgttcattcatcagagg

SEQ ID NO: 8008422 - DNA, 19 bp, Homo sapiens
tgtgttcattcatcagagg

SEQ ID NO: 8008423 - DNA, 22 bp, Homo sapiens
tgtgttcattagcattgccttg

SEQ ID NO: 8008424 - DNA, 22 bp, Homo sapiens
tgtgttcatgttgattcatagc

SEQ ID NO: 8008425 - DNA, 22 bp, Homo sapiens
tgtgttcattagcattgccttg

SEQ ID NO: 8008426 - DNA, 22 bp, Homo sapiens
tgtgttcatgttgattcatagc

SEQ ID NO: 8008427 - DNA, 22 bp, Homo sapiens
tgtgttcatgtcactggaatcc

SEQ ID NO: 8008428 - DNA, 22 bp, Homo sapiens
tgtgttcatgtatgtatacata

SEQ ID NO: 8008429 - DNA, 22 bp, Homo sapiens
tgtgttcatcatgatatcaggt

SEQ ID NO: 8008430 - DNA, 22 bp, Homo sapiens
tgtgttcatctttaaagggaag

SEQ ID NO: 8008431 - DNA, 22 bp, Homo sapiens
tgtgttcatcatgatatcaggt

SEQ ID NO: 8008432 - DNA, 23 bp, Homo sapiens
tgtgttcagtcaaggatcagagt

SEQ ID NO: 8008433 - DNA, 22 bp, Homo sapiens
tgtgttcatgtatgtatacata

SEQ ID NO: 8008434 - DNA, 22 bp, Homo sapiens
tgtgttcagtatgacattcaca

SEQ ID NO: 8008435 - DNA, 22 bp, Homo sapiens
tgtgttcagaatttgctgcttt

SEQ ID NO: 8008436 - DNA, 22 bp, Homo sapiens
tgtgttcaccctagcacttaac

SEQ ID NO: 8008437 - DNA, 22 bp, Homo sapiens
tgtgttcaccaaagtgtagaaa

SEQ ID NO: 8008438 - DNA, 22 bp, Homo sapiens
tgtgttcaccaaagtgtagaaa

SEQ ID NO: 8008439 - DNA, 22 bp, Homo sapiens
tgtgttcagcaggcaccttctt

SEQ ID NO: 8008440 - DNA, 22 bp, Homo sapiens
tgtgttcagtatgacattcaca

SEQ ID NO: 8008441 - DNA, 22 bp, Homo sapiens
tgtgttcagtatgacattcaca

SEQ ID NO: 8008442 - DNA, 22 bp, Homo sapiens
tgtgttcaatccctagtctcag

SEQ ID NO: 8008443 - DNA, 22 bp, Homo sapiens
cctggggacctgcctcagccct

SEQ ID NO: 8008444 - DNA, 22 bp, Homo sapiens
cctggggagaagagcttccccc

SEQ ID NO: 8008445 - DNA, 22 bp, Homo sapiens
cctggggacctgcctcagccct

SEQ ID NO: 8008446 - DNA, 22 bp, Homo sapiens
cctggggacctgcctcagccct

SEQ ID NO: 8008447 - DNA, 22 bp, Homo sapiens
cctggggacctgcctcagccct

SEQ ID NO: 8008448 - DNA, 22 bp, Homo sapiens
cctggggacctgcctcagccct

SEQ ID NO: 8008449 - DNA, 22 bp, Homo sapiens
cctggggaatcttgcaggggaa

SEQ ID NO: 8008450 - DNA, 22 bp, Homo sapiens
cctggggaatcttgcaggggaa

SEQ ID NO: 8008451 - DNA, 22 bp, Homo sapiens
cctggggacctgcctcagccct

SEQ ID NO: 8008452 - DNA, 22 bp, Homo sapiens
cctggggacctgcctcagccct

SEQ ID NO: 8008453 - DNA, 22 bp, Homo sapiens
cctggggaatcttgcaggggaa

SEQ ID NO: 8008454 - DNA, 22 bp, Homo sapiens
tgtctttgattgataggctatg

SEQ ID NO: 8008455 - DNA, 22 bp, Homo sapiens
tgtctttggaatatttagctga

SEQ ID NO: 8008456 - DNA, 22 bp, Homo sapiens
tgtctttggaatatttagctga

SEQ ID NO: 8008457 - DNA, 22 bp, Homo sapiens
tgtctttggaatatttagctga

SEQ ID NO: 8008458 - DNA, 22 bp, Homo sapiens
tgtgaagaattaatgtgaatca

SEQ ID NO: 8008459 - DNA, 22 bp, Homo sapiens
tgtgaagaattaatgtgaatca

SEQ ID NO: 8008460 - DNA, 22 bp, Homo sapiens
tgtgaagagagtaataaagtca

SEQ ID NO: 8008461 - DNA, 22 bp, Homo sapiens
tgtgaagaattaatgtgaatca

SEQ ID NO: 8008462 - DNA, 22 bp, Homo sapiens
tgtgaactttggatggttctga

SEQ ID NO: 8008463 - DNA, 22 bp, Homo sapiens
tgtgaactttggatggttctga

SEQ ID NO: 8008464 - DNA, 22 bp, Homo sapiens
tgtgaagaattaatgtgaatca

SEQ ID NO: 8008465 - DNA, 22 bp, Homo sapiens
tgtctttagttttactgtctgg

SEQ ID NO: 8008466 - DNA, 22 bp, Homo sapiens
tgtctttatatatttggaaaat

SEQ ID NO: 8008467 - DNA, 22 bp, Homo sapiens
tgtctttctatctctagattta

SEQ ID NO: 8008468 - DNA, 22 bp, Homo sapiens
tgtctttatgcacactgacttg

SEQ ID NO: 8008469 - DNA, 22 bp, Homo sapiens
tgtctttctgcaccacctcaca

SEQ ID NO: 8008470 - DNA, 22 bp, Homo sapiens
tgtctttctgcaccacctcaca

SEQ ID NO: 8008471 - DNA, 22 bp, Homo sapiens
tgtctttctgcaccacctcaca

SEQ ID NO: 8008472 - DNA, 22 bp, Homo sapiens
tgtctttctgacccaaggtagt

SEQ ID NO: 8008473 - DNA, 22 bp, Homo sapiens
tgtctttctgacccaaggtagt

SEQ ID NO: 8008474 - DNA, 22 bp, Homo sapiens
tgtctttctgacccaaggtagt

SEQ ID NO: 8008475 - DNA, 22 bp, Homo sapiens
tgtctttctgacccaaggtagt

SEQ ID NO: 8008476 - DNA, 22 bp, Homo sapiens
tgtgaagatttggcatgcagaa

SEQ ID NO: 8008477 - DNA, 22 bp, Homo sapiens
tgtgaagcatagattctgtaga

SEQ ID NO: 8008478 - DNA, 22 bp, Homo sapiens
tgtgaagatttggcatgcagaa

SEQ ID NO: 8008479 - DNA, 22 bp, Homo sapiens
tgtgaagatttggcatgcagaa

SEQ ID NO: 8008480 - DNA, 22 bp, Homo sapiens
tgtgaagatcagggtcctagag

SEQ ID NO: 8008481 - DNA, 22 bp, Homo sapiens
tgtgaagattaagttactgggc

SEQ ID NO: 8008482 - DNA, 22 bp, Homo sapiens
tgtgaagagtagacatgtggtg

SEQ ID NO: 8008483 - DNA, 22 bp, Homo sapiens
tgtgaagagtagacatgtggtg

SEQ ID NO: 8008484 - DNA, 22 bp, Homo sapiens
tgtgaaggagatgaagggagtg

SEQ ID NO: 8008485 - DNA, 22 bp, Homo sapiens
tgtgaaggagatgaagggagtg

SEQ ID NO: 8008486 - DNA, 22 bp, Homo sapiens
tgtgaaggagatgaagggagtg

SEQ ID NO: 8008487 - DNA, 22 bp, Homo sapiens
tgtgaaggcagagccagtgaaa

SEQ ID NO: 8008488 - DNA, 22 bp, Homo sapiens
tgtgaaggcagagccagtgaaa

SEQ ID NO: 8008489 - DNA, 22 bp, Homo sapiens
tgtgaaggagcatgcagagggg

SEQ ID NO: 8008490 - DNA, 22 bp, Homo sapiens
tgtgaaggagcatgcagagggg

SEQ ID NO: 8008491 - DNA, 23 bp, Homo sapiens
tgtgaaggtgggtccaagggctg

SEQ ID NO: 8008492 - DNA, 22 bp, Homo sapiens
tgtgaaggtaaggaggggcaag

SEQ ID NO: 8008493 - DNA, 22 bp, Homo sapiens
tgtgaaggcagagccagtgaaa

SEQ ID NO: 8008494 - DNA, 22 bp, Homo sapiens
tgtgaggacattggaggactca

SEQ ID NO: 8008495 - DNA, 21 bp, Homo sapiens
tgtgagctttgtgaaagcagg

SEQ ID NO: 8008496 - DNA, 22 bp, Homo sapiens
tgtgagcttaggacagggctat

SEQ ID NO: 8008497 - DNA, 22 bp, Homo sapiens
tgtgaggaacaggactagagca

SEQ ID NO: 8008498 - DNA, 22 bp, Homo sapiens
tgtgaggaacaggactagagca

SEQ ID NO: 8008499 - DNA, 22 bp, Homo sapiens
tgtgagctttctgctctcctgt

SEQ ID NO: 8008500 - DNA, 22 bp, Homo sapiens
tgtgagcttaggacagggctat

SEQ ID NO: 8008501 - DNA, 20 bp, Homo sapiens
tgtgagcagatgctgagtga

SEQ ID NO: 8008502 - DNA, 22 bp, Homo sapiens
tgtgagcagagacatgaaaagc

SEQ ID NO: 8008503 - DNA, 23 bp, Homo sapiens
tgtgaaggtgggtccaagggctg

SEQ ID NO: 8008504 - DNA, 22 bp, Homo sapiens
tgtgagcatatgttttcagctc

SEQ ID NO: 8008505 - DNA, 20 bp, Homo sapiens
tgtgagcagatgctgagtga

SEQ ID NO: 8008506 - DNA, 22 bp, Homo sapiens
tgtgagctgaagtgacaggctg

SEQ ID NO: 8008507 - DNA, 22 bp, Homo sapiens
tgtgaggaggcggccagaagag

SEQ ID NO: 8008508 - DNA, 22 bp, Homo sapiens
tgtgaggagtaggctgagggtg

SEQ ID NO: 8008509 - DNA, 22 bp, Homo sapiens
tgtgaggagggtcaaactgagt

SEQ ID NO: 8008510 - DNA, 22 bp, Homo sapiens
tgtgaggagtaggctgagggtg

SEQ ID NO: 8008511 - DNA, 22 bp, Homo sapiens
tgtgaggataaaaaggaaggag

SEQ ID NO: 8008512 - DNA, 22 bp, Homo sapiens
tgtgaggataaaaaggaaggag

SEQ ID NO: 8008513 - DNA, 22 bp, Homo sapiens
tgtgaggacctcagcagagtct

SEQ ID NO: 8008514 - DNA, 22 bp, Homo sapiens
tgtgaggacattggaggactca

SEQ ID NO: 8008515 - DNA, 22 bp, Homo sapiens
cctggctgcagtttttgcagaa

SEQ ID NO: 8008516 - DNA, 22 bp, Homo sapiens
cctggctgcagtttttgcagaa

SEQ ID NO: 8008517 - DNA, 22 bp, Homo sapiens
tgtgagggttttaagggaatga

SEQ ID NO: 8008518 - DNA, 22 bp, Homo sapiens
tgtgaggtaacgctgctctgtt

SEQ ID NO: 8008519 - DNA, 22 bp, Homo sapiens
tgtgaggcgaggccagtgagct

SEQ ID NO: 8008520 - DNA, 22 bp, Homo sapiens
tgtgaggctacctgccagggtc

SEQ ID NO: 8008521 - DNA, 22 bp, Homo sapiens
tgtgaggctacctgccagggtc

SEQ ID NO: 8008522 - DNA, 22 bp, Homo sapiens
tgtgagggttttaagggaatga

SEQ ID NO: 8008523 - DNA, 22 bp, Homo sapiens
tgtgaggctacctgccagggtc

SEQ ID NO: 8008524 - DNA, 22 bp, Homo sapiens
tgtgaggcctagacagcctggg

SEQ ID NO: 8008525 - DNA, 22 bp, Homo sapiens
tgtgaggcctctgcaggagcag

SEQ ID NO: 8008526 - DNA, 22 bp, Homo sapiens
tgtgaggcctagacagcctggg

SEQ ID NO: 8008527 - DNA, 22 bp, Homo sapiens
tgtgaggcctagacagcctggg

SEQ ID NO: 8008528 - DNA, 22 bp, Homo sapiens
tgtgaggcctctgcaggagcag

SEQ ID NO: 8008529 - DNA, 22 bp, Homo sapiens
tgtgaggcgaggccagtgagct

SEQ ID NO: 8008530 - DNA, 22 bp, Homo sapiens
tgtgaggcctctgcaggagcag

SEQ ID NO: 8008531 - DNA, 22 bp, Homo sapiens
tgtgaggattaaatgcatagtg

SEQ ID NO: 8008532 - DNA, 22 bp, Homo sapiens
tgtgaggatgtgagcgtgaacc

SEQ ID NO: 8008533 - DNA, 22 bp, Homo sapiens
tgtgaggatggagttctacagg

SEQ ID NO: 8008534 - DNA, 22 bp, Homo sapiens
tgtgaggatgtaaccagaagtc

SEQ ID NO: 8008535 - DNA, 22 bp, Homo sapiens
tgtgaggatggagttctacagg

SEQ ID NO: 8008536 - DNA, 22 bp, Homo sapiens
tgtctttacttagaagttcagg

SEQ ID NO: 8008537 - DNA, 22 bp, Homo sapiens
tgtctttagaaagaagcagaca

SEQ ID NO: 8008538 - DNA, 22 bp, Homo sapiens
tgtctttagacctctctggcct

SEQ ID NO: 8008539 - DNA, 22 bp, Homo sapiens
tgtctttagagtcacaaaacca

SEQ ID NO: 8008540 - DNA, 22 bp, Homo sapiens
tgtctttagagtcacaaaacca

SEQ ID NO: 8008541 - DNA, 22 bp, Homo sapiens
tgtctgtctgtccttctcatta

SEQ ID NO: 8008542 - DNA, 22 bp, Homo sapiens
tgtctgtctgtccttctcatta

SEQ ID NO: 8008543 - DNA, 22 bp, Homo sapiens
tgtctgtctgtacctatttttt

SEQ ID NO: 8008544 - DNA, 22 bp, Homo sapiens
tgtctgtctgtacctatttttt

SEQ ID NO: 8008545 - DNA, 22 bp, Homo sapiens
tgtctgtctttagtgagattgc

SEQ ID NO: 8008546 - DNA, 22 bp, Homo sapiens
tgtctttacttagaagttcagg

SEQ ID NO: 8008547 - DNA, 22 bp, Homo sapiens
tgtctttacttagaagttcagg

SEQ ID NO: 8008548 - DNA, 21 bp, Homo sapiens
tgtctttaggacctgttaaat

SEQ ID NO: 8008549 - DNA, 22 bp, Homo sapiens
tgtctttagttgcttagatttg

SEQ ID NO: 8008550 - DNA, 22 bp, Homo sapiens
tgtctttagttttactgtctgg

SEQ ID NO: 8008551 - DNA, 22 bp, Homo sapiens
tgtctttagttgcttagatttg

SEQ ID NO: 8008552 - DNA, 22 bp, Homo sapiens
tgtctttagttgcttagatttg

SEQ ID NO: 8008553 - DNA, 22 bp, Homo sapiens
tgtctttagccacttgcctctt

SEQ ID NO: 8008554 - DNA, 22 bp, Homo sapiens
tgtctttagagtcacaaaacca

SEQ ID NO: 8008555 - DNA, 22 bp, Homo sapiens
tgtctttagagtcacaaaacca

SEQ ID NO: 8008556 - DNA, 22 bp, Homo sapiens
tgtctttagcccatatagactt

SEQ ID NO: 8008557 - DNA, 22 bp, Homo sapiens
tgtctttagcccatatagactt

SEQ ID NO: 8008558 - DNA, 22 bp, Homo sapiens
tgtctttagccagcagtcttct

SEQ ID NO: 8008559 - DNA, 22 bp, Homo sapiens
tgtctggtgggttgacaggcag

SEQ ID NO: 8008560 - DNA, 22 bp, Homo sapiens
tgtctgggttttgggtcatatt

SEQ ID NO: 8008561 - DNA, 22 bp, Homo sapiens
tgtctggtgggttgacaggcag

SEQ ID NO: 8008562 - DNA, 22 bp, Homo sapiens
tgtctggtgggttgacaggcag

SEQ ID NO: 8008563 - DNA, 22 bp, Homo sapiens
tgtctggtgggttgacaggcag

SEQ ID NO: 8008564 - DNA, 22 bp, Homo sapiens
tgtctgtatatcacttttgtcc

SEQ ID NO: 8008565 - DNA, 22 bp, Homo sapiens
tgtctgtaatcaactgagtttc

SEQ ID NO: 8008566 - DNA, 22 bp, Homo sapiens
tgtctgtaatagtcactatgtg

SEQ ID NO: 8008567 - DNA, 23 bp, Homo sapiens
tgtctggtttcttttatttagca

SEQ ID NO: 8008568 - DNA, 23 bp, Homo sapiens
tgtctggttcatgcttattttgg

SEQ ID NO: 8008569 - DNA, 22 bp, Homo sapiens
tgtctggtttgaagtccatgat

SEQ ID NO: 8008570 - DNA, 22 bp, Homo sapiens
tgtctgtcagatattaagtttc

SEQ ID NO: 8008571 - DNA, 20 bp, Homo sapiens
tgtctgtatgcagtcatata

SEQ ID NO: 8008572 - DNA, 22 bp, Homo sapiens
tgtctgtcatcagggatatcct

SEQ ID NO: 8008573 - DNA, 17 bp, Homo sapiens
tgtctgtcatcagttcc

SEQ ID NO: 8008574 - DNA, 22 bp, Homo sapiens
tgtctgtcagcagtgggtcagg

SEQ ID NO: 8008575 - DNA, 22 bp, Homo sapiens
tgtctgtcagatattaagtttc

SEQ ID NO: 8008576 - DNA, 22 bp, Homo sapiens
tgtctgtcagtataggcaggtg

SEQ ID NO: 8008577 - DNA, 22 bp, Homo sapiens
tgtctgtcagtataggcaggtg

SEQ ID NO: 8008578 - DNA, 22 bp, Homo sapiens
tgtctgtccactcactgtggag

SEQ ID NO: 8008579 - DNA, 17 bp, Homo sapiens
tgtctgtcatcagttcc

SEQ ID NO: 8008580 - DNA, 22 bp, Homo sapiens
tgtctgtccatctgtctgggac

SEQ ID NO: 8008581 - DNA, 22 bp, Homo sapiens
tgtctgtccatctgtctgggac

SEQ ID NO: 8008582 - DNA, 22 bp, Homo sapiens
tgtctgtctgcaagccagaaag

SEQ ID NO: 8008583 - DNA, 22 bp, Homo sapiens
tgtctgtctccctgtgggcccc

SEQ ID NO: 8008584 - DNA, 22 bp, Homo sapiens
tgtctgtcggatgcaatttgta

SEQ ID NO: 8008585 - DNA, 22 bp, Homo sapiens
tgtctgtccttgtttggtatca

SEQ ID NO: 8008586 - DNA, 22 bp, Homo sapiens
tgtctgtcctgcttccttggac

SEQ ID NO: 8008587 - DNA, 22 bp, Homo sapiens
tgtctgtctgcacagctcatgg

SEQ ID NO: 8008588 - DNA, 22 bp, Homo sapiens
tgtctgtctgcacagctcatgg

SEQ ID NO: 8008589 - DNA, 22 bp, Homo sapiens
cctggctgaggggccaaggacc

SEQ ID NO: 8008590 - DNA, 21 bp, Homo sapiens
cctggctgcacagttgctggt

SEQ ID NO: 8008591 - DNA, 22 bp, Homo sapiens
cctggctgaggggccaaggacc

SEQ ID NO: 8008592 - DNA, 22 bp, Homo sapiens
cctggctgaggggccaaggacc

SEQ ID NO: 8008593 - DNA, 22 bp, Homo sapiens
cctggctgaggggccaaggacc

SEQ ID NO: 8008594 - DNA, 22 bp, Homo sapiens
cctggctgaggggccaaggacc

SEQ ID NO: 8008595 - DNA, 22 bp, Homo sapiens
cctggctgagcctccaggaaga

SEQ ID NO: 8008596 - DNA, 22 bp, Homo sapiens
cctggctgagcctccaggaaga

SEQ ID NO: 8008597 - DNA, 22 bp, Homo sapiens
cctggctgagggacctcgggta

SEQ ID NO: 8008598 - DNA, 22 bp, Homo sapiens
cctggctgagggacctcgggta

SEQ ID NO: 8008599 - DNA, 22 bp, Homo sapiens
cctggctgagggacctcgggta

SEQ ID NO: 8008600 - DNA, 22 bp, Homo sapiens
cctggctgagggacctcgggta

SEQ ID NO: 8008601 - DNA, 22 bp, Homo sapiens
cctggctgagggacctcgggta

SEQ ID NO: 8008602 - DNA, 22 bp, Homo sapiens
cctggctgagggacctcgggta

SEQ ID NO: 8008603 - DNA, 21 bp, Homo sapiens
cctggctgcacagttgctggt

SEQ ID NO: 8008604 - DNA, 21 bp, Homo sapiens
cctggctgcacagttgctggt

SEQ ID NO: 8008605 - DNA, 21 bp, Homo sapiens
cctggctgcacagttgctggt

SEQ ID NO: 8008606 - DNA, 23 bp, Homo sapiens
tgtctggggcgccagaagagaga

SEQ ID NO: 8008607 - DNA, 22 bp, Homo sapiens
tgtctggggaactgtgcatcca

SEQ ID NO: 8008608 - DNA, 21 bp, Homo sapiens
cctggctgcacagttgctggt

SEQ ID NO: 8008609 - DNA, 23 bp, Homo sapiens
tgtctggggcgccagaagagaga

SEQ ID NO: 8008610 - DNA, 22 bp, Homo sapiens
tgtctggggaactgtgcatcca

SEQ ID NO: 8008611 - DNA, 22 bp, Homo sapiens
tgtctgggggttctgaaagctg

SEQ ID NO: 8008612 - DNA, 22 bp, Homo sapiens
tgtctgggttttgggtcatatt

SEQ ID NO: 8008613 - DNA, 22 bp, Homo sapiens
tgtctggtgggttgacaggcag

SEQ ID NO: 8008614 - DNA, 22 bp, Homo sapiens
tgtctgggttcaaaacctggct

SEQ ID NO: 8008615 - DNA, 22 bp, Homo sapiens
tgtctgggtcacccctcctggc

SEQ ID NO: 8008616 - DNA, 22 bp, Homo sapiens
tgtctgggtcacccctcctggc

SEQ ID NO: 8008617 - DNA, 22 bp, Homo sapiens
tgtctgggttcaaaacctggct

SEQ ID NO: 8008618 - DNA, 22 bp, Homo sapiens
tgtctgggtcacccctcctggc

SEQ ID NO: 8008619 - DNA, 22 bp, Homo sapiens
tgtctgggtcacccctcctggc

SEQ ID NO: 8008620 - DNA, 22 bp, Homo sapiens
cctggctcttcgggagtttgtt

SEQ ID NO: 8008621 - DNA, 22 bp, Homo sapiens
cctggctcttctgtgtcagccc

SEQ ID NO: 8008622 - DNA, 22 bp, Homo sapiens
cctggctcttctgtgtcagccc

SEQ ID NO: 8008623 - DNA, 22 bp, Homo sapiens
cctggctcttctgtgtcagccc

SEQ ID NO: 8008624 - DNA, 22 bp, Homo sapiens
cctggctcttctgtgtcagccc

SEQ ID NO: 8008625 - DNA, 22 bp, Homo sapiens
cctggctcttcagaggttccta

SEQ ID NO: 8008626 - DNA, 19 bp, Homo sapiens
cctggctctgagcccagcc

SEQ ID NO: 8008627 - DNA, 22 bp, Homo sapiens
cctggctcttcgggagtttgtt

SEQ ID NO: 8008628 - DNA, 22 bp, Homo sapiens
cctggctcttcgggagtttgtt

SEQ ID NO: 8008629 - DNA, 19 bp, Homo sapiens
cctggctctgagcccagcc

SEQ ID NO: 8008630 - DNA, 19 bp, Homo sapiens
cctggctctgagcccagcc

SEQ ID NO: 8008631 - DNA, 19 bp, Homo sapiens
cctggctctgagcccagcc

SEQ ID NO: 8008632 - DNA, 19 bp, Homo sapiens
cctggctctgagcccagcc

SEQ ID NO: 8008633 - DNA, 19 bp, Homo sapiens
cctggctctgagcccagcc

SEQ ID NO: 8008634 - DNA, 19 bp, Homo sapiens
cctggctctgagcccagcc

SEQ ID NO: 8008635 - DNA, 22 bp, Homo sapiens
cctggctctgaagtccacatca

SEQ ID NO: 8008636 - DNA, 23 bp, Homo sapiens
cctggctgacctgaaggtgtagt

SEQ ID NO: 8008637 - DNA, 22 bp, Homo sapiens
cctggctgaaccaatgaagtgg

SEQ ID NO: 8008638 - DNA, 22 bp, Homo sapiens
cctggctgaaccaatgaagtgg

SEQ ID NO: 8008639 - DNA, 22 bp, Homo sapiens
cctggctgaacaaagtccctcc

SEQ ID NO: 8008640 - DNA, 22 bp, Homo sapiens
cctggctcttctgtgtcagccc

SEQ ID NO: 8008641 - DNA, 22 bp, Homo sapiens
cctggctcttctgtgtcagccc

SEQ ID NO: 8008642 - DNA, 22 bp, Homo sapiens
cctggctgaacaaagtccctcc

SEQ ID NO: 8008643 - DNA, 22 bp, Homo sapiens
cctggctgaacaaagtccctcc

SEQ ID NO: 8008644 - DNA, 22 bp, Homo sapiens
tgtgccatgaggctctgatatg

SEQ ID NO: 8008645 - DNA, 22 bp, Homo sapiens
tgtgccatctgatataagagcc

SEQ ID NO: 8008646 - DNA, 22 bp, Homo sapiens
tgtgccatctgatataagagcc

SEQ ID NO: 8008647 - DNA, 22 bp, Homo sapiens
tgtgccataggcagcgtggcca

SEQ ID NO: 8008648 - DNA, 22 bp, Homo sapiens
tgtgccattgagaggtttcaga

SEQ ID NO: 8008649 - DNA, 23 bp, Homo sapiens
tgtgccattgaggctgaggctca

SEQ ID NO: 8008650 - DNA, 23 bp, Homo sapiens
tgtgccattgaggctgaggctca

SEQ ID NO: 8008651 - DNA, 23 bp, Homo sapiens
tgtgccattgaggctgaggctca

SEQ ID NO: 8008652 - DNA, 23 bp, Homo sapiens
tgtgccattgaggctgaggctca

SEQ ID NO: 8008653 - DNA, 22 bp, Homo sapiens
tgtgccatttctattctgcagc

SEQ ID NO: 8008654 - DNA, 22 bp, Homo sapiens
tgtgccatttctattctgcagc

SEQ ID NO: 8008655 - DNA, 22 bp, Homo sapiens
tgtgccagtcatccagatgtgt

SEQ ID NO: 8008656 - DNA, 21 bp, Homo sapiens
tgtgccagggatggggagccc

SEQ ID NO: 8008657 - DNA, 22 bp, Homo sapiens
tgtgccaggggccgcttgcctt

SEQ ID NO: 8008658 - DNA, 22 bp, Homo sapiens
tgtgccagggcctccaaaagcc

SEQ ID NO: 8008659 - DNA, 22 bp, Homo sapiens
tgtgccaggccctggggaccaa

SEQ ID NO: 8008660 - DNA, 22 bp, Homo sapiens
tgtgccaggccctggggaccaa

SEQ ID NO: 8008661 - DNA, 21 bp, Homo sapiens
tgtgccagggatggggagccc

SEQ ID NO: 8008662 - DNA, 22 bp, Homo sapiens
tgtgccaggccggggcaggaca

SEQ ID NO: 8008663 - DNA, 22 bp, Homo sapiens
tgtgcccagactgcctcagtga

SEQ ID NO: 8008664 - DNA, 22 bp, Homo sapiens
tgtgcccagactgcctcagtga

SEQ ID NO: 8008665 - DNA, 22 bp, Homo sapiens
tgtgccattgagaggtttcaga

SEQ ID NO: 8008666 - DNA, 22 bp, Homo sapiens
tgtgcccatccctctggagtgt

SEQ ID NO: 8008667 - DNA, 22 bp, Homo sapiens
tgtgcccatccctctggagtgt

SEQ ID NO: 8008668 - DNA, 20 bp, Homo sapiens
tgtgcccagcagaggctgcc

SEQ ID NO: 8008669 - DNA, 20 bp, Homo sapiens
tgtgcccagcagaggctgcc

SEQ ID NO: 8008670 - DNA, 20 bp, Homo sapiens
tgtgcccagcagaggctgcc

SEQ ID NO: 8008671 - DNA, 22 bp, Homo sapiens
tgtgcccatccctctggagtgt

SEQ ID NO: 8008672 - DNA, 22 bp, Homo sapiens
tgtgcccatccctctggagtgt

SEQ ID NO: 8008673 - DNA, 22 bp, Homo sapiens
tgtgcccatccctctggagtgt

SEQ ID NO: 8008674 - DNA, 22 bp, Homo sapiens
tgtgcccatccctctggagtgt

SEQ ID NO: 8008675 - DNA, 22 bp, Homo sapiens
tgtgcccattacacagaggcat

SEQ ID NO: 8008676 - DNA, 22 bp, Homo sapiens
tgtgcttcttgcagctcctgta

SEQ ID NO: 8008677 - DNA, 22 bp, Homo sapiens
tgtgcttctgcagagactattt

SEQ ID NO: 8008678 - DNA, 22 bp, Homo sapiens
tgtgcttctcacatcactgttg

SEQ ID NO: 8008679 - DNA, 22 bp, Homo sapiens
tgtgcttctgcagagactattt

SEQ ID NO: 8008680 - DNA, 22 bp, Homo sapiens
tgtgcttctcacatcactgttg

SEQ ID NO: 8008681 - DNA, 22 bp, Homo sapiens
tgtgcttctctttctcacttaa

SEQ ID NO: 8008682 - DNA, 22 bp, Homo sapiens
tgtgctgtcagtatcaagggat

SEQ ID NO: 8008683 - DNA, 22 bp, Homo sapiens
tgtgctgtcagtatcaagggat

SEQ ID NO: 8008684 - DNA, 22 bp, Homo sapiens
tgtgctgtgggactcaggctcc

SEQ ID NO: 8008685 - DNA, 22 bp, Homo sapiens
tgtgctgtggaagtttagagaa

SEQ ID NO: 8008686 - DNA, 22 bp, Homo sapiens
tgtgcttctcacatcactgttg

SEQ ID NO: 8008687 - DNA, 22 bp, Homo sapiens
tgtgcttcatcacttctcagtt

SEQ ID NO: 8008688 - DNA, 22 bp, Homo sapiens
tgtgcccattacacagaggcat

SEQ ID NO: 8008689 - DNA, 22 bp, Homo sapiens
tgtgctgggaaatggcaggata

SEQ ID NO: 8008690 - DNA, 22 bp, Homo sapiens
tgtgctgggaaatggcaggata

SEQ ID NO: 8008691 - DNA, 22 bp, Homo sapiens
tgtgctgggaaatggcaggata

SEQ ID NO: 8008692 - DNA, 22 bp, Homo sapiens
tgtgctgggagatagagggagg

SEQ ID NO: 8008693 - DNA, 22 bp, Homo sapiens
tgtgctgggagatagagggagg

SEQ ID NO: 8008694 - DNA, 22 bp, Homo sapiens
tgtgctgggagatagagggagg

SEQ ID NO: 8008695 - DNA, 22 bp, Homo sapiens
tgtgctgggagatagagggagg

SEQ ID NO: 8008696 - DNA, 22 bp, Homo sapiens
tgtgctgggaaatggcaggata

SEQ ID NO: 8008697 - DNA, 22 bp, Homo sapiens
tgtgctggtacatgtgaggatg

SEQ ID NO: 8008698 - DNA, 22 bp, Homo sapiens
tgtgctggtacatgtgaggatg

SEQ ID NO: 8008699 - DNA, 22 bp, Homo sapiens
tgtgctggggtccagctgagcc

SEQ ID NO: 8008700 - DNA, 22 bp, Homo sapiens
tgtgctggggtccagctgagcc

SEQ ID NO: 8008701 - DNA, 22 bp, Homo sapiens
tgtgctggtacatgtgaggatg

SEQ ID NO: 8008702 - DNA, 22 bp, Homo sapiens
tgtgctgggagatagagggagg

SEQ ID NO: 8008703 - DNA, 22 bp, Homo sapiens
tgtgctggggtccagctgagcc

SEQ ID NO: 8008704 - DNA, 22 bp, Homo sapiens
tgtgctggggtccagctgagcc

SEQ ID NO: 8008705 - DNA, 22 bp, Homo sapiens
tgtgctggggtccagctgagcc

SEQ ID NO: 8008706 - DNA, 22 bp, Homo sapiens
tgtgctggggtccagctgagcc

SEQ ID NO: 8008707 - DNA, 22 bp, Homo sapiens
tgtgctggggtccagctgagcc

SEQ ID NO: 8008708 - DNA, 21 bp, Homo sapiens
cctgggagatcagctgccttc

SEQ ID NO: 8008709 - DNA, 21 bp, Homo sapiens
cctgggagatcagctgccttc

SEQ ID NO: 8008710 - DNA, 21 bp, Homo sapiens
cctgggagatcagctgccttc

SEQ ID NO: 8008711 - DNA, 21 bp, Homo sapiens
cctgggagatcagctgccttc

SEQ ID NO: 8008712 - DNA, 21 bp, Homo sapiens
cctgggagatcagctgccttc

SEQ ID NO: 8008713 - DNA, 21 bp, Homo sapiens
cctgggagatcagctgccttc

SEQ ID NO: 8008714 - DNA, 21 bp, Homo sapiens
cctgggagatcagctgccttc

SEQ ID NO: 8008715 - DNA, 22 bp, Homo sapiens
cctgggagccaagcctctgtgt

SEQ ID NO: 8008716 - DNA, 22 bp, Homo sapiens
cctgggagccaagcctctgtgt

SEQ ID NO: 8008717 - DNA, 22 bp, Homo sapiens
cctgggagccaagcctctgtgt

SEQ ID NO: 8008718 - DNA, 22 bp, Homo sapiens
cctgggagccaagcctctgtgt

SEQ ID NO: 8008719 - DNA, 22 bp, Homo sapiens
cctgggagccgactgactgtgc

SEQ ID NO: 8008720 - DNA, 22 bp, Homo sapiens
tgtgccagcctctggctgtgtc

SEQ ID NO: 8008721 - DNA, 22 bp, Homo sapiens
tgtgccagcctctggctgtgtc

SEQ ID NO: 8008722 - DNA, 22 bp, Homo sapiens
tgtgccaggcacttgcccaggc

SEQ ID NO: 8008723 - DNA, 22 bp, Homo sapiens
tgtgccaggcacttgcccaggc

SEQ ID NO: 8008724 - DNA, 22 bp, Homo sapiens
tgtgccagcctctggctgtgtc

SEQ ID NO: 8008725 - DNA, 22 bp, Homo sapiens
tgtgccagcctctggctgtgtc

SEQ ID NO: 8008726 - DNA, 22 bp, Homo sapiens
cctgggagagtctgtggtctcc

SEQ ID NO: 8008727 - DNA, 22 bp, Homo sapiens
cctgggagagtctgtggtctcc

SEQ ID NO: 8008728 - DNA, 22 bp, Homo sapiens
cctgggagagtctgtggtctcc

SEQ ID NO: 8008729 - DNA, 22 bp, Homo sapiens
cctgggagagtctgtggtctcc

SEQ ID NO: 8008730 - DNA, 22 bp, Homo sapiens
cctgggagagctgcccgggtga

SEQ ID NO: 8008731 - DNA, 22 bp, Homo sapiens
cctgggagagccatctgtggcc

SEQ ID NO: 8008732 - DNA, 22 bp, Homo sapiens
cctgggagagccatctgtggcc

SEQ ID NO: 8008733 - DNA, 22 bp, Homo sapiens
cctgggagagccatctgtggcc

SEQ ID NO: 8008734 - DNA, 20 bp, Homo sapiens
cctgggaaggcagccccagc

SEQ ID NO: 8008735 - DNA, 22 bp, Homo sapiens
cctgggaagcccatagcagctt

SEQ ID NO: 8008736 - DNA, 22 bp, Homo sapiens
cctgggaagaccggcagtgggg

SEQ ID NO: 8008737 - DNA, 22 bp, Homo sapiens
cctgggaagcccatagcagctt

SEQ ID NO: 8008738 - DNA, 22 bp, Homo sapiens
cctggcttccatatggcacata

SEQ ID NO: 8008739 - DNA, 18 bp, Homo sapiens
cctggcttccatcttggt

SEQ ID NO: 8008740 - DNA, 22 bp, Homo sapiens
cctggcttcctggagctcacaa

SEQ ID NO: 8008741 - DNA, 22 bp, Homo sapiens
cctggcttcctggagctcacaa

SEQ ID NO: 8008742 - DNA, 22 bp, Homo sapiens
cctggcttccatatggcacata

SEQ ID NO: 8008743 - DNA, 21 bp, Homo sapiens
cctggcttcagggtgcactgg

SEQ ID NO: 8008744 - DNA, 23 bp, Homo sapiens
cctggcttcattctcttagggtg

SEQ ID NO: 8008745 - DNA, 22 bp, Homo sapiens
cctggctgtttgagcggggaat

SEQ ID NO: 8008746 - DNA, 22 bp, Homo sapiens
cctggcttatttttatagcagt

SEQ ID NO: 8008747 - DNA, 22 bp, Homo sapiens
cctggcttagaggttgcctttc

SEQ ID NO: 8008748 - DNA, 21 bp, Homo sapiens
cctggcttcagggtgcactgg

SEQ ID NO: 8008749 - DNA, 21 bp, Homo sapiens
cctggcttcagggtgcactgg

SEQ ID NO: 8008750 - DNA, 22 bp, Homo sapiens
cctggcttatttttatagcagt

SEQ ID NO: 8008751 - DNA, 22 bp, Homo sapiens
cctggcttcagcattgccctct

SEQ ID NO: 8008752 - DNA, 22 bp, Homo sapiens
cctggctgtggcggtgctctca

SEQ ID NO: 8008753 - DNA, 22 bp, Homo sapiens
cctggctgtggcggtgctctca

SEQ ID NO: 8008754 - DNA, 22 bp, Homo sapiens
cctggctgtggcggtgctctca

SEQ ID NO: 8008755 - DNA, 22 bp, Homo sapiens
cctggctgtggcggtgctctca

SEQ ID NO: 8008756 - DNA, 22 bp, Homo sapiens
cctggctgtggcggtgctctca

SEQ ID NO: 8008757 - DNA, 22 bp, Homo sapiens
cctggctgtggcggtgctctca

SEQ ID NO: 8008758 - DNA, 22 bp, Homo sapiens
cctggctgtgtgaccttggcaa

SEQ ID NO: 8008759 - DNA, 22 bp, Homo sapiens
cctggctgtgtgaccttggcaa

SEQ ID NO: 8008760 - DNA, 22 bp, Homo sapiens
cctggctgtgtgaccttggcaa

SEQ ID NO: 8008761 - DNA, 22 bp, Homo sapiens
cctggctgtgtgaccttggcaa

SEQ ID NO: 8008762 - DNA, 22 bp, Homo sapiens
cctggctgtgtgaccttggcaa

SEQ ID NO: 8008763 - DNA, 22 bp, Homo sapiens
cctggctgtttatttcggggct

SEQ ID NO: 8008764 - DNA, 22 bp, Homo sapiens
cctggctgtttgagcggggaat

SEQ ID NO: 8008765 - DNA, 22 bp, Homo sapiens
cctggctttgcggatttacagg

SEQ ID NO: 8008766 - DNA, 18 bp, Homo sapiens
cctggcttttctacttgc

SEQ ID NO: 8008767 - DNA, 20 bp, Homo sapiens
cctggctttgcatctgtgat

SEQ ID NO: 8008768 - DNA, 22 bp, Homo sapiens
cctggcttttgtttataaattc

SEQ ID NO: 8008769 - DNA, 23 bp, Homo sapiens
cctgggaaaactgctgatcttgc

SEQ ID NO: 8008770 - DNA, 18 bp, Homo sapiens
cctggcttttctacttgc

SEQ ID NO: 8008771 - DNA, 22 bp, Homo sapiens
cctggcttttgttcccggcgtc

SEQ ID NO: 8008772 - DNA, 22 bp, Homo sapiens
cctggcttttgtttataaattc

SEQ ID NO: 8008773 - DNA, 22 bp, Homo sapiens
cctgggaagaccggcagtgggg

SEQ ID NO: 8008774 - DNA, 22 bp, Homo sapiens
cctgggaagaccggcagtgggg

SEQ ID NO: 8008775 - DNA, 22 bp, Homo sapiens
cctgggaacagtgggttggctc

SEQ ID NO: 8008776 - DNA, 22 bp, Homo sapiens
cctgggaacagtgggttggctc

SEQ ID NO: 8008777 - DNA, 22 bp, Homo sapiens
cctgggaaagtgaggtcattat

SEQ ID NO: 8008778 - DNA, 22 bp, Homo sapiens
cctgggaacagcagagtcctgg

SEQ ID NO: 8008779 - DNA, 20 bp, Homo sapiens
cctggctttgcagcatgaga

SEQ ID NO: 8008780 - DNA, 20 bp, Homo sapiens
cctggctttgcagcatgaga

SEQ ID NO: 8008781 - DNA, 20 bp, Homo sapiens
cctggctttgcagcatgaga

SEQ ID NO: 8008782 - DNA, 22 bp, Homo sapiens
cctggctttctcatttacaggc

SEQ ID NO: 8008783 - DNA, 22 bp, Homo sapiens
cctggctttgaccttgctgttt

SEQ ID NO: 8008784 - DNA, 22 bp, Homo sapiens
cctggcttctgggtctgtgaga

SEQ ID NO: 8008785 - DNA, 22 bp, Homo sapiens
cctggctttagctgccttccct

SEQ ID NO: 8008786 - DNA, 22 bp, Homo sapiens
cctggctttctcatttacaggc

SEQ ID NO: 8008787 - DNA, 22 bp, Homo sapiens
cctggctttgaccttgctgttt

SEQ ID NO: 8008788 - DNA, 22 bp, Homo sapiens
cctggcttctataccaccaggt

SEQ ID NO: 8008789 - DNA, 22 bp, Homo sapiens
cctggcttctataccaccaggt

SEQ ID NO: 8008790 - DNA, 22 bp, Homo sapiens
cctggcttctataccaccaggt

SEQ ID NO: 8008791 - DNA, 22 bp, Homo sapiens
cctggcttccttcatgacctgg

SEQ ID NO: 8008792 - DNA, 22 bp, Homo sapiens
cctggcttctgggtctgtgaga

SEQ ID NO: 8008793 - DNA, 22 bp, Homo sapiens
cctggcttctgggtctgtgaga

SEQ ID NO: 8008794 - DNA, 22 bp, Homo sapiens
cctggcttctcaccttgttctg

SEQ ID NO: 8008795 - DNA, 22 bp, Homo sapiens
cctggcttctctgcattgttct

SEQ ID NO: 8008796 - DNA, 22 bp, Homo sapiens
cctggctgtgcattgccggccc

SEQ ID NO: 8008797 - DNA, 22 bp, Homo sapiens
cctggctgtgcattgccggccc

SEQ ID NO: 8008798 - DNA, 22 bp, Homo sapiens
cctggctgtgcattgccggccc

SEQ ID NO: 8008799 - DNA, 19 bp, Homo sapiens
cctggctgtgaagcctgca

SEQ ID NO: 8008800 - DNA, 23 bp, Homo sapiens
cctggctgtggatttgggcctgc

SEQ ID NO: 8008801 - DNA, 22 bp, Homo sapiens
cctggctgtgcattgccggccc

SEQ ID NO: 8008802 - DNA, 22 bp, Homo sapiens
cctggctgtgcattgccggccc

SEQ ID NO: 8008803 - DNA, 23 bp, Homo sapiens
cctggctgtggatttgggcctgc

SEQ ID NO: 8008804 - DNA, 23 bp, Homo sapiens
cctggctgtggatttgggcctgc

SEQ ID NO: 8008805 - DNA, 22 bp, Homo sapiens
cctggctgtggcggtgctctca

SEQ ID NO: 8008806 - DNA, 23 bp, Homo sapiens
cctggctgtggatttgggcctgc

SEQ ID NO: 8008807 - DNA, 19 bp, Homo sapiens
cctggctgtgaagcctgca

SEQ ID NO: 8008808 - DNA, 19 bp, Homo sapiens
cctggctgtgaagcctgca

SEQ ID NO: 8008809 - DNA, 19 bp, Homo sapiens
cctggctgtgaagcctgca

SEQ ID NO: 8008810 - DNA, 19 bp, Homo sapiens
cctggctgtgaagcctgca

SEQ ID NO: 8008811 - DNA, 22 bp, Homo sapiens
cctggctgctgtcactgaccat

SEQ ID NO: 8008812 - DNA, 22 bp, Homo sapiens
cctggctggttgtctgattcta

SEQ ID NO: 8008813 - DNA, 22 bp, Homo sapiens
cctggctgctgtcactgaccat

SEQ ID NO: 8008814 - DNA, 22 bp, Homo sapiens
cctggctgctgtcactgaccat

SEQ ID NO: 8008815 - DNA, 22 bp, Homo sapiens
cctggctgctgtcactgaccat

SEQ ID NO: 8008816 - DNA, 22 bp, Homo sapiens
cctggctgctctgatgagcgcc

SEQ ID NO: 8008817 - DNA, 22 bp, Homo sapiens
cctggctgctctgatgagcgcc

SEQ ID NO: 8008818 - DNA, 22 bp, Homo sapiens
cctggctgctctgatgagcgcc

SEQ ID NO: 8008819 - DNA, 22 bp, Homo sapiens
cctggctgctatagcagcatgt

SEQ ID NO: 8008820 - DNA, 22 bp, Homo sapiens
cctggctgctatagcagcatgt

SEQ ID NO: 8008821 - DNA, 22 bp, Homo sapiens
cctggctgcattttgctggatg

SEQ ID NO: 8008822 - DNA, 22 bp, Homo sapiens
cctggctgcattttgctggatg

SEQ ID NO: 8008823 - DNA, 22 bp, Homo sapiens
cctggctgcccatggaccctct

SEQ ID NO: 8008824 - DNA, 22 bp, Homo sapiens
cctggctgcccatggaccctct

SEQ ID NO: 8008825 - DNA, 22 bp, Homo sapiens
cctggctgcattttgctggatg

SEQ ID NO: 8008826 - DNA, 22 bp, Homo sapiens
cctggctgcattttgctggatg

SEQ ID NO: 8008827 - DNA, 22 bp, Homo sapiens
cctggctgcattttgctggatg

SEQ ID NO: 8008828 - DNA, 22 bp, Homo sapiens
cctggctgcattttgctggatg

SEQ ID NO: 8008829 - DNA, 22 bp, Homo sapiens
cctggctgcattttgctggatg

SEQ ID NO: 8008830 - DNA, 20 bp, Homo sapiens
cctggctgcattcaggacgg

SEQ ID NO: 8008831 - DNA, 22 bp, Homo sapiens
cctggctgccttgtgttgatct

SEQ ID NO: 8008832 - DNA, 22 bp, Homo sapiens
cctggctgccgagtgtgcagcg

SEQ ID NO: 8008833 - DNA, 22 bp, Homo sapiens
cctggctgctatagcagcatgt

SEQ ID NO: 8008834 - DNA, 22 bp, Homo sapiens
cctggctgctatagcagcatgt

SEQ ID NO: 8008835 - DNA, 22 bp, Homo sapiens
cctggctgctatagcagcatgt

SEQ ID NO: 8008836 - DNA, 22 bp, Homo sapiens
cctggctgccgagtgtgcagcg

SEQ ID NO: 8008837 - DNA, 22 bp, Homo sapiens
cctggctgccgagtgtgcagcg

SEQ ID NO: 8008838 - DNA, 22 bp, Homo sapiens
cctggctgccgagtgtgcagcg

SEQ ID NO: 8008839 - DNA, 22 bp, Homo sapiens
cctggctgccgagtgtgcagcg

SEQ ID NO: 8008840 - DNA, 22 bp, Homo sapiens
cctggctgccgagtgtgcagcg

SEQ ID NO: 8008841 - DNA, 22 bp, Homo sapiens
cctggctgccgagtgtgcagcg

SEQ ID NO: 8008842 - DNA, 22 bp, Homo sapiens
cctggctgccgagtgtgcagcg

SEQ ID NO: 8008843 - DNA, 22 bp, Homo sapiens
cctggctgcccatggaccctct

SEQ ID NO: 8008844 - DNA, 22 bp, Homo sapiens
gttggccagcacagcttgcaag

SEQ ID NO: 8008845 - DNA, 22 bp, Homo sapiens
gttggccagcacagcttgcaag

SEQ ID NO: 8008846 - DNA, 22 bp, Homo sapiens
gttggccagagatgctgatata

SEQ ID NO: 8008847 - DNA, 22 bp, Homo sapiens
gttggccagagatgctgatata

SEQ ID NO: 8008848 - DNA, 22 bp, Homo sapiens
gttggcagaaagctttcgatcg

SEQ ID NO: 8008849 - DNA, 22 bp, Homo sapiens
gttggaaatggtttctatccct

SEQ ID NO: 8008850 - DNA, 22 bp, Homo sapiens
gttggagtgcagcttgtgcgat

SEQ ID NO: 8008851 - DNA, 22 bp, Homo sapiens
gttggagtgcagcttgtgcgat

SEQ ID NO: 8008852 - DNA, 22 bp, Homo sapiens
gttggcactactccttgcttaa

SEQ ID NO: 8008853 - DNA, 22 bp, Homo sapiens
gttggagtgcagcttgtgcgat

SEQ ID NO: 8008854 - DNA, 22 bp, Homo sapiens
gttggcaagtgttccttcctct

SEQ ID NO: 8008855 - DNA, 22 bp, Homo sapiens
gttggagattaaagagtggggt

SEQ ID NO: 8008856 - DNA, 22 bp, Homo sapiens
gttggagattaaagagtggggt

SEQ ID NO: 8008857 - DNA, 22 bp, Homo sapiens
gttggaagaagactgtaaatta

SEQ ID NO: 8008858 - DNA, 22 bp, Homo sapiens
gttggaaatggtttctatccct

SEQ ID NO: 8008859 - DNA, 22 bp, Homo sapiens
gttggaaatgcagagtctcaga

SEQ ID NO: 8008860 - DNA, 22 bp, Homo sapiens
gttggccatcgctatgacaaga

SEQ ID NO: 8008861 - DNA, 22 bp, Homo sapiens
gttggccatcgctatgacaaga

SEQ ID NO: 8008862 - DNA, 22 bp, Homo sapiens
gttggccaggctggtctcaatc

SEQ ID NO: 8008863 - DNA, 22 bp, Homo sapiens
gttggccaggctggtctcaaac

SEQ ID NO: 8008864 - DNA, 22 bp, Homo sapiens
gttggccattaattggaggaca

SEQ ID NO: 8008865 - DNA, 22 bp, Homo sapiens
gttggccattaattggaggaca

SEQ ID NO: 8008866 - DNA, 22 bp, Homo sapiens
gttggctatgagagctttagtg

SEQ ID NO: 8008867 - DNA, 22 bp, Homo sapiens
gttggctatgagagctttagtg

SEQ ID NO: 8008868 - DNA, 22 bp, Homo sapiens
gttggctatgagagctttagtg

SEQ ID NO: 8008869 - DNA, 22 bp, Homo sapiens
gttggctatagggagatggggc

SEQ ID NO: 8008870 - DNA, 22 bp, Homo sapiens
gttggctatagggagatggggc

SEQ ID NO: 8008871 - DNA, 22 bp, Homo sapiens
gttggctatagggagatggggc

SEQ ID NO: 8008872 - DNA, 22 bp, Homo sapiens
gttggccattaattggaggaca

SEQ ID NO: 8008873 - DNA, 22 bp, Homo sapiens
gttgggaagcagatggatgagc

SEQ ID NO: 8008874 - DNA, 22 bp, Homo sapiens
gttgggaaggcaagaagtagaa

SEQ ID NO: 8008875 - DNA, 22 bp, Homo sapiens
gttgggaacatgacctaatggt

SEQ ID NO: 8008876 - DNA, 22 bp, Homo sapiens
gttgggaagcagatggatgagc

SEQ ID NO: 8008877 - DNA, 22 bp, Homo sapiens
gttggctatgagagctttagtg

SEQ ID NO: 8008878 - DNA, 22 bp, Homo sapiens
gttggctatgagagctttagtg

SEQ ID NO: 8008879 - DNA, 22 bp, Homo sapiens
gttggctcattttatagacagc

SEQ ID NO: 8008880 - DNA, 22 bp, Homo sapiens
gttggctatgagagctttagtg

SEQ ID NO: 8008881 - DNA, 22 bp, Homo sapiens
gttggctcattttatagacagc

SEQ ID NO: 8008882 - DNA, 22 bp, Homo sapiens
gttggctcattttatagacagc

SEQ ID NO: 8008883 - DNA, 22 bp, Homo sapiens
caggaaagtctgtaaaggaacc

SEQ ID NO: 8008884 - DNA, 22 bp, Homo sapiens
caggaaaggtgtgtcatgatgg

SEQ ID NO: 8008885 - DNA, 22 bp, Homo sapiens
caggaaagtctgtaaaggaacc

SEQ ID NO: 8008886 - DNA, 22 bp, Homo sapiens
caggaaaggtagtcacaatgta

SEQ ID NO: 8008887 - DNA, 22 bp, Homo sapiens
caggaaaggtagtcacaatgta

SEQ ID NO: 8008888 - DNA, 22 bp, Homo sapiens
caggaaaggtgtgtcatgatgg

SEQ ID NO: 8008889 - DNA, 22 bp, Homo sapiens
caggaaaggtgtgtcatgatgg

SEQ ID NO: 8008890 - DNA, 22 bp, Homo sapiens
caggaaaggtgtgtcatgatgg

SEQ ID NO: 8008891 - DNA, 22 bp, Homo sapiens
caggaaagggatgggctgccac

SEQ ID NO: 8008892 - DNA, 22 bp, Homo sapiens
caggaaaggtagtcacaatgta

SEQ ID NO: 8008893 - DNA, 22 bp, Homo sapiens
caggaaaggtagtcacaatgta

SEQ ID NO: 8008894 - DNA, 22 bp, Homo sapiens
caggaaaggtagtcacaatgta

SEQ ID NO: 8008895 - DNA, 22 bp, Homo sapiens
caggaaaggtagtcacaatgta

SEQ ID NO: 8008896 - DNA, 22 bp, Homo sapiens
caggaaagggatgggctgccac

SEQ ID NO: 8008897 - DNA, 22 bp, Homo sapiens
caggaaagggatgggctgccac

SEQ ID NO: 8008898 - DNA, 22 bp, Homo sapiens
caggaaagggatgggctgccac

SEQ ID NO: 8008899 - DNA, 22 bp, Homo sapiens
caggaaagggatgggctgccac

SEQ ID NO: 8008900 - DNA, 22 bp, Homo sapiens
caggaaagggatgggctgccac

SEQ ID NO: 8008901 - DNA, 22 bp, Homo sapiens
caggaaagggatgggctgccac

SEQ ID NO: 8008902 - DNA, 22 bp, Homo sapiens
caggaaagccgagtgccatagg

SEQ ID NO: 8008903 - DNA, 22 bp, Homo sapiens
caggaaagccgagtgccatagg

SEQ ID NO: 8008904 - DNA, 22 bp, Homo sapiens
caggaaagccgagtgccatagg

SEQ ID NO: 8008905 - DNA, 22 bp, Homo sapiens
gttgggaagcagatggatgagc

SEQ ID NO: 8008906 - DNA, 22 bp, Homo sapiens
caggaaataaaaagtatcttct

SEQ ID NO: 8008907 - DNA, 22 bp, Homo sapiens
caggaaataaaaagtatcttct

SEQ ID NO: 8008908 - DNA, 22 bp, Homo sapiens
caggaaataaaaagtatcttct

SEQ ID NO: 8008909 - DNA, 22 bp, Homo sapiens
caggaaataaatggtaatgcat

SEQ ID NO: 8008910 - DNA, 22 bp, Homo sapiens
caggaaataaatggtaatgcat

SEQ ID NO: 8008911 - DNA, 22 bp, Homo sapiens
caggaaatagacactgtatgat

SEQ ID NO: 8008912 - DNA, 22 bp, Homo sapiens
caggaaataaaaagtatcttct

SEQ ID NO: 8008913 - DNA, 22 bp, Homo sapiens
caggaaatagttcagtcaaact

SEQ ID NO: 8008914 - DNA, 22 bp, Homo sapiens
caggaaataggcgtttgtcctc

SEQ ID NO: 8008915 - DNA, 22 bp, Homo sapiens
caggaaatagttcagtcaaact

SEQ ID NO: 8008916 - DNA, 22 bp, Homo sapiens
caggaaatagttcagtcaaact

SEQ ID NO: 8008917 - DNA, 22 bp, Homo sapiens
caggaaataggcgtttgtcctc

SEQ ID NO: 8008918 - DNA, 22 bp, Homo sapiens
caggaaataaatggtaatgcat

SEQ ID NO: 8008919 - DNA, 22 bp, Homo sapiens
caggaaataggcgtttgtcctc

SEQ ID NO: 8008920 - DNA, 22 bp, Homo sapiens
caggaaatggctgaataaattc

SEQ ID NO: 8008921 - DNA, 22 bp, Homo sapiens
caggaaatggctgaataaattc

SEQ ID NO: 8008922 - DNA, 22 bp, Homo sapiens
caggaaatggggtttagttatt

SEQ ID NO: 8008923 - DNA, 22 bp, Homo sapiens
caggaaatggggtttagttatt

SEQ ID NO: 8008924 - DNA, 22 bp, Homo sapiens
caggaaatggctgaataaattc

SEQ ID NO: 8008925 - DNA, 22 bp, Homo sapiens
caggaaattcaagagaggctgc

SEQ ID NO: 8008926 - DNA, 22 bp, Homo sapiens
caggaaattcaagagaggctgc

SEQ ID NO: 8008927 - DNA, 22 bp, Homo sapiens
caggaaattcccagaaggactg

SEQ ID NO: 8008928 - DNA, 22 bp, Homo sapiens
caggaaattcccagaaggactg

SEQ ID NO: 8008929 - DNA, 22 bp, Homo sapiens
caggaaattagtctctctgttg

SEQ ID NO: 8008930 - DNA, 22 bp, Homo sapiens
caggaaattagtctctctgttg

SEQ ID NO: 8008931 - DNA, 22 bp, Homo sapiens
caggaaattcaagagaggctgc

SEQ ID NO: 8008932 - DNA, 23 bp, Homo sapiens
caggaaatgttcttgaagcctga

SEQ ID NO: 8008933 - DNA, 23 bp, Homo sapiens
caggaaatgttcttgaagcctga

SEQ ID NO: 8008934 - DNA, 22 bp, Homo sapiens
caggaaatgggtcgttttataa

SEQ ID NO: 8008935 - DNA, 22 bp, Homo sapiens
caggaaatgggtcgttttataa

SEQ ID NO: 8008936 - DNA, 22 bp, Homo sapiens
caggaaatgtataattttataa

SEQ ID NO: 8008937 - DNA, 22 bp, Homo sapiens
caggaaatgggtcgttttataa

SEQ ID NO: 8008938 - DNA, 22 bp, Homo sapiens
caggaaatggggtttagttatt

SEQ ID NO: 8008939 - DNA, 22 bp, Homo sapiens
caggaaatggggtttagttatt

SEQ ID NO: 8008940 - DNA, 22 bp, Homo sapiens
caggaaattgcaacagtctgag

SEQ ID NO: 8008941 - DNA, 22 bp, Homo sapiens
caggaaattgcaacagtctgag

SEQ ID NO: 8008942 - DNA, 22 bp, Homo sapiens
caggaaattgcaacagtctgag

SEQ ID NO: 8008943 - DNA, 22 bp, Homo sapiens
caggaaattggctatttgggat

SEQ ID NO: 8008944 - DNA, 22 bp, Homo sapiens
caggaaattgcaacagtctgag

SEQ ID NO: 8008945 - DNA, 22 bp, Homo sapiens
caggaaattcttttgtttgtgc

SEQ ID NO: 8008946 - DNA, 22 bp, Homo sapiens
caggaaattctttttaacagaa

SEQ ID NO: 8008947 - DNA, 22 bp, Homo sapiens
caggaaattcttttgtttgtgc

SEQ ID NO: 8008948 - DNA, 22 bp, Homo sapiens
caggaaattctttttaacagaa

SEQ ID NO: 8008949 - DNA, 22 bp, Homo sapiens
caggaaattctttttaacagaa

SEQ ID NO: 8008950 - DNA, 22 bp, Homo sapiens
caggaaattctttttaacagaa

SEQ ID NO: 8008951 - DNA, 22 bp, Homo sapiens
caggaaattctttttaacagaa

SEQ ID NO: 8008952 - DNA, 22 bp, Homo sapiens
caggaaatttaagagtgtacaa

SEQ ID NO: 8008953 - DNA, 22 bp, Homo sapiens
caggaaatttaagagtgtacaa

SEQ ID NO: 8008954 - DNA, 22 bp, Homo sapiens
caggaaatttaagagtgtacaa

SEQ ID NO: 8008955 - DNA, 22 bp, Homo sapiens
caggaaattggctatttgggat

SEQ ID NO: 8008956 - DNA, 22 bp, Homo sapiens
caggaaattggctatttgggat

SEQ ID NO: 8008957 - DNA, 22 bp, Homo sapiens
caggaaatttatgttctactta

SEQ ID NO: 8008958 - DNA, 22 bp, Homo sapiens
caggaaatttaagagtgtacaa

SEQ ID NO: 8008959 - DNA, 22 bp, Homo sapiens
caggaaatttaagagtgtacaa

SEQ ID NO: 8008960 - DNA, 22 bp, Homo sapiens
caggaaatttatgttctactta

SEQ ID NO: 8008961 - DNA, 22 bp, Homo sapiens
caggaaattttgtgatctgttc

SEQ ID NO: 8008962 - DNA, 22 bp, Homo sapiens
caggaaatttatgttctactta

SEQ ID NO: 8008963 - DNA, 22 bp, Homo sapiens
caggaaattttgtgatctgttc

SEQ ID NO: 8008964 - DNA, 22 bp, Homo sapiens
caggaaattttgtgatctgttc

SEQ ID NO: 8008965 - DNA, 22 bp, Homo sapiens
caggaacaactcccagcatctc

SEQ ID NO: 8008966 - DNA, 22 bp, Homo sapiens
caggaacaactcccagcatctc

SEQ ID NO: 8008967 - DNA, 22 bp, Homo sapiens
caggaacaactcccagcatctc

SEQ ID NO: 8008968 - DNA, 22 bp, Homo sapiens
caggaacaactcccagcatctc

SEQ ID NO: 8008969 - DNA, 22 bp, Homo sapiens
caggaacaactcccagcatctc

SEQ ID NO: 8008970 - DNA, 22 bp, Homo sapiens
caggaacaatcttactactatt

SEQ ID NO: 8008971 - DNA, 22 bp, Homo sapiens
caggaacaatcttactactatt

SEQ ID NO: 8008972 - DNA, 22 bp, Homo sapiens
caggaacaaggcctatgggact

SEQ ID NO: 8008973 - DNA, 22 bp, Homo sapiens
caggaacaatacctcttgccag

SEQ ID NO: 8008974 - DNA, 22 bp, Homo sapiens
caggaacaatacctcttgccag

SEQ ID NO: 8008975 - DNA, 22 bp, Homo sapiens
caggaacaatatctgtcctggt

SEQ ID NO: 8008976 - DNA, 22 bp, Homo sapiens
caggaacaatatctgtcctggt

SEQ ID NO: 8008977 - DNA, 22 bp, Homo sapiens
caggaacaatatctgtcctggt

SEQ ID NO: 8008978 - DNA, 22 bp, Homo sapiens
caggaacaatatctgtcctggt

SEQ ID NO: 8008979 - DNA, 22 bp, Homo sapiens
gttcttcaccaaggtcagaggc

SEQ ID NO: 8008980 - DNA, 22 bp, Homo sapiens
gttcttcaccaaggtcagaggc

SEQ ID NO: 8008981 - DNA, 22 bp, Homo sapiens
gttcttcacattttggggtcac

SEQ ID NO: 8008982 - DNA, 22 bp, Homo sapiens
gttcttcacatttcattgagga

SEQ ID NO: 8008983 - DNA, 22 bp, Homo sapiens
gttcttaaccttctttggttgt

SEQ ID NO: 8008984 - DNA, 22 bp, Homo sapiens
gttcttaagaccacaataaaaa

SEQ ID NO: 8008985 - DNA, 21 bp, Homo sapiens
gttcttagttatattctcaat

SEQ ID NO: 8008986 - DNA, 22 bp, Homo sapiens
gttctgtctgagcaccacagga

SEQ ID NO: 8008987 - DNA, 22 bp, Homo sapiens
gttctgtcctcactgcaggcct

SEQ ID NO: 8008988 - DNA, 22 bp, Homo sapiens
gttctgtcctcctaccaggcat

SEQ ID NO: 8008989 - DNA, 19 bp, Homo sapiens
gttctgtgtcctggaggaa

SEQ ID NO: 8008990 - DNA, 22 bp, Homo sapiens
gttcttaaagattcatcaagca

SEQ ID NO: 8008991 - DNA, 19 bp, Homo sapiens
gttctgtgtcctggaggaa

SEQ ID NO: 8008992 - DNA, 22 bp, Homo sapiens
gttctgtagtcatagagcaatt

SEQ ID NO: 8008993 - DNA, 22 bp, Homo sapiens
gttctgtcacacactggtactt

SEQ ID NO: 8008994 - DNA, 22 bp, Homo sapiens
gttctgtcacacactggtactt

SEQ ID NO: 8008995 - DNA, 22 bp, Homo sapiens
gttctgtcctcactgcaggcct

SEQ ID NO: 8008996 - DNA, 22 bp, Homo sapiens
gttctgggtgatgaggttggct

SEQ ID NO: 8008997 - DNA, 22 bp, Homo sapiens
gttctgggttcaaaccccggcc

SEQ ID NO: 8008998 - DNA, 22 bp, Homo sapiens
gttctgggttctgggttattgg

SEQ ID NO: 8008999 - DNA, 22 bp, Homo sapiens
gttctgggagatcttgagcttc

SEQ ID NO: 8009000 - DNA, 22 bp, Homo sapiens
gttctgggagatcttgagcttc

SEQ ID NO: 8009001 - DNA, 22 bp, Homo sapiens
gttctgggaaggtggacctgtt

SEQ ID NO: 8009002 - DNA, 22 bp, Homo sapiens
gttctgggtagatgtatctttt

SEQ ID NO: 8009003 - DNA, 22 bp, Homo sapiens
gttctgggtctggacacacaga

SEQ ID NO: 8009004 - DNA, 22 bp, Homo sapiens
gttcttcaggctgagcagagag

SEQ ID NO: 8009005 - DNA, 22 bp, Homo sapiens
gttcttcagccctcaggtccta

SEQ ID NO: 8009006 - DNA, 22 bp, Homo sapiens
gttcttcagattccatttcagt

SEQ ID NO: 8009007 - DNA, 22 bp, Homo sapiens
gttgctgaaggcatgccagaga

SEQ ID NO: 8009008 - DNA, 22 bp, Homo sapiens
gttgctgaaagccctgactggc

SEQ ID NO: 8009009 - DNA, 22 bp, Homo sapiens
gttcttcagaggggaaagaacc

SEQ ID NO: 8009010 - DNA, 22 bp, Homo sapiens
gttcttcagaggtcggaggcta

SEQ ID NO: 8009011 - DNA, 22 bp, Homo sapiens
gttcttcaccaaggtcagaggc

SEQ ID NO: 8009012 - DNA, 22 bp, Homo sapiens
gttcttcagaggggaaagaacc

SEQ ID NO: 8009013 - DNA, 22 bp, Homo sapiens
gttgctgcaaaggagtgtaggt

SEQ ID NO: 8009014 - DNA, 22 bp, Homo sapiens
gttgctggaagctatggtccag

SEQ ID NO: 8009015 - DNA, 22 bp, Homo sapiens
gttgctggaagctatggtccag

SEQ ID NO: 8009016 - DNA, 22 bp, Homo sapiens
gttgctgggagcagggatcctg

SEQ ID NO: 8009017 - DNA, 22 bp, Homo sapiens
gttgctgggagcagggatcctg

SEQ ID NO: 8009018 - DNA, 22 bp, Homo sapiens
gttgctgattaacactttgagt

SEQ ID NO: 8009019 - DNA, 20 bp, Homo sapiens
gttggaaagttcactctgct

SEQ ID NO: 8009020 - DNA, 20 bp, Homo sapiens
gttggaaagttcactctgct

SEQ ID NO: 8009021 - DNA, 22 bp, Homo sapiens
gttggaaatgcagagtctcaga

SEQ ID NO: 8009022 - DNA, 22 bp, Homo sapiens
gttggaaatgcagagtctcaga

SEQ ID NO: 8009023 - DNA, 20 bp, Homo sapiens
gttgctttagtctggtttgg

SEQ ID NO: 8009024 - DNA, 22 bp, Homo sapiens
gttcacaggttctctttctaag

SEQ ID NO: 8009025 - DNA, 22 bp, Homo sapiens
gttcacaggttctctttctaag

SEQ ID NO: 8009026 - DNA, 22 bp, Homo sapiens
gttcacagtgttttctttgcat

SEQ ID NO: 8009027 - DNA, 22 bp, Homo sapiens
gttcacagtgttttctttgcat

SEQ ID NO: 8009028 - DNA, 22 bp, Homo sapiens
gttcacagtctacatagtaaag

SEQ ID NO: 8009029 - DNA, 22 bp, Homo sapiens
gttcacagtctacatagtaaag

SEQ ID NO: 8009030 - DNA, 22 bp, Homo sapiens
gttcacagtctacatagtaaag

SEQ ID NO: 8009031 - DNA, 22 bp, Homo sapiens
gttcacaggttctctttctaag

SEQ ID NO: 8009032 - DNA, 22 bp, Homo sapiens
gttcacagggttaggaatcact

SEQ ID NO: 8009033 - DNA, 22 bp, Homo sapiens
gttcacagggttaggaatcact

SEQ ID NO: 8009034 - DNA, 22 bp, Homo sapiens
gttcacagggatccttgttgaa

SEQ ID NO: 8009035 - DNA, 22 bp, Homo sapiens
gttcacagggatccttgttgaa

SEQ ID NO: 8009036 - DNA, 20 bp, Homo sapiens
gttcacaggcttcctttcag

SEQ ID NO: 8009037 - DNA, 20 bp, Homo sapiens
gttcacaggcttcctttcag

SEQ ID NO: 8009038 - DNA, 22 bp, Homo sapiens
gttcacagcttcttaggtcata

SEQ ID NO: 8009039 - DNA, 22 bp, Homo sapiens
gttcacagcttcttaggtcata

SEQ ID NO: 8009040 - DNA, 22 bp, Homo sapiens
gttcacagcttgtgttttctct

SEQ ID NO: 8009041 - DNA, 22 bp, Homo sapiens
gttcccaggccctgggctctcc

SEQ ID NO: 8009042 - DNA, 22 bp, Homo sapiens
gttcccaggccctgggctctcc

SEQ ID NO: 8009043 - DNA, 22 bp, Homo sapiens
gttcacagttttatacctgaga

SEQ ID NO: 8009044 - DNA, 22 bp, Homo sapiens
gttcacagtttctaatcccagc

SEQ ID NO: 8009045 - DNA, 22 bp, Homo sapiens
gttcccatacagtatcagtgct

SEQ ID NO: 8009046 - DNA, 22 bp, Homo sapiens
gttcccaggccctgggctctcc

SEQ ID NO: 8009047 - DNA, 22 bp, Homo sapiens
gttccccttgtgttgttgccca

SEQ ID NO: 8009048 - DNA, 22 bp, Homo sapiens
gttcccattgccctagcttgta

SEQ ID NO: 8009049 - DNA, 22 bp, Homo sapiens
gttcccattgccctagcttgta

SEQ ID NO: 8009050 - DNA, 22 bp, Homo sapiens
gttcccatgcctccaagcttca

SEQ ID NO: 8009051 - DNA, 22 bp, Homo sapiens
gttcccatgcctccaagcttca

SEQ ID NO: 8009052 - DNA, 22 bp, Homo sapiens
gttcccatcagggatgagggtg

SEQ ID NO: 8009053 - DNA, 22 bp, Homo sapiens
gttcccaggccctgggctctcc

SEQ ID NO: 8009054 - DNA, 22 bp, Homo sapiens
gttcacagttttatacctgaga

SEQ ID NO: 8009055 - DNA, 22 bp, Homo sapiens
gttcacagttttatacctgaga

SEQ ID NO: 8009056 - DNA, 22 bp, Homo sapiens
gttcacagttttatacctgaga

SEQ ID NO: 8009057 - DNA, 22 bp, Homo sapiens
gttcacagtttctaatcccagc

SEQ ID NO: 8009058 - DNA, 22 bp, Homo sapiens
gttcacagttcagcctgtaaca

SEQ ID NO: 8009059 - DNA, 22 bp, Homo sapiens
gttcacagttcagcctgtaaca

SEQ ID NO: 8009060 - DNA, 22 bp, Homo sapiens
gttcacagttaggacaactgct

SEQ ID NO: 8009061 - DNA, 22 bp, Homo sapiens
gttcacagttaggacaactgct

SEQ ID NO: 8009062 - DNA, 22 bp, Homo sapiens
gttcacagtgttttctttgcat

SEQ ID NO: 8009063 - DNA, 22 bp, Homo sapiens
gttcacagtgttttctttgcat

SEQ ID NO: 8009064 - DNA, 22 bp, Homo sapiens
gttcacagttaggacaactgct

SEQ ID NO: 8009065 - DNA, 22 bp, Homo sapiens
gttctgggaaggtggacctgtt

SEQ ID NO: 8009066 - DNA, 22 bp, Homo sapiens
gttctgggaaggtggacctgtt

SEQ ID NO: 8009067 - DNA, 22 bp, Homo sapiens
gttctggagtggtgccaggcct

SEQ ID NO: 8009068 - DNA, 22 bp, Homo sapiens
gttcctgggaggcatgggctgg

SEQ ID NO: 8009069 - DNA, 22 bp, Homo sapiens
gttcctgagaaataaagagaga

SEQ ID NO: 8009070 - DNA, 22 bp, Homo sapiens
gttcctgaagggactggtgcag

SEQ ID NO: 8009071 - DNA, 22 bp, Homo sapiens
gttcctgagaaataaagagaga

SEQ ID NO: 8009072 - DNA, 21 bp, Homo sapiens
gttcccttattggggcaggca

SEQ ID NO: 8009073 - DNA, 22 bp, Homo sapiens
gttcccttctcatggggtccag

SEQ ID NO: 8009074 - DNA, 22 bp, Homo sapiens
gttccctttcgtatggactggg

SEQ ID NO: 8009075 - DNA, 22 bp, Homo sapiens
gttccgcttcatatttggagtc

SEQ ID NO: 8009076 - DNA, 22 bp, Homo sapiens
gttcctaaatctggaggacctc

SEQ ID NO: 8009077 - DNA, 22 bp, Homo sapiens
gttcctcaaaaaggagagcccc

SEQ ID NO: 8009078 - DNA, 22 bp, Homo sapiens
gttcctaagcactgtgcattct

SEQ ID NO: 8009079 - DNA, 22 bp, Homo sapiens
gttcctaaccagcagagaaaca

SEQ ID NO: 8009080 - DNA, 22 bp, Homo sapiens
gttcctaaatttgaaggacttt

SEQ ID NO: 8009081 - DNA, 22 bp, Homo sapiens
gttcctaaccagcagagaaaca

SEQ ID NO: 8009082 - DNA, 22 bp, Homo sapiens
caggaagattgtggaggtggtt

SEQ ID NO: 8009083 - DNA, 22 bp, Homo sapiens
caggaagattgtggaggtggtt

SEQ ID NO: 8009084 - DNA, 22 bp, Homo sapiens
caggaagattgtggaggtggtt

SEQ ID NO: 8009085 - DNA, 22 bp, Homo sapiens
caggaagattgtggaggtggtt

SEQ ID NO: 8009086 - DNA, 22 bp, Homo sapiens
caggaagattgtggaggtggtt

SEQ ID NO: 8009087 - DNA, 22 bp, Homo sapiens
caggaagcaccagcccggcccc

SEQ ID NO: 8009088 - DNA, 22 bp, Homo sapiens
caggaagcacagtgaggagacc

SEQ ID NO: 8009089 - DNA, 22 bp, Homo sapiens
caggaagcacagtgaggagacc

SEQ ID NO: 8009090 - DNA, 22 bp, Homo sapiens
caggaagcacagtgaggagacc

SEQ ID NO: 8009091 - DNA, 22 bp, Homo sapiens
caggaagcaagtgattttcttg

SEQ ID NO: 8009092 - DNA, 22 bp, Homo sapiens
caggaagattagaccaagagct

SEQ ID NO: 8009093 - DNA, 22 bp, Homo sapiens
caggaagattagaccaagagct

SEQ ID NO: 8009094 - DNA, 22 bp, Homo sapiens
caggaagattagaccaagagct

SEQ ID NO: 8009095 - DNA, 22 bp, Homo sapiens
caggaagattagaccaagagct

SEQ ID NO: 8009096 - DNA, 22 bp, Homo sapiens
caggaagaggtggggctaaagt

SEQ ID NO: 8009097 - DNA, 22 bp, Homo sapiens
caggaagattagaccaagagct

SEQ ID NO: 8009098 - DNA, 22 bp, Homo sapiens
caggaagattagaccaagagct

SEQ ID NO: 8009099 - DNA, 22 bp, Homo sapiens
caggaagattagaccaagagct

SEQ ID NO: 8009100 - DNA, 22 bp, Homo sapiens
caggaagattagaccaagagct

SEQ ID NO: 8009101 - DNA, 22 bp, Homo sapiens
caggaagattgtggaggtggtt

SEQ ID NO: 8009102 - DNA, 22 bp, Homo sapiens
caggaagattagaccaagagct

SEQ ID NO: 8009103 - DNA, 22 bp, Homo sapiens
caggaagattagaccaagagct

SEQ ID NO: 8009104 - DNA, 22 bp, Homo sapiens
caggaagattagaccaagagct

SEQ ID NO: 8009105 - DNA, 22 bp, Homo sapiens
gtttacatattttaattggtga

SEQ ID NO: 8009106 - DNA, 22 bp, Homo sapiens
gtttacatgcagaaaatcaatg

SEQ ID NO: 8009107 - DNA, 22 bp, Homo sapiens
gtttacatgcagaaaatcaatg

SEQ ID NO: 8009108 - DNA, 22 bp, Homo sapiens
gtttacagtactcacttgcatt

SEQ ID NO: 8009109 - DNA, 22 bp, Homo sapiens
gtttacagtactcacttgcatt

SEQ ID NO: 8009110 - DNA, 22 bp, Homo sapiens
gtttacagtggcttcattggat

SEQ ID NO: 8009111 - DNA, 22 bp, Homo sapiens
gtttacagtactcacttgcatt

SEQ ID NO: 8009112 - DNA, 22 bp, Homo sapiens
gtttacagtggcttcattggat

SEQ ID NO: 8009113 - DNA, 22 bp, Homo sapiens
gtttacagagacagaaagtagt

SEQ ID NO: 8009114 - DNA, 22 bp, Homo sapiens
gtttacagagacagaaagtagt

SEQ ID NO: 8009115 - DNA, 18 bp, Homo sapiens
gtttacacattctagaaa

SEQ ID NO: 8009116 - DNA, 23 bp, Homo sapiens
caggaagcagatggggtagaaga

SEQ ID NO: 8009117 - DNA, 23 bp, Homo sapiens
caggaagcagatggggtagaaga

SEQ ID NO: 8009118 - DNA, 22 bp, Homo sapiens
gtttacaacatgccaactgggc

SEQ ID NO: 8009119 - DNA, 21 bp, Homo sapiens
gtttacaaggctttgctcctg

SEQ ID NO: 8009120 - DNA, 22 bp, Homo sapiens
caggaacagctgacctgacaat

SEQ ID NO: 8009121 - DNA, 22 bp, Homo sapiens
caggaacagctgacctgacaat

SEQ ID NO: 8009122 - DNA, 22 bp, Homo sapiens
caggaacagcaccaggagctag

SEQ ID NO: 8009123 - DNA, 22 bp, Homo sapiens
caggaacagcaccaggagctag

SEQ ID NO: 8009124 - DNA, 22 bp, Homo sapiens
caggaacagcaccaggagctag

SEQ ID NO: 8009125 - DNA, 22 bp, Homo sapiens
caggaacagcaccaggagctag

SEQ ID NO: 8009126 - DNA, 22 bp, Homo sapiens
caggaacagcaccaggagctag

SEQ ID NO: 8009127 - DNA, 22 bp, Homo sapiens
caggaacagagtggcattgtct

SEQ ID NO: 8009128 - DNA, 22 bp, Homo sapiens
caggaacaggctgatgggcagg

SEQ ID NO: 8009129 - DNA, 22 bp, Homo sapiens
caggaacaggctgatgggcagg

SEQ ID NO: 8009130 - DNA, 22 bp, Homo sapiens
caggaacaggctgatgggcagg

SEQ ID NO: 8009131 - DNA, 22 bp, Homo sapiens
caggaacagggtgtcctggcag

SEQ ID NO: 8009132 - DNA, 22 bp, Homo sapiens
caggaacagggtgtcctggcag

SEQ ID NO: 8009133 - DNA, 22 bp, Homo sapiens
caggaacaggggagtgaacctg

SEQ ID NO: 8009134 - DNA, 22 bp, Homo sapiens
caggaacagggtgtcctggcag

SEQ ID NO: 8009135 - DNA, 22 bp, Homo sapiens
caggaacaggggagtgaacctg

SEQ ID NO: 8009136 - DNA, 22 bp, Homo sapiens
caggaacacaagttcagggatg

SEQ ID NO: 8009137 - DNA, 22 bp, Homo sapiens
caggaacacaagttcagggatg

SEQ ID NO: 8009138 - DNA, 22 bp, Homo sapiens
caggaacacaagttcagggatg

SEQ ID NO: 8009139 - DNA, 22 bp, Homo sapiens
caggaacaatgtaagtctcatt

SEQ ID NO: 8009140 - DNA, 22 bp, Homo sapiens
caggaacaatgtaagtctcatt

SEQ ID NO: 8009141 - DNA, 22 bp, Homo sapiens
caggaacaatgtaagtctcatt

SEQ ID NO: 8009142 - DNA, 22 bp, Homo sapiens
caggaacaatgtaagtctcatt

SEQ ID NO: 8009143 - DNA, 22 bp, Homo sapiens
caggaacaatgtaagtctcatt

SEQ ID NO: 8009144 - DNA, 22 bp, Homo sapiens
caggaacacaatgagtctcaaa

SEQ ID NO: 8009145 - DNA, 22 bp, Homo sapiens
caggaacacaatgagtctcaaa

SEQ ID NO: 8009146 - DNA, 22 bp, Homo sapiens
caggaacacaatgagtctcaaa

SEQ ID NO: 8009147 - DNA, 22 bp, Homo sapiens
caggaacacaatgagtctcaaa

SEQ ID NO: 8009148 - DNA, 22 bp, Homo sapiens
caggaacacaatgagtctcaaa

SEQ ID NO: 8009149 - DNA, 22 bp, Homo sapiens
caggaacagagtggcattgtct

SEQ ID NO: 8009150 - DNA, 22 bp, Homo sapiens
caggaacagagtggcattgtct

SEQ ID NO: 8009151 - DNA, 22 bp, Homo sapiens
caggaacagagtggcattgtct

SEQ ID NO: 8009152 - DNA, 22 bp, Homo sapiens
caggaacacctgcagctagtgg

SEQ ID NO: 8009153 - DNA, 22 bp, Homo sapiens
caggaacacctgcagctagtgg

SEQ ID NO: 8009154 - DNA, 22 bp, Homo sapiens
caggaacatttaaccacagggt

SEQ ID NO: 8009155 - DNA, 22 bp, Homo sapiens
caggaacattgtagaattgaaa

SEQ ID NO: 8009156 - DNA, 22 bp, Homo sapiens
caggaacattgtagaattgaaa

SEQ ID NO: 8009157 - DNA, 21 bp, Homo sapiens
caggaacattctttacattta

SEQ ID NO: 8009158 - DNA, 22 bp, Homo sapiens
caggaacattgtagaattgaaa

SEQ ID NO: 8009159 - DNA, 21 bp, Homo sapiens
caggaacattctttacattta

SEQ ID NO: 8009160 - DNA, 22 bp, Homo sapiens
caggaacatgttggaaagaaat

SEQ ID NO: 8009161 - DNA, 19 bp, Homo sapiens
caggaacatggagggaggg

SEQ ID NO: 8009162 - DNA, 22 bp, Homo sapiens
caggaacatgtctccaattaga

SEQ ID NO: 8009163 - DNA, 22 bp, Homo sapiens
caggaacatgtctccaattaga

SEQ ID NO: 8009164 - DNA, 22 bp, Homo sapiens
caggaacatgttggaaagaaat

SEQ ID NO: 8009165 - DNA, 22 bp, Homo sapiens
caggaacatgtctccaattaga

SEQ ID NO: 8009166 - DNA, 22 bp, Homo sapiens
caggaacatgttggaaagaaat

SEQ ID NO: 8009167 - DNA, 22 bp, Homo sapiens
caggaacatgttggaaagaaat

SEQ ID NO: 8009168 - DNA, 22 bp, Homo sapiens
caggaagaggtatcaccgagca

SEQ ID NO: 8009169 - DNA, 22 bp, Homo sapiens
caggaagaggtatcaccgagca

SEQ ID NO: 8009170 - DNA, 22 bp, Homo sapiens
caggaagaggtatcaccgagca

SEQ ID NO: 8009171 - DNA, 22 bp, Homo sapiens
caggaagaggtatcaccgagca

SEQ ID NO: 8009172 - DNA, 22 bp, Homo sapiens
caggaagagaacatggaggctg

SEQ ID NO: 8009173 - DNA, 22 bp, Homo sapiens
caggaagaggacaggcttcccc

SEQ ID NO: 8009174 - DNA, 22 bp, Homo sapiens
caggaagaggacaggcttcccc

SEQ ID NO: 8009175 - DNA, 22 bp, Homo sapiens
caggaagaggacaggcttcccc

SEQ ID NO: 8009176 - DNA, 22 bp, Homo sapiens
caggaagaggacaggcttcccc

SEQ ID NO: 8009177 - DNA, 22 bp, Homo sapiens
gtttattattcaacttcatgtt

SEQ ID NO: 8009178 - DNA, 22 bp, Homo sapiens
gtttattattcaacttcatgtt

SEQ ID NO: 8009179 - DNA, 22 bp, Homo sapiens
gtttattattcaacttcatgtt

SEQ ID NO: 8009180 - DNA, 22 bp, Homo sapiens
gtttattattcaacttcatgtt

SEQ ID NO: 8009181 - DNA, 22 bp, Homo sapiens
gtttattattcaacttcatgtt

SEQ ID NO: 8009182 - DNA, 18 bp, Homo sapiens
gtttacattactgaatag

SEQ ID NO: 8009183 - DNA, 18 bp, Homo sapiens
gtttacattactgaatag

SEQ ID NO: 8009184 - DNA, 22 bp, Homo sapiens
gtttacattgctgtttgtgtct

SEQ ID NO: 8009185 - DNA, 22 bp, Homo sapiens
gtttattatacaacaaaagcta

SEQ ID NO: 8009186 - DNA, 22 bp, Homo sapiens
gtttattccagcaatctgctta

SEQ ID NO: 8009187 - DNA, 22 bp, Homo sapiens
gtttattccagcaatctgctta

SEQ ID NO: 8009188 - DNA, 22 bp, Homo sapiens
gtttattattcaacttcatgtt

SEQ ID NO: 8009189 - DNA, 22 bp, Homo sapiens
gtttacatgtactcattatact

SEQ ID NO: 8009190 - DNA, 22 bp, Homo sapiens
gtttacatgtactcattatact

SEQ ID NO: 8009191 - DNA, 22 bp, Homo sapiens
gtttacatgtaatgtgttattg

SEQ ID NO: 8009192 - DNA, 22 bp, Homo sapiens
gtttacatgtaatgtgttattg

SEQ ID NO: 8009193 - DNA, 22 bp, Homo sapiens
gtttacatgcatgcaagaatga

SEQ ID NO: 8009194 - DNA, 22 bp, Homo sapiens
gtttacatgtaatgtgttattg

SEQ ID NO: 8009195 - DNA, 22 bp, Homo sapiens
gtttacattaagtattagcatc

SEQ ID NO: 8009196 - DNA, 18 bp, Homo sapiens
gtttacattactgaatag

SEQ ID NO: 8009197 - DNA, 22 bp, Homo sapiens
gtttacattaagtattagcatc

SEQ ID NO: 8009198 - DNA, 22 bp, Homo sapiens
gtttacattaagtattagcatc

SEQ ID NO: 8009199 - DNA, 22 bp, Homo sapiens
gtttacattaagtattagcatc

SEQ ID NO: 8009200 - DNA, 22 bp, Homo sapiens
gtttacatgtttttctcttaca

SEQ ID NO: 8009201 - DNA, 22 bp, Homo sapiens
gtttacatgtttttctcttaca

SEQ ID NO: 8009202 - DNA, 22 bp, Homo sapiens
gtttattgataaaagctggaca

SEQ ID NO: 8009203 - DNA, 22 bp, Homo sapiens
gtttattgataaaagctggaca

SEQ ID NO: 8009204 - DNA, 22 bp, Homo sapiens
gtttattgataaaagctggaca

SEQ ID NO: 8009205 - DNA, 22 bp, Homo sapiens
gtttattgataaaagctggaca

SEQ ID NO: 8009206 - DNA, 22 bp, Homo sapiens
gtttattgataaaagctggaca

SEQ ID NO: 8009207 - DNA, 22 bp, Homo sapiens
gtttattgataaaagctggaca

SEQ ID NO: 8009208 - DNA, 22 bp, Homo sapiens
gtttattgataaaagctggaca

SEQ ID NO: 8009209 - DNA, 22 bp, Homo sapiens
gtttattgataaaagctggaca

SEQ ID NO: 8009210 - DNA, 22 bp, Homo sapiens
gtttattgataaaagctggaca

SEQ ID NO: 8009211 - DNA, 22 bp, Homo sapiens
gtttattcttcagcaacatctg

SEQ ID NO: 8009212 - DNA, 22 bp, Homo sapiens
gtttattgggtattgtggagcc

SEQ ID NO: 8009213 - DNA, 22 bp, Homo sapiens
gtttattgggtattgtggagcc

SEQ ID NO: 8009214 - DNA, 22 bp, Homo sapiens
gtttattgggtattgtggagcc

SEQ ID NO: 8009215 - DNA, 22 bp, Homo sapiens
gtttattgggtattgtggagcc

SEQ ID NO: 8009216 - DNA, 22 bp, Homo sapiens
gtttattgggtattgtggagcc

SEQ ID NO: 8009217 - DNA, 22 bp, Homo sapiens
gtttattgggtattgtggagcc

SEQ ID NO: 8009218 - DNA, 22 bp, Homo sapiens
gtttattgggtattgtggagcc

SEQ ID NO: 8009219 - DNA, 22 bp, Homo sapiens
gtttattgggtattgtggagcc

SEQ ID NO: 8009220 - DNA, 22 bp, Homo sapiens
gtttcaaagcacagctcacatt

SEQ ID NO: 8009221 - DNA, 22 bp, Homo sapiens
gtttcaaagcacagctcacatt

SEQ ID NO: 8009222 - DNA, 22 bp, Homo sapiens
gtttcctttctattgccttgat

SEQ ID NO: 8009223 - DNA, 22 bp, Homo sapiens
gtttgcatttattagtcttctg

SEQ ID NO: 8009224 - DNA, 22 bp, Homo sapiens
gtttgcattccaatttagggga

SEQ ID NO: 8009225 - DNA, 22 bp, Homo sapiens
gtttgcatttattagtcttctg

SEQ ID NO: 8009226 - DNA, 22 bp, Homo sapiens
gtttcctttaatagtgatattg

SEQ ID NO: 8009227 - DNA, 19 bp, Homo sapiens
gtttccttgggtgtaggga

SEQ ID NO: 8009228 - DNA, 22 bp, Homo sapiens
gtttcctttaatagtgatattg

SEQ ID NO: 8009229 - DNA, 22 bp, Homo sapiens
gtttgcatttcttgaactatat

SEQ ID NO: 8009230 - DNA, 22 bp, Homo sapiens
gtttcctgtttctcagcagccc

SEQ ID NO: 8009231 - DNA, 22 bp, Homo sapiens
gtttcctgtttctcagcagccc

SEQ ID NO: 8009232 - DNA, 19 bp, Homo sapiens
gtttccttgggtgtaggga

SEQ ID NO: 8009233 - DNA, 22 bp, Homo sapiens
gtttcctgtgggaactcggctg

SEQ ID NO: 8009234 - DNA, 22 bp, Homo sapiens
gtttcctgtggccacagaataa

SEQ ID NO: 8009235 - DNA, 22 bp, Homo sapiens
gtttcctgtggccacagaataa

SEQ ID NO: 8009236 - DNA, 22 bp, Homo sapiens
gtttcctgggccccaacccaga

SEQ ID NO: 8009237 - DNA, 22 bp, Homo sapiens
gtttcctgtctgctttactata

SEQ ID NO: 8009238 - DNA, 18 bp, Homo sapiens
gtttcctgtcttacgggg

SEQ ID NO: 8009239 - DNA, 22 bp, Homo sapiens
gtttcctgtctgctttactata

SEQ ID NO: 8009240 - DNA, 22 bp, Homo sapiens
gtttcctgtctgctttactata

SEQ ID NO: 8009241 - DNA, 22 bp, Homo sapiens
gtttcctggaggttatttttga

SEQ ID NO: 8009242 - DNA, 22 bp, Homo sapiens
gtttcctggaggttatttttga

SEQ ID NO: 8009243 - DNA, 22 bp, Homo sapiens
gtttcctggaggttatttttga

SEQ ID NO: 8009244 - DNA, 22 bp, Homo sapiens
gtttcctggaaactgctccact

SEQ ID NO: 8009245 - DNA, 22 bp, Homo sapiens
gtttcctggaaactgctccact

SEQ ID NO: 8009246 - DNA, 22 bp, Homo sapiens
gtttcctggaaacattaggaga

SEQ ID NO: 8009247 - DNA, 22 bp, Homo sapiens
gtttcctgaagttatttcatcc

SEQ ID NO: 8009248 - DNA, 22 bp, Homo sapiens
gtttcctgaagttatttcatcc

SEQ ID NO: 8009249 - DNA, 22 bp, Homo sapiens
gtttcctgaccctggcccagca

SEQ ID NO: 8009250 - DNA, 22 bp, Homo sapiens
gtttcctgaccctggcccagca

SEQ ID NO: 8009251 - DNA, 22 bp, Homo sapiens
gtttcctgaagttatttcatcc

SEQ ID NO: 8009252 - DNA, 22 bp, Homo sapiens
gtttcctctgctggttttcatt

SEQ ID NO: 8009253 - DNA, 22 bp, Homo sapiens
gtttcctgaaaagtaagggaca

SEQ ID NO: 8009254 - DNA, 22 bp, Homo sapiens
gtttcctgaaatagagtactgg

SEQ ID NO: 8009255 - DNA, 22 bp, Homo sapiens
gtttcctgaaatagagtactgg

SEQ ID NO: 8009256 - DNA, 22 bp, Homo sapiens
gtttcctgaaaagtaagggaca

SEQ ID NO: 8009257 - DNA, 22 bp, Homo sapiens
gtttcctctgctggttttcatt

SEQ ID NO: 8009258 - DNA, 18 bp, Homo sapiens
gtttcctgaggtgaaggg

SEQ ID NO: 8009259 - DNA, 18 bp, Homo sapiens
gtttcctgaggtgaaggg

SEQ ID NO: 8009260 - DNA, 22 bp, Homo sapiens
gtttcctgatgtgggagatctt

SEQ ID NO: 8009261 - DNA, 22 bp, Homo sapiens
gtttcctgatgtgggagatctt

SEQ ID NO: 8009262 - DNA, 22 bp, Homo sapiens
gtttcctgatgtgggagatctt

SEQ ID NO: 8009263 - DNA, 22 bp, Homo sapiens
gtttcctgactgtggaattata

SEQ ID NO: 8009264 - DNA, 22 bp, Homo sapiens
gtttcctgactgtggaattata

SEQ ID NO: 8009265 - DNA, 22 bp, Homo sapiens
gtttcctgactgtggaattata

SEQ ID NO: 8009266 - DNA, 22 bp, Homo sapiens
gtttcctgactgtggaattata

SEQ ID NO: 8009267 - DNA, 22 bp, Homo sapiens
gtttcctgaccctggcccagca

SEQ ID NO: 8009268 - DNA, 22 bp, Homo sapiens
gtttcctggaaacattaggaga

SEQ ID NO: 8009269 - DNA, 22 bp, Homo sapiens
gtttcctgcgtgtgccactcat

SEQ ID NO: 8009270 - DNA, 22 bp, Homo sapiens
gtttcctgccctgtcttatcca

SEQ ID NO: 8009271 - DNA, 22 bp, Homo sapiens
gtttcctgccctgtcttatcca

SEQ ID NO: 8009272 - DNA, 22 bp, Homo sapiens
gtttcctgccctgtcttatcca

SEQ ID NO: 8009273 - DNA, 22 bp, Homo sapiens
gtttcctgcacacgtgttatat

SEQ ID NO: 8009274 - DNA, 22 bp, Homo sapiens
gtttcctgcacacgtgttatat

SEQ ID NO: 8009275 - DNA, 22 bp, Homo sapiens
gtttcctgcacacgtgttatat

SEQ ID NO: 8009276 - DNA, 22 bp, Homo sapiens
gtttcctgcacacgtgttatat

SEQ ID NO: 8009277 - DNA, 22 bp, Homo sapiens
gtgtgtgtactctgtatataaa

SEQ ID NO: 8009278 - DNA, 22 bp, Homo sapiens
gtgtgtgtactctgtatataaa

SEQ ID NO: 8009279 - DNA, 22 bp, Homo sapiens
gtgtgtgtactctgtatataaa

SEQ ID NO: 8009280 - DNA, 22 bp, Homo sapiens
gtgtgtgtactctgtatataaa

SEQ ID NO: 8009281 - DNA, 22 bp, Homo sapiens
gtgtgtggggccttcgggtcct

SEQ ID NO: 8009282 - DNA, 22 bp, Homo sapiens
gtgtgtggcaaactgggcctgc

SEQ ID NO: 8009283 - DNA, 22 bp, Homo sapiens
gtgtgtggaaagttttccatgg

SEQ ID NO: 8009284 - DNA, 22 bp, Homo sapiens
gtgtgtgctccccaggagagct

SEQ ID NO: 8009285 - DNA, 23 bp, Homo sapiens
gtgtgtggaaagtgcatgggcct

SEQ ID NO: 8009286 - DNA, 23 bp, Homo sapiens
gtgtgtggaaagtgcatgggcct

SEQ ID NO: 8009287 - DNA, 20 bp, Homo sapiens
gtgtgtgctccatgcatgct

SEQ ID NO: 8009288 - DNA, 22 bp, Homo sapiens
gtgtgtgccatcaagagctttc

SEQ ID NO: 8009289 - DNA, 22 bp, Homo sapiens
gtgtgtgccaactttatgtgca

SEQ ID NO: 8009290 - DNA, 20 bp, Homo sapiens
gtgtgtgctccatgcatgct

SEQ ID NO: 8009291 - DNA, 22 bp, Homo sapiens
gtgtgtgctccccaggagagct

SEQ ID NO: 8009292 - DNA, 20 bp, Homo sapiens
gtgtgtgctccatgcatgct

SEQ ID NO: 8009293 - DNA, 22 bp, Homo sapiens
gtgtgtgcaagaggtttattga

SEQ ID NO: 8009294 - DNA, 22 bp, Homo sapiens
gtgtgtctttcatttcatgagg

SEQ ID NO: 8009295 - DNA, 22 bp, Homo sapiens
gtgtgtctttataagaagaggg

SEQ ID NO: 8009296 - DNA, 22 bp, Homo sapiens
gtgtgtgcaagaggtttattga

SEQ ID NO: 8009297 - DNA, 22 bp, Homo sapiens
gtgtgtgccaactttatgtgca

SEQ ID NO: 8009298 - DNA, 22 bp, Homo sapiens
gtgttttaagaaagaagctcag

SEQ ID NO: 8009299 - DNA, 22 bp, Homo sapiens
gtgttttagtgctgctgagctg

SEQ ID NO: 8009300 - DNA, 22 bp, Homo sapiens
gtgttttagtgctgctgagctg

SEQ ID NO: 8009301 - DNA, 22 bp, Homo sapiens
gtgttttatcagacaaagtata

SEQ ID NO: 8009302 - DNA, 22 bp, Homo sapiens
gtgttttatcagacaaagtata

SEQ ID NO: 8009303 - DNA, 22 bp, Homo sapiens
gtgttttatggagtcataacgt

SEQ ID NO: 8009304 - DNA, 22 bp, Homo sapiens
gtgttttatggagtcataacgt

SEQ ID NO: 8009305 - DNA, 22 bp, Homo sapiens
gtgttttatcagacaaagtata

SEQ ID NO: 8009306 - DNA, 22 bp, Homo sapiens
gtgttttaagaaagaagctcag

SEQ ID NO: 8009307 - DNA, 22 bp, Homo sapiens
gtgttttaagaaagaagctcag

SEQ ID NO: 8009308 - DNA, 22 bp, Homo sapiens
gtgttttaagaaagaagctcag

SEQ ID NO: 8009309 - DNA, 22 bp, Homo sapiens
gtgtgtgtatatatacacacac

SEQ ID NO: 8009310 - DNA, 22 bp, Homo sapiens
gtgtgtgtatatatacacacac

SEQ ID NO: 8009311 - DNA, 22 bp, Homo sapiens
gtgtgtgtactctgtatataaa

SEQ ID NO: 8009312 - DNA, 22 bp, Homo sapiens
gtgtgtgtatatatacacacac

SEQ ID NO: 8009313 - DNA, 22 bp, Homo sapiens
gtgtgtgtatatatacacacac

SEQ ID NO: 8009314 - DNA, 22 bp, Homo sapiens
gtgtttggtcagacgtccgggg

SEQ ID NO: 8009315 - DNA, 22 bp, Homo sapiens
gtgtgtgtatctgcctatcaca

SEQ ID NO: 8009316 - DNA, 22 bp, Homo sapiens
gtgtttggtcagacgtccgggg

SEQ ID NO: 8009317 - DNA, 22 bp, Homo sapiens
gtgttttattggtgcagtcaga

SEQ ID NO: 8009318 - DNA, 22 bp, Homo sapiens
gtgttttattggtgcagtcaga

SEQ ID NO: 8009319 - DNA, 22 bp, Homo sapiens
gtgttttggccattagtgtgat

SEQ ID NO: 8009320 - DNA, 22 bp, Homo sapiens
gtgttttggccattagtgtgat

SEQ ID NO: 8009321 - DNA, 20 bp, Homo sapiens
gttaaaagagtaatttgagg

SEQ ID NO: 8009322 - DNA, 22 bp, Homo sapiens
gttaaacaataactggcacaca

SEQ ID NO: 8009323 - DNA, 22 bp, Homo sapiens
gttaaacagttacatgtgctgg

SEQ ID NO: 8009324 - DNA, 22 bp, Homo sapiens
gttaaagtgatcttgtcaggtt

SEQ ID NO: 8009325 - DNA, 22 bp, Homo sapiens
gttaaataacctcatgtccgtt

SEQ ID NO: 8009326 - DNA, 22 bp, Homo sapiens
gttacaaatgccaaagctgaga

SEQ ID NO: 8009327 - DNA, 22 bp, Homo sapiens
gttaaagtgatcttgtcaggtt

SEQ ID NO: 8009328 - DNA, 22 bp, Homo sapiens
gttacaaatgccaaagctgaga

SEQ ID NO: 8009329 - DNA, 22 bp, Homo sapiens
gttacaaatgccaaagctgaga

SEQ ID NO: 8009330 - DNA, 22 bp, Homo sapiens
gttacaaatgccaaagctgaga

SEQ ID NO: 8009331 - DNA, 22 bp, Homo sapiens
gttacaaatgccaaagctgaga

SEQ ID NO: 8009332 - DNA, 22 bp, Homo sapiens
gttaaagaagaatagttccttt

SEQ ID NO: 8009333 - DNA, 22 bp, Homo sapiens
gttacaaatgtaaattctgggg

SEQ ID NO: 8009334 - DNA, 22 bp, Homo sapiens
gttacaaatgtaaattctgggg

SEQ ID NO: 8009335 - DNA, 22 bp, Homo sapiens
gttacaaatgccaaagctgaga

SEQ ID NO: 8009336 - DNA, 22 bp, Homo sapiens
gttacaagtgttcgagagtgac

SEQ ID NO: 8009337 - DNA, 22 bp, Homo sapiens
gttacaagtgagatttaggaga

SEQ ID NO: 8009338 - DNA, 22 bp, Homo sapiens
gttacaaatgtaaattctgggg

SEQ ID NO: 8009339 - DNA, 22 bp, Homo sapiens
gttacaaatgtaaattctgggg

SEQ ID NO: 8009340 - DNA, 22 bp, Homo sapiens
gttacacaggaaaacattagca

SEQ ID NO: 8009341 - DNA, 22 bp, Homo sapiens
gttacacagctaagcttctcct

SEQ ID NO: 8009342 - DNA, 22 bp, Homo sapiens
gttacacagctaagcttctcct

SEQ ID NO: 8009343 - DNA, 22 bp, Homo sapiens
gttacaatgtccttacatgaaa

SEQ ID NO: 8009344 - DNA, 22 bp, Homo sapiens
gttacaatgtccttacatgaaa

SEQ ID NO: 8009345 - DNA, 22 bp, Homo sapiens
gttacaatgtccttacatgaaa

SEQ ID NO: 8009346 - DNA, 22 bp, Homo sapiens
gttacaatgttcttcagttctg

SEQ ID NO: 8009347 - DNA, 22 bp, Homo sapiens
cagctgtggggagcttgggcca

SEQ ID NO: 8009348 - DNA, 22 bp, Homo sapiens
cagctgtgtaaacacatgtgta

SEQ ID NO: 8009349 - DNA, 22 bp, Homo sapiens
cagctgtgtaaacacatgtgta

SEQ ID NO: 8009350 - DNA, 22 bp, Homo sapiens
cagctgtgtaaacacatgtgta

SEQ ID NO: 8009351 - DNA, 22 bp, Homo sapiens
cagctgtgtaaacacatgtgta

SEQ ID NO: 8009352 - DNA, 22 bp, Homo sapiens
cagctgtgtaaacacatgtgta

SEQ ID NO: 8009353 - DNA, 22 bp, Homo sapiens
cagctgtgtaaacacatgtgta

SEQ ID NO: 8009354 - DNA, 22 bp, Homo sapiens
cagctgtgtatgagagcatgct

SEQ ID NO: 8009355 - DNA, 22 bp, Homo sapiens
cagctgtgtatgagagcatgct

SEQ ID NO: 8009356 - DNA, 22 bp, Homo sapiens
cagctgtgtatgagagcatgct

SEQ ID NO: 8009357 - DNA, 22 bp, Homo sapiens
cagctgtgtatgagagcatgct

SEQ ID NO: 8009358 - DNA, 22 bp, Homo sapiens
cagctgtgtagatgcagggtca

SEQ ID NO: 8009359 - DNA, 22 bp, Homo sapiens
cagctgtgtagatgcagggtca

SEQ ID NO: 8009360 - DNA, 22 bp, Homo sapiens
cagctgtgtagatgcagggtca

SEQ ID NO: 8009361 - DNA, 22 bp, Homo sapiens
cagctgtgtagatgcagggtca

SEQ ID NO: 8009362 - DNA, 22 bp, Homo sapiens
cagctgtgtagatgcagggtca

SEQ ID NO: 8009363 - DNA, 22 bp, Homo sapiens
cagctgtggctgccactgctcc

SEQ ID NO: 8009364 - DNA, 22 bp, Homo sapiens
cagctgtggctgccactgctcc

SEQ ID NO: 8009365 - DNA, 22 bp, Homo sapiens
cagctgtggctgccactgctcc

SEQ ID NO: 8009366 - DNA, 22 bp, Homo sapiens
cagctgtggagggaggaaatgc

SEQ ID NO: 8009367 - DNA, 22 bp, Homo sapiens
cagctgtggctgccactgctcc

SEQ ID NO: 8009368 - DNA, 22 bp, Homo sapiens
cagctgtggagggaggaaatgc

SEQ ID NO: 8009369 - DNA, 22 bp, Homo sapiens
cagctgtggctgccactgctcc

SEQ ID NO: 8009370 - DNA, 22 bp, Homo sapiens
cagctgtggctgccactgctcc

SEQ ID NO: 8009371 - DNA, 22 bp, Homo sapiens
cagctgtggctgccactgctcc

SEQ ID NO: 8009372 - DNA, 22 bp, Homo sapiens
cagctgtgggcctgacgtggca

SEQ ID NO: 8009373 - DNA, 22 bp, Homo sapiens
cagctgtggctgccactgctcc

SEQ ID NO: 8009374 - DNA, 22 bp, Homo sapiens
cagctgtggggagcttgggcca

SEQ ID NO: 8009375 - DNA, 22 bp, Homo sapiens
cagctgtggggagcttgggcca

SEQ ID NO: 8009376 - DNA, 22 bp, Homo sapiens
cagctgtggggagcttgggcca

SEQ ID NO: 8009377 - DNA, 22 bp, Homo sapiens
cagctgtgggcctgacgtggca

SEQ ID NO: 8009378 - DNA, 22 bp, Homo sapiens
cagctgtgggcctgacgtggca

SEQ ID NO: 8009379 - DNA, 22 bp, Homo sapiens
cagctgtgggcctgacgtggca

SEQ ID NO: 8009380 - DNA, 22 bp, Homo sapiens
cagctgtgggcctgacgtggca

SEQ ID NO: 8009381 - DNA, 22 bp, Homo sapiens
cagctgtgggcctgacgtggca

SEQ ID NO: 8009382 - DNA, 22 bp, Homo sapiens
cagctgtgggcctgacgtggca

SEQ ID NO: 8009383 - DNA, 22 bp, Homo sapiens
cagctgtgctgtattaagctct

SEQ ID NO: 8009384 - DNA, 22 bp, Homo sapiens
cagctgtggagatggggtgcat

SEQ ID NO: 8009385 - DNA, 22 bp, Homo sapiens
cagctgtgctgtattaagctct

SEQ ID NO: 8009386 - DNA, 22 bp, Homo sapiens
cagctgtggagatggggtgcat

SEQ ID NO: 8009387 - DNA, 22 bp, Homo sapiens
cagctgtggagatggggtgcat

SEQ ID NO: 8009388 - DNA, 22 bp, Homo sapiens
cagctgtggagggaggaaatgc

SEQ ID NO: 8009389 - DNA, 22 bp, Homo sapiens
cagctgtggagggaggaaatgc

SEQ ID NO: 8009390 - DNA, 22 bp, Homo sapiens
cagctgtggagggaggaaatgc

SEQ ID NO: 8009391 - DNA, 22 bp, Homo sapiens
cagctgtgctgattgctcagta

SEQ ID NO: 8009392 - DNA, 22 bp, Homo sapiens
cagctgtgctgattgctcagta

SEQ ID NO: 8009393 - DNA, 22 bp, Homo sapiens
cagctgtgctgattgctcagta

SEQ ID NO: 8009394 - DNA, 22 bp, Homo sapiens
cagctgtgctgattgctcagta

SEQ ID NO: 8009395 - DNA, 22 bp, Homo sapiens
cagctgtgctgattgctcagta

SEQ ID NO: 8009396 - DNA, 22 bp, Homo sapiens
cagctgtgctgtattaagctct

SEQ ID NO: 8009397 - DNA, 22 bp, Homo sapiens
cagctgtgctgtattaagctct

SEQ ID NO: 8009398 - DNA, 22 bp, Homo sapiens
cagctgtgctgattgctcagta

SEQ ID NO: 8009399 - DNA, 22 bp, Homo sapiens
cagctgtgctgattgctcagta

SEQ ID NO: 8009400 - DNA, 22 bp, Homo sapiens
cagctgtgctgattgctcagta

SEQ ID NO: 8009401 - DNA, 22 bp, Homo sapiens
cagctgtgctgattgctcagta

SEQ ID NO: 8009402 - DNA, 22 bp, Homo sapiens
cagctgtgattcctgctgtcca

SEQ ID NO: 8009403 - DNA, 22 bp, Homo sapiens
cagctgtgattcctgctgtcca

SEQ ID NO: 8009404 - DNA, 22 bp, Homo sapiens
cagctgtgattcctgctgtcca

SEQ ID NO: 8009405 - DNA, 22 bp, Homo sapiens
cagctgtgattcctgctgtcca

SEQ ID NO: 8009406 - DNA, 22 bp, Homo sapiens
cagctgtgatatgcctgcctga

SEQ ID NO: 8009407 - DNA, 22 bp, Homo sapiens
cagctgtgatatgcctgcctga

SEQ ID NO: 8009408 - DNA, 22 bp, Homo sapiens
cagctgtgatatgcctgcctga

SEQ ID NO: 8009409 - DNA, 22 bp, Homo sapiens
cagctgtgatatgcctgcctga

SEQ ID NO: 8009410 - DNA, 22 bp, Homo sapiens
cagctgtgatatgcctgcctga

SEQ ID NO: 8009411 - DNA, 22 bp, Homo sapiens
cagctgtgatatgcctgcctga

SEQ ID NO: 8009412 - DNA, 22 bp, Homo sapiens
cagctgtgagagtgcattgaag

SEQ ID NO: 8009413 - DNA, 22 bp, Homo sapiens
cagctgtgagcagccagttgcc

SEQ ID NO: 8009414 - DNA, 22 bp, Homo sapiens
cagctgtgagcagccagttgcc

SEQ ID NO: 8009415 - DNA, 22 bp, Homo sapiens
cagctgtgctagaagccacgaa

SEQ ID NO: 8009416 - DNA, 22 bp, Homo sapiens
cagctgtgctagaagccacgaa

SEQ ID NO: 8009417 - DNA, 22 bp, Homo sapiens
cagctgtgctagaagccacgaa

SEQ ID NO: 8009418 - DNA, 22 bp, Homo sapiens
cagctgtgctagaagccacgaa

SEQ ID NO: 8009419 - DNA, 22 bp, Homo sapiens
cagctgtgctagaagccacgaa

SEQ ID NO: 8009420 - DNA, 22 bp, Homo sapiens
cagctgtgctgattgctcagta

SEQ ID NO: 8009421 - DNA, 22 bp, Homo sapiens
cagctgtgctgattgctcagta

SEQ ID NO: 8009422 - DNA, 18 bp, Homo sapiens
cagctgtgccctgtttgg

SEQ ID NO: 8009423 - DNA, 22 bp, Homo sapiens
cagctgtgattcctgctgtcca

SEQ ID NO: 8009424 - DNA, 18 bp, Homo sapiens
cagctgtgccctgtttgg

SEQ ID NO: 8009425 - DNA, 22 bp, Homo sapiens
cagctgtgattcctgctgtcca

SEQ ID NO: 8009426 - DNA, 22 bp, Homo sapiens
cagctgtgattcctgctgtcca

SEQ ID NO: 8009427 - DNA, 22 bp, Homo sapiens
cagctgtgctagaagccacgaa

SEQ ID NO: 8009428 - DNA, 22 bp, Homo sapiens
cagctgtgctagaagccacgaa

SEQ ID NO: 8009429 - DNA, 22 bp, Homo sapiens
cagctgtgattcctgctgtcca

SEQ ID NO: 8009430 - DNA, 18 bp, Homo sapiens
cagctgtgccctgtttgg

SEQ ID NO: 8009431 - DNA, 22 bp, Homo sapiens
cagcttcatgacaaacagtttt

SEQ ID NO: 8009432 - DNA, 22 bp, Homo sapiens
cagcttcatgacaaacagtttt

SEQ ID NO: 8009433 - DNA, 22 bp, Homo sapiens
cagcttcatgacaaacagtttt

SEQ ID NO: 8009434 - DNA, 22 bp, Homo sapiens
cagcttcatgacaaacagtttt

SEQ ID NO: 8009435 - DNA, 22 bp, Homo sapiens
cagcttcagggacagcttcttt

SEQ ID NO: 8009436 - DNA, 22 bp, Homo sapiens
cagcttcagcgtgacaccagtg

SEQ ID NO: 8009437 - DNA, 22 bp, Homo sapiens
cagcttcagaccctgggctgca

SEQ ID NO: 8009438 - DNA, 22 bp, Homo sapiens
cagcttcagggacagcttcttt

SEQ ID NO: 8009439 - DNA, 22 bp, Homo sapiens
cagcttcagaagaagccgtgag

SEQ ID NO: 8009440 - DNA, 22 bp, Homo sapiens
cagcttcagaagaagccgtgag

SEQ ID NO: 8009441 - DNA, 22 bp, Homo sapiens
cagcttcaccagggccatggtt

SEQ ID NO: 8009442 - DNA, 22 bp, Homo sapiens
cagcttcaccagggccatggtt

SEQ ID NO: 8009443 - DNA, 22 bp, Homo sapiens
cagcttcaccagggccatggtt

SEQ ID NO: 8009444 - DNA, 22 bp, Homo sapiens
cagcttcaccagggccatggtt

SEQ ID NO: 8009445 - DNA, 20 bp, Homo sapiens
cagcttcaatgtcagcttga

SEQ ID NO: 8009446 - DNA, 22 bp, Homo sapiens
cagcttcaactgcacagtcaac

SEQ ID NO: 8009447 - DNA, 22 bp, Homo sapiens
cagcttcaactgcacagtcaac

SEQ ID NO: 8009448 - DNA, 22 bp, Homo sapiens
cagcttcaactgcacagtcaac

SEQ ID NO: 8009449 - DNA, 22 bp, Homo sapiens
cagcttcaactgcacagtcaac

SEQ ID NO: 8009450 - DNA, 22 bp, Homo sapiens
cagctgtttgggcatggccaga

SEQ ID NO: 8009451 - DNA, 22 bp, Homo sapiens
cagctgtttcagtagcgttact

SEQ ID NO: 8009452 - DNA, 22 bp, Homo sapiens
cagctgttgttatgtctgcagg

SEQ ID NO: 8009453 - DNA, 22 bp, Homo sapiens
cagctgtgtatgagagcatgct

SEQ ID NO: 8009454 - DNA, 22 bp, Homo sapiens
cagctgttgttatgtctgcagg

SEQ ID NO: 8009455 - DNA, 22 bp, Homo sapiens
cagctgttgtgtatcaggcaga

SEQ ID NO: 8009456 - DNA, 22 bp, Homo sapiens
cagcttcattgcctgatgtctt

SEQ ID NO: 8009457 - DNA, 22 bp, Homo sapiens
cagcttcatgtccaggtactgt

SEQ ID NO: 8009458 - DNA, 22 bp, Homo sapiens
cagcttccacagacttggctcg

SEQ ID NO: 8009459 - DNA, 22 bp, Homo sapiens
cagcttcccttggctgagcaga

SEQ ID NO: 8009460 - DNA, 22 bp, Homo sapiens
gtgtgtctgaagttgagtagac

SEQ ID NO: 8009461 - DNA, 22 bp, Homo sapiens
gtgtgtctgaagttgagtagac

SEQ ID NO: 8009462 - DNA, 22 bp, Homo sapiens
gtgtgtctgaagttgagtagac

SEQ ID NO: 8009463 - DNA, 22 bp, Homo sapiens
gtgtgtcttgaccaggatcgga

SEQ ID NO: 8009464 - DNA, 22 bp, Homo sapiens
gtgtgtctttataagaagaggg

SEQ ID NO: 8009465 - DNA, 22 bp, Homo sapiens
gtgtgtcttgaccaggatcgga

SEQ ID NO: 8009466 - DNA, 22 bp, Homo sapiens
cagcttctaccatcaggaaatt

SEQ ID NO: 8009467 - DNA, 21 bp, Homo sapiens
gtgtgtctaatgtagtggaaa

SEQ ID NO: 8009468 - DNA, 22 bp, Homo sapiens
gtgtgtctcccaagaaggccca

SEQ ID NO: 8009469 - DNA, 22 bp, Homo sapiens
cagcttccgaccgggggctgca

SEQ ID NO: 8009470 - DNA, 22 bp, Homo sapiens
cagcttctaaagtgtgaagcca

SEQ ID NO: 8009471 - DNA, 22 bp, Homo sapiens
cagcttccgaccgggggctgca

SEQ ID NO: 8009472 - DNA, 22 bp, Homo sapiens
gttattctaccactatgtacag

SEQ ID NO: 8009473 - DNA, 22 bp, Homo sapiens
gttattctattaatgtgattgt

SEQ ID NO: 8009474 - DNA, 22 bp, Homo sapiens
gttattctagtgctcagccatt

SEQ ID NO: 8009475 - DNA, 22 bp, Homo sapiens
gttattctaccactatgtacag

SEQ ID NO: 8009476 - DNA, 22 bp, Homo sapiens
gttattctaccactatgtacag

SEQ ID NO: 8009477 - DNA, 22 bp, Homo sapiens
gttattctaccactatgtacag

SEQ ID NO: 8009478 - DNA, 22 bp, Homo sapiens
gttattcttggtggccctgctg

SEQ ID NO: 8009479 - DNA, 22 bp, Homo sapiens
gttattctttgtatggtacatc

SEQ ID NO: 8009480 - DNA, 22 bp, Homo sapiens
gttattctttgtatggtacatc

SEQ ID NO: 8009481 - DNA, 22 bp, Homo sapiens
gttattctttgtatggtacatc

SEQ ID NO: 8009482 - DNA, 22 bp, Homo sapiens
gttattctttgtatggtacatc

SEQ ID NO: 8009483 - DNA, 22 bp, Homo sapiens
gttattctgcacacctttaaaa

SEQ ID NO: 8009484 - DNA, 22 bp, Homo sapiens
gttattctcttggcctaattat

SEQ ID NO: 8009485 - DNA, 18 bp, Homo sapiens
gttattctctctgcagta

SEQ ID NO: 8009486 - DNA, 22 bp, Homo sapiens
gttattctgcgatgcaatcctg

SEQ ID NO: 8009487 - DNA, 22 bp, Homo sapiens
gttattctgccaaacttccaca

SEQ ID NO: 8009488 - DNA, 22 bp, Homo sapiens
gttattcttttatagcaataca

SEQ ID NO: 8009489 - DNA, 22 bp, Homo sapiens
gttattcttttatagcaataca

SEQ ID NO: 8009490 - DNA, 22 bp, Homo sapiens
gttattcttttatagcaataca

SEQ ID NO: 8009491 - DNA, 22 bp, Homo sapiens
gttattcttttatagcaataca

SEQ ID NO: 8009492 - DNA, 22 bp, Homo sapiens
cagcttctaccatcaggaaatt

SEQ ID NO: 8009493 - DNA, 22 bp, Homo sapiens
gttattgaggtggagtctcact

SEQ ID NO: 8009494 - DNA, 22 bp, Homo sapiens
gttattaaagtatttgatgtta

SEQ ID NO: 8009495 - DNA, 22 bp, Homo sapiens
gttattaaagtatttgatgtta

SEQ ID NO: 8009496 - DNA, 22 bp, Homo sapiens
gttattaaagtatttgatgtta

SEQ ID NO: 8009497 - DNA, 22 bp, Homo sapiens
gttatgtattgggaaatccaag

SEQ ID NO: 8009498 - DNA, 22 bp, Homo sapiens
gttaccctttctgcaggacttg

SEQ ID NO: 8009499 - DNA, 22 bp, Homo sapiens
gttattctacagtcattgaagt

SEQ ID NO: 8009500 - DNA, 22 bp, Homo sapiens
gttattctacagtcattgaagt

SEQ ID NO: 8009501 - DNA, 22 bp, Homo sapiens
gttattctacagtcattgaagt

SEQ ID NO: 8009502 - DNA, 22 bp, Homo sapiens
gttacatttattagaggtctct

SEQ ID NO: 8009503 - DNA, 22 bp, Homo sapiens
gttatgtatgggggccttatga

SEQ ID NO: 8009504 - DNA, 22 bp, Homo sapiens
gttacattaaaaacattcactg

SEQ ID NO: 8009505 - DNA, 22 bp, Homo sapiens
gttacataggtgtgttcagttt

SEQ ID NO: 8009506 - DNA, 20 bp, Homo sapiens
cagcttggatgagaggctga

SEQ ID NO: 8009507 - DNA, 22 bp, Homo sapiens
cagcttggattttggcacgtgt

SEQ ID NO: 8009508 - DNA, 22 bp, Homo sapiens
cagcttggattttggcacgtgt

SEQ ID NO: 8009509 - DNA, 20 bp, Homo sapiens
cagcttggatgagaggctga

SEQ ID NO: 8009510 - DNA, 20 bp, Homo sapiens
cagcttggatgagaggctga

SEQ ID NO: 8009511 - DNA, 22 bp, Homo sapiens
cagcttgctaactggtaggggt

SEQ ID NO: 8009512 - DNA, 22 bp, Homo sapiens
cagcttgctaattttgacttca

SEQ ID NO: 8009513 - DNA, 22 bp, Homo sapiens
cagcttctgctatcgaacatct

SEQ ID NO: 8009514 - DNA, 22 bp, Homo sapiens
cagcttctgctatcgaacatct

SEQ ID NO: 8009515 - DNA, 22 bp, Homo sapiens
cagcttgcagtacttgtttttg

SEQ ID NO: 8009516 - DNA, 22 bp, Homo sapiens
cagcttggaggaggatctaaga

SEQ ID NO: 8009517 - DNA, 22 bp, Homo sapiens
cagcttgctaattttgacttca

SEQ ID NO: 8009518 - DNA, 22 bp, Homo sapiens
cagcttgctcaaggttatagat

SEQ ID NO: 8009519 - DNA, 20 bp, Homo sapiens
cagcttgctttgggacattt

SEQ ID NO: 8009520 - DNA, 20 bp, Homo sapiens
cagcttgctttgggacattt

SEQ ID NO: 8009521 - DNA, 22 bp, Homo sapiens
cagcttgggtcaggtgcctgct

SEQ ID NO: 8009522 - DNA, 22 bp, Homo sapiens
cagcttgggtcaggtgcctgct

SEQ ID NO: 8009523 - DNA, 22 bp, Homo sapiens
cagcttgggtcaggtgcctgct

SEQ ID NO: 8009524 - DNA, 22 bp, Homo sapiens
cagcttgggggcgctggcctca

SEQ ID NO: 8009525 - DNA, 22 bp, Homo sapiens
cagcttgggggcgctggcctca

SEQ ID NO: 8009526 - DNA, 22 bp, Homo sapiens
cagcttgggggcgctggcctca

SEQ ID NO: 8009527 - DNA, 22 bp, Homo sapiens
cagcttgggggcgctggcctca

SEQ ID NO: 8009528 - DNA, 22 bp, Homo sapiens
cagcttgggggcgctggcctca

SEQ ID NO: 8009529 - DNA, 22 bp, Homo sapiens
cagcttggcttcacattctgta

SEQ ID NO: 8009530 - DNA, 22 bp, Homo sapiens
cagcttggcgaatgtaggtatg

SEQ ID NO: 8009531 - DNA, 22 bp, Homo sapiens
cagcttggcttcacattctgta

SEQ ID NO: 8009532 - DNA, 22 bp, Homo sapiens
cagcttggcttccgctttactg

SEQ ID NO: 8009533 - DNA, 22 bp, Homo sapiens
cagcttctgagcaagccagggg

SEQ ID NO: 8009534 - DNA, 21 bp, Homo sapiens
cagcttctgaaggtgtaggaa

SEQ ID NO: 8009535 - DNA, 21 bp, Homo sapiens
cagcttctgaaggtgtaggaa

SEQ ID NO: 8009536 - DNA, 22 bp, Homo sapiens
cagcttctgagcaagccagggg

SEQ ID NO: 8009537 - DNA, 22 bp, Homo sapiens
cagcttctgagcaagccagggg

SEQ ID NO: 8009538 - DNA, 22 bp, Homo sapiens
cagcttctcgggagcgcatgtg

SEQ ID NO: 8009539 - DNA, 22 bp, Homo sapiens
cagcttctccggcctggtgcgg

SEQ ID NO: 8009540 - DNA, 22 bp, Homo sapiens
cagcttctccattcttctggct

SEQ ID NO: 8009541 - DNA, 22 bp, Homo sapiens
cagcttctccattcttctggct

SEQ ID NO: 8009542 - DNA, 22 bp, Homo sapiens
cagcttctcagaaagctgaggt

SEQ ID NO: 8009543 - DNA, 22 bp, Homo sapiens
cagcttctatttatctttgtgt

SEQ ID NO: 8009544 - DNA, 22 bp, Homo sapiens
cagcttctatttatctttgtgt

SEQ ID NO: 8009545 - DNA, 22 bp, Homo sapiens
cagcttctagcatcggctttga

SEQ ID NO: 8009546 - DNA, 22 bp, Homo sapiens
cagcttctaccatcaggaaatt

SEQ ID NO: 8009547 - DNA, 22 bp, Homo sapiens
cagcttctccagatgaccctca

SEQ ID NO: 8009548 - DNA, 22 bp, Homo sapiens
cagcttctccagatgaccctca

SEQ ID NO: 8009549 - DNA, 22 bp, Homo sapiens
cagcttctcagaaagctgaggt

SEQ ID NO: 8009550 - DNA, 22 bp, Homo sapiens
cagcttctcagaaagctgaggt

SEQ ID NO: 8009551 - DNA, 22 bp, Homo sapiens
cagcttctcagaaagctgaggt

SEQ ID NO: 8009552 - DNA, 22 bp, Homo sapiens
cagcttctcagaaagctgaggt

SEQ ID NO: 8009553 - DNA, 22 bp, Homo sapiens
cagcttctcagaaagctgaggt

SEQ ID NO: 8009554 - DNA, 22 bp, Homo sapiens
cagctttagagaaaacatattt

SEQ ID NO: 8009555 - DNA, 22 bp, Homo sapiens
cagcttgttttatttggggacc

SEQ ID NO: 8009556 - DNA, 22 bp, Homo sapiens
cagcttgtttacatgcttattc

SEQ ID NO: 8009557 - DNA, 22 bp, Homo sapiens
cagcttgttaccaagggtggct

SEQ ID NO: 8009558 - DNA, 22 bp, Homo sapiens
cagcttgttaccgagggagggt

SEQ ID NO: 8009559 - DNA, 22 bp, Homo sapiens
cagcttgtgtcattcatcttgt

SEQ ID NO: 8009560 - DNA, 22 bp, Homo sapiens
cagcttgtgcaaaggtcctggg

SEQ ID NO: 8009561 - DNA, 22 bp, Homo sapiens
cagcttgtgcaaaggtcctggg

SEQ ID NO: 8009562 - DNA, 22 bp, Homo sapiens
cagcttgtgaaatgtcaccact

SEQ ID NO: 8009563 - DNA, 22 bp, Homo sapiens
cagcttgtattgaagctatacc

SEQ ID NO: 8009564 - DNA, 22 bp, Homo sapiens
cagctttattaatgattgtctt

SEQ ID NO: 8009565 - DNA, 22 bp, Homo sapiens
cagctttaggactcataataaa

SEQ ID NO: 8009566 - DNA, 22 bp, Homo sapiens
cagctttaggactcataataaa

SEQ ID NO: 8009567 - DNA, 22 bp, Homo sapiens
cagctttaggactcataataaa

SEQ ID NO: 8009568 - DNA, 22 bp, Homo sapiens
cagctttagagaaaacatattt

SEQ ID NO: 8009569 - DNA, 22 bp, Homo sapiens
cagctttagagaaaacatattt

SEQ ID NO: 8009570 - DNA, 22 bp, Homo sapiens
cagctttagagaaaacatattt

SEQ ID NO: 8009571 - DNA, 23 bp, Homo sapiens
cagctttcagggctttagggaag

SEQ ID NO: 8009572 - DNA, 22 bp, Homo sapiens
cagctttccccgtgcctcagcc

SEQ ID NO: 8009573 - DNA, 22 bp, Homo sapiens
cagctttccagagacctgcccc

SEQ ID NO: 8009574 - DNA, 22 bp, Homo sapiens
cagctttctctggtttcaagat

SEQ ID NO: 8009575 - DNA, 22 bp, Homo sapiens
cagctttctttccataaggttt

SEQ ID NO: 8009576 - DNA, 22 bp, Homo sapiens
cagctttctttccataaggttt

SEQ ID NO: 8009577 - DNA, 22 bp, Homo sapiens
cagctttctgtctcatgactga

SEQ ID NO: 8009578 - DNA, 22 bp, Homo sapiens
cagctttcttccttctgtctgt

SEQ ID NO: 8009579 - DNA, 22 bp, Homo sapiens
cagctttctctggtttcaagat

SEQ ID NO: 8009580 - DNA, 22 bp, Homo sapiens
cagctttctaccttaggcagtg

SEQ ID NO: 8009581 - DNA, 22 bp, Homo sapiens
cagctttctaccttaggcagtg

SEQ ID NO: 8009582 - DNA, 22 bp, Homo sapiens
cagctttccccgtgcctcagcc

SEQ ID NO: 8009583 - DNA, 22 bp, Homo sapiens
cagctttgaaacatggctctag

SEQ ID NO: 8009584 - DNA, 22 bp, Homo sapiens
cagctttgacctaaagtaggaa

SEQ ID NO: 8009585 - DNA, 22 bp, Homo sapiens
cagctttgagagttgcatttta

SEQ ID NO: 8009586 - DNA, 22 bp, Homo sapiens
cagctttgagcagccagtggca

SEQ ID NO: 8009587 - DNA, 22 bp, Homo sapiens
cagctttgattcactgcctagt

SEQ ID NO: 8009588 - DNA, 22 bp, Homo sapiens
caggaaaatctgcccacacaag

SEQ ID NO: 8009589 - DNA, 22 bp, Homo sapiens
caggaaaatctgcccacacaag

SEQ ID NO: 8009590 - DNA, 22 bp, Homo sapiens
caggaaaatctgcccacacaag

SEQ ID NO: 8009591 - DNA, 22 bp, Homo sapiens
caggaaaatggaatcacctgta

SEQ ID NO: 8009592 - DNA, 22 bp, Homo sapiens
caggaaaatggaatcacctgta

SEQ ID NO: 8009593 - DNA, 22 bp, Homo sapiens
caggaaaatggaatcacctgta

SEQ ID NO: 8009594 - DNA, 22 bp, Homo sapiens
caggaaaatgtcaatggaaagc

SEQ ID NO: 8009595 - DNA, 22 bp, Homo sapiens
caggaaaatgtcaatggaaagc

SEQ ID NO: 8009596 - DNA, 22 bp, Homo sapiens
gttcacagcttcttaggtcata

SEQ ID NO: 8009597 - DNA, 22 bp, Homo sapiens
gttcacagctgggacaagactg

SEQ ID NO: 8009598 - DNA, 22 bp, Homo sapiens
gttcacagctgggacaagactg

SEQ ID NO: 8009599 - DNA, 22 bp, Homo sapiens
gttcacagctgggacaagactg

SEQ ID NO: 8009600 - DNA, 22 bp, Homo sapiens
gttcacagctgggacaagactg

SEQ ID NO: 8009601 - DNA, 22 bp, Homo sapiens
gttcacagctgggacaagactg

SEQ ID NO: 8009602 - DNA, 22 bp, Homo sapiens
gttcacagcaaacctatgaact

SEQ ID NO: 8009603 - DNA, 22 bp, Homo sapiens
gttcacagcaaacctatgaact

SEQ ID NO: 8009604 - DNA, 22 bp, Homo sapiens
gttcacagatccttgaagccag

SEQ ID NO: 8009605 - DNA, 22 bp, Homo sapiens
gttcacagaaggccagatggta

SEQ ID NO: 8009606 - DNA, 22 bp, Homo sapiens
gttcacagaaggccagatggta

SEQ ID NO: 8009607 - DNA, 22 bp, Homo sapiens
gttcacagaaattgtgtacctc

SEQ ID NO: 8009608 - DNA, 22 bp, Homo sapiens
gttcacagaaattgtgtacctc

SEQ ID NO: 8009609 - DNA, 22 bp, Homo sapiens
gttcacagaaattgtgtacctc

SEQ ID NO: 8009610 - DNA, 22 bp, Homo sapiens
caggaaagagctgccaggcagg

SEQ ID NO: 8009611 - DNA, 22 bp, Homo sapiens
caggaaagagctgccaggcagg

SEQ ID NO: 8009612 - DNA, 22 bp, Homo sapiens
caggaaagagctgccaggcagg

SEQ ID NO: 8009613 - DNA, 22 bp, Homo sapiens
caggaaagagctgccaggcagg

SEQ ID NO: 8009614 - DNA, 22 bp, Homo sapiens
caggaaagagctgccaggcagg

SEQ ID NO: 8009615 - DNA, 22 bp, Homo sapiens
caggaaagagctgccaggcagg

SEQ ID NO: 8009616 - DNA, 22 bp, Homo sapiens
caggaaagccgagtgccatagg

SEQ ID NO: 8009617 - DNA, 22 bp, Homo sapiens
caggaaagccgagtgccatagg

SEQ ID NO: 8009618 - DNA, 22 bp, Homo sapiens
caggaaagccgagtgccatagg

SEQ ID NO: 8009619 - DNA, 22 bp, Homo sapiens
caggaaacatatgtgcttgagg

SEQ ID NO: 8009620 - DNA, 22 bp, Homo sapiens
caggaaacatatgtgcttgagg

SEQ ID NO: 8009621 - DNA, 19 bp, Homo sapiens
caggaaacacctactgcta

SEQ ID NO: 8009622 - DNA, 19 bp, Homo sapiens
caggaaacacctactgcta

SEQ ID NO: 8009623 - DNA, 22 bp, Homo sapiens
caggaaacaaagccttgctcat

SEQ ID NO: 8009624 - DNA, 22 bp, Homo sapiens
caggaaacaaagccttgctcat

SEQ ID NO: 8009625 - DNA, 22 bp, Homo sapiens
caggaaaatgtcaatggaaagc

SEQ ID NO: 8009626 - DNA, 21 bp, Homo sapiens
caggaaactgaggccatgggg

SEQ ID NO: 8009627 - DNA, 21 bp, Homo sapiens
caggaaactgaggccatgggg

SEQ ID NO: 8009628 - DNA, 22 bp, Homo sapiens
caggaaaccgcatcccagtggg

SEQ ID NO: 8009629 - DNA, 22 bp, Homo sapiens
caggaaaccgcatcccagtggg

SEQ ID NO: 8009630 - DNA, 22 bp, Homo sapiens
caggaaacggctattcttttgt

SEQ ID NO: 8009631 - DNA, 22 bp, Homo sapiens
caggaaacattcccataacaca

SEQ ID NO: 8009632 - DNA, 22 bp, Homo sapiens
caggaaacattcttggtaagga

SEQ ID NO: 8009633 - DNA, 22 bp, Homo sapiens
caggaaacattcccataacaca

SEQ ID NO: 8009634 - DNA, 21 bp, Homo sapiens
caggaaagaaaacgtacatat

SEQ ID NO: 8009635 - DNA, 22 bp, Homo sapiens
caggaaactgtgggcttaaatc

SEQ ID NO: 8009636 - DNA, 16 bp, Homo sapiens
caggaaacttaaagac

SEQ ID NO: 8009637 - DNA, 22 bp, Homo sapiens
caggaaagaaatgagaacacca

SEQ ID NO: 8009638 - DNA, 22 bp, Homo sapiens
caggaaagaaatgagaacacca

SEQ ID NO: 8009639 - DNA, 21 bp, Homo sapiens
caggaaagaaaacgtacatat

SEQ ID NO: 8009640 - DNA, 21 bp, Homo sapiens
caggaaagaaaacgtacatat

SEQ ID NO: 8009641 - DNA, 22 bp, Homo sapiens
caggaaagagctgccaggcagg

SEQ ID NO: 8009642 - DNA, 22 bp, Homo sapiens
caggaaagagctgccaggcagg

SEQ ID NO: 8009643 - DNA, 22 bp, Homo sapiens
caggaaagagagctattcactt

SEQ ID NO: 8009644 - DNA, 22 bp, Homo sapiens
caggaaagaaatgagaacacca

SEQ ID NO: 8009645 - DNA, 22 bp, Homo sapiens
caggaaagaaatgagaacacca

SEQ ID NO: 8009646 - DNA, 22 bp, Homo sapiens
caggaaagaaatgagaacacca

SEQ ID NO: 8009647 - DNA, 22 bp, Homo sapiens
gtggggcatgcacgctgctcct

SEQ ID NO: 8009648 - DNA, 22 bp, Homo sapiens
gtggggcagtggcctgggagca

SEQ ID NO: 8009649 - DNA, 22 bp, Homo sapiens
gtggggcatgcacgctgctcct

SEQ ID NO: 8009650 - DNA, 22 bp, Homo sapiens
gtggggcatgcacgctgctcct

SEQ ID NO: 8009651 - DNA, 22 bp, Homo sapiens
gtggggcatgcacgctgctcct

SEQ ID NO: 8009652 - DNA, 22 bp, Homo sapiens
gtggggcatgcacgctgctcct

SEQ ID NO: 8009653 - DNA, 22 bp, Homo sapiens
gtggggctaaaaactgtgcagt

SEQ ID NO: 8009654 - DNA, 22 bp, Homo sapiens
gtggggctaaaaactgtgcagt

SEQ ID NO: 8009655 - DNA, 22 bp, Homo sapiens
gtggggctaaaaactgtgcagt

SEQ ID NO: 8009656 - DNA, 22 bp, Homo sapiens
gtggggctcccatctcctggct

SEQ ID NO: 8009657 - DNA, 22 bp, Homo sapiens
gtggggctcccatctcctggct

SEQ ID NO: 8009658 - DNA, 22 bp, Homo sapiens
gtggggagtgttctgtgattgg

SEQ ID NO: 8009659 - DNA, 22 bp, Homo sapiens
gtggggagtgttctgtgattgg

SEQ ID NO: 8009660 - DNA, 22 bp, Homo sapiens
gtggggagtgttctgtgattgg

SEQ ID NO: 8009661 - DNA, 22 bp, Homo sapiens
gtggggagtgttctgtgattgg

SEQ ID NO: 8009662 - DNA, 22 bp, Homo sapiens
gtggggagggagatgctgaagt

SEQ ID NO: 8009663 - DNA, 22 bp, Homo sapiens
gtggggagggagatgctgaagt

SEQ ID NO: 8009664 - DNA, 22 bp, Homo sapiens
gtggggcagtggcctgggagca

SEQ ID NO: 8009665 - DNA, 22 bp, Homo sapiens
gtggggcagtggcctgggagca

SEQ ID NO: 8009666 - DNA, 22 bp, Homo sapiens
gtggggcagtggcctgggagca

SEQ ID NO: 8009667 - DNA, 22 bp, Homo sapiens
gtggggcagtggcctgggagca

SEQ ID NO: 8009668 - DNA, 22 bp, Homo sapiens
gtggggcagtggcctgggagca

SEQ ID NO: 8009669 - DNA, 22 bp, Homo sapiens
gtggggcagtggcctgggagca

SEQ ID NO: 8009670 - DNA, 22 bp, Homo sapiens
gtggggcagtggcctgggagca

SEQ ID NO: 8009671 - DNA, 22 bp, Homo sapiens
gtggggcagtggcctgggagca

SEQ ID NO: 8009672 - DNA, 22 bp, Homo sapiens
cagctgcaatcagaagctaagg

SEQ ID NO: 8009673 - DNA, 22 bp, Homo sapiens
cagctgcaatcagaagctaagg

SEQ ID NO: 8009674 - DNA, 22 bp, Homo sapiens
cagctgatggttttgctgagac

SEQ ID NO: 8009675 - DNA, 22 bp, Homo sapiens
cagctgatggttttgctgagac

SEQ ID NO: 8009676 - DNA, 22 bp, Homo sapiens
gtggggctggaagatgggtact

SEQ ID NO: 8009677 - DNA, 19 bp, Homo sapiens
cagctgcaccgtgaccatc

SEQ ID NO: 8009678 - DNA, 19 bp, Homo sapiens
cagctgcaccgtgaccatc

SEQ ID NO: 8009679 - DNA, 19 bp, Homo sapiens
cagctgcaccgtgaccatc

SEQ ID NO: 8009680 - DNA, 19 bp, Homo sapiens
cagctgcaccgtgaccatc

SEQ ID NO: 8009681 - DNA, 22 bp, Homo sapiens
gtggggctgcttaggctgcgca

SEQ ID NO: 8009682 - DNA, 22 bp, Homo sapiens
gtggggctgcttaggctgcgca

SEQ ID NO: 8009683 - DNA, 22 bp, Homo sapiens
gtggggctgagtggagccagaa

SEQ ID NO: 8009684 - DNA, 22 bp, Homo sapiens
gtggggctgagtggagccagaa

SEQ ID NO: 8009685 - DNA, 22 bp, Homo sapiens
cagctgcagaaagcaagcaggt

SEQ ID NO: 8009686 - DNA, 22 bp, Homo sapiens
cagctgcagatcatgtttacag

SEQ ID NO: 8009687 - DNA, 22 bp, Homo sapiens
cagctgcagatcatgtttacag

SEQ ID NO: 8009688 - DNA, 22 bp, Homo sapiens
cagctgcagaaagcaagcaggt

SEQ ID NO: 8009689 - DNA, 22 bp, Homo sapiens
cagctgcagaaagcaagcaggt

SEQ ID NO: 8009690 - DNA, 22 bp, Homo sapiens
cagctgcagaaagcaagcaggt

SEQ ID NO: 8009691 - DNA, 22 bp, Homo sapiens
cagctgcagaaagcaagcaggt

SEQ ID NO: 8009692 - DNA, 22 bp, Homo sapiens
cagctgcactgaagcaggtttg

SEQ ID NO: 8009693 - DNA, 22 bp, Homo sapiens
cagctgcactgaagcaggtttg

SEQ ID NO: 8009694 - DNA, 22 bp, Homo sapiens
cagctgcaggagaaacagaggc

SEQ ID NO: 8009695 - DNA, 22 bp, Homo sapiens
cagctgcaggagaaacagaggc

SEQ ID NO: 8009696 - DNA, 22 bp, Homo sapiens
cagctgcaggagaaacagaggc

SEQ ID NO: 8009697 - DNA, 22 bp, Homo sapiens
cagctgcaggagctgagcactt

SEQ ID NO: 8009698 - DNA, 22 bp, Homo sapiens
cagctgcaggagctgagcactt

SEQ ID NO: 8009699 - DNA, 22 bp, Homo sapiens
cagctgcaggagctgagcactt

SEQ ID NO: 8009700 - DNA, 22 bp, Homo sapiens
cagctgcaggaacaaaaatgtg

SEQ ID NO: 8009701 - DNA, 22 bp, Homo sapiens
cagctgcaggagaaacagaggc

SEQ ID NO: 8009702 - DNA, 22 bp, Homo sapiens
cagctgcaggagaaacagaggc

SEQ ID NO: 8009703 - DNA, 18 bp, Homo sapiens
cagctgcaggctcaggac

SEQ ID NO: 8009704 - DNA, 22 bp, Homo sapiens
cagctgcaggagctgagcactt

SEQ ID NO: 8009705 - DNA, 22 bp, Homo sapiens
cagctgcaggagctgagcactt

SEQ ID NO: 8009706 - DNA, 18 bp, Homo sapiens
cagctgcaggctcaggac

SEQ ID NO: 8009707 - DNA, 18 bp, Homo sapiens
cagctgcaggctcaggac

SEQ ID NO: 8009708 - DNA, 22 bp, Homo sapiens
cagctgcaggctgtgcaggaag

SEQ ID NO: 8009709 - DNA, 22 bp, Homo sapiens
cagctgcaggctgtgcaggaag

SEQ ID NO: 8009710 - DNA, 22 bp, Homo sapiens
cagctgcaggctgtgcaggaag

SEQ ID NO: 8009711 - DNA, 18 bp, Homo sapiens
cagctgcaggctcaggac

SEQ ID NO: 8009712 - DNA, 22 bp, Homo sapiens
cagctgcagttcaatgcttgct

SEQ ID NO: 8009713 - DNA, 22 bp, Homo sapiens
cagctgcatgtctgtggtggtc

SEQ ID NO: 8009714 - DNA, 22 bp, Homo sapiens
cagctgcagtgggggaccacaa

SEQ ID NO: 8009715 - DNA, 22 bp, Homo sapiens
cagctgcagttcaatgcttgct

SEQ ID NO: 8009716 - DNA, 22 bp, Homo sapiens
cagctgcaggctgtgcaggaag

SEQ ID NO: 8009717 - DNA, 22 bp, Homo sapiens
cagctgcagtcatcttctagaa

SEQ ID NO: 8009718 - DNA, 22 bp, Homo sapiens
cagctgcagtcatcttctagaa

SEQ ID NO: 8009719 - DNA, 22 bp, Homo sapiens
cagctgcagtgggggaccacaa

SEQ ID NO: 8009720 - DNA, 22 bp, Homo sapiens
cagctgcagtgggggaccacaa

SEQ ID NO: 8009721 - DNA, 22 bp, Homo sapiens
cagctgcagtgggggaccacaa

SEQ ID NO: 8009722 - DNA, 22 bp, Homo sapiens
cagctgcatgtctgtggtggtc

SEQ ID NO: 8009723 - DNA, 22 bp, Homo sapiens
cagctgcatgtctgtggtggtc

SEQ ID NO: 8009724 - DNA, 22 bp, Homo sapiens
cagctgcatgtctgtggtggtc

SEQ ID NO: 8009725 - DNA, 22 bp, Homo sapiens
cagctgcattaattttagtgaa

SEQ ID NO: 8009726 - DNA, 22 bp, Homo sapiens
cagctgccaagaatcttttcta

SEQ ID NO: 8009727 - DNA, 22 bp, Homo sapiens
cagctgcattaattttagtgaa

SEQ ID NO: 8009728 - DNA, 22 bp, Homo sapiens
cagctgcattaattttagtgaa

SEQ ID NO: 8009729 - DNA, 22 bp, Homo sapiens
cagctgccacttgctctcggct

SEQ ID NO: 8009730 - DNA, 22 bp, Homo sapiens
cagctgcattaattttagtgaa

SEQ ID NO: 8009731 - DNA, 22 bp, Homo sapiens
cagctgccacttgctctcggct

SEQ ID NO: 8009732 - DNA, 22 bp, Homo sapiens
cagctgccacaggactttctga

SEQ ID NO: 8009733 - DNA, 22 bp, Homo sapiens
cagctgccacacctctttctct

SEQ ID NO: 8009734 - DNA, 22 bp, Homo sapiens
cagctgccacacctctttctct

SEQ ID NO: 8009735 - DNA, 22 bp, Homo sapiens
cagctgcctatgacctagcctc

SEQ ID NO: 8009736 - DNA, 22 bp, Homo sapiens
cagctgcctatgacctagcctc

SEQ ID NO: 8009737 - DNA, 22 bp, Homo sapiens
cagctgcctatgacctagcctc

SEQ ID NO: 8009738 - DNA, 22 bp, Homo sapiens
cagctgcctatgacctagcctc

SEQ ID NO: 8009739 - DNA, 22 bp, Homo sapiens
cagctgcctatgacctagcctc

SEQ ID NO: 8009740 - DNA, 22 bp, Homo sapiens
cagctgcctatgacctagcctc

SEQ ID NO: 8009741 - DNA, 22 bp, Homo sapiens
cagctgcctatgacctagcctc

SEQ ID NO: 8009742 - DNA, 22 bp, Homo sapiens
cagctgccctgccttgccctta

SEQ ID NO: 8009743 - DNA, 22 bp, Homo sapiens
cagctgccctgccttgccctta

SEQ ID NO: 8009744 - DNA, 22 bp, Homo sapiens
cagctgccctgccttgccctta

SEQ ID NO: 8009745 - DNA, 22 bp, Homo sapiens
cagctgccacttgctctcggct

SEQ ID NO: 8009746 - DNA, 22 bp, Homo sapiens
cagctgccacttgctctcggct

SEQ ID NO: 8009747 - DNA, 22 bp, Homo sapiens
cagctgcccctccagggctggg

SEQ ID NO: 8009748 - DNA, 22 bp, Homo sapiens
cagctgcccctccagggctggg

SEQ ID NO: 8009749 - DNA, 22 bp, Homo sapiens
cagctgcccctccagggctggg

SEQ ID NO: 8009750 - DNA, 20 bp, Homo sapiens
cagctgcctggctctgggat

SEQ ID NO: 8009751 - DNA, 20 bp, Homo sapiens
cagctgcctggctctgggat

SEQ ID NO: 8009752 - DNA, 20 bp, Homo sapiens
cagctgcctggctctgggat

SEQ ID NO: 8009753 - DNA, 22 bp, Homo sapiens
cagctgcctgtattgtcctcat

SEQ ID NO: 8009754 - DNA, 22 bp, Homo sapiens
cagctgcctgtattgtcctcat

SEQ ID NO: 8009755 - DNA, 22 bp, Homo sapiens
cagctgcctgtattgtcctcat

SEQ ID NO: 8009756 - DNA, 22 bp, Homo sapiens
cagctgcctgcaacacaagctt

SEQ ID NO: 8009757 - DNA, 22 bp, Homo sapiens
cagctgcctgcaacacaagctt

SEQ ID NO: 8009758 - DNA, 22 bp, Homo sapiens
cagctgcctgcaacacaagctt

SEQ ID NO: 8009759 - DNA, 22 bp, Homo sapiens
cagctgcctgcaacacaagctt

SEQ ID NO: 8009760 - DNA, 20 bp, Homo sapiens
cagctgcctggctctgggat

SEQ ID NO: 8009761 - DNA, 22 bp, Homo sapiens
cagctgcctgcaacacaagctt

SEQ ID NO: 8009762 - DNA, 22 bp, Homo sapiens
cagctgcctgcaacacaagctt

SEQ ID NO: 8009763 - DNA, 22 bp, Homo sapiens
cagctgctgcctcatccacttt

SEQ ID NO: 8009764 - DNA, 22 bp, Homo sapiens
cagctgctgcccttggctgcag

SEQ ID NO: 8009765 - DNA, 22 bp, Homo sapiens
cagctgctgcccttggctgcag

SEQ ID NO: 8009766 - DNA, 22 bp, Homo sapiens
cagctgctgtaacagaatactt

SEQ ID NO: 8009767 - DNA, 22 bp, Homo sapiens
cagctgctgtaacagaatactt

SEQ ID NO: 8009768 - DNA, 22 bp, Homo sapiens
cagctgctgcctcatccacttt

SEQ ID NO: 8009769 - DNA, 22 bp, Homo sapiens
cagctgctggctccgggctaag

SEQ ID NO: 8009770 - DNA, 22 bp, Homo sapiens
cagctgctggctccgggctaag

SEQ ID NO: 8009771 - DNA, 22 bp, Homo sapiens
cagctgctgttactgcttatta

SEQ ID NO: 8009772 - DNA, 22 bp, Homo sapiens
cagctgctgttcagttttgttt

SEQ ID NO: 8009773 - DNA, 22 bp, Homo sapiens
cagctgctgttcagttttgttt

SEQ ID NO: 8009774 - DNA, 22 bp, Homo sapiens
cagctgctgttcagttttgttt

SEQ ID NO: 8009775 - DNA, 22 bp, Homo sapiens
cagctgctgttcagttttgttt

SEQ ID NO: 8009776 - DNA, 22 bp, Homo sapiens
cagctgctgttcagttttgttt

SEQ ID NO: 8009777 - DNA, 22 bp, Homo sapiens
cagctgctgttcagttttgttt

SEQ ID NO: 8009778 - DNA, 22 bp, Homo sapiens
cagctgctgttactgcttatta

SEQ ID NO: 8009779 - DNA, 22 bp, Homo sapiens
cagctgctgttactgcttatta

SEQ ID NO: 8009780 - DNA, 22 bp, Homo sapiens
cagctgctgttactgcttatta

SEQ ID NO: 8009781 - DNA, 22 bp, Homo sapiens
cagctgctgttcagttttgttt

SEQ ID NO: 8009782 - DNA, 22 bp, Homo sapiens
cagctgcttactagctgtgtga

SEQ ID NO: 8009783 - DNA, 22 bp, Homo sapiens
cagctgcttactagctgtgtga

SEQ ID NO: 8009784 - DNA, 22 bp, Homo sapiens
cagctgcttactagctgtgtga

SEQ ID NO: 8009785 - DNA, 22 bp, Homo sapiens
cagctgcttactagctgtgtga

SEQ ID NO: 8009786 - DNA, 22 bp, Homo sapiens
cagctggccaatcagggcgccc

SEQ ID NO: 8009787 - DNA, 22 bp, Homo sapiens
cagctggccaatcagggcgccc

SEQ ID NO: 8009788 - DNA, 22 bp, Homo sapiens
cagctgctttagttttccatcc

SEQ ID NO: 8009789 - DNA, 22 bp, Homo sapiens
cagctgctttagttttccatcc

SEQ ID NO: 8009790 - DNA, 22 bp, Homo sapiens
cagctgcttctcctccagagct

SEQ ID NO: 8009791 - DNA, 22 bp, Homo sapiens
cagctgcttctcctccagagct

SEQ ID NO: 8009792 - DNA, 22 bp, Homo sapiens
cagctgctgagaagcctccctt

SEQ ID NO: 8009793 - DNA, 22 bp, Homo sapiens
cagctgctgaggaaggggttgg

SEQ ID NO: 8009794 - DNA, 22 bp, Homo sapiens
cagctgctgaggaaggggttgg

SEQ ID NO: 8009795 - DNA, 22 bp, Homo sapiens
cagctgctcttctggcctgtca

SEQ ID NO: 8009796 - DNA, 22 bp, Homo sapiens
cagctgctcttctggcctgtca

SEQ ID NO: 8009797 - DNA, 22 bp, Homo sapiens
cagctgctcttctggcctgtca

SEQ ID NO: 8009798 - DNA, 22 bp, Homo sapiens
cagctgctcttctggcctgtca

SEQ ID NO: 8009799 - DNA, 22 bp, Homo sapiens
cagctgctcttctggcctgtca

SEQ ID NO: 8009800 - DNA, 22 bp, Homo sapiens
cagctgctgcccttggctgcag

SEQ ID NO: 8009801 - DNA, 22 bp, Homo sapiens
cagctgctgcccttggctgcag

SEQ ID NO: 8009802 - DNA, 22 bp, Homo sapiens
cagctgctgcccttggctgcag

SEQ ID NO: 8009803 - DNA, 22 bp, Homo sapiens
cagctgctgcccttggctgcag

SEQ ID NO: 8009804 - DNA, 22 bp, Homo sapiens
cagctgctgcccttggctgcag

SEQ ID NO: 8009805 - DNA, 22 bp, Homo sapiens
cagctgctgcccttggctgcag

SEQ ID NO: 8009806 - DNA, 22 bp, Homo sapiens
cagctgctgatggcctgacaga

SEQ ID NO: 8009807 - DNA, 22 bp, Homo sapiens
cagctgctgatggcctgacaga

SEQ ID NO: 8009808 - DNA, 22 bp, Homo sapiens
cagctgctgatggcctgacaga

SEQ ID NO: 8009809 - DNA, 22 bp, Homo sapiens
cagctgctgatggcctgacaga

SEQ ID NO: 8009810 - DNA, 22 bp, Homo sapiens
cagctgcctgtctggaggcaat

SEQ ID NO: 8009811 - DNA, 22 bp, Homo sapiens
cagctgcctgtctggaggcaat

SEQ ID NO: 8009812 - DNA, 22 bp, Homo sapiens
cagctgcctgtattgtcctcat

SEQ ID NO: 8009813 - DNA, 22 bp, Homo sapiens
cagctgcctgtctggaggcaat

SEQ ID NO: 8009814 - DNA, 22 bp, Homo sapiens
cagctgcctgtattgtcctcat

SEQ ID NO: 8009815 - DNA, 22 bp, Homo sapiens
cagctgcctgtattgtcctcat

SEQ ID NO: 8009816 - DNA, 22 bp, Homo sapiens
cagctgctctggtggtctctcc

SEQ ID NO: 8009817 - DNA, 22 bp, Homo sapiens
cagctgctctggtggtctctcc

SEQ ID NO: 8009818 - DNA, 22 bp, Homo sapiens
cagctgctctggtggtctctcc

SEQ ID NO: 8009819 - DNA, 22 bp, Homo sapiens
cagctgctctggtggtctctcc

SEQ ID NO: 8009820 - DNA, 22 bp, Homo sapiens
cagctgctctggtggtctctcc

SEQ ID NO: 8009821 - DNA, 21 bp, Homo sapiens
cagctgcgtgtcctcccaccc

SEQ ID NO: 8009822 - DNA, 19 bp, Homo sapiens
cagctgccttttctttgca

SEQ ID NO: 8009823 - DNA, 22 bp, Homo sapiens
cagctgccttctgcgggaagtc

SEQ ID NO: 8009824 - DNA, 22 bp, Homo sapiens
cagctggcctgagcggtggcgg

SEQ ID NO: 8009825 - DNA, 22 bp, Homo sapiens
cagctggcctgagcggtggcgg

SEQ ID NO: 8009826 - DNA, 22 bp, Homo sapiens
cagctggcctgagcggtggcgg

SEQ ID NO: 8009827 - DNA, 22 bp, Homo sapiens
cagctggcctgagcggtggcgg

SEQ ID NO: 8009828 - DNA, 22 bp, Homo sapiens
cagctggcctgatccctgtggc

SEQ ID NO: 8009829 - DNA, 22 bp, Homo sapiens
cagctggcctgatccctgtggc

SEQ ID NO: 8009830 - DNA, 22 bp, Homo sapiens
cagctggcctgatccctgtggc

SEQ ID NO: 8009831 - DNA, 22 bp, Homo sapiens
cagctggcctgatccctgtggc

SEQ ID NO: 8009832 - DNA, 22 bp, Homo sapiens
cagctggcctgatccctgtggc

SEQ ID NO: 8009833 - DNA, 22 bp, Homo sapiens
cagctggccaatcagggcgccc

SEQ ID NO: 8009834 - DNA, 22 bp, Homo sapiens
cagctggccaatcagggcgccc

SEQ ID NO: 8009835 - DNA, 22 bp, Homo sapiens
cagctggccccacagtagaggc

SEQ ID NO: 8009836 - DNA, 22 bp, Homo sapiens
cagctggccccacagtagaggc

SEQ ID NO: 8009837 - DNA, 22 bp, Homo sapiens
cagctggccctttggtagcctt

SEQ ID NO: 8009838 - DNA, 22 bp, Homo sapiens
cagctggccctttggtagcctt

SEQ ID NO: 8009839 - DNA, 22 bp, Homo sapiens
cagctggccctttggtagcctt

SEQ ID NO: 8009840 - DNA, 22 bp, Homo sapiens
cagctggctccacctctgggct

SEQ ID NO: 8009841 - DNA, 22 bp, Homo sapiens
cagctggctccacctctgggct

SEQ ID NO: 8009842 - DNA, 22 bp, Homo sapiens
cagctggctccacctctgggct

SEQ ID NO: 8009843 - DNA, 22 bp, Homo sapiens
cagctggctccacctctgggct

SEQ ID NO: 8009844 - DNA, 22 bp, Homo sapiens
cagctggcgtggagtgattgca

SEQ ID NO: 8009845 - DNA, 22 bp, Homo sapiens
cagctggcgtggagtgattgca

SEQ ID NO: 8009846 - DNA, 22 bp, Homo sapiens
cagctggcgtggagtgattgca

SEQ ID NO: 8009847 - DNA, 22 bp, Homo sapiens
cagctggcgggcagagccgcca

SEQ ID NO: 8009848 - DNA, 22 bp, Homo sapiens
cagctggcgggcagagccgcca

SEQ ID NO: 8009849 - DNA, 22 bp, Homo sapiens
cagctggcgggcagagccgcca

SEQ ID NO: 8009850 - DNA, 22 bp, Homo sapiens
cagctggcgcctggggaccaga

SEQ ID NO: 8009851 - DNA, 22 bp, Homo sapiens
cagctggcgcctggggaccaga

SEQ ID NO: 8009852 - DNA, 22 bp, Homo sapiens
cagctggcgcctggggaccaga

SEQ ID NO: 8009853 - DNA, 22 bp, Homo sapiens
cagctggcgcctggggaccaga

SEQ ID NO: 8009854 - DNA, 22 bp, Homo sapiens
cagctggcgcctggggaccaga

SEQ ID NO: 8009855 - DNA, 22 bp, Homo sapiens
cagctggcgactctcctcgatg

SEQ ID NO: 8009856 - DNA, 22 bp, Homo sapiens
cagctggctccacctctgggct

SEQ ID NO: 8009857 - DNA, 22 bp, Homo sapiens
cagctggctccacctctgggct

SEQ ID NO: 8009858 - DNA, 22 bp, Homo sapiens
cagctggctgcatgatgccaaa

SEQ ID NO: 8009859 - DNA, 22 bp, Homo sapiens
cagctggctccacctctgggct

SEQ ID NO: 8009860 - DNA, 22 bp, Homo sapiens
cagctggctgcatgatgccaaa

SEQ ID NO: 8009861 - DNA, 22 bp, Homo sapiens
cagctggctgcatgatgccaaa

SEQ ID NO: 8009862 - DNA, 22 bp, Homo sapiens
gtgggtggatcacctgaggtca

SEQ ID NO: 8009863 - DNA, 22 bp, Homo sapiens
gtgggtggatcacctgaggtca

SEQ ID NO: 8009864 - DNA, 22 bp, Homo sapiens
gtgggtggatcacctgaggtca

SEQ ID NO: 8009865 - DNA, 22 bp, Homo sapiens
cagctggctgcggtgaggggac

SEQ ID NO: 8009866 - DNA, 22 bp, Homo sapiens
cagctggctgcggtgaggggac

SEQ ID NO: 8009867 - DNA, 22 bp, Homo sapiens
cagctggctgcggtgaggggac

SEQ ID NO: 8009868 - DNA, 22 bp, Homo sapiens
gtgggtggatcatgaggtcagg

SEQ ID NO: 8009869 - DNA, 22 bp, Homo sapiens
gtgggtggatcatgaggtcagg

SEQ ID NO: 8009870 - DNA, 22 bp, Homo sapiens
gtgggtggatcacctgaggtca

SEQ ID NO: 8009871 - DNA, 22 bp, Homo sapiens
gtgggtggatcacctgaggtca

SEQ ID NO: 8009872 - DNA, 22 bp, Homo sapiens
gtgggtggatcatgaggtcagg

SEQ ID NO: 8009873 - DNA, 22 bp, Homo sapiens
gtgggtggatcatgaggtcagg

SEQ ID NO: 8009874 - DNA, 22 bp, Homo sapiens
gtgggtggatggctcacctcca

SEQ ID NO: 8009875 - DNA, 22 bp, Homo sapiens
gtgggtggatcatgaggtcagg

SEQ ID NO: 8009876 - DNA, 22 bp, Homo sapiens
gtgggtggatcatgaggtcagg

SEQ ID NO: 8009877 - DNA, 22 bp, Homo sapiens
gtgggtggatcatgaggtcagg

SEQ ID NO: 8009878 - DNA, 22 bp, Homo sapiens
gtgggtggatcatgaggtcagg

SEQ ID NO: 8009879 - DNA, 22 bp, Homo sapiens
gtgggtggatcatgaggtcagg

SEQ ID NO: 8009880 - DNA, 22 bp, Homo sapiens
gtgggtggatcatgaggtcagg

SEQ ID NO: 8009881 - DNA, 22 bp, Homo sapiens
gtgggtggatcatgaggtcagg

SEQ ID NO: 8009882 - DNA, 22 bp, Homo sapiens
gtgtcttttctgtctagcacaa

SEQ ID NO: 8009883 - DNA, 17 bp, Homo sapiens
gtgtctttgctgttgtg

SEQ ID NO: 8009884 - DNA, 18 bp, Homo sapiens
gtgtcttattacagtggg

SEQ ID NO: 8009885 - DNA, 22 bp, Homo sapiens
gtgtcttagtcatttcaggctg

SEQ ID NO: 8009886 - DNA, 22 bp, Homo sapiens
gtgtgaaagttcctaagactat

SEQ ID NO: 8009887 - DNA, 22 bp, Homo sapiens
gtgtgaaaatgtgcacaatatg

SEQ ID NO: 8009888 - DNA, 22 bp, Homo sapiens
gtgtgaaagcttgtcctctgta

SEQ ID NO: 8009889 - DNA, 22 bp, Homo sapiens
gtgtgagagaagctgccatgga

SEQ ID NO: 8009890 - DNA, 22 bp, Homo sapiens
gtgtgagaagggaatgtaaagc

SEQ ID NO: 8009891 - DNA, 22 bp, Homo sapiens
gtgtgactttatttggaaatag

SEQ ID NO: 8009892 - DNA, 22 bp, Homo sapiens
gtgtgagaagggaatgtaaagc

SEQ ID NO: 8009893 - DNA, 22 bp, Homo sapiens
gtgtgactttatttggaaatag

SEQ ID NO: 8009894 - DNA, 20 bp, Homo sapiens
gtgtgaagccctcaggagga

SEQ ID NO: 8009895 - DNA, 22 bp, Homo sapiens
gtgtgactttatttggaaatag

SEQ ID NO: 8009896 - DNA, 22 bp, Homo sapiens
gtgtgagcatcaaagcctgtca

SEQ ID NO: 8009897 - DNA, 22 bp, Homo sapiens
gtgtgagcatcaaagcctgtca

SEQ ID NO: 8009898 - DNA, 22 bp, Homo sapiens
gtgtgagcaggtttgacctaag

SEQ ID NO: 8009899 - DNA, 22 bp, Homo sapiens
gtgtgagagcaaaactgcagga

SEQ ID NO: 8009900 - DNA, 22 bp, Homo sapiens
gtgtgagagactgaagaaagcc

SEQ ID NO: 8009901 - DNA, 22 bp, Homo sapiens
gtgtgagcagaaaccatgagta

SEQ ID NO: 8009902 - DNA, 22 bp, Homo sapiens
gtgtatgggaaagcccttgagt

SEQ ID NO: 8009903 - DNA, 22 bp, Homo sapiens
gtgtatgttctacttaatatta

SEQ ID NO: 8009904 - DNA, 22 bp, Homo sapiens
gtgtatgttctacttaatatta

SEQ ID NO: 8009905 - DNA, 22 bp, Homo sapiens
gtgtcaaatccactcctctttt

SEQ ID NO: 8009906 - DNA, 22 bp, Homo sapiens
gtgtctgcaagatagccaagtc

SEQ ID NO: 8009907 - DNA, 22 bp, Homo sapiens
gtgtcaaatccactcctctttt

SEQ ID NO: 8009908 - DNA, 22 bp, Homo sapiens
gtgtctgcacataggatctcaa

SEQ ID NO: 8009909 - DNA, 20 bp, Homo sapiens
gtgtctgcatatagcaggtg

SEQ ID NO: 8009910 - DNA, 20 bp, Homo sapiens
gtgtctgcatatagcaggtg

SEQ ID NO: 8009911 - DNA, 22 bp, Homo sapiens
gtgtctgcatattcaaacttgt

SEQ ID NO: 8009912 - DNA, 22 bp, Homo sapiens
gtgtctgcatattcaaacttgt

SEQ ID NO: 8009913 - DNA, 22 bp, Homo sapiens
gtgtctgcatattcaaacttgt

SEQ ID NO: 8009914 - DNA, 22 bp, Homo sapiens
gtgtctgcctttggactaactg

SEQ ID NO: 8009915 - DNA, 19 bp, Homo sapiens
gtgtctgcctttgtgccac

SEQ ID NO: 8009916 - DNA, 22 bp, Homo sapiens
gtgtctgctcagcttgctagaa

SEQ ID NO: 8009917 - DNA, 22 bp, Homo sapiens
gtgtctgctgcaccctcacacc

SEQ ID NO: 8009918 - DNA, 22 bp, Homo sapiens
gtgtctgctgcaccctcacacc

SEQ ID NO: 8009919 - DNA, 19 bp, Homo sapiens
gtgtctgcctttgtgccac

SEQ ID NO: 8009920 - DNA, 22 bp, Homo sapiens
gtgtctgcttgctgagcattta

SEQ ID NO: 8009921 - DNA, 22 bp, Homo sapiens
gtgtctgctttcagctagtagg

SEQ ID NO: 8009922 - DNA, 22 bp, Homo sapiens
gtgtctggaacgggtggtactc

SEQ ID NO: 8009923 - DNA, 22 bp, Homo sapiens
gtgtctgcttgctgagcattta

SEQ ID NO: 8009924 - DNA, 22 bp, Homo sapiens
gtgtctgcttggtcatctttca

SEQ ID NO: 8009925 - DNA, 22 bp, Homo sapiens
gtgtctgcttggtcatctttca

SEQ ID NO: 8009926 - DNA, 22 bp, Homo sapiens
gtgtctgctttcagctagtagg

SEQ ID NO: 8009927 - DNA, 22 bp, Homo sapiens
gtgtcttaattcttgttgttca

SEQ ID NO: 8009928 - DNA, 22 bp, Homo sapiens
gtgtctgttatacagaggagac

SEQ ID NO: 8009929 - DNA, 22 bp, Homo sapiens
gtgtctgtgtcattactaatag

SEQ ID NO: 8009930 - DNA, 20 bp, Homo sapiens
gtgtctggagtactagagag

SEQ ID NO: 8009931 - DNA, 22 bp, Homo sapiens
gtgtactgcaaatgctgctgcc

SEQ ID NO: 8009932 - DNA, 22 bp, Homo sapiens
gtgtacttctgctgagccatgg

SEQ ID NO: 8009933 - DNA, 22 bp, Homo sapiens
gtgtacatattgagtctgctga

SEQ ID NO: 8009934 - DNA, 22 bp, Homo sapiens
gtgtacatagaattgtgctttg

SEQ ID NO: 8009935 - DNA, 22 bp, Homo sapiens
gtgtacatagaattgtgctttg

SEQ ID NO: 8009936 - DNA, 22 bp, Homo sapiens
gtgtacatattgagtctgctga

SEQ ID NO: 8009937 - DNA, 22 bp, Homo sapiens
gtgtacatattgagtctgctga

SEQ ID NO: 8009938 - DNA, 19 bp, Homo sapiens
gtgtagctattggtcaaaa

SEQ ID NO: 8009939 - DNA, 22 bp, Homo sapiens
gtgtataacccaaatatgctgc

SEQ ID NO: 8009940 - DNA, 22 bp, Homo sapiens
gtgtagatagtttagatttcaa

SEQ ID NO: 8009941 - DNA, 22 bp, Homo sapiens
gtgtagatagtttagatttcaa

SEQ ID NO: 8009942 - DNA, 22 bp, Homo sapiens
gtgtagcatatagcaagagcat

SEQ ID NO: 8009943 - DNA, 22 bp, Homo sapiens
gtgtagatgcttgtgtacaact

SEQ ID NO: 8009944 - DNA, 22 bp, Homo sapiens
gtgtagcagaaagaaaattaga

SEQ ID NO: 8009945 - DNA, 22 bp, Homo sapiens
gtgtataatgctgtttgtacat

SEQ ID NO: 8009946 - DNA, 22 bp, Homo sapiens
gtgtataatgctttgaagatta

SEQ ID NO: 8009947 - DNA, 22 bp, Homo sapiens
gtgtataactatctatctagta

SEQ ID NO: 8009948 - DNA, 22 bp, Homo sapiens
gtgtatctgttaagtataaaaa

SEQ ID NO: 8009949 - DNA, 22 bp, Homo sapiens
gtgtatctggcatgtcgagtgt

SEQ ID NO: 8009950 - DNA, 22 bp, Homo sapiens
gtgtatccttattcacacacat

SEQ ID NO: 8009951 - DNA, 22 bp, Homo sapiens
gtgtatgcaattgagtcataga

SEQ ID NO: 8009952 - DNA, 22 bp, Homo sapiens
gtgtatgatttcaaatggctag

SEQ ID NO: 8009953 - DNA, 22 bp, Homo sapiens
gtgtatgaacgaaagaatggat

SEQ ID NO: 8009954 - DNA, 22 bp, Homo sapiens
gtgtatgagcctccagctgggc

SEQ ID NO: 8009955 - DNA, 22 bp, Homo sapiens
gtgtatgaggggagaatgtttt

SEQ ID NO: 8009956 - DNA, 22 bp, Homo sapiens
gtgtatggacacatgtcatgtt

SEQ ID NO: 8009957 - DNA, 19 bp, Homo sapiens
gtgtatgtaagttgtgagg

SEQ ID NO: 8009958 - DNA, 22 bp, Homo sapiens
gtgggtgtggaactgtgagacc

SEQ ID NO: 8009959 - DNA, 22 bp, Homo sapiens
gtgggtgtggaactgtgagacc

SEQ ID NO: 8009960 - DNA, 22 bp, Homo sapiens
gtgtacagtaagtgaatctagg

SEQ ID NO: 8009961 - DNA, 22 bp, Homo sapiens
gtgtacagtgatttgagttcac

SEQ ID NO: 8009962 - DNA, 22 bp, Homo sapiens
gtgtacatagaattgtgctttg

SEQ ID NO: 8009963 - DNA, 22 bp, Homo sapiens
gtggtaggcacagagaacaaga

SEQ ID NO: 8009964 - DNA, 22 bp, Homo sapiens
gtgtacaggatgactgtactta

SEQ ID NO: 8009965 - DNA, 22 bp, Homo sapiens
gtgggtggggagctctctggag

SEQ ID NO: 8009966 - DNA, 22 bp, Homo sapiens
gtgggtggggagctctctggag

SEQ ID NO: 8009967 - DNA, 22 bp, Homo sapiens
gtgggtggggagctctctggag

SEQ ID NO: 8009968 - DNA, 22 bp, Homo sapiens
gtgggtggggagctctctggag

SEQ ID NO: 8009969 - DNA, 22 bp, Homo sapiens
gtgggtggggagctctctggag

SEQ ID NO: 8009970 - DNA, 22 bp, Homo sapiens
gtgggtggattccagcaacgct

SEQ ID NO: 8009971 - DNA, 22 bp, Homo sapiens
gtgggtggattccagcaacgct

SEQ ID NO: 8009972 - DNA, 22 bp, Homo sapiens
gtgggtggatggctcacctcca

SEQ ID NO: 8009973 - DNA, 22 bp, Homo sapiens
gtgggtggggagctctctggag

SEQ ID NO: 8009974 - DNA, 22 bp, Homo sapiens
gtgggtgtcagtatctttaacg

SEQ ID NO: 8009975 - DNA, 22 bp, Homo sapiens
gtgggtggggagctctctggag

SEQ ID NO: 8009976 - DNA, 22 bp, Homo sapiens
gtgggtgtgataagaccaaggg

SEQ ID NO: 8009977 - DNA, 22 bp, Homo sapiens
gtgggtgtcctgtgaaggctca

SEQ ID NO: 8009978 - DNA, 22 bp, Homo sapiens
gtgggtgtgagtgacggcgtcc

SEQ ID NO: 8009979 - DNA, 22 bp, Homo sapiens
cagctgtctggggagtgctcgc

SEQ ID NO: 8009980 - DNA, 22 bp, Homo sapiens
cagctgtctttgcacagtttag

SEQ ID NO: 8009981 - DNA, 22 bp, Homo sapiens
cagctgtcttttctaaatatta

SEQ ID NO: 8009982 - DNA, 22 bp, Homo sapiens
cagctgtcttttctaaatatta

SEQ ID NO: 8009983 - DNA, 22 bp, Homo sapiens
cagctgtctggggagtgctcgc

SEQ ID NO: 8009984 - DNA, 22 bp, Homo sapiens
cagctgtctgctgaaggaagct

SEQ ID NO: 8009985 - DNA, 22 bp, Homo sapiens
cagctgtctgaagcaggagtcc

SEQ ID NO: 8009986 - DNA, 22 bp, Homo sapiens
cagctgtctgaagcaggagtcc

SEQ ID NO: 8009987 - DNA, 22 bp, Homo sapiens
cagctgtctcagggaggtgatc

SEQ ID NO: 8009988 - DNA, 22 bp, Homo sapiens
cagctgggtgatcttgggcagg

SEQ ID NO: 8009989 - DNA, 22 bp, Homo sapiens
cagctgtctaagttgagcagga

SEQ ID NO: 8009990 - DNA, 22 bp, Homo sapiens
cagctgtctaagttgagcagga

SEQ ID NO: 8009991 - DNA, 17 bp, Homo sapiens
cagctgtgagagcctta

SEQ ID NO: 8009992 - DNA, 17 bp, Homo sapiens
cagctgtgagagcctta

SEQ ID NO: 8009993 - DNA, 22 bp, Homo sapiens
cagctgtgagagtgcattgaag

SEQ ID NO: 8009994 - DNA, 17 bp, Homo sapiens
cagctgtgagagcctta

SEQ ID NO: 8009995 - DNA, 22 bp, Homo sapiens
cagctgtgagcagccagttgcc

SEQ ID NO: 8009996 - DNA, 22 bp, Homo sapiens
cagctgtgagcagccagttgcc

SEQ ID NO: 8009997 - DNA, 22 bp, Homo sapiens
cagctgtgagcagccagttgcc

SEQ ID NO: 8009998 - DNA, 22 bp, Homo sapiens
cagctgtgagcagccagttgcc

SEQ ID NO: 8009999 - DNA, 22 bp, Homo sapiens
cagctgtgagagtgcattgaag

SEQ ID NO: 8010000 - DNA, 22 bp, Homo sapiens
cagctgtgagagtgcattgaag

SEQ ID NO: 8010001 - DNA, 17 bp, Homo sapiens
cagctgtgagagcctta

SEQ ID NO: 8010002 - DNA, 17 bp, Homo sapiens
cagctgtgagagcctta

SEQ ID NO: 8010003 - DNA, 22 bp, Homo sapiens
cagctgtgacagccagttgatg

SEQ ID NO: 8010004 - DNA, 22 bp, Homo sapiens
cagctgtgacagccagttgatg

SEQ ID NO: 8010005 - DNA, 22 bp, Homo sapiens
cagctgtgacagccagttgatg

SEQ ID NO: 8010006 - DNA, 17 bp, Homo sapiens
cagctgtgagagcctta

SEQ ID NO: 8010007 - DNA, 22 bp, Homo sapiens
cagctgtgacagccagttgatg

SEQ ID NO: 8010008 - DNA, 22 bp, Homo sapiens
cagctgtgaattgtcttatcta

SEQ ID NO: 8010009 - DNA, 22 bp, Homo sapiens
cagctgtgaattgtcttatcta

SEQ ID NO: 8010010 - DNA, 22 bp, Homo sapiens
cagctgtgaattgtcttatcta

SEQ ID NO: 8010011 - DNA, 22 bp, Homo sapiens
cagctgtgacagccagttgatg

SEQ ID NO: 8010012 - DNA, 22 bp, Homo sapiens
cagctgtgacagccagttgatg

SEQ ID NO: 8010013 - DNA, 22 bp, Homo sapiens
cagctgggcctcctgagccctg

SEQ ID NO: 8010014 - DNA, 22 bp, Homo sapiens
cagctgggcctcctgagccctg

SEQ ID NO: 8010015 - DNA, 22 bp, Homo sapiens
cagctgggcctcctgagccctg

SEQ ID NO: 8010016 - DNA, 22 bp, Homo sapiens
cagctgggcctcctgagccctg

SEQ ID NO: 8010017 - DNA, 22 bp, Homo sapiens
cagctgggcctcctgagccctg

SEQ ID NO: 8010018 - DNA, 22 bp, Homo sapiens
cagctgggctaagagtagaggc

SEQ ID NO: 8010019 - DNA, 22 bp, Homo sapiens
cagctgggctaagagtagaggc

SEQ ID NO: 8010020 - DNA, 22 bp, Homo sapiens
cagctgggctaagagtagaggc

SEQ ID NO: 8010021 - DNA, 22 bp, Homo sapiens
cagctgggctaagagtagaggc

SEQ ID NO: 8010022 - DNA, 22 bp, Homo sapiens
cagctgggcctcctgagccctg

SEQ ID NO: 8010023 - DNA, 22 bp, Homo sapiens
cagctggggagagacatggcag

SEQ ID NO: 8010024 - DNA, 22 bp, Homo sapiens
cagctggggagagacatggcag

SEQ ID NO: 8010025 - DNA, 22 bp, Homo sapiens
cagctgggctaagagtagaggc

SEQ ID NO: 8010026 - DNA, 22 bp, Homo sapiens
cagctgggtgatcttgggcagg

SEQ ID NO: 8010027 - DNA, 22 bp, Homo sapiens
cagctgggtgatcttgggcagg

SEQ ID NO: 8010028 - DNA, 22 bp, Homo sapiens
cagctggggcagccacgtgcgg

SEQ ID NO: 8010029 - DNA, 22 bp, Homo sapiens
cagctgggtgatcttgggcagg

SEQ ID NO: 8010030 - DNA, 22 bp, Homo sapiens
cagctggggcagccacgtgcgg

SEQ ID NO: 8010031 - DNA, 22 bp, Homo sapiens
cagctggggcagccacgtgcgg

SEQ ID NO: 8010032 - DNA, 22 bp, Homo sapiens
cagctggggcagccacgtgcgg

SEQ ID NO: 8010033 - DNA, 22 bp, Homo sapiens
cagctggggcagccacgtgcgg

SEQ ID NO: 8010034 - DNA, 22 bp, Homo sapiens
cagctggggcagccacgtgcgg

SEQ ID NO: 8010035 - DNA, 22 bp, Homo sapiens
cagctggggcagccacgtgcgg

SEQ ID NO: 8010036 - DNA, 22 bp, Homo sapiens
cagctggggcagccacgtgcgg

SEQ ID NO: 8010037 - DNA, 22 bp, Homo sapiens
cagctggggagagacatggcag

SEQ ID NO: 8010038 - DNA, 22 bp, Homo sapiens
cagctggggagagacatggcag

SEQ ID NO: 8010039 - DNA, 22 bp, Homo sapiens
cagctggggagagacatggcag

SEQ ID NO: 8010040 - DNA, 22 bp, Homo sapiens
cagctggctgcggtgaggggac

SEQ ID NO: 8010041 - DNA, 22 bp, Homo sapiens
cagctggctgcggtgaggggac

SEQ ID NO: 8010042 - DNA, 22 bp, Homo sapiens
gtgtggccgtgtatccatggct

SEQ ID NO: 8010043 - DNA, 22 bp, Homo sapiens
gtgtggccgtgtatccatggct

SEQ ID NO: 8010044 - DNA, 22 bp, Homo sapiens
gtgtggcctcaacgggatgcaa

SEQ ID NO: 8010045 - DNA, 22 bp, Homo sapiens
cagctggctggtcagtgcacaa

SEQ ID NO: 8010046 - DNA, 22 bp, Homo sapiens
cagctggctggtcagtgcacaa

SEQ ID NO: 8010047 - DNA, 22 bp, Homo sapiens
cagctggctggtcagtgcacaa

SEQ ID NO: 8010048 - DNA, 22 bp, Homo sapiens
cagctgggagctccattagata

SEQ ID NO: 8010049 - DNA, 22 bp, Homo sapiens
cagctggcttgtttgttcttga

SEQ ID NO: 8010050 - DNA, 22 bp, Homo sapiens
cagctggctggtcagtgcacaa

SEQ ID NO: 8010051 - DNA, 22 bp, Homo sapiens
cagctggctggtcagtgcacaa

SEQ ID NO: 8010052 - DNA, 22 bp, Homo sapiens
gtgtggactctctggtgcacag

SEQ ID NO: 8010053 - DNA, 22 bp, Homo sapiens
gtgtggaagcagatgggtgagc

SEQ ID NO: 8010054 - DNA, 22 bp, Homo sapiens
gtgtggcaaggtgagaagtggg

SEQ ID NO: 8010055 - DNA, 22 bp, Homo sapiens
gtgtggcacctcctttccagct

SEQ ID NO: 8010056 - DNA, 19 bp, Homo sapiens
gtgtggcagagagtgacca

SEQ ID NO: 8010057 - DNA, 19 bp, Homo sapiens
gtgtggcagagagtgacca

SEQ ID NO: 8010058 - DNA, 19 bp, Homo sapiens
gtgtggcagagagtgacca

SEQ ID NO: 8010059 - DNA, 20 bp, Homo sapiens
gtgtggccaggagctgcgct

SEQ ID NO: 8010060 - DNA, 22 bp, Homo sapiens
gtgtggccaattatgggcattc

SEQ ID NO: 8010061 - DNA, 20 bp, Homo sapiens
gtgtggccaggagctgcgct

SEQ ID NO: 8010062 - DNA, 22 bp, Homo sapiens
gtgtggcagggcgtttgcagac

SEQ ID NO: 8010063 - DNA, 22 bp, Homo sapiens
gtgtggccaattatgggcattc

SEQ ID NO: 8010064 - DNA, 22 bp, Homo sapiens
gtgtggccctgcgtcctgagtc

SEQ ID NO: 8010065 - DNA, 22 bp, Homo sapiens
gtgtggccctgcgtcctgagtc

SEQ ID NO: 8010066 - DNA, 23 bp, Homo sapiens
gtgtggccccagggcctcctcgc

SEQ ID NO: 8010067 - DNA, 22 bp, Homo sapiens
gtgtgctgcccaactcgcagat

SEQ ID NO: 8010068 - DNA, 22 bp, Homo sapiens
gtgtgctgcccaactcgcagat

SEQ ID NO: 8010069 - DNA, 22 bp, Homo sapiens
gtgtgctgcccaactcgcagat

SEQ ID NO: 8010070 - DNA, 22 bp, Homo sapiens
gtgtgctgcccaactcgcagat

SEQ ID NO: 8010071 - DNA, 22 bp, Homo sapiens
gtgtgctgcccaactcgcagat

SEQ ID NO: 8010072 - DNA, 21 bp, Homo sapiens
gtgtgctgatacattggagaa

SEQ ID NO: 8010073 - DNA, 21 bp, Homo sapiens
gtgtgctgatacattggagaa

SEQ ID NO: 8010074 - DNA, 22 bp, Homo sapiens
gtgtgctgttgttcaggtagaa

SEQ ID NO: 8010075 - DNA, 22 bp, Homo sapiens
gtgtgctgttgttcaggtagaa

SEQ ID NO: 8010076 - DNA, 22 bp, Homo sapiens
gtgtgctgttgttcaggtagaa

SEQ ID NO: 8010077 - DNA, 22 bp, Homo sapiens
gtgtgctgttgttcaggtagaa

SEQ ID NO: 8010078 - DNA, 22 bp, Homo sapiens
gtgtgctgggaccacgctgggt

SEQ ID NO: 8010079 - DNA, 22 bp, Homo sapiens
gtgtgctgggaccacgctgggt

SEQ ID NO: 8010080 - DNA, 22 bp, Homo sapiens
gtgtgctgcccaactcgcagat

SEQ ID NO: 8010081 - DNA, 22 bp, Homo sapiens
gtgtgctgggaccacgctgggt

SEQ ID NO: 8010082 - DNA, 22 bp, Homo sapiens
gtgtggaaacagagagggcaac

SEQ ID NO: 8010083 - DNA, 22 bp, Homo sapiens
gtgtgctgttgttcaggtagaa

SEQ ID NO: 8010084 - DNA, 22 bp, Homo sapiens
gtgtggaaccaaataacctaaa

SEQ ID NO: 8010085 - DNA, 22 bp, Homo sapiens
gtgtggaatggagtttttgccc

SEQ ID NO: 8010086 - DNA, 22 bp, Homo sapiens
gtgtggaaccaaataacctaaa

SEQ ID NO: 8010087 - DNA, 21 bp, Homo sapiens
gtgtgctgatacattggagaa

SEQ ID NO: 8010088 - DNA, 22 bp, Homo sapiens
gtgtgctgagtgactgtcatca

SEQ ID NO: 8010089 - DNA, 22 bp, Homo sapiens
gtgtgctgagtgactgtcatca

SEQ ID NO: 8010090 - DNA, 22 bp, Homo sapiens
gtgtgctgagtgactgtcatca

SEQ ID NO: 8010091 - DNA, 22 bp, Homo sapiens
gtgtgctgagtgactgtcatca

SEQ ID NO: 8010092 - DNA, 22 bp, Homo sapiens
gtgtgctctggaggctagattt

SEQ ID NO: 8010093 - DNA, 18 bp, Homo sapiens
gtgtgctcagagagtgag

SEQ ID NO: 8010094 - DNA, 22 bp, Homo sapiens
gtgtgctcaagggcaggaacct

SEQ ID NO: 8010095 - DNA, 22 bp, Homo sapiens
gtgtgcgttcctagtaaacgtg

SEQ ID NO: 8010096 - DNA, 17 bp, Homo sapiens
gtgtgctactatcattt

SEQ ID NO: 8010097 - DNA, 17 bp, Homo sapiens
gtgtgctactatcattt

SEQ ID NO: 8010098 - DNA, 22 bp, Homo sapiens
gtgtgctcaagggcaggaacct

SEQ ID NO: 8010099 - DNA, 22 bp, Homo sapiens
gtgtgctattctcttatattca

SEQ ID NO: 8010100 - DNA, 22 bp, Homo sapiens
gtgtgcctttcacacactggga

SEQ ID NO: 8010101 - DNA, 22 bp, Homo sapiens
gtgtgcgccgacacagccaggt

SEQ ID NO: 8010102 - DNA, 22 bp, Homo sapiens
gtgtgcgcgctcataggtgtgt

SEQ ID NO: 8010103 - DNA, 22 bp, Homo sapiens
gtgtgcgctggtgcttggtcaa

SEQ ID NO: 8010104 - DNA, 22 bp, Homo sapiens
gtgggcaggccctaggcgattt

SEQ ID NO: 8010105 - DNA, 22 bp, Homo sapiens
gtgggcaggccctaggcgattt

SEQ ID NO: 8010106 - DNA, 22 bp, Homo sapiens
gtgggcaggccctaggcgattt

SEQ ID NO: 8010107 - DNA, 22 bp, Homo sapiens
gtgggcaggccctaggcgattt

SEQ ID NO: 8010108 - DNA, 22 bp, Homo sapiens
gtgggcaggccctaggcgattt

SEQ ID NO: 8010109 - DNA, 22 bp, Homo sapiens
gtgggcaggccctaggcgattt

SEQ ID NO: 8010110 - DNA, 22 bp, Homo sapiens
gtgggcaggccccaaagcaggg

SEQ ID NO: 8010111 - DNA, 22 bp, Homo sapiens
gtgggcaggccccaaagcaggg

SEQ ID NO: 8010112 - DNA, 22 bp, Homo sapiens
gtgggcaggccccaaagcaggg

SEQ ID NO: 8010113 - DNA, 22 bp, Homo sapiens
gtgggcaggccccaaagcaggg

SEQ ID NO: 8010114 - DNA, 22 bp, Homo sapiens
gtgggcaggagtgagcaacagg

SEQ ID NO: 8010115 - DNA, 22 bp, Homo sapiens
gtgggcaggccccaaagcaggg

SEQ ID NO: 8010116 - DNA, 22 bp, Homo sapiens
gtgggcaggccccaaagcaggg

SEQ ID NO: 8010117 - DNA, 22 bp, Homo sapiens
gtgggcaggccccaaagcaggg

SEQ ID NO: 8010118 - DNA, 22 bp, Homo sapiens
gtgggacagtcagaagtgagca

SEQ ID NO: 8010119 - DNA, 22 bp, Homo sapiens
gtgggacagcggggtgggacag

SEQ ID NO: 8010120 - DNA, 22 bp, Homo sapiens
gtgggcaggagtgagcaacagg

SEQ ID NO: 8010121 - DNA, 22 bp, Homo sapiens
gtgggcaggagtgagcaacagg

SEQ ID NO: 8010122 - DNA, 22 bp, Homo sapiens
gtgggcaggagtgagcaacagg

SEQ ID NO: 8010123 - DNA, 22 bp, Homo sapiens
gtgggcaggagtgagcaacagg

SEQ ID NO: 8010124 - DNA, 22 bp, Homo sapiens
gtgggactcttctttggcagtg

SEQ ID NO: 8010125 - DNA, 22 bp, Homo sapiens
gtgggactcttctttggcagtg

SEQ ID NO: 8010126 - DNA, 22 bp, Homo sapiens
gtgggcagtgcctgacggatga

SEQ ID NO: 8010127 - DNA, 22 bp, Homo sapiens
gtgggcagtgcctgacggatga

SEQ ID NO: 8010128 - DNA, 22 bp, Homo sapiens
gtgggcagtcatgaaatctaga

SEQ ID NO: 8010129 - DNA, 22 bp, Homo sapiens
gtgggcagtgcctgacggatga

SEQ ID NO: 8010130 - DNA, 22 bp, Homo sapiens
gtgggcagggttgctttctccg

SEQ ID NO: 8010131 - DNA, 22 bp, Homo sapiens
gtgggcaggtaggcaccagcta

SEQ ID NO: 8010132 - DNA, 22 bp, Homo sapiens
gtgggcaggtaggcaccagcta

SEQ ID NO: 8010133 - DNA, 22 bp, Homo sapiens
gtgggcaggtaggcaccagcta

SEQ ID NO: 8010134 - DNA, 22 bp, Homo sapiens
gtgggcaggtaggcaccagcta

SEQ ID NO: 8010135 - DNA, 22 bp, Homo sapiens
gtggggagggagatgctgaagt

SEQ ID NO: 8010136 - DNA, 22 bp, Homo sapiens
gtggggagggagatgctgaagt

SEQ ID NO: 8010137 - DNA, 22 bp, Homo sapiens
gtggggagggagatgctgaagt

SEQ ID NO: 8010138 - DNA, 22 bp, Homo sapiens
gtggggagggagatgctgaagt

SEQ ID NO: 8010139 - DNA, 22 bp, Homo sapiens
gtggggagggagatgctgaagt

SEQ ID NO: 8010140 - DNA, 22 bp, Homo sapiens
gtggggagggagatgctgaagt

SEQ ID NO: 8010141 - DNA, 22 bp, Homo sapiens
gtggggaggcctaagcaagttg

SEQ ID NO: 8010142 - DNA, 22 bp, Homo sapiens
gtgggcagtggggtcttctgcc

SEQ ID NO: 8010143 - DNA, 22 bp, Homo sapiens
gtgggcagtgcctgacggatga

SEQ ID NO: 8010144 - DNA, 22 bp, Homo sapiens
gtgggcagtggggtcttctgcc

SEQ ID NO: 8010145 - DNA, 22 bp, Homo sapiens
gtgggcagtggggtcttctgcc

SEQ ID NO: 8010146 - DNA, 22 bp, Homo sapiens
gtgggcagtggtttgcgcggtc

SEQ ID NO: 8010147 - DNA, 22 bp, Homo sapiens
gtgggcagtggggtcttctgcc

SEQ ID NO: 8010148 - DNA, 22 bp, Homo sapiens
gtgggaagaacttcaagtggct

SEQ ID NO: 8010149 - DNA, 22 bp, Homo sapiens
gtggctttgtttccaaatgaaa

SEQ ID NO: 8010150 - DNA, 22 bp, Homo sapiens
gtggcttggaccagtcacagtg

SEQ ID NO: 8010151 - DNA, 22 bp, Homo sapiens
gtggcttgagcaggggcagagg

SEQ ID NO: 8010152 - DNA, 22 bp, Homo sapiens
gtggcttggaccagtcacagtg

SEQ ID NO: 8010153 - DNA, 22 bp, Homo sapiens
gtggctttataggaagaggaac

SEQ ID NO: 8010154 - DNA, 22 bp, Homo sapiens
gtggcttgtgtgggaagtgcag

SEQ ID NO: 8010155 - DNA, 22 bp, Homo sapiens
gtggcttcttcttgggagctgc

SEQ ID NO: 8010156 - DNA, 22 bp, Homo sapiens
gtggcttctggctgggcctcag

SEQ ID NO: 8010157 - DNA, 22 bp, Homo sapiens
gtggcttctggctgggcctcag

SEQ ID NO: 8010158 - DNA, 22 bp, Homo sapiens
gtggcttggaccagtcacagtg

SEQ ID NO: 8010159 - DNA, 22 bp, Homo sapiens
gtggcttgaccatccctgctac

SEQ ID NO: 8010160 - DNA, 22 bp, Homo sapiens
gtggcttcttcttgggagctgc

SEQ ID NO: 8010161 - DNA, 19 bp, Homo sapiens
gtgggacagacattacata

SEQ ID NO: 8010162 - DNA, 22 bp, Homo sapiens
gtgggacaaggatgaagatatt

SEQ ID NO: 8010163 - DNA, 22 bp, Homo sapiens
gtgggaagtctctcggaggaag

SEQ ID NO: 8010164 - DNA, 22 bp, Homo sapiens
gtgggaagaacttcaagtggct

SEQ ID NO: 8010165 - DNA, 22 bp, Homo sapiens
gtgggaagaacttcaagtggct

SEQ ID NO: 8010166 - DNA, 22 bp, Homo sapiens
gtgggaagaacttcaagtggct

SEQ ID NO: 8010167 - DNA, 22 bp, Homo sapiens
gtggctcacacctgtaatccca

SEQ ID NO: 8010168 - DNA, 22 bp, Homo sapiens
gtggctagggacacagattgct

SEQ ID NO: 8010169 - DNA, 22 bp, Homo sapiens
gtggctagggacacagattgct

SEQ ID NO: 8010170 - DNA, 22 bp, Homo sapiens
gtggctcacacctgtaatccca

SEQ ID NO: 8010171 - DNA, 22 bp, Homo sapiens
gtggctcacacctgtaatccca

SEQ ID NO: 8010172 - DNA, 22 bp, Homo sapiens
gtggctcacagcaatgtttcct

SEQ ID NO: 8010173 - DNA, 22 bp, Homo sapiens
gtggctcacagcaatgtttcct

SEQ ID NO: 8010174 - DNA, 22 bp, Homo sapiens
gtggctcacagcaatgtttcct

SEQ ID NO: 8010175 - DNA, 22 bp, Homo sapiens
gtggctcacgcctgtaatccca

SEQ ID NO: 8010176 - DNA, 22 bp, Homo sapiens
gtggcttctgcggtgtgcgcag

SEQ ID NO: 8010177 - DNA, 22 bp, Homo sapiens
gtggcttctgcggtgtgcgcag

SEQ ID NO: 8010178 - DNA, 22 bp, Homo sapiens
gtggctcacgtctgtcatctca

SEQ ID NO: 8010179 - DNA, 22 bp, Homo sapiens
gtggctcagcggagctctgcac

SEQ ID NO: 8010180 - DNA, 22 bp, Homo sapiens
gtggctcacgcctgtaatccca

SEQ ID NO: 8010181 - DNA, 22 bp, Homo sapiens
gtggctcacgcctgtaatccca

SEQ ID NO: 8010182 - DNA, 22 bp, Homo sapiens
gtggctcacgtctgtcatctca

SEQ ID NO: 8010183 - DNA, 22 bp, Homo sapiens
gtggctaggcccaacggcagga

SEQ ID NO: 8010184 - DNA, 22 bp, Homo sapiens
gtggctagaaaaatatgggtgc

SEQ ID NO: 8010185 - DNA, 22 bp, Homo sapiens
gtggcggactcgacctggcctg

SEQ ID NO: 8010186 - DNA, 22 bp, Homo sapiens
gtggcgtgatctcggctcactg

SEQ ID NO: 8010187 - DNA, 22 bp, Homo sapiens
gtggcgcagagggtggcagaga

SEQ ID NO: 8010188 - DNA, 22 bp, Homo sapiens
gtggcgagtgcagcagatgcag

SEQ ID NO: 8010189 - DNA, 22 bp, Homo sapiens
gtggcggactcgacctggcctg

SEQ ID NO: 8010190 - DNA, 22 bp, Homo sapiens
gtggcgaggggaggtcctggcg

SEQ ID NO: 8010191 - DNA, 22 bp, Homo sapiens
gtggcgcagagggtggcagaga

SEQ ID NO: 8010192 - DNA, 22 bp, Homo sapiens
gtggcgaggggaggtcctggcg

SEQ ID NO: 8010193 - DNA, 22 bp, Homo sapiens
gtggccttgctcacatgtccag

SEQ ID NO: 8010194 - DNA, 22 bp, Homo sapiens
cagctgaacatgtagagcatct

SEQ ID NO: 8010195 - DNA, 22 bp, Homo sapiens
cagctgaagaaagagtggttag

SEQ ID NO: 8010196 - DNA, 22 bp, Homo sapiens
cagctgaaagaaggaagtgtca

SEQ ID NO: 8010197 - DNA, 22 bp, Homo sapiens
cagctcttttttgcagcagctg

SEQ ID NO: 8010198 - DNA, 22 bp, Homo sapiens
cagctctttattgccaatattc

SEQ ID NO: 8010199 - DNA, 22 bp, Homo sapiens
cagctctttgagtattccattt

SEQ ID NO: 8010200 - DNA, 22 bp, Homo sapiens
cagctctttttcacacaacatg

SEQ ID NO: 8010201 - DNA, 22 bp, Homo sapiens
cagctcttttttgcagcagctg

SEQ ID NO: 8010202 - DNA, 22 bp, Homo sapiens
cagctctttttcacacaacatg

SEQ ID NO: 8010203 - DNA, 22 bp, Homo sapiens
cagctcttttttgcagcagctg

SEQ ID NO: 8010204 - DNA, 22 bp, Homo sapiens
cagctctttattgccaatattc

SEQ ID NO: 8010205 - DNA, 18 bp, Homo sapiens
cagctcttctccagtaac

SEQ ID NO: 8010206 - DNA, 22 bp, Homo sapiens
cagctcttggagaaaccagagc

SEQ ID NO: 8010207 - DNA, 22 bp, Homo sapiens
cagctcttggagaaaccagagc

SEQ ID NO: 8010208 - DNA, 22 bp, Homo sapiens
cagctcttggagcctccagtaa

SEQ ID NO: 8010209 - DNA, 18 bp, Homo sapiens
cagctcttctccagtaac

SEQ ID NO: 8010210 - DNA, 18 bp, Homo sapiens
cagctcttctccagtaac

SEQ ID NO: 8010211 - DNA, 17 bp, Homo sapiens
cagctcttcctccctct

SEQ ID NO: 8010212 - DNA, 17 bp, Homo sapiens
cagctcttcctccctct

SEQ ID NO: 8010213 - DNA, 22 bp, Homo sapiens
cagctcttcctcccaccggaca

SEQ ID NO: 8010214 - DNA, 22 bp, Homo sapiens
cagctcttcctagccatgccac

SEQ ID NO: 8010215 - DNA, 22 bp, Homo sapiens
cagctcttcctagccatgccac

SEQ ID NO: 8010216 - DNA, 22 bp, Homo sapiens
cagctcttcctagccatgccac

SEQ ID NO: 8010217 - DNA, 22 bp, Homo sapiens
cagctcttcctagccatgccac

SEQ ID NO: 8010218 - DNA, 22 bp, Homo sapiens
cagctctgttgccctggaaacg

SEQ ID NO: 8010219 - DNA, 22 bp, Homo sapiens
cagctcttaacacagcttgtat

SEQ ID NO: 8010220 - DNA, 22 bp, Homo sapiens
cagctctgttgccctggaaacg

SEQ ID NO: 8010221 - DNA, 22 bp, Homo sapiens
cagctctgttgccaaagtgggc

SEQ ID NO: 8010222 - DNA, 22 bp, Homo sapiens
cagctctgttgccaaagtgggc

SEQ ID NO: 8010223 - DNA, 22 bp, Homo sapiens
cagctctgttgccaaagtgggc

SEQ ID NO: 8010224 - DNA, 22 bp, Homo sapiens
cagctctgttcaaactatccag

SEQ ID NO: 8010225 - DNA, 22 bp, Homo sapiens
cagctctgttcatagatggtgc

SEQ ID NO: 8010226 - DNA, 22 bp, Homo sapiens
cagctctgttcaaactatccag

SEQ ID NO: 8010227 - DNA, 22 bp, Homo sapiens
cagctctgttcatagatggtgc

SEQ ID NO: 8010228 - DNA, 22 bp, Homo sapiens
cagctcttcctaccctagttgg

SEQ ID NO: 8010229 - DNA, 22 bp, Homo sapiens
cagctcttcctaccctagttgg

SEQ ID NO: 8010230 - DNA, 22 bp, Homo sapiens
cagctcttcctaccctagttgg

SEQ ID NO: 8010231 - DNA, 22 bp, Homo sapiens
cagctcttccctcttcttgtag

SEQ ID NO: 8010232 - DNA, 22 bp, Homo sapiens
cagctcttccatttccttcagc

SEQ ID NO: 8010233 - DNA, 22 bp, Homo sapiens
cagctcttcagtgcctgagata

SEQ ID NO: 8010234 - DNA, 22 bp, Homo sapiens
cagctcttccatttccttcagc

SEQ ID NO: 8010235 - DNA, 22 bp, Homo sapiens
cagctcttccatttccttcagc

SEQ ID NO: 8010236 - DNA, 22 bp, Homo sapiens
cagctcttattttctctcctaa

SEQ ID NO: 8010237 - DNA, 22 bp, Homo sapiens
cagctcttattttctctcctaa

SEQ ID NO: 8010238 - DNA, 22 bp, Homo sapiens
cagctcttcagagtgagcaatg

SEQ ID NO: 8010239 - DNA, 22 bp, Homo sapiens
cagctcttcagagtgagcaatg

SEQ ID NO: 8010240 - DNA, 22 bp, Homo sapiens
cagctcttaacacagcttgtat

SEQ ID NO: 8010241 - DNA, 22 bp, Homo sapiens
cagctcttagagggagacagac

SEQ ID NO: 8010242 - DNA, 22 bp, Homo sapiens
cagctcttagagggagacagac

SEQ ID NO: 8010243 - DNA, 22 bp, Homo sapiens
cagctgaggtcttttttatgtg

SEQ ID NO: 8010244 - DNA, 22 bp, Homo sapiens
cagctgaggtcttttttatgtg

SEQ ID NO: 8010245 - DNA, 22 bp, Homo sapiens
cagctgagtatgcattcaagca

SEQ ID NO: 8010246 - DNA, 22 bp, Homo sapiens
cagctgaggtcaaagaagcagg

SEQ ID NO: 8010247 - DNA, 22 bp, Homo sapiens
cagctgaggaatactagatgta

SEQ ID NO: 8010248 - DNA, 22 bp, Homo sapiens
cagctgagctgccagactactg

SEQ ID NO: 8010249 - DNA, 22 bp, Homo sapiens
cagctgaggaatactagatgta

SEQ ID NO: 8010250 - DNA, 18 bp, Homo sapiens
cagctgaggaccaaactg

SEQ ID NO: 8010251 - DNA, 22 bp, Homo sapiens
cagctgaggaatactagatgta

SEQ ID NO: 8010252 - DNA, 22 bp, Homo sapiens
cagctgagcatcactagtctgg

SEQ ID NO: 8010253 - DNA, 22 bp, Homo sapiens
cagctgagcatcactagtctgg

SEQ ID NO: 8010254 - DNA, 22 bp, Homo sapiens
cagctgaagagaggtgctgagt

SEQ ID NO: 8010255 - DNA, 23 bp, Homo sapiens
cagctgaagcagcctgggctgga

SEQ ID NO: 8010256 - DNA, 22 bp, Homo sapiens
cagctgagctcccaggccatca

SEQ ID NO: 8010257 - DNA, 22 bp, Homo sapiens
cagctgagcatcactagtctgg

SEQ ID NO: 8010258 - DNA, 22 bp, Homo sapiens
cagctgagctgccagactactg

SEQ ID NO: 8010259 - DNA, 22 bp, Homo sapiens
cagctgagtctgaggttctttg

SEQ ID NO: 8010260 - DNA, 22 bp, Homo sapiens
cagctgagtggaccctagaggc

SEQ ID NO: 8010261 - DNA, 22 bp, Homo sapiens
cagctgagtggaccctagaggc

SEQ ID NO: 8010262 - DNA, 22 bp, Homo sapiens
cagctgagtggaccctagaggc

SEQ ID NO: 8010263 - DNA, 22 bp, Homo sapiens
cagctgagtgttggcatgttca

SEQ ID NO: 8010264 - DNA, 22 bp, Homo sapiens
cagctgagtgttggcatgttca

SEQ ID NO: 8010265 - DNA, 22 bp, Homo sapiens
cagctgagtgttggcatgttca

SEQ ID NO: 8010266 - DNA, 22 bp, Homo sapiens
cagctgagtggaccctagaggc

SEQ ID NO: 8010267 - DNA, 22 bp, Homo sapiens
cagctgagttactctgaggtct

SEQ ID NO: 8010268 - DNA, 22 bp, Homo sapiens
cagctgagttactctgaggtct

SEQ ID NO: 8010269 - DNA, 22 bp, Homo sapiens
cagctgagttactctgaggtct

SEQ ID NO: 8010270 - DNA, 22 bp, Homo sapiens
cagctgagttactctgaggtct

SEQ ID NO: 8010271 - DNA, 22 bp, Homo sapiens
cagctgagtttccaagtctgcc

SEQ ID NO: 8010272 - DNA, 22 bp, Homo sapiens
cagctgagttactctgaggtct

SEQ ID NO: 8010273 - DNA, 22 bp, Homo sapiens
cagctgagtttccaagtctgcc

SEQ ID NO: 8010274 - DNA, 22 bp, Homo sapiens
cagctgagtttccaagtctgcc

SEQ ID NO: 8010275 - DNA, 22 bp, Homo sapiens
gtggcctgtcagaagccgtggg

SEQ ID NO: 8010276 - DNA, 22 bp, Homo sapiens
gtggcctgtcagaagccgtggg

SEQ ID NO: 8010277 - DNA, 22 bp, Homo sapiens
gtggcctgtcagaagccgtggg

SEQ ID NO: 8010278 - DNA, 22 bp, Homo sapiens
gtggcctgtcagaagccgtggg

SEQ ID NO: 8010279 - DNA, 22 bp, Homo sapiens
cagctgagtttccaagtctgcc

SEQ ID NO: 8010280 - DNA, 22 bp, Homo sapiens
cagctgagtttccaagtctgcc

SEQ ID NO: 8010281 - DNA, 22 bp, Homo sapiens
cagctgagtttccaagtctgcc

SEQ ID NO: 8010282 - DNA, 20 bp, Homo sapiens
gtggcctgtcctgttgtggg

SEQ ID NO: 8010283 - DNA, 22 bp, Homo sapiens
gtggcagtcggaagtcaggaga

SEQ ID NO: 8010284 - DNA, 22 bp, Homo sapiens
gtggcagtcatcaaggacagat

SEQ ID NO: 8010285 - DNA, 22 bp, Homo sapiens
gtggcagtctcatctgtggctc

SEQ ID NO: 8010286 - DNA, 22 bp, Homo sapiens
gtggcagtcggaagtcaggaga

SEQ ID NO: 8010287 - DNA, 22 bp, Homo sapiens
gtggcagtctcatctgtggctc

SEQ ID NO: 8010288 - DNA, 22 bp, Homo sapiens
gtggcagtcggaagtcaggaga

SEQ ID NO: 8010289 - DNA, 22 bp, Homo sapiens
gtggcaggttccgtagacagca

SEQ ID NO: 8010290 - DNA, 22 bp, Homo sapiens
gtggcaggttccgtagacagca

SEQ ID NO: 8010291 - DNA, 22 bp, Homo sapiens
gtggcaggttccgtagacagca

SEQ ID NO: 8010292 - DNA, 22 bp, Homo sapiens
gtggcaggttccgtagacagca

SEQ ID NO: 8010293 - DNA, 22 bp, Homo sapiens
gtggcaggttccgtagacagca

SEQ ID NO: 8010294 - DNA, 22 bp, Homo sapiens
gtggcagtagacagtgcatcta

SEQ ID NO: 8010295 - DNA, 22 bp, Homo sapiens
gtggcagtagacagtgcatcta

SEQ ID NO: 8010296 - DNA, 22 bp, Homo sapiens
gtggcagtagacagtgcatcta

SEQ ID NO: 8010297 - DNA, 22 bp, Homo sapiens
gtggcagtagacagtgcatcta

SEQ ID NO: 8010298 - DNA, 22 bp, Homo sapiens
gtggcagtagacagtgcatcta

SEQ ID NO: 8010299 - DNA, 22 bp, Homo sapiens
gtggcagtagacagtgcatcta

SEQ ID NO: 8010300 - DNA, 22 bp, Homo sapiens
gtggcagtgaggcaggagcagt

SEQ ID NO: 8010301 - DNA, 22 bp, Homo sapiens
gtggcagtgaggcaggagcagt

SEQ ID NO: 8010302 - DNA, 22 bp, Homo sapiens
gtggccaggcgtccgcgcggct

SEQ ID NO: 8010303 - DNA, 22 bp, Homo sapiens
gtggccaggccgactgccaggc

SEQ ID NO: 8010304 - DNA, 19 bp, Homo sapiens
gtggccagggcaggggctg

SEQ ID NO: 8010305 - DNA, 19 bp, Homo sapiens
gtggccagggcaggggctg

SEQ ID NO: 8010306 - DNA, 19 bp, Homo sapiens
gtggccagggcaggggctg

SEQ ID NO: 8010307 - DNA, 19 bp, Homo sapiens
gtggccagggcaggggctg

SEQ ID NO: 8010308 - DNA, 22 bp, Homo sapiens
gtggccaggcgtccgcgcggct

SEQ ID NO: 8010309 - DNA, 22 bp, Homo sapiens
gtggccagtcccgatgcttgtt

SEQ ID NO: 8010310 - DNA, 22 bp, Homo sapiens
gtggccagtcccgatgcttgtt

SEQ ID NO: 8010311 - DNA, 22 bp, Homo sapiens
gtggccagtcccgatgcttgtt

SEQ ID NO: 8010312 - DNA, 22 bp, Homo sapiens
gtggccagtcccgatgcttgtt

SEQ ID NO: 8010313 - DNA, 22 bp, Homo sapiens
gtggccaggtcagggacttgtg

SEQ ID NO: 8010314 - DNA, 22 bp, Homo sapiens
gtggccagggcccacaggatga

SEQ ID NO: 8010315 - DNA, 22 bp, Homo sapiens
gtggccagggcccacaggatga

SEQ ID NO: 8010316 - DNA, 22 bp, Homo sapiens
gtggccagggcccacaggatga

SEQ ID NO: 8010317 - DNA, 22 bp, Homo sapiens
gtggccagggcccacaggatga

SEQ ID NO: 8010318 - DNA, 19 bp, Homo sapiens
gtggccagggcaggggctg

SEQ ID NO: 8010319 - DNA, 22 bp, Homo sapiens
gtggccaggtcagggacttgtg

SEQ ID NO: 8010320 - DNA, 22 bp, Homo sapiens
gtggccaggtcagggacttgtg

SEQ ID NO: 8010321 - DNA, 22 bp, Homo sapiens
gtggccagggcccacaggatga

SEQ ID NO: 8010322 - DNA, 22 bp, Homo sapiens
gtggccagtggtgggcgccctg

SEQ ID NO: 8010323 - DNA, 22 bp, Homo sapiens
gtggccatacatgtccatatta

SEQ ID NO: 8010324 - DNA, 22 bp, Homo sapiens
gtggccatttggaaggcaagta

SEQ ID NO: 8010325 - DNA, 22 bp, Homo sapiens
gtggccatctttggccctgact

SEQ ID NO: 8010326 - DNA, 22 bp, Homo sapiens
gtggccatgtgcttgcagggta

SEQ ID NO: 8010327 - DNA, 22 bp, Homo sapiens
gtggccagtcccgatgcttgtt

SEQ ID NO: 8010328 - DNA, 22 bp, Homo sapiens
gtggccagtggtgggcgccctg

SEQ ID NO: 8010329 - DNA, 22 bp, Homo sapiens
gtggccagtgggaatgggctca

SEQ ID NO: 8010330 - DNA, 22 bp, Homo sapiens
gtggccagtgggaatgggctca

SEQ ID NO: 8010331 - DNA, 21 bp, Homo sapiens
gtggccagtgactacttattg

SEQ ID NO: 8010332 - DNA, 22 bp, Homo sapiens
gtggccagtgggaatgggctca

SEQ ID NO: 8010333 - DNA, 22 bp, Homo sapiens
cagctctgctggtggtgccagg

SEQ ID NO: 8010334 - DNA, 22 bp, Homo sapiens
cagctctgctggtggtgccagg

SEQ ID NO: 8010335 - DNA, 22 bp, Homo sapiens
cagctctgcttccttgtacagg

SEQ ID NO: 8010336 - DNA, 22 bp, Homo sapiens
cagctctgcttccttgtacagg

SEQ ID NO: 8010337 - DNA, 22 bp, Homo sapiens
cagctctgcttccttgtacagg

SEQ ID NO: 8010338 - DNA, 22 bp, Homo sapiens
cagctctgcttccttgtacagg

SEQ ID NO: 8010339 - DNA, 22 bp, Homo sapiens
cagctctgctggtggtgccagg

SEQ ID NO: 8010340 - DNA, 22 bp, Homo sapiens
cagctctgctggtggtgccagg

SEQ ID NO: 8010341 - DNA, 22 bp, Homo sapiens
cagctctgctggtggtgccagg

SEQ ID NO: 8010342 - DNA, 22 bp, Homo sapiens
gtggcccacacagacagcatct

SEQ ID NO: 8010343 - DNA, 22 bp, Homo sapiens
cagctctgctgggaggatgcag

SEQ ID NO: 8010344 - DNA, 22 bp, Homo sapiens
cagctctgctgggaggatgcag

SEQ ID NO: 8010345 - DNA, 22 bp, Homo sapiens
cagctctgctgggaggatgcag

SEQ ID NO: 8010346 - DNA, 22 bp, Homo sapiens
gtggccattttttcctagcaca

SEQ ID NO: 8010347 - DNA, 22 bp, Homo sapiens
gtggccatgttgctttcctttg

SEQ ID NO: 8010348 - DNA, 22 bp, Homo sapiens
cagctctgctggtggtgccagg

SEQ ID NO: 8010349 - DNA, 22 bp, Homo sapiens
cagctctgctggtggtgccagg

SEQ ID NO: 8010350 - DNA, 22 bp, Homo sapiens
cagctctgctggtggtgccagg

SEQ ID NO: 8010351 - DNA, 22 bp, Homo sapiens
cagctctggcgtcagggagcga

SEQ ID NO: 8010352 - DNA, 22 bp, Homo sapiens
cagctctggcgtcagggagcga

SEQ ID NO: 8010353 - DNA, 22 bp, Homo sapiens
cagctctggcgtcagggagcga

SEQ ID NO: 8010354 - DNA, 22 bp, Homo sapiens
cagctctggcgtcagggagcga

SEQ ID NO: 8010355 - DNA, 22 bp, Homo sapiens
cagctctggcgtcagggagcga

SEQ ID NO: 8010356 - DNA, 22 bp, Homo sapiens
cagctctggcgtcagggagcga

SEQ ID NO: 8010357 - DNA, 22 bp, Homo sapiens
cagctctggcgtcagggagcga

SEQ ID NO: 8010358 - DNA, 22 bp, Homo sapiens
cagctctggcagagcccaaccc

SEQ ID NO: 8010359 - DNA, 22 bp, Homo sapiens
cagctctggccagatctatcct

SEQ ID NO: 8010360 - DNA, 22 bp, Homo sapiens
cagctctggcagagcccaaccc

SEQ ID NO: 8010361 - DNA, 22 bp, Homo sapiens
cagctctggcagagcccaaccc

SEQ ID NO: 8010362 - DNA, 22 bp, Homo sapiens
cagctctgtgcaggcctgggga

SEQ ID NO: 8010363 - DNA, 22 bp, Homo sapiens
cagctctgtgcaggcctgggga

SEQ ID NO: 8010364 - DNA, 22 bp, Homo sapiens
cagctctgtgcaggcctgggga

SEQ ID NO: 8010365 - DNA, 22 bp, Homo sapiens
cagctctgtgcaggcctgggga

SEQ ID NO: 8010366 - DNA, 22 bp, Homo sapiens
cagctctgtgcaggcctgggga

SEQ ID NO: 8010367 - DNA, 22 bp, Homo sapiens
cagctctgtgcaggcctgggga

SEQ ID NO: 8010368 - DNA, 22 bp, Homo sapiens
cagctctgtgcaggcctgggga

SEQ ID NO: 8010369 - DNA, 22 bp, Homo sapiens
cagctctgtgggagcgtatgtg

SEQ ID NO: 8010370 - DNA, 22 bp, Homo sapiens
cagctctggctattgaggacca

SEQ ID NO: 8010371 - DNA, 22 bp, Homo sapiens
cagctctggctattgaggacca

SEQ ID NO: 8010372 - DNA, 22 bp, Homo sapiens
cagctctggctattgaggacca

SEQ ID NO: 8010373 - DNA, 22 bp, Homo sapiens
cagctctggctattgaggacca

SEQ ID NO: 8010374 - DNA, 22 bp, Homo sapiens
cagctctggctattgaggacca

SEQ ID NO: 8010375 - DNA, 22 bp, Homo sapiens
cagctctggctttggggagctt

SEQ ID NO: 8010376 - DNA, 22 bp, Homo sapiens
cagctctggctttggggagctt

SEQ ID NO: 8010377 - DNA, 22 bp, Homo sapiens
cagctctggctttggggagctt

SEQ ID NO: 8010378 - DNA, 20 bp, Homo sapiens
cagctctgggaaagaggcca

SEQ ID NO: 8010379 - DNA, 20 bp, Homo sapiens
cagctctgggaaagaggcca

SEQ ID NO: 8010380 - DNA, 22 bp, Homo sapiens
cagctctgggagtcccacccct

SEQ ID NO: 8010381 - DNA, 20 bp, Homo sapiens
cagctctgggaaagaggcca

SEQ ID NO: 8010382 - DNA, 20 bp, Homo sapiens
cagctctgggaaagaggcca

SEQ ID NO: 8010383 - DNA, 20 bp, Homo sapiens
cagctctgggaaagaggcca

SEQ ID NO: 8010384 - DNA, 22 bp, Homo sapiens
cagcccagccgagggcctggct

SEQ ID NO: 8010385 - DNA, 22 bp, Homo sapiens
cagcccagccgagggcctggct

SEQ ID NO: 8010386 - DNA, 22 bp, Homo sapiens
cagcccagccgagggcctggct

SEQ ID NO: 8010387 - DNA, 22 bp, Homo sapiens
cagcccagccgagggcctggct

SEQ ID NO: 8010388 - DNA, 22 bp, Homo sapiens
cagcccagccgagggcctggct

SEQ ID NO: 8010389 - DNA, 21 bp, Homo sapiens
cagcccagcccattgacagtg

SEQ ID NO: 8010390 - DNA, 22 bp, Homo sapiens
cagcccagccgagggcctggct

SEQ ID NO: 8010391 - DNA, 22 bp, Homo sapiens
cagcccagcgcaaacaactggc

SEQ ID NO: 8010392 - DNA, 22 bp, Homo sapiens
cagcccagcgcaaacaactggc

SEQ ID NO: 8010393 - DNA, 22 bp, Homo sapiens
cagcccagccttgtctctttat

SEQ ID NO: 8010394 - DNA, 22 bp, Homo sapiens
cagcccagccttgtctctttat

SEQ ID NO: 8010395 - DNA, 22 bp, Homo sapiens
cagcccagccttgtctctttat

SEQ ID NO: 8010396 - DNA, 22 bp, Homo sapiens
cagcccagccgagggcctggct

SEQ ID NO: 8010397 - DNA, 22 bp, Homo sapiens
cagcccagccgagggcctggct

SEQ ID NO: 8010398 - DNA, 21 bp, Homo sapiens
cagcccagcttcttccccagt

SEQ ID NO: 8010399 - DNA, 21 bp, Homo sapiens
cagcccagcttcttccccagt

SEQ ID NO: 8010400 - DNA, 21 bp, Homo sapiens
cagcccagcttcttccccagt

SEQ ID NO: 8010401 - DNA, 21 bp, Homo sapiens
cagcccagcttcttccccagt

SEQ ID NO: 8010402 - DNA, 22 bp, Homo sapiens
cagcccagctgggatcacactc

SEQ ID NO: 8010403 - DNA, 22 bp, Homo sapiens
cagcccagctgggatcacactc

SEQ ID NO: 8010404 - DNA, 22 bp, Homo sapiens
cagcccagcgcaaacaactggc

SEQ ID NO: 8010405 - DNA, 22 bp, Homo sapiens
cagcccagcgcaaacaactggc

SEQ ID NO: 8010406 - DNA, 22 bp, Homo sapiens
cagcccaggactgcaggtgttt

SEQ ID NO: 8010407 - DNA, 22 bp, Homo sapiens
cagcccaggactgcaggtgttt

SEQ ID NO: 8010408 - DNA, 22 bp, Homo sapiens
cagcccaggactgcaggtgttt

SEQ ID NO: 8010409 - DNA, 22 bp, Homo sapiens
cagcccaggccgacagttcctc

SEQ ID NO: 8010410 - DNA, 22 bp, Homo sapiens
cagcccaggactgcaggtgttt

SEQ ID NO: 8010411 - DNA, 22 bp, Homo sapiens
cagcccaggactgcaggtgttt

SEQ ID NO: 8010412 - DNA, 22 bp, Homo sapiens
cagcccaggactgcaggtgttt

SEQ ID NO: 8010413 - DNA, 22 bp, Homo sapiens
cagcccaggactgcaggtgttt

SEQ ID NO: 8010414 - DNA, 22 bp, Homo sapiens
cagcccaggccgacagttcctc

SEQ ID NO: 8010415 - DNA, 22 bp, Homo sapiens
cagcccaggccgacagttcctc

SEQ ID NO: 8010416 - DNA, 22 bp, Homo sapiens
cagcccaggccgacagttcctc

SEQ ID NO: 8010417 - DNA, 22 bp, Homo sapiens
cagcccaggccgacagttcctc

SEQ ID NO: 8010418 - DNA, 22 bp, Homo sapiens
cagcccaggccgacagttcctc

SEQ ID NO: 8010419 - DNA, 22 bp, Homo sapiens
gtggcagaaactggcagaggag

SEQ ID NO: 8010420 - DNA, 22 bp, Homo sapiens
gtggcagaaactggcagaggag

SEQ ID NO: 8010421 - DNA, 22 bp, Homo sapiens
gtggcagaaactggcagaggag

SEQ ID NO: 8010422 - DNA, 22 bp, Homo sapiens
gtggcagaaactggcagaggag

SEQ ID NO: 8010423 - DNA, 22 bp, Homo sapiens
gtggcactgtttcccacggaag

SEQ ID NO: 8010424 - DNA, 22 bp, Homo sapiens
gtggcactggtagttttaagat

SEQ ID NO: 8010425 - DNA, 22 bp, Homo sapiens
gtggcactgtttcccacggaag

SEQ ID NO: 8010426 - DNA, 22 bp, Homo sapiens
gtggcactgggtgagtgagtga

SEQ ID NO: 8010427 - DNA, 22 bp, Homo sapiens
gtggcactgggtgagtgagtga

SEQ ID NO: 8010428 - DNA, 22 bp, Homo sapiens
cagcccaggccgacagttcctc

SEQ ID NO: 8010429 - DNA, 22 bp, Homo sapiens
gtggagccaggggctgtaggta

SEQ ID NO: 8010430 - DNA, 22 bp, Homo sapiens
gtggagccaggggctgtaggta

SEQ ID NO: 8010431 - DNA, 22 bp, Homo sapiens
gtggcactgatagtttcactct

SEQ ID NO: 8010432 - DNA, 22 bp, Homo sapiens
gtggagccctgccttgctcatg

SEQ ID NO: 8010433 - DNA, 22 bp, Homo sapiens
gtggcactgggtgagtgagtga

SEQ ID NO: 8010434 - DNA, 22 bp, Homo sapiens
gtggcactggggtctagctggc

SEQ ID NO: 8010435 - DNA, 22 bp, Homo sapiens
gtggcaggttataagcatctca

SEQ ID NO: 8010436 - DNA, 22 bp, Homo sapiens
gtggcaggttataagcatctca

SEQ ID NO: 8010437 - DNA, 22 bp, Homo sapiens
gtggcaggtggagcctcctgca

SEQ ID NO: 8010438 - DNA, 22 bp, Homo sapiens
gtggcaggttataagcatctca

SEQ ID NO: 8010439 - DNA, 22 bp, Homo sapiens
gtggcaggttataagcatctca

SEQ ID NO: 8010440 - DNA, 22 bp, Homo sapiens
gtggcaggttataagcatctca

SEQ ID NO: 8010441 - DNA, 22 bp, Homo sapiens
gtggcaggttataagcatctca

SEQ ID NO: 8010442 - DNA, 22 bp, Homo sapiens
gtggcaggttccgtagacagca

SEQ ID NO: 8010443 - DNA, 22 bp, Homo sapiens
gtggcaggttccgtagacagca

SEQ ID NO: 8010444 - DNA, 22 bp, Homo sapiens
gtggcaggttccgtagacagca

SEQ ID NO: 8010445 - DNA, 22 bp, Homo sapiens
gtggcaggttataagcatctca

SEQ ID NO: 8010446 - DNA, 22 bp, Homo sapiens
gtggcaggtggagcctcctgca

SEQ ID NO: 8010447 - DNA, 22 bp, Homo sapiens
gtggcaggtggagcctcctgca

SEQ ID NO: 8010448 - DNA, 22 bp, Homo sapiens
gtggcaggtggagcctcctgca

SEQ ID NO: 8010449 - DNA, 22 bp, Homo sapiens
gtggcaggttataagcatctca

SEQ ID NO: 8010450 - DNA, 22 bp, Homo sapiens
gtggcaggttataagcatctca

SEQ ID NO: 8010451 - DNA, 22 bp, Homo sapiens
gtggcaggtggagcctcctgca

SEQ ID NO: 8010452 - DNA, 22 bp, Homo sapiens
gtggcaggtcccattggagcag

SEQ ID NO: 8010453 - DNA, 22 bp, Homo sapiens
gtggcaggtggagcctcctgca

SEQ ID NO: 8010454 - DNA, 22 bp, Homo sapiens
gtggcaggtggagcctcctgca

SEQ ID NO: 8010455 - DNA, 22 bp, Homo sapiens
gtggcaggtggagcctcctgca

SEQ ID NO: 8010456 - DNA, 22 bp, Homo sapiens
gtggcagagccaaggctggagc

SEQ ID NO: 8010457 - DNA, 22 bp, Homo sapiens
gtggcagagccaaggctggagc

SEQ ID NO: 8010458 - DNA, 22 bp, Homo sapiens
gtggcagagccaaggctggagc

SEQ ID NO: 8010459 - DNA, 22 bp, Homo sapiens
gtggcagagccaaggctggagc

SEQ ID NO: 8010460 - DNA, 22 bp, Homo sapiens
gtggcagggtgctcatcatgca

SEQ ID NO: 8010461 - DNA, 22 bp, Homo sapiens
gtggcagggtgctcatcatgca

SEQ ID NO: 8010462 - DNA, 22 bp, Homo sapiens
gtggcagggtgctcatcatgca

SEQ ID NO: 8010463 - DNA, 22 bp, Homo sapiens
gtggcagggtgctcatcatgca

SEQ ID NO: 8010464 - DNA, 22 bp, Homo sapiens
gtggcaggtcccattggagcag

SEQ ID NO: 8010465 - DNA, 22 bp, Homo sapiens
gtggcaggtcccattggagcag

SEQ ID NO: 8010466 - DNA, 22 bp, Homo sapiens
gtggcaggtcccattggagcag

SEQ ID NO: 8010467 - DNA, 22 bp, Homo sapiens
gtggcaggtcccattggagcag

SEQ ID NO: 8010468 - DNA, 22 bp, Homo sapiens
gtggcaggtcccattggagcag

SEQ ID NO: 8010469 - DNA, 22 bp, Homo sapiens
gtggcagggtgctcatcatgca

SEQ ID NO: 8010470 - DNA, 22 bp, Homo sapiens
gtggcaggtcccattggagcag

SEQ ID NO: 8010471 - DNA, 22 bp, Homo sapiens
gtggcaggtcccattggagcag

SEQ ID NO: 8010472 - DNA, 22 bp, Homo sapiens
gtggcaggtcccattggagcag

SEQ ID NO: 8010473 - DNA, 22 bp, Homo sapiens
gtggcagagagcaagtgtctga

SEQ ID NO: 8010474 - DNA, 22 bp, Homo sapiens
gtggcagagcaggagacaggac

SEQ ID NO: 8010475 - DNA, 22 bp, Homo sapiens
gtggcagagatagaactggaat

SEQ ID NO: 8010476 - DNA, 22 bp, Homo sapiens
gtggcagagcaggagacaggac

SEQ ID NO: 8010477 - DNA, 22 bp, Homo sapiens
gtggcagagcaggagacaggac

SEQ ID NO: 8010478 - DNA, 22 bp, Homo sapiens
gtggcagagaacaaggagaggt

SEQ ID NO: 8010479 - DNA, 22 bp, Homo sapiens
gtggcagagaacaaggagaggt

SEQ ID NO: 8010480 - DNA, 22 bp, Homo sapiens
gtggcagagaacaaggagaggt

SEQ ID NO: 8010481 - DNA, 22 bp, Homo sapiens
gtggcagagaacaaggagaggt

SEQ ID NO: 8010482 - DNA, 22 bp, Homo sapiens
gtggcagagaacaaggagaggt

SEQ ID NO: 8010483 - DNA, 22 bp, Homo sapiens
gtggcagagaacaaggagaggt

SEQ ID NO: 8010484 - DNA, 22 bp, Homo sapiens
gtggcagaaactggcagaggag

SEQ ID NO: 8010485 - DNA, 22 bp, Homo sapiens
gtggcagaaactggcagaggag

SEQ ID NO: 8010486 - DNA, 22 bp, Homo sapiens
gtggcagaaactggcagaggag

SEQ ID NO: 8010487 - DNA, 22 bp, Homo sapiens
gtggcagaaatgggactttgag

SEQ ID NO: 8010488 - DNA, 22 bp, Homo sapiens
gtggcagaaatgggactttgag

SEQ ID NO: 8010489 - DNA, 22 bp, Homo sapiens
gtggcagaaatgggactttgag

SEQ ID NO: 8010490 - DNA, 22 bp, Homo sapiens
gtggcagaaatattcttgctct

SEQ ID NO: 8010491 - DNA, 22 bp, Homo sapiens
gtggcagaaatattcttgctct

SEQ ID NO: 8010492 - DNA, 22 bp, Homo sapiens
gtggcagaccttcccttctcct

SEQ ID NO: 8010493 - DNA, 22 bp, Homo sapiens
gtggcagaagagtaggatgggc

SEQ ID NO: 8010494 - DNA, 22 bp, Homo sapiens
gtggcagaactatgtgattgct

SEQ ID NO: 8010495 - DNA, 22 bp, Homo sapiens
gtggcagaactatgtgattgct

SEQ ID NO: 8010496 - DNA, 22 bp, Homo sapiens
gtggcagaagagtaggatgggc

SEQ ID NO: 8010497 - DNA, 22 bp, Homo sapiens
gtggcagaagagtaggatgggc

SEQ ID NO: 8010498 - DNA, 22 bp, Homo sapiens
gtttgggtaatatcagtagagt

SEQ ID NO: 8010499 - DNA, 22 bp, Homo sapiens
gtttggggtctgcagagcggcg

SEQ ID NO: 8010500 - DNA, 22 bp, Homo sapiens
gtttggctttctctctatcctg

SEQ ID NO: 8010501 - DNA, 22 bp, Homo sapiens
gtttggctatttattctcagtg

SEQ ID NO: 8010502 - DNA, 22 bp, Homo sapiens
gtttggctctgggtgcctgtgc

SEQ ID NO: 8010503 - DNA, 22 bp, Homo sapiens
gtttggcataaatattttcacc

SEQ ID NO: 8010504 - DNA, 19 bp, Homo sapiens
gtttggcagcaaatcagac

SEQ ID NO: 8010505 - DNA, 22 bp, Homo sapiens
gtttggcagtgttatgtaggtt

SEQ ID NO: 8010506 - DNA, 18 bp, Homo sapiens
gtttggcataactgatgc

SEQ ID NO: 8010507 - DNA, 22 bp, Homo sapiens
gtttggcataggatgtgggtta

SEQ ID NO: 8010508 - DNA, 22 bp, Homo sapiens
gtttggcatctcacttaaaccg

SEQ ID NO: 8010509 - DNA, 22 bp, Homo sapiens
gtttggaatgagtcctgccatt

SEQ ID NO: 8010510 - DNA, 21 bp, Homo sapiens
gtttggaacagaccctgggga

SEQ ID NO: 8010511 - DNA, 22 bp, Homo sapiens
gtttggaagttaagtgcagcag

SEQ ID NO: 8010512 - DNA, 22 bp, Homo sapiens
gtttggaagttaagtgcagcag

SEQ ID NO: 8010513 - DNA, 22 bp, Homo sapiens
gtttggaatagcagtaaacatt

SEQ ID NO: 8010514 - DNA, 22 bp, Homo sapiens
gtttggaatagcagtaaacatt

SEQ ID NO: 8010515 - DNA, 22 bp, Homo sapiens
gtttggaatagcagtaaacatt

SEQ ID NO: 8010516 - DNA, 22 bp, Homo sapiens
gtttggatgtgtagtgagggga

SEQ ID NO: 8010517 - DNA, 22 bp, Homo sapiens
gtttggatgtgtagtgagggga

SEQ ID NO: 8010518 - DNA, 22 bp, Homo sapiens
gtttggcactatgatgaggcta

SEQ ID NO: 8010519 - DNA, 22 bp, Homo sapiens
gtttggcaatatttgtggaaca

SEQ ID NO: 8010520 - DNA, 22 bp, Homo sapiens
gtttggcacatgaacctatttt

SEQ ID NO: 8010521 - DNA, 22 bp, Homo sapiens
gtttggcagagcatggggatga

SEQ ID NO: 8010522 - DNA, 22 bp, Homo sapiens
caggaagccttccttgtctgct

SEQ ID NO: 8010523 - DNA, 22 bp, Homo sapiens
caggaagccttccttgtctgct

SEQ ID NO: 8010524 - DNA, 22 bp, Homo sapiens
caggaagctgagctgcactgca

SEQ ID NO: 8010525 - DNA, 22 bp, Homo sapiens
caggaagccacaggacaggtag

SEQ ID NO: 8010526 - DNA, 22 bp, Homo sapiens
caggaagccacaggacaggtag

SEQ ID NO: 8010527 - DNA, 22 bp, Homo sapiens
caggaagcatctggctagctaa

SEQ ID NO: 8010528 - DNA, 22 bp, Homo sapiens
caggaagcatctggctagctaa

SEQ ID NO: 8010529 - DNA, 23 bp, Homo sapiens
caggaagcagatggggtagaaga

SEQ ID NO: 8010530 - DNA, 22 bp, Homo sapiens
gtttgtaattactgcagcatgg

SEQ ID NO: 8010531 - DNA, 22 bp, Homo sapiens
gtttgtaattacctcttttgac

SEQ ID NO: 8010532 - DNA, 22 bp, Homo sapiens
gtttgtatgaatgttttatgct

SEQ ID NO: 8010533 - DNA, 22 bp, Homo sapiens
gtttggttccaaagcccattct

SEQ ID NO: 8010534 - DNA, 21 bp, Homo sapiens
gtttgtaaggcactgtgttct

SEQ ID NO: 8010535 - DNA, 22 bp, Homo sapiens
gtttgtaagcagtctgcttgtg

SEQ ID NO: 8010536 - DNA, 22 bp, Homo sapiens
gtttgtaaccagaacagagagt

SEQ ID NO: 8010537 - DNA, 22 bp, Homo sapiens
gtttgtaaccagaacagagagt

SEQ ID NO: 8010538 - DNA, 22 bp, Homo sapiens
gtttggttggctgtctttaaca

SEQ ID NO: 8010539 - DNA, 22 bp, Homo sapiens
caggaagtcgcagagctggggg

SEQ ID NO: 8010540 - DNA, 22 bp, Homo sapiens
caggaagtctttgcccaggcca

SEQ ID NO: 8010541 - DNA, 22 bp, Homo sapiens
caggaagtctttgcccaggcca

SEQ ID NO: 8010542 - DNA, 22 bp, Homo sapiens
caggaagtctttgcccaggcca

SEQ ID NO: 8010543 - DNA, 22 bp, Homo sapiens
caggaagggggatccttggaag

SEQ ID NO: 8010544 - DNA, 22 bp, Homo sapiens
caggaagggggatccttggaag

SEQ ID NO: 8010545 - DNA, 22 bp, Homo sapiens
caggaagtgtgagggtggtgta

SEQ ID NO: 8010546 - DNA, 22 bp, Homo sapiens
caggaagtgggtagaaggaata

SEQ ID NO: 8010547 - DNA, 22 bp, Homo sapiens
caggaagtggggtcatggagta

SEQ ID NO: 8010548 - DNA, 22 bp, Homo sapiens
caggaagtgcctggtgagagga

SEQ ID NO: 8010549 - DNA, 22 bp, Homo sapiens
caggaatagtggagcaacaaga

SEQ ID NO: 8010550 - DNA, 22 bp, Homo sapiens
caggaatccagagtgagcctcc

SEQ ID NO: 8010551 - DNA, 22 bp, Homo sapiens
caggaatagtggagcaacaaga

SEQ ID NO: 8010552 - DNA, 22 bp, Homo sapiens
caggaatccagagtgagcctcc

SEQ ID NO: 8010553 - DNA, 22 bp, Homo sapiens
caggaatcctatggcttttgct

SEQ ID NO: 8010554 - DNA, 22 bp, Homo sapiens
caggaatccagagtgagcctcc

SEQ ID NO: 8010555 - DNA, 22 bp, Homo sapiens
caggaatagggcgtgagcatat

SEQ ID NO: 8010556 - DNA, 22 bp, Homo sapiens
caggaagtgtgcctgagcacct

SEQ ID NO: 8010557 - DNA, 22 bp, Homo sapiens
caggaatgaaaggtcagggttg

SEQ ID NO: 8010558 - DNA, 22 bp, Homo sapiens
caggaatgaaaggtcagggttg

SEQ ID NO: 8010559 - DNA, 22 bp, Homo sapiens
caggaatgacccaacagtttca

SEQ ID NO: 8010560 - DNA, 22 bp, Homo sapiens
caggaatgaaaggtcagggttg

SEQ ID NO: 8010561 - DNA, 22 bp, Homo sapiens
caggaatgactgcagatggggc

SEQ ID NO: 8010562 - DNA, 22 bp, Homo sapiens
caggaatgactgcagatggggc

SEQ ID NO: 8010563 - DNA, 22 bp, Homo sapiens
caggaagggggatccttggaag

SEQ ID NO: 8010564 - DNA, 22 bp, Homo sapiens
caggaagggggatccttggaag

SEQ ID NO: 8010565 - DNA, 22 bp, Homo sapiens
caggaaggaccgtccagatcag

SEQ ID NO: 8010566 - DNA, 22 bp, Homo sapiens
caggaaggaaagggtgtggaga

SEQ ID NO: 8010567 - DNA, 22 bp, Homo sapiens
caggaaggaaagggtgtggaga

SEQ ID NO: 8010568 - DNA, 22 bp, Homo sapiens
caggaaggaaagggtgtggaga

SEQ ID NO: 8010569 - DNA, 22 bp, Homo sapiens
caggaaggaaagggtgtggaga

SEQ ID NO: 8010570 - DNA, 22 bp, Homo sapiens
caggaaggaaagggtgtggaga

SEQ ID NO: 8010571 - DNA, 22 bp, Homo sapiens
caggaaggaaagggtgtggaga

SEQ ID NO: 8010572 - DNA, 22 bp, Homo sapiens
caggaagctgtgaaggagacgg

SEQ ID NO: 8010573 - DNA, 22 bp, Homo sapiens
caggaagctgtgaaggagacgg

SEQ ID NO: 8010574 - DNA, 22 bp, Homo sapiens
caggaagctgtgaaggagacgg

SEQ ID NO: 8010575 - DNA, 22 bp, Homo sapiens
caggaagctgtgaaggagacgg

SEQ ID NO: 8010576 - DNA, 22 bp, Homo sapiens
caggaagctgccggtgagcgag

SEQ ID NO: 8010577 - DNA, 22 bp, Homo sapiens
caggaagctgccggtgagcgag

SEQ ID NO: 8010578 - DNA, 22 bp, Homo sapiens
caggaagctggtcagatcctgt

SEQ ID NO: 8010579 - DNA, 22 bp, Homo sapiens
caggaagctggtcagatcctgt

SEQ ID NO: 8010580 - DNA, 22 bp, Homo sapiens
caggaagctgagctgcactgca

SEQ ID NO: 8010581 - DNA, 22 bp, Homo sapiens
caggaagctgatgtctagtcat

SEQ ID NO: 8010582 - DNA, 22 bp, Homo sapiens
caggaagctgagctgcactgca

SEQ ID NO: 8010583 - DNA, 22 bp, Homo sapiens
caggaagctgagctgcactgca

SEQ ID NO: 8010584 - DNA, 22 bp, Homo sapiens
caggacaagagggaatcgataa

SEQ ID NO: 8010585 - DNA, 22 bp, Homo sapiens
caggacaagagggaatcgataa

SEQ ID NO: 8010586 - DNA, 22 bp, Homo sapiens
caggacaatctcgtcgggtcct

SEQ ID NO: 8010587 - DNA, 22 bp, Homo sapiens
caggaatgtgagggttccctgc

SEQ ID NO: 8010588 - DNA, 22 bp, Homo sapiens
caggaatgtccttgtcatttca

SEQ ID NO: 8010589 - DNA, 22 bp, Homo sapiens
caggaatgtcccatccccttca

SEQ ID NO: 8010590 - DNA, 22 bp, Homo sapiens
caggaatgtttgtgctccttta

SEQ ID NO: 8010591 - DNA, 22 bp, Homo sapiens
caggaatgttgcatgtgatctt

SEQ ID NO: 8010592 - DNA, 22 bp, Homo sapiens
caggaatgtttgtgctccttta

SEQ ID NO: 8010593 - DNA, 22 bp, Homo sapiens
caggacacagggtgtggctgat

SEQ ID NO: 8010594 - DNA, 22 bp, Homo sapiens
caggacacagggtgtggctgat

SEQ ID NO: 8010595 - DNA, 22 bp, Homo sapiens
caggacacagaataaggcagtt

SEQ ID NO: 8010596 - DNA, 22 bp, Homo sapiens
caggacacagaataaggcagtt

SEQ ID NO: 8010597 - DNA, 22 bp, Homo sapiens
caggacacagaataaggcagtt

SEQ ID NO: 8010598 - DNA, 22 bp, Homo sapiens
caggacacagaataaggcagtt

SEQ ID NO: 8010599 - DNA, 22 bp, Homo sapiens
caggacaattttgagccacctg

SEQ ID NO: 8010600 - DNA, 22 bp, Homo sapiens
caggacacagaataaggcagtt

SEQ ID NO: 8010601 - DNA, 22 bp, Homo sapiens
caggacaattttgagccacctg

SEQ ID NO: 8010602 - DNA, 22 bp, Homo sapiens
caggacaatttccacttggtaa

SEQ ID NO: 8010603 - DNA, 22 bp, Homo sapiens
caggacactaaaaagccaagct

SEQ ID NO: 8010604 - DNA, 22 bp, Homo sapiens
caggacactaaaaagccaagct

SEQ ID NO: 8010605 - DNA, 22 bp, Homo sapiens
caggacactaaaaagccaagct

SEQ ID NO: 8010606 - DNA, 22 bp, Homo sapiens
caggacacagggtgtggctgat

SEQ ID NO: 8010607 - DNA, 22 bp, Homo sapiens
caggacacagggtgtggctgat

SEQ ID NO: 8010608 - DNA, 22 bp, Homo sapiens
caggacacagggtgtggctgat

SEQ ID NO: 8010609 - DNA, 22 bp, Homo sapiens
caggaatgccaaccagtgcatg

SEQ ID NO: 8010610 - DNA, 22 bp, Homo sapiens
caggaatgccaaccagtgcatg

SEQ ID NO: 8010611 - DNA, 22 bp, Homo sapiens
caggaatgcattctagaatggc

SEQ ID NO: 8010612 - DNA, 22 bp, Homo sapiens
caggaatgatctgctgagtgat

SEQ ID NO: 8010613 - DNA, 22 bp, Homo sapiens
caggaatgatctgctgagtgat

SEQ ID NO: 8010614 - DNA, 22 bp, Homo sapiens
caggaatgatctgctgagtgat

SEQ ID NO: 8010615 - DNA, 22 bp, Homo sapiens
caggaatgatctgctgagtgat

SEQ ID NO: 8010616 - DNA, 22 bp, Homo sapiens
caggaatgagttctggtgctct

SEQ ID NO: 8010617 - DNA, 22 bp, Homo sapiens
caggaatgatattcgaggagat

SEQ ID NO: 8010618 - DNA, 22 bp, Homo sapiens
caggaatgagttctggtgctct

SEQ ID NO: 8010619 - DNA, 22 bp, Homo sapiens
caggaatgagttctggtgctct

SEQ ID NO: 8010620 - DNA, 22 bp, Homo sapiens
caggaatgactgcagatggggc

SEQ ID NO: 8010621 - DNA, 19 bp, Homo sapiens
caggaatgaggtaatggct

SEQ ID NO: 8010622 - DNA, 19 bp, Homo sapiens
caggaatgaggtaatggct

SEQ ID NO: 8010623 - DNA, 22 bp, Homo sapiens
caggaatgaggtcgtaagtgtc

SEQ ID NO: 8010624 - DNA, 22 bp, Homo sapiens
caggaatgggtgacagtcagct

SEQ ID NO: 8010625 - DNA, 22 bp, Homo sapiens
caggaatgggtgacagtcagct

SEQ ID NO: 8010626 - DNA, 18 bp, Homo sapiens
caggaatggatgggattt

SEQ ID NO: 8010627 - DNA, 18 bp, Homo sapiens
caggaatggatgggattt

SEQ ID NO: 8010628 - DNA, 22 bp, Homo sapiens
caggaatgccttcttcagccat

SEQ ID NO: 8010629 - DNA, 22 bp, Homo sapiens
caggaatgccttcttcagccat

SEQ ID NO: 8010630 - DNA, 22 bp, Homo sapiens
caggaatggaggcatttatgaa

SEQ ID NO: 8010631 - DNA, 22 bp, Homo sapiens
caggaatgtagcagcgatggaa

SEQ ID NO: 8010632 - DNA, 22 bp, Homo sapiens
caggaatgtagcagcgatggaa

SEQ ID NO: 8010633 - DNA, 22 bp, Homo sapiens
caggaatgtagcagcgatggaa

SEQ ID NO: 8010634 - DNA, 22 bp, Homo sapiens
caggaatgtatgatacagtggt

SEQ ID NO: 8010635 - DNA, 22 bp, Homo sapiens
caggaatgtatgatacagtggt

SEQ ID NO: 8010636 - DNA, 22 bp, Homo sapiens
caggaatggttgggactatgtt

SEQ ID NO: 8010637 - DNA, 22 bp, Homo sapiens
caggaatgtagcagcgatggaa

SEQ ID NO: 8010638 - DNA, 22 bp, Homo sapiens
caggaatggttgggactatgtt

SEQ ID NO: 8010639 - DNA, 22 bp, Homo sapiens
caggaatggttgggactatgtt

SEQ ID NO: 8010640 - DNA, 22 bp, Homo sapiens
caggaatggttaatctaaagtg

SEQ ID NO: 8010641 - DNA, 22 bp, Homo sapiens
caggacaggagtggggtcaaag

SEQ ID NO: 8010642 - DNA, 22 bp, Homo sapiens
caggacaggagtggggtcaaag

SEQ ID NO: 8010643 - DNA, 22 bp, Homo sapiens
caggacaggagtggggtcaaag

SEQ ID NO: 8010644 - DNA, 22 bp, Homo sapiens
caggacaggagtggggtcaaag

SEQ ID NO: 8010645 - DNA, 22 bp, Homo sapiens
caggacagctgggccaccacca

SEQ ID NO: 8010646 - DNA, 22 bp, Homo sapiens
caggacaggagtggggtcaaag

SEQ ID NO: 8010647 - DNA, 22 bp, Homo sapiens
caggacaggagtggggtcaaag

SEQ ID NO: 8010648 - DNA, 22 bp, Homo sapiens
caggacaggagtggggtcaaag

SEQ ID NO: 8010649 - DNA, 22 bp, Homo sapiens
caggacaggagtggggtcaaag

SEQ ID NO: 8010650 - DNA, 22 bp, Homo sapiens
caggacaggagtggggtcaaag

SEQ ID NO: 8010651 - DNA, 22 bp, Homo sapiens
caggacaggccctgtggggtct

SEQ ID NO: 8010652 - DNA, 22 bp, Homo sapiens
caggacaggccctgtggggtct

SEQ ID NO: 8010653 - DNA, 22 bp, Homo sapiens
caggacaggccctgtggggtct

SEQ ID NO: 8010654 - DNA, 22 bp, Homo sapiens
caggacaggccctgtggggtct

SEQ ID NO: 8010655 - DNA, 22 bp, Homo sapiens
caggacaggccctgtggggtct

SEQ ID NO: 8010656 - DNA, 22 bp, Homo sapiens
caggacaggccctgtggggtct

SEQ ID NO: 8010657 - DNA, 22 bp, Homo sapiens
caggacaggccctgtggggtct

SEQ ID NO: 8010658 - DNA, 22 bp, Homo sapiens
caggacaggccctgtggggtct

SEQ ID NO: 8010659 - DNA, 22 bp, Homo sapiens
caggacactacagatgggaggg

SEQ ID NO: 8010660 - DNA, 22 bp, Homo sapiens
caggacactacagatgggaggg

SEQ ID NO: 8010661 - DNA, 22 bp, Homo sapiens
caggacacttgttcttctctgc

SEQ ID NO: 8010662 - DNA, 22 bp, Homo sapiens
caggacagctcaacacctcctc

SEQ ID NO: 8010663 - DNA, 22 bp, Homo sapiens
caggacagctcaacacctcctc

SEQ ID NO: 8010664 - DNA, 22 bp, Homo sapiens
caggacagctcaacacctcctc

SEQ ID NO: 8010665 - DNA, 22 bp, Homo sapiens
caggacagctcaacacctcctc

SEQ ID NO: 8010666 - DNA, 22 bp, Homo sapiens
caggacagctcaacacctcctc

SEQ ID NO: 8010667 - DNA, 22 bp, Homo sapiens
caggacagctcaacacctcctc

SEQ ID NO: 8010668 - DNA, 22 bp, Homo sapiens
caggacagctcaacacctcctc

SEQ ID NO: 8010669 - DNA, 22 bp, Homo sapiens
caggacagctgggccaccacca

SEQ ID NO: 8010670 - DNA, 22 bp, Homo sapiens
caggacagctcaacacctcctc

SEQ ID NO: 8010671 - DNA, 22 bp, Homo sapiens
caggacagctgggccaccacca

SEQ ID NO: 8010672 - DNA, 22 bp, Homo sapiens
caggacagctgggccaccacca

SEQ ID NO: 8010673 - DNA, 22 bp, Homo sapiens
caggacagtataggctttagga

SEQ ID NO: 8010674 - DNA, 22 bp, Homo sapiens
caggacagtgcaggtccatcct

SEQ ID NO: 8010675 - DNA, 22 bp, Homo sapiens
caggacagtgcaggtccatcct

SEQ ID NO: 8010676 - DNA, 22 bp, Homo sapiens
caggacagtgcaggtccatcct

SEQ ID NO: 8010677 - DNA, 22 bp, Homo sapiens
gttttccaggtaccttggtatt

SEQ ID NO: 8010678 - DNA, 22 bp, Homo sapiens
gttttccaggtaccttggtatt

SEQ ID NO: 8010679 - DNA, 22 bp, Homo sapiens
gttttcctactgtatcatcaaa

SEQ ID NO: 8010680 - DNA, 22 bp, Homo sapiens
gttttcctactgtatcatcaaa

SEQ ID NO: 8010681 - DNA, 22 bp, Homo sapiens
gttttcctactgtatcatcaaa

SEQ ID NO: 8010682 - DNA, 22 bp, Homo sapiens
gttttcctgaaactgatggtgt

SEQ ID NO: 8010683 - DNA, 22 bp, Homo sapiens
gttttcctactgtatcatcaaa

SEQ ID NO: 8010684 - DNA, 22 bp, Homo sapiens
gttttcctactgtatcatcaaa

SEQ ID NO: 8010685 - DNA, 22 bp, Homo sapiens
gttttccatggaggtctgacct

SEQ ID NO: 8010686 - DNA, 22 bp, Homo sapiens
gttttccaggtaccttggtatt

SEQ ID NO: 8010687 - DNA, 18 bp, Homo sapiens
gttttccatttgttcctc

SEQ ID NO: 8010688 - DNA, 18 bp, Homo sapiens
gttttccatttgttcctc

SEQ ID NO: 8010689 - DNA, 22 bp, Homo sapiens
caggacaggccctgtggggtct

SEQ ID NO: 8010690 - DNA, 22 bp, Homo sapiens
caggacaggtgttctagatcag

SEQ ID NO: 8010691 - DNA, 22 bp, Homo sapiens
caggacaggtgttctagatcag

SEQ ID NO: 8010692 - DNA, 22 bp, Homo sapiens
caggacaggtgttctagatcag

SEQ ID NO: 8010693 - DNA, 22 bp, Homo sapiens
caggacaggtgttctagatcag

SEQ ID NO: 8010694 - DNA, 22 bp, Homo sapiens
caggacaggtgttctagatcag

SEQ ID NO: 8010695 - DNA, 22 bp, Homo sapiens
caggacagtataggctttagga

SEQ ID NO: 8010696 - DNA, 22 bp, Homo sapiens
caggacaggtgttctagatcag

SEQ ID NO: 8010697 - DNA, 22 bp, Homo sapiens
caggacagtataggctttagga

SEQ ID NO: 8010698 - DNA, 22 bp, Homo sapiens
caggacagtataggctttagga

SEQ ID NO: 8010699 - DNA, 22 bp, Homo sapiens
caggacagtataggctttagga

SEQ ID NO: 8010700 - DNA, 22 bp, Homo sapiens
taaaatgatctctcatgttctt

SEQ ID NO: 8010701 - DNA, 22 bp, Homo sapiens
taaaatgatctctcatgttctt

SEQ ID NO: 8010702 - DNA, 22 bp, Homo sapiens
taaaatgatctctcatgttctt

SEQ ID NO: 8010703 - DNA, 22 bp, Homo sapiens
taaacatttgttattcttgttt

SEQ ID NO: 8010704 - DNA, 22 bp, Homo sapiens
taaacatttgttattcttgttt

SEQ ID NO: 8010705 - DNA, 22 bp, Homo sapiens
taaacatttgttattcttgttt

SEQ ID NO: 8010706 - DNA, 22 bp, Homo sapiens
taaacatttgttattcttgttt

SEQ ID NO: 8010707 - DNA, 22 bp, Homo sapiens
taaacatttgttattcttgttt

SEQ ID NO: 8010708 - DNA, 22 bp, Homo sapiens
taaacatttgttattcttgttt

SEQ ID NO: 8010709 - DNA, 22 bp, Homo sapiens
taaacatttgttattcttgttt

SEQ ID NO: 8010710 - DNA, 22 bp, Homo sapiens
taaaccttatttgaataccaac

SEQ ID NO: 8010711 - DNA, 22 bp, Homo sapiens
taaacctgtagttgatgtaatt

SEQ ID NO: 8010712 - DNA, 21 bp, Homo sapiens
taaacctggcgctgttcaaag

SEQ ID NO: 8010713 - DNA, 18 bp, Homo sapiens
taaacctgagaagcgtgt

SEQ ID NO: 8010714 - DNA, 19 bp, Homo sapiens
taaaccctggctttttctg

SEQ ID NO: 8010715 - DNA, 22 bp, Homo sapiens
taaacctgcaactatagccacc

SEQ ID NO: 8010716 - DNA, 22 bp, Homo sapiens
taaaccattcacatcccagaaa

SEQ ID NO: 8010717 - DNA, 22 bp, Homo sapiens
taaaccattcagactgaaccac

SEQ ID NO: 8010718 - DNA, 22 bp, Homo sapiens
taaaccaagtgtccatattagt

SEQ ID NO: 8010719 - DNA, 22 bp, Homo sapiens
taaaccaagtgtccatattagt

SEQ ID NO: 8010720 - DNA, 22 bp, Homo sapiens
taaaccaagtgtccatattagt

SEQ ID NO: 8010721 - DNA, 22 bp, Homo sapiens
taaaccatccatcccacctgtg

SEQ ID NO: 8010722 - DNA, 22 bp, Homo sapiens
taaaccaagtgtccatattagt

SEQ ID NO: 8010723 - DNA, 22 bp, Homo sapiens
taaaccaggtaaagaagctctc

SEQ ID NO: 8010724 - DNA, 22 bp, Homo sapiens
caggacagtgcaggtccatcct

SEQ ID NO: 8010725 - DNA, 22 bp, Homo sapiens
caggacagtgcaggtccatcct

SEQ ID NO: 8010726 - DNA, 22 bp, Homo sapiens
caggacagtgcaggtccatcct

SEQ ID NO: 8010727 - DNA, 22 bp, Homo sapiens
caggacagtgcaggtccatcct

SEQ ID NO: 8010728 - DNA, 22 bp, Homo sapiens
caggacagtgcaggtccatcct

SEQ ID NO: 8010729 - DNA, 22 bp, Homo sapiens
caggacagtgcaggtccatcct

SEQ ID NO: 8010730 - DNA, 22 bp, Homo sapiens
taaactcttctgtagaatcaga

SEQ ID NO: 8010731 - DNA, 22 bp, Homo sapiens
taaactgaagctcaactcaaat

SEQ ID NO: 8010732 - DNA, 22 bp, Homo sapiens
taaactgcttctctcagtctgt

SEQ ID NO: 8010733 - DNA, 22 bp, Homo sapiens
caggacagtgcaggtccatcct

SEQ ID NO: 8010734 - DNA, 22 bp, Homo sapiens
caggacagttggcatctgctgc

SEQ ID NO: 8010735 - DNA, 22 bp, Homo sapiens
caggacagttggcatctgctgc

SEQ ID NO: 8010736 - DNA, 22 bp, Homo sapiens
caggacagttggcatctgctgc

SEQ ID NO: 8010737 - DNA, 22 bp, Homo sapiens
caggacagttggcatctgctgc

SEQ ID NO: 8010738 - DNA, 22 bp, Homo sapiens
caggacagttggcatctgctgc

SEQ ID NO: 8010739 - DNA, 22 bp, Homo sapiens
caggacagttggcatctgctgc

SEQ ID NO: 8010740 - DNA, 22 bp, Homo sapiens
taaactactgggcaaggacagg

SEQ ID NO: 8010741 - DNA, 22 bp, Homo sapiens
taaactatctgtgtttgaagtt

SEQ ID NO: 8010742 - DNA, 22 bp, Homo sapiens
taaactctgcattcttttaaaa

SEQ ID NO: 8010743 - DNA, 22 bp, Homo sapiens
taaactcttctgtagaatcaga

SEQ ID NO: 8010744 - DNA, 22 bp, Homo sapiens
taaactctcaacagagaaccac

SEQ ID NO: 8010745 - DNA, 22 bp, Homo sapiens
taaactctcaacagagaaccac

SEQ ID NO: 8010746 - DNA, 18 bp, Homo sapiens
taaacctttcttgtggca

SEQ ID NO: 8010747 - DNA, 22 bp, Homo sapiens
taaaccttggtagcatcttgct

SEQ ID NO: 8010748 - DNA, 22 bp, Homo sapiens
taaaccttcatgatggtcatta

SEQ ID NO: 8010749 - DNA, 22 bp, Homo sapiens
taaaccttatttgaataccaac

SEQ ID NO: 8010750 - DNA, 22 bp, Homo sapiens
taaaccttcatgatggtcatta

SEQ ID NO: 8010751 - DNA, 22 bp, Homo sapiens
taaacgtgcttcatatttttag

SEQ ID NO: 8010752 - DNA, 22 bp, Homo sapiens
taaactacagtggtaatgtctc

SEQ ID NO: 8010753 - DNA, 22 bp, Homo sapiens
taaactacttccatctagagat

SEQ ID NO: 8010754 - DNA, 22 bp, Homo sapiens
caggagacaagttagcagctga

SEQ ID NO: 8010755 - DNA, 22 bp, Homo sapiens
caggagacaagttagcagctga

SEQ ID NO: 8010756 - DNA, 22 bp, Homo sapiens
caggagacaatggctgtggggc

SEQ ID NO: 8010757 - DNA, 22 bp, Homo sapiens
caggagacaatggctgtggggc

SEQ ID NO: 8010758 - DNA, 22 bp, Homo sapiens
caggagacaagttagcagctga

SEQ ID NO: 8010759 - DNA, 22 bp, Homo sapiens
caggagacaagttagcagctga

SEQ ID NO: 8010760 - DNA, 22 bp, Homo sapiens
caggagacctggtaagccaagt

SEQ ID NO: 8010761 - DNA, 22 bp, Homo sapiens
caggagacaatggctgtggggc

SEQ ID NO: 8010762 - DNA, 22 bp, Homo sapiens
caggagactatggcccaaggcc

SEQ ID NO: 8010763 - DNA, 22 bp, Homo sapiens
caggagactatggcccaaggcc

SEQ ID NO: 8010764 - DNA, 22 bp, Homo sapiens
caggagaaggtttggagtgcag

SEQ ID NO: 8010765 - DNA, 22 bp, Homo sapiens
caggagaaggtttggagtgcag

SEQ ID NO: 8010766 - DNA, 22 bp, Homo sapiens
caggacccatcagccaggcact

SEQ ID NO: 8010767 - DNA, 22 bp, Homo sapiens
caggaccccatattcactgaac

SEQ ID NO: 8010768 - DNA, 22 bp, Homo sapiens
caggagaagtctctagggggtg

SEQ ID NO: 8010769 - DNA, 22 bp, Homo sapiens
caggagaaggtttggagtgcag

SEQ ID NO: 8010770 - DNA, 22 bp, Homo sapiens
caggagaagtctctagggggtg

SEQ ID NO: 8010771 - DNA, 22 bp, Homo sapiens
caggagaagtctctagggggtg

SEQ ID NO: 8010772 - DNA, 22 bp, Homo sapiens
caggagaagtctctagggggtg

SEQ ID NO: 8010773 - DNA, 22 bp, Homo sapiens
caggacagttggcatctgctgc

SEQ ID NO: 8010774 - DNA, 19 bp, Homo sapiens
caggacagtttgccaagaa

SEQ ID NO: 8010775 - DNA, 19 bp, Homo sapiens
caggacagtttgccaagaa

SEQ ID NO: 8010776 - DNA, 22 bp, Homo sapiens
caggacagttggcatctgctgc

SEQ ID NO: 8010777 - DNA, 19 bp, Homo sapiens
caggacagtttgccaagaa

SEQ ID NO: 8010778 - DNA, 19 bp, Homo sapiens
caggacagtttgccaagaa

SEQ ID NO: 8010779 - DNA, 19 bp, Homo sapiens
caggacagtttgccaagaa

SEQ ID NO: 8010780 - DNA, 19 bp, Homo sapiens
caggacagtttgccaagaa

SEQ ID NO: 8010781 - DNA, 19 bp, Homo sapiens
caggacagtttgccaagaa

SEQ ID NO: 8010782 - DNA, 19 bp, Homo sapiens
caggacagtttgccaagaa

SEQ ID NO: 8010783 - DNA, 22 bp, Homo sapiens
caggacagtttgctttgccctg

SEQ ID NO: 8010784 - DNA, 22 bp, Homo sapiens
caggacagtttgctttgccctg

SEQ ID NO: 8010785 - DNA, 19 bp, Homo sapiens
caggacagtttgccaagaa

SEQ ID NO: 8010786 - DNA, 19 bp, Homo sapiens
caggacagtttgccaagaa

SEQ ID NO: 8010787 - DNA, 22 bp, Homo sapiens
caggacagttggcatctgctgc

SEQ ID NO: 8010788 - DNA, 22 bp, Homo sapiens
caggacagtttgctttgccctg

SEQ ID NO: 8010789 - DNA, 22 bp, Homo sapiens
caggaccaggcgttctgggctg

SEQ ID NO: 8010790 - DNA, 22 bp, Homo sapiens
caggacccatcagccaggcact

SEQ ID NO: 8010791 - DNA, 22 bp, Homo sapiens
caggacccatcagccaggcact

SEQ ID NO: 8010792 - DNA, 22 bp, Homo sapiens
caggacccatcagccaggcact

SEQ ID NO: 8010793 - DNA, 22 bp, Homo sapiens
caggaccattgcaactgcccct

SEQ ID NO: 8010794 - DNA, 22 bp, Homo sapiens
caggacccaacctccctgctct

SEQ ID NO: 8010795 - DNA, 22 bp, Homo sapiens
caggaccattgcaactgcccct

SEQ ID NO: 8010796 - DNA, 22 bp, Homo sapiens
caggaccaggcgttctgggctg

SEQ ID NO: 8010797 - DNA, 19 bp, Homo sapiens
taaaaactgaaggaagcag

SEQ ID NO: 8010798 - DNA, 19 bp, Homo sapiens
taaaaactgaaggaagcag

SEQ ID NO: 8010799 - DNA, 19 bp, Homo sapiens
taaaaactgaaggaagcag

SEQ ID NO: 8010800 - DNA, 19 bp, Homo sapiens
taaaaactgaaggaagcag

SEQ ID NO: 8010801 - DNA, 19 bp, Homo sapiens
taaaaactgaaggaagcag

SEQ ID NO: 8010802 - DNA, 19 bp, Homo sapiens
taaaaactgaaggaagcag

SEQ ID NO: 8010803 - DNA, 22 bp, Homo sapiens
taaaaagcagctgagattttct

SEQ ID NO: 8010804 - DNA, 22 bp, Homo sapiens
taaaaagtagtgagaatggcgc

SEQ ID NO: 8010805 - DNA, 22 bp, Homo sapiens
taaaaagtagtgagaatggcgc

SEQ ID NO: 8010806 - DNA, 22 bp, Homo sapiens
taaaaaacattactctgtcctg

SEQ ID NO: 8010807 - DNA, 19 bp, Homo sapiens
taaaaactgaaggaagcag

SEQ ID NO: 8010808 - DNA, 22 bp, Homo sapiens
taaaaaacattactctgtcctg

SEQ ID NO: 8010809 - DNA, 22 bp, Homo sapiens
taaaaaacattactctgtcctg

SEQ ID NO: 8010810 - DNA, 22 bp, Homo sapiens
taaaaaacattactctgtcctg

SEQ ID NO: 8010811 - DNA, 22 bp, Homo sapiens
gttttctggcagttattcctta

SEQ ID NO: 8010812 - DNA, 22 bp, Homo sapiens
gttttcttcctgcaattggcat

SEQ ID NO: 8010813 - DNA, 22 bp, Homo sapiens
gttttcttcctgcaattggcat

SEQ ID NO: 8010814 - DNA, 22 bp, Homo sapiens
taaaaaacattactctgtcctg

SEQ ID NO: 8010815 - DNA, 22 bp, Homo sapiens
taaaaaacattactctgtcctg

SEQ ID NO: 8010816 - DNA, 22 bp, Homo sapiens
taaaaaacattactctgtcctg

SEQ ID NO: 8010817 - DNA, 22 bp, Homo sapiens
gttttcctgagcccagagatgc

SEQ ID NO: 8010818 - DNA, 22 bp, Homo sapiens
gttttcctgagcccagagatgc

SEQ ID NO: 8010819 - DNA, 22 bp, Homo sapiens
gttttcctgaaactgatggtgt

SEQ ID NO: 8010820 - DNA, 22 bp, Homo sapiens
gttttcctgaaactgatggtgt

SEQ ID NO: 8010821 - DNA, 22 bp, Homo sapiens
gttttcctgaaactgatggtgt

SEQ ID NO: 8010822 - DNA, 22 bp, Homo sapiens
gttttcctgagcccagagatgc

SEQ ID NO: 8010823 - DNA, 22 bp, Homo sapiens
gttttcctgagcccagagatgc

SEQ ID NO: 8010824 - DNA, 22 bp, Homo sapiens
gttttcctgagcccagagatgc

SEQ ID NO: 8010825 - DNA, 22 bp, Homo sapiens
gttttcctgttgagtagtattc

SEQ ID NO: 8010826 - DNA, 22 bp, Homo sapiens
gttttcctgttgagtagtattc

SEQ ID NO: 8010827 - DNA, 22 bp, Homo sapiens
gttttcctgttgagtagtattc

SEQ ID NO: 8010828 - DNA, 22 bp, Homo sapiens
gttttcctgttgagtagtattc

SEQ ID NO: 8010829 - DNA, 22 bp, Homo sapiens
gttttcctgttgagtagtattc

SEQ ID NO: 8010830 - DNA, 22 bp, Homo sapiens
gttttccttctcagccattgcc

SEQ ID NO: 8010831 - DNA, 22 bp, Homo sapiens
gttttccttctcagccattgcc

SEQ ID NO: 8010832 - DNA, 22 bp, Homo sapiens
gttttccttctcagccattgcc

SEQ ID NO: 8010833 - DNA, 22 bp, Homo sapiens
gttttcctgttgagtagtattc

SEQ ID NO: 8010834 - DNA, 22 bp, Homo sapiens
gttttccttctcagccattgcc

SEQ ID NO: 8010835 - DNA, 22 bp, Homo sapiens
gttttccttctcagccattgcc

SEQ ID NO: 8010836 - DNA, 22 bp, Homo sapiens
gttttctcaggatggtgtgtac

SEQ ID NO: 8010837 - DNA, 22 bp, Homo sapiens
gttttctcatctcctcaatggt

SEQ ID NO: 8010838 - DNA, 22 bp, Homo sapiens
gttttctcaggatggtgtgtac

SEQ ID NO: 8010839 - DNA, 22 bp, Homo sapiens
gttttctcaggatggtgtgtac

SEQ ID NO: 8010840 - DNA, 22 bp, Homo sapiens
gttttctaccagggaagagagt

SEQ ID NO: 8010841 - DNA, 22 bp, Homo sapiens
gttttctaccagggaagagagt

SEQ ID NO: 8010842 - DNA, 22 bp, Homo sapiens
gttttctaccagggaagagagt

SEQ ID NO: 8010843 - DNA, 22 bp, Homo sapiens
gttttctaccagggaagagagt

SEQ ID NO: 8010844 - DNA, 22 bp, Homo sapiens
gttttctctgagatgcctttct

SEQ ID NO: 8010845 - DNA, 22 bp, Homo sapiens
gttttctctgtgtttggatgat

SEQ ID NO: 8010846 - DNA, 22 bp, Homo sapiens
gttttctctgagatgcctttct

SEQ ID NO: 8010847 - DNA, 22 bp, Homo sapiens
gttttctgattagcaaatctga

SEQ ID NO: 8010848 - DNA, 22 bp, Homo sapiens
taaaaatcttatgaatggcaag

SEQ ID NO: 8010849 - DNA, 22 bp, Homo sapiens
taaaaatcttatgaatggcaag

SEQ ID NO: 8010850 - DNA, 22 bp, Homo sapiens
taaaaatcttatgaatggcaag

SEQ ID NO: 8010851 - DNA, 22 bp, Homo sapiens
taaaaatcttatgaatggcaag

SEQ ID NO: 8010852 - DNA, 22 bp, Homo sapiens
taaaaatcttatgaatggcaag

SEQ ID NO: 8010853 - DNA, 22 bp, Homo sapiens
taaaaatcttatgaatggcaag

SEQ ID NO: 8010854 - DNA, 22 bp, Homo sapiens
taaaaatcttatgaatggcaag

SEQ ID NO: 8010855 - DNA, 22 bp, Homo sapiens
taaaaatcttatgaatggcaag

SEQ ID NO: 8010856 - DNA, 22 bp, Homo sapiens
taaaaagtagtgagaatggcgc

SEQ ID NO: 8010857 - DNA, 22 bp, Homo sapiens
taaaaagttgaaaggacttatc

SEQ ID NO: 8010858 - DNA, 22 bp, Homo sapiens
taaaaagttgaaaggacttatc

SEQ ID NO: 8010859 - DNA, 22 bp, Homo sapiens
taaaaagttgaaaggacttatc

SEQ ID NO: 8010860 - DNA, 22 bp, Homo sapiens
taaaaagttgaaaggacttatc

SEQ ID NO: 8010861 - DNA, 22 bp, Homo sapiens
taaaaatcttatgaatggcaag

SEQ ID NO: 8010862 - DNA, 22 bp, Homo sapiens
taaaatagcatgtgcagtgaaa

SEQ ID NO: 8010863 - DNA, 22 bp, Homo sapiens
taaaatagcatgtgcagtgaaa

SEQ ID NO: 8010864 - DNA, 22 bp, Homo sapiens
taaaatagcatgtgcagtgaaa

SEQ ID NO: 8010865 - DNA, 22 bp, Homo sapiens
taaaatagcatgtgcagtgaaa

SEQ ID NO: 8010866 - DNA, 22 bp, Homo sapiens
taaaatagcatgtgcagtgaaa

SEQ ID NO: 8010867 - DNA, 22 bp, Homo sapiens
taaaatagcttatgtcttttga

SEQ ID NO: 8010868 - DNA, 22 bp, Homo sapiens
taaaatagcttatgtcttttga

SEQ ID NO: 8010869 - DNA, 22 bp, Homo sapiens
taaaatagcttatgtcttttga

SEQ ID NO: 8010870 - DNA, 22 bp, Homo sapiens
taaaatagccagtgcccctctg

SEQ ID NO: 8010871 - DNA, 22 bp, Homo sapiens
taaaatagccagtgcccctctg

SEQ ID NO: 8010872 - DNA, 22 bp, Homo sapiens
taaaatgacttcctccaacatc

SEQ ID NO: 8010873 - DNA, 22 bp, Homo sapiens
taaaatgacttcctccaacatc

SEQ ID NO: 8010874 - DNA, 22 bp, Homo sapiens
taaaatgacttcctccaacatc

SEQ ID NO: 8010875 - DNA, 22 bp, Homo sapiens
taaaatgacttcctccaacatc

SEQ ID NO: 8010876 - DNA, 22 bp, Homo sapiens
taaaatgacttcctccaacatc

SEQ ID NO: 8010877 - DNA, 22 bp, Homo sapiens
taaaatgacttcctccaacatc

SEQ ID NO: 8010878 - DNA, 22 bp, Homo sapiens
taaaatgacttcctccaacatc

SEQ ID NO: 8010879 - DNA, 22 bp, Homo sapiens
taaaatcattctggtgtcagta

SEQ ID NO: 8010880 - DNA, 22 bp, Homo sapiens
taaaatgacttcctccaacatc

SEQ ID NO: 8010881 - DNA, 22 bp, Homo sapiens
taaaatcattctggtgtcagta

SEQ ID NO: 8010882 - DNA, 22 bp, Homo sapiens
taaaatcattctggtgtcagta

SEQ ID NO: 8010883 - DNA, 22 bp, Homo sapiens
taaaatcagccgaccatggtgg

SEQ ID NO: 8010884 - DNA, 22 bp, Homo sapiens
taaaatcagccgaccatggtgg

SEQ ID NO: 8010885 - DNA, 22 bp, Homo sapiens
taaaatcagccgaccatggtgg

SEQ ID NO: 8010886 - DNA, 22 bp, Homo sapiens
taaaatcatgacagattgacat

SEQ ID NO: 8010887 - DNA, 22 bp, Homo sapiens
taaaatcatgacagattgacat

SEQ ID NO: 8010888 - DNA, 22 bp, Homo sapiens
taaaatcatgacagattgacat

SEQ ID NO: 8010889 - DNA, 22 bp, Homo sapiens
taaaatcatgacagattgacat

SEQ ID NO: 8010890 - DNA, 22 bp, Homo sapiens
taaaatcaccaaaagcaggtgg

SEQ ID NO: 8010891 - DNA, 22 bp, Homo sapiens
taaaatcaccaaaagcaggtgg

SEQ ID NO: 8010892 - DNA, 22 bp, Homo sapiens
caggaggaaagttccactcaac

SEQ ID NO: 8010893 - DNA, 22 bp, Homo sapiens
caggaggaaagttccactcaac

SEQ ID NO: 8010894 - DNA, 22 bp, Homo sapiens
caggaggaaagttccactcaac

SEQ ID NO: 8010895 - DNA, 22 bp, Homo sapiens
caggaggaaatgtgaccctgct

SEQ ID NO: 8010896 - DNA, 22 bp, Homo sapiens
caggaggaaatgtgaccctgct

SEQ ID NO: 8010897 - DNA, 22 bp, Homo sapiens
caggaggaaatgtgaccctgct

SEQ ID NO: 8010898 - DNA, 22 bp, Homo sapiens
caggaggaaatgtgaccctgct

SEQ ID NO: 8010899 - DNA, 22 bp, Homo sapiens
caggaggaaatgtgaccctgct

SEQ ID NO: 8010900 - DNA, 22 bp, Homo sapiens
caggaggaaatgtgaccctgct

SEQ ID NO: 8010901 - DNA, 22 bp, Homo sapiens
caggaggaaatgtgaccctgct

SEQ ID NO: 8010902 - DNA, 22 bp, Homo sapiens
caggaggaacaagaggttctgg

SEQ ID NO: 8010903 - DNA, 22 bp, Homo sapiens
caggaggaacaagaggttctgg

SEQ ID NO: 8010904 - DNA, 20 bp, Homo sapiens
caggaggcaaggtcaaggtc

SEQ ID NO: 8010905 - DNA, 20 bp, Homo sapiens
caggaggcaaggtcaaggtc

SEQ ID NO: 8010906 - DNA, 20 bp, Homo sapiens
caggaggcaaggtcaaggtc

SEQ ID NO: 8010907 - DNA, 22 bp, Homo sapiens
caggaggcagaggatgcccagt

SEQ ID NO: 8010908 - DNA, 20 bp, Homo sapiens
caggaggcaaggtcaaggtc

SEQ ID NO: 8010909 - DNA, 22 bp, Homo sapiens
caggaggacatactggctcaca

SEQ ID NO: 8010910 - DNA, 22 bp, Homo sapiens
caggaggattgcttgaggccag

SEQ ID NO: 8010911 - DNA, 22 bp, Homo sapiens
caggaggaagaactctgcaaca

SEQ ID NO: 8010912 - DNA, 22 bp, Homo sapiens
caggaggaagaactctgcaaca

SEQ ID NO: 8010913 - DNA, 22 bp, Homo sapiens
caggaggcagcgctctcaggac

SEQ ID NO: 8010914 - DNA, 22 bp, Homo sapiens
caggaggcagcgctctcaggac

SEQ ID NO: 8010915 - DNA, 22 bp, Homo sapiens
caggaggcagcgctctcaggac

SEQ ID NO: 8010916 - DNA, 22 bp, Homo sapiens
caggaggcagcgctctcaggac

SEQ ID NO: 8010917 - DNA, 22 bp, Homo sapiens
caggaggcagcgctctcaggac

SEQ ID NO: 8010918 - DNA, 22 bp, Homo sapiens
caggaggcaggtgcattttgag

SEQ ID NO: 8010919 - DNA, 22 bp, Homo sapiens
caggaggcagtgggtgttgtct

SEQ ID NO: 8010920 - DNA, 22 bp, Homo sapiens
caggaggcagtttcagaagtca

SEQ ID NO: 8010921 - DNA, 22 bp, Homo sapiens
caggaggcagtttcagaagtca

SEQ ID NO: 8010922 - DNA, 22 bp, Homo sapiens
caggaggcagaggttgcagtga

SEQ ID NO: 8010923 - DNA, 22 bp, Homo sapiens
caggaggcagaggttgcagtga

SEQ ID NO: 8010924 - DNA, 22 bp, Homo sapiens
caggaggcagaggttgcagtga

SEQ ID NO: 8010925 - DNA, 22 bp, Homo sapiens
caggaggcagaggttgcagtga

SEQ ID NO: 8010926 - DNA, 22 bp, Homo sapiens
caggaggcagaggttgcagcga

SEQ ID NO: 8010927 - DNA, 22 bp, Homo sapiens
caggaggcagaggttgcagcga

SEQ ID NO: 8010928 - DNA, 22 bp, Homo sapiens
caggaggcagaggttgcagcga

SEQ ID NO: 8010929 - DNA, 22 bp, Homo sapiens
caggaggcagaggttgcagcga

SEQ ID NO: 8010930 - DNA, 22 bp, Homo sapiens
caggaggcagaggttgcagcga

SEQ ID NO: 8010931 - DNA, 22 bp, Homo sapiens
caggaggcagaggatgcccagt

SEQ ID NO: 8010932 - DNA, 22 bp, Homo sapiens
caggaggcagaggatgcccagt

SEQ ID NO: 8010933 - DNA, 22 bp, Homo sapiens
caggaggcagaggatgcccagt

SEQ ID NO: 8010934 - DNA, 22 bp, Homo sapiens
caggaggcagaggatgcccagt

SEQ ID NO: 8010935 - DNA, 22 bp, Homo sapiens
caggaggcagaggatgcccagt

SEQ ID NO: 8010936 - DNA, 22 bp, Homo sapiens
caggaggcagaggatgcccagt

SEQ ID NO: 8010937 - DNA, 22 bp, Homo sapiens
taaatgtaccttctgccttact

SEQ ID NO: 8010938 - DNA, 22 bp, Homo sapiens
taaatgtaaatggcgtcttgcg

SEQ ID NO: 8010939 - DNA, 22 bp, Homo sapiens
taaatgtaccttctgccttact

SEQ ID NO: 8010940 - DNA, 22 bp, Homo sapiens
taaatgtaaatggcgtcttgcg

SEQ ID NO: 8010941 - DNA, 22 bp, Homo sapiens
taaatgtaaatggcgtcttgcg

SEQ ID NO: 8010942 - DNA, 22 bp, Homo sapiens
taaatggtatccttgctgtgct

SEQ ID NO: 8010943 - DNA, 20 bp, Homo sapiens
taaatggtgcatttcttata

SEQ ID NO: 8010944 - DNA, 22 bp, Homo sapiens
taaatggcaacccctagagctg

SEQ ID NO: 8010945 - DNA, 20 bp, Homo sapiens
taaatggtgcatttcttata

SEQ ID NO: 8010946 - DNA, 22 bp, Homo sapiens
taaatgtactgaggcaacagga

SEQ ID NO: 8010947 - DNA, 22 bp, Homo sapiens
taaatgtactgaggcaacagga

SEQ ID NO: 8010948 - DNA, 22 bp, Homo sapiens
taaatgtaccttctgccttact

SEQ ID NO: 8010949 - DNA, 22 bp, Homo sapiens
taaatgtcaatgtgatttataa

SEQ ID NO: 8010950 - DNA, 22 bp, Homo sapiens
taaatgtctgttaacatgaatg

SEQ ID NO: 8010951 - DNA, 22 bp, Homo sapiens
taaatgtctgttaacatgaatg

SEQ ID NO: 8010952 - DNA, 22 bp, Homo sapiens
taaatgtctcccgtgagcctca

SEQ ID NO: 8010953 - DNA, 22 bp, Homo sapiens
taaatgtataggcactaaacct

SEQ ID NO: 8010954 - DNA, 22 bp, Homo sapiens
taaatgtataggcactaaacct

SEQ ID NO: 8010955 - DNA, 22 bp, Homo sapiens
taaatgtataggcactaaacct

SEQ ID NO: 8010956 - DNA, 22 bp, Homo sapiens
taaatgtagtcaaaggagcctc

SEQ ID NO: 8010957 - DNA, 22 bp, Homo sapiens
taaatgtagtcaaaggagcctc

SEQ ID NO: 8010958 - DNA, 22 bp, Homo sapiens
taaatgtataggcactaaacct

SEQ ID NO: 8010959 - DNA, 22 bp, Homo sapiens
taaatgtataggcactaaacct

SEQ ID NO: 8010960 - DNA, 22 bp, Homo sapiens
taaatgtataggcactaaacct

SEQ ID NO: 8010961 - DNA, 22 bp, Homo sapiens
taaatgtataggcactaaacct

SEQ ID NO: 8010962 - DNA, 22 bp, Homo sapiens
taaatgtataggcactaaacct

SEQ ID NO: 8010963 - DNA, 22 bp, Homo sapiens
taaatgtataggcactaaacct

SEQ ID NO: 8010964 - DNA, 21 bp, Homo sapiens
taaatgtgagcagggctgggc

SEQ ID NO: 8010965 - DNA, 22 bp, Homo sapiens
taaatgtctttgtcacgttggg

SEQ ID NO: 8010966 - DNA, 22 bp, Homo sapiens
caggagctgggtctggaagcag

SEQ ID NO: 8010967 - DNA, 22 bp, Homo sapiens
caggagctgggtctggaagcag

SEQ ID NO: 8010968 - DNA, 22 bp, Homo sapiens
caggagctgggtctggaagcag

SEQ ID NO: 8010969 - DNA, 22 bp, Homo sapiens
caggagctggatctccttgcgg

SEQ ID NO: 8010970 - DNA, 22 bp, Homo sapiens
taaatgtgcacaggttagaagg

SEQ ID NO: 8010971 - DNA, 22 bp, Homo sapiens
caggagctgggtctggaagcag

SEQ ID NO: 8010972 - DNA, 22 bp, Homo sapiens
caggagctgggtctggaagcag

SEQ ID NO: 8010973 - DNA, 22 bp, Homo sapiens
caggagctgggtctggaagcag

SEQ ID NO: 8010974 - DNA, 22 bp, Homo sapiens
caggagctgggtctggaagcag

SEQ ID NO: 8010975 - DNA, 22 bp, Homo sapiens
caggagcttctgcccatggcca

SEQ ID NO: 8010976 - DNA, 22 bp, Homo sapiens
caggagcttctgcccatggcca

SEQ ID NO: 8010977 - DNA, 22 bp, Homo sapiens
caggagcttctgcccatggcca

SEQ ID NO: 8010978 - DNA, 22 bp, Homo sapiens
caggagcttctgcccatggcca

SEQ ID NO: 8010979 - DNA, 22 bp, Homo sapiens
caggaggaaactggattcactt

SEQ ID NO: 8010980 - DNA, 22 bp, Homo sapiens
caggaggaaactggattcactt

SEQ ID NO: 8010981 - DNA, 22 bp, Homo sapiens
caggagctttcttcccaaactt

SEQ ID NO: 8010982 - DNA, 22 bp, Homo sapiens
caggagcttctgcccatggcca

SEQ ID NO: 8010983 - DNA, 22 bp, Homo sapiens
caggagcttctgcccatggcca

SEQ ID NO: 8010984 - DNA, 22 bp, Homo sapiens
caggagcttctgcccatggcca

SEQ ID NO: 8010985 - DNA, 22 bp, Homo sapiens
caggagggcccgagactcttcc

SEQ ID NO: 8010986 - DNA, 22 bp, Homo sapiens
caggagggggtggagtttcgcc

SEQ ID NO: 8010987 - DNA, 22 bp, Homo sapiens
caggagggcccgagactcttcc

SEQ ID NO: 8010988 - DNA, 22 bp, Homo sapiens
caggagggggtggagtttcgcc

SEQ ID NO: 8010989 - DNA, 22 bp, Homo sapiens
caggagggggtggagtttcgcc

SEQ ID NO: 8010990 - DNA, 22 bp, Homo sapiens
caggagggggtggagtttcgcc

SEQ ID NO: 8010991 - DNA, 23 bp, Homo sapiens
caggagggaatgaagttagacaa

SEQ ID NO: 8010992 - DNA, 23 bp, Homo sapiens
caggagggaatgaagttagacaa

SEQ ID NO: 8010993 - DNA, 23 bp, Homo sapiens
caggagggaatgaagttagacaa

SEQ ID NO: 8010994 - DNA, 20 bp, Homo sapiens
caggagggacatttcagcat

SEQ ID NO: 8010995 - DNA, 20 bp, Homo sapiens
caggagggacatttcagcat

SEQ ID NO: 8010996 - DNA, 20 bp, Homo sapiens
caggagggacatttcagcat

SEQ ID NO: 8010997 - DNA, 20 bp, Homo sapiens
caggagggacatttcagcat

SEQ ID NO: 8010998 - DNA, 20 bp, Homo sapiens
caggagggacatttcagcat

SEQ ID NO: 8010999 - DNA, 22 bp, Homo sapiens
caggagggcccgagactcttcc

SEQ ID NO: 8011000 - DNA, 22 bp, Homo sapiens
caggaggctcctagggctctgt

SEQ ID NO: 8011001 - DNA, 22 bp, Homo sapiens
caggaggctttgggatccaagt

SEQ ID NO: 8011002 - DNA, 22 bp, Homo sapiens
caggaggctttgggatccaagt

SEQ ID NO: 8011003 - DNA, 22 bp, Homo sapiens
caggaggctttgggatccaagt

SEQ ID NO: 8011004 - DNA, 23 bp, Homo sapiens
caggagggaatgaagttagacaa

SEQ ID NO: 8011005 - DNA, 23 bp, Homo sapiens
caggagggaatgaagttagacaa

SEQ ID NO: 8011006 - DNA, 22 bp, Homo sapiens
caggaggctttgggatccaagt

SEQ ID NO: 8011007 - DNA, 22 bp, Homo sapiens
caggaggcgtcttcagtttgtt

SEQ ID NO: 8011008 - DNA, 22 bp, Homo sapiens
caggaggcgtcttcagtttgtt

SEQ ID NO: 8011009 - DNA, 22 bp, Homo sapiens
caggaggctcctagggctctgt

SEQ ID NO: 8011010 - DNA, 22 bp, Homo sapiens
caggaggctcctagggctctgt

SEQ ID NO: 8011011 - DNA, 22 bp, Homo sapiens
caggaggcccggccacagccca

SEQ ID NO: 8011012 - DNA, 22 bp, Homo sapiens
caggaggcccggccacagccca

SEQ ID NO: 8011013 - DNA, 22 bp, Homo sapiens
caggaggcgtcttcagtttgtt

SEQ ID NO: 8011014 - DNA, 22 bp, Homo sapiens
caggaggccaactgtgggactt

SEQ ID NO: 8011015 - DNA, 22 bp, Homo sapiens
caggaggccaactgtgggactt

SEQ ID NO: 8011016 - DNA, 22 bp, Homo sapiens
caggaggccaactgtgggactt

SEQ ID NO: 8011017 - DNA, 22 bp, Homo sapiens
caggaggccaactgtgggactt

SEQ ID NO: 8011018 - DNA, 22 bp, Homo sapiens
caggaggccaactgtgggactt

SEQ ID NO: 8011019 - DNA, 22 bp, Homo sapiens
caggaggccaactgtgggactt

SEQ ID NO: 8011020 - DNA, 22 bp, Homo sapiens
caggaggcatcatggagcggac

SEQ ID NO: 8011021 - DNA, 22 bp, Homo sapiens
caggaggcatcatggagcggac

SEQ ID NO: 8011022 - DNA, 22 bp, Homo sapiens
caggaggcatcatggagcggac

SEQ ID NO: 8011023 - DNA, 22 bp, Homo sapiens
caggaggcccacaggcccctgc

SEQ ID NO: 8011024 - DNA, 22 bp, Homo sapiens
caggaggcccacaggcccctgc

SEQ ID NO: 8011025 - DNA, 22 bp, Homo sapiens
caggaggcccggccacagccca

SEQ ID NO: 8011026 - DNA, 22 bp, Homo sapiens
caggaggcccggccacagccca

SEQ ID NO: 8011027 - DNA, 22 bp, Homo sapiens
caggaggcccggccacagccca

SEQ ID NO: 8011028 - DNA, 22 bp, Homo sapiens
caggaggcccacaggcccctgc

SEQ ID NO: 8011029 - DNA, 22 bp, Homo sapiens
caggaggcccaaagggcgcaga

SEQ ID NO: 8011030 - DNA, 22 bp, Homo sapiens
caggaggcccaaagggcgcaga

SEQ ID NO: 8011031 - DNA, 22 bp, Homo sapiens
caggaggcccaaagggcgcaga

SEQ ID NO: 8011032 - DNA, 22 bp, Homo sapiens
caggaggcccaaagggcgcaga

SEQ ID NO: 8011033 - DNA, 22 bp, Homo sapiens
caggaggcccaaagggcgcaga

SEQ ID NO: 8011034 - DNA, 22 bp, Homo sapiens
caggagtgtcgggtcactaggt

SEQ ID NO: 8011035 - DNA, 22 bp, Homo sapiens
caggagtgtcgggtcactaggt

SEQ ID NO: 8011036 - DNA, 22 bp, Homo sapiens
caggagtggtgtgagggactcc

SEQ ID NO: 8011037 - DNA, 22 bp, Homo sapiens
caggagtggtgtgagggactcc

SEQ ID NO: 8011038 - DNA, 22 bp, Homo sapiens
caggagtggtgtgagggactcc

SEQ ID NO: 8011039 - DNA, 22 bp, Homo sapiens
caggagtggtgtgagggactcc

SEQ ID NO: 8011040 - DNA, 22 bp, Homo sapiens
caggagtggtgtgagggactcc

SEQ ID NO: 8011041 - DNA, 22 bp, Homo sapiens
caggagtggtgtgagggactcc

SEQ ID NO: 8011042 - DNA, 22 bp, Homo sapiens
caggagtgtcgggtcactaggt

SEQ ID NO: 8011043 - DNA, 22 bp, Homo sapiens
caggagtgtcgggtcactaggt

SEQ ID NO: 8011044 - DNA, 22 bp, Homo sapiens
caggagtgtcgggtcactaggt

SEQ ID NO: 8011045 - DNA, 22 bp, Homo sapiens
caggagtgtctccacacagcaa

SEQ ID NO: 8011046 - DNA, 22 bp, Homo sapiens
caggagtgtctccacacagcaa

SEQ ID NO: 8011047 - DNA, 22 bp, Homo sapiens
caggagtggtgtgagggactcc

SEQ ID NO: 8011048 - DNA, 22 bp, Homo sapiens
caggagtggcacccttttccct

SEQ ID NO: 8011049 - DNA, 22 bp, Homo sapiens
caggagtggtgtgagggactcc

SEQ ID NO: 8011050 - DNA, 22 bp, Homo sapiens
caggagtgcaggtggtgaggca

SEQ ID NO: 8011051 - DNA, 22 bp, Homo sapiens
caggagtgagttggggtctaca

SEQ ID NO: 8011052 - DNA, 22 bp, Homo sapiens
caggagtgcaggtggtgaggca

SEQ ID NO: 8011053 - DNA, 22 bp, Homo sapiens
caggagtgcaggtggtgaggca

SEQ ID NO: 8011054 - DNA, 22 bp, Homo sapiens
caggagtgcaggtggtgaggca

SEQ ID NO: 8011055 - DNA, 22 bp, Homo sapiens
caggagggtgtggaaaactggg

SEQ ID NO: 8011056 - DNA, 22 bp, Homo sapiens
caggagtgaaatgaggcccagg

SEQ ID NO: 8011057 - DNA, 22 bp, Homo sapiens
caggagtgagttggggtctaca

SEQ ID NO: 8011058 - DNA, 22 bp, Homo sapiens
caggagtgagttggggtctaca

SEQ ID NO: 8011059 - DNA, 22 bp, Homo sapiens
caggagtgagatgcgatcactt

SEQ ID NO: 8011060 - DNA, 22 bp, Homo sapiens
caggataaatagtaaatgtaag

SEQ ID NO: 8011061 - DNA, 22 bp, Homo sapiens
caggataaatagtaaatgtaag

SEQ ID NO: 8011062 - DNA, 22 bp, Homo sapiens
caggatagaaaggccatggagt

SEQ ID NO: 8011063 - DNA, 22 bp, Homo sapiens
caggataacagaaaatagctga

SEQ ID NO: 8011064 - DNA, 22 bp, Homo sapiens
caggagtgtttgctacagtttc

SEQ ID NO: 8011065 - DNA, 22 bp, Homo sapiens
caggagtgttgattgctcagga

SEQ ID NO: 8011066 - DNA, 22 bp, Homo sapiens
caggagtgttgattgctcagga

SEQ ID NO: 8011067 - DNA, 22 bp, Homo sapiens
caggagtgttgattgctcagga

SEQ ID NO: 8011068 - DNA, 22 bp, Homo sapiens
caggagtgtctccacacagcaa

SEQ ID NO: 8011069 - DNA, 22 bp, Homo sapiens
taacaaagtaccatagattggg

SEQ ID NO: 8011070 - DNA, 22 bp, Homo sapiens
taacaaagtaccatagactgga

SEQ ID NO: 8011071 - DNA, 22 bp, Homo sapiens
taacaaagtaccatagattggg

SEQ ID NO: 8011072 - DNA, 22 bp, Homo sapiens
taacaaaggttgccaaactaag

SEQ ID NO: 8011073 - DNA, 22 bp, Homo sapiens
taacaaaggttgccaaactaag

SEQ ID NO: 8011074 - DNA, 22 bp, Homo sapiens
taacaaaggttgccaaactaag

SEQ ID NO: 8011075 - DNA, 22 bp, Homo sapiens
taacaaaggttgccaaactaag

SEQ ID NO: 8011076 - DNA, 22 bp, Homo sapiens
caggatagaaaggccatggagt

SEQ ID NO: 8011077 - DNA, 22 bp, Homo sapiens
taaagtcatctttaaacatgcc

SEQ ID NO: 8011078 - DNA, 22 bp, Homo sapiens
taaagtcatctttacatctttg

SEQ ID NO: 8011079 - DNA, 22 bp, Homo sapiens
taaagtcatctttaaacatgcc

SEQ ID NO: 8011080 - DNA, 22 bp, Homo sapiens
taaagtcatctttaaacatgcc

SEQ ID NO: 8011081 - DNA, 22 bp, Homo sapiens
taaagtcatctttaaacatgcc

SEQ ID NO: 8011082 - DNA, 22 bp, Homo sapiens
taaagtcatctttacatctttg

SEQ ID NO: 8011083 - DNA, 22 bp, Homo sapiens
taaagtcatctttacatctttg

SEQ ID NO: 8011084 - DNA, 22 bp, Homo sapiens
taaagtcatctttacatctttg

SEQ ID NO: 8011085 - DNA, 22 bp, Homo sapiens
taaagtcatctttacatctttg

SEQ ID NO: 8011086 - DNA, 22 bp, Homo sapiens
taaagtgaaggtcataatgatt

SEQ ID NO: 8011087 - DNA, 22 bp, Homo sapiens
taaagtgaaggtcataatgatt

SEQ ID NO: 8011088 - DNA, 22 bp, Homo sapiens
taaagtgaaggtcataatgatt

SEQ ID NO: 8011089 - DNA, 22 bp, Homo sapiens
taaagtgaaggtcataatgatt

SEQ ID NO: 8011090 - DNA, 22 bp, Homo sapiens
taaagtgaagttcagaatggct

SEQ ID NO: 8011091 - DNA, 23 bp, Homo sapiens
taaagtcacatattagagtgagc

SEQ ID NO: 8011092 - DNA, 23 bp, Homo sapiens
taaagtcacatattagagtgagc

SEQ ID NO: 8011093 - DNA, 23 bp, Homo sapiens
taaagtcacatattagagtgagc

SEQ ID NO: 8011094 - DNA, 22 bp, Homo sapiens
taaagtcagagatccttggctt

SEQ ID NO: 8011095 - DNA, 22 bp, Homo sapiens
taaagtcacagagcaggtgcaa

SEQ ID NO: 8011096 - DNA, 22 bp, Homo sapiens
taaagtcacagagcaggtgcaa

SEQ ID NO: 8011097 - DNA, 22 bp, Homo sapiens
taaagtcataagagtggatccg

SEQ ID NO: 8011098 - DNA, 22 bp, Homo sapiens
taaagtcataagagtggatccg

SEQ ID NO: 8011099 - DNA, 22 bp, Homo sapiens
taaagtcagggagattgaggct

SEQ ID NO: 8011100 - DNA, 22 bp, Homo sapiens
taaagtcagggagattgaggct

SEQ ID NO: 8011101 - DNA, 22 bp, Homo sapiens
taaagtcagatatctgggttga

SEQ ID NO: 8011102 - DNA, 23 bp, Homo sapiens
taaagtcacatattagagtgagc

SEQ ID NO: 8011103 - DNA, 22 bp, Homo sapiens
taaagtcagatatctgggttga

SEQ ID NO: 8011104 - DNA, 22 bp, Homo sapiens
taaagtcagatatctgggttga

SEQ ID NO: 8011105 - DNA, 22 bp, Homo sapiens
taaagccacgctggaaatcagg

SEQ ID NO: 8011106 - DNA, 22 bp, Homo sapiens
taaagccacttcattctagtct

SEQ ID NO: 8011107 - DNA, 22 bp, Homo sapiens
taaagccacgctggaaatcagg

SEQ ID NO: 8011108 - DNA, 22 bp, Homo sapiens
taaagccacgctggaaatcagg

SEQ ID NO: 8011109 - DNA, 22 bp, Homo sapiens
taaagccacgctggaaatcagg

SEQ ID NO: 8011110 - DNA, 22 bp, Homo sapiens
taaagccatactgaaagccact

SEQ ID NO: 8011111 - DNA, 22 bp, Homo sapiens
taaagccatactgaaagccact

SEQ ID NO: 8011112 - DNA, 17 bp, Homo sapiens
taaagccagtcaagtca

SEQ ID NO: 8011113 - DNA, 17 bp, Homo sapiens
taaagccagtcaagtca

SEQ ID NO: 8011114 - DNA, 22 bp, Homo sapiens
taaagctacacattattaatcc

SEQ ID NO: 8011115 - DNA, 22 bp, Homo sapiens
taaagctaatagtttgtaagat

SEQ ID NO: 8011116 - DNA, 22 bp, Homo sapiens
taaagtcaaggtactgtttcac

SEQ ID NO: 8011117 - DNA, 22 bp, Homo sapiens
taaagctacacattattaatcc

SEQ ID NO: 8011118 - DNA, 22 bp, Homo sapiens
taaagctacacattattaatcc

SEQ ID NO: 8011119 - DNA, 22 bp, Homo sapiens
taaagctacacattattaatcc

SEQ ID NO: 8011120 - DNA, 22 bp, Homo sapiens
taaagccacgctggaaatcagg

SEQ ID NO: 8011121 - DNA, 22 bp, Homo sapiens
taaagccaatatacctagcata

SEQ ID NO: 8011122 - DNA, 22 bp, Homo sapiens
taaagccaacactttactgctc

SEQ ID NO: 8011123 - DNA, 22 bp, Homo sapiens
taaagcatttttgaaattatga

SEQ ID NO: 8011124 - DNA, 22 bp, Homo sapiens
taaagcatttttgaaattatga

SEQ ID NO: 8011125 - DNA, 22 bp, Homo sapiens
taaagcatgtttcagtaaggtt

SEQ ID NO: 8011126 - DNA, 22 bp, Homo sapiens
taaagcatgtgttagaagtgca

SEQ ID NO: 8011127 - DNA, 22 bp, Homo sapiens
taaatatcagtccagctcttcc

SEQ ID NO: 8011128 - DNA, 22 bp, Homo sapiens
taaatatgcatgtatccttatc

SEQ ID NO: 8011129 - DNA, 22 bp, Homo sapiens
taaatatgcatgtatccttatc

SEQ ID NO: 8011130 - DNA, 22 bp, Homo sapiens
taaatatgcatgtatccttatc

SEQ ID NO: 8011131 - DNA, 22 bp, Homo sapiens
taaatatcagtccagctcttcc

SEQ ID NO: 8011132 - DNA, 22 bp, Homo sapiens
taaatatcacctggaattgtta

SEQ ID NO: 8011133 - DNA, 22 bp, Homo sapiens
taaatatcacctggaattgtta

SEQ ID NO: 8011134 - DNA, 22 bp, Homo sapiens
taaatcacaaattttctcattt

SEQ ID NO: 8011135 - DNA, 22 bp, Homo sapiens
taaatcacaaattttctcattt

SEQ ID NO: 8011136 - DNA, 22 bp, Homo sapiens
taaatcacaaattttctcattt

SEQ ID NO: 8011137 - DNA, 22 bp, Homo sapiens
taaatcacatcgaaatctgggt

SEQ ID NO: 8011138 - DNA, 22 bp, Homo sapiens
taaatcacatcgaaatctgggt

SEQ ID NO: 8011139 - DNA, 22 bp, Homo sapiens
taaatcaagaatatcagcttgt

SEQ ID NO: 8011140 - DNA, 22 bp, Homo sapiens
taaatcaagaatatcagcttgt

SEQ ID NO: 8011141 - DNA, 22 bp, Homo sapiens
taaatgcttagattcatagaaa

SEQ ID NO: 8011142 - DNA, 22 bp, Homo sapiens
taaatgctttctatgaaagagg

SEQ ID NO: 8011143 - DNA, 22 bp, Homo sapiens
taaatgcttagattcatagaaa

SEQ ID NO: 8011144 - DNA, 22 bp, Homo sapiens
taaatcacattcgtctgctcct

SEQ ID NO: 8011145 - DNA, 22 bp, Homo sapiens
taaatcacattttctttgtgtt

SEQ ID NO: 8011146 - DNA, 22 bp, Homo sapiens
taaatcacattcgtctgctcct

SEQ ID NO: 8011147 - DNA, 22 bp, Homo sapiens
taaagtgcaggctactcagaag

SEQ ID NO: 8011148 - DNA, 22 bp, Homo sapiens
taaagtgcaggctactcagaag

SEQ ID NO: 8011149 - DNA, 22 bp, Homo sapiens
taaatagaatctaaactgctca

SEQ ID NO: 8011150 - DNA, 22 bp, Homo sapiens
taaagtgcccagggaaagcggg

SEQ ID NO: 8011151 - DNA, 22 bp, Homo sapiens
taaagtgcatgcggggccagat

SEQ ID NO: 8011152 - DNA, 22 bp, Homo sapiens
taaagtgagtacaaaatgaggg

SEQ ID NO: 8011153 - DNA, 22 bp, Homo sapiens
taaagtgagtacaaaatgaggg

SEQ ID NO: 8011154 - DNA, 22 bp, Homo sapiens
taaagtgagtacaaaatgaggg

SEQ ID NO: 8011155 - DNA, 22 bp, Homo sapiens
taaagtgagtacaaaatgaggg

SEQ ID NO: 8011156 - DNA, 22 bp, Homo sapiens
taaagtgcagattgtgattcag

SEQ ID NO: 8011157 - DNA, 22 bp, Homo sapiens
taaagtgcagactcccggaaac

SEQ ID NO: 8011158 - DNA, 22 bp, Homo sapiens
taaatagagaatcagcttggag

SEQ ID NO: 8011159 - DNA, 22 bp, Homo sapiens
taaatagagaatcagcttggag

SEQ ID NO: 8011160 - DNA, 22 bp, Homo sapiens
taaatagaatctaaactgctca

SEQ ID NO: 8011161 - DNA, 22 bp, Homo sapiens
taaatagagaatcagcttggag

SEQ ID NO: 8011162 - DNA, 22 bp, Homo sapiens
taaatagagaatcagcttggag

SEQ ID NO: 8011163 - DNA, 22 bp, Homo sapiens
taaatagagaatcagcttggag

SEQ ID NO: 8011164 - DNA, 22 bp, Homo sapiens
taaatagggaatagaagaggaa

SEQ ID NO: 8011165 - DNA, 22 bp, Homo sapiens
taaatagggaatagaagaggaa

SEQ ID NO: 8011166 - DNA, 18 bp, Homo sapiens
taaatatatttccccctt

SEQ ID NO: 8011167 - DNA, 18 bp, Homo sapiens
taaatatatttccccctt

SEQ ID NO: 8011168 - DNA, 18 bp, Homo sapiens
taaatatatttccccctt

SEQ ID NO: 8011169 - DNA, 18 bp, Homo sapiens
taaatatatttccccctt

SEQ ID NO: 8011170 - DNA, 18 bp, Homo sapiens
taaatatatttccccctt

SEQ ID NO: 8011171 - DNA, 18 bp, Homo sapiens
taaatatatttccccctt

SEQ ID NO: 8011172 - DNA, 18 bp, Homo sapiens
taaatatatttccccctt

SEQ ID NO: 8011173 - DNA, 22 bp, Homo sapiens
caggagatgacagggaagaacc

SEQ ID NO: 8011174 - DNA, 22 bp, Homo sapiens
caggagatgacagggaagaacc

SEQ ID NO: 8011175 - DNA, 22 bp, Homo sapiens
caggagatgacagggaagaacc

SEQ ID NO: 8011176 - DNA, 22 bp, Homo sapiens
caggagatcttaggaattctta

SEQ ID NO: 8011177 - DNA, 22 bp, Homo sapiens
caggagatgacagggaagaacc

SEQ ID NO: 8011178 - DNA, 22 bp, Homo sapiens
caggagatgacagggaagaacc

SEQ ID NO: 8011179 - DNA, 22 bp, Homo sapiens
caggagataaaagagatgcttt

SEQ ID NO: 8011180 - DNA, 22 bp, Homo sapiens
caggagaggaggctacttctta

SEQ ID NO: 8011181 - DNA, 22 bp, Homo sapiens
caggagataaaagagatgcttt

SEQ ID NO: 8011182 - DNA, 22 bp, Homo sapiens
caggagaggctgtacgtttctc

SEQ ID NO: 8011183 - DNA, 22 bp, Homo sapiens
caggagaggctgtacgtttctc

SEQ ID NO: 8011184 - DNA, 22 bp, Homo sapiens
caggagaggaggctacttctta

SEQ ID NO: 8011185 - DNA, 22 bp, Homo sapiens
caggagaggctgtacgtttctc

SEQ ID NO: 8011186 - DNA, 22 bp, Homo sapiens
caggagcaaggagcagtgggat

SEQ ID NO: 8011187 - DNA, 22 bp, Homo sapiens
caggagcaaatccaaaagaatt

SEQ ID NO: 8011188 - DNA, 22 bp, Homo sapiens
caggagatgtacctgtttttga

SEQ ID NO: 8011189 - DNA, 22 bp, Homo sapiens
caggagatgtaagacttctgtt

SEQ ID NO: 8011190 - DNA, 22 bp, Homo sapiens
caggagatgtaagacttctgtt

SEQ ID NO: 8011191 - DNA, 22 bp, Homo sapiens
caggagatgcggtgtttgctct

SEQ ID NO: 8011192 - DNA, 23 bp, Homo sapiens
caggagatggctgctgtgtcagc

SEQ ID NO: 8011193 - DNA, 23 bp, Homo sapiens
caggagatggctgctgtgtcagc

SEQ ID NO: 8011194 - DNA, 22 bp, Homo sapiens
caggagatgcggtgtttgctct

SEQ ID NO: 8011195 - DNA, 22 bp, Homo sapiens
caggagatgacagggaagaacc

SEQ ID NO: 8011196 - DNA, 22 bp, Homo sapiens
caggagatgacagggaagaacc

SEQ ID NO: 8011197 - DNA, 22 bp, Homo sapiens
caggagatgacagggaagaacc

SEQ ID NO: 8011198 - DNA, 22 bp, Homo sapiens
caggagatgacagggaagaacc

SEQ ID NO: 8011199 - DNA, 22 bp, Homo sapiens
caggagatgacagggaagaacc

SEQ ID NO: 8011200 - DNA, 22 bp, Homo sapiens
caggagagcccgggtccgggct

SEQ ID NO: 8011201 - DNA, 22 bp, Homo sapiens
caggagagcccgggtccgggct

SEQ ID NO: 8011202 - DNA, 22 bp, Homo sapiens
caggagagcccgggtccgggct

SEQ ID NO: 8011203 - DNA, 22 bp, Homo sapiens
caggagagcccgggtccgggct

SEQ ID NO: 8011204 - DNA, 22 bp, Homo sapiens
caggagagcccgggtccgggct

SEQ ID NO: 8011205 - DNA, 22 bp, Homo sapiens
caggagagcccgggtccgggct

SEQ ID NO: 8011206 - DNA, 22 bp, Homo sapiens
caggagagcccgggtccgggct

SEQ ID NO: 8011207 - DNA, 19 bp, Homo sapiens
caggagagcatgcactttg

SEQ ID NO: 8011208 - DNA, 22 bp, Homo sapiens
caggagaggaggctacttctta

SEQ ID NO: 8011209 - DNA, 22 bp, Homo sapiens
caggagagatatgagtccccac

SEQ ID NO: 8011210 - DNA, 22 bp, Homo sapiens
caggagagatatgagtccccac

SEQ ID NO: 8011211 - DNA, 22 bp, Homo sapiens
caggagagatatgagtccccac

SEQ ID NO: 8011212 - DNA, 22 bp, Homo sapiens
caggagagatatgagtccccac

SEQ ID NO: 8011213 - DNA, 22 bp, Homo sapiens
caggagagatatgagtccccac

SEQ ID NO: 8011214 - DNA, 22 bp, Homo sapiens
caggagagatatgagtccccac

SEQ ID NO: 8011215 - DNA, 22 bp, Homo sapiens
caggagactcagcatccaggat

SEQ ID NO: 8011216 - DNA, 22 bp, Homo sapiens
caggagactcagcatccaggat

SEQ ID NO: 8011217 - DNA, 22 bp, Homo sapiens
caggagactcagcatccaggat

SEQ ID NO: 8011218 - DNA, 22 bp, Homo sapiens
caggagagatatgagtccccac

SEQ ID NO: 8011219 - DNA, 22 bp, Homo sapiens
caggagagatatgagtccccac

SEQ ID NO: 8011220 - DNA, 19 bp, Homo sapiens
caggagagcatgcactttg

SEQ ID NO: 8011221 - DNA, 19 bp, Homo sapiens
caggagagcatgcactttg

SEQ ID NO: 8011222 - DNA, 22 bp, Homo sapiens
taaagcataatgaatatctaga

SEQ ID NO: 8011223 - DNA, 22 bp, Homo sapiens
taaagcatgtactgtgtgctag

SEQ ID NO: 8011224 - DNA, 22 bp, Homo sapiens
taaagcataatgaatatctaga

SEQ ID NO: 8011225 - DNA, 22 bp, Homo sapiens
taaagcataatgaatatctaga

SEQ ID NO: 8011226 - DNA, 22 bp, Homo sapiens
taaagcataatgaatatctaga

SEQ ID NO: 8011227 - DNA, 22 bp, Homo sapiens
taaagcagtgttgggtcggacg

SEQ ID NO: 8011228 - DNA, 22 bp, Homo sapiens
taaagcagtgttgggtcggacg

SEQ ID NO: 8011229 - DNA, 22 bp, Homo sapiens
taaagcagtgtggttgtgtccc

SEQ ID NO: 8011230 - DNA, 22 bp, Homo sapiens
taaagcagtggttctcaaactt

SEQ ID NO: 8011231 - DNA, 22 bp, Homo sapiens
taaagcagtgtggttgtgtccc

SEQ ID NO: 8011232 - DNA, 22 bp, Homo sapiens
taaagcagtggttctcaaactt

SEQ ID NO: 8011233 - DNA, 22 bp, Homo sapiens
taaagcagtgtggttgtgtccc

SEQ ID NO: 8011234 - DNA, 22 bp, Homo sapiens
taaagcagtgcaaaagcgtttt

SEQ ID NO: 8011235 - DNA, 22 bp, Homo sapiens
taaagcagtgcaaaagcgtttt

SEQ ID NO: 8011236 - DNA, 22 bp, Homo sapiens
taaagcagtgcaaaagcgtttt

SEQ ID NO: 8011237 - DNA, 22 bp, Homo sapiens
taaagcagtgcaaaagcgtttt

SEQ ID NO: 8011238 - DNA, 22 bp, Homo sapiens
caggagctcttaaggatgtgat

SEQ ID NO: 8011239 - DNA, 22 bp, Homo sapiens
caggagctcttaaggatgtgat

SEQ ID NO: 8011240 - DNA, 22 bp, Homo sapiens
caggagctctcatcgtcagggc

SEQ ID NO: 8011241 - DNA, 22 bp, Homo sapiens
caggagctctcatcgtcagggc

SEQ ID NO: 8011242 - DNA, 22 bp, Homo sapiens
caggagctcttaaggatgtgat

SEQ ID NO: 8011243 - DNA, 22 bp, Homo sapiens
caggagctcttaaggatgtgat

SEQ ID NO: 8011244 - DNA, 22 bp, Homo sapiens
caggagctcttaaggatgtgat

SEQ ID NO: 8011245 - DNA, 22 bp, Homo sapiens
caggagctggataggaccacaa

SEQ ID NO: 8011246 - DNA, 22 bp, Homo sapiens
caggagctggataggaccacaa

SEQ ID NO: 8011247 - DNA, 22 bp, Homo sapiens
caggagctggataggaccacaa

SEQ ID NO: 8011248 - DNA, 22 bp, Homo sapiens
caggagctggataggaccacaa

SEQ ID NO: 8011249 - DNA, 22 bp, Homo sapiens
caggagctggatctccttgcgg

SEQ ID NO: 8011250 - DNA, 22 bp, Homo sapiens
caggagctggataggaccacaa

SEQ ID NO: 8011251 - DNA, 22 bp, Homo sapiens
caggagctactcaggttgggtt

SEQ ID NO: 8011252 - DNA, 22 bp, Homo sapiens
caggagctactcaggttgggtt

SEQ ID NO: 8011253 - DNA, 22 bp, Homo sapiens
caggagctcaagaccaccctgg

SEQ ID NO: 8011254 - DNA, 22 bp, Homo sapiens
caggagctactcaggttgggtt

SEQ ID NO: 8011255 - DNA, 22 bp, Homo sapiens
caggagctcacagtctttgggt

SEQ ID NO: 8011256 - DNA, 22 bp, Homo sapiens
caggagctcaagaccaccctgg

SEQ ID NO: 8011257 - DNA, 22 bp, Homo sapiens
caggagctcactgtctaatggg

SEQ ID NO: 8011258 - DNA, 22 bp, Homo sapiens
caggagctcactgtctaatggg

SEQ ID NO: 8011259 - DNA, 22 bp, Homo sapiens
caggagctcagatgacatctca

SEQ ID NO: 8011260 - DNA, 22 bp, Homo sapiens
caggagctcagatgacatctca

SEQ ID NO: 8011261 - DNA, 22 bp, Homo sapiens
caggagcccgttgctccggcgg

SEQ ID NO: 8011262 - DNA, 22 bp, Homo sapiens
caggagccctggtgggtggaca

SEQ ID NO: 8011263 - DNA, 22 bp, Homo sapiens
caggagcccgttgctccggcgg

SEQ ID NO: 8011264 - DNA, 22 bp, Homo sapiens
caggagcaaggagcagtgggat

SEQ ID NO: 8011265 - DNA, 22 bp, Homo sapiens
caggagccccaggctgacaata

SEQ ID NO: 8011266 - DNA, 22 bp, Homo sapiens
caggagccgccaggcacgttgg

SEQ ID NO: 8011267 - DNA, 22 bp, Homo sapiens
caggagccctggtgggtggaca

SEQ ID NO: 8011268 - DNA, 22 bp, Homo sapiens
taacaacatgcaatttaacctt

SEQ ID NO: 8011269 - DNA, 22 bp, Homo sapiens
taacaacttgcttttatcttag

SEQ ID NO: 8011270 - DNA, 22 bp, Homo sapiens
taacaacttgcttttatcttag

SEQ ID NO: 8011271 - DNA, 22 bp, Homo sapiens
taacaacttgcttttatcttag

SEQ ID NO: 8011272 - DNA, 22 bp, Homo sapiens
taacaagaaatacattggttct

SEQ ID NO: 8011273 - DNA, 23 bp, Homo sapiens
taacaagaacctcatgtgacttt

SEQ ID NO: 8011274 - DNA, 23 bp, Homo sapiens
taacaagaacctcatgtgacttt

SEQ ID NO: 8011275 - DNA, 22 bp, Homo sapiens
taacaagaaatacattggttct

SEQ ID NO: 8011276 - DNA, 22 bp, Homo sapiens
taacaagagcacctgggaatgg

SEQ ID NO: 8011277 - DNA, 22 bp, Homo sapiens
taacaagagcacctgggaatgg

SEQ ID NO: 8011278 - DNA, 22 bp, Homo sapiens
taacaagatatatgacttggat

SEQ ID NO: 8011279 - DNA, 22 bp, Homo sapiens
taacaagatatatgacttggat

SEQ ID NO: 8011280 - DNA, 22 bp, Homo sapiens
taacaagatatatgacttggat

SEQ ID NO: 8011281 - DNA, 22 bp, Homo sapiens
taacaactgaggaagaggcaga

SEQ ID NO: 8011282 - DNA, 22 bp, Homo sapiens
taacaactcagtttgttccttg

SEQ ID NO: 8011283 - DNA, 19 bp, Homo sapiens
taacaaagtctgaagtcag

SEQ ID NO: 8011284 - DNA, 22 bp, Homo sapiens
taacaactgctgaggtatttga

SEQ ID NO: 8011285 - DNA, 22 bp, Homo sapiens
taacaactgctgaggtatttga

SEQ ID NO: 8011286 - DNA, 22 bp, Homo sapiens
taacaactggacaatgttgctc

SEQ ID NO: 8011287 - DNA, 22 bp, Homo sapiens
taacaactggacaatgttgctc

SEQ ID NO: 8011288 - DNA, 22 bp, Homo sapiens
taacaaagtattgtttgtgtat

SEQ ID NO: 8011289 - DNA, 22 bp, Homo sapiens
taacaaagtattgtttgtgtat

SEQ ID NO: 8011290 - DNA, 19 bp, Homo sapiens
taacaaagtctgaagtcag

SEQ ID NO: 8011291 - DNA, 22 bp, Homo sapiens
taacaacatgcaatttaacctt

SEQ ID NO: 8011292 - DNA, 22 bp, Homo sapiens
taacaagtcattttaaattatg

SEQ ID NO: 8011293 - DNA, 22 bp, Homo sapiens
taacaagtcattttatcagcag

SEQ ID NO: 8011294 - DNA, 22 bp, Homo sapiens
taacaagttctgacagcattgt

SEQ ID NO: 8011295 - DNA, 22 bp, Homo sapiens
taacaagtttcatttatagaat

SEQ ID NO: 8011296 - DNA, 22 bp, Homo sapiens
taacaaggcaatttgtgatcct

SEQ ID NO: 8011297 - DNA, 22 bp, Homo sapiens
taacaaggagatggtgggtcat

SEQ ID NO: 8011298 - DNA, 22 bp, Homo sapiens
taacaaggtaagcctggccatg

SEQ ID NO: 8011299 - DNA, 22 bp, Homo sapiens
taacaaggtggtcttggtattt

SEQ ID NO: 8011300 - DNA, 22 bp, Homo sapiens
taacaagtcattttaaattatg

SEQ ID NO: 8011301 - DNA, 22 bp, Homo sapiens
taacaagatgtcactcctgtcc

SEQ ID NO: 8011302 - DNA, 22 bp, Homo sapiens
taacaagatgtcactcctgtcc

SEQ ID NO: 8011303 - DNA, 19 bp, Homo sapiens
taacaagcactctgcattc

SEQ ID NO: 8011304 - DNA, 22 bp, Homo sapiens
taacaagatttgtaaaattgta

SEQ ID NO: 8011305 - DNA, 22 bp, Homo sapiens
taacaagatttgtaaaattgta

SEQ ID NO: 8011306 - DNA, 22 bp, Homo sapiens
taacaagatttgtaaaattgta

SEQ ID NO: 8011307 - DNA, 22 bp, Homo sapiens
taacacttgaagccatttttgc

SEQ ID NO: 8011308 - DNA, 22 bp, Homo sapiens
taacacttcagatgattttgtt

SEQ ID NO: 8011309 - DNA, 20 bp, Homo sapiens
taacacttgctttttgactt

SEQ ID NO: 8011310 - DNA, 22 bp, Homo sapiens
taacactgtgtctgccatatcc

SEQ ID NO: 8011311 - DNA, 22 bp, Homo sapiens
taacaatacccattctaattac

SEQ ID NO: 8011312 - DNA, 22 bp, Homo sapiens
taacactgtgtctgccatatcc

SEQ ID NO: 8011313 - DNA, 22 bp, Homo sapiens
taacaatacccattctaattac

SEQ ID NO: 8011314 - DNA, 22 bp, Homo sapiens
taacaatacccattctaattac

SEQ ID NO: 8011315 - DNA, 22 bp, Homo sapiens
taacaatacccattctaattac

SEQ ID NO: 8011316 - DNA, 22 bp, Homo sapiens
taacaatacccattctaattac

SEQ ID NO: 8011317 - DNA, 22 bp, Homo sapiens
taacaatacccattctaattac

SEQ ID NO: 8011318 - DNA, 22 bp, Homo sapiens
taacaatacccattctaattac

SEQ ID NO: 8011319 - DNA, 22 bp, Homo sapiens
taacaatacccattctaattac

SEQ ID NO: 8011320 - DNA, 22 bp, Homo sapiens
taacaatacccattctaattac

SEQ ID NO: 8011321 - DNA, 22 bp, Homo sapiens
taacaatacccattctaattac

SEQ ID NO: 8011322 - DNA, 22 bp, Homo sapiens
taacaatacccattctaattac

SEQ ID NO: 8011323 - DNA, 22 bp, Homo sapiens
taacaatacccattctaattac

SEQ ID NO: 8011324 - DNA, 22 bp, Homo sapiens
taacagaaaagaactgagtttg

SEQ ID NO: 8011325 - DNA, 22 bp, Homo sapiens
taacagaaaagaactgagtttg

SEQ ID NO: 8011326 - DNA, 22 bp, Homo sapiens
taacactttggattaaaattct

SEQ ID NO: 8011327 - DNA, 22 bp, Homo sapiens
taacacttgggggcatccttag

SEQ ID NO: 8011328 - DNA, 22 bp, Homo sapiens
taacagaaaggggacagaaata

SEQ ID NO: 8011329 - DNA, 22 bp, Homo sapiens
taacagaaaggctcaggtgctc

SEQ ID NO: 8011330 - DNA, 22 bp, Homo sapiens
taacagaaaggctcaggtgctc

SEQ ID NO: 8011331 - DNA, 22 bp, Homo sapiens
taacagaaacagataagtgtaa

SEQ ID NO: 8011332 - DNA, 22 bp, Homo sapiens
taacagaaacagataagtgtaa

SEQ ID NO: 8011333 - DNA, 22 bp, Homo sapiens
taacagaaacagataagtgtaa

SEQ ID NO: 8011334 - DNA, 22 bp, Homo sapiens
taacattaggtagacataagcc

SEQ ID NO: 8011335 - DNA, 22 bp, Homo sapiens
taacattaggtagacataagcc

SEQ ID NO: 8011336 - DNA, 22 bp, Homo sapiens
taacattatacagagaggacag

SEQ ID NO: 8011337 - DNA, 22 bp, Homo sapiens
taacattaggtagacataagcc

SEQ ID NO: 8011338 - DNA, 22 bp, Homo sapiens
taacattaggtagacataagcc

SEQ ID NO: 8011339 - DNA, 22 bp, Homo sapiens
taacattaggtagacataagcc

SEQ ID NO: 8011340 - DNA, 22 bp, Homo sapiens
taacagaagttgttcattgtgg

SEQ ID NO: 8011341 - DNA, 22 bp, Homo sapiens
taacagaagagcaggcagccct

SEQ ID NO: 8011342 - DNA, 20 bp, Homo sapiens
taacagaagtagaagtgggt

SEQ ID NO: 8011343 - DNA, 20 bp, Homo sapiens
taacagaagtagaagtgggt

SEQ ID NO: 8011344 - DNA, 22 bp, Homo sapiens
taacattaggtagacataagcc

SEQ ID NO: 8011345 - DNA, 22 bp, Homo sapiens
taacagaagttgttcattgtgg

SEQ ID NO: 8011346 - DNA, 22 bp, Homo sapiens
taacattgagtccactaaacag

SEQ ID NO: 8011347 - DNA, 22 bp, Homo sapiens
taacattgttatgaatcaggtc

SEQ ID NO: 8011348 - DNA, 22 bp, Homo sapiens
taacatttaaatttttcacata

SEQ ID NO: 8011349 - DNA, 22 bp, Homo sapiens
taacattcttaacttagaaaca

SEQ ID NO: 8011350 - DNA, 22 bp, Homo sapiens
taacattcttaacttagaaaca

SEQ ID NO: 8011351 - DNA, 22 bp, Homo sapiens
taacattcttaacttagaaaca

SEQ ID NO: 8011352 - DNA, 22 bp, Homo sapiens
taacattccctttgtgccaagg

SEQ ID NO: 8011353 - DNA, 22 bp, Homo sapiens
taacattccatggatctgcaga

SEQ ID NO: 8011354 - DNA, 22 bp, Homo sapiens
taacattccatggatctgcaga

SEQ ID NO: 8011355 - DNA, 22 bp, Homo sapiens
taacagaaattttagttagggg

SEQ ID NO: 8011356 - DNA, 22 bp, Homo sapiens
taacagaaatatttccaggtga

SEQ ID NO: 8011357 - DNA, 22 bp, Homo sapiens
taacagaagaaaacatattgga

SEQ ID NO: 8011358 - DNA, 22 bp, Homo sapiens
taacagaaattttagttagggg

SEQ ID NO: 8011359 - DNA, 22 bp, Homo sapiens
taacagaaattttagttagggg

SEQ ID NO: 8011360 - DNA, 22 bp, Homo sapiens
taacagaaatatttccaggtga

SEQ ID NO: 8011361 - DNA, 22 bp, Homo sapiens
taacagaagatgaaacttcttt

SEQ ID NO: 8011362 - DNA, 22 bp, Homo sapiens
taacagaagatgaaacttcttt

SEQ ID NO: 8011363 - DNA, 22 bp, Homo sapiens
taacagaagaaaacatattgga

SEQ ID NO: 8011364 - DNA, 22 bp, Homo sapiens
taacagaagagcaggcagccct

SEQ ID NO: 8011365 - DNA, 22 bp, Homo sapiens
taacagaagatgaaacttcttt

SEQ ID NO: 8011366 - DNA, 22 bp, Homo sapiens
taacagaaatagtaggtgaggg

SEQ ID NO: 8011367 - DNA, 22 bp, Homo sapiens
taacagaaatagaaatgagagt

SEQ ID NO: 8011368 - DNA, 22 bp, Homo sapiens
taacagaaatagaaatgagagt

SEQ ID NO: 8011369 - DNA, 22 bp, Homo sapiens
taacagaaatagaaatgagagt

SEQ ID NO: 8011370 - DNA, 22 bp, Homo sapiens
taacagaaaggctcaggtgctc

SEQ ID NO: 8011371 - DNA, 22 bp, Homo sapiens
taacagaaatagaaatgagagt

SEQ ID NO: 8011372 - DNA, 22 bp, Homo sapiens
taacagaaaggggacagaaata

SEQ ID NO: 8011373 - DNA, 22 bp, Homo sapiens
taacagaaaggggacagaaata

SEQ ID NO: 8011374 - DNA, 22 bp, Homo sapiens
taacagaaaggggacagaaata

SEQ ID NO: 8011375 - DNA, 22 bp, Homo sapiens
taacagaaaggggacagaaata

SEQ ID NO: 8011376 - DNA, 22 bp, Homo sapiens
taacagaaaggggacagaaata

SEQ ID NO: 8011377 - DNA, 22 bp, Homo sapiens
taagaaacatgatacttttcct

SEQ ID NO: 8011378 - DNA, 22 bp, Homo sapiens
taagaaacatgatacttttcct

SEQ ID NO: 8011379 - DNA, 22 bp, Homo sapiens
taagaaacatgattaatggcag

SEQ ID NO: 8011380 - DNA, 22 bp, Homo sapiens
taagaaacatgatacttttcct

SEQ ID NO: 8011381 - DNA, 22 bp, Homo sapiens
taagaaacatttttatgacagt

SEQ ID NO: 8011382 - DNA, 22 bp, Homo sapiens
taacttttctaggtgtgataat

SEQ ID NO: 8011383 - DNA, 21 bp, Homo sapiens
taacttttgtgcctatcttgt

SEQ ID NO: 8011384 - DNA, 22 bp, Homo sapiens
taactttgataagaatcaggga

SEQ ID NO: 8011385 - DNA, 22 bp, Homo sapiens
taactttggggacacttctctt

SEQ ID NO: 8011386 - DNA, 22 bp, Homo sapiens
taactttgatcacttgataagg

SEQ ID NO: 8011387 - DNA, 22 bp, Homo sapiens
taactttcttcatatgtgaacc

SEQ ID NO: 8011388 - DNA, 22 bp, Homo sapiens
taactttcttcatatgtgaacc

SEQ ID NO: 8011389 - DNA, 20 bp, Homo sapiens
taactttctatgctttcagc

SEQ ID NO: 8011390 - DNA, 20 bp, Homo sapiens
taactttctatgctttcagc

SEQ ID NO: 8011391 - DNA, 22 bp, Homo sapiens
taactttgaagggaattttact

SEQ ID NO: 8011392 - DNA, 22 bp, Homo sapiens
taactttcttcatatgtgaacc

SEQ ID NO: 8011393 - DNA, 22 bp, Homo sapiens
taactttagtgtatgaggtaag

SEQ ID NO: 8011394 - DNA, 22 bp, Homo sapiens
taactttaggaataggtaatct

SEQ ID NO: 8011395 - DNA, 22 bp, Homo sapiens
taactttcacatcacactgact

SEQ ID NO: 8011396 - DNA, 22 bp, Homo sapiens
taactttagtgtatgaggtaag

SEQ ID NO: 8011397 - DNA, 22 bp, Homo sapiens
taacatttaaatttttcacata

SEQ ID NO: 8011398 - DNA, 22 bp, Homo sapiens
taacatttaaatttttcacata

SEQ ID NO: 8011399 - DNA, 22 bp, Homo sapiens
taacatttaaatttttcacata

SEQ ID NO: 8011400 - DNA, 22 bp, Homo sapiens
taacatttagaaagtgtccatt

SEQ ID NO: 8011401 - DNA, 22 bp, Homo sapiens
taacatttagaaagtgtccatt

SEQ ID NO: 8011402 - DNA, 22 bp, Homo sapiens
taacatttagaaagtgtccatt

SEQ ID NO: 8011403 - DNA, 22 bp, Homo sapiens
taacatttaaatttttcacata

SEQ ID NO: 8011404 - DNA, 22 bp, Homo sapiens
taacatttagaaagtgtccatt

SEQ ID NO: 8011405 - DNA, 22 bp, Homo sapiens
taacatttgctgtctcctatgt

SEQ ID NO: 8011406 - DNA, 22 bp, Homo sapiens
taacatttgctgtctcctatgt

SEQ ID NO: 8011407 - DNA, 22 bp, Homo sapiens
taacatttgctgtctcctatgt

SEQ ID NO: 8011408 - DNA, 22 bp, Homo sapiens
taacatttcggtgacagtggga

SEQ ID NO: 8011409 - DNA, 22 bp, Homo sapiens
taacatttcggtgacagtggga

SEQ ID NO: 8011410 - DNA, 22 bp, Homo sapiens
taacatttcggtgacagtggga

SEQ ID NO: 8011411 - DNA, 19 bp, Homo sapiens
taacttgtagatatgaagt

SEQ ID NO: 8011412 - DNA, 22 bp, Homo sapiens
taacttgtgttacattactctt

SEQ ID NO: 8011413 - DNA, 22 bp, Homo sapiens
taacttgtgttacattactctt

SEQ ID NO: 8011414 - DNA, 22 bp, Homo sapiens
taactttaggaataggtaatct

SEQ ID NO: 8011415 - DNA, 22 bp, Homo sapiens
taacttgataagtattctctgc

SEQ ID NO: 8011416 - DNA, 19 bp, Homo sapiens
taacttgtagatatgaagt

SEQ ID NO: 8011417 - DNA, 22 bp, Homo sapiens
taacttggttggtgggcaggag

SEQ ID NO: 8011418 - DNA, 22 bp, Homo sapiens
taacttctttggtttaaagaga

SEQ ID NO: 8011419 - DNA, 22 bp, Homo sapiens
taacttctttggtttaaagaga

SEQ ID NO: 8011420 - DNA, 22 bp, Homo sapiens
taaccaaagggcctaaggaatg

SEQ ID NO: 8011421 - DNA, 16 bp, Homo sapiens
taacatttttaaaagg

SEQ ID NO: 8011422 - DNA, 16 bp, Homo sapiens
taacatttttaaaagg

SEQ ID NO: 8011423 - DNA, 16 bp, Homo sapiens
taacatttttaaaagg

SEQ ID NO: 8011424 - DNA, 16 bp, Homo sapiens
taacatttttaaaagg

SEQ ID NO: 8011425 - DNA, 22 bp, Homo sapiens
caggatggtctcgatctcctga

SEQ ID NO: 8011426 - DNA, 22 bp, Homo sapiens
caggatggagagtgaggggtca

SEQ ID NO: 8011427 - DNA, 22 bp, Homo sapiens
caggatggagagtgaggggtca

SEQ ID NO: 8011428 - DNA, 22 bp, Homo sapiens
caggatggagagtgaggggtca

SEQ ID NO: 8011429 - DNA, 22 bp, Homo sapiens
caggatgctgaaaacacgagga

SEQ ID NO: 8011430 - DNA, 22 bp, Homo sapiens
caggatgcttctggggccaggc

SEQ ID NO: 8011431 - DNA, 22 bp, Homo sapiens
caggatggtggcatgatcagaa

SEQ ID NO: 8011432 - DNA, 22 bp, Homo sapiens
caggatggtcttcatttggctc

SEQ ID NO: 8011433 - DNA, 22 bp, Homo sapiens
caggatggtggcatgatcagaa

SEQ ID NO: 8011434 - DNA, 22 bp, Homo sapiens
caggatggtggcatgatcagaa

SEQ ID NO: 8011435 - DNA, 22 bp, Homo sapiens
caggatggtctcgatctcctga

SEQ ID NO: 8011436 - DNA, 22 bp, Homo sapiens
caggatggtcttcatttggctc

SEQ ID NO: 8011437 - DNA, 22 bp, Homo sapiens
caggatgatgttaattgaagtt

SEQ ID NO: 8011438 - DNA, 22 bp, Homo sapiens
caggatgatgttaattgaagtt

SEQ ID NO: 8011439 - DNA, 21 bp, Homo sapiens
caggatgatgggaaggtggtg

SEQ ID NO: 8011440 - DNA, 21 bp, Homo sapiens
caggatgatgggaaggtggtg

SEQ ID NO: 8011441 - DNA, 21 bp, Homo sapiens
caggatgatgataattcatgg

SEQ ID NO: 8011442 - DNA, 22 bp, Homo sapiens
caggatgatgagtagagtgtga

SEQ ID NO: 8011443 - DNA, 22 bp, Homo sapiens
caggatgcggcctgactctaag

SEQ ID NO: 8011444 - DNA, 22 bp, Homo sapiens
caggatgcctttgaactctgga

SEQ ID NO: 8011445 - DNA, 22 bp, Homo sapiens
caggatgcagtgggacccaggg

SEQ ID NO: 8011446 - DNA, 22 bp, Homo sapiens
taagaaacccaggaatttctta

SEQ ID NO: 8011447 - DNA, 22 bp, Homo sapiens
caggatattacctaatatttga

SEQ ID NO: 8011448 - DNA, 22 bp, Homo sapiens
taagaaacatttttatgacagt

SEQ ID NO: 8011449 - DNA, 22 bp, Homo sapiens
taagaaacatttttatgacagt

SEQ ID NO: 8011450 - DNA, 22 bp, Homo sapiens
taagaaacatttttatgacagt

SEQ ID NO: 8011451 - DNA, 22 bp, Homo sapiens
caggatccctggcctccgccca

SEQ ID NO: 8011452 - DNA, 22 bp, Homo sapiens
caggatcctggctgcatggacg

SEQ ID NO: 8011453 - DNA, 22 bp, Homo sapiens
caggatccctggcctccgccca

SEQ ID NO: 8011454 - DNA, 22 bp, Homo sapiens
caggatctgcccaggcctttgg

SEQ ID NO: 8011455 - DNA, 22 bp, Homo sapiens
caggatctgcccaggcctttgg

SEQ ID NO: 8011456 - DNA, 22 bp, Homo sapiens
caggatgaagggcaaaggcaag

SEQ ID NO: 8011457 - DNA, 22 bp, Homo sapiens
caggatctgttaagttgttcca

SEQ ID NO: 8011458 - DNA, 22 bp, Homo sapiens
caggatcttttaatgtctccag

SEQ ID NO: 8011459 - DNA, 22 bp, Homo sapiens
caggatgaccatatgttccagt

SEQ ID NO: 8011460 - DNA, 22 bp, Homo sapiens
caggatgaccatatgttccagt

SEQ ID NO: 8011461 - DNA, 18 bp, Homo sapiens
caggatgagtgatgggga

SEQ ID NO: 8011462 - DNA, 19 bp, Homo sapiens
caggatgatcccatgacac

SEQ ID NO: 8011463 - DNA, 22 bp, Homo sapiens
taagatttttaaaatgtcctca

SEQ ID NO: 8011464 - DNA, 22 bp, Homo sapiens
taagatttttaaaatgtcctca

SEQ ID NO: 8011465 - DNA, 22 bp, Homo sapiens
taagatttttaaaatgtcctca

SEQ ID NO: 8011466 - DNA, 22 bp, Homo sapiens
taagcaaaagtcgagtgtgagc

SEQ ID NO: 8011467 - DNA, 22 bp, Homo sapiens
taagcaaaagtcgagtgtgagc

SEQ ID NO: 8011468 - DNA, 22 bp, Homo sapiens
taagcaaaagtcgagtgtgagc

SEQ ID NO: 8011469 - DNA, 22 bp, Homo sapiens
taagcaaaagtcgagtgtgagc

SEQ ID NO: 8011470 - DNA, 22 bp, Homo sapiens
taagcaaaagtcgagtgtgagc

SEQ ID NO: 8011471 - DNA, 22 bp, Homo sapiens
taagcaaaggattttgatcttt

SEQ ID NO: 8011472 - DNA, 22 bp, Homo sapiens
taagcaaaggattttgatcttt

SEQ ID NO: 8011473 - DNA, 22 bp, Homo sapiens
taagcaaaggattttgatcttt

SEQ ID NO: 8011474 - DNA, 22 bp, Homo sapiens
taagcaaagtttataaggctct

SEQ ID NO: 8011475 - DNA, 22 bp, Homo sapiens
taagcaaaggattttgatcttt

SEQ ID NO: 8011476 - DNA, 22 bp, Homo sapiens
taagcaaaggattttgatcttt

SEQ ID NO: 8011477 - DNA, 22 bp, Homo sapiens
taagcaaagtttataaggctct

SEQ ID NO: 8011478 - DNA, 22 bp, Homo sapiens
taagcaaataatgcatcaaggg

SEQ ID NO: 8011479 - DNA, 22 bp, Homo sapiens
taagcaaataatgcatcaaggg

SEQ ID NO: 8011480 - DNA, 22 bp, Homo sapiens
taagcaaataatgcatcaaggg

SEQ ID NO: 8011481 - DNA, 22 bp, Homo sapiens
taagatgtcatccacatagagt

SEQ ID NO: 8011482 - DNA, 22 bp, Homo sapiens
taagatgtcatccacatagagt

SEQ ID NO: 8011483 - DNA, 22 bp, Homo sapiens
taagatgtctaagaggagatgc

SEQ ID NO: 8011484 - DNA, 22 bp, Homo sapiens
taagatgtggaatcacagcttc

SEQ ID NO: 8011485 - DNA, 22 bp, Homo sapiens
taagatgtctaagaggagatgc

SEQ ID NO: 8011486 - DNA, 22 bp, Homo sapiens
taagatgtttacagtatggaga

SEQ ID NO: 8011487 - DNA, 22 bp, Homo sapiens
taagattacagtgagaaataaa

SEQ ID NO: 8011488 - DNA, 22 bp, Homo sapiens
taagattacagtgagaaataaa

SEQ ID NO: 8011489 - DNA, 22 bp, Homo sapiens
taagattatacttaaagagaaa

SEQ ID NO: 8011490 - DNA, 22 bp, Homo sapiens
taagattacagtgagaaataaa

SEQ ID NO: 8011491 - DNA, 22 bp, Homo sapiens
taagatttttaaaatgtcctca

SEQ ID NO: 8011492 - DNA, 22 bp, Homo sapiens
taagatttttaaaatgtcctca

SEQ ID NO: 8011493 - DNA, 22 bp, Homo sapiens
taagattatacttaaagagaaa

SEQ ID NO: 8011494 - DNA, 22 bp, Homo sapiens
taagattatacttaaagagaaa

SEQ ID NO: 8011495 - DNA, 22 bp, Homo sapiens
taagatgtacaaccacttctct

SEQ ID NO: 8011496 - DNA, 22 bp, Homo sapiens
taagatgtcaaagggtcacagt

SEQ ID NO: 8011497 - DNA, 22 bp, Homo sapiens
taagatgtaagatcagagcttg

SEQ ID NO: 8011498 - DNA, 22 bp, Homo sapiens
taagatgtaagatcagagcttg

SEQ ID NO: 8011499 - DNA, 19 bp, Homo sapiens
taagacagattcctagagt

SEQ ID NO: 8011500 - DNA, 19 bp, Homo sapiens
taagacagattcctagagt

SEQ ID NO: 8011501 - DNA, 22 bp, Homo sapiens
taagacacctctctgcccttca

SEQ ID NO: 8011502 - DNA, 22 bp, Homo sapiens
taagacacgggctgatctaaag

SEQ ID NO: 8011503 - DNA, 23 bp, Homo sapiens
taagacacccgactccagagatg

SEQ ID NO: 8011504 - DNA, 22 bp, Homo sapiens
taagacacattggagtagatga

SEQ ID NO: 8011505 - DNA, 22 bp, Homo sapiens
taagacacattggagtagatga

SEQ ID NO: 8011506 - DNA, 22 bp, Homo sapiens
taagacacattggagtagatga

SEQ ID NO: 8011507 - DNA, 22 bp, Homo sapiens
taagacacattgagaaacacaa

SEQ ID NO: 8011508 - DNA, 22 bp, Homo sapiens
taagacacattcatatctgtct

SEQ ID NO: 8011509 - DNA, 22 bp, Homo sapiens
taagacacatgcgtacaagata

SEQ ID NO: 8011510 - DNA, 22 bp, Homo sapiens
taaggcacccttctgagtagag

SEQ ID NO: 8011511 - DNA, 22 bp, Homo sapiens
taaggcacccatgttcatacag

SEQ ID NO: 8011512 - DNA, 22 bp, Homo sapiens
taaggcacccgtgagctgccag

SEQ ID NO: 8011513 - DNA, 22 bp, Homo sapiens
taaggcacgcataagagggggc

SEQ ID NO: 8011514 - DNA, 22 bp, Homo sapiens
taaggcacctgtccaggctggg

SEQ ID NO: 8011515 - DNA, 22 bp, Homo sapiens
taaggcagaaatatgagcaggg

SEQ ID NO: 8011516 - DNA, 22 bp, Homo sapiens
taaggcagaaatatgagcaggg

SEQ ID NO: 8011517 - DNA, 22 bp, Homo sapiens
taaggcagaaatatgagcaggg

SEQ ID NO: 8011518 - DNA, 22 bp, Homo sapiens
taaggcacgcggtgaatgccaa

SEQ ID NO: 8011519 - DNA, 22 bp, Homo sapiens
taaggcacttcaatgtttagaa

SEQ ID NO: 8011520 - DNA, 22 bp, Homo sapiens
taagcaaataatgcatcaaggg

SEQ ID NO: 8011521 - DNA, 22 bp, Homo sapiens
taagcaaataatgcatcaaggg

SEQ ID NO: 8011522 - DNA, 22 bp, Homo sapiens
taagcaaatagctagatcagag

SEQ ID NO: 8011523 - DNA, 22 bp, Homo sapiens
taagcaaatagctagatcagag

SEQ ID NO: 8011524 - DNA, 22 bp, Homo sapiens
taagcaaatagctagatcagag

SEQ ID NO: 8011525 - DNA, 22 bp, Homo sapiens
taagcaaatagctagatcagag

SEQ ID NO: 8011526 - DNA, 22 bp, Homo sapiens
taagcaacaaatggtttctgat

SEQ ID NO: 8011527 - DNA, 22 bp, Homo sapiens
taaggcaccataatatatttaa

SEQ ID NO: 8011528 - DNA, 22 bp, Homo sapiens
taaggcacccatgttcatacag

SEQ ID NO: 8011529 - DNA, 22 bp, Homo sapiens
taagcaacaaggtgtttaaatt

SEQ ID NO: 8011530 - DNA, 22 bp, Homo sapiens
taagcaacaaggtgtttaaatt

SEQ ID NO: 8011531 - DNA, 22 bp, Homo sapiens
taaggcacacagttgctgcatg

SEQ ID NO: 8011532 - DNA, 22 bp, Homo sapiens
taaggcacacagttgctgcatg

SEQ ID NO: 8011533 - DNA, 22 bp, Homo sapiens
caggcactttgctgggggcgca

SEQ ID NO: 8011534 - DNA, 22 bp, Homo sapiens
caggcagaaagtattctgtgta

SEQ ID NO: 8011535 - DNA, 22 bp, Homo sapiens
caggcagaaattttgtttcatt

SEQ ID NO: 8011536 - DNA, 22 bp, Homo sapiens
caggcagaaattttgtttcatt

SEQ ID NO: 8011537 - DNA, 22 bp, Homo sapiens
caggcagaaattttgtttcatt

SEQ ID NO: 8011538 - DNA, 22 bp, Homo sapiens
caggcagaaagtattctgtgta

SEQ ID NO: 8011539 - DNA, 22 bp, Homo sapiens
taaggcagcctcagggtagggt

SEQ ID NO: 8011540 - DNA, 22 bp, Homo sapiens
taaggcagccgctcagagaggt

SEQ ID NO: 8011541 - DNA, 22 bp, Homo sapiens
caggcactcagtctggatccct

SEQ ID NO: 8011542 - DNA, 22 bp, Homo sapiens
caggcactagcagaatgaggct

SEQ ID NO: 8011543 - DNA, 22 bp, Homo sapiens
taaggcagccgctcagagaggt

SEQ ID NO: 8011544 - DNA, 22 bp, Homo sapiens
taaggcagccgctcagagaggt

SEQ ID NO: 8011545 - DNA, 22 bp, Homo sapiens
taaggcagcataattaggccac

SEQ ID NO: 8011546 - DNA, 22 bp, Homo sapiens
taaggcagcataattaggccac

SEQ ID NO: 8011547 - DNA, 19 bp, Homo sapiens
taaggcagcagtgacaggc

SEQ ID NO: 8011548 - DNA, 19 bp, Homo sapiens
taaggcagcagtgacaggc

SEQ ID NO: 8011549 - DNA, 22 bp, Homo sapiens
taaggcagatgtggaatcaatt

SEQ ID NO: 8011550 - DNA, 22 bp, Homo sapiens
taaggcagatgtggaatcaatt

SEQ ID NO: 8011551 - DNA, 19 bp, Homo sapiens
taaggcagcagtgacaggc

SEQ ID NO: 8011552 - DNA, 22 bp, Homo sapiens
taaggcagatgtggaatcaatt

SEQ ID NO: 8011553 - DNA, 22 bp, Homo sapiens
taaggcagaggtaccactaggc

SEQ ID NO: 8011554 - DNA, 22 bp, Homo sapiens
taagacaattcttcagtcacaa

SEQ ID NO: 8011555 - DNA, 22 bp, Homo sapiens
taagacacagtccgcactctct

SEQ ID NO: 8011556 - DNA, 22 bp, Homo sapiens
caggcacatgggagctcatcat

SEQ ID NO: 8011557 - DNA, 22 bp, Homo sapiens
caggcacatgggagctcatcat

SEQ ID NO: 8011558 - DNA, 22 bp, Homo sapiens
caggcacatgggagctcatcat

SEQ ID NO: 8011559 - DNA, 22 bp, Homo sapiens
caggcacatgggagctcatcat

SEQ ID NO: 8011560 - DNA, 22 bp, Homo sapiens
caggcaccaacttcctggggag

SEQ ID NO: 8011561 - DNA, 22 bp, Homo sapiens
caggcaccaacttcctggggag

SEQ ID NO: 8011562 - DNA, 22 bp, Homo sapiens
caggcaccaacttcctggggag

SEQ ID NO: 8011563 - DNA, 22 bp, Homo sapiens
caggcaccaacttcctggggag

SEQ ID NO: 8011564 - DNA, 22 bp, Homo sapiens
caggcacatgggagctcatcat

SEQ ID NO: 8011565 - DNA, 22 bp, Homo sapiens
caggcacatgggagctcatcat

SEQ ID NO: 8011566 - DNA, 22 bp, Homo sapiens
caggcacatgggagctcatcat

SEQ ID NO: 8011567 - DNA, 17 bp, Homo sapiens
caggcacatgaagccag

SEQ ID NO: 8011568 - DNA, 22 bp, Homo sapiens
caggcacatgggagctcatcat

SEQ ID NO: 8011569 - DNA, 22 bp, Homo sapiens
caggcacatgggagctcatcat

SEQ ID NO: 8011570 - DNA, 17 bp, Homo sapiens
caggcacatgaagccag

SEQ ID NO: 8011571 - DNA, 17 bp, Homo sapiens
caggcacatgaagccag

SEQ ID NO: 8011572 - DNA, 22 bp, Homo sapiens
caggcacagtgttgctgttcaa

SEQ ID NO: 8011573 - DNA, 22 bp, Homo sapiens
caggcacagttccaagcatttt

SEQ ID NO: 8011574 - DNA, 22 bp, Homo sapiens
caggcacagttccaagcatttt

SEQ ID NO: 8011575 - DNA, 22 bp, Homo sapiens
caggcacagtgttgctgttcaa

SEQ ID NO: 8011576 - DNA, 22 bp, Homo sapiens
caggcacagtgttgctgttcaa

SEQ ID NO: 8011577 - DNA, 22 bp, Homo sapiens
caggcacagtggggtcctctct

SEQ ID NO: 8011578 - DNA, 22 bp, Homo sapiens
caggcacagtggggtcctctct

SEQ ID NO: 8011579 - DNA, 22 bp, Homo sapiens
caggcacagtggggtcctctct

SEQ ID NO: 8011580 - DNA, 22 bp, Homo sapiens
caggcacagtgttgctgttcaa

SEQ ID NO: 8011581 - DNA, 22 bp, Homo sapiens
caggcacaagatcggctagata

SEQ ID NO: 8011582 - DNA, 22 bp, Homo sapiens
caggcacaagatcggctagata

SEQ ID NO: 8011583 - DNA, 22 bp, Homo sapiens
caggcacaagaagcaaatgtta

SEQ ID NO: 8011584 - DNA, 22 bp, Homo sapiens
caggcacaagatcggctagata

SEQ ID NO: 8011585 - DNA, 22 bp, Homo sapiens
caggcacaagaagcaaatgtta

SEQ ID NO: 8011586 - DNA, 22 bp, Homo sapiens
caggcacaaatttctagataag

SEQ ID NO: 8011587 - DNA, 22 bp, Homo sapiens
caggcacaagaagcaaatgtta

SEQ ID NO: 8011588 - DNA, 22 bp, Homo sapiens
caggcacaagaagcaaatgtta

SEQ ID NO: 8011589 - DNA, 22 bp, Homo sapiens
caggcacaagaagcaaatgtta

SEQ ID NO: 8011590 - DNA, 22 bp, Homo sapiens
caggcacaagatcggctagata

SEQ ID NO: 8011591 - DNA, 22 bp, Homo sapiens
caggcacaatgagcgccatctt

SEQ ID NO: 8011592 - DNA, 22 bp, Homo sapiens
caggcacaatgagcgccatctt

SEQ ID NO: 8011593 - DNA, 22 bp, Homo sapiens
caggcacaatgagcgccatctt

SEQ ID NO: 8011594 - DNA, 22 bp, Homo sapiens
caggcacaatgagcgccatctt

SEQ ID NO: 8011595 - DNA, 22 bp, Homo sapiens
caggcacactgtctacactgag

SEQ ID NO: 8011596 - DNA, 22 bp, Homo sapiens
caggcacaggggaatgtctttt

SEQ ID NO: 8011597 - DNA, 22 bp, Homo sapiens
caggcacagctgggcaattgcg

SEQ ID NO: 8011598 - DNA, 22 bp, Homo sapiens
caggcacagtggggtcctctct

SEQ ID NO: 8011599 - DNA, 22 bp, Homo sapiens
caggcacagtggggtcctctct

SEQ ID NO: 8011600 - DNA, 22 bp, Homo sapiens
caggcacagctgggcaattgcg

SEQ ID NO: 8011601 - DNA, 22 bp, Homo sapiens
caggcacagctgggcaattgcg

SEQ ID NO: 8011602 - DNA, 22 bp, Homo sapiens
caggcacaggggaatgtctttt

SEQ ID NO: 8011603 - DNA, 22 bp, Homo sapiens
caggcacagctgggcaattgcg

SEQ ID NO: 8011604 - DNA, 22 bp, Homo sapiens
caggcacagctaagactggcca

SEQ ID NO: 8011605 - DNA, 22 bp, Homo sapiens
caggcacagctaagactggcca

SEQ ID NO: 8011606 - DNA, 22 bp, Homo sapiens
caggcacagagttattcattta

SEQ ID NO: 8011607 - DNA, 22 bp, Homo sapiens
caggcacagacgcaaacttctt

SEQ ID NO: 8011608 - DNA, 22 bp, Homo sapiens
caggcacagacgcaaacttctt

SEQ ID NO: 8011609 - DNA, 22 bp, Homo sapiens
caggcacaaatttctagataag

SEQ ID NO: 8011610 - DNA, 22 bp, Homo sapiens
caggcacaaatttctagataag

SEQ ID NO: 8011611 - DNA, 22 bp, Homo sapiens
caggcacaaatttctagataag

SEQ ID NO: 8011612 - DNA, 22 bp, Homo sapiens
caggcacaaatttctagataag

SEQ ID NO: 8011613 - DNA, 22 bp, Homo sapiens
caggcacaaaaggaccccagca

SEQ ID NO: 8011614 - DNA, 22 bp, Homo sapiens
caggcacaaaaggaccccagca

SEQ ID NO: 8011615 - DNA, 22 bp, Homo sapiens
caggcaagttcatttccaggca

SEQ ID NO: 8011616 - DNA, 22 bp, Homo sapiens
caggcaaggaggcactgaggga

SEQ ID NO: 8011617 - DNA, 22 bp, Homo sapiens
caggcaaggaggcactgaggga

SEQ ID NO: 8011618 - DNA, 22 bp, Homo sapiens
caggcaaggaggcactgaggga

SEQ ID NO: 8011619 - DNA, 22 bp, Homo sapiens
caggcaaggaggcactgaggga

SEQ ID NO: 8011620 - DNA, 22 bp, Homo sapiens
caggcaagcaaggggtcttgaa

SEQ ID NO: 8011621 - DNA, 22 bp, Homo sapiens
caggcaagcacggtgaacctgg

SEQ ID NO: 8011622 - DNA, 22 bp, Homo sapiens
caggcaagcacggtgaacctgg

SEQ ID NO: 8011623 - DNA, 22 bp, Homo sapiens
caggcaaggagctggctcaagt

SEQ ID NO: 8011624 - DNA, 22 bp, Homo sapiens
caggcaaggaggcactgaggga

SEQ ID NO: 8011625 - DNA, 22 bp, Homo sapiens
caggcaaggaggcactgaggga

SEQ ID NO: 8011626 - DNA, 22 bp, Homo sapiens
caggcaagcaaggggtcttgaa

SEQ ID NO: 8011627 - DNA, 22 bp, Homo sapiens
caggcaagcaaggggtcttgaa

SEQ ID NO: 8011628 - DNA, 22 bp, Homo sapiens
caggcaagcaaggggtcttgaa

SEQ ID NO: 8011629 - DNA, 22 bp, Homo sapiens
caggcaagcaaggggtcttgaa

SEQ ID NO: 8011630 - DNA, 22 bp, Homo sapiens
caggcaagattagagatgagca

SEQ ID NO: 8011631 - DNA, 22 bp, Homo sapiens
caggattataaactgtgcactg

SEQ ID NO: 8011632 - DNA, 22 bp, Homo sapiens
caggattgaatgcttctccctg

SEQ ID NO: 8011633 - DNA, 22 bp, Homo sapiens
caggatgttgctcccatgtccc

SEQ ID NO: 8011634 - DNA, 22 bp, Homo sapiens
caggatgtatgtcttattcttc

SEQ ID NO: 8011635 - DNA, 22 bp, Homo sapiens
caggatggtgtgagtgtgagga

SEQ ID NO: 8011636 - DNA, 22 bp, Homo sapiens
caggatggtgtgagtgtgagga

SEQ ID NO: 8011637 - DNA, 22 bp, Homo sapiens
caggatggtgtgagtgtgagga

SEQ ID NO: 8011638 - DNA, 22 bp, Homo sapiens
caggatggtgtgagtgtgagga

SEQ ID NO: 8011639 - DNA, 22 bp, Homo sapiens
caggatggtgtgagtgtgagga

SEQ ID NO: 8011640 - DNA, 22 bp, Homo sapiens
caggatggtgtgagtgtgagga

SEQ ID NO: 8011641 - DNA, 22 bp, Homo sapiens
caggatggtggcatgatcagaa

SEQ ID NO: 8011642 - DNA, 22 bp, Homo sapiens
caggatggtggcatgatcagaa

SEQ ID NO: 8011643 - DNA, 22 bp, Homo sapiens
caggatggtggcatgatcagaa

SEQ ID NO: 8011644 - DNA, 22 bp, Homo sapiens
caggcaagatccagaggctgct

SEQ ID NO: 8011645 - DNA, 22 bp, Homo sapiens
caggcaagatccagaggctgct

SEQ ID NO: 8011646 - DNA, 22 bp, Homo sapiens
caggcaagattagagatgagca

SEQ ID NO: 8011647 - DNA, 22 bp, Homo sapiens
caggcaagattagagatgagca

SEQ ID NO: 8011648 - DNA, 22 bp, Homo sapiens
caggcaagattagagatgagca

SEQ ID NO: 8011649 - DNA, 22 bp, Homo sapiens
caggcaagatccagaggctgct

SEQ ID NO: 8011650 - DNA, 22 bp, Homo sapiens
caggcaagatccagaggctgct

SEQ ID NO: 8011651 - DNA, 22 bp, Homo sapiens
caggcaagatccagaggctgct

SEQ ID NO: 8011652 - DNA, 22 bp, Homo sapiens
caggattgagcaaatggattat

SEQ ID NO: 8011653 - DNA, 19 bp, Homo sapiens
caggattgtttaaagcttt

SEQ ID NO: 8011654 - DNA, 22 bp, Homo sapiens
caggatttcatacatctttact

SEQ ID NO: 8011655 - DNA, 22 bp, Homo sapiens
caggcaacgtccttagagatgc

SEQ ID NO: 8011656 - DNA, 22 bp, Homo sapiens
caggcaagatccagaggctgct

SEQ ID NO: 8011657 - DNA, 22 bp, Homo sapiens
caggcaagatccagaggctgct

SEQ ID NO: 8011658 - DNA, 22 bp, Homo sapiens
caggcaagatccagaggctgct

SEQ ID NO: 8011659 - DNA, 22 bp, Homo sapiens
caggcaagatccagaggctgct

SEQ ID NO: 8011660 - DNA, 22 bp, Homo sapiens
caggcaagatccagaggctgct

SEQ ID NO: 8011661 - DNA, 22 bp, Homo sapiens
taatttaatccaagtgttacat

SEQ ID NO: 8011662 - DNA, 22 bp, Homo sapiens
taattgttttcaatgttaatga

SEQ ID NO: 8011663 - DNA, 22 bp, Homo sapiens
taattgttttcaatgttaatga

SEQ ID NO: 8011664 - DNA, 22 bp, Homo sapiens
taatttaatccaagtgttacat

SEQ ID NO: 8011665 - DNA, 22 bp, Homo sapiens
taatttaatccaagtgttacat

SEQ ID NO: 8011666 - DNA, 22 bp, Homo sapiens
taatttaatccaagtgttacat

SEQ ID NO: 8011667 - DNA, 22 bp, Homo sapiens
taatttaattccatggattcta

SEQ ID NO: 8011668 - DNA, 22 bp, Homo sapiens
taatttacttgcaaataacaat

SEQ ID NO: 8011669 - DNA, 22 bp, Homo sapiens
taatttactcagatgttcaatc

SEQ ID NO: 8011670 - DNA, 22 bp, Homo sapiens
taatttactcagatgttcaatc

SEQ ID NO: 8011671 - DNA, 22 bp, Homo sapiens
taatttacttgcaaataacaat

SEQ ID NO: 8011672 - DNA, 22 bp, Homo sapiens
taatttaattccatggattcta

SEQ ID NO: 8011673 - DNA, 22 bp, Homo sapiens
taatttaatttcatgccagcct

SEQ ID NO: 8011674 - DNA, 22 bp, Homo sapiens
taatttaatttcatgccagcct

SEQ ID NO: 8011675 - DNA, 22 bp, Homo sapiens
taatgttagtatgtaatcttat

SEQ ID NO: 8011676 - DNA, 22 bp, Homo sapiens
taatgttagtatgtaatcttat

SEQ ID NO: 8011677 - DNA, 22 bp, Homo sapiens
caggcagagccaatcgtggggt

SEQ ID NO: 8011678 - DNA, 22 bp, Homo sapiens
taatgttataaattcttggttt

SEQ ID NO: 8011679 - DNA, 22 bp, Homo sapiens
taatgttgctgtagaaagtcaa

SEQ ID NO: 8011680 - DNA, 22 bp, Homo sapiens
taatgttgctgtagaaagtcaa

SEQ ID NO: 8011681 - DNA, 22 bp, Homo sapiens
taatgttataaattcttggttt

SEQ ID NO: 8011682 - DNA, 22 bp, Homo sapiens
taatgtttagaagcagacagct

SEQ ID NO: 8011683 - DNA, 22 bp, Homo sapiens
taatgtttagaagcagacagct

SEQ ID NO: 8011684 - DNA, 22 bp, Homo sapiens
taatgtttagaagcagacagct

SEQ ID NO: 8011685 - DNA, 22 bp, Homo sapiens
caggcagagcaactggtccaga

SEQ ID NO: 8011686 - DNA, 22 bp, Homo sapiens
caggcagagcaactggtccaga

SEQ ID NO: 8011687 - DNA, 22 bp, Homo sapiens
caggcagagcaactggtccaga

SEQ ID NO: 8011688 - DNA, 22 bp, Homo sapiens
caggcagagcaactggtccaga

SEQ ID NO: 8011689 - DNA, 22 bp, Homo sapiens
caggcagagcaactggtccaga

SEQ ID NO: 8011690 - DNA, 22 bp, Homo sapiens
caggcagagcaactggtccaga

SEQ ID NO: 8011691 - DNA, 22 bp, Homo sapiens
caggcagagcaactggtccaga

SEQ ID NO: 8011692 - DNA, 22 bp, Homo sapiens
taattgtactccctgtgggaaa

SEQ ID NO: 8011693 - DNA, 22 bp, Homo sapiens
taattgtagctttgtaatcagc

SEQ ID NO: 8011694 - DNA, 22 bp, Homo sapiens
taattgtatggagaaggctgca

SEQ ID NO: 8011695 - DNA, 22 bp, Homo sapiens
taattgtacgatgttaaatcag

SEQ ID NO: 8011696 - DNA, 22 bp, Homo sapiens
taattgtacgatgttaaatcag

SEQ ID NO: 8011697 - DNA, 22 bp, Homo sapiens
taattgtaaagtagtagtacag

SEQ ID NO: 8011698 - DNA, 22 bp, Homo sapiens
taattgctttatcctgttagaa

SEQ ID NO: 8011699 - DNA, 22 bp, Homo sapiens
taattggatgttctctggaagc

SEQ ID NO: 8011700 - DNA, 22 bp, Homo sapiens
taattgggcaatttaggactag

SEQ ID NO: 8011701 - DNA, 22 bp, Homo sapiens
taattggttttctaggtttaat

SEQ ID NO: 8011702 - DNA, 22 bp, Homo sapiens
taattgtaaagtagtagtacag

SEQ ID NO: 8011703 - DNA, 22 bp, Homo sapiens
taattggtgagagagctgagtc

SEQ ID NO: 8011704 - DNA, 22 bp, Homo sapiens
taattggtagctggtataatgc

SEQ ID NO: 8011705 - DNA, 22 bp, Homo sapiens
taattggtgagagagctgagtc

SEQ ID NO: 8011706 - DNA, 22 bp, Homo sapiens
caggcagaaggaagtaccaggc

SEQ ID NO: 8011707 - DNA, 22 bp, Homo sapiens
caggcagaaggaagtaccaggc

SEQ ID NO: 8011708 - DNA, 22 bp, Homo sapiens
caggcagaatgaccgacctcgc

SEQ ID NO: 8011709 - DNA, 22 bp, Homo sapiens
caggcagaatgaccgacctcgc

SEQ ID NO: 8011710 - DNA, 22 bp, Homo sapiens
caggcagaaggaagtaccaggc

SEQ ID NO: 8011711 - DNA, 22 bp, Homo sapiens
caggcagaaggaagtaccaggc

SEQ ID NO: 8011712 - DNA, 17 bp, Homo sapiens
caggcagacatgtaagc

SEQ ID NO: 8011713 - DNA, 17 bp, Homo sapiens
caggcagacatgtaagc

SEQ ID NO: 8011714 - DNA, 17 bp, Homo sapiens
caggcagacatgtaagc

SEQ ID NO: 8011715 - DNA, 17 bp, Homo sapiens
caggcagacatgtaagc

SEQ ID NO: 8011716 - DNA, 22 bp, Homo sapiens
caggcagaatgagattacttca

SEQ ID NO: 8011717 - DNA, 22 bp, Homo sapiens
caggcagaatgagattacttca

SEQ ID NO: 8011718 - DNA, 22 bp, Homo sapiens
caggcagaatgagattacttca

SEQ ID NO: 8011719 - DNA, 22 bp, Homo sapiens
caggcagaatgagattacttca

SEQ ID NO: 8011720 - DNA, 22 bp, Homo sapiens
caggcagaatgagattacttca

SEQ ID NO: 8011721 - DNA, 22 bp, Homo sapiens
caggcagaatgaccgacctcgc

SEQ ID NO: 8011722 - DNA, 22 bp, Homo sapiens
caggcagaagaagtggaaggac

SEQ ID NO: 8011723 - DNA, 22 bp, Homo sapiens
caggcagaagaagtggaaggac

SEQ ID NO: 8011724 - DNA, 22 bp, Homo sapiens
caggcagaaattttgtttcatt

SEQ ID NO: 8011725 - DNA, 22 bp, Homo sapiens
caggcagaaagtattctgtgta

SEQ ID NO: 8011726 - DNA, 22 bp, Homo sapiens
caggcagaaattttgtttcatt

SEQ ID NO: 8011727 - DNA, 22 bp, Homo sapiens
caggcagaagaagtggaaggac

SEQ ID NO: 8011728 - DNA, 22 bp, Homo sapiens
caggcagaagaagtggaaggac

SEQ ID NO: 8011729 - DNA, 22 bp, Homo sapiens
caggcagaagaagtggaaggac

SEQ ID NO: 8011730 - DNA, 22 bp, Homo sapiens
caggcagaagaagtggaaggac

SEQ ID NO: 8011731 - DNA, 22 bp, Homo sapiens
caggcagaagaagtggaaggac

SEQ ID NO: 8011732 - DNA, 22 bp, Homo sapiens
caggcagaaggaagtaccaggc

SEQ ID NO: 8011733 - DNA, 22 bp, Homo sapiens
caggcagaagaagtggaaggac

SEQ ID NO: 8011734 - DNA, 22 bp, Homo sapiens
caggcagaaggaagtaccaggc

SEQ ID NO: 8011735 - DNA, 22 bp, Homo sapiens
caggcagaaggaagtaccaggc

SEQ ID NO: 8011736 - DNA, 22 bp, Homo sapiens
caggcagaaggaagtaccaggc

SEQ ID NO: 8011737 - DNA, 22 bp, Homo sapiens
caggcagaaggaagtaccaggc

SEQ ID NO: 8011738 - DNA, 22 bp, Homo sapiens
caggcagaaggaagtaccaggc

SEQ ID NO: 8011739 - DNA, 22 bp, Homo sapiens
caggcagaaggaagtaccaggc

SEQ ID NO: 8011740 - DNA, 22 bp, Homo sapiens
caggcagaaggaagtaccaggc

SEQ ID NO: 8011741 - DNA, 22 bp, Homo sapiens
caggcagactttgagaatgatg

SEQ ID NO: 8011742 - DNA, 22 bp, Homo sapiens
caggcagactttgagaatgatg

SEQ ID NO: 8011743 - DNA, 22 bp, Homo sapiens
caggcagacatttttgacatag

SEQ ID NO: 8011744 - DNA, 22 bp, Homo sapiens
caggcagacatttttgacatag

SEQ ID NO: 8011745 - DNA, 17 bp, Homo sapiens
caggcagacatgtaagc

SEQ ID NO: 8011746 - DNA, 22 bp, Homo sapiens
caggcagagaactcatccgtga

SEQ ID NO: 8011747 - DNA, 22 bp, Homo sapiens
caggcagagaccctctcctaaa

SEQ ID NO: 8011748 - DNA, 22 bp, Homo sapiens
caggcagagaccctctcctaaa

SEQ ID NO: 8011749 - DNA, 22 bp, Homo sapiens
caggcagagaccctctcctaaa

SEQ ID NO: 8011750 - DNA, 22 bp, Homo sapiens
caggcagagaactcatccgtga

SEQ ID NO: 8011751 - DNA, 22 bp, Homo sapiens
caggcagagaactcatccgtga

SEQ ID NO: 8011752 - DNA, 22 bp, Homo sapiens
caggcagagaactcatccgtga

SEQ ID NO: 8011753 - DNA, 22 bp, Homo sapiens
caggcagagaactcatccgtga

SEQ ID NO: 8011754 - DNA, 22 bp, Homo sapiens
caggcagactttgagaatgatg

SEQ ID NO: 8011755 - DNA, 17 bp, Homo sapiens
caggcagacatgtaagc

SEQ ID NO: 8011756 - DNA, 22 bp, Homo sapiens
caggcagactttgagaatgatg

SEQ ID NO: 8011757 - DNA, 22 bp, Homo sapiens
caggcagacatttttgacatag

SEQ ID NO: 8011758 - DNA, 22 bp, Homo sapiens
caggcagactttgagaatgatg

SEQ ID NO: 8011759 - DNA, 22 bp, Homo sapiens
caggcagactttgagaatgatg

SEQ ID NO: 8011760 - DNA, 22 bp, Homo sapiens
caggcagagacgtcagtgtagg

SEQ ID NO: 8011761 - DNA, 22 bp, Homo sapiens
caggcagagaggagcatttaat

SEQ ID NO: 8011762 - DNA, 22 bp, Homo sapiens
caggcagagacgtcagtgtagg

SEQ ID NO: 8011763 - DNA, 22 bp, Homo sapiens
caggcagagaggagcatttaat

SEQ ID NO: 8011764 - DNA, 22 bp, Homo sapiens
caggcagagcaactggtccaga

SEQ ID NO: 8011765 - DNA, 22 bp, Homo sapiens
caggcagagaggagcatttaat

SEQ ID NO: 8011766 - DNA, 22 bp, Homo sapiens
caggcagagaggagcatttaat

SEQ ID NO: 8011767 - DNA, 22 bp, Homo sapiens
caggcagagaccctctcctaaa

SEQ ID NO: 8011768 - DNA, 22 bp, Homo sapiens
caggcagagaccctctcctaaa

SEQ ID NO: 8011769 - DNA, 22 bp, Homo sapiens
caggcagagaccctctcctaaa

SEQ ID NO: 8011770 - DNA, 22 bp, Homo sapiens
caggcagagacgtcagtgtagg

SEQ ID NO: 8011771 - DNA, 22 bp, Homo sapiens
caggcagagacgtcagtgtagg

SEQ ID NO: 8011772 - DNA, 22 bp, Homo sapiens
caggcagagaccctctcctaaa

SEQ ID NO: 8011773 - DNA, 22 bp, Homo sapiens
caggcagagacgtcagtgtagg

SEQ ID NO: 8011774 - DNA, 22 bp, Homo sapiens
caggcagagaccctctcctaaa

SEQ ID NO: 8011775 - DNA, 22 bp, Homo sapiens
caggcagagacgtcagtgtagg

SEQ ID NO: 8011776 - DNA, 22 bp, Homo sapiens
caggcagagacgtcagtgtagg

SEQ ID NO: 8011777 - DNA, 22 bp, Homo sapiens
caggcagagacgtcagtgtagg

SEQ ID NO: 8011778 - DNA, 22 bp, Homo sapiens
caggcagcaggagccctgctcg

SEQ ID NO: 8011779 - DNA, 22 bp, Homo sapiens
caggcagcaggagccctgctcg

SEQ ID NO: 8011780 - DNA, 22 bp, Homo sapiens
caggcagcaggagccctgctcg

SEQ ID NO: 8011781 - DNA, 22 bp, Homo sapiens
caggcagcaggagccctgctcg

SEQ ID NO: 8011782 - DNA, 22 bp, Homo sapiens
caggcagcaggagccctgctcg

SEQ ID NO: 8011783 - DNA, 22 bp, Homo sapiens
caggcagcagccactctggtat

SEQ ID NO: 8011784 - DNA, 22 bp, Homo sapiens
caggcagcagccactctggtat

SEQ ID NO: 8011785 - DNA, 22 bp, Homo sapiens
caggcagcagccactctggtat

SEQ ID NO: 8011786 - DNA, 22 bp, Homo sapiens
caggcagcagccactctggtat

SEQ ID NO: 8011787 - DNA, 22 bp, Homo sapiens
taatttacttgcaaataacaat

SEQ ID NO: 8011788 - DNA, 22 bp, Homo sapiens
caggcagcagccactctggtat

SEQ ID NO: 8011789 - DNA, 22 bp, Homo sapiens
taatttacttgcaaataacaat

SEQ ID NO: 8011790 - DNA, 22 bp, Homo sapiens
caggcagcatcagtctgctgta

SEQ ID NO: 8011791 - DNA, 22 bp, Homo sapiens
caggcagcatcagtctgctgta

SEQ ID NO: 8011792 - DNA, 22 bp, Homo sapiens
caggcagcatcagtctgctgta

SEQ ID NO: 8011793 - DNA, 22 bp, Homo sapiens
caggcagcatcagtctgctgta

SEQ ID NO: 8011794 - DNA, 22 bp, Homo sapiens
caggcagcatttactctgatga

SEQ ID NO: 8011795 - DNA, 22 bp, Homo sapiens
caggcagcatcagtctgctgta

SEQ ID NO: 8011796 - DNA, 22 bp, Homo sapiens
caggcagcatcagtctgctgta

SEQ ID NO: 8011797 - DNA, 22 bp, Homo sapiens
caggcagccaggggacctgtcc

SEQ ID NO: 8011798 - DNA, 22 bp, Homo sapiens
caggcagccaggggacctgtcc

SEQ ID NO: 8011799 - DNA, 22 bp, Homo sapiens
caggcagccaggggacctgtcc

SEQ ID NO: 8011800 - DNA, 22 bp, Homo sapiens
caggcagccaggggacctgtcc

SEQ ID NO: 8011801 - DNA, 22 bp, Homo sapiens
caggcagccaggggacctgtcc

SEQ ID NO: 8011802 - DNA, 22 bp, Homo sapiens
caggcagcatttactctgatga

SEQ ID NO: 8011803 - DNA, 22 bp, Homo sapiens
caggcagcatttactctgatga

SEQ ID NO: 8011804 - DNA, 22 bp, Homo sapiens
caggcagcatcagtctgctgta

SEQ ID NO: 8011805 - DNA, 22 bp, Homo sapiens
caggcagcatttactctgatga

SEQ ID NO: 8011806 - DNA, 22 bp, Homo sapiens
caggcagctctaatggaaagtg

SEQ ID NO: 8011807 - DNA, 22 bp, Homo sapiens
caggcagctctaatggaaagtg

SEQ ID NO: 8011808 - DNA, 22 bp, Homo sapiens
caggcagctctgcttttcctaa

SEQ ID NO: 8011809 - DNA, 22 bp, Homo sapiens
caggcagctctgcttttcctaa

SEQ ID NO: 8011810 - DNA, 22 bp, Homo sapiens
caggcagctctaatggaaagtg

SEQ ID NO: 8011811 - DNA, 22 bp, Homo sapiens
caggcagctctaatggaaagtg

SEQ ID NO: 8011812 - DNA, 22 bp, Homo sapiens
caggcagctctaatggaaagtg

SEQ ID NO: 8011813 - DNA, 22 bp, Homo sapiens
caggcagctctaatggaaagtg

SEQ ID NO: 8011814 - DNA, 22 bp, Homo sapiens
caggcagctgactgtcagatat

SEQ ID NO: 8011815 - DNA, 22 bp, Homo sapiens
caggcagctgactgtcagatat

SEQ ID NO: 8011816 - DNA, 22 bp, Homo sapiens
caggcagctgactgtcagatat

SEQ ID NO: 8011817 - DNA, 22 bp, Homo sapiens
caggcagctctgcttttcctaa

SEQ ID NO: 8011818 - DNA, 22 bp, Homo sapiens
caggcagctctgcttttcctaa

SEQ ID NO: 8011819 - DNA, 22 bp, Homo sapiens
caggcagctgactgtcagatat

SEQ ID NO: 8011820 - DNA, 22 bp, Homo sapiens
caggcagctgactgtcagatat

SEQ ID NO: 8011821 - DNA, 22 bp, Homo sapiens
caggcagccctgcaccaagtgt

SEQ ID NO: 8011822 - DNA, 22 bp, Homo sapiens
caggcagccaggggacctgtcc

SEQ ID NO: 8011823 - DNA, 22 bp, Homo sapiens
caggcagcctgagggatctggg

SEQ ID NO: 8011824 - DNA, 22 bp, Homo sapiens
caggcagcctgagggatctggg

SEQ ID NO: 8011825 - DNA, 22 bp, Homo sapiens
caggcagcctgagggatctggg

SEQ ID NO: 8011826 - DNA, 22 bp, Homo sapiens
caggcagccctgcaccaagtgt

SEQ ID NO: 8011827 - DNA, 22 bp, Homo sapiens
caggcagccctgcaccaagtgt

SEQ ID NO: 8011828 - DNA, 22 bp, Homo sapiens
caggcagcctgagggatctggg

SEQ ID NO: 8011829 - DNA, 22 bp, Homo sapiens
caggcagcctgagggatctggg

SEQ ID NO: 8011830 - DNA, 22 bp, Homo sapiens
caggcagctctaatggaaagtg

SEQ ID NO: 8011831 - DNA, 22 bp, Homo sapiens
caggcagcctgcggtctgcaca

SEQ ID NO: 8011832 - DNA, 22 bp, Homo sapiens
caggcagctcgatgccttgttg

SEQ ID NO: 8011833 - DNA, 22 bp, Homo sapiens
caggcagggagccactgtataa

SEQ ID NO: 8011834 - DNA, 22 bp, Homo sapiens
caggcagggagccactgtataa

SEQ ID NO: 8011835 - DNA, 22 bp, Homo sapiens
caggcaggctgctttttgttca

SEQ ID NO: 8011836 - DNA, 22 bp, Homo sapiens
caggcaggctgctttttgttca

SEQ ID NO: 8011837 - DNA, 22 bp, Homo sapiens
caggcaggctgctttttgttca

SEQ ID NO: 8011838 - DNA, 23 bp, Homo sapiens
caggcaggatgaggactacactc

SEQ ID NO: 8011839 - DNA, 23 bp, Homo sapiens
caggcaggatgaggactacactc

SEQ ID NO: 8011840 - DNA, 23 bp, Homo sapiens
caggcaggatgaggactacactc

SEQ ID NO: 8011841 - DNA, 23 bp, Homo sapiens
caggcaggatgaggactacactc

SEQ ID NO: 8011842 - DNA, 22 bp, Homo sapiens
caggcaggagccagggattcca

SEQ ID NO: 8011843 - DNA, 22 bp, Homo sapiens
caggcaggagccagggattcca

SEQ ID NO: 8011844 - DNA, 22 bp, Homo sapiens
caggcaggagccagggattcca

SEQ ID NO: 8011845 - DNA, 22 bp, Homo sapiens
caggcaggagccagggattcca

SEQ ID NO: 8011846 - DNA, 22 bp, Homo sapiens
caggcaggagccagggattcca

SEQ ID NO: 8011847 - DNA, 22 bp, Homo sapiens
caggcaggagccagggattcca

SEQ ID NO: 8011848 - DNA, 23 bp, Homo sapiens
caggcaggatgaggactacactc

SEQ ID NO: 8011849 - DNA, 22 bp, Homo sapiens
caggcaggagaggaggatttct

SEQ ID NO: 8011850 - DNA, 22 bp, Homo sapiens
caggcaggagaggaggatttct

SEQ ID NO: 8011851 - DNA, 22 bp, Homo sapiens
caggcaggagaggaggatttct

SEQ ID NO: 8011852 - DNA, 22 bp, Homo sapiens
caggcaggagaggaggatttct

SEQ ID NO: 8011853 - DNA, 22 bp, Homo sapiens
caggcagctgcgacaagagagc

SEQ ID NO: 8011854 - DNA, 22 bp, Homo sapiens
caggcagctgcgacaagagagc

SEQ ID NO: 8011855 - DNA, 22 bp, Homo sapiens
caggcagctgcgacaagagagc

SEQ ID NO: 8011856 - DNA, 22 bp, Homo sapiens
caggcagctgcgacaagagagc

SEQ ID NO: 8011857 - DNA, 22 bp, Homo sapiens
caggcagctgctgggttcagcc

SEQ ID NO: 8011858 - DNA, 22 bp, Homo sapiens
caggcagctgcgacaagagagc

SEQ ID NO: 8011859 - DNA, 22 bp, Homo sapiens
caggcagctgcgacaagagagc

SEQ ID NO: 8011860 - DNA, 22 bp, Homo sapiens
caggcagctgaggactttgcta

SEQ ID NO: 8011861 - DNA, 22 bp, Homo sapiens
caggcagctgaggactttgcta

SEQ ID NO: 8011862 - DNA, 22 bp, Homo sapiens
caggcagctgactgtcagatat

SEQ ID NO: 8011863 - DNA, 22 bp, Homo sapiens
caggcagctgcgacaagagagc

SEQ ID NO: 8011864 - DNA, 22 bp, Homo sapiens
caggcagctgaggactttgcta

SEQ ID NO: 8011865 - DNA, 22 bp, Homo sapiens
caggcagctgaggactttgcta

SEQ ID NO: 8011866 - DNA, 22 bp, Homo sapiens
caggcagctgctgggttcagcc

SEQ ID NO: 8011867 - DNA, 22 bp, Homo sapiens
caggcagctgctgggttcagcc

SEQ ID NO: 8011868 - DNA, 22 bp, Homo sapiens
caggcagctgctgggttcagcc

SEQ ID NO: 8011869 - DNA, 22 bp, Homo sapiens
caggcagctgctgggttcagcc

SEQ ID NO: 8011870 - DNA, 22 bp, Homo sapiens
caggcagctgctgggttcagcc

SEQ ID NO: 8011871 - DNA, 22 bp, Homo sapiens
caggcagctgctgggttcagcc

SEQ ID NO: 8011872 - DNA, 22 bp, Homo sapiens
caggcaggagacatttggttgg

SEQ ID NO: 8011873 - DNA, 22 bp, Homo sapiens
caggcaggagacatttggttgg

SEQ ID NO: 8011874 - DNA, 22 bp, Homo sapiens
caggcagctgggtcaccgtccc

SEQ ID NO: 8011875 - DNA, 22 bp, Homo sapiens
caggcagctgggtcaccgtccc

SEQ ID NO: 8011876 - DNA, 22 bp, Homo sapiens
caggcagctgggtcaccgtccc

SEQ ID NO: 8011877 - DNA, 22 bp, Homo sapiens
caggcagctgggtcaccgtccc

SEQ ID NO: 8011878 - DNA, 22 bp, Homo sapiens
tacaagtatgttttaaaatgtt

SEQ ID NO: 8011879 - DNA, 22 bp, Homo sapiens
tacaagtatggaatgattctca

SEQ ID NO: 8011880 - DNA, 22 bp, Homo sapiens
tacaagtactgtggctttgaat

SEQ ID NO: 8011881 - DNA, 22 bp, Homo sapiens
tacaagtactgtggctttgaat

SEQ ID NO: 8011882 - DNA, 22 bp, Homo sapiens
tacaaggcttcagctcagctat

SEQ ID NO: 8011883 - DNA, 22 bp, Homo sapiens
tacaagggagattattcatatt

SEQ ID NO: 8011884 - DNA, 22 bp, Homo sapiens
tacaaggttgtactttctctct

SEQ ID NO: 8011885 - DNA, 22 bp, Homo sapiens
tacaagtaaattgtagatacca

SEQ ID NO: 8011886 - DNA, 22 bp, Homo sapiens
tacaagttccattttgaaagtg

SEQ ID NO: 8011887 - DNA, 22 bp, Homo sapiens
tacaagtgtttgagaggtggac

SEQ ID NO: 8011888 - DNA, 16 bp, Homo sapiens
tacaagtgttagggaa

SEQ ID NO: 8011889 - DNA, 22 bp, Homo sapiens
tacaagtgtaagcttgtgagac

SEQ ID NO: 8011890 - DNA, 22 bp, Homo sapiens
tacaagtgtgcaccaccatgtc

SEQ ID NO: 8011891 - DNA, 22 bp, Homo sapiens
tacaagtgtggctcctctgtct

SEQ ID NO: 8011892 - DNA, 22 bp, Homo sapiens
tacaagtggagttaggaagttt

SEQ ID NO: 8011893 - DNA, 22 bp, Homo sapiens
tacaagtgctagcagatattgt

SEQ ID NO: 8011894 - DNA, 22 bp, Homo sapiens
tacaagtgctagcagatattgt

SEQ ID NO: 8011895 - DNA, 22 bp, Homo sapiens
tacaagtgctagcagatattgt

SEQ ID NO: 8011896 - DNA, 22 bp, Homo sapiens
tacaagtcacttcctttctaaa

SEQ ID NO: 8011897 - DNA, 22 bp, Homo sapiens
tacaagtcattggatgaggaat

SEQ ID NO: 8011898 - DNA, 22 bp, Homo sapiens
tacaagtccgtaaagggcagat

SEQ ID NO: 8011899 - DNA, 22 bp, Homo sapiens
tacagctgttggtgtttcctct

SEQ ID NO: 8011900 - DNA, 22 bp, Homo sapiens
tacagctgttggtgtttcctct

SEQ ID NO: 8011901 - DNA, 22 bp, Homo sapiens
tacagcttaaaaaagccaactt

SEQ ID NO: 8011902 - DNA, 22 bp, Homo sapiens
tacagggattcctgccgctcgc

SEQ ID NO: 8011903 - DNA, 21 bp, Homo sapiens
tacaagttgcttttgaagtcc

SEQ ID NO: 8011904 - DNA, 22 bp, Homo sapiens
tacaagtttatccatcattgtt

SEQ ID NO: 8011905 - DNA, 22 bp, Homo sapiens
tacaagtttatccatcattgtt

SEQ ID NO: 8011906 - DNA, 22 bp, Homo sapiens
tacaatacttaacctattttgc

SEQ ID NO: 8011907 - DNA, 20 bp, Homo sapiens
tacaatacacatgcatatga

SEQ ID NO: 8011908 - DNA, 20 bp, Homo sapiens
tacaatacacatgcatatga

SEQ ID NO: 8011909 - DNA, 22 bp, Homo sapiens
tacaggggtaacagtggggaat

SEQ ID NO: 8011910 - DNA, 22 bp, Homo sapiens
tacagggtataggtacagatga

SEQ ID NO: 8011911 - DNA, 22 bp, Homo sapiens
tacagggtattcaagggtagtt

SEQ ID NO: 8011912 - DNA, 22 bp, Homo sapiens
tacagggtattcaagggtagtt

SEQ ID NO: 8011913 - DNA, 22 bp, Homo sapiens
tacaggtagcaaaacctttcct

SEQ ID NO: 8011914 - DNA, 22 bp, Homo sapiens
tacaggtagagtctctagttta

SEQ ID NO: 8011915 - DNA, 22 bp, Homo sapiens
tacaggtaaatgcaaacagctc

SEQ ID NO: 8011916 - DNA, 22 bp, Homo sapiens
tacaaatgggttaaaatatagt

SEQ ID NO: 8011917 - DNA, 22 bp, Homo sapiens
tacaaatgggttaaaatatagt

SEQ ID NO: 8011918 - DNA, 22 bp, Homo sapiens
tacaaatgggttaaaatatagt

SEQ ID NO: 8011919 - DNA, 22 bp, Homo sapiens
tacaaatgggttaaaatatagt

SEQ ID NO: 8011920 - DNA, 22 bp, Homo sapiens
tacaaatgcctgacacacagat

SEQ ID NO: 8011921 - DNA, 22 bp, Homo sapiens
tacaaatgggttaaaatatagt

SEQ ID NO: 8011922 - DNA, 22 bp, Homo sapiens
tacaaatgggttaaaatatagt

SEQ ID NO: 8011923 - DNA, 22 bp, Homo sapiens
tacaaatgggttaaaatatagt

SEQ ID NO: 8011924 - DNA, 22 bp, Homo sapiens
tacaaattaatgggcatgttta

SEQ ID NO: 8011925 - DNA, 22 bp, Homo sapiens
tacaaatgtattttattttggt

SEQ ID NO: 8011926 - DNA, 22 bp, Homo sapiens
tacaaatgtattttattttggt

SEQ ID NO: 8011927 - DNA, 22 bp, Homo sapiens
tacaaatgtattttattttggt

SEQ ID NO: 8011928 - DNA, 22 bp, Homo sapiens
tacaaatgtattttattttggt

SEQ ID NO: 8011929 - DNA, 22 bp, Homo sapiens
tacaaatggttgaatggatgaa

SEQ ID NO: 8011930 - DNA, 22 bp, Homo sapiens
tacaaatgtattttattttggt

SEQ ID NO: 8011931 - DNA, 22 bp, Homo sapiens
tacaaatggttgaatggatgaa

SEQ ID NO: 8011932 - DNA, 22 bp, Homo sapiens
tacaaatggttgaatggatgaa

SEQ ID NO: 8011933 - DNA, 22 bp, Homo sapiens
tacaaatggttgaatggatgaa

SEQ ID NO: 8011934 - DNA, 22 bp, Homo sapiens
tacaaatggttgaatggatgaa

SEQ ID NO: 8011935 - DNA, 20 bp, Homo sapiens
tacaaattttccatgtttcc

SEQ ID NO: 8011936 - DNA, 20 bp, Homo sapiens
tacaaattttccatgtttcc

SEQ ID NO: 8011937 - DNA, 22 bp, Homo sapiens
tacaaggaaaatcttgaagtac

SEQ ID NO: 8011938 - DNA, 22 bp, Homo sapiens
tacaaggcaaatccatgatgtc

SEQ ID NO: 8011939 - DNA, 22 bp, Homo sapiens
tacaaggaggctaatgatgaca

SEQ ID NO: 8011940 - DNA, 22 bp, Homo sapiens
tacaaattaatgggcatgttta

SEQ ID NO: 8011941 - DNA, 22 bp, Homo sapiens
tacaaattaatgggcatgttta

SEQ ID NO: 8011942 - DNA, 20 bp, Homo sapiens
tacaaattttccatgtttcc

SEQ ID NO: 8011943 - DNA, 20 bp, Homo sapiens
tacaaattttccatgtttcc

SEQ ID NO: 8011944 - DNA, 20 bp, Homo sapiens
tacaaattttccatgtttcc

SEQ ID NO: 8011945 - DNA, 20 bp, Homo sapiens
tacaaattttccatgtttcc

SEQ ID NO: 8011946 - DNA, 22 bp, Homo sapiens
tacaaatgagttgtatgaacca

SEQ ID NO: 8011947 - DNA, 22 bp, Homo sapiens
tacaaatgagttgtatgaacca

SEQ ID NO: 8011948 - DNA, 22 bp, Homo sapiens
tacaaatgagttgtatgaacca

SEQ ID NO: 8011949 - DNA, 22 bp, Homo sapiens
tacaaatgagttgtatgaacca

SEQ ID NO: 8011950 - DNA, 22 bp, Homo sapiens
tacaaatgagttgtatgaacca

SEQ ID NO: 8011951 - DNA, 22 bp, Homo sapiens
tacaaatgaccatagccactta

SEQ ID NO: 8011952 - DNA, 22 bp, Homo sapiens
tacaaatgaccatagccactta

SEQ ID NO: 8011953 - DNA, 22 bp, Homo sapiens
tacaaatgcctgacacacagat

SEQ ID NO: 8011954 - DNA, 22 bp, Homo sapiens
tacaaatgcctgacacacagat

SEQ ID NO: 8011955 - DNA, 22 bp, Homo sapiens
tacaaatgcctgacacacagat

SEQ ID NO: 8011956 - DNA, 22 bp, Homo sapiens
tacaaatgcctgacacacagat

SEQ ID NO: 8011957 - DNA, 22 bp, Homo sapiens
tacaaatgagttgtatgaacca

SEQ ID NO: 8011958 - DNA, 22 bp, Homo sapiens
tacaaatgagttgtatgaacca

SEQ ID NO: 8011959 - DNA, 22 bp, Homo sapiens
tacaaatgagttgtatgaacca

SEQ ID NO: 8011960 - DNA, 22 bp, Homo sapiens
tacaaatgagttgtatgaacca

SEQ ID NO: 8011961 - DNA, 22 bp, Homo sapiens
caggcagggagctggaaaggat

SEQ ID NO: 8011962 - DNA, 22 bp, Homo sapiens
tacaaactaacatgtctcatcc

SEQ ID NO: 8011963 - DNA, 22 bp, Homo sapiens
tacaaactaacatgtctcatcc

SEQ ID NO: 8011964 - DNA, 22 bp, Homo sapiens
tacaaactaacatgtctcatcc

SEQ ID NO: 8011965 - DNA, 22 bp, Homo sapiens
tacaaactaacatgtctcatcc

SEQ ID NO: 8011966 - DNA, 22 bp, Homo sapiens
caggcagggagctggaaaggat

SEQ ID NO: 8011967 - DNA, 20 bp, Homo sapiens
tacaaacctccacactggtg

SEQ ID NO: 8011968 - DNA, 22 bp, Homo sapiens
tacaaactaacatgtctcatcc

SEQ ID NO: 8011969 - DNA, 22 bp, Homo sapiens
tacaaactaacatgtctcatcc

SEQ ID NO: 8011970 - DNA, 22 bp, Homo sapiens
tacaaactccgaagtttgtacc

SEQ ID NO: 8011971 - DNA, 22 bp, Homo sapiens
tacaaatgaaccaactttgatg

SEQ ID NO: 8011972 - DNA, 22 bp, Homo sapiens
tacaaatgaaccaactttgatg

SEQ ID NO: 8011973 - DNA, 22 bp, Homo sapiens
tacaaatgaaccaactttgatg

SEQ ID NO: 8011974 - DNA, 22 bp, Homo sapiens
tacaaatgaaccaactttgatg

SEQ ID NO: 8011975 - DNA, 22 bp, Homo sapiens
tacaaatgaaccaactttgatg

SEQ ID NO: 8011976 - DNA, 22 bp, Homo sapiens
tacatatgaactttataacttg

SEQ ID NO: 8011977 - DNA, 22 bp, Homo sapiens
tacatatgaactttataacttg

SEQ ID NO: 8011978 - DNA, 22 bp, Homo sapiens
tacatatgaactttataacttg

SEQ ID NO: 8011979 - DNA, 22 bp, Homo sapiens
tacatatgaactttataacttg

SEQ ID NO: 8011980 - DNA, 22 bp, Homo sapiens
tacagtttgttacattgttagt

SEQ ID NO: 8011981 - DNA, 22 bp, Homo sapiens
tacatatagacagttactctag

SEQ ID NO: 8011982 - DNA, 22 bp, Homo sapiens
tacatatgtatttgtgtatacg

SEQ ID NO: 8011983 - DNA, 22 bp, Homo sapiens
tacatatgtaaacatgtataaa

SEQ ID NO: 8011984 - DNA, 22 bp, Homo sapiens
tacatatgtatttgtgtatacg

SEQ ID NO: 8011985 - DNA, 22 bp, Homo sapiens
tacatatgtaaacatgtataaa

SEQ ID NO: 8011986 - DNA, 22 bp, Homo sapiens
tacatatgtaaacatgtataaa

SEQ ID NO: 8011987 - DNA, 22 bp, Homo sapiens
tacagtttgttacattgttagt

SEQ ID NO: 8011988 - DNA, 22 bp, Homo sapiens
tacatatttgtctttgtactgt

SEQ ID NO: 8011989 - DNA, 22 bp, Homo sapiens
tacatatttgtctttgtactgt

SEQ ID NO: 8011990 - DNA, 22 bp, Homo sapiens
tacatatgtaaacatgtataaa

SEQ ID NO: 8011991 - DNA, 22 bp, Homo sapiens
tacatattctacccctttttct

SEQ ID NO: 8011992 - DNA, 22 bp, Homo sapiens
tacatatttgtctttgtactgt

SEQ ID NO: 8011993 - DNA, 22 bp, Homo sapiens
tacatatttgtctttgtactgt

SEQ ID NO: 8011994 - DNA, 22 bp, Homo sapiens
tacatattgtccatagttgctt

SEQ ID NO: 8011995 - DNA, 22 bp, Homo sapiens
tacatatttgtctttgtactgt

SEQ ID NO: 8011996 - DNA, 22 bp, Homo sapiens
tacatattcaacgttcagtatt

SEQ ID NO: 8011997 - DNA, 22 bp, Homo sapiens
tacatattctacccctttttct

SEQ ID NO: 8011998 - DNA, 22 bp, Homo sapiens
tacatattgtccatagttgctt

SEQ ID NO: 8011999 - DNA, 20 bp, Homo sapiens
tacatattatatcagctgca

SEQ ID NO: 8012000 - DNA, 20 bp, Homo sapiens
tacatattatatcagctgca

SEQ ID NO: 8012001 - DNA, 22 bp, Homo sapiens
tacatattcaacgttcagtatt

SEQ ID NO: 8012002 - DNA, 22 bp, Homo sapiens
tacatattcaacgttcagtatt

SEQ ID NO: 8012003 - DNA, 22 bp, Homo sapiens
tacatattcaacgttcagtatt

SEQ ID NO: 8012004 - DNA, 22 bp, Homo sapiens
tacatattcaacgttcagtatt

SEQ ID NO: 8012005 - DNA, 22 bp, Homo sapiens
tacatcataataatacttagaa

SEQ ID NO: 8012006 - DNA, 22 bp, Homo sapiens
tacatcataataatacttagaa

SEQ ID NO: 8012007 - DNA, 22 bp, Homo sapiens
tacatcatgaaagcatacatca

SEQ ID NO: 8012008 - DNA, 22 bp, Homo sapiens
tacatcatgaaagcatacatca

SEQ ID NO: 8012009 - DNA, 22 bp, Homo sapiens
tacatcatgaaagcatacatca

SEQ ID NO: 8012010 - DNA, 22 bp, Homo sapiens
tacatcaagataaaaactgtca

SEQ ID NO: 8012011 - DNA, 22 bp, Homo sapiens
tacatcaaggaacacctggtat

SEQ ID NO: 8012012 - DNA, 22 bp, Homo sapiens
tacatcaaggaacacctggtat

SEQ ID NO: 8012013 - DNA, 22 bp, Homo sapiens
tacatcaagataaaaactgtca

SEQ ID NO: 8012014 - DNA, 22 bp, Homo sapiens
tacatcaaatcaatgttccagt

SEQ ID NO: 8012015 - DNA, 22 bp, Homo sapiens
tacatatttgtctttgtactgt

SEQ ID NO: 8012016 - DNA, 22 bp, Homo sapiens
tacatatttgtctttgtactgt

SEQ ID NO: 8012017 - DNA, 22 bp, Homo sapiens
tacatgtgcacgtgtgactttg

SEQ ID NO: 8012018 - DNA, 22 bp, Homo sapiens
tacatgtgatcagaaagtgaaa

SEQ ID NO: 8012019 - DNA, 22 bp, Homo sapiens
tacatgtgatcagaaagtgaaa

SEQ ID NO: 8012020 - DNA, 22 bp, Homo sapiens
tacatgtgataaattgattaaa

SEQ ID NO: 8012021 - DNA, 21 bp, Homo sapiens
tacatcatgctacttctctga

SEQ ID NO: 8012022 - DNA, 22 bp, Homo sapiens
tacatcatggcttcatgctgca

SEQ ID NO: 8012023 - DNA, 22 bp, Homo sapiens
tacatcatggcttcatgctgca

SEQ ID NO: 8012024 - DNA, 22 bp, Homo sapiens
tacatgtgataaattgattaaa

SEQ ID NO: 8012025 - DNA, 22 bp, Homo sapiens
tacatcatggcttcatgctgca

SEQ ID NO: 8012026 - DNA, 22 bp, Homo sapiens
tacatgtggagataactgaagc

SEQ ID NO: 8012027 - DNA, 22 bp, Homo sapiens
tacatgtggagttttctagtca

SEQ ID NO: 8012028 - DNA, 22 bp, Homo sapiens
tacatgtggagataactgaagc

SEQ ID NO: 8012029 - DNA, 22 bp, Homo sapiens
tacatgtgctgggttcttggcc

SEQ ID NO: 8012030 - DNA, 22 bp, Homo sapiens
tacagtaaccttatttgtcatt

SEQ ID NO: 8012031 - DNA, 22 bp, Homo sapiens
tacagtaaccttatttgtcatt

SEQ ID NO: 8012032 - DNA, 22 bp, Homo sapiens
tacagtaaccttatttgtcatt

SEQ ID NO: 8012033 - DNA, 22 bp, Homo sapiens
caggccctggcagggctgagtc

SEQ ID NO: 8012034 - DNA, 19 bp, Homo sapiens
caggccctggacccatctg

SEQ ID NO: 8012035 - DNA, 22 bp, Homo sapiens
tacagtaaccagtctacttaga

SEQ ID NO: 8012036 - DNA, 22 bp, Homo sapiens
tacagtaaccagtctacttaga

SEQ ID NO: 8012037 - DNA, 22 bp, Homo sapiens
tacagtaaccagtctacttaga

SEQ ID NO: 8012038 - DNA, 22 bp, Homo sapiens
tacagtaaatgtggtagaaact

SEQ ID NO: 8012039 - DNA, 22 bp, Homo sapiens
tacagtaacatgttgtacaagc

SEQ ID NO: 8012040 - DNA, 22 bp, Homo sapiens
tacagtaacatgttgtacaagc

SEQ ID NO: 8012041 - DNA, 22 bp, Homo sapiens
tacagtaacatgttgtacaagc

SEQ ID NO: 8012042 - DNA, 22 bp, Homo sapiens
tacagtaacatgttgtacaagc

SEQ ID NO: 8012043 - DNA, 22 bp, Homo sapiens
tacaggtggtaaaaatattgtt

SEQ ID NO: 8012044 - DNA, 22 bp, Homo sapiens
tacaggtggtaaaaatattgtt

SEQ ID NO: 8012045 - DNA, 22 bp, Homo sapiens
tacaggtggatcactagtatag

SEQ ID NO: 8012046 - DNA, 22 bp, Homo sapiens
tacagtaaatgtggtagaaact

SEQ ID NO: 8012047 - DNA, 22 bp, Homo sapiens
tacagtaaatgtggtagaaact

SEQ ID NO: 8012048 - DNA, 22 bp, Homo sapiens
tacagtaaagctgctatgaatt

SEQ ID NO: 8012049 - DNA, 22 bp, Homo sapiens
tacaggttccaggaattaggac

SEQ ID NO: 8012050 - DNA, 22 bp, Homo sapiens
tacagtaaagctgctatgaatt

SEQ ID NO: 8012051 - DNA, 22 bp, Homo sapiens
caggccggccggccccagctct

SEQ ID NO: 8012052 - DNA, 22 bp, Homo sapiens
caggccctttcctgggcatagg

SEQ ID NO: 8012053 - DNA, 22 bp, Homo sapiens
tacagtttgtgtggagctggag

SEQ ID NO: 8012054 - DNA, 22 bp, Homo sapiens
caggccggccggccccagctct

SEQ ID NO: 8012055 - DNA, 22 bp, Homo sapiens
tacagtttgttacattgttagt

SEQ ID NO: 8012056 - DNA, 18 bp, Homo sapiens
caggccctgtctggcctc

SEQ ID NO: 8012057 - DNA, 18 bp, Homo sapiens
caggccctgtctggcctc

SEQ ID NO: 8012058 - DNA, 18 bp, Homo sapiens
caggccctgtctggcctc

SEQ ID NO: 8012059 - DNA, 22 bp, Homo sapiens
caggccctggcagggctgagtc

SEQ ID NO: 8012060 - DNA, 22 bp, Homo sapiens
caggccctggcagggctgagtc

SEQ ID NO: 8012061 - DNA, 22 bp, Homo sapiens
caggccctggcagggctgagtc

SEQ ID NO: 8012062 - DNA, 22 bp, Homo sapiens
caggccctggcagggctgagtc

SEQ ID NO: 8012063 - DNA, 22 bp, Homo sapiens
caggccctggcagggctgagtc

SEQ ID NO: 8012064 - DNA, 22 bp, Homo sapiens
caggccctggcagggctgagtc

SEQ ID NO: 8012065 - DNA, 22 bp, Homo sapiens
caggccctgggcaggatcagcc

SEQ ID NO: 8012066 - DNA, 22 bp, Homo sapiens
caggccctgggcaggcacagag

SEQ ID NO: 8012067 - DNA, 22 bp, Homo sapiens
caggccctgggcaggcacagag

SEQ ID NO: 8012068 - DNA, 22 bp, Homo sapiens
caggccctgggcaggcacagag

SEQ ID NO: 8012069 - DNA, 22 bp, Homo sapiens
caggccctgggcaggcacagag

SEQ ID NO: 8012070 - DNA, 19 bp, Homo sapiens
tctctctgtacattagata

SEQ ID NO: 8012071 - DNA, 19 bp, Homo sapiens
tctctctgtacattagata

SEQ ID NO: 8012072 - DNA, 20 bp, Homo sapiens
tctctctggttggaggagct

SEQ ID NO: 8012073 - DNA, 19 bp, Homo sapiens
tctctctgtacattagata

SEQ ID NO: 8012074 - DNA, 22 bp, Homo sapiens
ccagatggtttgcatgggaggg

SEQ ID NO: 8012075 - DNA, 22 bp, Homo sapiens
ccagatggtttgcatgggaggg

SEQ ID NO: 8012076 - DNA, 22 bp, Homo sapiens
ccagatgtatgtatgagtgcat

SEQ ID NO: 8012077 - DNA, 20 bp, Homo sapiens
ccagatggtccctgtgaaaa

SEQ ID NO: 8012078 - DNA, 22 bp, Homo sapiens
ccagatggtgcctgtcagaagg

SEQ ID NO: 8012079 - DNA, 22 bp, Homo sapiens
ccagatggtccagagtctagcc

SEQ ID NO: 8012080 - DNA, 22 bp, Homo sapiens
ccagatggtatagtagggagag

SEQ ID NO: 8012081 - DNA, 22 bp, Homo sapiens
ccagatggtatagtagggagag

SEQ ID NO: 8012082 - DNA, 22 bp, Homo sapiens
ccagatgggctttagcaaatga

SEQ ID NO: 8012083 - DNA, 22 bp, Homo sapiens
ccagatgggccaggggtttgtt

SEQ ID NO: 8012084 - DNA, 22 bp, Homo sapiens
ccagatgggaagaagcatgact

SEQ ID NO: 8012085 - DNA, 22 bp, Homo sapiens
ccagatgggaagaagcatgact

SEQ ID NO: 8012086 - DNA, 22 bp, Homo sapiens
ccagatgggccaggggtttgtt

SEQ ID NO: 8012087 - DNA, 18 bp, Homo sapiens
ccagatggccagtctgct

SEQ ID NO: 8012088 - DNA, 18 bp, Homo sapiens
ccagatggccagtctgct

SEQ ID NO: 8012089 - DNA, 22 bp, Homo sapiens
ccagatggaaatgatgttctca

SEQ ID NO: 8012090 - DNA, 22 bp, Homo sapiens
ccagatggaaatgatgttctca

SEQ ID NO: 8012091 - DNA, 22 bp, Homo sapiens
ccagatggaaatgatgttctca

SEQ ID NO: 8012092 - DNA, 17 bp, Homo sapiens
ccagatgccctgtctcc

SEQ ID NO: 8012093 - DNA, 21 bp, Homo sapiens
ccagatgcaaatgcagacatt

SEQ ID NO: 8012094 - DNA, 22 bp, Homo sapiens
ccagaggtgctgggagaggtct

SEQ ID NO: 8012095 - DNA, 19 bp, Homo sapiens
ccagagttggcagagcagg

SEQ ID NO: 8012096 - DNA, 22 bp, Homo sapiens
ccagaggtgctgggagaggtct

SEQ ID NO: 8012097 - DNA, 22 bp, Homo sapiens
ccagaggtgctgggagaggtct

SEQ ID NO: 8012098 - DNA, 22 bp, Homo sapiens
ccagatatcactgccgtgttgt

SEQ ID NO: 8012099 - DNA, 22 bp, Homo sapiens
ccagatagcaggtcagaagtgc

SEQ ID NO: 8012100 - DNA, 22 bp, Homo sapiens
ccagatagggatgagagtgcta

SEQ ID NO: 8012101 - DNA, 22 bp, Homo sapiens
ccagagttttatacaacttttt

SEQ ID NO: 8012102 - DNA, 22 bp, Homo sapiens
ccagataagaccatcagctatg

SEQ ID NO: 8012103 - DNA, 22 bp, Homo sapiens
ccagatatcactgccgtgttgt

SEQ ID NO: 8012104 - DNA, 22 bp, Homo sapiens
ccagatatcactgccgtgttgt

SEQ ID NO: 8012105 - DNA, 22 bp, Homo sapiens
ccagatcactcaaccagagctc

SEQ ID NO: 8012106 - DNA, 22 bp, Homo sapiens
ccagatctaagtccaaagtact

SEQ ID NO: 8012107 - DNA, 22 bp, Homo sapiens
ccagaggacttgggggctgaat

SEQ ID NO: 8012108 - DNA, 22 bp, Homo sapiens
ccagaggacttgggggctgaat

SEQ ID NO: 8012109 - DNA, 22 bp, Homo sapiens
ccagaggacttgggggctgaat

SEQ ID NO: 8012110 - DNA, 22 bp, Homo sapiens
ccagaggacttgggggctgaat

SEQ ID NO: 8012111 - DNA, 22 bp, Homo sapiens
ccagaggagcaggctggctcca

SEQ ID NO: 8012112 - DNA, 22 bp, Homo sapiens
ccagaggagcaggctggctcca

SEQ ID NO: 8012113 - DNA, 22 bp, Homo sapiens
ccagaggagatgcctcctctgt

SEQ ID NO: 8012114 - DNA, 22 bp, Homo sapiens
ccagaggagatgcctcctctgt

SEQ ID NO: 8012115 - DNA, 22 bp, Homo sapiens
ccagaggagatgcctcctctgt

SEQ ID NO: 8012116 - DNA, 22 bp, Homo sapiens
ccagaggagggctctgatgagg

SEQ ID NO: 8012117 - DNA, 22 bp, Homo sapiens
ccagaggaggggggtctttctg

SEQ ID NO: 8012118 - DNA, 22 bp, Homo sapiens
ccagaggtgccacagaaagagc

SEQ ID NO: 8012119 - DNA, 22 bp, Homo sapiens
ccagaggagcaggctggctcca

SEQ ID NO: 8012120 - DNA, 22 bp, Homo sapiens
ccagaggagggctctgatgagg

SEQ ID NO: 8012121 - DNA, 22 bp, Homo sapiens
tctctaggttgatataaattat

SEQ ID NO: 8012122 - DNA, 22 bp, Homo sapiens
tctctagtataatatagcaaaa

SEQ ID NO: 8012123 - DNA, 22 bp, Homo sapiens
tctctaggtgcagtcactgctc

SEQ ID NO: 8012124 - DNA, 22 bp, Homo sapiens
tctctaggtgcagtcactgctc

SEQ ID NO: 8012125 - DNA, 22 bp, Homo sapiens
tctctagtattaaatatagtgt

SEQ ID NO: 8012126 - DNA, 22 bp, Homo sapiens
tctctaggttgatataaattat

SEQ ID NO: 8012127 - DNA, 22 bp, Homo sapiens
tctctagtataatatagcaaaa

SEQ ID NO: 8012128 - DNA, 19 bp, Homo sapiens
ccagaggactgttaatgaa

SEQ ID NO: 8012129 - DNA, 22 bp, Homo sapiens
ccagaggacttgggggctgaat

SEQ ID NO: 8012130 - DNA, 22 bp, Homo sapiens
tctctaggcagtgtcagaatca

SEQ ID NO: 8012131 - DNA, 22 bp, Homo sapiens
tctctacctgctccatagccat

SEQ ID NO: 8012132 - DNA, 22 bp, Homo sapiens
tctctagacatggggaatgtca

SEQ ID NO: 8012133 - DNA, 22 bp, Homo sapiens
tctctagagcatgtgctgggca

SEQ ID NO: 8012134 - DNA, 22 bp, Homo sapiens
tctctaggggagccccgtttgt

SEQ ID NO: 8012135 - DNA, 22 bp, Homo sapiens
tctctagggtttagcacagata

SEQ ID NO: 8012136 - DNA, 22 bp, Homo sapiens
tctctaggcagtgtcagaatca

SEQ ID NO: 8012137 - DNA, 22 bp, Homo sapiens
tctctagggatctgttttaatt

SEQ ID NO: 8012138 - DNA, 22 bp, Homo sapiens
tctctagggcgggttgaaatga

SEQ ID NO: 8012139 - DNA, 22 bp, Homo sapiens
tctctagacatggggaatgtca

SEQ ID NO: 8012140 - DNA, 22 bp, Homo sapiens
tctctaagataggaatacagtt

SEQ ID NO: 8012141 - DNA, 22 bp, Homo sapiens
tctctaacctaatgtggaggga

SEQ ID NO: 8012142 - DNA, 21 bp, Homo sapiens
tctctacaaattatgttaggt

SEQ ID NO: 8012143 - DNA, 22 bp, Homo sapiens
tctctaattgacattacttgac

SEQ ID NO: 8012144 - DNA, 21 bp, Homo sapiens
tctctacaaattatgttaggt

SEQ ID NO: 8012145 - DNA, 19 bp, Homo sapiens
tctctacactacatttcta

SEQ ID NO: 8012146 - DNA, 22 bp, Homo sapiens
tctctacagacactgttgactt

SEQ ID NO: 8012147 - DNA, 22 bp, Homo sapiens
tctcccaaggcacagaaagagt

SEQ ID NO: 8012148 - DNA, 22 bp, Homo sapiens
tctcccaagggcacattcaagg

SEQ ID NO: 8012149 - DNA, 22 bp, Homo sapiens
tctcccaaggcacagaaagagt

SEQ ID NO: 8012150 - DNA, 22 bp, Homo sapiens
tctcccaaggcacagaaagagt

SEQ ID NO: 8012151 - DNA, 22 bp, Homo sapiens
tctcccaagggcacattcaagg

SEQ ID NO: 8012152 - DNA, 22 bp, Homo sapiens
tctcccaagggcacattcaagg

SEQ ID NO: 8012153 - DNA, 22 bp, Homo sapiens
tctcccaagtgaccaggaaaga

SEQ ID NO: 8012154 - DNA, 22 bp, Homo sapiens
tctcccaagggcacattcaagg

SEQ ID NO: 8012155 - DNA, 22 bp, Homo sapiens
tctcccaagtgaccaggaaaga

SEQ ID NO: 8012156 - DNA, 22 bp, Homo sapiens
tctcccaagtgaccaggaaaga

SEQ ID NO: 8012157 - DNA, 22 bp, Homo sapiens
tctcctgggaggacaaggaagg

SEQ ID NO: 8012158 - DNA, 22 bp, Homo sapiens
tctcctgggaggacaaggaagg

SEQ ID NO: 8012159 - DNA, 22 bp, Homo sapiens
tctcctgggaggacaaggaagg

SEQ ID NO: 8012160 - DNA, 22 bp, Homo sapiens
tctcccacagccgtgcttcaag

SEQ ID NO: 8012161 - DNA, 22 bp, Homo sapiens
tctcccacagccgtgcttcaag

SEQ ID NO: 8012162 - DNA, 22 bp, Homo sapiens
tctcccacagccgtgcttcaag

SEQ ID NO: 8012163 - DNA, 22 bp, Homo sapiens
tctctaaagtagaaaagacccc

SEQ ID NO: 8012164 - DNA, 20 bp, Homo sapiens
tctctaacatgaatgctatc

SEQ ID NO: 8012165 - DNA, 22 bp, Homo sapiens
tctcccaagcctggcaggggca

SEQ ID NO: 8012166 - DNA, 23 bp, Homo sapiens
tctcccaagcctggcaggggcac

SEQ ID NO: 8012167 - DNA, 21 bp, Homo sapiens
tctcccaaggaggtcctgagg

SEQ ID NO: 8012168 - DNA, 22 bp, Homo sapiens
tctcccaaggcacagaaagagt

SEQ ID NO: 8012169 - DNA, 21 bp, Homo sapiens
tctcccaaggaggtcctgagg

SEQ ID NO: 8012170 - DNA, 22 bp, Homo sapiens
tctcccaacatgtggaggtcag

SEQ ID NO: 8012171 - DNA, 22 bp, Homo sapiens
tctcccaagcctggcaggggca

SEQ ID NO: 8012172 - DNA, 22 bp, Homo sapiens
tctcccaacatgtggaggtcag

SEQ ID NO: 8012173 - DNA, 22 bp, Homo sapiens
tctcccaacctctggtgggtgc

SEQ ID NO: 8012174 - DNA, 22 bp, Homo sapiens
tctccatacttgcctttggcct

SEQ ID NO: 8012175 - DNA, 22 bp, Homo sapiens
tctccatctgtcattcttgtcc

SEQ ID NO: 8012176 - DNA, 22 bp, Homo sapiens
tctccatctgtcattcttgtcc

SEQ ID NO: 8012177 - DNA, 21 bp, Homo sapiens
tctccagttgacagtgtctcc

SEQ ID NO: 8012178 - DNA, 19 bp, Homo sapiens
tctccagtttattcttcca

SEQ ID NO: 8012179 - DNA, 22 bp, Homo sapiens
ccagaggaaaaatatctcccta

SEQ ID NO: 8012180 - DNA, 22 bp, Homo sapiens
ccagaggaattgggaaacatgt

SEQ ID NO: 8012181 - DNA, 19 bp, Homo sapiens
ccagaggactgttaatgaa

SEQ ID NO: 8012182 - DNA, 19 bp, Homo sapiens
ccagaggactgttaatgaa

SEQ ID NO: 8012183 - DNA, 21 bp, Homo sapiens
tctccagtatccttctctgag

SEQ ID NO: 8012184 - DNA, 22 bp, Homo sapiens
tctccagtcccttctctgttag

SEQ ID NO: 8012185 - DNA, 22 bp, Homo sapiens
tctccagtcccttctctgttag

SEQ ID NO: 8012186 - DNA, 22 bp, Homo sapiens
tctccagtatctttccaatgaa

SEQ ID NO: 8012187 - DNA, 22 bp, Homo sapiens
tctccagtgaatctcctcctgg

SEQ ID NO: 8012188 - DNA, 21 bp, Homo sapiens
tctccagtgcttctgcctctt

SEQ ID NO: 8012189 - DNA, 22 bp, Homo sapiens
tctccagtgaatctcctcctgg

SEQ ID NO: 8012190 - DNA, 23 bp, Homo sapiens
tctccagtgtctcttcattgagt

SEQ ID NO: 8012191 - DNA, 22 bp, Homo sapiens
ccagaggaaaaatatctcccta

SEQ ID NO: 8012192 - DNA, 22 bp, Homo sapiens
ccagagcttgacgtgcaacgga

SEQ ID NO: 8012193 - DNA, 22 bp, Homo sapiens
ccagagcttgacgtgcaacgga

SEQ ID NO: 8012194 - DNA, 22 bp, Homo sapiens
ccagagcttcggggcggctgta

SEQ ID NO: 8012195 - DNA, 22 bp, Homo sapiens
ccagagcttgacgtgcaacgga

SEQ ID NO: 8012196 - DNA, 22 bp, Homo sapiens
ccagagcttcggggcggctgta

SEQ ID NO: 8012197 - DNA, 18 bp, Homo sapiens
ccagagctggctcctcgc

SEQ ID NO: 8012198 - DNA, 18 bp, Homo sapiens
ccagagctggctcctcgc

SEQ ID NO: 8012199 - DNA, 22 bp, Homo sapiens
ccagagcttcggggcggctgta

SEQ ID NO: 8012200 - DNA, 22 bp, Homo sapiens
ccagagcttcggggcggctgta

SEQ ID NO: 8012201 - DNA, 22 bp, Homo sapiens
ccagagcttcggggcggctgta

SEQ ID NO: 8012202 - DNA, 22 bp, Homo sapiens
ccagagcttcggggcggctgta

SEQ ID NO: 8012203 - DNA, 22 bp, Homo sapiens
ccagagctgattcctgggactt

SEQ ID NO: 8012204 - DNA, 22 bp, Homo sapiens
ccagagctgatgggcccagggt

SEQ ID NO: 8012205 - DNA, 22 bp, Homo sapiens
ccagagctgattcctgggactt

SEQ ID NO: 8012206 - DNA, 22 bp, Homo sapiens
ccagagctgattcctgggactt

SEQ ID NO: 8012207 - DNA, 22 bp, Homo sapiens
ccagagctgattcctgggactt

SEQ ID NO: 8012208 - DNA, 22 bp, Homo sapiens
ccagagctgattcctgggactt

SEQ ID NO: 8012209 - DNA, 22 bp, Homo sapiens
ccagagctgattcctgggactt

SEQ ID NO: 8012210 - DNA, 22 bp, Homo sapiens
ccagagctgcatccagcaggtt

SEQ ID NO: 8012211 - DNA, 22 bp, Homo sapiens
ccagagctgcatccagcaggtt

SEQ ID NO: 8012212 - DNA, 22 bp, Homo sapiens
ccagagctgcatccagcaggtt

SEQ ID NO: 8012213 - DNA, 22 bp, Homo sapiens
ccagagctgcatccagcaggtt

SEQ ID NO: 8012214 - DNA, 20 bp, Homo sapiens
ccagacagcacctgcctggt

SEQ ID NO: 8012215 - DNA, 20 bp, Homo sapiens
ccagacagcacctgcctggt

SEQ ID NO: 8012216 - DNA, 20 bp, Homo sapiens
ccagacagcacctgcctggt

SEQ ID NO: 8012217 - DNA, 20 bp, Homo sapiens
ccagacagcacctgcctggt

SEQ ID NO: 8012218 - DNA, 20 bp, Homo sapiens
ccagacagcacctgcctggt

SEQ ID NO: 8012219 - DNA, 20 bp, Homo sapiens
ccagacagcacctgcctggt

SEQ ID NO: 8012220 - DNA, 22 bp, Homo sapiens
ccagaatgttctagagccaccc

SEQ ID NO: 8012221 - DNA, 20 bp, Homo sapiens
ccagacagcacctgcctggt

SEQ ID NO: 8012222 - DNA, 20 bp, Homo sapiens
ccagacagcacctgcctggt

SEQ ID NO: 8012223 - DNA, 20 bp, Homo sapiens
ccagacagcacctgcctggt

SEQ ID NO: 8012224 - DNA, 20 bp, Homo sapiens
ccagagctgatggctgcccg

SEQ ID NO: 8012225 - DNA, 20 bp, Homo sapiens
ccagagctgatggctgcccg

SEQ ID NO: 8012226 - DNA, 22 bp, Homo sapiens
ccagagcctgctgagccccatt

SEQ ID NO: 8012227 - DNA, 21 bp, Homo sapiens
ccagagcctgctgagccccct

SEQ ID NO: 8012228 - DNA, 22 bp, Homo sapiens
ccagagcctgctgagccccatt

SEQ ID NO: 8012229 - DNA, 22 bp, Homo sapiens
ccagagcctgctgagccccatt

SEQ ID NO: 8012230 - DNA, 22 bp, Homo sapiens
ccagacaggaacacacatctcc

SEQ ID NO: 8012231 - DNA, 22 bp, Homo sapiens
ccagagcctgctgagccccatt

SEQ ID NO: 8012232 - DNA, 22 bp, Homo sapiens
ccagacaggaacacacatctcc

SEQ ID NO: 8012233 - DNA, 22 bp, Homo sapiens
ccagacaggaacacacatctcc

SEQ ID NO: 8012234 - DNA, 22 bp, Homo sapiens
ccagacaggaacacacatctcc

SEQ ID NO: 8012235 - DNA, 22 bp, Homo sapiens
tcctggtctacactgcattggg

SEQ ID NO: 8012236 - DNA, 22 bp, Homo sapiens
tcctggtcttcaggttgcaaaa

SEQ ID NO: 8012237 - DNA, 22 bp, Homo sapiens
tcctggtgaatgactttttatt

SEQ ID NO: 8012238 - DNA, 22 bp, Homo sapiens
tcctggtgaatgactttttatt

SEQ ID NO: 8012239 - DNA, 23 bp, Homo sapiens
tcctggtgacatgcctgagcatc

SEQ ID NO: 8012240 - DNA, 23 bp, Homo sapiens
tcctggtgacatgcctgagcatc

SEQ ID NO: 8012241 - DNA, 23 bp, Homo sapiens
tcctggtgacatgcctgagcatc

SEQ ID NO: 8012242 - DNA, 22 bp, Homo sapiens
tcctggtgaatgactttttatt

SEQ ID NO: 8012243 - DNA, 23 bp, Homo sapiens
tcctggtgacatgcctgagcatc

SEQ ID NO: 8012244 - DNA, 22 bp, Homo sapiens
tcctggggagggttctggctcc

SEQ ID NO: 8012245 - DNA, 20 bp, Homo sapiens
tcctggtcatgtggctgggc

SEQ ID NO: 8012246 - DNA, 20 bp, Homo sapiens
tcctggtcatgtggctgggc

SEQ ID NO: 8012247 - DNA, 22 bp, Homo sapiens
tcctggtcagtgccaaactggt

SEQ ID NO: 8012248 - DNA, 20 bp, Homo sapiens
tcctggtcatgtggctgggc

SEQ ID NO: 8012249 - DNA, 22 bp, Homo sapiens
tcctggtctacactgcattggg

SEQ ID NO: 8012250 - DNA, 20 bp, Homo sapiens
tcctggtcatgtggctgggc

SEQ ID NO: 8012251 - DNA, 22 bp, Homo sapiens
tcctggggagggttctggctcc

SEQ ID NO: 8012252 - DNA, 22 bp, Homo sapiens
tcctggggagggttctggctcc

SEQ ID NO: 8012253 - DNA, 22 bp, Homo sapiens
tcctggtgctgacacccatagc

SEQ ID NO: 8012254 - DNA, 22 bp, Homo sapiens
tcctggtgctgacacccatagc

SEQ ID NO: 8012255 - DNA, 22 bp, Homo sapiens
tcctggtgctgacacccatagc

SEQ ID NO: 8012256 - DNA, 19 bp, Homo sapiens
tcctggtgcttgacactga

SEQ ID NO: 8012257 - DNA, 22 bp, Homo sapiens
tcctggtgcctggagctctcca

SEQ ID NO: 8012258 - DNA, 22 bp, Homo sapiens
tcctggtgcctggagctctcca

SEQ ID NO: 8012259 - DNA, 22 bp, Homo sapiens
tcctggtgcctggagctctcca

SEQ ID NO: 8012260 - DNA, 22 bp, Homo sapiens
tcctggtgatcaaaattcattt

SEQ ID NO: 8012261 - DNA, 22 bp, Homo sapiens
tcctggtgatcaaaattcattt

SEQ ID NO: 8012262 - DNA, 22 bp, Homo sapiens
tcctggtgaggctagaagtgtc

SEQ ID NO: 8012263 - DNA, 22 bp, Homo sapiens
tcctggtgaggactccaagata

SEQ ID NO: 8012264 - DNA, 22 bp, Homo sapiens
tcctggtgaggactccaagata

SEQ ID NO: 8012265 - DNA, 22 bp, Homo sapiens
tcctggtgaggactccaagata

SEQ ID NO: 8012266 - DNA, 19 bp, Homo sapiens
tcctggtgaccctgaaatt

SEQ ID NO: 8012267 - DNA, 19 bp, Homo sapiens
tcctggtgaccctgaaatt

SEQ ID NO: 8012268 - DNA, 23 bp, Homo sapiens
tcctggtgacatgcctgagcatc

SEQ ID NO: 8012269 - DNA, 23 bp, Homo sapiens
tcctggtgacatgcctgagcatc

SEQ ID NO: 8012270 - DNA, 22 bp, Homo sapiens
tcctggtgaggctagaagtgtc

SEQ ID NO: 8012271 - DNA, 22 bp, Homo sapiens
tcctggtgaggctagaagtgtc

SEQ ID NO: 8012272 - DNA, 22 bp, Homo sapiens
tcctggtgaggctagaagtgtc

SEQ ID NO: 8012273 - DNA, 22 bp, Homo sapiens
tcctggtgaggactccaagata

SEQ ID NO: 8012274 - DNA, 22 bp, Homo sapiens
tcctggtgaggctagaagtgtc

SEQ ID NO: 8012275 - DNA, 22 bp, Homo sapiens
ccacagggtcagccactctgca

SEQ ID NO: 8012276 - DNA, 22 bp, Homo sapiens
ccacagggtcagccactctgca

SEQ ID NO: 8012277 - DNA, 22 bp, Homo sapiens
ccacagggtcagccactctgca

SEQ ID NO: 8012278 - DNA, 22 bp, Homo sapiens
ccacagggtgtcatcagcttga

SEQ ID NO: 8012279 - DNA, 22 bp, Homo sapiens
ccacagggtgtcatcagcttga

SEQ ID NO: 8012280 - DNA, 22 bp, Homo sapiens
ccacaggtacggattgaggacc

SEQ ID NO: 8012281 - DNA, 16 bp, Homo sapiens
ccacaggtgtcctgca

SEQ ID NO: 8012282 - DNA, 22 bp, Homo sapiens
ccacagtaaagaaacaacttcg

SEQ ID NO: 8012283 - DNA, 22 bp, Homo sapiens
ccacagtaaatggattcagacc

SEQ ID NO: 8012284 - DNA, 22 bp, Homo sapiens
ccacagtaactgttttgtaccg

SEQ ID NO: 8012285 - DNA, 22 bp, Homo sapiens
ccacagtaaatggattcagacc

SEQ ID NO: 8012286 - DNA, 16 bp, Homo sapiens
ccacagtaagaaatac

SEQ ID NO: 8012287 - DNA, 22 bp, Homo sapiens
ccacagtacaggaaatcttgtt

SEQ ID NO: 8012288 - DNA, 22 bp, Homo sapiens
ccacagtaagagatagtttatg

SEQ ID NO: 8012289 - DNA, 22 bp, Homo sapiens
ccacagtacaggaaatcttgtt

SEQ ID NO: 8012290 - DNA, 22 bp, Homo sapiens
tcctggtggatagaagccaagg

SEQ ID NO: 8012291 - DNA, 22 bp, Homo sapiens
tcctggtggatagaagccaagg

SEQ ID NO: 8012292 - DNA, 22 bp, Homo sapiens
tcctggtggatagaagccaagg

SEQ ID NO: 8012293 - DNA, 22 bp, Homo sapiens
tcctggtggatagaagccaagg

SEQ ID NO: 8012294 - DNA, 20 bp, Homo sapiens
tcctggtggatactgcttaa

SEQ ID NO: 8012295 - DNA, 20 bp, Homo sapiens
tcctggtggatactgcttaa

SEQ ID NO: 8012296 - DNA, 22 bp, Homo sapiens
ccacagggtcagccactctgca

SEQ ID NO: 8012297 - DNA, 22 bp, Homo sapiens
ccacagggtcagccactctgca

SEQ ID NO: 8012298 - DNA, 22 bp, Homo sapiens
ccacaggggtctctgtagctga

SEQ ID NO: 8012299 - DNA, 22 bp, Homo sapiens
tcctggtggatagaagccaagg

SEQ ID NO: 8012300 - DNA, 18 bp, Homo sapiens
tcctggtggagaagtggt

SEQ ID NO: 8012301 - DNA, 18 bp, Homo sapiens
tcctggtggagaagtggt

SEQ ID NO: 8012302 - DNA, 18 bp, Homo sapiens
tcctggtggagaagtggt

SEQ ID NO: 8012303 - DNA, 22 bp, Homo sapiens
tcctggtgcttgtatttgaagt

SEQ ID NO: 8012304 - DNA, 22 bp, Homo sapiens
tcctggtgcttgtatttgaagt

SEQ ID NO: 8012305 - DNA, 19 bp, Homo sapiens
tcctggtgcttgacactga

SEQ ID NO: 8012306 - DNA, 18 bp, Homo sapiens
tcctggtggagaagtggt

SEQ ID NO: 8012307 - DNA, 20 bp, Homo sapiens
tcctggtggatactgcttaa

SEQ ID NO: 8012308 - DNA, 18 bp, Homo sapiens
tcctggtggagaagtggt

SEQ ID NO: 8012309 - DNA, 18 bp, Homo sapiens
tcctggtggagaagtggt

SEQ ID NO: 8012310 - DNA, 22 bp, Homo sapiens
ccactctgatttcaagggagat

SEQ ID NO: 8012311 - DNA, 22 bp, Homo sapiens
ccactctgatttcaagggagat

SEQ ID NO: 8012312 - DNA, 21 bp, Homo sapiens
ccactctgagtgttgaacaga

SEQ ID NO: 8012313 - DNA, 21 bp, Homo sapiens
ccactctgagtgttgaacaga

SEQ ID NO: 8012314 - DNA, 23 bp, Homo sapiens
ccactctcccaccatatctgtat

SEQ ID NO: 8012315 - DNA, 23 bp, Homo sapiens
ccactctcccaccatatctgtat

SEQ ID NO: 8012316 - DNA, 23 bp, Homo sapiens
ccacctggactctgggcaggtgc

SEQ ID NO: 8012317 - DNA, 22 bp, Homo sapiens
ccactctgctgtgctccatgat

SEQ ID NO: 8012318 - DNA, 22 bp, Homo sapiens
ccactctgctgtgctccatgat

SEQ ID NO: 8012319 - DNA, 22 bp, Homo sapiens
ccactctgctgtgctccatgat

SEQ ID NO: 8012320 - DNA, 22 bp, Homo sapiens
ccactctgctgtgctccatgat

SEQ ID NO: 8012321 - DNA, 22 bp, Homo sapiens
ccactctgctgtgctccatgat

SEQ ID NO: 8012322 - DNA, 22 bp, Homo sapiens
ccactctgattttggctccact

SEQ ID NO: 8012323 - DNA, 22 bp, Homo sapiens
ccactctgattttggctccact

SEQ ID NO: 8012324 - DNA, 22 bp, Homo sapiens
ccactctgattttggctccact

SEQ ID NO: 8012325 - DNA, 22 bp, Homo sapiens
ccactctgattttggctccact

SEQ ID NO: 8012326 - DNA, 22 bp, Homo sapiens
ccactctgattttggctccact

SEQ ID NO: 8012327 - DNA, 23 bp, Homo sapiens
ccactgaagaatccagggagttt

SEQ ID NO: 8012328 - DNA, 23 bp, Homo sapiens
ccactgaagaatccagggagttt

SEQ ID NO: 8012329 - DNA, 22 bp, Homo sapiens
ccactgaaggtcaacatagagc

SEQ ID NO: 8012330 - DNA, 23 bp, Homo sapiens
ccactgaagaatccagggagttt

SEQ ID NO: 8012331 - DNA, 22 bp, Homo sapiens
ccactgaaaaatttgagatgga

SEQ ID NO: 8012332 - DNA, 22 bp, Homo sapiens
ccactgaaaaatttgagatgga

SEQ ID NO: 8012333 - DNA, 22 bp, Homo sapiens
ccactctgctgtgctccatgat

SEQ ID NO: 8012334 - DNA, 22 bp, Homo sapiens
ccactgacacagacaaggcctg

SEQ ID NO: 8012335 - DNA, 22 bp, Homo sapiens
ccactgaaggtcaacatagagc

SEQ ID NO: 8012336 - DNA, 22 bp, Homo sapiens
ccactgagaaggggttggggtc

SEQ ID NO: 8012337 - DNA, 22 bp, Homo sapiens
ccactgagaagcacagcttgtc

SEQ ID NO: 8012338 - DNA, 22 bp, Homo sapiens
ccacagtgagttctgtactctg

SEQ ID NO: 8012339 - DNA, 22 bp, Homo sapiens
ccacagtgagttctgtactctg

SEQ ID NO: 8012340 - DNA, 16 bp, Homo sapiens
ccacctgcagctctca

SEQ ID NO: 8012341 - DNA, 16 bp, Homo sapiens
ccacctgcagctctca

SEQ ID NO: 8012342 - DNA, 16 bp, Homo sapiens
ccacctgcagctctca

SEQ ID NO: 8012343 - DNA, 22 bp, Homo sapiens
ccacagtgacacgggctggccc

SEQ ID NO: 8012344 - DNA, 22 bp, Homo sapiens
ccacagtgacacgggctggccc

SEQ ID NO: 8012345 - DNA, 22 bp, Homo sapiens
ccacagtgacacgggctggccc

SEQ ID NO: 8012346 - DNA, 22 bp, Homo sapiens
ccacagtgagtgtcatacttgg

SEQ ID NO: 8012347 - DNA, 22 bp, Homo sapiens
ccacagtgacacgggctggccc

SEQ ID NO: 8012348 - DNA, 22 bp, Homo sapiens
ccacagtgacacgggctggccc

SEQ ID NO: 8012349 - DNA, 22 bp, Homo sapiens
ccacagtctatgcaacaaggtc

SEQ ID NO: 8012350 - DNA, 22 bp, Homo sapiens
ccacagtctatgcaacaaggtc

SEQ ID NO: 8012351 - DNA, 22 bp, Homo sapiens
ccacagtgaaatcttgatggag

SEQ ID NO: 8012352 - DNA, 22 bp, Homo sapiens
ccacagtgaaatcttgatggag

SEQ ID NO: 8012353 - DNA, 22 bp, Homo sapiens
ccacagtccgggctggcaggac

SEQ ID NO: 8012354 - DNA, 22 bp, Homo sapiens
ccacagtctagctagaaggcat

SEQ ID NO: 8012355 - DNA, 22 bp, Homo sapiens
ccacagtctagctagaaggcat

SEQ ID NO: 8012356 - DNA, 22 bp, Homo sapiens
ccacagtagaattcatctccct

SEQ ID NO: 8012357 - DNA, 22 bp, Homo sapiens
ccacagtagaattcatctccct

SEQ ID NO: 8012358 - DNA, 22 bp, Homo sapiens
ccacagtagaattcatctccct

SEQ ID NO: 8012359 - DNA, 22 bp, Homo sapiens
ccacagtagcatccaaacagta

SEQ ID NO: 8012360 - DNA, 22 bp, Homo sapiens
ccacagtagcatccaaacagta

SEQ ID NO: 8012361 - DNA, 22 bp, Homo sapiens
ccacagtaggaacaagttgtcg

SEQ ID NO: 8012362 - DNA, 22 bp, Homo sapiens
ccacagtaggaacaagttgtcg

SEQ ID NO: 8012363 - DNA, 22 bp, Homo sapiens
ccacagtagcatccaaacagta

SEQ ID NO: 8012364 - DNA, 22 bp, Homo sapiens
ccacagtccgggctggcaggac

SEQ ID NO: 8012365 - DNA, 22 bp, Homo sapiens
ccacagtccgggctggcaggac

SEQ ID NO: 8012366 - DNA, 22 bp, Homo sapiens
ccactgcacttcagcctgggtg

SEQ ID NO: 8012367 - DNA, 22 bp, Homo sapiens
ccactgccagccgcccggaggc

SEQ ID NO: 8012368 - DNA, 22 bp, Homo sapiens
ccactgccagccgcccggaggc

SEQ ID NO: 8012369 - DNA, 22 bp, Homo sapiens
ccactgcacttcagcctgggtg

SEQ ID NO: 8012370 - DNA, 22 bp, Homo sapiens
ccactgccagccgcccggaggc

SEQ ID NO: 8012371 - DNA, 22 bp, Homo sapiens
ccactgcactccagccttggca

SEQ ID NO: 8012372 - DNA, 22 bp, Homo sapiens
ccactgcactccagccttggca

SEQ ID NO: 8012373 - DNA, 22 bp, Homo sapiens
ccactgcactccagcctgccaa

SEQ ID NO: 8012374 - DNA, 22 bp, Homo sapiens
ccactgcacttcagcctgggtg

SEQ ID NO: 8012375 - DNA, 23 bp, Homo sapiens
ccactgatgcattttctctctgt

SEQ ID NO: 8012376 - DNA, 22 bp, Homo sapiens
ccactgagtacccgatggctgc

SEQ ID NO: 8012377 - DNA, 22 bp, Homo sapiens
ccactgagtacccgatggctgc

SEQ ID NO: 8012378 - DNA, 22 bp, Homo sapiens
ccactgaggttttgtggttatg

SEQ ID NO: 8012379 - DNA, 22 bp, Homo sapiens
ccactgagtgagcagagcaggg

SEQ ID NO: 8012380 - DNA, 22 bp, Homo sapiens
ccactgagtacccgatggctgc

SEQ ID NO: 8012381 - DNA, 22 bp, Homo sapiens
ccactgagtgagcagagcaggg

SEQ ID NO: 8012382 - DNA, 22 bp, Homo sapiens
ccactgatcctgactttggagc

SEQ ID NO: 8012383 - DNA, 22 bp, Homo sapiens
ccactgaggaggtgaggacaga

SEQ ID NO: 8012384 - DNA, 22 bp, Homo sapiens
ccactgaggaacatgggctcca

SEQ ID NO: 8012385 - DNA, 21 bp, Homo sapiens
ccactgagcattgttatgaag

SEQ ID NO: 8012386 - DNA, 22 bp, Homo sapiens
ccactgagcagtagctgcgtcg

SEQ ID NO: 8012387 - DNA, 21 bp, Homo sapiens
ccactgagcattgttatgaag

SEQ ID NO: 8012388 - DNA, 21 bp, Homo sapiens
ccactgagcattgttatgaag

SEQ ID NO: 8012389 - DNA, 22 bp, Homo sapiens
ccactgagcagtagctgcgtcg

SEQ ID NO: 8012390 - DNA, 22 bp, Homo sapiens
ccactgaggttttgtggttatg

SEQ ID NO: 8012391 - DNA, 22 bp, Homo sapiens
ccactgaggttttgtggttatg

SEQ ID NO: 8012392 - DNA, 22 bp, Homo sapiens
ccactgaggggtcatggtggga

SEQ ID NO: 8012393 - DNA, 22 bp, Homo sapiens
ccactgaggggtcatggtggga

SEQ ID NO: 8012394 - DNA, 22 bp, Homo sapiens
ccactgaggggtcatggtggga

SEQ ID NO: 8012395 - DNA, 19 bp, Homo sapiens
ccactgaggcttggttctt

SEQ ID NO: 8012396 - DNA, 19 bp, Homo sapiens
ccactgaggcttggttctt

SEQ ID NO: 8012397 - DNA, 22 bp, Homo sapiens
ccactgaggcctgggcccaggg

SEQ ID NO: 8012398 - DNA, 22 bp, Homo sapiens
ccactgaggcctgggcccaggg

SEQ ID NO: 8012399 - DNA, 22 bp, Homo sapiens
ccactgccatgggctaggcatg

SEQ ID NO: 8012400 - DNA, 22 bp, Homo sapiens
ccactgccatgggctaggcatg

SEQ ID NO: 8012401 - DNA, 22 bp, Homo sapiens
ccactgccatgggctaggcatg

SEQ ID NO: 8012402 - DNA, 22 bp, Homo sapiens
ccactgccatgggctaggcatg

SEQ ID NO: 8012403 - DNA, 22 bp, Homo sapiens
ccactgccagctttgtcctccc

SEQ ID NO: 8012404 - DNA, 22 bp, Homo sapiens
ccactgccagctttgtcctccc

SEQ ID NO: 8012405 - DNA, 22 bp, Homo sapiens
ccactgccagctttgtcctccc

SEQ ID NO: 8012406 - DNA, 22 bp, Homo sapiens
ccactgccagctttgtcctccc

SEQ ID NO: 8012407 - DNA, 22 bp, Homo sapiens
ccactgcccaccccgacgtcta

SEQ ID NO: 8012408 - DNA, 22 bp, Homo sapiens
ccactgcccaccccgacgtcta

SEQ ID NO: 8012409 - DNA, 22 bp, Homo sapiens
ccactgccccctgaagaccagg

SEQ ID NO: 8012410 - DNA, 22 bp, Homo sapiens
ccactgccgtgggccttgggga

SEQ ID NO: 8012411 - DNA, 22 bp, Homo sapiens
ccactgccctgcaaaagctgga

SEQ ID NO: 8012412 - DNA, 22 bp, Homo sapiens
ccactgccgatgttccatcttg

SEQ ID NO: 8012413 - DNA, 22 bp, Homo sapiens
ccactgcctctccagggccatc

SEQ ID NO: 8012414 - DNA, 22 bp, Homo sapiens
ccactgcctctccagggccatc

SEQ ID NO: 8012415 - DNA, 22 bp, Homo sapiens
ccactgcctatttgcagggccc

SEQ ID NO: 8012416 - DNA, 22 bp, Homo sapiens
ccactgcctatttgcagggccc

SEQ ID NO: 8012417 - DNA, 22 bp, Homo sapiens
ccactgcctatttgcagggccc

SEQ ID NO: 8012418 - DNA, 22 bp, Homo sapiens
ccactgcctatttgcagggccc

SEQ ID NO: 8012419 - DNA, 22 bp, Homo sapiens
ccactgccgtgggccttgggga

SEQ ID NO: 8012420 - DNA, 22 bp, Homo sapiens
ccactgccgtgggccttgggga

SEQ ID NO: 8012421 - DNA, 22 bp, Homo sapiens
ccactgccgtgggccttgggga

SEQ ID NO: 8012422 - DNA, 22 bp, Homo sapiens
ccactgccgtgggccttgggga

SEQ ID NO: 8012423 - DNA, 22 bp, Homo sapiens
ccagaaaagcatctggttcttt

SEQ ID NO: 8012424 - DNA, 22 bp, Homo sapiens
ccagaaaagcatctggttcttt

SEQ ID NO: 8012425 - DNA, 22 bp, Homo sapiens
ccagaaaaggagctgcaggatg

SEQ ID NO: 8012426 - DNA, 22 bp, Homo sapiens
ccagaaaaggagctgcaggatg

SEQ ID NO: 8012427 - DNA, 22 bp, Homo sapiens
ccagaaaaggagctgcaggatg

SEQ ID NO: 8012428 - DNA, 22 bp, Homo sapiens
ccagaaaagcatctggttcttt

SEQ ID NO: 8012429 - DNA, 22 bp, Homo sapiens
ccagaaaagcatctggttcttt

SEQ ID NO: 8012430 - DNA, 22 bp, Homo sapiens
ccagaaaactctacatgcttgt

SEQ ID NO: 8012431 - DNA, 22 bp, Homo sapiens
ccactgcctgacttagatgaca

SEQ ID NO: 8012432 - DNA, 22 bp, Homo sapiens
ccagaagtcaatgcagatgtga

SEQ ID NO: 8012433 - DNA, 22 bp, Homo sapiens
ccagaagtcaatgcagatgtga

SEQ ID NO: 8012434 - DNA, 20 bp, Homo sapiens
ccagaaggtttgccactttc

SEQ ID NO: 8012435 - DNA, 20 bp, Homo sapiens
ccagaaggtaggatggaaca

SEQ ID NO: 8012436 - DNA, 20 bp, Homo sapiens
ccagaaggtaggatggaaca

SEQ ID NO: 8012437 - DNA, 20 bp, Homo sapiens
ccagaaggtttgccactttc

SEQ ID NO: 8012438 - DNA, 22 bp, Homo sapiens
ccagaagggctattgcagtgac

SEQ ID NO: 8012439 - DNA, 19 bp, Homo sapiens
ccagaagggcagctatgga

SEQ ID NO: 8012440 - DNA, 22 bp, Homo sapiens
ccagaagggctattgcagtgac

SEQ ID NO: 8012441 - DNA, 22 bp, Homo sapiens
ccagaagggctattgcagtgac

SEQ ID NO: 8012442 - DNA, 22 bp, Homo sapiens
ccagaagggctattgcagtgac

SEQ ID NO: 8012443 - DNA, 22 bp, Homo sapiens
ccagaagggctattgcagtgac

SEQ ID NO: 8012444 - DNA, 22 bp, Homo sapiens
ccagaagtcaggaatgagtctt

SEQ ID NO: 8012445 - DNA, 22 bp, Homo sapiens
ccagaagtggctttctcaggga

SEQ ID NO: 8012446 - DNA, 22 bp, Homo sapiens
ccagaagtgtctatcaagatgt

SEQ ID NO: 8012447 - DNA, 22 bp, Homo sapiens
ccagaagttcctaagcatcatt

SEQ ID NO: 8012448 - DNA, 22 bp, Homo sapiens
ccagaagttcctaagcatcatt

SEQ ID NO: 8012449 - DNA, 22 bp, Homo sapiens
ccagaatccaaaacgttttgag

SEQ ID NO: 8012450 - DNA, 22 bp, Homo sapiens
ccagaatcatcatctgaagcct

SEQ ID NO: 8012451 - DNA, 22 bp, Homo sapiens
ccagaatccaaaacgttttgag

SEQ ID NO: 8012452 - DNA, 22 bp, Homo sapiens
ccagaatcatcatctgaagcct

SEQ ID NO: 8012453 - DNA, 22 bp, Homo sapiens
ccagaatcatcatctgaagcct

SEQ ID NO: 8012454 - DNA, 22 bp, Homo sapiens
ccagaatcccattgtcacttca

SEQ ID NO: 8012455 - DNA, 22 bp, Homo sapiens
ccagaatccacattccccagag

SEQ ID NO: 8012456 - DNA, 23 bp, Homo sapiens
ccagaatctactcattggaatga

SEQ ID NO: 8012457 - DNA, 22 bp, Homo sapiens
ccagaatcccattgtcacttca

SEQ ID NO: 8012458 - DNA, 22 bp, Homo sapiens
ccagaatctcaatacctttcaa

SEQ ID NO: 8012459 - DNA, 23 bp, Homo sapiens
ccagaatctactcattggaatga

SEQ ID NO: 8012460 - DNA, 22 bp, Homo sapiens
ccagaagcaaaacagacagttt

SEQ ID NO: 8012461 - DNA, 22 bp, Homo sapiens
ccagaagcacctccttttgtgc

SEQ ID NO: 8012462 - DNA, 20 bp, Homo sapiens
ccagaagcactcttcatgtt

SEQ ID NO: 8012463 - DNA, 22 bp, Homo sapiens
ccagaagatggctcaaaccatg

SEQ ID NO: 8012464 - DNA, 22 bp, Homo sapiens
ccagaagatggctcaaaccatg

SEQ ID NO: 8012465 - DNA, 22 bp, Homo sapiens
ccagaagagatcacagttcttg

SEQ ID NO: 8012466 - DNA, 22 bp, Homo sapiens
ccagaagagatcacagttcttg

SEQ ID NO: 8012467 - DNA, 22 bp, Homo sapiens
ccagaagagatcacagttcttg

SEQ ID NO: 8012468 - DNA, 22 bp, Homo sapiens
ccagaagagatcacagttcttg

SEQ ID NO: 8012469 - DNA, 22 bp, Homo sapiens
ccagaagagatcacagttcttg

SEQ ID NO: 8012470 - DNA, 22 bp, Homo sapiens
ccagaagaggacacagtgtgga

SEQ ID NO: 8012471 - DNA, 22 bp, Homo sapiens
ccagaagaggacacagtgtgga

SEQ ID NO: 8012472 - DNA, 22 bp, Homo sapiens
ccagaagaggacacagtgtgga

SEQ ID NO: 8012473 - DNA, 20 bp, Homo sapiens
ccagaagagatgatcatcca

SEQ ID NO: 8012474 - DNA, 20 bp, Homo sapiens
ccagaagagatgatcatcca

SEQ ID NO: 8012475 - DNA, 20 bp, Homo sapiens
ccagaagagatgatcatcca

SEQ ID NO: 8012476 - DNA, 21 bp, Homo sapiens
ccagaagctgcttgcaggcta

SEQ ID NO: 8012477 - DNA, 21 bp, Homo sapiens
ccagaagctgcttgcaggcta

SEQ ID NO: 8012478 - DNA, 22 bp, Homo sapiens
ccagaaggcggagattgcagtg

SEQ ID NO: 8012479 - DNA, 23 bp, Homo sapiens
ccagaaggagccacactccttgc

SEQ ID NO: 8012480 - DNA, 22 bp, Homo sapiens
ccagaaggcggagattgcagtg

SEQ ID NO: 8012481 - DNA, 22 bp, Homo sapiens
ccagaaggcggagattgcagtg

SEQ ID NO: 8012482 - DNA, 22 bp, Homo sapiens
catttatgttttacttggtcac

SEQ ID NO: 8012483 - DNA, 22 bp, Homo sapiens
catttatgttttacttggtcac

SEQ ID NO: 8012484 - DNA, 22 bp, Homo sapiens
catttattagttagttcgatgt

SEQ ID NO: 8012485 - DNA, 22 bp, Homo sapiens
catttattagttagttcgatgt

SEQ ID NO: 8012486 - DNA, 22 bp, Homo sapiens
catttattagttagttcgatgt

SEQ ID NO: 8012487 - DNA, 22 bp, Homo sapiens
catttattagttagttcgatgt

SEQ ID NO: 8012488 - DNA, 22 bp, Homo sapiens
catttattagttagttcgatgt

SEQ ID NO: 8012489 - DNA, 22 bp, Homo sapiens
catttattagttagttcgatgt

SEQ ID NO: 8012490 - DNA, 22 bp, Homo sapiens
tcccagggcactcaccctccct

SEQ ID NO: 8012491 - DNA, 22 bp, Homo sapiens
catttatgatagtaatatgaaa

SEQ ID NO: 8012492 - DNA, 22 bp, Homo sapiens
catttatcttggccctaaggcc

SEQ ID NO: 8012493 - DNA, 22 bp, Homo sapiens
catttatgatagtaatatgaaa

SEQ ID NO: 8012494 - DNA, 22 bp, Homo sapiens
catttatgaagcactttagagt

SEQ ID NO: 8012495 - DNA, 22 bp, Homo sapiens
catttatgaagcactttagagt

SEQ ID NO: 8012496 - DNA, 22 bp, Homo sapiens
tcccagggcagctgtccagaag

SEQ ID NO: 8012497 - DNA, 22 bp, Homo sapiens
tcccagggcagctgtccagaag

SEQ ID NO: 8012498 - DNA, 22 bp, Homo sapiens
tcccagggcagctgtccagaag

SEQ ID NO: 8012499 - DNA, 22 bp, Homo sapiens
tcccagggcactcaccctccct

SEQ ID NO: 8012500 - DNA, 22 bp, Homo sapiens
tcccagggcactcaccctccct

SEQ ID NO: 8012501 - DNA, 21 bp, Homo sapiens
tcccagggccaggtgccatca

SEQ ID NO: 8012502 - DNA, 21 bp, Homo sapiens
tcccagggccaggtgccatca

SEQ ID NO: 8012503 - DNA, 21 bp, Homo sapiens
tcccagggccaggtgccatca

SEQ ID NO: 8012504 - DNA, 22 bp, Homo sapiens
tcccagggccgcaaacgagttt

SEQ ID NO: 8012505 - DNA, 22 bp, Homo sapiens
tcccagggccgcaaacgagttt

SEQ ID NO: 8012506 - DNA, 22 bp, Homo sapiens
tcccagggccgcaaacgagttt

SEQ ID NO: 8012507 - DNA, 21 bp, Homo sapiens
tcccagggccaggtgccatca

SEQ ID NO: 8012508 - DNA, 22 bp, Homo sapiens
tcccagggggatgaacactgcc

SEQ ID NO: 8012509 - DNA, 22 bp, Homo sapiens
tcccagggtcagtggtgaggcc

SEQ ID NO: 8012510 - DNA, 22 bp, Homo sapiens
tcccagggtcagtggtgaggcc

SEQ ID NO: 8012511 - DNA, 22 bp, Homo sapiens
tcccagggtcagtggtgaggcc

SEQ ID NO: 8012512 - DNA, 22 bp, Homo sapiens
tcccagggtcagtggtgaggcc

SEQ ID NO: 8012513 - DNA, 21 bp, Homo sapiens
catttctattgatgagaaaag

SEQ ID NO: 8012514 - DNA, 22 bp, Homo sapiens
catttctcactccagcaacttt

SEQ ID NO: 8012515 - DNA, 22 bp, Homo sapiens
catttctcactccagcaacttt

SEQ ID NO: 8012516 - DNA, 22 bp, Homo sapiens
catttctcactccagcaacttt

SEQ ID NO: 8012517 - DNA, 22 bp, Homo sapiens
tcccagggcttttctcatgctt

SEQ ID NO: 8012518 - DNA, 22 bp, Homo sapiens
tcccagggcttttctcatgctt

SEQ ID NO: 8012519 - DNA, 22 bp, Homo sapiens
tcccagggcttttctcatgctt

SEQ ID NO: 8012520 - DNA, 22 bp, Homo sapiens
tcccagggggatgaacactgcc

SEQ ID NO: 8012521 - DNA, 22 bp, Homo sapiens
tcccagggcttttctcatgctt

SEQ ID NO: 8012522 - DNA, 22 bp, Homo sapiens
tcccagggcttttctcatgctt

SEQ ID NO: 8012523 - DNA, 22 bp, Homo sapiens
tcccagggcttttctcatgctt

SEQ ID NO: 8012524 - DNA, 22 bp, Homo sapiens
tcccagggctctagagtgctgg

SEQ ID NO: 8012525 - DNA, 22 bp, Homo sapiens
tcccagggctctagagtgctgg

SEQ ID NO: 8012526 - DNA, 22 bp, Homo sapiens
tcccagggctctagagtgctgg

SEQ ID NO: 8012527 - DNA, 17 bp, Homo sapiens
tccaggcagcaactgag

SEQ ID NO: 8012528 - DNA, 17 bp, Homo sapiens
tccaggcagcaactgag

SEQ ID NO: 8012529 - DNA, 17 bp, Homo sapiens
tccaggcagcaactgag

SEQ ID NO: 8012530 - DNA, 22 bp, Homo sapiens
catttacacttctaaccacaag

SEQ ID NO: 8012531 - DNA, 22 bp, Homo sapiens
catttacagcagactgatgaaa

SEQ ID NO: 8012532 - DNA, 22 bp, Homo sapiens
catttacagcagactgatgaaa

SEQ ID NO: 8012533 - DNA, 22 bp, Homo sapiens
catttacagcagactgatgaaa

SEQ ID NO: 8012534 - DNA, 22 bp, Homo sapiens
catttacttaaatctttacaag

SEQ ID NO: 8012535 - DNA, 22 bp, Homo sapiens
catttagaaaatgataaccctt

SEQ ID NO: 8012536 - DNA, 22 bp, Homo sapiens
catttacttaaatctttacaag

SEQ ID NO: 8012537 - DNA, 20 bp, Homo sapiens
tccaggcagacagctatggg

SEQ ID NO: 8012538 - DNA, 20 bp, Homo sapiens
tccaggcagacagctatggg

SEQ ID NO: 8012539 - DNA, 22 bp, Homo sapiens
tccaggcactatatatactttt

SEQ ID NO: 8012540 - DNA, 22 bp, Homo sapiens
tccaggcactatatatactttt

SEQ ID NO: 8012541 - DNA, 17 bp, Homo sapiens
tccaggcagcaactgag

SEQ ID NO: 8012542 - DNA, 17 bp, Homo sapiens
tccaggcagcaactgag

SEQ ID NO: 8012543 - DNA, 22 bp, Homo sapiens
tccaggcagagcaacaaaatat

SEQ ID NO: 8012544 - DNA, 22 bp, Homo sapiens
tccaggcagagcaacaaaatat

SEQ ID NO: 8012545 - DNA, 22 bp, Homo sapiens
tccaggcacgaggccctgtgca

SEQ ID NO: 8012546 - DNA, 22 bp, Homo sapiens
tccaggcacagagttggtcagt

SEQ ID NO: 8012547 - DNA, 23 bp, Homo sapiens
tccaggcacgcatttcttctagc

SEQ ID NO: 8012548 - DNA, 23 bp, Homo sapiens
tccaggcacgcatttcttctagc

SEQ ID NO: 8012549 - DNA, 23 bp, Homo sapiens
tccaggcacgcatttcttctagc

SEQ ID NO: 8012550 - DNA, 23 bp, Homo sapiens
tccaggcacgcatttcttctagc

SEQ ID NO: 8012551 - DNA, 22 bp, Homo sapiens
tccaggcactatatatactttt

SEQ ID NO: 8012552 - DNA, 22 bp, Homo sapiens
catttagttatactaaaacatt

SEQ ID NO: 8012553 - DNA, 22 bp, Homo sapiens
catttagttttgcagtagcagg

SEQ ID NO: 8012554 - DNA, 22 bp, Homo sapiens
catttagttatactaaaacatt

SEQ ID NO: 8012555 - DNA, 22 bp, Homo sapiens
catttagttatactaaaacatt

SEQ ID NO: 8012556 - DNA, 22 bp, Homo sapiens
catttagttttgcagtagcagg

SEQ ID NO: 8012557 - DNA, 22 bp, Homo sapiens
catttagagagtaaaaattagc

SEQ ID NO: 8012558 - DNA, 22 bp, Homo sapiens
catttagaaactgtttttaaca

SEQ ID NO: 8012559 - DNA, 19 bp, Homo sapiens
catttagaagtacatatta

SEQ ID NO: 8012560 - DNA, 19 bp, Homo sapiens
catttagaagtacatatta

SEQ ID NO: 8012561 - DNA, 22 bp, Homo sapiens
catttagaagtcttagaactat

SEQ ID NO: 8012562 - DNA, 22 bp, Homo sapiens
catttagagaagattacaagga

SEQ ID NO: 8012563 - DNA, 22 bp, Homo sapiens
catttagagaagattacaagga

SEQ ID NO: 8012564 - DNA, 22 bp, Homo sapiens
catttagaagtcttagaactat

SEQ ID NO: 8012565 - DNA, 22 bp, Homo sapiens
catttagaagtcttagaactat

SEQ ID NO: 8012566 - DNA, 22 bp, Homo sapiens
catttagaagtcttagaactat

SEQ ID NO: 8012567 - DNA, 22 bp, Homo sapiens
catttagagaagattacaagga

SEQ ID NO: 8012568 - DNA, 22 bp, Homo sapiens
catttagagaagattacaagga

SEQ ID NO: 8012569 - DNA, 22 bp, Homo sapiens
catttgaaattcttagaacaaa

SEQ ID NO: 8012570 - DNA, 22 bp, Homo sapiens
catttctcataatattagcact

SEQ ID NO: 8012571 - DNA, 22 bp, Homo sapiens
catttgaacctggatgttctta

SEQ ID NO: 8012572 - DNA, 22 bp, Homo sapiens
catttgaagacttagaagagga

SEQ ID NO: 8012573 - DNA, 22 bp, Homo sapiens
catttgaactaataactgtgct

SEQ ID NO: 8012574 - DNA, 22 bp, Homo sapiens
catttgaagaagaaacgtacta

SEQ ID NO: 8012575 - DNA, 23 bp, Homo sapiens
catttgatcctcacaataaatgg

SEQ ID NO: 8012576 - DNA, 22 bp, Homo sapiens
catttgatctcctgaataaaca

SEQ ID NO: 8012577 - DNA, 22 bp, Homo sapiens
catttgatgactcaactcataa

SEQ ID NO: 8012578 - DNA, 22 bp, Homo sapiens
catttgattactaaagataatt

SEQ ID NO: 8012579 - DNA, 22 bp, Homo sapiens
catttgattactaaagataatt

SEQ ID NO: 8012580 - DNA, 22 bp, Homo sapiens
catttgatcctcacaacaatct

SEQ ID NO: 8012581 - DNA, 21 bp, Homo sapiens
catttgatccctcatcaggat

SEQ ID NO: 8012582 - DNA, 21 bp, Homo sapiens
catttgatccctcatcaggat

SEQ ID NO: 8012583 - DNA, 22 bp, Homo sapiens
catttgatcctcacaacaatct

SEQ ID NO: 8012584 - DNA, 22 bp, Homo sapiens
catttgatcctcacaacaatct

SEQ ID NO: 8012585 - DNA, 21 bp, Homo sapiens
catttgatccctcatcaggat

SEQ ID NO: 8012586 - DNA, 22 bp, Homo sapiens
catttgacagtgagtcacagca

SEQ ID NO: 8012587 - DNA, 22 bp, Homo sapiens
catttgacttgctttcccagct

SEQ ID NO: 8012588 - DNA, 22 bp, Homo sapiens
catttgcaagagataaatgttt

SEQ ID NO: 8012589 - DNA, 22 bp, Homo sapiens
catttgcagagggtgacactct

SEQ ID NO: 8012590 - DNA, 22 bp, Homo sapiens
catttgcaaaccaacaagatga

SEQ ID NO: 8012591 - DNA, 22 bp, Homo sapiens
catttgattcctttactcttat

SEQ ID NO: 8012592 - DNA, 22 bp, Homo sapiens
catttgctagcaggccttttat

SEQ ID NO: 8012593 - DNA, 22 bp, Homo sapiens
catttgctctgtgtcagtggca

SEQ ID NO: 8012594 - DNA, 22 bp, Homo sapiens
catttgctgaggccttcagagg

SEQ ID NO: 8012595 - DNA, 22 bp, Homo sapiens
catttgctgaggccttcagagg

SEQ ID NO: 8012596 - DNA, 22 bp, Homo sapiens
tccctgcctgacagcacccacc

SEQ ID NO: 8012597 - DNA, 20 bp, Homo sapiens
tccctgccttttactgctgg

SEQ ID NO: 8012598 - DNA, 22 bp, Homo sapiens
tccctgcctgacagcacccacc

SEQ ID NO: 8012599 - DNA, 22 bp, Homo sapiens
tccctgcctgacagcacccacc

SEQ ID NO: 8012600 - DNA, 22 bp, Homo sapiens
tccctgcctgacagcacccacc

SEQ ID NO: 8012601 - DNA, 22 bp, Homo sapiens
tccctgcctgacagcacccacc

SEQ ID NO: 8012602 - DNA, 22 bp, Homo sapiens
tccctgcctgacagcacccacc

SEQ ID NO: 8012603 - DNA, 17 bp, Homo sapiens
catttgctggttggctc

SEQ ID NO: 8012604 - DNA, 22 bp, Homo sapiens
catttgctgtattttcagattc

SEQ ID NO: 8012605 - DNA, 22 bp, Homo sapiens
catttggaaagagactagagaa

SEQ ID NO: 8012606 - DNA, 22 bp, Homo sapiens
catttgctgtaatgacaataag

SEQ ID NO: 8012607 - DNA, 22 bp, Homo sapiens
catttggaaagagactagagaa

SEQ ID NO: 8012608 - DNA, 22 bp, Homo sapiens
catttggaaagagactagagaa

SEQ ID NO: 8012609 - DNA, 22 bp, Homo sapiens
ccaaagtccatagtttacatta

SEQ ID NO: 8012610 - DNA, 22 bp, Homo sapiens
ccaaagtccatagtttacttta

SEQ ID NO: 8012611 - DNA, 22 bp, Homo sapiens
ccaaagtccatagtttacataa

SEQ ID NO: 8012612 - DNA, 22 bp, Homo sapiens
ccaaagtccacagtttacatta

SEQ ID NO: 8012613 - DNA, 22 bp, Homo sapiens
ccaaaaattagatacacatata

SEQ ID NO: 8012614 - DNA, 22 bp, Homo sapiens
tccctgctttcttgtgagggga

SEQ ID NO: 8012615 - DNA, 22 bp, Homo sapiens
ccaaaaattagatacacatata

SEQ ID NO: 8012616 - DNA, 23 bp, Homo sapiens
ccaaaagcgagtctgttgttccc

SEQ ID NO: 8012617 - DNA, 22 bp, Homo sapiens
ccaaagtgatatgtgctgtaag

SEQ ID NO: 8012618 - DNA, 22 bp, Homo sapiens
tccctgctgggagatgacctta

SEQ ID NO: 8012619 - DNA, 22 bp, Homo sapiens
tccctgcttgctctcagccctt

SEQ ID NO: 8012620 - DNA, 22 bp, Homo sapiens
tccctgctgcactcacacctac

SEQ ID NO: 8012621 - DNA, 21 bp, Homo sapiens
tccctgctttctggcccagtc

SEQ ID NO: 8012622 - DNA, 21 bp, Homo sapiens
tccctgctttctggcccagtc

SEQ ID NO: 8012623 - DNA, 21 bp, Homo sapiens
tccctgctttctggcccagtc

SEQ ID NO: 8012624 - DNA, 22 bp, Homo sapiens
tccctgcttggaatgaccctta

SEQ ID NO: 8012625 - DNA, 22 bp, Homo sapiens
tccctgcttgctctcagccctt

SEQ ID NO: 8012626 - DNA, 22 bp, Homo sapiens
tccctgcttggaatgaccctta

SEQ ID NO: 8012627 - DNA, 22 bp, Homo sapiens
tccctgctgagagtgctctccc

SEQ ID NO: 8012628 - DNA, 22 bp, Homo sapiens
tccctgctgagagtgctctccc

SEQ ID NO: 8012629 - DNA, 22 bp, Homo sapiens
tccctgctgcactcacacctac

SEQ ID NO: 8012630 - DNA, 22 bp, Homo sapiens
tccctgctgcactcacacctac

SEQ ID NO: 8012631 - DNA, 22 bp, Homo sapiens
tccctgctgcactcacacctac

SEQ ID NO: 8012632 - DNA, 22 bp, Homo sapiens
ccacaaagaatgggggaagcat

SEQ ID NO: 8012633 - DNA, 22 bp, Homo sapiens
ccacaagactctgtcagcataa

SEQ ID NO: 8012634 - DNA, 22 bp, Homo sapiens
ccacaagactctgtcagcataa

SEQ ID NO: 8012635 - DNA, 22 bp, Homo sapiens
ccacaagactctgtcagcataa

SEQ ID NO: 8012636 - DNA, 22 bp, Homo sapiens
ccacaaattaggttttgcttgt

SEQ ID NO: 8012637 - DNA, 19 bp, Homo sapiens
ccacaaaattattttagtt

SEQ ID NO: 8012638 - DNA, 22 bp, Homo sapiens
ccacaaaactgtgtgtcaaaga

SEQ ID NO: 8012639 - DNA, 22 bp, Homo sapiens
ccacaaaactgtgtgtcaaaga

SEQ ID NO: 8012640 - DNA, 22 bp, Homo sapiens
ccacaaaactgtgtgtcaaaga

SEQ ID NO: 8012641 - DNA, 23 bp, Homo sapiens
ccaattcatggcagatttgaaga

SEQ ID NO: 8012642 - DNA, 23 bp, Homo sapiens
ccaattcatggcagatttgaaga

SEQ ID NO: 8012643 - DNA, 22 bp, Homo sapiens
ccaattcatcctctggggcttc

SEQ ID NO: 8012644 - DNA, 22 bp, Homo sapiens
ccaattcacttccaaccccttc

SEQ ID NO: 8012645 - DNA, 22 bp, Homo sapiens
ccaatgtttattttcctgctgc

SEQ ID NO: 8012646 - DNA, 22 bp, Homo sapiens
ccaatgttttatacagaagtac

SEQ ID NO: 8012647 - DNA, 22 bp, Homo sapiens
ccaatgttttatacagaagtac

SEQ ID NO: 8012648 - DNA, 22 bp, Homo sapiens
ccaagggctatttacagaacag

SEQ ID NO: 8012649 - DNA, 20 bp, Homo sapiens
ccaatgtttacagattactt

SEQ ID NO: 8012650 - DNA, 22 bp, Homo sapiens
ccaagggcgcctccgttccccc

SEQ ID NO: 8012651 - DNA, 22 bp, Homo sapiens
ccaagggcatcttgcatgctgg

SEQ ID NO: 8012652 - DNA, 22 bp, Homo sapiens
ccaagggcatcttgcatgctgg

SEQ ID NO: 8012653 - DNA, 22 bp, Homo sapiens
ccaagggccatcctatcacttg

SEQ ID NO: 8012654 - DNA, 22 bp, Homo sapiens
tcctgcagttacatcccagcca

SEQ ID NO: 8012655 - DNA, 22 bp, Homo sapiens
tcctgcagttacatcccagcca

SEQ ID NO: 8012656 - DNA, 22 bp, Homo sapiens
tcctgcagttacatcccagcca

SEQ ID NO: 8012657 - DNA, 22 bp, Homo sapiens
tcctgcagttacatcccagcca

SEQ ID NO: 8012658 - DNA, 22 bp, Homo sapiens
tcctgcagtgtgtctcctgcac

SEQ ID NO: 8012659 - DNA, 22 bp, Homo sapiens
tcctgcagtgtgtctcctgcac

SEQ ID NO: 8012660 - DNA, 22 bp, Homo sapiens
tcctgcagtgtgtctcctgcac

SEQ ID NO: 8012661 - DNA, 22 bp, Homo sapiens
tcctgcagtgtgtctcctgcac

SEQ ID NO: 8012662 - DNA, 22 bp, Homo sapiens
tcctgcagtgtgtctcctgcac

SEQ ID NO: 8012663 - DNA, 22 bp, Homo sapiens
tcctgcagtgtgtctcctgcac

SEQ ID NO: 8012664 - DNA, 22 bp, Homo sapiens
ccacacagggggatgagttatt

SEQ ID NO: 8012665 - DNA, 22 bp, Homo sapiens
ccacacagataagtgttttcta

SEQ ID NO: 8012666 - DNA, 22 bp, Homo sapiens
ccacacagggggatgagttatt

SEQ ID NO: 8012667 - DNA, 22 bp, Homo sapiens
ccacacagataagtgttttcta

SEQ ID NO: 8012668 - DNA, 22 bp, Homo sapiens
ccacaattttatgatttaggag

SEQ ID NO: 8012669 - DNA, 23 bp, Homo sapiens
ccacaattgagagattctgcaat

SEQ ID NO: 8012670 - DNA, 22 bp, Homo sapiens
ccacaattttatgatttaggag

SEQ ID NO: 8012671 - DNA, 22 bp, Homo sapiens
ccacaattttatgatttaggag

SEQ ID NO: 8012672 - DNA, 22 bp, Homo sapiens
ccacaattccacagcaacttgc

SEQ ID NO: 8012673 - DNA, 22 bp, Homo sapiens
ccacaagtttgttgattgaaac

SEQ ID NO: 8012674 - DNA, 22 bp, Homo sapiens
ccacaattctgctttaatttct

SEQ ID NO: 8012675 - DNA, 21 bp, Homo sapiens
ccacaattctagttacatatg

SEQ ID NO: 8012676 - DNA, 22 bp, Homo sapiens
ccacaatttatgtattctccta

SEQ ID NO: 8012677 - DNA, 22 bp, Homo sapiens
ccacaatttatgtattctccta

SEQ ID NO: 8012678 - DNA, 22 bp, Homo sapiens
ccacaaggcctgtggggctgct

SEQ ID NO: 8012679 - DNA, 22 bp, Homo sapiens
ccacaaggcctgtggggctgct

SEQ ID NO: 8012680 - DNA, 22 bp, Homo sapiens
ccacaagtttcagcacccagag

SEQ ID NO: 8012681 - DNA, 22 bp, Homo sapiens
ccacaagtgaagtacacctgcc

SEQ ID NO: 8012682 - DNA, 22 bp, Homo sapiens
ccacaagtgaagtacacctgcc

SEQ ID NO: 8012683 - DNA, 22 bp, Homo sapiens
ccaaatgtctattaggtcaatt

SEQ ID NO: 8012684 - DNA, 22 bp, Homo sapiens
ccaaatgtctattaggtcaatt

SEQ ID NO: 8012685 - DNA, 22 bp, Homo sapiens
ccaaatcaggggccacaagcat

SEQ ID NO: 8012686 - DNA, 22 bp, Homo sapiens
ccaaatgtgcctgtttcaacaa

SEQ ID NO: 8012687 - DNA, 22 bp, Homo sapiens
ccaaatgtgcctgtttcaacaa

SEQ ID NO: 8012688 - DNA, 20 bp, Homo sapiens
ccaaatgtggagaaaaagta

SEQ ID NO: 8012689 - DNA, 20 bp, Homo sapiens
ccaaatgtggagaaaaagta

SEQ ID NO: 8012690 - DNA, 22 bp, Homo sapiens
ccaaattaaatcatacagacag

SEQ ID NO: 8012691 - DNA, 23 bp, Homo sapiens
tcctcccaaatttcagcctcatt

SEQ ID NO: 8012692 - DNA, 23 bp, Homo sapiens
tcctcccaaatttcagcctcatt

SEQ ID NO: 8012693 - DNA, 23 bp, Homo sapiens
tcctcccaaatttcagcctcatt

SEQ ID NO: 8012694 - DNA, 22 bp, Homo sapiens
ccaaagtgctggggttacaggc

SEQ ID NO: 8012695 - DNA, 22 bp, Homo sapiens
ccaaagtgtgggagaagaggta

SEQ ID NO: 8012696 - DNA, 22 bp, Homo sapiens
ccaaataatatttcagaaccat

SEQ ID NO: 8012697 - DNA, 22 bp, Homo sapiens
ccaaataatatttcagaaccat

SEQ ID NO: 8012698 - DNA, 22 bp, Homo sapiens
ccaaagtgtgggagaagaggta

SEQ ID NO: 8012699 - DNA, 22 bp, Homo sapiens
ccaaatcaccagcacgatcatt

SEQ ID NO: 8012700 - DNA, 22 bp, Homo sapiens
ccaaatcaccagcacgatcatt

SEQ ID NO: 8012701 - DNA, 22 bp, Homo sapiens
ccaaatagtctttcattgaatt

SEQ ID NO: 8012702 - DNA, 21 bp, Homo sapiens
ccaaatagcctccattaacag

SEQ ID NO: 8012703 - DNA, 22 bp, Homo sapiens
ccaaatagtctttcattgaatt

SEQ ID NO: 8012704 - DNA, 22 bp, Homo sapiens
ccaaatattaacaaagtaattt

SEQ ID NO: 8012705 - DNA, 22 bp, Homo sapiens
ccaaatattaacaaagtaattt

SEQ ID NO: 8012706 - DNA, 22 bp, Homo sapiens
ccaaatattaacaaagtaattt

SEQ ID NO: 8012707 - DNA, 22 bp, Homo sapiens
tcctccccaaagcccagcctgg

SEQ ID NO: 8012708 - DNA, 22 bp, Homo sapiens
tcctccccaaagcccagcctgg

SEQ ID NO: 8012709 - DNA, 22 bp, Homo sapiens
tcctcccacataggacaatggg

SEQ ID NO: 8012710 - DNA, 22 bp, Homo sapiens
tcctcccacataggacaatggg

SEQ ID NO: 8012711 - DNA, 22 bp, Homo sapiens
tcctcccacataggacaatggg

SEQ ID NO: 8012712 - DNA, 22 bp, Homo sapiens
tcctcccacataggacaatggg

SEQ ID NO: 8012713 - DNA, 22 bp, Homo sapiens
tcctcccaacttttccatctca

SEQ ID NO: 8012714 - DNA, 22 bp, Homo sapiens
tcctcccaacttttccatctca

SEQ ID NO: 8012715 - DNA, 22 bp, Homo sapiens
tcctcccaacttttccatctca

SEQ ID NO: 8012716 - DNA, 22 bp, Homo sapiens
tcctcccaacttttccatctca

SEQ ID NO: 8012717 - DNA, 22 bp, Homo sapiens
tcctccccaaagcccagcctgg

SEQ ID NO: 8012718 - DNA, 22 bp, Homo sapiens
tcctccccaaagcccagcctgg

SEQ ID NO: 8012719 - DNA, 22 bp, Homo sapiens
tcctccccaaagcccagcctgg

SEQ ID NO: 8012720 - DNA, 22 bp, Homo sapiens
tcctccccaaagcccagcctgg

SEQ ID NO: 8012721 - DNA, 22 bp, Homo sapiens
tcctccccaaagcccagcctgg

SEQ ID NO: 8012722 - DNA, 22 bp, Homo sapiens
tcctccccaaagcccagcctgg

SEQ ID NO: 8012723 - DNA, 22 bp, Homo sapiens
tcctccccaaagcccagcctgg

SEQ ID NO: 8012724 - DNA, 20 bp, Homo sapiens
tcctcccccacctttgcagc

SEQ ID NO: 8012725 - DNA, 20 bp, Homo sapiens
tcctcccccacctttgcagc

SEQ ID NO: 8012726 - DNA, 20 bp, Homo sapiens
tcctcccccacctttgcagc

SEQ ID NO: 8012727 - DNA, 20 bp, Homo sapiens
tcctcccccacctttgcagc

SEQ ID NO: 8012728 - DNA, 20 bp, Homo sapiens
tcctcccccacctttgcagc

SEQ ID NO: 8012729 - DNA, 20 bp, Homo sapiens
tcctcccccacctttgcagc

SEQ ID NO: 8012730 - DNA, 17 bp, Homo sapiens
tcctccccgcagttgca

SEQ ID NO: 8012731 - DNA, 17 bp, Homo sapiens
tcctccccgcagttgca

SEQ ID NO: 8012732 - DNA, 22 bp, Homo sapiens
ccaagggaaggatgtatatgat

SEQ ID NO: 8012733 - DNA, 22 bp, Homo sapiens
ccacagcaccgctgccagtccc

SEQ ID NO: 8012734 - DNA, 22 bp, Homo sapiens
ccacagcaccgctgccagtccc

SEQ ID NO: 8012735 - DNA, 22 bp, Homo sapiens
ccacagcaccgctgccagtccc

SEQ ID NO: 8012736 - DNA, 22 bp, Homo sapiens
ccacagcaccgctgccagtccc

SEQ ID NO: 8012737 - DNA, 22 bp, Homo sapiens
ccacagattatttctaaacagg

SEQ ID NO: 8012738 - DNA, 22 bp, Homo sapiens
ccacagcaccgctgccagtccc

SEQ ID NO: 8012739 - DNA, 22 bp, Homo sapiens
ccacagcaccgctgccagtccc

SEQ ID NO: 8012740 - DNA, 22 bp, Homo sapiens
ccacagcacctgcagccagttg

SEQ ID NO: 8012741 - DNA, 22 bp, Homo sapiens
ccacagcacctgcagccagttg

SEQ ID NO: 8012742 - DNA, 22 bp, Homo sapiens
ccacagcacctgcagccagttg

SEQ ID NO: 8012743 - DNA, 22 bp, Homo sapiens
ccacagcacctgcagccagttg

SEQ ID NO: 8012744 - DNA, 22 bp, Homo sapiens
ccacagcacctgcagccagttg

SEQ ID NO: 8012745 - DNA, 22 bp, Homo sapiens
ccacagcacctgcagccagttg

SEQ ID NO: 8012746 - DNA, 22 bp, Homo sapiens
ccacagagttgatgcaataaga

SEQ ID NO: 8012747 - DNA, 22 bp, Homo sapiens
ccacagagttacaaaacagtca

SEQ ID NO: 8012748 - DNA, 22 bp, Homo sapiens
ccacagagttacaaaacagtca

SEQ ID NO: 8012749 - DNA, 22 bp, Homo sapiens
ccacagagttacaaaacagtca

SEQ ID NO: 8012750 - DNA, 18 bp, Homo sapiens
ccacagcagagttcttac

SEQ ID NO: 8012751 - DNA, 18 bp, Homo sapiens
ccacagcagagttcttac

SEQ ID NO: 8012752 - DNA, 22 bp, Homo sapiens
ccacagcacctgcagccagttg

SEQ ID NO: 8012753 - DNA, 18 bp, Homo sapiens
ccacagcagagttcttac

SEQ ID NO: 8012754 - DNA, 18 bp, Homo sapiens
ccacagcagagttcttac

SEQ ID NO: 8012755 - DNA, 22 bp, Homo sapiens
ccacagcaggactggagccgcc

SEQ ID NO: 8012756 - DNA, 22 bp, Homo sapiens
ccacagcaggactggagccgcc

SEQ ID NO: 8012757 - DNA, 22 bp, Homo sapiens
ccacagcaggactggagccgcc

SEQ ID NO: 8012758 - DNA, 18 bp, Homo sapiens
ccacagcagagttcttac

SEQ ID NO: 8012759 - DNA, 18 bp, Homo sapiens
ccacagcagagttcttac

SEQ ID NO: 8012760 - DNA, 22 bp, Homo sapiens
ccacagcatgcaggcctgacac

SEQ ID NO: 8012761 - DNA, 22 bp, Homo sapiens
ccacagcatgcaggcctgacac

SEQ ID NO: 8012762 - DNA, 22 bp, Homo sapiens
ccacagcatgcaggcctgacac

SEQ ID NO: 8012763 - DNA, 22 bp, Homo sapiens
ccacagcaggactggagccgcc

SEQ ID NO: 8012764 - DNA, 22 bp, Homo sapiens
ccacagcatgcaggcctgacac

SEQ ID NO: 8012765 - DNA, 22 bp, Homo sapiens
ccacagcatgcaggcctgacac

SEQ ID NO: 8012766 - DNA, 22 bp, Homo sapiens
ccacagcatgcaggcctgacac

SEQ ID NO: 8012767 - DNA, 22 bp, Homo sapiens
ccacagcatgcaggcctgacac

SEQ ID NO: 8012768 - DNA, 22 bp, Homo sapiens
ccacagctcctcagcctctttc

SEQ ID NO: 8012769 - DNA, 23 bp, Homo sapiens
ccacagctatagggtagtgcagt

SEQ ID NO: 8012770 - DNA, 22 bp, Homo sapiens
ccacagctcctcagcctctttc

SEQ ID NO: 8012771 - DNA, 22 bp, Homo sapiens
ccacagctcctcagcctctttc

SEQ ID NO: 8012772 - DNA, 22 bp, Homo sapiens
ccacagctcctcagcctctttc

SEQ ID NO: 8012773 - DNA, 22 bp, Homo sapiens
ccacagctctagctccctccca

SEQ ID NO: 8012774 - DNA, 23 bp, Homo sapiens
ccacagctatagggtagtgcagt

SEQ ID NO: 8012775 - DNA, 22 bp, Homo sapiens
ccacagctagggcaatctgatt

SEQ ID NO: 8012776 - DNA, 23 bp, Homo sapiens
ccacagctatagggtagtgcagt

SEQ ID NO: 8012777 - DNA, 22 bp, Homo sapiens
ccacagctgaaagcagaggctc

SEQ ID NO: 8012778 - DNA, 22 bp, Homo sapiens
ccacagctgaaagcagaggctc

SEQ ID NO: 8012779 - DNA, 22 bp, Homo sapiens
ccacagctctagctccctccca

SEQ ID NO: 8012780 - DNA, 22 bp, Homo sapiens
ccacagctgaaagcagaggctc

SEQ ID NO: 8012781 - DNA, 22 bp, Homo sapiens
ccacagctgaaagcagaggctc

SEQ ID NO: 8012782 - DNA, 22 bp, Homo sapiens
ccacagctgaaagcagaggctc

SEQ ID NO: 8012783 - DNA, 17 bp, Homo sapiens
ccacagcctggcacttg

SEQ ID NO: 8012784 - DNA, 17 bp, Homo sapiens
ccacagcctggcacttg

SEQ ID NO: 8012785 - DNA, 17 bp, Homo sapiens
ccacagcctggcacttg

SEQ ID NO: 8012786 - DNA, 17 bp, Homo sapiens
ccacagcctggcacttg

SEQ ID NO: 8012787 - DNA, 17 bp, Homo sapiens
ccacagcctggcacttg

SEQ ID NO: 8012788 - DNA, 18 bp, Homo sapiens
ccacagcggaatggacat

SEQ ID NO: 8012789 - DNA, 22 bp, Homo sapiens
ccacagcggcgggagcgcgggt

SEQ ID NO: 8012790 - DNA, 22 bp, Homo sapiens
ccacagctagggcaatctgatt

SEQ ID NO: 8012791 - DNA, 17 bp, Homo sapiens
ccacagcctggcacttg

SEQ ID NO: 8012792 - DNA, 22 bp, Homo sapiens
ccacagccattccagggaggct

SEQ ID NO: 8012793 - DNA, 19 bp, Homo sapiens
ccacagcctgctgtcttcc

SEQ ID NO: 8012794 - DNA, 22 bp, Homo sapiens
ccacagccattccagggaggct

SEQ ID NO: 8012795 - DNA, 22 bp, Homo sapiens
tcctgccaaagcatgtactggg

SEQ ID NO: 8012796 - DNA, 17 bp, Homo sapiens
tcctgccacctgtcagg

SEQ ID NO: 8012797 - DNA, 17 bp, Homo sapiens
tcctgccacctgtcagg

SEQ ID NO: 8012798 - DNA, 17 bp, Homo sapiens
tcctgccacctgtcagg

SEQ ID NO: 8012799 - DNA, 22 bp, Homo sapiens
tcctgccacctgcacagctccc

SEQ ID NO: 8012800 - DNA, 20 bp, Homo sapiens
tcctgcagttcctaggaggg

SEQ ID NO: 8012801 - DNA, 20 bp, Homo sapiens
tcctgcagttcctaggaggg

SEQ ID NO: 8012802 - DNA, 20 bp, Homo sapiens
tcctgcagttcctaggaggg

SEQ ID NO: 8012803 - DNA, 20 bp, Homo sapiens
tcctgcagttcctaggaggg

SEQ ID NO: 8012804 - DNA, 22 bp, Homo sapiens
tcctgccatcccacccggctca

SEQ ID NO: 8012805 - DNA, 22 bp, Homo sapiens
tcctgccaggagtgctggccct

SEQ ID NO: 8012806 - DNA, 22 bp, Homo sapiens
tcctgcccacagctgctggaca

SEQ ID NO: 8012807 - DNA, 22 bp, Homo sapiens
tcctgcccacagctgctggaca

SEQ ID NO: 8012808 - DNA, 22 bp, Homo sapiens
tcctgcccacagctgctggaca

SEQ ID NO: 8012809 - DNA, 22 bp, Homo sapiens
tcctgcccacagctgctggaca

SEQ ID NO: 8012810 - DNA, 22 bp, Homo sapiens
tcctgccactgcacatatactt

SEQ ID NO: 8012811 - DNA, 22 bp, Homo sapiens
tcctgccagcccacagactcat

SEQ ID NO: 8012812 - DNA, 22 bp, Homo sapiens
tcctgccaggagtgctggccct

SEQ ID NO: 8012813 - DNA, 22 bp, Homo sapiens
tcctgccaggagtgctggccct

SEQ ID NO: 8012814 - DNA, 20 bp, Homo sapiens
ccacagaggacagggctgtg

SEQ ID NO: 8012815 - DNA, 20 bp, Homo sapiens
ccacagaggacagggctgtg

SEQ ID NO: 8012816 - DNA, 20 bp, Homo sapiens
ccacagaggacagggctgtg

SEQ ID NO: 8012817 - DNA, 20 bp, Homo sapiens
ccacagaggacagggctgtg

SEQ ID NO: 8012818 - DNA, 22 bp, Homo sapiens
ccacagaggacaactgcctggc

SEQ ID NO: 8012819 - DNA, 20 bp, Homo sapiens
ccacagaggacagggctgtg

SEQ ID NO: 8012820 - DNA, 20 bp, Homo sapiens
ccacagaggacagggctgtg

SEQ ID NO: 8012821 - DNA, 22 bp, Homo sapiens
ccacagagtccgcatttgaggc

SEQ ID NO: 8012822 - DNA, 22 bp, Homo sapiens
ccacagagtccgcatttgaggc

SEQ ID NO: 8012823 - DNA, 20 bp, Homo sapiens
ccacagaggacagggctgtg

SEQ ID NO: 8012824 - DNA, 22 bp, Homo sapiens
ccacagagtcttccttctcttc

SEQ ID NO: 8012825 - DNA, 22 bp, Homo sapiens
ccacagagtcttccttctcttc

SEQ ID NO: 8012826 - DNA, 22 bp, Homo sapiens
ccacagaatgatgacacttcag

SEQ ID NO: 8012827 - DNA, 22 bp, Homo sapiens
ccacagaatgatgacacttcag

SEQ ID NO: 8012828 - DNA, 22 bp, Homo sapiens
ccacagaatcgctagtggagca

SEQ ID NO: 8012829 - DNA, 22 bp, Homo sapiens
ccacagaatcgctagtggagca

SEQ ID NO: 8012830 - DNA, 22 bp, Homo sapiens
ccacagaatcgctagtggagca

SEQ ID NO: 8012831 - DNA, 19 bp, Homo sapiens
tcctgcccaccagccaggg

SEQ ID NO: 8012832 - DNA, 22 bp, Homo sapiens
ccacagaatgatgacacttcag

SEQ ID NO: 8012833 - DNA, 23 bp, Homo sapiens
ccacagagctgccaattcctgtg

SEQ ID NO: 8012834 - DNA, 22 bp, Homo sapiens
ccacagaggacaactgcctggc

SEQ ID NO: 8012835 - DNA, 22 bp, Homo sapiens
ccacagaggacaactgcctggc

SEQ ID NO: 8012836 - DNA, 22 bp, Homo sapiens
ccacagaggacaactgcctggc

SEQ ID NO: 8012837 - DNA, 22 bp, Homo sapiens
ccacagaggacaactgcctggc

SEQ ID NO: 8012838 - DNA, 22 bp, Homo sapiens
ccacagaggacaactgcctggc

SEQ ID NO: 8012839 - DNA, 22 bp, Homo sapiens
tctgcctcctgcttgtcccgac

SEQ ID NO: 8012840 - DNA, 22 bp, Homo sapiens
tctgcctcctgcttgtcccgac

SEQ ID NO: 8012841 - DNA, 22 bp, Homo sapiens
tctgcctcctgcttgtcccgac

SEQ ID NO: 8012842 - DNA, 22 bp, Homo sapiens
tctgcctcgctaacagcagcca

SEQ ID NO: 8012843 - DNA, 22 bp, Homo sapiens
tctgcctcgctaacagcagcca

SEQ ID NO: 8012844 - DNA, 22 bp, Homo sapiens
tctgcctcgctaacagcagcca

SEQ ID NO: 8012845 - DNA, 22 bp, Homo sapiens
tctgcctcgctaacagcagcca

SEQ ID NO: 8012846 - DNA, 22 bp, Homo sapiens
tctgcctcgctaacagcagcca

SEQ ID NO: 8012847 - DNA, 22 bp, Homo sapiens
tctgcctcgctaacagcagcca

SEQ ID NO: 8012848 - DNA, 19 bp, Homo sapiens
tctgcctctggtcaggctc

SEQ ID NO: 8012849 - DNA, 19 bp, Homo sapiens
tctgcctctggtcaggctc

SEQ ID NO: 8012850 - DNA, 19 bp, Homo sapiens
tctgcctctggtcaggctc

SEQ ID NO: 8012851 - DNA, 22 bp, Homo sapiens
tctgcctcgctaacagcagcca

SEQ ID NO: 8012852 - DNA, 22 bp, Homo sapiens
tctgcctcgctaacagcagcca

SEQ ID NO: 8012853 - DNA, 22 bp, Homo sapiens
tctgcctcgctaacagcagcca

SEQ ID NO: 8012854 - DNA, 22 bp, Homo sapiens
tctgcctcgctaacagcagcca

SEQ ID NO: 8012855 - DNA, 21 bp, Homo sapiens
tctgccagctgaagaggtgga

SEQ ID NO: 8012856 - DNA, 22 bp, Homo sapiens
tctgccagcttctggtggttgc

SEQ ID NO: 8012857 - DNA, 22 bp, Homo sapiens
tctgccaggaagaaagcacaat

SEQ ID NO: 8012858 - DNA, 22 bp, Homo sapiens
tctgccaggaagaaagcacaat

SEQ ID NO: 8012859 - DNA, 21 bp, Homo sapiens
tctgccagctgaagaggtgga

SEQ ID NO: 8012860 - DNA, 21 bp, Homo sapiens
tctgccagctgaagaggtgga

SEQ ID NO: 8012861 - DNA, 22 bp, Homo sapiens
tctgccagctctgtgggtctcg

SEQ ID NO: 8012862 - DNA, 21 bp, Homo sapiens
tctgccagctgaagaggtgga

SEQ ID NO: 8012863 - DNA, 21 bp, Homo sapiens
tctgccagctgaagaggtgga

SEQ ID NO: 8012864 - DNA, 22 bp, Homo sapiens
tctgccaggcattgtgctgctc

SEQ ID NO: 8012865 - DNA, 22 bp, Homo sapiens
tctgccaggagccatgagcaag

SEQ ID NO: 8012866 - DNA, 22 bp, Homo sapiens
tctgccaggagccatgagcaag

SEQ ID NO: 8012867 - DNA, 22 bp, Homo sapiens
tctgccaggagccatgagcaag

SEQ ID NO: 8012868 - DNA, 22 bp, Homo sapiens
tctgcctcctgcttgtcccgac

SEQ ID NO: 8012869 - DNA, 22 bp, Homo sapiens
tctgcctcctgcttgtcccgac

SEQ ID NO: 8012870 - DNA, 22 bp, Homo sapiens
tctgccagaagttctgagagta

SEQ ID NO: 8012871 - DNA, 22 bp, Homo sapiens
tctgccagaagttctgagagta

SEQ ID NO: 8012872 - DNA, 22 bp, Homo sapiens
tctgccagaagttctgagagta

SEQ ID NO: 8012873 - DNA, 22 bp, Homo sapiens
tctgccagaagttctgagagta

SEQ ID NO: 8012874 - DNA, 22 bp, Homo sapiens
tctgccagaagttctgagagta

SEQ ID NO: 8012875 - DNA, 22 bp, Homo sapiens
tctgccagaagttctgagagta

SEQ ID NO: 8012876 - DNA, 22 bp, Homo sapiens
tctgccagctctgtgggtctcg

SEQ ID NO: 8012877 - DNA, 22 bp, Homo sapiens
tctgccagccctgtgagtcttg

SEQ ID NO: 8012878 - DNA, 22 bp, Homo sapiens
tctgccagcaccatgatccttc

SEQ ID NO: 8012879 - DNA, 22 bp, Homo sapiens
tctgccagcaccatgatccttc

SEQ ID NO: 8012880 - DNA, 22 bp, Homo sapiens
tctgccagcaccatgatccttc

SEQ ID NO: 8012881 - DNA, 22 bp, Homo sapiens
tctgccagcaccatgatccttc

SEQ ID NO: 8012882 - DNA, 22 bp, Homo sapiens
tctgccagacctgactcagtag

SEQ ID NO: 8012883 - DNA, 22 bp, Homo sapiens
tctgccagaagccagggtctgg

SEQ ID NO: 8012884 - DNA, 22 bp, Homo sapiens
tctgccagaagccagggtctgg

SEQ ID NO: 8012885 - DNA, 22 bp, Homo sapiens
tctgccagaagccagggtctgg

SEQ ID NO: 8012886 - DNA, 22 bp, Homo sapiens
tctgccagaactccattagaaa

SEQ ID NO: 8012887 - DNA, 22 bp, Homo sapiens
tctgccagaactccattagaaa

SEQ ID NO: 8012888 - DNA, 20 bp, Homo sapiens
tctgccactttttctgtcac

SEQ ID NO: 8012889 - DNA, 20 bp, Homo sapiens
tctgccactgcactctgccc

SEQ ID NO: 8012890 - DNA, 22 bp, Homo sapiens
tctgccactgtgatgcatgata

SEQ ID NO: 8012891 - DNA, 22 bp, Homo sapiens
tctgccactgtggccatgggag

SEQ ID NO: 8012892 - DNA, 22 bp, Homo sapiens
tctgccacttacctccatgtac

SEQ ID NO: 8012893 - DNA, 20 bp, Homo sapiens
tctgccacgtctggtgactg

SEQ ID NO: 8012894 - DNA, 22 bp, Homo sapiens
tctgccaccttcatcctccact

SEQ ID NO: 8012895 - DNA, 22 bp, Homo sapiens
tctgccaccttcatcctccact

SEQ ID NO: 8012896 - DNA, 22 bp, Homo sapiens
ccagctctcagcgggagactca

SEQ ID NO: 8012897 - DNA, 22 bp, Homo sapiens
ccagctctcagcgggagactca

SEQ ID NO: 8012898 - DNA, 22 bp, Homo sapiens
ccagctctcagcgggagactca

SEQ ID NO: 8012899 - DNA, 22 bp, Homo sapiens
ccagctctagccccatgtggct

SEQ ID NO: 8012900 - DNA, 22 bp, Homo sapiens
ccagctctagccccatgtggct

SEQ ID NO: 8012901 - DNA, 22 bp, Homo sapiens
ccagctctagccccatgtggct

SEQ ID NO: 8012902 - DNA, 22 bp, Homo sapiens
ccagctctcaaggctccctggg

SEQ ID NO: 8012903 - DNA, 22 bp, Homo sapiens
ccagctctagccccatgtggct

SEQ ID NO: 8012904 - DNA, 22 bp, Homo sapiens
ccagctctaaacggctctgtgg

SEQ ID NO: 8012905 - DNA, 22 bp, Homo sapiens
ccagctctaaacggctctgtgg

SEQ ID NO: 8012906 - DNA, 22 bp, Homo sapiens
ccagctccttctgtctgtggag

SEQ ID NO: 8012907 - DNA, 22 bp, Homo sapiens
ccagctctaaacggctctgtgg

SEQ ID NO: 8012908 - DNA, 22 bp, Homo sapiens
ccagctctaaacggctctgtgg

SEQ ID NO: 8012909 - DNA, 22 bp, Homo sapiens
ccagctctaaacggctctgtgg

SEQ ID NO: 8012910 - DNA, 22 bp, Homo sapiens
ccagctctaaacggctctgtgg

SEQ ID NO: 8012911 - DNA, 22 bp, Homo sapiens
ccagctcctgggtcttagtcag

SEQ ID NO: 8012912 - DNA, 22 bp, Homo sapiens
ccagctccttctgtctgtggag

SEQ ID NO: 8012913 - DNA, 22 bp, Homo sapiens
ccagctcctcttcccagtgtca

SEQ ID NO: 8012914 - DNA, 22 bp, Homo sapiens
ccagctcctcttcccagtgtca

SEQ ID NO: 8012915 - DNA, 23 bp, Homo sapiens
ccagctccgtgagcctcgggctc

SEQ ID NO: 8012916 - DNA, 22 bp, Homo sapiens
ccagctcctcttcccagtgtca

SEQ ID NO: 8012917 - DNA, 22 bp, Homo sapiens
ccagctccaggactgggagctg

SEQ ID NO: 8012918 - DNA, 21 bp, Homo sapiens
ccagctccaggaccttggatc

SEQ ID NO: 8012919 - DNA, 22 bp, Homo sapiens
ccagctccaggactgggagctg

SEQ ID NO: 8012920 - DNA, 22 bp, Homo sapiens
ccagctccaggactgggagctg

SEQ ID NO: 8012921 - DNA, 22 bp, Homo sapiens
ccagctcctcttgtctctagca

SEQ ID NO: 8012922 - DNA, 22 bp, Homo sapiens
ccagctcctgagcatggtttcc

SEQ ID NO: 8012923 - DNA, 22 bp, Homo sapiens
ccagctcctgagcatggtttcc

SEQ ID NO: 8012924 - DNA, 22 bp, Homo sapiens
ccagctcctgggtcttagtcag

SEQ ID NO: 8012925 - DNA, 22 bp, Homo sapiens
ccagctcctgggtcttagtcag

SEQ ID NO: 8012926 - DNA, 22 bp, Homo sapiens
ccagctcctcttcccagtgtca

SEQ ID NO: 8012927 - DNA, 22 bp, Homo sapiens
ccagctcctcttgtctctagca

SEQ ID NO: 8012928 - DNA, 22 bp, Homo sapiens
ccagctcctcttgtctctagca

SEQ ID NO: 8012929 - DNA, 22 bp, Homo sapiens
ccagctcctcttcccagtgtca

SEQ ID NO: 8012930 - DNA, 22 bp, Homo sapiens
ccagctcctcttgtctctagca

SEQ ID NO: 8012931 - DNA, 22 bp, Homo sapiens
ccagcctggttcagaattggct

SEQ ID NO: 8012932 - DNA, 22 bp, Homo sapiens
ccagccttactgcccttcagtg

SEQ ID NO: 8012933 - DNA, 22 bp, Homo sapiens
ccagccttcacctgctctggtc

SEQ ID NO: 8012934 - DNA, 22 bp, Homo sapiens
ccagcctggttcagaattggct

SEQ ID NO: 8012935 - DNA, 22 bp, Homo sapiens
ccagccttcacctgctctggtc

SEQ ID NO: 8012936 - DNA, 22 bp, Homo sapiens
ccagccttccagccaatggctg

SEQ ID NO: 8012937 - DNA, 22 bp, Homo sapiens
ccagcctgggtgttagaagaca

SEQ ID NO: 8012938 - DNA, 22 bp, Homo sapiens
ccagcctgggtgttagaagaca

SEQ ID NO: 8012939 - DNA, 22 bp, Homo sapiens
ccagcctggggaggcagcttct

SEQ ID NO: 8012940 - DNA, 22 bp, Homo sapiens
ccagcctgggtgttagaagaca

SEQ ID NO: 8012941 - DNA, 22 bp, Homo sapiens
ccagcctggggaggcagcttct

SEQ ID NO: 8012942 - DNA, 23 bp, Homo sapiens
ccagcgctcactcagagcatgtt

SEQ ID NO: 8012943 - DNA, 23 bp, Homo sapiens
ccagcgctcactcagagcatgtt

SEQ ID NO: 8012944 - DNA, 19 bp, Homo sapiens
ccagcctttccagtgattg

SEQ ID NO: 8012945 - DNA, 22 bp, Homo sapiens
ccagccttctgggactctcatc

SEQ ID NO: 8012946 - DNA, 22 bp, Homo sapiens
ccagccttgcaccgagccagcc

SEQ ID NO: 8012947 - DNA, 22 bp, Homo sapiens
ccagccttgcaccgagccagcc

SEQ ID NO: 8012948 - DNA, 22 bp, Homo sapiens
ccagctccaagtttgggcatca

SEQ ID NO: 8012949 - DNA, 22 bp, Homo sapiens
ccagctccaagtttgggcatca

SEQ ID NO: 8012950 - DNA, 22 bp, Homo sapiens
ccagctccactgtcagatgaga

SEQ ID NO: 8012951 - DNA, 22 bp, Homo sapiens
ccagctccactgtcagatgaga

SEQ ID NO: 8012952 - DNA, 22 bp, Homo sapiens
ccagctccagcatagccaccat

SEQ ID NO: 8012953 - DNA, 22 bp, Homo sapiens
ccagctccagcatagccaccat

SEQ ID NO: 8012954 - DNA, 22 bp, Homo sapiens
ccagctccagcatagccaccat

SEQ ID NO: 8012955 - DNA, 22 bp, Homo sapiens
ccagctccagcatagccaccat

SEQ ID NO: 8012956 - DNA, 22 bp, Homo sapiens
ccagctccagcatagccaccat

SEQ ID NO: 8012957 - DNA, 21 bp, Homo sapiens
ccagctccaggaccttggatc

SEQ ID NO: 8012958 - DNA, 21 bp, Homo sapiens
ccagctccaggaccttggatc

SEQ ID NO: 8012959 - DNA, 21 bp, Homo sapiens
ccagctccaggaccttggatc

SEQ ID NO: 8012960 - DNA, 21 bp, Homo sapiens
ccagctccaggaccttggatc

SEQ ID NO: 8012961 - DNA, 22 bp, Homo sapiens
ccagctcatctcagtgaaatgc

SEQ ID NO: 8012962 - DNA, 22 bp, Homo sapiens
ccagctccaagtttgggcatca

SEQ ID NO: 8012963 - DNA, 22 bp, Homo sapiens
ccagctcagggtcacatggcac

SEQ ID NO: 8012964 - DNA, 22 bp, Homo sapiens
ccagctcagggtcacatggcac

SEQ ID NO: 8012965 - DNA, 22 bp, Homo sapiens
ccagctcagggtcacatggcac

SEQ ID NO: 8012966 - DNA, 23 bp, Homo sapiens
ccagctcatccattacctctctt

SEQ ID NO: 8012967 - DNA, 22 bp, Homo sapiens
ccagctagtaagcacctgcatc

SEQ ID NO: 8012968 - DNA, 22 bp, Homo sapiens
ccagctagtaagcacctgcatc

SEQ ID NO: 8012969 - DNA, 23 bp, Homo sapiens
ccagcgctcactcagagcatgtt

SEQ ID NO: 8012970 - DNA, 22 bp, Homo sapiens
ccagcgcttcccatcagggagg

SEQ ID NO: 8012971 - DNA, 22 bp, Homo sapiens
ccagcgttactattactgacac

SEQ ID NO: 8012972 - DNA, 22 bp, Homo sapiens
tctgataagtggtgtatactgt

SEQ ID NO: 8012973 - DNA, 22 bp, Homo sapiens
tctgataagacagctgatttga

SEQ ID NO: 8012974 - DNA, 22 bp, Homo sapiens
tctgataagacagctgatttga

SEQ ID NO: 8012975 - DNA, 22 bp, Homo sapiens
tctgataacaaccatgtctggc

SEQ ID NO: 8012976 - DNA, 22 bp, Homo sapiens
tctgagtttaggaccaggctga

SEQ ID NO: 8012977 - DNA, 22 bp, Homo sapiens
tctgagtttaggaccaggctga

SEQ ID NO: 8012978 - DNA, 22 bp, Homo sapiens
tctgataaatgccatctttttg

SEQ ID NO: 8012979 - DNA, 22 bp, Homo sapiens
tctgataaatgccatctttttg

SEQ ID NO: 8012980 - DNA, 22 bp, Homo sapiens
tctgataaatgccatctttttg

SEQ ID NO: 8012981 - DNA, 22 bp, Homo sapiens
tctgagtgatcagatgcattgc

SEQ ID NO: 8012982 - DNA, 22 bp, Homo sapiens
tctgagtgagtgtaggcctgac

SEQ ID NO: 8012983 - DNA, 22 bp, Homo sapiens
tctgagttcataccaggctacc

SEQ ID NO: 8012984 - DNA, 23 bp, Homo sapiens
tctgagtgattagcctctggggt

SEQ ID NO: 8012985 - DNA, 22 bp, Homo sapiens
tctgagtgggaactctcatgac

SEQ ID NO: 8012986 - DNA, 22 bp, Homo sapiens
tctgagtggactgtcctgcagg

SEQ ID NO: 8012987 - DNA, 22 bp, Homo sapiens
ccagcctggggaggcagcttct

SEQ ID NO: 8012988 - DNA, 22 bp, Homo sapiens
ccagcctggggaggcagcttct

SEQ ID NO: 8012989 - DNA, 22 bp, Homo sapiens
ccagcctggggaggcagcttct

SEQ ID NO: 8012990 - DNA, 22 bp, Homo sapiens
ccagcctggagggcagtggtgg

SEQ ID NO: 8012991 - DNA, 22 bp, Homo sapiens
ccagcctggagggcagtggtgg

SEQ ID NO: 8012992 - DNA, 22 bp, Homo sapiens
ccagcctggagggcagtggtgg

SEQ ID NO: 8012993 - DNA, 22 bp, Homo sapiens
ccagcctggagggcagtggtgg

SEQ ID NO: 8012994 - DNA, 22 bp, Homo sapiens
ccagcctggagggcagtggtgg

SEQ ID NO: 8012995 - DNA, 22 bp, Homo sapiens
ccagcctggactgggtcttgtg

SEQ ID NO: 8012996 - DNA, 22 bp, Homo sapiens
ccagcctggagggcagtggtgg

SEQ ID NO: 8012997 - DNA, 22 bp, Homo sapiens
ccagcctggagggcagtggtgg

SEQ ID NO: 8012998 - DNA, 22 bp, Homo sapiens
ccagcctggagggcagtggtgg

SEQ ID NO: 8012999 - DNA, 22 bp, Homo sapiens
ccagcctggagggcagtggtgg

SEQ ID NO: 8013000 - DNA, 22 bp, Homo sapiens
ccagcctggagggcagtggtgg

SEQ ID NO: 8013001 - DNA, 22 bp, Homo sapiens
tctgataggtggtagaaggagg

SEQ ID NO: 8013002 - DNA, 22 bp, Homo sapiens
tctgataatggacttctcatct

SEQ ID NO: 8013003 - DNA, 22 bp, Homo sapiens
tctgataatgtgcttcgtgacc

SEQ ID NO: 8013004 - DNA, 21 bp, Homo sapiens
ccagcctcagatcagggagct

SEQ ID NO: 8013005 - DNA, 21 bp, Homo sapiens
ccagcctcagatcagggagct

SEQ ID NO: 8013006 - DNA, 22 bp, Homo sapiens
ccagcctcatcatattcctgct

SEQ ID NO: 8013007 - DNA, 22 bp, Homo sapiens
ccagcctggactgggtcttgtg

SEQ ID NO: 8013008 - DNA, 22 bp, Homo sapiens
ccagcctggactgggtcttgtg

SEQ ID NO: 8013009 - DNA, 22 bp, Homo sapiens
ccagcctcatcatattcctgct

SEQ ID NO: 8013010 - DNA, 22 bp, Homo sapiens
tctctctgtgacagctttgctg

SEQ ID NO: 8013011 - DNA, 19 bp, Homo sapiens
tctctctgtacattagata

SEQ ID NO: 8013012 - DNA, 16 bp, Homo sapiens
tctctctgtatttgct

SEQ ID NO: 8013013 - DNA, 23 bp, Homo sapiens
tctctcttagctatgcttatggc

SEQ ID NO: 8013014 - DNA, 23 bp, Homo sapiens
tctctcttagctatgcttatggc

SEQ ID NO: 8013015 - DNA, 23 bp, Homo sapiens
tctctcttagctatgcttatggc

SEQ ID NO: 8013016 - DNA, 22 bp, Homo sapiens
tctctcttcaacccttaactag

SEQ ID NO: 8013017 - DNA, 22 bp, Homo sapiens
tctctcttcaacccttaactag

SEQ ID NO: 8013018 - DNA, 22 bp, Homo sapiens
tctctcttcagagataccttgc

SEQ ID NO: 8013019 - DNA, 22 bp, Homo sapiens
tctctcttgtcaccccatctgc

SEQ ID NO: 8013020 - DNA, 22 bp, Homo sapiens
tctctcttgtcaccccatctgc

SEQ ID NO: 8013021 - DNA, 22 bp, Homo sapiens
tctctcttgaagtattagctag

SEQ ID NO: 8013022 - DNA, 22 bp, Homo sapiens
tctctcttgaagtattagctag

SEQ ID NO: 8013023 - DNA, 22 bp, Homo sapiens
tctctcttgaagtattagctag

SEQ ID NO: 8013024 - DNA, 22 bp, Homo sapiens
tctctcttcagagataccttgc

SEQ ID NO: 8013025 - DNA, 22 bp, Homo sapiens
tctctcttcatgcttttagaat

SEQ ID NO: 8013026 - DNA, 22 bp, Homo sapiens
tctctcttctttgttaagaatg

SEQ ID NO: 8013027 - DNA, 22 bp, Homo sapiens
tctctcttctttgttaagaatg

SEQ ID NO: 8013028 - DNA, 22 bp, Homo sapiens
tctctcttgaagtattagctag

SEQ ID NO: 8013029 - DNA, 22 bp, Homo sapiens
tctcttggacatgtggctctgc

SEQ ID NO: 8013030 - DNA, 22 bp, Homo sapiens
tctcttggaacacttgctctta

SEQ ID NO: 8013031 - DNA, 22 bp, Homo sapiens
tctcttggaaagcttgcccact

SEQ ID NO: 8013032 - DNA, 18 bp, Homo sapiens
tctcttgcatcttctgta

SEQ ID NO: 8013033 - DNA, 22 bp, Homo sapiens
tctcttgatgttcccagacagc

SEQ ID NO: 8013034 - DNA, 18 bp, Homo sapiens
tctcttgcatcttctgta

SEQ ID NO: 8013035 - DNA, 22 bp, Homo sapiens
tctcttgatatattacatagag

SEQ ID NO: 8013036 - DNA, 22 bp, Homo sapiens
tctcttgatgttcccagacagc

SEQ ID NO: 8013037 - DNA, 22 bp, Homo sapiens
tctcttggaggttcttcctgtt

SEQ ID NO: 8013038 - DNA, 22 bp, Homo sapiens
tctcttggaggttcttcctgtt

SEQ ID NO: 8013039 - DNA, 22 bp, Homo sapiens
tctcttggaggttcttcctgtt

SEQ ID NO: 8013040 - DNA, 22 bp, Homo sapiens
tctcttgggaggaaagagagaa

SEQ ID NO: 8013041 - DNA, 22 bp, Homo sapiens
tctcttgggaggaaagagagaa

SEQ ID NO: 8013042 - DNA, 22 bp, Homo sapiens
tctcttgggaggaaagagagaa

SEQ ID NO: 8013043 - DNA, 22 bp, Homo sapiens
tctcttgaagattgaagacaaa

SEQ ID NO: 8013044 - DNA, 22 bp, Homo sapiens
tctcttctttggggtgggctca

SEQ ID NO: 8013045 - DNA, 22 bp, Homo sapiens
tctcttaataagtaaatactga

SEQ ID NO: 8013046 - DNA, 22 bp, Homo sapiens
tctcttaataagtaaatactga

SEQ ID NO: 8013047 - DNA, 22 bp, Homo sapiens
tctcttaataagtaaatactga

SEQ ID NO: 8013048 - DNA, 22 bp, Homo sapiens
tctcttaataagtaaatactga

SEQ ID NO: 8013049 - DNA, 22 bp, Homo sapiens
tctcttaataagtaaatactga

SEQ ID NO: 8013050 - DNA, 22 bp, Homo sapiens
tctcttaactggttcagcaatt

SEQ ID NO: 8013051 - DNA, 22 bp, Homo sapiens
tctcttaactggttcagcaatt

SEQ ID NO: 8013052 - DNA, 22 bp, Homo sapiens
tctcttgactgctaaaattaga

SEQ ID NO: 8013053 - DNA, 22 bp, Homo sapiens
tctcttgactgctaaaattaga

SEQ ID NO: 8013054 - DNA, 19 bp, Homo sapiens
tctcttgaataggtcaaac

SEQ ID NO: 8013055 - DNA, 22 bp, Homo sapiens
tctcttgaagattgaagacaaa

SEQ ID NO: 8013056 - DNA, 22 bp, Homo sapiens
tctcttgatatattacatagag

SEQ ID NO: 8013057 - DNA, 22 bp, Homo sapiens
tctcttgatatattacatagag

SEQ ID NO: 8013058 - DNA, 22 bp, Homo sapiens
tctcttaatccggtgctttctg

SEQ ID NO: 8013059 - DNA, 22 bp, Homo sapiens
tctcttgaagattgaagacaaa

SEQ ID NO: 8013060 - DNA, 22 bp, Homo sapiens
tctcttgactgctaaaattaga

SEQ ID NO: 8013061 - DNA, 22 bp, Homo sapiens
tctcttgagctcagttctgatg

SEQ ID NO: 8013062 - DNA, 22 bp, Homo sapiens
tctcttgactgctaaaattaga

SEQ ID NO: 8013063 - DNA, 22 bp, Homo sapiens
ccagccagtatattccaaagcc

SEQ ID NO: 8013064 - DNA, 22 bp, Homo sapiens
ccagccagtccagcattggtgt

SEQ ID NO: 8013065 - DNA, 22 bp, Homo sapiens
ccagccagtcccgcatgaccgc

SEQ ID NO: 8013066 - DNA, 22 bp, Homo sapiens
ccagccagtcccgcatgaccgc

SEQ ID NO: 8013067 - DNA, 22 bp, Homo sapiens
ccagccagtcccgcatgaccgc

SEQ ID NO: 8013068 - DNA, 22 bp, Homo sapiens
ccagccagtcccgcatgaccgc

SEQ ID NO: 8013069 - DNA, 22 bp, Homo sapiens
ccagccagtcccgcatgaccgc

SEQ ID NO: 8013070 - DNA, 22 bp, Homo sapiens
ccagccataaacccagatgact

SEQ ID NO: 8013071 - DNA, 22 bp, Homo sapiens
ccagccataaacccagatgact

SEQ ID NO: 8013072 - DNA, 22 bp, Homo sapiens
ccagccataaacccagatgact

SEQ ID NO: 8013073 - DNA, 22 bp, Homo sapiens
ccagccactgggccactgccag

SEQ ID NO: 8013074 - DNA, 22 bp, Homo sapiens
ccagccactgggccactgccag

SEQ ID NO: 8013075 - DNA, 22 bp, Homo sapiens
ccagccactgggccactgccag

SEQ ID NO: 8013076 - DNA, 22 bp, Homo sapiens
ccagccacgaagctcccttcat

SEQ ID NO: 8013077 - DNA, 22 bp, Homo sapiens
ccagccactgggccactgccag

SEQ ID NO: 8013078 - DNA, 22 bp, Homo sapiens
ccagccacgaagctcccttcat

SEQ ID NO: 8013079 - DNA, 22 bp, Homo sapiens
tctgaaatcctttatcttggct

SEQ ID NO: 8013080 - DNA, 22 bp, Homo sapiens
tctgaaatctaatgctctgtgg

SEQ ID NO: 8013081 - DNA, 22 bp, Homo sapiens
tctgaaatcctttatcttggct

SEQ ID NO: 8013082 - DNA, 22 bp, Homo sapiens
tctgaaatctgtaagcactagc

SEQ ID NO: 8013083 - DNA, 22 bp, Homo sapiens
tctgaaatctaatgctctgtgg

SEQ ID NO: 8013084 - DNA, 22 bp, Homo sapiens
tctgaaatctgtaagcactagc

SEQ ID NO: 8013085 - DNA, 22 bp, Homo sapiens
tctgaaatctgtaagcactagc

SEQ ID NO: 8013086 - DNA, 22 bp, Homo sapiens
tctgaaatatattttgagtgtt

SEQ ID NO: 8013087 - DNA, 22 bp, Homo sapiens
tctgaaatctgtaagcactagc

SEQ ID NO: 8013088 - DNA, 22 bp, Homo sapiens
tctgaaataggaaagcaaatgg

SEQ ID NO: 8013089 - DNA, 22 bp, Homo sapiens
tctgaaataggaaagcaaatgg

SEQ ID NO: 8013090 - DNA, 22 bp, Homo sapiens
tctgaaataggaaagcaaatgg

SEQ ID NO: 8013091 - DNA, 22 bp, Homo sapiens
tctgaaataggaaagcaaatgg

SEQ ID NO: 8013092 - DNA, 22 bp, Homo sapiens
tctcttggtgacttaaaatgtt

SEQ ID NO: 8013093 - DNA, 22 bp, Homo sapiens
tctcttggtgatagtctttctt

SEQ ID NO: 8013094 - DNA, 22 bp, Homo sapiens
tctcttggtgacttaaaatgtt

SEQ ID NO: 8013095 - DNA, 22 bp, Homo sapiens
tctcttggtacacagatgatca

SEQ ID NO: 8013096 - DNA, 22 bp, Homo sapiens
tctcttgggaggaaagagagaa

SEQ ID NO: 8013097 - DNA, 22 bp, Homo sapiens
tctcttggggaaagagaagaat

SEQ ID NO: 8013098 - DNA, 22 bp, Homo sapiens
tctgaaataggcttcttttggt

SEQ ID NO: 8013099 - DNA, 22 bp, Homo sapiens
tctgaaataggagccatgtaga

SEQ ID NO: 8013100 - DNA, 22 bp, Homo sapiens
tctgaaataggagccatgtaga

SEQ ID NO: 8013101 - DNA, 22 bp, Homo sapiens
tctgaaatatattttgagtgtt

SEQ ID NO: 8013102 - DNA, 22 bp, Homo sapiens
tctgaaatatattttgagtgtt

SEQ ID NO: 8013103 - DNA, 22 bp, Homo sapiens
tctgaaataggcttcttttggt

SEQ ID NO: 8013104 - DNA, 22 bp, Homo sapiens
tctgaaataggcttcttttggt

SEQ ID NO: 8013105 - DNA, 22 bp, Homo sapiens
tctgaaatattggtaatacttt

SEQ ID NO: 8013106 - DNA, 22 bp, Homo sapiens
tctgaaatatattttgagtgtt

SEQ ID NO: 8013107 - DNA, 22 bp, Homo sapiens
tctgaaatattggtaatacttt

SEQ ID NO: 8013108 - DNA, 22 bp, Homo sapiens
tctgaaatattggtaatacttt

SEQ ID NO: 8013109 - DNA, 22 bp, Homo sapiens
tctgagattaagcagagatgga

SEQ ID NO: 8013110 - DNA, 22 bp, Homo sapiens
tctgagatccttgtgttgtttt

SEQ ID NO: 8013111 - DNA, 22 bp, Homo sapiens
tctgagagtctttcttcaagtg

SEQ ID NO: 8013112 - DNA, 22 bp, Homo sapiens
tctgagagtctttcttcaagtg

SEQ ID NO: 8013113 - DNA, 22 bp, Homo sapiens
tctgagagtctttcttcaagtg

SEQ ID NO: 8013114 - DNA, 22 bp, Homo sapiens
ccagccctcactgaggcctctc

SEQ ID NO: 8013115 - DNA, 22 bp, Homo sapiens
ccagccctcactgaggcctctc

SEQ ID NO: 8013116 - DNA, 20 bp, Homo sapiens
tctgagagtctgagtgatga

SEQ ID NO: 8013117 - DNA, 20 bp, Homo sapiens
tctgagagtctgagtgatga

SEQ ID NO: 8013118 - DNA, 22 bp, Homo sapiens
tctgaggagttgggccagtgct

SEQ ID NO: 8013119 - DNA, 22 bp, Homo sapiens
tctgaggagttgggccagtgct

SEQ ID NO: 8013120 - DNA, 22 bp, Homo sapiens
tctgaggatctgaagggaacag

SEQ ID NO: 8013121 - DNA, 22 bp, Homo sapiens
tctgaggacctactgaagagtt

SEQ ID NO: 8013122 - DNA, 22 bp, Homo sapiens
tctgaggacctactgaagagtt

SEQ ID NO: 8013123 - DNA, 22 bp, Homo sapiens
tctgaggcagcttgccactcta

SEQ ID NO: 8013124 - DNA, 22 bp, Homo sapiens
tctgaggcagcttgccactcta

SEQ ID NO: 8013125 - DNA, 22 bp, Homo sapiens
tctgaggcagcttgccactcta

SEQ ID NO: 8013126 - DNA, 22 bp, Homo sapiens
tctgaggcaaacagaggagtgt

SEQ ID NO: 8013127 - DNA, 22 bp, Homo sapiens
tctgaggcaaacagaggagtgt

SEQ ID NO: 8013128 - DNA, 22 bp, Homo sapiens
tctgaggcaaacagaggagtgt

SEQ ID NO: 8013129 - DNA, 22 bp, Homo sapiens
tctgaggcccagttcaactctt

SEQ ID NO: 8013130 - DNA, 22 bp, Homo sapiens
tctgaggcccagttcaactctt

SEQ ID NO: 8013131 - DNA, 22 bp, Homo sapiens
tctgaggcccagttcaactctt

SEQ ID NO: 8013132 - DNA, 22 bp, Homo sapiens
tctgaggcccagttcaactctt

SEQ ID NO: 8013133 - DNA, 22 bp, Homo sapiens
tctgaggcatacccaggccccc

SEQ ID NO: 8013134 - DNA, 22 bp, Homo sapiens
tctgaggcatttaattatgacc

SEQ ID NO: 8013135 - DNA, 22 bp, Homo sapiens
tctgaggcatacccaggccccc

SEQ ID NO: 8013136 - DNA, 22 bp, Homo sapiens
tctgaggcatacccaggccccc

SEQ ID NO: 8013137 - DNA, 22 bp, Homo sapiens
tctgaggcataacctgttctgc

SEQ ID NO: 8013138 - DNA, 22 bp, Homo sapiens
tctgaggcataacctgttctgc

SEQ ID NO: 8013139 - DNA, 22 bp, Homo sapiens
tctgaggcataacctgttctgc

SEQ ID NO: 8013140 - DNA, 22 bp, Homo sapiens
tctgaggccccagccctgcaca

SEQ ID NO: 8013141 - DNA, 22 bp, Homo sapiens
tctgaggccccagccctgcaca

SEQ ID NO: 8013142 - DNA, 22 bp, Homo sapiens
tctgaggccccagccctgcaca

SEQ ID NO: 8013143 - DNA, 22 bp, Homo sapiens
tctgaggcccctgggcaggatg

SEQ ID NO: 8013144 - DNA, 22 bp, Homo sapiens
tctgaggcccctgggcaggatg

SEQ ID NO: 8013145 - DNA, 22 bp, Homo sapiens
tctgaggcccctgggcaggatg

SEQ ID NO: 8013146 - DNA, 22 bp, Homo sapiens
tctgaggcccctgggcaggatg

SEQ ID NO: 8013147 - DNA, 22 bp, Homo sapiens
tctgaggttttcatgttttctg

SEQ ID NO: 8013148 - DNA, 22 bp, Homo sapiens
tctgaggttgaactttgcaaag

SEQ ID NO: 8013149 - DNA, 22 bp, Homo sapiens
tctgaggttctgttttcaactg

SEQ ID NO: 8013150 - DNA, 22 bp, Homo sapiens
tctgaggttctgttttcaactg

SEQ ID NO: 8013151 - DNA, 22 bp, Homo sapiens
tctgaggttccctcaactacct

SEQ ID NO: 8013152 - DNA, 22 bp, Homo sapiens
tctgaggcccctgggcaggatg

SEQ ID NO: 8013153 - DNA, 22 bp, Homo sapiens
tctgaggccctaccctgagcct

SEQ ID NO: 8013154 - DNA, 22 bp, Homo sapiens
ccagcccaaacaagccgccttc

SEQ ID NO: 8013155 - DNA, 22 bp, Homo sapiens
ccagcccaaacaagccgccttc

SEQ ID NO: 8013156 - DNA, 22 bp, Homo sapiens
ccagcccaaagtcaccccggga

SEQ ID NO: 8013157 - DNA, 22 bp, Homo sapiens
ccagcccaaagtcaccccggga

SEQ ID NO: 8013158 - DNA, 22 bp, Homo sapiens
ccagccatgggccacctagctg

SEQ ID NO: 8013159 - DNA, 22 bp, Homo sapiens
ccagccataatacgaacccagc

SEQ ID NO: 8013160 - DNA, 22 bp, Homo sapiens
ccagccatgggccacctagctg

SEQ ID NO: 8013161 - DNA, 22 bp, Homo sapiens
ccagccatgggccacctagctg

SEQ ID NO: 8013162 - DNA, 22 bp, Homo sapiens
ccagcccaaacaagccgccttc

SEQ ID NO: 8013163 - DNA, 22 bp, Homo sapiens
ccagcccaaacaagccgccttc

SEQ ID NO: 8013164 - DNA, 22 bp, Homo sapiens
ccagccatgcacaaaccatgag

SEQ ID NO: 8013165 - DNA, 21 bp, Homo sapiens
ccagcccagctgtgtcccagc

SEQ ID NO: 8013166 - DNA, 19 bp, Homo sapiens
ccagcccatagtccatcac

SEQ ID NO: 8013167 - DNA, 21 bp, Homo sapiens
ccagcccagctgtgtcccagc

SEQ ID NO: 8013168 - DNA, 21 bp, Homo sapiens
ccagcccagctgtgtcccagc

SEQ ID NO: 8013169 - DNA, 21 bp, Homo sapiens
ccagcccagctgtgtcccagc

SEQ ID NO: 8013170 - DNA, 21 bp, Homo sapiens
ccagcccagcctccttctctt

SEQ ID NO: 8013171 - DNA, 21 bp, Homo sapiens
ccagcccagctgtgtcccagc

SEQ ID NO: 8013172 - DNA, 21 bp, Homo sapiens
ccagcccagctgtgtcccagc

SEQ ID NO: 8013173 - DNA, 19 bp, Homo sapiens
ccagcccacagtgactttc

SEQ ID NO: 8013174 - DNA, 19 bp, Homo sapiens
ccagcccacagtgactttc

SEQ ID NO: 8013175 - DNA, 19 bp, Homo sapiens
ccagcccacagtgactttc

SEQ ID NO: 8013176 - DNA, 21 bp, Homo sapiens
ccagcccagcctccttctctt

SEQ ID NO: 8013177 - DNA, 21 bp, Homo sapiens
ccagcccagcctccttctctt

SEQ ID NO: 8013178 - DNA, 19 bp, Homo sapiens
ccagcccatagtccatcac

SEQ ID NO: 8013179 - DNA, 19 bp, Homo sapiens
ccagcccatagtccatcac

SEQ ID NO: 8013180 - DNA, 22 bp, Homo sapiens
ccagcccatgcccttatagcat

SEQ ID NO: 8013181 - DNA, 19 bp, Homo sapiens
ccagcccatagtccatcac

SEQ ID NO: 8013182 - DNA, 22 bp, Homo sapiens
ccagccccgggaacctggccgt

SEQ ID NO: 8013183 - DNA, 22 bp, Homo sapiens
ccagccccgggaacctggccgt

SEQ ID NO: 8013184 - DNA, 22 bp, Homo sapiens
ccagccccgggaacctggccgt

SEQ ID NO: 8013185 - DNA, 19 bp, Homo sapiens
ccagcccatagtccatcac

SEQ ID NO: 8013186 - DNA, 22 bp, Homo sapiens
ccagccccgggaacctggccgt

SEQ ID NO: 8013187 - DNA, 22 bp, Homo sapiens
ccagcccatgcccttatagcat

SEQ ID NO: 8013188 - DNA, 22 bp, Homo sapiens
ccagcccctatcctcgctccac

SEQ ID NO: 8013189 - DNA, 22 bp, Homo sapiens
ccagcccctatcctcgctccac

SEQ ID NO: 8013190 - DNA, 22 bp, Homo sapiens
ccagcccctatcctcgctccac

SEQ ID NO: 8013191 - DNA, 22 bp, Homo sapiens
ccagcccctatcctcgctccac

SEQ ID NO: 8013192 - DNA, 22 bp, Homo sapiens
ccagcccctatcctcgctccac

SEQ ID NO: 8013193 - DNA, 22 bp, Homo sapiens
ccagccccgggccttaccgtgc

SEQ ID NO: 8013194 - DNA, 22 bp, Homo sapiens
ccagccccgggccttaccgtgc

SEQ ID NO: 8013195 - DNA, 22 bp, Homo sapiens
ccagccccgggaacctggccgt

SEQ ID NO: 8013196 - DNA, 22 bp, Homo sapiens
ccagccccgggaacctggccgt

SEQ ID NO: 8013197 - DNA, 22 bp, Homo sapiens
ccagccccgggaacctggccgt

SEQ ID NO: 8013198 - DNA, 22 bp, Homo sapiens
tctgcgccctgtcgcctgctcc

SEQ ID NO: 8013199 - DNA, 22 bp, Homo sapiens
tctgccttttcactgccactaa

SEQ ID NO: 8013200 - DNA, 22 bp, Homo sapiens
tctgccttttcactgccactaa

SEQ ID NO: 8013201 - DNA, 22 bp, Homo sapiens
tctgcgcgctgctggtaccgaa

SEQ ID NO: 8013202 - DNA, 22 bp, Homo sapiens
tctgcgtggctgctgtgagcgt

SEQ ID NO: 8013203 - DNA, 22 bp, Homo sapiens
tctgcgtggcgtggttctgtgc

SEQ ID NO: 8013204 - DNA, 22 bp, Homo sapiens
tctgcgtgatgagggtgcagca

SEQ ID NO: 8013205 - DNA, 22 bp, Homo sapiens
tctgcgtgaatttgcattgtgg

SEQ ID NO: 8013206 - DNA, 22 bp, Homo sapiens
tctgcctttgctttggctgtca

SEQ ID NO: 8013207 - DNA, 22 bp, Homo sapiens
tctgcctttgctttggctgtca

SEQ ID NO: 8013208 - DNA, 22 bp, Homo sapiens
tctgcctttcccaggctactgt

SEQ ID NO: 8013209 - DNA, 22 bp, Homo sapiens
tctgcctttctcaagggcaaaa

SEQ ID NO: 8013210 - DNA, 22 bp, Homo sapiens
tctgccttttactagctggatg

SEQ ID NO: 8013211 - DNA, 22 bp, Homo sapiens
tctgccttttactagctggatg

SEQ ID NO: 8013212 - DNA, 22 bp, Homo sapiens
tctgccttttactagctggatg

SEQ ID NO: 8013213 - DNA, 22 bp, Homo sapiens
tctgcctttgtggtcgggagaa

SEQ ID NO: 8013214 - DNA, 22 bp, Homo sapiens
tctgccttgttgcaggcgctat

SEQ ID NO: 8013215 - DNA, 22 bp, Homo sapiens
tctgccttgttgcaggcgctat

SEQ ID NO: 8013216 - DNA, 22 bp, Homo sapiens
tctgccttgtttgagctttgac

SEQ ID NO: 8013217 - DNA, 22 bp, Homo sapiens
tctgccttgtttgagctttgac

SEQ ID NO: 8013218 - DNA, 22 bp, Homo sapiens
tctgcctttcacacagacggcc

SEQ ID NO: 8013219 - DNA, 22 bp, Homo sapiens
tctgcctctttcaggcctggca

SEQ ID NO: 8013220 - DNA, 19 bp, Homo sapiens
tctgcctctggtcaggctc

SEQ ID NO: 8013221 - DNA, 22 bp, Homo sapiens
tctgcctctttcaggcctggca

SEQ ID NO: 8013222 - DNA, 22 bp, Homo sapiens
tctgcctctttcaggcctggca

SEQ ID NO: 8013223 - DNA, 22 bp, Homo sapiens
tctgcctctttcaggcctggca

SEQ ID NO: 8013224 - DNA, 19 bp, Homo sapiens
tctgcctctggtcaggctc

SEQ ID NO: 8013225 - DNA, 19 bp, Homo sapiens
tctgcctctggtcaggctc

SEQ ID NO: 8013226 - DNA, 22 bp, Homo sapiens
tctgcctgaaattcacatgtaa

SEQ ID NO: 8013227 - DNA, 22 bp, Homo sapiens
tctgcctgaaattcacatgtaa

SEQ ID NO: 8013228 - DNA, 22 bp, Homo sapiens
tctgcctgaaattcacatgtaa

SEQ ID NO: 8013229 - DNA, 22 bp, Homo sapiens
tctgcctctttcaggcctggca

SEQ ID NO: 8013230 - DNA, 22 bp, Homo sapiens
tctgcctgaaattcacatgtaa

SEQ ID NO: 8013231 - DNA, 22 bp, Homo sapiens
tctgcctgaaattcacatgtaa

SEQ ID NO: 8013232 - DNA, 22 bp, Homo sapiens
tctgcctgagaagtggggtgcc

SEQ ID NO: 8013233 - DNA, 22 bp, Homo sapiens
tctgcctgaatctcttagaaca

SEQ ID NO: 8013234 - DNA, 22 bp, Homo sapiens
tctgcctgaaccactcttggag

SEQ ID NO: 8013235 - DNA, 22 bp, Homo sapiens
tctgcctgaatctcttagaaca

SEQ ID NO: 8013236 - DNA, 22 bp, Homo sapiens
tctgcctgaaccactcttggag

SEQ ID NO: 8013237 - DNA, 22 bp, Homo sapiens
tctgcctgaaccactcttggag

SEQ ID NO: 8013238 - DNA, 22 bp, Homo sapiens
tctgcctgaaccactcttggag

SEQ ID NO: 8013239 - DNA, 22 bp, Homo sapiens
tctgccttggcaaccacagctt

SEQ ID NO: 8013240 - DNA, 22 bp, Homo sapiens
tctgccttggaaatttcaacag

SEQ ID NO: 8013241 - DNA, 22 bp, Homo sapiens
tctgccttggcaaccacagctt

SEQ ID NO: 8013242 - DNA, 22 bp, Homo sapiens
tctgcctgaaccactcttggag

SEQ ID NO: 8013243 - DNA, 22 bp, Homo sapiens
tctgccttgccgaattccaggc

SEQ ID NO: 8013244 - DNA, 22 bp, Homo sapiens
tctgcctgagaagtggggtgcc

SEQ ID NO: 8013245 - DNA, 22 bp, Homo sapiens
tctgccttgccgaattccaggc

SEQ ID NO: 8013246 - DNA, 22 bp, Homo sapiens
tctgccttgccgaattccaggc

SEQ ID NO: 8013247 - DNA, 22 bp, Homo sapiens
tctgccttgccgaattccaggc

SEQ ID NO: 8013248 - DNA, 22 bp, Homo sapiens
ccagctggtctgtgctcatgtt

SEQ ID NO: 8013249 - DNA, 22 bp, Homo sapiens
ccagctggtctgtgctcatgtt

SEQ ID NO: 8013250 - DNA, 22 bp, Homo sapiens
ccagctggtctgtgctcatgtt

SEQ ID NO: 8013251 - DNA, 22 bp, Homo sapiens
ccagctggtctgtgctcatgtt

SEQ ID NO: 8013252 - DNA, 22 bp, Homo sapiens
ccagctggtctgtgctcatgtt

SEQ ID NO: 8013253 - DNA, 22 bp, Homo sapiens
ccagctggtctgtgctcatgtt

SEQ ID NO: 8013254 - DNA, 22 bp, Homo sapiens
ccagctggtctgtgctcatgtt

SEQ ID NO: 8013255 - DNA, 22 bp, Homo sapiens
ccagctggtctgtgctcatgtt

SEQ ID NO: 8013256 - DNA, 22 bp, Homo sapiens
ccagctggtgacatccccaacc

SEQ ID NO: 8013257 - DNA, 22 bp, Homo sapiens
ccagctggtgacatccccaacc

SEQ ID NO: 8013258 - DNA, 22 bp, Homo sapiens
ccagctggtgggtctttctctg

SEQ ID NO: 8013259 - DNA, 22 bp, Homo sapiens
ccagctggtgggtctttctctg

SEQ ID NO: 8013260 - DNA, 22 bp, Homo sapiens
ccagctggtgttccttaggacc

SEQ ID NO: 8013261 - DNA, 22 bp, Homo sapiens
ccagctggtgttccttaggacc

SEQ ID NO: 8013262 - DNA, 22 bp, Homo sapiens
tctggagccttggatgggaaag

SEQ ID NO: 8013263 - DNA, 19 bp, Homo sapiens
tctggagctgatgcaggtg

SEQ ID NO: 8013264 - DNA, 19 bp, Homo sapiens
tctggagctgatgcaggtg

SEQ ID NO: 8013265 - DNA, 21 bp, Homo sapiens
tctggagccctaagctgagaa

SEQ ID NO: 8013266 - DNA, 21 bp, Homo sapiens
tctggagccctaagctgagaa

SEQ ID NO: 8013267 - DNA, 22 bp, Homo sapiens
ccagctggttaaaatagagaaa

SEQ ID NO: 8013268 - DNA, 22 bp, Homo sapiens
ccagctggttaaaatagagaaa

SEQ ID NO: 8013269 - DNA, 22 bp, Homo sapiens
ccagctggttaaaatagagaaa

SEQ ID NO: 8013270 - DNA, 22 bp, Homo sapiens
ccagctggtgttccttaggacc

SEQ ID NO: 8013271 - DNA, 22 bp, Homo sapiens
ccagctggtgttccttaggacc

SEQ ID NO: 8013272 - DNA, 22 bp, Homo sapiens
ccagctggtgttccttaggacc

SEQ ID NO: 8013273 - DNA, 22 bp, Homo sapiens
ccagctgggattaagggaaaat

SEQ ID NO: 8013274 - DNA, 22 bp, Homo sapiens
ccagctggggaagtggggcata

SEQ ID NO: 8013275 - DNA, 22 bp, Homo sapiens
ccagctggggaagtggggcata

SEQ ID NO: 8013276 - DNA, 22 bp, Homo sapiens
ccagctggggaagtggggcata

SEQ ID NO: 8013277 - DNA, 22 bp, Homo sapiens
ccagctggggaagtggggcata

SEQ ID NO: 8013278 - DNA, 22 bp, Homo sapiens
ccagctggggaagtggggcata

SEQ ID NO: 8013279 - DNA, 22 bp, Homo sapiens
ccagctgggattaagggaaaat

SEQ ID NO: 8013280 - DNA, 22 bp, Homo sapiens
ccagctgggattaagggaaaat

SEQ ID NO: 8013281 - DNA, 22 bp, Homo sapiens
ccagctgctttttgtcacatgg

SEQ ID NO: 8013282 - DNA, 22 bp, Homo sapiens
ccagctgctttttgtcacatgg

SEQ ID NO: 8013283 - DNA, 22 bp, Homo sapiens
ccagctgctttttgtcacatgg

SEQ ID NO: 8013284 - DNA, 22 bp, Homo sapiens
ccagctgctttttgtcacatgg

SEQ ID NO: 8013285 - DNA, 22 bp, Homo sapiens
ccagctgctttttgtcacatgg

SEQ ID NO: 8013286 - DNA, 22 bp, Homo sapiens
tctgcgttgctcacgctgggag

SEQ ID NO: 8013287 - DNA, 22 bp, Homo sapiens
tctgctaacaatattgcagact

SEQ ID NO: 8013288 - DNA, 22 bp, Homo sapiens
ccagctgcttgggaaaatgtct

SEQ ID NO: 8013289 - DNA, 22 bp, Homo sapiens
ccagctgggtccctgctggggc

SEQ ID NO: 8013290 - DNA, 22 bp, Homo sapiens
ccagctgggtccctgctggggc

SEQ ID NO: 8013291 - DNA, 22 bp, Homo sapiens
ccagctggggaagtggggcata

SEQ ID NO: 8013292 - DNA, 22 bp, Homo sapiens
ccagctggtaagtgatggagcc

SEQ ID NO: 8013293 - DNA, 22 bp, Homo sapiens
ccagctggtaagtgatggagcc

SEQ ID NO: 8013294 - DNA, 22 bp, Homo sapiens
ccagctggtaagtgatggagcc

SEQ ID NO: 8013295 - DNA, 22 bp, Homo sapiens
ccagctggtaagtgatggagcc

SEQ ID NO: 8013296 - DNA, 22 bp, Homo sapiens
ccagctggtaagtgatggagcc

SEQ ID NO: 8013297 - DNA, 22 bp, Homo sapiens
ccagctggtaagtgatggagcc

SEQ ID NO: 8013298 - DNA, 22 bp, Homo sapiens
ccagctggtaagtgatggagcc

SEQ ID NO: 8013299 - DNA, 22 bp, Homo sapiens
ccagctggtaagtgatggagcc

SEQ ID NO: 8013300 - DNA, 22 bp, Homo sapiens
ccagctggtaagtgatggagcc

SEQ ID NO: 8013301 - DNA, 22 bp, Homo sapiens
tctggcttctcctagagcaatg

SEQ ID NO: 8013302 - DNA, 22 bp, Homo sapiens
tctggcttctcctagagcaatg

SEQ ID NO: 8013303 - DNA, 22 bp, Homo sapiens
tctggcttccctacttactatg

SEQ ID NO: 8013304 - DNA, 22 bp, Homo sapiens
tctggcttccctctgttctggg

SEQ ID NO: 8013305 - DNA, 22 bp, Homo sapiens
tctggcttctatgaatgtcctt

SEQ ID NO: 8013306 - DNA, 22 bp, Homo sapiens
tctggcttctatgaatgtcctt

SEQ ID NO: 8013307 - DNA, 22 bp, Homo sapiens
tctggcttcgcagctcccagcc

SEQ ID NO: 8013308 - DNA, 22 bp, Homo sapiens
tctggcttcccactctgccggg

SEQ ID NO: 8013309 - DNA, 22 bp, Homo sapiens
tctggcttccctacttactatg

SEQ ID NO: 8013310 - DNA, 23 bp, Homo sapiens
tctggcttccagtgggttcaacc

SEQ ID NO: 8013311 - DNA, 22 bp, Homo sapiens
tctggcttcagtagggttcact

SEQ ID NO: 8013312 - DNA, 22 bp, Homo sapiens
tctggcttcacactgaagtttg

SEQ ID NO: 8013313 - DNA, 22 bp, Homo sapiens
tctggctgttaggcctgacctt

SEQ ID NO: 8013314 - DNA, 22 bp, Homo sapiens
tctggctgttaggcctgacctt

SEQ ID NO: 8013315 - DNA, 22 bp, Homo sapiens
tctggctgttgttaggttcctg

SEQ ID NO: 8013316 - DNA, 22 bp, Homo sapiens
tctggctcatctctccaggtaa

SEQ ID NO: 8013317 - DNA, 22 bp, Homo sapiens
tctggctcatctctccaggtaa

SEQ ID NO: 8013318 - DNA, 22 bp, Homo sapiens
tctggctcatctctccaggtaa

SEQ ID NO: 8013319 - DNA, 22 bp, Homo sapiens
tctggctcataggaaggccatt

SEQ ID NO: 8013320 - DNA, 22 bp, Homo sapiens
tctggctgttttagatgagctc

SEQ ID NO: 8013321 - DNA, 22 bp, Homo sapiens
tctggctgttttagatgagctc

SEQ ID NO: 8013322 - DNA, 22 bp, Homo sapiens
tctggctgttttagatgagctc

SEQ ID NO: 8013323 - DNA, 22 bp, Homo sapiens
tctggctgttgttaggttcctg

SEQ ID NO: 8013324 - DNA, 22 bp, Homo sapiens
tctggctgttttagatgagctc

SEQ ID NO: 8013325 - DNA, 22 bp, Homo sapiens
tctggcttcaactttactgaaa

SEQ ID NO: 8013326 - DNA, 22 bp, Homo sapiens
tctggcttcaactttactgaaa

SEQ ID NO: 8013327 - DNA, 22 bp, Homo sapiens
tctggcttcaagtcccagctct

SEQ ID NO: 8013328 - DNA, 22 bp, Homo sapiens
tctggcttcacactgaagtttg

SEQ ID NO: 8013329 - DNA, 22 bp, Homo sapiens
tctggagcttgtttcagatggt

SEQ ID NO: 8013330 - DNA, 22 bp, Homo sapiens
tctggagcttgaagctttggtt

SEQ ID NO: 8013331 - DNA, 22 bp, Homo sapiens
tctggagcttgtttcagatggt

SEQ ID NO: 8013332 - DNA, 22 bp, Homo sapiens
tctggagcttgtttcagatggt

SEQ ID NO: 8013333 - DNA, 22 bp, Homo sapiens
tctggagcttgaagctttggtt

SEQ ID NO: 8013334 - DNA, 22 bp, Homo sapiens
tctggagcttgaagctttggtt

SEQ ID NO: 8013335 - DNA, 22 bp, Homo sapiens
tctggagcttgaagctttggtt

SEQ ID NO: 8013336 - DNA, 22 bp, Homo sapiens
tctggagcttgaagctttggtt

SEQ ID NO: 8013337 - DNA, 22 bp, Homo sapiens
tctggagcttgtttcagatggt

SEQ ID NO: 8013338 - DNA, 22 bp, Homo sapiens
tctggaggcaggctgccaggat

SEQ ID NO: 8013339 - DNA, 22 bp, Homo sapiens
tctggaggcaggctgccaggat

SEQ ID NO: 8013340 - DNA, 22 bp, Homo sapiens
tctggaggcaggctgccaggat

SEQ ID NO: 8013341 - DNA, 22 bp, Homo sapiens
tctggaggcaactaacctagtt

SEQ ID NO: 8013342 - DNA, 22 bp, Homo sapiens
tctggctcataggaaggccatt

SEQ ID NO: 8013343 - DNA, 22 bp, Homo sapiens
tctggctcatacaagcctgcaa

SEQ ID NO: 8013344 - DNA, 22 bp, Homo sapiens
tctggctcatacaagcctgcaa

SEQ ID NO: 8013345 - DNA, 22 bp, Homo sapiens
tctggctcatacaagcctgcaa

SEQ ID NO: 8013346 - DNA, 22 bp, Homo sapiens
tctggagctggagggcaaggca

SEQ ID NO: 8013347 - DNA, 21 bp, Homo sapiens
tctggagctgcaggctgggca

SEQ ID NO: 8013348 - DNA, 21 bp, Homo sapiens
tctggagctgcaggctgggca

SEQ ID NO: 8013349 - DNA, 19 bp, Homo sapiens
tctggagctgatgcaggtg

SEQ ID NO: 8013350 - DNA, 21 bp, Homo sapiens
tctggagctgcaggctgggca

SEQ ID NO: 8013351 - DNA, 22 bp, Homo sapiens
tctggagcgaggtccctgtctg

SEQ ID NO: 8013352 - DNA, 22 bp, Homo sapiens
tctggagctgggggcttagtat

SEQ ID NO: 8013353 - DNA, 22 bp, Homo sapiens
tctggagctgggggcttagtat

SEQ ID NO: 8013354 - DNA, 22 bp, Homo sapiens
tctggagctgggggcttagtat

SEQ ID NO: 8013355 - DNA, 22 bp, Homo sapiens
tctggagcttcctcatttacag

SEQ ID NO: 8013356 - DNA, 22 bp, Homo sapiens
tctggagctggcagggccctgg

SEQ ID NO: 8013357 - DNA, 22 bp, Homo sapiens
tctggagctggcagggccctgg

SEQ ID NO: 8013358 - DNA, 22 bp, Homo sapiens
tctggagctggagggcaaggca

SEQ ID NO: 8013359 - DNA, 22 bp, Homo sapiens
tctggcttgctggcttggtccc

SEQ ID NO: 8013360 - DNA, 22 bp, Homo sapiens
tctggcttgagcttcgaccagt

SEQ ID NO: 8013361 - DNA, 22 bp, Homo sapiens
tctggcttgagcttcgaccagt

SEQ ID NO: 8013362 - DNA, 22 bp, Homo sapiens
tctggcttgagcttcgaccagt

SEQ ID NO: 8013363 - DNA, 22 bp, Homo sapiens
tctggcttgaacaattaggtaa

SEQ ID NO: 8013364 - DNA, 22 bp, Homo sapiens
tctggcttctgcaggattacta

SEQ ID NO: 8013365 - DNA, 22 bp, Homo sapiens
tctggcttgagaggtaattatt

SEQ ID NO: 8013366 - DNA, 22 bp, Homo sapiens
tctggcttgagaggtaattatt

SEQ ID NO: 8013367 - DNA, 22 bp, Homo sapiens
tctggcttggcgctgccctctg

SEQ ID NO: 8013368 - DNA, 22 bp, Homo sapiens
tctggcttggacacaatcttcc

SEQ ID NO: 8013369 - DNA, 22 bp, Homo sapiens
tctggcttggacacaatcttcc

SEQ ID NO: 8013370 - DNA, 22 bp, Homo sapiens
tctggcttgtctcagggtctga

SEQ ID NO: 8013371 - DNA, 22 bp, Homo sapiens
tctggcttgggtaggtagttca

SEQ ID NO: 8013372 - DNA, 22 bp, Homo sapiens
tctggcttggctggcatctctg

SEQ ID NO: 8013373 - DNA, 22 bp, Homo sapiens
tctggcttggctggcatctctg

SEQ ID NO: 8013374 - DNA, 22 bp, Homo sapiens
tctggctttattccttcactga

SEQ ID NO: 8013375 - DNA, 22 bp, Homo sapiens
ccagctggtttatattccccac

SEQ ID NO: 8013376 - DNA, 22 bp, Homo sapiens
tctggctttattttcatcatct

SEQ ID NO: 8013377 - DNA, 22 bp, Homo sapiens
tctggcttgtgtccttccttgc

SEQ ID NO: 8013378 - DNA, 22 bp, Homo sapiens
tctggcttgtgtccttccttgc

SEQ ID NO: 8013379 - DNA, 22 bp, Homo sapiens
ccagctgtcactcagaaaggcc

SEQ ID NO: 8013380 - DNA, 22 bp, Homo sapiens
ccagctgtcactcagaaaggcc

SEQ ID NO: 8013381 - DNA, 22 bp, Homo sapiens
ccagctgtaggcagggggttta

SEQ ID NO: 8013382 - DNA, 22 bp, Homo sapiens
ccagctgtctggttccagagcc

SEQ ID NO: 8013383 - DNA, 22 bp, Homo sapiens
ccagctgtcagtgtgaaaataa

SEQ ID NO: 8013384 - DNA, 22 bp, Homo sapiens
ccagctgtcagtgtgaaaataa

SEQ ID NO: 8013385 - DNA, 22 bp, Homo sapiens
ccagctgtcactcagaaaggcc

SEQ ID NO: 8013386 - DNA, 23 bp, Homo sapiens
ccagctgtgcctggcccaggagc

SEQ ID NO: 8013387 - DNA, 22 bp, Homo sapiens
ccagctgtgctgttggcttgtc

SEQ ID NO: 8013388 - DNA, 23 bp, Homo sapiens
ccagctgtgcctggcccaggagc

SEQ ID NO: 8013389 - DNA, 22 bp, Homo sapiens
ccagctgtgcctaggagcaggg

SEQ ID NO: 8013390 - DNA, 22 bp, Homo sapiens
ccagctgtgctgttggcttgtc

SEQ ID NO: 8013391 - DNA, 21 bp, Homo sapiens
ccagctgttcctcgtccgatg

SEQ ID NO: 8013392 - DNA, 21 bp, Homo sapiens
ccagctgttcctcgtccgatg

SEQ ID NO: 8013393 - DNA, 22 bp, Homo sapiens
ccagctgttggagtttcactgc

SEQ ID NO: 8013394 - DNA, 22 bp, Homo sapiens
ccagctgtttctgatgctaggc

SEQ ID NO: 8013395 - DNA, 22 bp, Homo sapiens
ccagcttcatgggcatgcacca

SEQ ID NO: 8013396 - DNA, 22 bp, Homo sapiens
ccagcttcatgggcatgcacca

SEQ ID NO: 8013397 - DNA, 22 bp, Homo sapiens
ccagctgtttctgatgctaggc

SEQ ID NO: 8013398 - DNA, 22 bp, Homo sapiens
ccagctgttggagtttcactgc

SEQ ID NO: 8013399 - DNA, 22 bp, Homo sapiens
ccagctgttggagtttcactgc

SEQ ID NO: 8013400 - DNA, 22 bp, Homo sapiens
ccagctgtttctgatgctaggc

SEQ ID NO: 8013401 - DNA, 18 bp, Homo sapiens
ccagctgtgcagcatctg

SEQ ID NO: 8013402 - DNA, 22 bp, Homo sapiens
ccagctgtcttgagaggaggca

SEQ ID NO: 8013403 - DNA, 22 bp, Homo sapiens
ccagctgtcttgagaggaggca

SEQ ID NO: 8013404 - DNA, 21 bp, Homo sapiens
ccagctgtctgtccttaggca

SEQ ID NO: 8013405 - DNA, 21 bp, Homo sapiens
ccagctgtctgtccttaggca

SEQ ID NO: 8013406 - DNA, 22 bp, Homo sapiens
ccagctgtctggttccagagcc

SEQ ID NO: 8013407 - DNA, 22 bp, Homo sapiens
ccagctgtctggttccagagcc

SEQ ID NO: 8013408 - DNA, 22 bp, Homo sapiens
ccagctgtctggttccagagcc

SEQ ID NO: 8013409 - DNA, 22 bp, Homo sapiens
ccagctgtctggttccagagcc

SEQ ID NO: 8013410 - DNA, 22 bp, Homo sapiens
ccagctgtgccggggacctggg

SEQ ID NO: 8013411 - DNA, 22 bp, Homo sapiens
ccagctgtgccggggacctggg

SEQ ID NO: 8013412 - DNA, 18 bp, Homo sapiens
ccagctgtgcagcatctg

SEQ ID NO: 8013413 - DNA, 18 bp, Homo sapiens
ccagctgtgcagcatctg

SEQ ID NO: 8013414 - DNA, 18 bp, Homo sapiens
ccagctgtgcagcatctg

SEQ ID NO: 8013415 - DNA, 22 bp, Homo sapiens
ccagctgtgcctaggagcaggg

SEQ ID NO: 8013416 - DNA, 22 bp, Homo sapiens
ccagctgtgccgtgtggatagc

SEQ ID NO: 8013417 - DNA, 22 bp, Homo sapiens
ccagctgtgccggggacctggg

SEQ ID NO: 8013418 - DNA, 22 bp, Homo sapiens
ccaggaggcggaaggtacagtg

SEQ ID NO: 8013419 - DNA, 22 bp, Homo sapiens
ccaggaggcagaggttgtagtg

SEQ ID NO: 8013420 - DNA, 22 bp, Homo sapiens
ccaggaggcagaggttgtagtg

SEQ ID NO: 8013421 - DNA, 22 bp, Homo sapiens
ccaggaggcagaggttacagtg

SEQ ID NO: 8013422 - DNA, 22 bp, Homo sapiens
ccaggaggcagaggttacagtg

SEQ ID NO: 8013423 - DNA, 22 bp, Homo sapiens
ccaggaggcagaggttacagtg

SEQ ID NO: 8013424 - DNA, 22 bp, Homo sapiens
ccaggaggcagaggttacagtg

SEQ ID NO: 8013425 - DNA, 22 bp, Homo sapiens
ccaggaggcggaaggtacagtg

SEQ ID NO: 8013426 - DNA, 22 bp, Homo sapiens
ccaggaggcggaaggtacagtg

SEQ ID NO: 8013427 - DNA, 22 bp, Homo sapiens
ccaggaggcggaaggtacagtg

SEQ ID NO: 8013428 - DNA, 22 bp, Homo sapiens
ccaggaggcggaaggtacagtg

SEQ ID NO: 8013429 - DNA, 22 bp, Homo sapiens
ccaggaggcggaggttgcagcg

SEQ ID NO: 8013430 - DNA, 22 bp, Homo sapiens
ccaggaggcggaggttgcagcg

SEQ ID NO: 8013431 - DNA, 22 bp, Homo sapiens
ccaggaggcggaggttgcagcg

SEQ ID NO: 8013432 - DNA, 23 bp, Homo sapiens
tctgtcactttctgctgtggagt

SEQ ID NO: 8013433 - DNA, 22 bp, Homo sapiens
tctgtcagcccctcagctgtca

SEQ ID NO: 8013434 - DNA, 22 bp, Homo sapiens
tctgtcacttaagaattgccta

SEQ ID NO: 8013435 - DNA, 22 bp, Homo sapiens
tctgtcactattggccagaaca

SEQ ID NO: 8013436 - DNA, 22 bp, Homo sapiens
tctgtcactgagctcaggattc

SEQ ID NO: 8013437 - DNA, 22 bp, Homo sapiens
tctgtcactctagagatggcag

SEQ ID NO: 8013438 - DNA, 22 bp, Homo sapiens
tctgtcacccctgtttctggct

SEQ ID NO: 8013439 - DNA, 22 bp, Homo sapiens
tctgtcacccctgtttctggct

SEQ ID NO: 8013440 - DNA, 22 bp, Homo sapiens
tctgtcacccctgtttctggct

SEQ ID NO: 8013441 - DNA, 22 bp, Homo sapiens
tctgtcacccgagcaggcgaga

SEQ ID NO: 8013442 - DNA, 23 bp, Homo sapiens
tctgtcacctatggctgctcttc

SEQ ID NO: 8013443 - DNA, 18 bp, Homo sapiens
tctgtctgtacaagtatc

SEQ ID NO: 8013444 - DNA, 18 bp, Homo sapiens
tctgtctgtacaagtatc

SEQ ID NO: 8013445 - DNA, 21 bp, Homo sapiens
tctgtctggttttagagtggc

SEQ ID NO: 8013446 - DNA, 17 bp, Homo sapiens
tctgtctgtggtccact

SEQ ID NO: 8013447 - DNA, 22 bp, Homo sapiens
tctgtctgtccagggcccccgc

SEQ ID NO: 8013448 - DNA, 22 bp, Homo sapiens
tctgtctgggtgcctcgagtac

SEQ ID NO: 8013449 - DNA, 22 bp, Homo sapiens
tctgtcatccaggctggaatat

SEQ ID NO: 8013450 - DNA, 21 bp, Homo sapiens
tctgtctggttttagagtggc

SEQ ID NO: 8013451 - DNA, 22 bp, Homo sapiens
tctgtctgggtgcctcgagtac

SEQ ID NO: 8013452 - DNA, 22 bp, Homo sapiens
tctgtcttagccatctcaggct

SEQ ID NO: 8013453 - DNA, 22 bp, Homo sapiens
tctgtcttcatcagcatgtgat

SEQ ID NO: 8013454 - DNA, 22 bp, Homo sapiens
tctgtcttcatcagcatgtgat

SEQ ID NO: 8013455 - DNA, 22 bp, Homo sapiens
tctgtcttagccatctcaggct

SEQ ID NO: 8013456 - DNA, 22 bp, Homo sapiens
tctgtcttagccatctcaggct

SEQ ID NO: 8013457 - DNA, 22 bp, Homo sapiens
tctgtcttagcatctttgctca

SEQ ID NO: 8013458 - DNA, 22 bp, Homo sapiens
tctgtcttagcatctttgctca

SEQ ID NO: 8013459 - DNA, 18 bp, Homo sapiens
tctgtctgtgttgtcttt

SEQ ID NO: 8013460 - DNA, 18 bp, Homo sapiens
tctgtctgtgttgtcttt

SEQ ID NO: 8013461 - DNA, 17 bp, Homo sapiens
tctgtctgtggtccact

SEQ ID NO: 8013462 - DNA, 17 bp, Homo sapiens
tctgtctgtggtccact

SEQ ID NO: 8013463 - DNA, 23 bp, Homo sapiens
tctgtctgtgtatgtgcagaaag

SEQ ID NO: 8013464 - DNA, 23 bp, Homo sapiens
tctgtctgtgtatgtgcagaaag

SEQ ID NO: 8013465 - DNA, 21 bp, Homo sapiens
tctgtcttcctcagcctaagg

SEQ ID NO: 8013466 - DNA, 22 bp, Homo sapiens
tctgtcttctgtagctaataat

SEQ ID NO: 8013467 - DNA, 22 bp, Homo sapiens
tctgtcttctgtagctaataat

SEQ ID NO: 8013468 - DNA, 22 bp, Homo sapiens
tctgtcttctgtagctaataat

SEQ ID NO: 8013469 - DNA, 22 bp, Homo sapiens
tctgtcttcttcattgcctata

SEQ ID NO: 8013470 - DNA, 22 bp, Homo sapiens
tctgtcttcttcattgcctata

SEQ ID NO: 8013471 - DNA, 22 bp, Homo sapiens
tctgtcttcttcattgcctata

SEQ ID NO: 8013472 - DNA, 17 bp, Homo sapiens
tctgtcttgactgtcac

SEQ ID NO: 8013473 - DNA, 17 bp, Homo sapiens
tctgtcttgactgtcac

SEQ ID NO: 8013474 - DNA, 17 bp, Homo sapiens
tctgtcttgactgtcac

SEQ ID NO: 8013475 - DNA, 22 bp, Homo sapiens
tctgtcttggccagccatctgg

SEQ ID NO: 8013476 - DNA, 23 bp, Homo sapiens
tctgtcttgtttaggccactgtt

SEQ ID NO: 8013477 - DNA, 18 bp, Homo sapiens
tctgtggcagcagtgcac

SEQ ID NO: 8013478 - DNA, 20 bp, Homo sapiens
tctgtggcaggtggcgcttg

SEQ ID NO: 8013479 - DNA, 19 bp, Homo sapiens
tctgtggcacctgggaggg

SEQ ID NO: 8013480 - DNA, 22 bp, Homo sapiens
tctgtggcaaacacagtgacca

SEQ ID NO: 8013481 - DNA, 22 bp, Homo sapiens
tctgtctttagaggcctgtgct

SEQ ID NO: 8013482 - DNA, 22 bp, Homo sapiens
ccaggaagcctcagatgctgag

SEQ ID NO: 8013483 - DNA, 22 bp, Homo sapiens
ccaggaagcataatgtagtggg

SEQ ID NO: 8013484 - DNA, 22 bp, Homo sapiens
ccaggaagcataatgtagtggg

SEQ ID NO: 8013485 - DNA, 22 bp, Homo sapiens
ccaggaagcctgtgtctctgga

SEQ ID NO: 8013486 - DNA, 22 bp, Homo sapiens
ccaggaagcctgtgtctctgga

SEQ ID NO: 8013487 - DNA, 22 bp, Homo sapiens
ccaggaagcctgtgtctctgga

SEQ ID NO: 8013488 - DNA, 22 bp, Homo sapiens
ccaggaagcctgtgtctctgga

SEQ ID NO: 8013489 - DNA, 22 bp, Homo sapiens
ccaggaagcctgtgtctctgga

SEQ ID NO: 8013490 - DNA, 22 bp, Homo sapiens
ccaggaagcctcagatgctgag

SEQ ID NO: 8013491 - DNA, 22 bp, Homo sapiens
ccaggaagcctcagatgctgag

SEQ ID NO: 8013492 - DNA, 22 bp, Homo sapiens
ccaggaagacacatgctcatcc

SEQ ID NO: 8013493 - DNA, 23 bp, Homo sapiens
ccaggaagaggccatccacagtc

SEQ ID NO: 8013494 - DNA, 23 bp, Homo sapiens
ccaggaagaggccatccacagtc

SEQ ID NO: 8013495 - DNA, 23 bp, Homo sapiens
ccaggaagaggccatccacagtc

SEQ ID NO: 8013496 - DNA, 23 bp, Homo sapiens
ccaggaagaggccatccacagtc

SEQ ID NO: 8013497 - DNA, 23 bp, Homo sapiens
ccaggaagaggccatccacagtc

SEQ ID NO: 8013498 - DNA, 23 bp, Homo sapiens
ccaggaagaggccatccacagtc

SEQ ID NO: 8013499 - DNA, 23 bp, Homo sapiens
ccaggaagaggccatccacagtc

SEQ ID NO: 8013500 - DNA, 23 bp, Homo sapiens
ccaggaagaggccatccacagtc

SEQ ID NO: 8013501 - DNA, 22 bp, Homo sapiens
ccaggaagcataatgtagtggg

SEQ ID NO: 8013502 - DNA, 22 bp, Homo sapiens
ccaggaagcataatgtagtggg

SEQ ID NO: 8013503 - DNA, 22 bp, Homo sapiens
ccaggaagatttattttggctt

SEQ ID NO: 8013504 - DNA, 22 bp, Homo sapiens
ccaggaagatttattttggctt

SEQ ID NO: 8013505 - DNA, 22 bp, Homo sapiens
ccaggaaccgatgatcagaggg

SEQ ID NO: 8013506 - DNA, 19 bp, Homo sapiens
ccaggaacccctagctacc

SEQ ID NO: 8013507 - DNA, 16 bp, Homo sapiens
ccaggaacacacagct

SEQ ID NO: 8013508 - DNA, 22 bp, Homo sapiens
ccaggaaccgatgatcagaggg

SEQ ID NO: 8013509 - DNA, 22 bp, Homo sapiens
ccaggaactaagaatcctttag

SEQ ID NO: 8013510 - DNA, 22 bp, Homo sapiens
ccaggaactcagctctgcactt

SEQ ID NO: 8013511 - DNA, 22 bp, Homo sapiens
ccaggaaatagtgctgtgatct

SEQ ID NO: 8013512 - DNA, 22 bp, Homo sapiens
ccaggaaatggcttgcttcttt

SEQ ID NO: 8013513 - DNA, 22 bp, Homo sapiens
ccaggaaatggcttgcttcttt

SEQ ID NO: 8013514 - DNA, 22 bp, Homo sapiens
ccaggaacaaagccccatccac

SEQ ID NO: 8013515 - DNA, 22 bp, Homo sapiens
ccaggaagaaacagtctttata

SEQ ID NO: 8013516 - DNA, 22 bp, Homo sapiens
ccaggaagaaacagtctttata

SEQ ID NO: 8013517 - DNA, 22 bp, Homo sapiens
ccaggaagacacatgctcatcc

SEQ ID NO: 8013518 - DNA, 22 bp, Homo sapiens
ccaggaagacacatgctcatcc

SEQ ID NO: 8013519 - DNA, 22 bp, Homo sapiens
ccaggaagacacatgctcatcc

SEQ ID NO: 8013520 - DNA, 22 bp, Homo sapiens
ccaggaaaataccaagctttaa

SEQ ID NO: 8013521 - DNA, 22 bp, Homo sapiens
ccaggaaacctgcgccatccag

SEQ ID NO: 8013522 - DNA, 22 bp, Homo sapiens
ccaggaaaataccaagctttaa

SEQ ID NO: 8013523 - DNA, 22 bp, Homo sapiens
ccaggaaagaggaagaacgcat

SEQ ID NO: 8013524 - DNA, 22 bp, Homo sapiens
ccaggaaagaggaagaacgcat

SEQ ID NO: 8013525 - DNA, 22 bp, Homo sapiens
ccaggaaatagtgctgtgatct

SEQ ID NO: 8013526 - DNA, 23 bp, Homo sapiens
ccaggaaagatccaggaagaggc

SEQ ID NO: 8013527 - DNA, 22 bp, Homo sapiens
ccaggaaagaggaagaacgcat

SEQ ID NO: 8013528 - DNA, 22 bp, Homo sapiens
ccaggaaaaagagaaacatggt

SEQ ID NO: 8013529 - DNA, 22 bp, Homo sapiens
ccaggaaaaagagaaacatggt

SEQ ID NO: 8013530 - DNA, 22 bp, Homo sapiens
ccaggaaaaagagaaacatggt

SEQ ID NO: 8013531 - DNA, 22 bp, Homo sapiens
ccagcttctccttatgtcctca

SEQ ID NO: 8013532 - DNA, 22 bp, Homo sapiens
ccagcttcatgggcatgcacca

SEQ ID NO: 8013533 - DNA, 22 bp, Homo sapiens
ccagcttcatgggcatgcacca

SEQ ID NO: 8013534 - DNA, 22 bp, Homo sapiens
ccagcttcatgggcatgcacca

SEQ ID NO: 8013535 - DNA, 22 bp, Homo sapiens
ccagcttcggcaagcagacttt

SEQ ID NO: 8013536 - DNA, 22 bp, Homo sapiens
ccaggagcctgggccaggctgg

SEQ ID NO: 8013537 - DNA, 21 bp, Homo sapiens
ccaggaaggactgagctccct

SEQ ID NO: 8013538 - DNA, 22 bp, Homo sapiens
ccaggagcgcgtgaacaggctg

SEQ ID NO: 8013539 - DNA, 22 bp, Homo sapiens
ccaggagcgcgtgaacaggctg

SEQ ID NO: 8013540 - DNA, 22 bp, Homo sapiens
ccaggagcctgggccaggctgg

SEQ ID NO: 8013541 - DNA, 21 bp, Homo sapiens
ccaggaaggactgagctccct

SEQ ID NO: 8013542 - DNA, 21 bp, Homo sapiens
ccaggaaggactgagctccct

SEQ ID NO: 8013543 - DNA, 21 bp, Homo sapiens
ccaggaaggactgagctccct

SEQ ID NO: 8013544 - DNA, 21 bp, Homo sapiens
ccaggaaggactgagctccct

SEQ ID NO: 8013545 - DNA, 22 bp, Homo sapiens
ccaggagcgcgtgaacaggctg

SEQ ID NO: 8013546 - DNA, 22 bp, Homo sapiens
ccaggagcgcgtgaacaggctg

SEQ ID NO: 8013547 - DNA, 22 bp, Homo sapiens
ccaggaggatgattttaagagg

SEQ ID NO: 8013548 - DNA, 22 bp, Homo sapiens
ccaggaggatggttgttaggtg

SEQ ID NO: 8013549 - DNA, 22 bp, Homo sapiens
ccaggaggatggttgttaggtg

SEQ ID NO: 8013550 - DNA, 22 bp, Homo sapiens
ccaggaggatgattttaagagg

SEQ ID NO: 8013551 - DNA, 22 bp, Homo sapiens
ccaggaggcagaagttgcagtg

SEQ ID NO: 8013552 - DNA, 22 bp, Homo sapiens
ccaggaggcagaagttgcagtg

SEQ ID NO: 8013553 - DNA, 22 bp, Homo sapiens
ccaggaggcagaagttgcagtg

SEQ ID NO: 8013554 - DNA, 22 bp, Homo sapiens
ccaggaggcagaagttgcagtg

SEQ ID NO: 8013555 - DNA, 22 bp, Homo sapiens
ccaggaggcagaagttgcagtg

SEQ ID NO: 8013556 - DNA, 22 bp, Homo sapiens
ccaggaggcaatatcaagtcca

SEQ ID NO: 8013557 - DNA, 22 bp, Homo sapiens
ccaggaggcaatatcaagtcca

SEQ ID NO: 8013558 - DNA, 22 bp, Homo sapiens
ccaggaggcaatatcaagtcca

SEQ ID NO: 8013559 - DNA, 22 bp, Homo sapiens
ccaggaggcaatatcaagtcca

SEQ ID NO: 8013560 - DNA, 22 bp, Homo sapiens
ccaggaggcaatatcaagtcca

SEQ ID NO: 8013561 - DNA, 22 bp, Homo sapiens
ccaggaggatgattttaagagg

SEQ ID NO: 8013562 - DNA, 22 bp, Homo sapiens
ccaggaagctctgctccacggg

SEQ ID NO: 8013563 - DNA, 22 bp, Homo sapiens
ccaggaagctctgctccacggg

SEQ ID NO: 8013564 - DNA, 22 bp, Homo sapiens
ccaggaagctctgctccacggg

SEQ ID NO: 8013565 - DNA, 22 bp, Homo sapiens
ccaggaagctctgctccacggg

SEQ ID NO: 8013566 - DNA, 22 bp, Homo sapiens
ccaggaagctgtctgatatgaa

SEQ ID NO: 8013567 - DNA, 22 bp, Homo sapiens
ccaggaagctgtctgatatgaa

SEQ ID NO: 8013568 - DNA, 22 bp, Homo sapiens
ccaggaagctgtctgatatgaa

SEQ ID NO: 8013569 - DNA, 22 bp, Homo sapiens
ccaggaaggaagcaggggtttc

SEQ ID NO: 8013570 - DNA, 22 bp, Homo sapiens
ccaggaagctgtgagattccaa

SEQ ID NO: 8013571 - DNA, 22 bp, Homo sapiens
ccaggaagctgtgagattccaa

SEQ ID NO: 8013572 - DNA, 22 bp, Homo sapiens
ccaggaagctctgctccacggg

SEQ ID NO: 8013573 - DNA, 22 bp, Homo sapiens
ccaggaagcggtgagggctgcc

SEQ ID NO: 8013574 - DNA, 22 bp, Homo sapiens
ccaggaagcggtgagggctgcc

SEQ ID NO: 8013575 - DNA, 22 bp, Homo sapiens
ccaggaagcggtgagggctgcc

SEQ ID NO: 8013576 - DNA, 22 bp, Homo sapiens
ccaggaagcggtgagggctgcc

SEQ ID NO: 8013577 - DNA, 22 bp, Homo sapiens
ccaggaagcggtgagggctgcc

SEQ ID NO: 8013578 - DNA, 22 bp, Homo sapiens
ccaggaagcggtgagggctgcc

SEQ ID NO: 8013579 - DNA, 22 bp, Homo sapiens
ccaggaagcctttttctttgac

SEQ ID NO: 8013580 - DNA, 22 bp, Homo sapiens
ccaggaagcctgtgtctctgga

SEQ ID NO: 8013581 - DNA, 22 bp, Homo sapiens
ccaggaagcggtgagggctgcc

SEQ ID NO: 8013582 - DNA, 22 bp, Homo sapiens
tatgtactaactttcattctag

SEQ ID NO: 8013583 - DNA, 22 bp, Homo sapiens
tatgtactaactttcattctag

SEQ ID NO: 8013584 - DNA, 22 bp, Homo sapiens
tatgtacatgttaaagggcaaa

SEQ ID NO: 8013585 - DNA, 22 bp, Homo sapiens
caggtctttgttgcagcatgga

SEQ ID NO: 8013586 - DNA, 22 bp, Homo sapiens
caggtgaacccagtctaatcat

SEQ ID NO: 8013587 - DNA, 22 bp, Homo sapiens
caggtctttgttgcagcatgga

SEQ ID NO: 8013588 - DNA, 22 bp, Homo sapiens
caggtctttgttgcagcatgga

SEQ ID NO: 8013589 - DNA, 22 bp, Homo sapiens
caggtcttttctactggtggag

SEQ ID NO: 8013590 - DNA, 22 bp, Homo sapiens
caggtgaaaaagcaaccatatt

SEQ ID NO: 8013591 - DNA, 22 bp, Homo sapiens
caggtctgttttcaaggtcagt

SEQ ID NO: 8013592 - DNA, 20 bp, Homo sapiens
caggtcttcatgtggctgtc

SEQ ID NO: 8013593 - DNA, 20 bp, Homo sapiens
caggtcttcatgtggctgtc

SEQ ID NO: 8013594 - DNA, 22 bp, Homo sapiens
caggtctgtttccatcagtgct

SEQ ID NO: 8013595 - DNA, 18 bp, Homo sapiens
caggtctgtctgcctccc

SEQ ID NO: 8013596 - DNA, 22 bp, Homo sapiens
caggtctgtgtgccatttccaa

SEQ ID NO: 8013597 - DNA, 22 bp, Homo sapiens
caggtctgtttccatcagtgct

SEQ ID NO: 8013598 - DNA, 22 bp, Homo sapiens
caggtctgttttcaaggtcagt

SEQ ID NO: 8013599 - DNA, 22 bp, Homo sapiens
caggtctgtattaacagagggt

SEQ ID NO: 8013600 - DNA, 22 bp, Homo sapiens
caggtctgtattaacagagggt

SEQ ID NO: 8013601 - DNA, 18 bp, Homo sapiens
caggtctgtctgcctccc

SEQ ID NO: 8013602 - DNA, 18 bp, Homo sapiens
caggtctgtctgcctccc

SEQ ID NO: 8013603 - DNA, 22 bp, Homo sapiens
caggtctgtgtgccatttccaa

SEQ ID NO: 8013604 - DNA, 18 bp, Homo sapiens
caggtctgtctgcctccc

SEQ ID NO: 8013605 - DNA, 22 bp, Homo sapiens
tatggcatttagaaatgtcaga

SEQ ID NO: 8013606 - DNA, 22 bp, Homo sapiens
tatggcatttagaaatgtcaga

SEQ ID NO: 8013607 - DNA, 22 bp, Homo sapiens
tatggcatttagaaatgtcaga

SEQ ID NO: 8013608 - DNA, 22 bp, Homo sapiens
tatggccaatcgggtggacgcc

SEQ ID NO: 8013609 - DNA, 23 bp, Homo sapiens
tatggctcataaaacagagcagg

SEQ ID NO: 8013610 - DNA, 22 bp, Homo sapiens
tatggctaattctttactgacc

SEQ ID NO: 8013611 - DNA, 22 bp, Homo sapiens
tatggctcatggggctagcaag

SEQ ID NO: 8013612 - DNA, 17 bp, Homo sapiens
tatggctgtgtttgtgc

SEQ ID NO: 8013613 - DNA, 22 bp, Homo sapiens
caggtctggtgagagaacagtt

SEQ ID NO: 8013614 - DNA, 22 bp, Homo sapiens
caggtctggtgagagaacagtt

SEQ ID NO: 8013615 - DNA, 22 bp, Homo sapiens
caggtctggtgagagaacagtt

SEQ ID NO: 8013616 - DNA, 21 bp, Homo sapiens
caggtctggtgaacactctca

SEQ ID NO: 8013617 - DNA, 22 bp, Homo sapiens
caggtctgggttgatggcctgg

SEQ ID NO: 8013618 - DNA, 23 bp, Homo sapiens
tatggcttacagtgctttaggta

SEQ ID NO: 8013619 - DNA, 22 bp, Homo sapiens
caggtctgggttgatggcctgg

SEQ ID NO: 8013620 - DNA, 22 bp, Homo sapiens
tatctcagctggatcagtggaa

SEQ ID NO: 8013621 - DNA, 22 bp, Homo sapiens
tatctccatctggagagcaaaa

SEQ ID NO: 8013622 - DNA, 22 bp, Homo sapiens
tatctccatctggagagcaaaa

SEQ ID NO: 8013623 - DNA, 22 bp, Homo sapiens
tatctcttgcatgctttttaga

SEQ ID NO: 8013624 - DNA, 22 bp, Homo sapiens
tatctcttgcatgctttttaga

SEQ ID NO: 8013625 - DNA, 17 bp, Homo sapiens
tatctcttcaagtttca

SEQ ID NO: 8013626 - DNA, 22 bp, Homo sapiens
tatctctaggctgccacttaaa

SEQ ID NO: 8013627 - DNA, 22 bp, Homo sapiens
tatctctgtaaaagaaatcaca

SEQ ID NO: 8013628 - DNA, 17 bp, Homo sapiens
tatctctgcttcatggt

SEQ ID NO: 8013629 - DNA, 22 bp, Homo sapiens
tatctgagaaagaagcaccaga

SEQ ID NO: 8013630 - DNA, 22 bp, Homo sapiens
tatctgaatcagttaggactct

SEQ ID NO: 8013631 - DNA, 22 bp, Homo sapiens
tatctgaacaacctttattact

SEQ ID NO: 8013632 - DNA, 20 bp, Homo sapiens
tatctgctctagtagcagtt

SEQ ID NO: 8013633 - DNA, 22 bp, Homo sapiens
tatctgcatctgcatgtgtatt

SEQ ID NO: 8013634 - DNA, 22 bp, Homo sapiens
tatctgggaaggggagaataga

SEQ ID NO: 8013635 - DNA, 21 bp, Homo sapiens
tatctgctttttaaggctcac

SEQ ID NO: 8013636 - DNA, 22 bp, Homo sapiens
tatctctttattgacaataaaa

SEQ ID NO: 8013637 - DNA, 22 bp, Homo sapiens
tatctcttgcatgctttttaga

SEQ ID NO: 8013638 - DNA, 22 bp, Homo sapiens
tatctcttgtctgttttgcaaa

SEQ ID NO: 8013639 - DNA, 22 bp, Homo sapiens
tatctctttattgacaataaaa

SEQ ID NO: 8013640 - DNA, 23 bp, Homo sapiens
tatggcatggtacttccagcaga

SEQ ID NO: 8013641 - DNA, 22 bp, Homo sapiens
tatggcagttacccttgatgat

SEQ ID NO: 8013642 - DNA, 19 bp, Homo sapiens
tatggcaggccgaggcact

SEQ ID NO: 8013643 - DNA, 22 bp, Homo sapiens
tatggcagaggagaggcactag

SEQ ID NO: 8013644 - DNA, 22 bp, Homo sapiens
tatggcagaggagaggcactag

SEQ ID NO: 8013645 - DNA, 22 bp, Homo sapiens
tatggcaatatgtatcaagatc

SEQ ID NO: 8013646 - DNA, 22 bp, Homo sapiens
tatggcaagatgacatgttctc

SEQ ID NO: 8013647 - DNA, 22 bp, Homo sapiens
tatggcaagagaatcaactgaa

SEQ ID NO: 8013648 - DNA, 22 bp, Homo sapiens
tatctggtttagtatgatgtta

SEQ ID NO: 8013649 - DNA, 22 bp, Homo sapiens
tatctggttcctttgaggagat

SEQ ID NO: 8013650 - DNA, 22 bp, Homo sapiens
tatgcacagaagtttgctgaat

SEQ ID NO: 8013651 - DNA, 22 bp, Homo sapiens
tatggagattcaaaagcatctt

SEQ ID NO: 8013652 - DNA, 22 bp, Homo sapiens
tatggatgtttatctacaggct

SEQ ID NO: 8013653 - DNA, 22 bp, Homo sapiens
tatggatggaaagggccaagct

SEQ ID NO: 8013654 - DNA, 22 bp, Homo sapiens
tatggatgagttcctgaggagt

SEQ ID NO: 8013655 - DNA, 22 bp, Homo sapiens
tatgtgctttgcactgtgctat

SEQ ID NO: 8013656 - DNA, 22 bp, Homo sapiens
tatgtgctgccaccagggagag

SEQ ID NO: 8013657 - DNA, 22 bp, Homo sapiens
tatgtgctgccaccagggagag

SEQ ID NO: 8013658 - DNA, 22 bp, Homo sapiens
tatgtgcattattaccagtgga

SEQ ID NO: 8013659 - DNA, 22 bp, Homo sapiens
tatgtgctaaacaccttccata

SEQ ID NO: 8013660 - DNA, 22 bp, Homo sapiens
tatgtgctaaacaccttccata

SEQ ID NO: 8013661 - DNA, 22 bp, Homo sapiens
tatgtgctaagctccagatcag

SEQ ID NO: 8013662 - DNA, 22 bp, Homo sapiens
tatgtgctgaagtctttacacc

SEQ ID NO: 8013663 - DNA, 22 bp, Homo sapiens
tatgtgctgaagtctttacacc

SEQ ID NO: 8013664 - DNA, 22 bp, Homo sapiens
tatgtgcattattaccagtgga

SEQ ID NO: 8013665 - DNA, 22 bp, Homo sapiens
tatgtgcatatgcatacacaca

SEQ ID NO: 8013666 - DNA, 22 bp, Homo sapiens
tatgtactaactttcattctag

SEQ ID NO: 8013667 - DNA, 22 bp, Homo sapiens
tatgtgtactcgttaaatattt

SEQ ID NO: 8013668 - DNA, 22 bp, Homo sapiens
tatgtgtaggaggaggacaggg

SEQ ID NO: 8013669 - DNA, 22 bp, Homo sapiens
tatgtgtactcgttaaatattt

SEQ ID NO: 8013670 - DNA, 22 bp, Homo sapiens
tatgtgtagtgtgatcccaatg

SEQ ID NO: 8013671 - DNA, 23 bp, Homo sapiens
tatgtgtaaggagaaggagtgag

SEQ ID NO: 8013672 - DNA, 22 bp, Homo sapiens
tatgtgtacaaatcagtaagtg

SEQ ID NO: 8013673 - DNA, 22 bp, Homo sapiens
tatgtgtacagtatactggttt

SEQ ID NO: 8013674 - DNA, 22 bp, Homo sapiens
tatgtgtaatcaaacacatgct

SEQ ID NO: 8013675 - DNA, 22 bp, Homo sapiens
tatgtgtaatcaaacacatgct

SEQ ID NO: 8013676 - DNA, 22 bp, Homo sapiens
tatgtgtatgtacatacataca

SEQ ID NO: 8013677 - DNA, 22 bp, Homo sapiens
tatgtgtatgtacatacataca

SEQ ID NO: 8013678 - DNA, 22 bp, Homo sapiens
tatgtgtatgtacatacataca

SEQ ID NO: 8013679 - DNA, 22 bp, Homo sapiens
tatgtgtattgagcattgttac

SEQ ID NO: 8013680 - DNA, 22 bp, Homo sapiens
tatgttttaggaattaattgtt

SEQ ID NO: 8013681 - DNA, 22 bp, Homo sapiens
tatgttttaggaattaattgtt

SEQ ID NO: 8013682 - DNA, 22 bp, Homo sapiens
tatgttttaggaattaattgtt

SEQ ID NO: 8013683 - DNA, 22 bp, Homo sapiens
tatgtttttaagagaatgcatt

SEQ ID NO: 8013684 - DNA, 22 bp, Homo sapiens
tatgttttaggaattaattgtt

SEQ ID NO: 8013685 - DNA, 22 bp, Homo sapiens
tatgttttaggaattaattgtt

SEQ ID NO: 8013686 - DNA, 22 bp, Homo sapiens
tatgtttttaagagaatgcatt

SEQ ID NO: 8013687 - DNA, 22 bp, Homo sapiens
tatgtttttaagagaatgcatt

SEQ ID NO: 8013688 - DNA, 22 bp, Homo sapiens
tattaaatatatctgttagttg

SEQ ID NO: 8013689 - DNA, 22 bp, Homo sapiens
tattaaatatatctgttagttg

SEQ ID NO: 8013690 - DNA, 22 bp, Homo sapiens
tattaaatatatctgttagttg

SEQ ID NO: 8013691 - DNA, 22 bp, Homo sapiens
tattaaatatatctgttagttg

SEQ ID NO: 8013692 - DNA, 22 bp, Homo sapiens
tattaaatatatctgttagttg

SEQ ID NO: 8013693 - DNA, 22 bp, Homo sapiens
tattaaatatatctgttagttg

SEQ ID NO: 8013694 - DNA, 18 bp, Homo sapiens
tattcctgagtcatccct

SEQ ID NO: 8013695 - DNA, 22 bp, Homo sapiens
tattcctcctttctgctcagcc

SEQ ID NO: 8013696 - DNA, 23 bp, Homo sapiens
tattcctggtaagcctgtcactg

SEQ ID NO: 8013697 - DNA, 22 bp, Homo sapiens
tattcctggtgttggctgggtc

SEQ ID NO: 8013698 - DNA, 23 bp, Homo sapiens
tattcctggtaagcctgtcactg

SEQ ID NO: 8013699 - DNA, 22 bp, Homo sapiens
tattaaagagagaatcatcatc

SEQ ID NO: 8013700 - DNA, 22 bp, Homo sapiens
tattaaagggaagttatgcatg

SEQ ID NO: 8013701 - DNA, 22 bp, Homo sapiens
tattaaagggaagttatgcatg

SEQ ID NO: 8013702 - DNA, 22 bp, Homo sapiens
tattaaagggaagttatgcatg

SEQ ID NO: 8013703 - DNA, 22 bp, Homo sapiens
tattaaagagagaatcatcatc

SEQ ID NO: 8013704 - DNA, 22 bp, Homo sapiens
tattaaagagagaatcatcatc

SEQ ID NO: 8013705 - DNA, 22 bp, Homo sapiens
tatgtttttcagacgtcctaca

SEQ ID NO: 8013706 - DNA, 22 bp, Homo sapiens
tatgtttttcaagtgcacacta

SEQ ID NO: 8013707 - DNA, 22 bp, Homo sapiens
tatgtttttcaagtgcacacta

SEQ ID NO: 8013708 - DNA, 22 bp, Homo sapiens
tatgtttttcaagtgcacacta

SEQ ID NO: 8013709 - DNA, 22 bp, Homo sapiens
tattgctttctcagacgtttag

SEQ ID NO: 8013710 - DNA, 22 bp, Homo sapiens
tattgctttctcagacgtttag

SEQ ID NO: 8013711 - DNA, 22 bp, Homo sapiens
tattgcttcataattgttgcca

SEQ ID NO: 8013712 - DNA, 22 bp, Homo sapiens
tattgcttcataattgttgcca

SEQ ID NO: 8013713 - DNA, 22 bp, Homo sapiens
tattgcttggggtacaaggtat

SEQ ID NO: 8013714 - DNA, 22 bp, Homo sapiens
tattgcttataatttgttgcaa

SEQ ID NO: 8013715 - DNA, 22 bp, Homo sapiens
tattgcttataatttgttgcaa

SEQ ID NO: 8013716 - DNA, 22 bp, Homo sapiens
tattgctggtgctgttctgaat

SEQ ID NO: 8013717 - DNA, 22 bp, Homo sapiens
tattgctggggtgggccatgtt

SEQ ID NO: 8013718 - DNA, 22 bp, Homo sapiens
tattgctcagagaaggagatgt

SEQ ID NO: 8013719 - DNA, 18 bp, Homo sapiens
tattgctctagagagaca

SEQ ID NO: 8013720 - DNA, 22 bp, Homo sapiens
tattgctgacttgttcagtgtt

SEQ ID NO: 8013721 - DNA, 22 bp, Homo sapiens
tattgctgactgtcttctgagt

SEQ ID NO: 8013722 - DNA, 22 bp, Homo sapiens
tattgctgctattgtcagttca

SEQ ID NO: 8013723 - DNA, 22 bp, Homo sapiens
tataatattccttgttgtaggt

SEQ ID NO: 8013724 - DNA, 22 bp, Homo sapiens
tataatccattcattgatttct

SEQ ID NO: 8013725 - DNA, 22 bp, Homo sapiens
tataatattccttgttgtaggt

SEQ ID NO: 8013726 - DNA, 22 bp, Homo sapiens
tataatattccttgttgtaggt

SEQ ID NO: 8013727 - DNA, 22 bp, Homo sapiens
tataatctggttttattaagag

SEQ ID NO: 8013728 - DNA, 22 bp, Homo sapiens
caggggcaagaatgctgtcagc

SEQ ID NO: 8013729 - DNA, 22 bp, Homo sapiens
caggggcaagaatgctgtcagc

SEQ ID NO: 8013730 - DNA, 22 bp, Homo sapiens
caggggcaagaatgctgtcagc

SEQ ID NO: 8013731 - DNA, 22 bp, Homo sapiens
tataatgttttccatggactga

SEQ ID NO: 8013732 - DNA, 22 bp, Homo sapiens
tataatctggttttattaagag

SEQ ID NO: 8013733 - DNA, 22 bp, Homo sapiens
tataattagtaaatggcagatt

SEQ ID NO: 8013734 - DNA, 22 bp, Homo sapiens
tataattagtaaatggcagatt

SEQ ID NO: 8013735 - DNA, 20 bp, Homo sapiens
tataagcagctccaggcaga

SEQ ID NO: 8013736 - DNA, 22 bp, Homo sapiens
tataagtagttgttgaagactt

SEQ ID NO: 8013737 - DNA, 22 bp, Homo sapiens
tataagtgacagattatccaaa

SEQ ID NO: 8013738 - DNA, 22 bp, Homo sapiens
tataagtagttgttgaagactt

SEQ ID NO: 8013739 - DNA, 22 bp, Homo sapiens
tataagtagcattggaacttca

SEQ ID NO: 8013740 - DNA, 22 bp, Homo sapiens
tataagtagttgttgaagactt

SEQ ID NO: 8013741 - DNA, 22 bp, Homo sapiens
tataatatgaggcaggagtgat

SEQ ID NO: 8013742 - DNA, 22 bp, Homo sapiens
tataagtgtgtcagcttccaac

SEQ ID NO: 8013743 - DNA, 22 bp, Homo sapiens
tataagtgtagtttcaaatgtt

SEQ ID NO: 8013744 - DNA, 22 bp, Homo sapiens
tataatatgaggcaggagtgat

SEQ ID NO: 8013745 - DNA, 22 bp, Homo sapiens
tataatatgaggcaggagtgat

SEQ ID NO: 8013746 - DNA, 22 bp, Homo sapiens
tataatattccttgttgtaggt

SEQ ID NO: 8013747 - DNA, 22 bp, Homo sapiens
tataatattccttgttgtaggt

SEQ ID NO: 8013748 - DNA, 22 bp, Homo sapiens
tacatgttatttcactattggt

SEQ ID NO: 8013749 - DNA, 22 bp, Homo sapiens
tacatgtggtagggagggcagt

SEQ ID NO: 8013750 - DNA, 17 bp, Homo sapiens
tacatgtgtatctgatt

SEQ ID NO: 8013751 - DNA, 17 bp, Homo sapiens
tacatgtgtatctgatt

SEQ ID NO: 8013752 - DNA, 22 bp, Homo sapiens
tacatgtgatcagaaagtgaaa

SEQ ID NO: 8013753 - DNA, 22 bp, Homo sapiens
tacatgtgggttaaaaacactc

SEQ ID NO: 8013754 - DNA, 22 bp, Homo sapiens
tacatgtggtagggagggcagt

SEQ ID NO: 8013755 - DNA, 22 bp, Homo sapiens
tacatgtgggttaaaaacactc

SEQ ID NO: 8013756 - DNA, 22 bp, Homo sapiens
tacatgtgggttaaaaacactc

SEQ ID NO: 8013757 - DNA, 22 bp, Homo sapiens
tataagatacttggcatagtgc

SEQ ID NO: 8013758 - DNA, 22 bp, Homo sapiens
tataagaagtgaagaagagtta

SEQ ID NO: 8013759 - DNA, 22 bp, Homo sapiens
tataagaagtgaagaagagtta

SEQ ID NO: 8013760 - DNA, 22 bp, Homo sapiens
tataagaatgcttgtttggggt

SEQ ID NO: 8013761 - DNA, 22 bp, Homo sapiens
tataagaagtgaagaagagtta

SEQ ID NO: 8013762 - DNA, 22 bp, Homo sapiens
tataagaagtgaagaagagtta

SEQ ID NO: 8013763 - DNA, 22 bp, Homo sapiens
tataagaaattgccaacctgtt

SEQ ID NO: 8013764 - DNA, 22 bp, Homo sapiens
tataagaagtgaagaagagtta

SEQ ID NO: 8013765 - DNA, 22 bp, Homo sapiens
tataagaagtgaagaagagtta

SEQ ID NO: 8013766 - DNA, 22 bp, Homo sapiens
tagttttagtcccattttacag

SEQ ID NO: 8013767 - DNA, 22 bp, Homo sapiens
tataagaaacaaggcaaatttt

SEQ ID NO: 8013768 - DNA, 22 bp, Homo sapiens
tataagaaacaaggcaaatttt

SEQ ID NO: 8013769 - DNA, 22 bp, Homo sapiens
tataagaaattgccaacctgtt

SEQ ID NO: 8013770 - DNA, 22 bp, Homo sapiens
tataagaaattgccaacctgtt

SEQ ID NO: 8013771 - DNA, 22 bp, Homo sapiens
cagggtggaagctgtagagtgg

SEQ ID NO: 8013772 - DNA, 22 bp, Homo sapiens
cagggtggaagctgtagagtgg

SEQ ID NO: 8013773 - DNA, 22 bp, Homo sapiens
cagggtggaacaggcaatactt

SEQ ID NO: 8013774 - DNA, 22 bp, Homo sapiens
cagggtggaacaggcaatactt

SEQ ID NO: 8013775 - DNA, 22 bp, Homo sapiens
cagggtggaacaggcaatactt

SEQ ID NO: 8013776 - DNA, 22 bp, Homo sapiens
cagggtggaagctgtagagtgg

SEQ ID NO: 8013777 - DNA, 22 bp, Homo sapiens
cagggtggaagctgtagagtgg

SEQ ID NO: 8013778 - DNA, 22 bp, Homo sapiens
cagggtggaagctgtagagtgg

SEQ ID NO: 8013779 - DNA, 22 bp, Homo sapiens
cagggtggaagctgtagagtgg

SEQ ID NO: 8013780 - DNA, 22 bp, Homo sapiens
cagggtggaacaggcaatactt

SEQ ID NO: 8013781 - DNA, 22 bp, Homo sapiens
cagggtggaaaagctagttgga

SEQ ID NO: 8013782 - DNA, 22 bp, Homo sapiens
cagggtggaaaagctagttgga

SEQ ID NO: 8013783 - DNA, 22 bp, Homo sapiens
cagggtggaacaggcaatactt

SEQ ID NO: 8013784 - DNA, 22 bp, Homo sapiens
cagggtggaacaggcaatactt

SEQ ID NO: 8013785 - DNA, 22 bp, Homo sapiens
cagggtggaaaagctagttgga

SEQ ID NO: 8013786 - DNA, 22 bp, Homo sapiens
cagggtgcttccgtggagctgt

SEQ ID NO: 8013787 - DNA, 22 bp, Homo sapiens
cagggtggaaaagctagttgga

SEQ ID NO: 8013788 - DNA, 22 bp, Homo sapiens
cagggtggaaaagctagttgga

SEQ ID NO: 8013789 - DNA, 22 bp, Homo sapiens
caggggcctggctgtctaggaa

SEQ ID NO: 8013790 - DNA, 22 bp, Homo sapiens
caggggcctggctgtctaggaa

SEQ ID NO: 8013791 - DNA, 22 bp, Homo sapiens
caggggcctggctgtctaggaa

SEQ ID NO: 8013792 - DNA, 22 bp, Homo sapiens
caggggcctggctgtctaggaa

SEQ ID NO: 8013793 - DNA, 22 bp, Homo sapiens
caggggcctggctgtctaggaa

SEQ ID NO: 8013794 - DNA, 22 bp, Homo sapiens
cagggtcttataaggccaattt

SEQ ID NO: 8013795 - DNA, 22 bp, Homo sapiens
caggggcctgtcctggcttctg

SEQ ID NO: 8013796 - DNA, 22 bp, Homo sapiens
cagggtctgatggtcctcactt

SEQ ID NO: 8013797 - DNA, 22 bp, Homo sapiens
cagggtgcttccgtggagctgt

SEQ ID NO: 8013798 - DNA, 22 bp, Homo sapiens
cagggtgcttccgtggagctgt

SEQ ID NO: 8013799 - DNA, 22 bp, Homo sapiens
cagggtgcttccgtggagctgt

SEQ ID NO: 8013800 - DNA, 22 bp, Homo sapiens
cagggtcttggcgccatcaccc

SEQ ID NO: 8013801 - DNA, 22 bp, Homo sapiens
caggggccaagggtccagacct

SEQ ID NO: 8013802 - DNA, 22 bp, Homo sapiens
caggggccaagggtccagacct

SEQ ID NO: 8013803 - DNA, 22 bp, Homo sapiens
caggggccaagggtccagacct

SEQ ID NO: 8013804 - DNA, 22 bp, Homo sapiens
caggggcagtctgtgtgcgtgg

SEQ ID NO: 8013805 - DNA, 22 bp, Homo sapiens
caggggcagtctgtgtgcgtgg

SEQ ID NO: 8013806 - DNA, 22 bp, Homo sapiens
caggggcagtctgtgtgcgtgg

SEQ ID NO: 8013807 - DNA, 22 bp, Homo sapiens
caggggcaggtgtgagatcatc

SEQ ID NO: 8013808 - DNA, 22 bp, Homo sapiens
caggggcaggtgtgagatcatc

SEQ ID NO: 8013809 - DNA, 22 bp, Homo sapiens
caggggcaggtgtgagatcatc

SEQ ID NO: 8013810 - DNA, 22 bp, Homo sapiens
caggggcaggtgtgagatcatc

SEQ ID NO: 8013811 - DNA, 22 bp, Homo sapiens
caggggcaagaatgctgtcagc

SEQ ID NO: 8013812 - DNA, 22 bp, Homo sapiens
caggggccaggctgtctgctgt

SEQ ID NO: 8013813 - DNA, 22 bp, Homo sapiens
caggggccaagggtccagacct

SEQ ID NO: 8013814 - DNA, 22 bp, Homo sapiens
caggggccaggctgtctgctgt

SEQ ID NO: 8013815 - DNA, 22 bp, Homo sapiens
caggggcctggctgtctaggaa

SEQ ID NO: 8013816 - DNA, 22 bp, Homo sapiens
caggggccggctgtccgtgccc

SEQ ID NO: 8013817 - DNA, 22 bp, Homo sapiens
caggggccaggctgtctgctgt

SEQ ID NO: 8013818 - DNA, 22 bp, Homo sapiens
caggggccggctgtccgtgccc

SEQ ID NO: 8013819 - DNA, 22 bp, Homo sapiens
tatacagtcttttgctatattc

SEQ ID NO: 8013820 - DNA, 20 bp, Homo sapiens
tatacagtcttttgggaaaa

SEQ ID NO: 8013821 - DNA, 22 bp, Homo sapiens
tatacagtgcctcttccattag

SEQ ID NO: 8013822 - DNA, 20 bp, Homo sapiens
tatacagtcttttgggaaaa

SEQ ID NO: 8013823 - DNA, 22 bp, Homo sapiens
tatacagtcttttgctatattc

SEQ ID NO: 8013824 - DNA, 22 bp, Homo sapiens
tatacagtatcttttgaaggca

SEQ ID NO: 8013825 - DNA, 22 bp, Homo sapiens
tatacagtatcttttgaaggca

SEQ ID NO: 8013826 - DNA, 22 bp, Homo sapiens
tatacagtcttttgctatattc

SEQ ID NO: 8013827 - DNA, 23 bp, Homo sapiens
tatacagtctccaggcagtcctt

SEQ ID NO: 8013828 - DNA, 22 bp, Homo sapiens
tatacagtcttttgctatattc

SEQ ID NO: 8013829 - DNA, 22 bp, Homo sapiens
tatacaggaaattttggaacag

SEQ ID NO: 8013830 - DNA, 22 bp, Homo sapiens
tatacagtatcttttgaaggca

SEQ ID NO: 8013831 - DNA, 21 bp, Homo sapiens
tatacagtaattaagtggtat

SEQ ID NO: 8013832 - DNA, 22 bp, Homo sapiens
tatacagatttctgggcaatct

SEQ ID NO: 8013833 - DNA, 22 bp, Homo sapiens
tatacagctatggcaagacaaa

SEQ ID NO: 8013834 - DNA, 22 bp, Homo sapiens
tatacagattaacagatttaaa

SEQ ID NO: 8013835 - DNA, 22 bp, Homo sapiens
tatacagattaacagatttaaa

SEQ ID NO: 8013836 - DNA, 22 bp, Homo sapiens
cagggtggcacatcacagcatt

SEQ ID NO: 8013837 - DNA, 22 bp, Homo sapiens
cagggtggcacatcacagcatt

SEQ ID NO: 8013838 - DNA, 22 bp, Homo sapiens
cagggtggaatggaatgctggc

SEQ ID NO: 8013839 - DNA, 22 bp, Homo sapiens
cagggtggaatggaatgctggc

SEQ ID NO: 8013840 - DNA, 22 bp, Homo sapiens
cagggtggcacatcacagcatt

SEQ ID NO: 8013841 - DNA, 22 bp, Homo sapiens
cagggtggcacatcacagcatt

SEQ ID NO: 8013842 - DNA, 22 bp, Homo sapiens
cagggtggcacatcacagcatt

SEQ ID NO: 8013843 - DNA, 22 bp, Homo sapiens
cagggtggaagctgtagagtgg

SEQ ID NO: 8013844 - DNA, 22 bp, Homo sapiens
cagggtggaatggaatgctggc

SEQ ID NO: 8013845 - DNA, 22 bp, Homo sapiens
cagggtggaagctgtagagtgg

SEQ ID NO: 8013846 - DNA, 22 bp, Homo sapiens
cagggtggaagctgtagagtgg

SEQ ID NO: 8013847 - DNA, 22 bp, Homo sapiens
cagggtggaatggaatgctggc

SEQ ID NO: 8013848 - DNA, 22 bp, Homo sapiens
cagggtggaatggaatgctggc

SEQ ID NO: 8013849 - DNA, 22 bp, Homo sapiens
cagggtggaatggaatgctggc

SEQ ID NO: 8013850 - DNA, 22 bp, Homo sapiens
cagggtggaatggaatgctggc

SEQ ID NO: 8013851 - DNA, 22 bp, Homo sapiens
cagggtggcacatcacagcatt

SEQ ID NO: 8013852 - DNA, 22 bp, Homo sapiens
cagggtggcacatcacagcatt

SEQ ID NO: 8013853 - DNA, 22 bp, Homo sapiens
cagggtggcactcagcgcatct

SEQ ID NO: 8013854 - DNA, 22 bp, Homo sapiens
cagggtggcactcagcgcatct

SEQ ID NO: 8013855 - DNA, 22 bp, Homo sapiens
cagggtggcactcagcgcatct

SEQ ID NO: 8013856 - DNA, 22 bp, Homo sapiens
cagggtggcactcagcgcatct

SEQ ID NO: 8013857 - DNA, 22 bp, Homo sapiens
tatacagatggaaagatacaca

SEQ ID NO: 8013858 - DNA, 22 bp, Homo sapiens
tatacagatggaaagatacaca

SEQ ID NO: 8013859 - DNA, 22 bp, Homo sapiens
tatacagatggaaagatacaca

SEQ ID NO: 8013860 - DNA, 22 bp, Homo sapiens
tatacagatggaaagatacaca

SEQ ID NO: 8013861 - DNA, 22 bp, Homo sapiens
tatacagatggaaagatacaca

SEQ ID NO: 8013862 - DNA, 22 bp, Homo sapiens
tatacagttaagtttcttcagt

SEQ ID NO: 8013863 - DNA, 22 bp, Homo sapiens
caggtccaccatgcctcaagcc

SEQ ID NO: 8013864 - DNA, 22 bp, Homo sapiens
caggtccacggcgcccaggggt

SEQ ID NO: 8013865 - DNA, 22 bp, Homo sapiens
caggtccacggcgcccaggggt

SEQ ID NO: 8013866 - DNA, 22 bp, Homo sapiens
caggtccacggcgcccaggggt

SEQ ID NO: 8013867 - DNA, 22 bp, Homo sapiens
caggtccagaaaccaaaggatt

SEQ ID NO: 8013868 - DNA, 22 bp, Homo sapiens
caggtctccagctcagggtcca

SEQ ID NO: 8013869 - DNA, 20 bp, Homo sapiens
caggtccagcacgtgcacgg

SEQ ID NO: 8013870 - DNA, 22 bp, Homo sapiens
caggtctccagctcagggtcca

SEQ ID NO: 8013871 - DNA, 20 bp, Homo sapiens
caggtccagcacgtgcacgg

SEQ ID NO: 8013872 - DNA, 22 bp, Homo sapiens
caggtctcccatcccctctgtt

SEQ ID NO: 8013873 - DNA, 22 bp, Homo sapiens
caggtctccattttgatgagtt

SEQ ID NO: 8013874 - DNA, 22 bp, Homo sapiens
caggtctcgggttcagcagtga

SEQ ID NO: 8013875 - DNA, 17 bp, Homo sapiens
caggtctgaggccaggc

SEQ ID NO: 8013876 - DNA, 17 bp, Homo sapiens
caggtctgaggccaggc

SEQ ID NO: 8013877 - DNA, 17 bp, Homo sapiens
caggtctgaggccaggc

SEQ ID NO: 8013878 - DNA, 22 bp, Homo sapiens
caggtctgaagagtcacatgcc

SEQ ID NO: 8013879 - DNA, 22 bp, Homo sapiens
caggtctgaagagtcacatgcc

SEQ ID NO: 8013880 - DNA, 22 bp, Homo sapiens
caggtctgaagagtcacatgcc

SEQ ID NO: 8013881 - DNA, 22 bp, Homo sapiens
caggtctctgcagcccctctgt

SEQ ID NO: 8013882 - DNA, 22 bp, Homo sapiens
caggtctcttttgtcacaccac

SEQ ID NO: 8013883 - DNA, 22 bp, Homo sapiens
caggtctctgcagcccctctgt

SEQ ID NO: 8013884 - DNA, 22 bp, Homo sapiens
tatctattccaaatatcagcgt

SEQ ID NO: 8013885 - DNA, 22 bp, Homo sapiens
tatctattatgttctatgtgtc

SEQ ID NO: 8013886 - DNA, 22 bp, Homo sapiens
tatctatgtgctctgacctctc

SEQ ID NO: 8013887 - DNA, 22 bp, Homo sapiens
tatctatgtgctctgacctctc

SEQ ID NO: 8013888 - DNA, 22 bp, Homo sapiens
caggtctggcatcagctgtgtg

SEQ ID NO: 8013889 - DNA, 22 bp, Homo sapiens
caggtctgggttgatggcctgg

SEQ ID NO: 8013890 - DNA, 22 bp, Homo sapiens
caggtctggcatcagctgtgtg

SEQ ID NO: 8013891 - DNA, 22 bp, Homo sapiens
caggtctgcaggctggagtcca

SEQ ID NO: 8013892 - DNA, 22 bp, Homo sapiens
caggtctggcatcagctgtgtg

SEQ ID NO: 8013893 - DNA, 22 bp, Homo sapiens
caggtctggcatcagctgtgtg

SEQ ID NO: 8013894 - DNA, 22 bp, Homo sapiens
caggtctgcagacagggccatg

SEQ ID NO: 8013895 - DNA, 22 bp, Homo sapiens
caggtctgcagacagggccatg

SEQ ID NO: 8013896 - DNA, 22 bp, Homo sapiens
caggtctgcagacagggccatg

SEQ ID NO: 8013897 - DNA, 17 bp, Homo sapiens
caggtctgaggccaggc

SEQ ID NO: 8013898 - DNA, 22 bp, Homo sapiens
caggtctgcagacagggccatg

SEQ ID NO: 8013899 - DNA, 22 bp, Homo sapiens
caggtctgcagacagggccatg

SEQ ID NO: 8013900 - DNA, 22 bp, Homo sapiens
caggtctgagtcacatgttcat

SEQ ID NO: 8013901 - DNA, 22 bp, Homo sapiens
caggtctgagtcacatgttcat

SEQ ID NO: 8013902 - DNA, 22 bp, Homo sapiens
cagtgctgggcagaggagagcg

SEQ ID NO: 8013903 - DNA, 22 bp, Homo sapiens
cagtgctgggcagaggagagcg

SEQ ID NO: 8013904 - DNA, 22 bp, Homo sapiens
cagtgctgggcagaggagagcg

SEQ ID NO: 8013905 - DNA, 22 bp, Homo sapiens
cagtgctgggcagaggagagcg

SEQ ID NO: 8013906 - DNA, 22 bp, Homo sapiens
cagtgctggtgtaggctgacca

SEQ ID NO: 8013907 - DNA, 22 bp, Homo sapiens
cagtgctggtgtaggctgacca

SEQ ID NO: 8013908 - DNA, 22 bp, Homo sapiens
cagtgctggctgttaggacagt

SEQ ID NO: 8013909 - DNA, 22 bp, Homo sapiens
cagtgctggctgttaggacagt

SEQ ID NO: 8013910 - DNA, 22 bp, Homo sapiens
cagtgctggctgttaggacagt

SEQ ID NO: 8013911 - DNA, 22 bp, Homo sapiens
cagtgctgggcagaggagagcg

SEQ ID NO: 8013912 - DNA, 22 bp, Homo sapiens
cagtgctgggcagaggagagcg

SEQ ID NO: 8013913 - DNA, 22 bp, Homo sapiens
cagtgctgggcagaggagagcg

SEQ ID NO: 8013914 - DNA, 22 bp, Homo sapiens
cagtgctggctgttaggacagt

SEQ ID NO: 8013915 - DNA, 22 bp, Homo sapiens
cagtgctggctgttaggacagt

SEQ ID NO: 8013916 - DNA, 22 bp, Homo sapiens
cagtgctggctgttaggacagt

SEQ ID NO: 8013917 - DNA, 22 bp, Homo sapiens
cagtgctggctgttaggacagt

SEQ ID NO: 8013918 - DNA, 22 bp, Homo sapiens
cagtgctggaggctggagggaa

SEQ ID NO: 8013919 - DNA, 22 bp, Homo sapiens
cagtgctggaggctggagggaa

SEQ ID NO: 8013920 - DNA, 22 bp, Homo sapiens
cagtgctggaggggtgcttgca

SEQ ID NO: 8013921 - DNA, 22 bp, Homo sapiens
cagtgctggaggggtgcttgca

SEQ ID NO: 8013922 - DNA, 22 bp, Homo sapiens
cagtgctggaggggtgcttgca

SEQ ID NO: 8013923 - DNA, 22 bp, Homo sapiens
cagtgctggctgttaggacagt

SEQ ID NO: 8013924 - DNA, 22 bp, Homo sapiens
cagtgctggaggggtgcttgca

SEQ ID NO: 8013925 - DNA, 21 bp, Homo sapiens
cagtgctgcctaatagggagt

SEQ ID NO: 8013926 - DNA, 21 bp, Homo sapiens
cagtgctgcctaatagggagt

SEQ ID NO: 8013927 - DNA, 21 bp, Homo sapiens
cagtgctgcctaatagggagt

SEQ ID NO: 8013928 - DNA, 22 bp, Homo sapiens
cagtgctgctctctgtaagaga

SEQ ID NO: 8013929 - DNA, 22 bp, Homo sapiens
cagtgctgctctctgtaagaga

SEQ ID NO: 8013930 - DNA, 22 bp, Homo sapiens
cagtgctggagatgggtggaac

SEQ ID NO: 8013931 - DNA, 22 bp, Homo sapiens
cagtgctggagatgggtggaac

SEQ ID NO: 8013932 - DNA, 22 bp, Homo sapiens
cagtgctggagatgggtggaac

SEQ ID NO: 8013933 - DNA, 22 bp, Homo sapiens
cagtgctggaggctggagggaa

SEQ ID NO: 8013934 - DNA, 22 bp, Homo sapiens
cagtgctggaggctggagggaa

SEQ ID NO: 8013935 - DNA, 22 bp, Homo sapiens
cagtgctggaggctggagggaa

SEQ ID NO: 8013936 - DNA, 22 bp, Homo sapiens
cagtgctggaggctggagggaa

SEQ ID NO: 8013937 - DNA, 22 bp, Homo sapiens
cagtgcagaggccagggaggat

SEQ ID NO: 8013938 - DNA, 17 bp, Homo sapiens
cagtgcagagccctttc

SEQ ID NO: 8013939 - DNA, 22 bp, Homo sapiens
cagtgcagaggccagggaggat

SEQ ID NO: 8013940 - DNA, 22 bp, Homo sapiens
cagtgcagaggccagggaggat

SEQ ID NO: 8013941 - DNA, 22 bp, Homo sapiens
cagtgcagaggccagggaggat

SEQ ID NO: 8013942 - DNA, 22 bp, Homo sapiens
cagtgcagaggccagggaggat

SEQ ID NO: 8013943 - DNA, 22 bp, Homo sapiens
cagtgcagaggccagggaggat

SEQ ID NO: 8013944 - DNA, 22 bp, Homo sapiens
cagtgcagaggccagggaggat

SEQ ID NO: 8013945 - DNA, 22 bp, Homo sapiens
cagtgcagaggccagggaggat

SEQ ID NO: 8013946 - DNA, 22 bp, Homo sapiens
cagtgcagaggccagggaggat

SEQ ID NO: 8013947 - DNA, 22 bp, Homo sapiens
cagtgcagaggccagggaggat

SEQ ID NO: 8013948 - DNA, 22 bp, Homo sapiens
cagtgcccaagatgtgccatgc

SEQ ID NO: 8013949 - DNA, 22 bp, Homo sapiens
cagtgctgacagggaggaacct

SEQ ID NO: 8013950 - DNA, 22 bp, Homo sapiens
cagtgctgacagggaggaacct

SEQ ID NO: 8013951 - DNA, 22 bp, Homo sapiens
cagtgctgacagggaggaacct

SEQ ID NO: 8013952 - DNA, 22 bp, Homo sapiens
cagtgctgacagggaggaacct

SEQ ID NO: 8013953 - DNA, 19 bp, Homo sapiens
cagtgcccaccctagcaca

SEQ ID NO: 8013954 - DNA, 21 bp, Homo sapiens
cagtgccccagctacaaaagg

SEQ ID NO: 8013955 - DNA, 19 bp, Homo sapiens
cagtgcccgacgcaggtct

SEQ ID NO: 8013956 - DNA, 22 bp, Homo sapiens
cagtgctcctgatgtacccttg

SEQ ID NO: 8013957 - DNA, 22 bp, Homo sapiens
cagtgctgcatctccatgccag

SEQ ID NO: 8013958 - DNA, 22 bp, Homo sapiens
cagtgctgccaaagggaccttg

SEQ ID NO: 8013959 - DNA, 22 bp, Homo sapiens
cagtgctgccaaagggaccttg

SEQ ID NO: 8013960 - DNA, 21 bp, Homo sapiens
cagtgctgcctaatagggagt

SEQ ID NO: 8013961 - DNA, 21 bp, Homo sapiens
cagtgctgcctaatagggagt

SEQ ID NO: 8013962 - DNA, 22 bp, Homo sapiens
cagtgctgcaggcgcctgcggt

SEQ ID NO: 8013963 - DNA, 22 bp, Homo sapiens
cagtgctgcaggcgcctgcggt

SEQ ID NO: 8013964 - DNA, 22 bp, Homo sapiens
cagtgctgcatctccatgccag

SEQ ID NO: 8013965 - DNA, 22 bp, Homo sapiens
cagtgctgcatctccatgccag

SEQ ID NO: 8013966 - DNA, 22 bp, Homo sapiens
cagtgctgcatctccatgccag

SEQ ID NO: 8013967 - DNA, 22 bp, Homo sapiens
cagtgctgagagcctggccagg

SEQ ID NO: 8013968 - DNA, 22 bp, Homo sapiens
cagtgctgagagcctggccagg

SEQ ID NO: 8013969 - DNA, 22 bp, Homo sapiens
cagtgctgcaggcgcctgcggt

SEQ ID NO: 8013970 - DNA, 22 bp, Homo sapiens
cagtgctgcaggcgcctgcggt

SEQ ID NO: 8013971 - DNA, 22 bp, Homo sapiens
cagtgctgagagcctggccagg

SEQ ID NO: 8013972 - DNA, 22 bp, Homo sapiens
cagtgctgagagcctggccagg

SEQ ID NO: 8013973 - DNA, 22 bp, Homo sapiens
cagtgctgagagcctggccagg

SEQ ID NO: 8013974 - DNA, 22 bp, Homo sapiens
cagtgctgacagggaggaacct

SEQ ID NO: 8013975 - DNA, 22 bp, Homo sapiens
cagtgctgagagcctggccagg

SEQ ID NO: 8013976 - DNA, 22 bp, Homo sapiens
tcaccagggctccagccagcct

SEQ ID NO: 8013977 - DNA, 22 bp, Homo sapiens
tcaccagggaggcttaacttat

SEQ ID NO: 8013978 - DNA, 22 bp, Homo sapiens
tcaccagggagcttgtcctctg

SEQ ID NO: 8013979 - DNA, 22 bp, Homo sapiens
tcaccagggagcttgtcctctg

SEQ ID NO: 8013980 - DNA, 22 bp, Homo sapiens
tcaccagggagcttgtcctctg

SEQ ID NO: 8013981 - DNA, 22 bp, Homo sapiens
tcaccaggctggagtgcagtgg

SEQ ID NO: 8013982 - DNA, 22 bp, Homo sapiens
tcaccagggctccagccagcct

SEQ ID NO: 8013983 - DNA, 22 bp, Homo sapiens
tcaccagggctccagccagcct

SEQ ID NO: 8013984 - DNA, 22 bp, Homo sapiens
tcaccagtctttcttaccattg

SEQ ID NO: 8013985 - DNA, 22 bp, Homo sapiens
tcaccagttaaaataacagtaa

SEQ ID NO: 8013986 - DNA, 22 bp, Homo sapiens
tcaccataggaacacagtcaga

SEQ ID NO: 8013987 - DNA, 22 bp, Homo sapiens
tcacccaagaccatcggaagtg

SEQ ID NO: 8013988 - DNA, 22 bp, Homo sapiens
cagtgctgttgtaagctcattg

SEQ ID NO: 8013989 - DNA, 22 bp, Homo sapiens
cagtgctgttgtaagctcattg

SEQ ID NO: 8013990 - DNA, 22 bp, Homo sapiens
tcacattgaagaaattttaagt

SEQ ID NO: 8013991 - DNA, 22 bp, Homo sapiens
tcacattctttatttgccatcc

SEQ ID NO: 8013992 - DNA, 22 bp, Homo sapiens
tcacattgaatggaagaataga

SEQ ID NO: 8013993 - DNA, 22 bp, Homo sapiens
tcacattgaagaaattttaagt

SEQ ID NO: 8013994 - DNA, 22 bp, Homo sapiens
tcacattgccattagttcagtt

SEQ ID NO: 8013995 - DNA, 22 bp, Homo sapiens
tcaccaggctcctgttaagatg

SEQ ID NO: 8013996 - DNA, 22 bp, Homo sapiens
tcaccaggctagagtgcagtgg

SEQ ID NO: 8013997 - DNA, 22 bp, Homo sapiens
tcaccaggctagagtgcagtgg

SEQ ID NO: 8013998 - DNA, 22 bp, Homo sapiens
tcaccaggctggaatgcagtgg

SEQ ID NO: 8013999 - DNA, 22 bp, Homo sapiens
tcaccaggctggagtgcagtgg

SEQ ID NO: 8014000 - DNA, 22 bp, Homo sapiens
tcaccaggctggagtgcagtgg

SEQ ID NO: 8014001 - DNA, 22 bp, Homo sapiens
tcaccaggctcctgttaagatg

SEQ ID NO: 8014002 - DNA, 22 bp, Homo sapiens
tcaccaggctggaatgcagtgg

SEQ ID NO: 8014003 - DNA, 22 bp, Homo sapiens
tcaccaggctggaatgcagtgg

SEQ ID NO: 8014004 - DNA, 22 bp, Homo sapiens
cagtgctgtgtttgctgcctgg

SEQ ID NO: 8014005 - DNA, 22 bp, Homo sapiens
cagtgctgtgtttgctgcctgg

SEQ ID NO: 8014006 - DNA, 22 bp, Homo sapiens
cagtgctgtgctggaagctgtt

SEQ ID NO: 8014007 - DNA, 22 bp, Homo sapiens
cagtgctgtgtttgctgcctgg

SEQ ID NO: 8014008 - DNA, 22 bp, Homo sapiens
cagtgctgtgctggaagctgtt

SEQ ID NO: 8014009 - DNA, 22 bp, Homo sapiens
cagtgctgtgctggaagctgtt

SEQ ID NO: 8014010 - DNA, 22 bp, Homo sapiens
cagtgctgtgctggaagctgtt

SEQ ID NO: 8014011 - DNA, 22 bp, Homo sapiens
cagtgctgtgctggaagctgtt

SEQ ID NO: 8014012 - DNA, 23 bp, Homo sapiens
cagtgctggttctgcctgtgggg

SEQ ID NO: 8014013 - DNA, 22 bp, Homo sapiens
cagtgctgtgctggaagctgtt

SEQ ID NO: 8014014 - DNA, 23 bp, Homo sapiens
cagtgctggttctgcctgtgggg

SEQ ID NO: 8014015 - DNA, 23 bp, Homo sapiens
cagtgctggttctgcctgtgggg

SEQ ID NO: 8014016 - DNA, 23 bp, Homo sapiens
cagtgctggttctgcctgtgggg

SEQ ID NO: 8014017 - DNA, 22 bp, Homo sapiens
cagtgctggtgtaggctgacca

SEQ ID NO: 8014018 - DNA, 22 bp, Homo sapiens
cagtgctggtgtaggctgacca

SEQ ID NO: 8014019 - DNA, 23 bp, Homo sapiens
cagtgctggttctgcctgtgggg

SEQ ID NO: 8014020 - DNA, 23 bp, Homo sapiens
cagtgctggttctgcctgtgggg

SEQ ID NO: 8014021 - DNA, 23 bp, Homo sapiens
cagtgctggttctgcctgtgggg

SEQ ID NO: 8014022 - DNA, 19 bp, Homo sapiens
cagtgctgttcattcagtg

SEQ ID NO: 8014023 - DNA, 19 bp, Homo sapiens
cagtgctgttcattcagtg

SEQ ID NO: 8014024 - DNA, 22 bp, Homo sapiens
cagtgctgttgggcccagagag

SEQ ID NO: 8014025 - DNA, 19 bp, Homo sapiens
cagtgctgttcattcagtg

SEQ ID NO: 8014026 - DNA, 19 bp, Homo sapiens
cagtgctgttcattcagtg

SEQ ID NO: 8014027 - DNA, 19 bp, Homo sapiens
cagtgctgttcattcagtg

SEQ ID NO: 8014028 - DNA, 22 bp, Homo sapiens
cagtgctgttgggcccagagag

SEQ ID NO: 8014029 - DNA, 22 bp, Homo sapiens
cagtgctgttgggcccagagag

SEQ ID NO: 8014030 - DNA, 22 bp, Homo sapiens
cagtgctgttgggcccagagag

SEQ ID NO: 8014031 - DNA, 22 bp, Homo sapiens
cagtgctgttgggcccagagag

SEQ ID NO: 8014032 - DNA, 22 bp, Homo sapiens
cagtgctgtgtttgctgcctgg

SEQ ID NO: 8014033 - DNA, 22 bp, Homo sapiens
cagtgctgtgtttgctgcctgg

SEQ ID NO: 8014034 - DNA, 18 bp, Homo sapiens
cagtgctgttaacagtga

SEQ ID NO: 8014035 - DNA, 18 bp, Homo sapiens
cagtgctgttaacagtga

SEQ ID NO: 8014036 - DNA, 22 bp, Homo sapiens
cagtgctgtgtttgctgcctgg

SEQ ID NO: 8014037 - DNA, 22 bp, Homo sapiens
cagtgctgtgtttgctgcctgg

SEQ ID NO: 8014038 - DNA, 22 bp, Homo sapiens
cagtgctgttaataaacacaaa

SEQ ID NO: 8014039 - DNA, 22 bp, Homo sapiens
cagtgctgttaataaacacaaa

SEQ ID NO: 8014040 - DNA, 18 bp, Homo sapiens
cagtgctgttaacagtga

SEQ ID NO: 8014041 - DNA, 19 bp, Homo sapiens
cagtgctgttcattcagtg

SEQ ID NO: 8014042 - DNA, 19 bp, Homo sapiens
cagtgctgttcattcagtg

SEQ ID NO: 8014043 - DNA, 22 bp, Homo sapiens
cagtgctgttaataaacacaaa

SEQ ID NO: 8014044 - DNA, 22 bp, Homo sapiens
tcactcaatggtatcaggaggt

SEQ ID NO: 8014045 - DNA, 22 bp, Homo sapiens
tcactcagagatagcctcattt

SEQ ID NO: 8014046 - DNA, 22 bp, Homo sapiens
tcactcagcattcactgggcct

SEQ ID NO: 8014047 - DNA, 22 bp, Homo sapiens
tcactcagctagcttcaggagc

SEQ ID NO: 8014048 - DNA, 22 bp, Homo sapiens
tcactcagcattcactgggcct

SEQ ID NO: 8014049 - DNA, 22 bp, Homo sapiens
tcactcaagcatctacagggat

SEQ ID NO: 8014050 - DNA, 22 bp, Homo sapiens
tcacccagcagctgcttctgct

SEQ ID NO: 8014051 - DNA, 22 bp, Homo sapiens
tcacccagacagcttgcactga

SEQ ID NO: 8014052 - DNA, 22 bp, Homo sapiens
tcacccagactgtctgactctt

SEQ ID NO: 8014053 - DNA, 22 bp, Homo sapiens
tcacccagaaaagacagcagat

SEQ ID NO: 8014054 - DNA, 22 bp, Homo sapiens
tcacccaagaccatcggaagtg

SEQ ID NO: 8014055 - DNA, 22 bp, Homo sapiens
tcacccagacttgtgaatgtgt

SEQ ID NO: 8014056 - DNA, 22 bp, Homo sapiens
tcacccagatagtgagcatagt

SEQ ID NO: 8014057 - DNA, 22 bp, Homo sapiens
tcacccagattacatcctgtca

SEQ ID NO: 8014058 - DNA, 22 bp, Homo sapiens
tcactcaggctggagtgcagtg

SEQ ID NO: 8014059 - DNA, 22 bp, Homo sapiens
tcactcaggttcatgtctttgt

SEQ ID NO: 8014060 - DNA, 22 bp, Homo sapiens
tcactcaggttcatgtctttgt

SEQ ID NO: 8014061 - DNA, 22 bp, Homo sapiens
tcactcagtttttggcctctgc

SEQ ID NO: 8014062 - DNA, 22 bp, Homo sapiens
tcactcaggctggagtgcagtg

SEQ ID NO: 8014063 - DNA, 22 bp, Homo sapiens
tcactccatctttgctactggt

SEQ ID NO: 8014064 - DNA, 22 bp, Homo sapiens
tcactccatagcttaactcttt

SEQ ID NO: 8014065 - DNA, 22 bp, Homo sapiens
tcactccatagcttaactcttt

SEQ ID NO: 8014066 - DNA, 22 bp, Homo sapiens
tcactcatattatctctccaca

SEQ ID NO: 8014067 - DNA, 22 bp, Homo sapiens
tcactccaaaccccaggcttgt

SEQ ID NO: 8014068 - DNA, 22 bp, Homo sapiens
tcactcatattatctctccaca

SEQ ID NO: 8014069 - DNA, 22 bp, Homo sapiens
tcactcctcaggctagcatcat

SEQ ID NO: 8014070 - DNA, 22 bp, Homo sapiens
tcactcctcaggctagcatcat

SEQ ID NO: 8014071 - DNA, 22 bp, Homo sapiens
tcacttcccagacggggtggca

SEQ ID NO: 8014072 - DNA, 22 bp, Homo sapiens
tcacttcccagacggggtggca

SEQ ID NO: 8014073 - DNA, 22 bp, Homo sapiens
tcactccatctttgctactggt

SEQ ID NO: 8014074 - DNA, 22 bp, Homo sapiens
tcactccatctttgctactggt

SEQ ID NO: 8014075 - DNA, 22 bp, Homo sapiens
tcagaaagtgaactgttgacat

SEQ ID NO: 8014076 - DNA, 22 bp, Homo sapiens
tcagaaagtgaactgttgacat

SEQ ID NO: 8014077 - DNA, 22 bp, Homo sapiens
tcagaaagtgaactgttgacat

SEQ ID NO: 8014078 - DNA, 22 bp, Homo sapiens
tcagaaaggttgagtcatgtgc

SEQ ID NO: 8014079 - DNA, 22 bp, Homo sapiens
tcagaaaggttgagtcatgtgc

SEQ ID NO: 8014080 - DNA, 22 bp, Homo sapiens
tcacttcgtaaacccctcccat

SEQ ID NO: 8014081 - DNA, 22 bp, Homo sapiens
tcacttccctcttcagctccca

SEQ ID NO: 8014082 - DNA, 22 bp, Homo sapiens
tcagaacaattcctttataaca

SEQ ID NO: 8014083 - DNA, 22 bp, Homo sapiens
tcagaacaattcctttataaca

SEQ ID NO: 8014084 - DNA, 22 bp, Homo sapiens
tcagaagctaaatttgatattt

SEQ ID NO: 8014085 - DNA, 22 bp, Homo sapiens
tcagaagctgggtctcagaagc

SEQ ID NO: 8014086 - DNA, 21 bp, Homo sapiens
tcagaacaattccatgcctcc

SEQ ID NO: 8014087 - DNA, 22 bp, Homo sapiens
tcagaaatttaggctggacttg

SEQ ID NO: 8014088 - DNA, 22 bp, Homo sapiens
tcagaaatttaggctggacttg

SEQ ID NO: 8014089 - DNA, 22 bp, Homo sapiens
tcagaaatttaggctggacttg

SEQ ID NO: 8014090 - DNA, 22 bp, Homo sapiens
tcagaaattttctcagtagttc

SEQ ID NO: 8014091 - DNA, 23 bp, Homo sapiens
tcagaacaatgccttaggggcat

SEQ ID NO: 8014092 - DNA, 22 bp, Homo sapiens
tcagaaattttctcagtagttc

SEQ ID NO: 8014093 - DNA, 22 bp, Homo sapiens
tcagaaggaaacgatgccagct

SEQ ID NO: 8014094 - DNA, 22 bp, Homo sapiens
tcagaagctgggtctcagaagc

SEQ ID NO: 8014095 - DNA, 22 bp, Homo sapiens
tcagaacaattcctttataaca

SEQ ID NO: 8014096 - DNA, 22 bp, Homo sapiens
tcagaaggaaacgatgccagct

SEQ ID NO: 8014097 - DNA, 22 bp, Homo sapiens
tcagaaggaagaagtcatggga

SEQ ID NO: 8014098 - DNA, 19 bp, Homo sapiens
tcagaaggcaggagaggcc

SEQ ID NO: 8014099 - DNA, 19 bp, Homo sapiens
tcagaaggcaggagaggcc

SEQ ID NO: 8014100 - DNA, 22 bp, Homo sapiens
tcagaaggcccgttgctaagag

SEQ ID NO: 8014101 - DNA, 20 bp, Homo sapiens
tcagaaggctccagagcaga

SEQ ID NO: 8014102 - DNA, 20 bp, Homo sapiens
tcagaaggctccagagcaga

SEQ ID NO: 8014103 - DNA, 22 bp, Homo sapiens
tcagaaggatgtgcaggtggca

SEQ ID NO: 8014104 - DNA, 22 bp, Homo sapiens
tcagaaggaagttagagtatgg

SEQ ID NO: 8014105 - DNA, 22 bp, Homo sapiens
tcagaaggaagttagagtatgg

SEQ ID NO: 8014106 - DNA, 22 bp, Homo sapiens
tcagaaggatgtgcaggtggca

SEQ ID NO: 8014107 - DNA, 22 bp, Homo sapiens
tcagaaggatgtgcaggtggca

SEQ ID NO: 8014108 - DNA, 22 bp, Homo sapiens
tcagaaatgtaagctgatgact

SEQ ID NO: 8014109 - DNA, 22 bp, Homo sapiens
tcagaaatagtctttaaaatga

SEQ ID NO: 8014110 - DNA, 22 bp, Homo sapiens
tcagaaatcttgtcaaggcatc

SEQ ID NO: 8014111 - DNA, 22 bp, Homo sapiens
tcagaaatcttgtcaaggcatc

SEQ ID NO: 8014112 - DNA, 22 bp, Homo sapiens
tcagaaatgatcgttattcatt

SEQ ID NO: 8014113 - DNA, 22 bp, Homo sapiens
tcagaaatacaaaacacttact

SEQ ID NO: 8014114 - DNA, 22 bp, Homo sapiens
tcagaaatactatcagcttttg

SEQ ID NO: 8014115 - DNA, 22 bp, Homo sapiens
tcagaaatagctctaagctcct

SEQ ID NO: 8014116 - DNA, 22 bp, Homo sapiens
tcagaaatagctctaagctcct

SEQ ID NO: 8014117 - DNA, 22 bp, Homo sapiens
tcagaaatagtctttaaaatga

SEQ ID NO: 8014118 - DNA, 22 bp, Homo sapiens
tcagaaataatgaatgatgggg

SEQ ID NO: 8014119 - DNA, 22 bp, Homo sapiens
tcagaaataatgaatgatgggg

SEQ ID NO: 8014120 - DNA, 22 bp, Homo sapiens
tcagaaagtgaactgttgacat

SEQ ID NO: 8014121 - DNA, 22 bp, Homo sapiens
tcagaaatacaaaacacttact

SEQ ID NO: 8014122 - DNA, 22 bp, Homo sapiens
tcagaaataatgaatgatgggg

SEQ ID NO: 8014123 - DNA, 22 bp, Homo sapiens
tcagaaatacaaaacacttact

SEQ ID NO: 8014124 - DNA, 22 bp, Homo sapiens
tcagaaatacaaaacacttact

SEQ ID NO: 8014125 - DNA, 22 bp, Homo sapiens
cagtgcagaacacatggaaaat

SEQ ID NO: 8014126 - DNA, 22 bp, Homo sapiens
cagtgcagaacacatggaaaat

SEQ ID NO: 8014127 - DNA, 22 bp, Homo sapiens
cagtgcagacgtggagggggca

SEQ ID NO: 8014128 - DNA, 22 bp, Homo sapiens
cagtgcagacgtggagggggca

SEQ ID NO: 8014129 - DNA, 22 bp, Homo sapiens
cagtgcacgggccagtcctgcc

SEQ ID NO: 8014130 - DNA, 22 bp, Homo sapiens
cagtgcacacaatcctctgccg

SEQ ID NO: 8014131 - DNA, 22 bp, Homo sapiens
cagtgcagaacacatggaaaat

SEQ ID NO: 8014132 - DNA, 22 bp, Homo sapiens
cagtgcagaacacatggaaaat

SEQ ID NO: 8014133 - DNA, 22 bp, Homo sapiens
cagtgcacacaatcctctgccg

SEQ ID NO: 8014134 - DNA, 22 bp, Homo sapiens
cagtgcagaacacatggaaaat

SEQ ID NO: 8014135 - DNA, 22 bp, Homo sapiens
cagtgcagacgtggagggggca

SEQ ID NO: 8014136 - DNA, 22 bp, Homo sapiens
cagtgcagacgtggagggggca

SEQ ID NO: 8014137 - DNA, 22 bp, Homo sapiens
cagtgcagacgtggagggggca

SEQ ID NO: 8014138 - DNA, 22 bp, Homo sapiens
cagtgcagacgtggagggggca

SEQ ID NO: 8014139 - DNA, 17 bp, Homo sapiens
cagtgcagagccctttc

SEQ ID NO: 8014140 - DNA, 17 bp, Homo sapiens
cagtgcagagccctttc

SEQ ID NO: 8014141 - DNA, 17 bp, Homo sapiens
cagtgcagagccctttc

SEQ ID NO: 8014142 - DNA, 17 bp, Homo sapiens
cagtgcagagccctttc

SEQ ID NO: 8014143 - DNA, 22 bp, Homo sapiens
cagtgcagaggccagggaggat

SEQ ID NO: 8014144 - DNA, 22 bp, Homo sapiens
cagtgcaatattcaaagtggag

SEQ ID NO: 8014145 - DNA, 22 bp, Homo sapiens
cagtgcaagtgactgatcaagg

SEQ ID NO: 8014146 - DNA, 22 bp, Homo sapiens
cagtgcaatattcaaagtggag

SEQ ID NO: 8014147 - DNA, 22 bp, Homo sapiens
cagtgcaagggtgctgggggca

SEQ ID NO: 8014148 - DNA, 22 bp, Homo sapiens
cagtgcaagctgatactgaggt

SEQ ID NO: 8014149 - DNA, 22 bp, Homo sapiens
cagtgcaagggtgctgggggca

SEQ ID NO: 8014150 - DNA, 20 bp, Homo sapiens
cagtgcaactgaagaactga

SEQ ID NO: 8014151 - DNA, 22 bp, Homo sapiens
cagtgcaacttttgcctcccgg

SEQ ID NO: 8014152 - DNA, 20 bp, Homo sapiens
cagtgcaactgaagaactga

SEQ ID NO: 8014153 - DNA, 22 bp, Homo sapiens
cagtgcaacttttgcctcccgg

SEQ ID NO: 8014154 - DNA, 22 bp, Homo sapiens
cagtgcaatgcagatgacacca

SEQ ID NO: 8014155 - DNA, 22 bp, Homo sapiens
cagtgcaatgttaaataggaaa

SEQ ID NO: 8014156 - DNA, 22 bp, Homo sapiens
cagtgcaatgcagatgacacca

SEQ ID NO: 8014157 - DNA, 22 bp, Homo sapiens
cagtgcaattagaacttattta

SEQ ID NO: 8014158 - DNA, 21 bp, Homo sapiens
cagtgcaattgattttttaga

SEQ ID NO: 8014159 - DNA, 21 bp, Homo sapiens
cagtgcaattgattttttaga

SEQ ID NO: 8014160 - DNA, 22 bp, Homo sapiens
cagtgcaattacaagctaattc

SEQ ID NO: 8014161 - DNA, 22 bp, Homo sapiens
cagtgattaaaacatgacagcc

SEQ ID NO: 8014162 - DNA, 19 bp, Homo sapiens
cagtgattaattcatctta

SEQ ID NO: 8014163 - DNA, 22 bp, Homo sapiens
cagtgattcacgcccttgggcc

SEQ ID NO: 8014164 - DNA, 22 bp, Homo sapiens
cagtgattcagactcatcattt

SEQ ID NO: 8014165 - DNA, 22 bp, Homo sapiens
cagtgatgaatgaaccacaggt

SEQ ID NO: 8014166 - DNA, 22 bp, Homo sapiens
cagtgatgatcattgtaacatc

SEQ ID NO: 8014167 - DNA, 22 bp, Homo sapiens
cagtgatgatcattgtaacatc

SEQ ID NO: 8014168 - DNA, 22 bp, Homo sapiens
cagtgatggatatggagaagtc

SEQ ID NO: 8014169 - DNA, 22 bp, Homo sapiens
cagtgatgtttctgcatcagag

SEQ ID NO: 8014170 - DNA, 22 bp, Homo sapiens
cagtgattcaggtctccagttt

SEQ ID NO: 8014171 - DNA, 22 bp, Homo sapiens
cagtgcaacgttgtgcattcaa

SEQ ID NO: 8014172 - DNA, 22 bp, Homo sapiens
cagtgcaacgttgtgcattcaa

SEQ ID NO: 8014173 - DNA, 20 bp, Homo sapiens
cagtgcaactgaagaactga

SEQ ID NO: 8014174 - DNA, 22 bp, Homo sapiens
cagtgcaacgttgtgcattcaa

SEQ ID NO: 8014175 - DNA, 22 bp, Homo sapiens
cagtgcaaactccctgaggtgg

SEQ ID NO: 8014176 - DNA, 22 bp, Homo sapiens
cagtgcaaactccctgaggtgg

SEQ ID NO: 8014177 - DNA, 22 bp, Homo sapiens
cagtgcaacagattcgagaagc

SEQ ID NO: 8014178 - DNA, 22 bp, Homo sapiens
cagtgcaacagattcgagaagc

SEQ ID NO: 8014179 - DNA, 22 bp, Homo sapiens
cagtgatttttacagtaaggaa

SEQ ID NO: 8014180 - DNA, 22 bp, Homo sapiens
cagtctaacttcacagcctgga

SEQ ID NO: 8014181 - DNA, 22 bp, Homo sapiens
cagtccttggcttcatccgagt

SEQ ID NO: 8014182 - DNA, 19 bp, Homo sapiens
cagtcctttccgctttctc

SEQ ID NO: 8014183 - DNA, 18 bp, Homo sapiens
cagtctaattcccttccc

SEQ ID NO: 8014184 - DNA, 22 bp, Homo sapiens
cagtctcaccctggaggcccca

SEQ ID NO: 8014185 - DNA, 22 bp, Homo sapiens
cagtctcaccctggaggcccca

SEQ ID NO: 8014186 - DNA, 22 bp, Homo sapiens
cagtctcagaggtgggagtggg

SEQ ID NO: 8014187 - DNA, 22 bp, Homo sapiens
cagtctcaccctggaggcccca

SEQ ID NO: 8014188 - DNA, 22 bp, Homo sapiens
cagtctagatgctagaaaatat

SEQ ID NO: 8014189 - DNA, 18 bp, Homo sapiens
cagtctagtgagaaatgt

SEQ ID NO: 8014190 - DNA, 18 bp, Homo sapiens
cagtctagtgagaaatgt

SEQ ID NO: 8014191 - DNA, 20 bp, Homo sapiens
cagtgaggaggtgctggggg

SEQ ID NO: 8014192 - DNA, 20 bp, Homo sapiens
cagtgaggaggtgctggggg

SEQ ID NO: 8014193 - DNA, 20 bp, Homo sapiens
cagtgaggaggtgctggggg

SEQ ID NO: 8014194 - DNA, 20 bp, Homo sapiens
cagtgaggaggtgctggggg

SEQ ID NO: 8014195 - DNA, 22 bp, Homo sapiens
cagtctccgccagctcctcaca

SEQ ID NO: 8014196 - DNA, 22 bp, Homo sapiens
cagtctcctgggggctgttgtt

SEQ ID NO: 8014197 - DNA, 22 bp, Homo sapiens
cagtctcctgggggctgttgtt

SEQ ID NO: 8014198 - DNA, 22 bp, Homo sapiens
cagtctcagaggtgggagtggg

SEQ ID NO: 8014199 - DNA, 22 bp, Homo sapiens
cagtctcatagttgtttcttat

SEQ ID NO: 8014200 - DNA, 22 bp, Homo sapiens
cagtctcagaggtgggagtggg

SEQ ID NO: 8014201 - DNA, 22 bp, Homo sapiens
cagtctccaaatcagtctgaat

SEQ ID NO: 8014202 - DNA, 22 bp, Homo sapiens
cagtctccaaatcaatctgaat

SEQ ID NO: 8014203 - DNA, 22 bp, Homo sapiens
cagtctcatagttgtttcttat

SEQ ID NO: 8014204 - DNA, 22 bp, Homo sapiens
cagtctccaaatcaatctgaat

SEQ ID NO: 8014205 - DNA, 22 bp, Homo sapiens
cagtctccaaatcagtctgaat

SEQ ID NO: 8014206 - DNA, 22 bp, Homo sapiens
cagtctccaaatcagtctgaat

SEQ ID NO: 8014207 - DNA, 22 bp, Homo sapiens
cagtctccgccagctcctcaca

SEQ ID NO: 8014208 - DNA, 20 bp, Homo sapiens
cagtgaggaggtgctggggg

SEQ ID NO: 8014209 - DNA, 22 bp, Homo sapiens
cagtgagggcccccttccaggt

SEQ ID NO: 8014210 - DNA, 22 bp, Homo sapiens
cagtgaggtggatggatggcct

SEQ ID NO: 8014211 - DNA, 22 bp, Homo sapiens
cagtgaggtgcccagcctgccc

SEQ ID NO: 8014212 - DNA, 22 bp, Homo sapiens
cagtgaggtgcccagcctgccc

SEQ ID NO: 8014213 - DNA, 22 bp, Homo sapiens
cagtgaggtgcccagcctgccc

SEQ ID NO: 8014214 - DNA, 21 bp, Homo sapiens
cagtgaggtccccagcctagg

SEQ ID NO: 8014215 - DNA, 21 bp, Homo sapiens
cagtgaggtccccagcctagg

SEQ ID NO: 8014216 - DNA, 22 bp, Homo sapiens
cagtgaggtgcccagcctgccc

SEQ ID NO: 8014217 - DNA, 22 bp, Homo sapiens
cagtgaggtggatggatggcct

SEQ ID NO: 8014218 - DNA, 22 bp, Homo sapiens
cagtgaggtggatggatggcct

SEQ ID NO: 8014219 - DNA, 22 bp, Homo sapiens
cagtgaggtggatggatggcct

SEQ ID NO: 8014220 - DNA, 22 bp, Homo sapiens
cagtgaggtggatggatggcct

SEQ ID NO: 8014221 - DNA, 22 bp, Homo sapiens
cagtgaggtggatggatggcct

SEQ ID NO: 8014222 - DNA, 22 bp, Homo sapiens
cagtgaggtggatggatggcct

SEQ ID NO: 8014223 - DNA, 22 bp, Homo sapiens
cagtgagtaagtagacagctta

SEQ ID NO: 8014224 - DNA, 22 bp, Homo sapiens
cagtgagtccaagatggctgaa

SEQ ID NO: 8014225 - DNA, 22 bp, Homo sapiens
cagtgagtaagtagacagctta

SEQ ID NO: 8014226 - DNA, 22 bp, Homo sapiens
cagtgagtgtgggaagtctctg

SEQ ID NO: 8014227 - DNA, 22 bp, Homo sapiens
cagtgagttcatcaagacatga

SEQ ID NO: 8014228 - DNA, 22 bp, Homo sapiens
cagtgagtgtgggaagtctctg

SEQ ID NO: 8014229 - DNA, 22 bp, Homo sapiens
cagtgatatttatcctactcac

SEQ ID NO: 8014230 - DNA, 17 bp, Homo sapiens
cagtgatcattacatta

SEQ ID NO: 8014231 - DNA, 17 bp, Homo sapiens
cagtgatcattacatta

SEQ ID NO: 8014232 - DNA, 22 bp, Homo sapiens
cagtgatatttatcctactcac

SEQ ID NO: 8014233 - DNA, 22 bp, Homo sapiens
tattggaccacagactttaagg

SEQ ID NO: 8014234 - DNA, 22 bp, Homo sapiens
tattggaggaaaccaagaagaa

SEQ ID NO: 8014235 - DNA, 22 bp, Homo sapiens
tattggagaggtcttgggtaga

SEQ ID NO: 8014236 - DNA, 22 bp, Homo sapiens
tattggaagtgaacaccaggct

SEQ ID NO: 8014237 - DNA, 22 bp, Homo sapiens
tattggaaggcattagtgaata

SEQ ID NO: 8014238 - DNA, 22 bp, Homo sapiens
tattggaatgcactgggagaga

SEQ ID NO: 8014239 - DNA, 22 bp, Homo sapiens
tattggattgagacattttaga

SEQ ID NO: 8014240 - DNA, 22 bp, Homo sapiens
tattggatcttttattgctcag

SEQ ID NO: 8014241 - DNA, 22 bp, Homo sapiens
tattggagtatggggctggagt

SEQ ID NO: 8014242 - DNA, 22 bp, Homo sapiens
tattggagttggtaagaagtca

SEQ ID NO: 8014243 - DNA, 22 bp, Homo sapiens
tattggagtactgcgagctgcc

SEQ ID NO: 8014244 - DNA, 22 bp, Homo sapiens
tattggagtatggggctggagt

SEQ ID NO: 8014245 - DNA, 22 bp, Homo sapiens
tattggacagtccagtgagaat

SEQ ID NO: 8014246 - DNA, 22 bp, Homo sapiens
tattgggcagacatcaggctta

SEQ ID NO: 8014247 - DNA, 22 bp, Homo sapiens
tattgggacttaaaggtaaaga

SEQ ID NO: 8014248 - DNA, 22 bp, Homo sapiens
tattgggaaaagggcgatggct

SEQ ID NO: 8014249 - DNA, 22 bp, Homo sapiens
tattgggctggaattgcttcag

SEQ ID NO: 8014250 - DNA, 22 bp, Homo sapiens
tattgggcagacatcaggctta

SEQ ID NO: 8014251 - DNA, 22 bp, Homo sapiens
tattgggtaaagatccagtttt

SEQ ID NO: 8014252 - DNA, 20 bp, Homo sapiens
tatttacaacttagagcctc

SEQ ID NO: 8014253 - DNA, 20 bp, Homo sapiens
tatttacaacttagagcctc

SEQ ID NO: 8014254 - DNA, 20 bp, Homo sapiens
tatttacaacttagagcctc

SEQ ID NO: 8014255 - DNA, 22 bp, Homo sapiens
tattggcttttccagacctggc

SEQ ID NO: 8014256 - DNA, 22 bp, Homo sapiens
tattgggaaaagggcgatggct

SEQ ID NO: 8014257 - DNA, 23 bp, Homo sapiens
tattggctttttaaaggagtata

SEQ ID NO: 8014258 - DNA, 22 bp, Homo sapiens
tattggatttctgaaagatgag

SEQ ID NO: 8014259 - DNA, 21 bp, Homo sapiens
tattggccattaaagggaaaa

SEQ ID NO: 8014260 - DNA, 20 bp, Homo sapiens
tatttacaacttagagcctc

SEQ ID NO: 8014261 - DNA, 20 bp, Homo sapiens
tatttacaacttagagcctc

SEQ ID NO: 8014262 - DNA, 22 bp, Homo sapiens
tatttagttatctttcataaaa

SEQ ID NO: 8014263 - DNA, 21 bp, Homo sapiens
tatttagttttacaaatgtgg

SEQ ID NO: 8014264 - DNA, 22 bp, Homo sapiens
tatttagtgatagaagcaagga

SEQ ID NO: 8014265 - DNA, 22 bp, Homo sapiens
tatttagtgatagaagcaagga

SEQ ID NO: 8014266 - DNA, 20 bp, Homo sapiens
tatttagattcaagtatgga

SEQ ID NO: 8014267 - DNA, 20 bp, Homo sapiens
tatttagattcaagtatgga

SEQ ID NO: 8014268 - DNA, 20 bp, Homo sapiens
tatttagattcaagtatgga

SEQ ID NO: 8014269 - DNA, 20 bp, Homo sapiens
tatttagattcaagtatgga

SEQ ID NO: 8014270 - DNA, 20 bp, Homo sapiens
tatttagattcaagtatgga

SEQ ID NO: 8014271 - DNA, 22 bp, Homo sapiens
tatttagaggagaaaagtggct

SEQ ID NO: 8014272 - DNA, 22 bp, Homo sapiens
tatttagatgcatttggattgc

SEQ ID NO: 8014273 - DNA, 22 bp, Homo sapiens
tatttacttttaaattgagaac

SEQ ID NO: 8014274 - DNA, 22 bp, Homo sapiens
tatttagaacagacaatagaaa

SEQ ID NO: 8014275 - DNA, 19 bp, Homo sapiens
tatttacttcttgattgca

SEQ ID NO: 8014276 - DNA, 22 bp, Homo sapiens
tatttacttttaaattgagaac

SEQ ID NO: 8014277 - DNA, 19 bp, Homo sapiens
tatttacttcttgattgca

SEQ ID NO: 8014278 - DNA, 22 bp, Homo sapiens
cagtcctctctgtgtctgcacc

SEQ ID NO: 8014279 - DNA, 22 bp, Homo sapiens
cagtcctctgcaacaccccttc

SEQ ID NO: 8014280 - DNA, 22 bp, Homo sapiens
cagtcctctctgtgtctgcacc

SEQ ID NO: 8014281 - DNA, 22 bp, Homo sapiens
cagtcctctctgtgtctgcacc

SEQ ID NO: 8014282 - DNA, 22 bp, Homo sapiens
cagtcctctcactcaggccttt

SEQ ID NO: 8014283 - DNA, 22 bp, Homo sapiens
cagtcctgggcaggtcaggcca

SEQ ID NO: 8014284 - DNA, 22 bp, Homo sapiens
cagtcctgggcaggtcaggcca

SEQ ID NO: 8014285 - DNA, 22 bp, Homo sapiens
cagtcctgggcaggtcaggcca

SEQ ID NO: 8014286 - DNA, 22 bp, Homo sapiens
cagtcctgggcaggtcaggcca

SEQ ID NO: 8014287 - DNA, 22 bp, Homo sapiens
cagtcctgggcacagccctggg

SEQ ID NO: 8014288 - DNA, 22 bp, Homo sapiens
cagtcctgggcacagccctggg

SEQ ID NO: 8014289 - DNA, 22 bp, Homo sapiens
cagtcctgggcacagccctggg

SEQ ID NO: 8014290 - DNA, 20 bp, Homo sapiens
cagtcctgtccctgctgccc

SEQ ID NO: 8014291 - DNA, 20 bp, Homo sapiens
cagtcctgtccctgctgccc

SEQ ID NO: 8014292 - DNA, 20 bp, Homo sapiens
cagtcctgtccctgctgccc

SEQ ID NO: 8014293 - DNA, 22 bp, Homo sapiens
cagtcctgggtgcagcaggaaa

SEQ ID NO: 8014294 - DNA, 20 bp, Homo sapiens
cagtcctgtccctgctgccc

SEQ ID NO: 8014295 - DNA, 20 bp, Homo sapiens
cagtcctgtccctgctgccc

SEQ ID NO: 8014296 - DNA, 20 bp, Homo sapiens
cagtcctgtccctgctgccc

SEQ ID NO: 8014297 - DNA, 22 bp, Homo sapiens
cagtcctgggtgcagcaggaaa

SEQ ID NO: 8014298 - DNA, 22 bp, Homo sapiens
cagtcctgggtgcagcaggaaa

SEQ ID NO: 8014299 - DNA, 22 bp, Homo sapiens
cagtcctgggtgcagcaggaaa

SEQ ID NO: 8014300 - DNA, 22 bp, Homo sapiens
cagtcctgggtgcagcaggaaa

SEQ ID NO: 8014301 - DNA, 22 bp, Homo sapiens
cagtcctggggaccaggctgag

SEQ ID NO: 8014302 - DNA, 22 bp, Homo sapiens
cagtcctggggaccaggctgag

SEQ ID NO: 8014303 - DNA, 22 bp, Homo sapiens
cagtcctggggaccaggctgag

SEQ ID NO: 8014304 - DNA, 22 bp, Homo sapiens
cagtcctggggaccaggctgag

SEQ ID NO: 8014305 - DNA, 22 bp, Homo sapiens
cagtcctggggaccaggctgag

SEQ ID NO: 8014306 - DNA, 22 bp, Homo sapiens
cagtcctggggaccaggctgag

SEQ ID NO: 8014307 - DNA, 22 bp, Homo sapiens
cagtcctggggaccaggctgag

SEQ ID NO: 8014308 - DNA, 22 bp, Homo sapiens
cagtcctggggaccaggctgag

SEQ ID NO: 8014309 - DNA, 22 bp, Homo sapiens
cagtccttaaggaaacatttgt

SEQ ID NO: 8014310 - DNA, 22 bp, Homo sapiens
cagtccttgatccaatagtggg

SEQ ID NO: 8014311 - DNA, 22 bp, Homo sapiens
cagtccttgctcaaagtctaca

SEQ ID NO: 8014312 - DNA, 22 bp, Homo sapiens
cagtccttggcaagttctcagt

SEQ ID NO: 8014313 - DNA, 22 bp, Homo sapiens
cagtccttgctctgggatgatg

SEQ ID NO: 8014314 - DNA, 22 bp, Homo sapiens
cagtccttggcttcatccgagt

SEQ ID NO: 8014315 - DNA, 22 bp, Homo sapiens
cagtcctgtgtcccttggtggg

SEQ ID NO: 8014316 - DNA, 22 bp, Homo sapiens
cagtcctgtctttatgacttca

SEQ ID NO: 8014317 - DNA, 22 bp, Homo sapiens
cagtcctgtctttatgacttca

SEQ ID NO: 8014318 - DNA, 22 bp, Homo sapiens
cagtcctgtctttatgacttca

SEQ ID NO: 8014319 - DNA, 22 bp, Homo sapiens
cagtcctgtgtcccttggtggg

SEQ ID NO: 8014320 - DNA, 22 bp, Homo sapiens
cagtcctgtgtcccttggtggg

SEQ ID NO: 8014321 - DNA, 22 bp, Homo sapiens
cagtcctgtgtcccttggtggg

SEQ ID NO: 8014322 - DNA, 22 bp, Homo sapiens
cagtcctgtgttaaacaagagc

SEQ ID NO: 8014323 - DNA, 22 bp, Homo sapiens
cagtcctgttcctggagtagtt

SEQ ID NO: 8014324 - DNA, 22 bp, Homo sapiens
cagtcctgttcctggagtagtt

SEQ ID NO: 8014325 - DNA, 22 bp, Homo sapiens
cagtcctgtgttaaacaagagc

SEQ ID NO: 8014326 - DNA, 22 bp, Homo sapiens
cagtcctgttcctggagtagtt

SEQ ID NO: 8014327 - DNA, 18 bp, Homo sapiens
cagtcctgtttctacagg

SEQ ID NO: 8014328 - DNA, 18 bp, Homo sapiens
cagtcctgtttctacagg

SEQ ID NO: 8014329 - DNA, 22 bp, Homo sapiens
cagtccttaaggaaacatttgt

SEQ ID NO: 8014330 - DNA, 22 bp, Homo sapiens
catgagaaggttttggcatata

SEQ ID NO: 8014331 - DNA, 22 bp, Homo sapiens
catgagaagtggccttcaaaaa

SEQ ID NO: 8014332 - DNA, 22 bp, Homo sapiens
catgagaaggttttggcatata

SEQ ID NO: 8014333 - DNA, 22 bp, Homo sapiens
catgagttcaaaatgcctgcct

SEQ ID NO: 8014334 - DNA, 22 bp, Homo sapiens
catgataacacttctgtttaat

SEQ ID NO: 8014335 - DNA, 22 bp, Homo sapiens
catgagttttttagttcatgca

SEQ ID NO: 8014336 - DNA, 22 bp, Homo sapiens
tcagtttaatacccagatgcct

SEQ ID NO: 8014337 - DNA, 22 bp, Homo sapiens
tcagtttaatacccagatgcct

SEQ ID NO: 8014338 - DNA, 22 bp, Homo sapiens
tcagtttaagatgactaacaat

SEQ ID NO: 8014339 - DNA, 22 bp, Homo sapiens
tcagtttagagttatttaatct

SEQ ID NO: 8014340 - DNA, 22 bp, Homo sapiens
tcagtttagatgcatttgtcgt

SEQ ID NO: 8014341 - DNA, 22 bp, Homo sapiens
tcagtttagatgcatttgtcgt

SEQ ID NO: 8014342 - DNA, 22 bp, Homo sapiens
tcagtttataaattgtatttag

SEQ ID NO: 8014343 - DNA, 22 bp, Homo sapiens
tcagtttataaattgtatttag

SEQ ID NO: 8014344 - DNA, 22 bp, Homo sapiens
tcagtttataaattgtatttag

SEQ ID NO: 8014345 - DNA, 22 bp, Homo sapiens
tcagtttataaattgtatttag

SEQ ID NO: 8014346 - DNA, 22 bp, Homo sapiens
tcagtttatggtctagttcatg

SEQ ID NO: 8014347 - DNA, 22 bp, Homo sapiens
catgataacttcattacacaat

SEQ ID NO: 8014348 - DNA, 22 bp, Homo sapiens
catgataacttcattacacaat

SEQ ID NO: 8014349 - DNA, 22 bp, Homo sapiens
catgataacttcattacacaat

SEQ ID NO: 8014350 - DNA, 21 bp, Homo sapiens
catgataatgaaggtgttatt

SEQ ID NO: 8014351 - DNA, 22 bp, Homo sapiens
catgataacttcattacacaat

SEQ ID NO: 8014352 - DNA, 22 bp, Homo sapiens
catgataattgttaacaaagta

SEQ ID NO: 8014353 - DNA, 22 bp, Homo sapiens
catgatataaagtagtagataa

SEQ ID NO: 8014354 - DNA, 22 bp, Homo sapiens
catgataggtatttaattaaat

SEQ ID NO: 8014355 - DNA, 22 bp, Homo sapiens
catgattatattaatggcttca

SEQ ID NO: 8014356 - DNA, 22 bp, Homo sapiens
catgatgttatcaagcacaaag

SEQ ID NO: 8014357 - DNA, 22 bp, Homo sapiens
catgatggttcttacaaaggtg

SEQ ID NO: 8014358 - DNA, 22 bp, Homo sapiens
catgatgtcacagagaagcaca

SEQ ID NO: 8014359 - DNA, 22 bp, Homo sapiens
catgatgtcacagagaagcaca

SEQ ID NO: 8014360 - DNA, 22 bp, Homo sapiens
catgatggatgtgcacttcgct

SEQ ID NO: 8014361 - DNA, 22 bp, Homo sapiens
catgatctggtcctactgtggg

SEQ ID NO: 8014362 - DNA, 22 bp, Homo sapiens
catgatctggtcctactgtggg

SEQ ID NO: 8014363 - DNA, 22 bp, Homo sapiens
tcatgtcagctgttgatgtgca

SEQ ID NO: 8014364 - DNA, 22 bp, Homo sapiens
tcatgtcagtttcttctataaa

SEQ ID NO: 8014365 - DNA, 18 bp, Homo sapiens
tcatgtctcacaggtgat

SEQ ID NO: 8014366 - DNA, 22 bp, Homo sapiens
tcatttcaagttctgacagcta

SEQ ID NO: 8014367 - DNA, 19 bp, Homo sapiens
tcatgtctctcatctgtga

SEQ ID NO: 8014368 - DNA, 22 bp, Homo sapiens
tcatgtctctatgtgcctatta

SEQ ID NO: 8014369 - DNA, 22 bp, Homo sapiens
tcatgtctctatgtgcctatta

SEQ ID NO: 8014370 - DNA, 19 bp, Homo sapiens
tcatgtctctcatctgtga

SEQ ID NO: 8014371 - DNA, 19 bp, Homo sapiens
tcatgtctctcatctgtga

SEQ ID NO: 8014372 - DNA, 22 bp, Homo sapiens
tcatttcaagttctgacagcta

SEQ ID NO: 8014373 - DNA, 22 bp, Homo sapiens
tcatttcaatgatactactaag

SEQ ID NO: 8014374 - DNA, 22 bp, Homo sapiens
tcatttgttctcattctctact

SEQ ID NO: 8014375 - DNA, 22 bp, Homo sapiens
tcatttgttgaactttagtgcg

SEQ ID NO: 8014376 - DNA, 22 bp, Homo sapiens
tcatttgttgaactttagtgcg

SEQ ID NO: 8014377 - DNA, 22 bp, Homo sapiens
tcatttgttgaactttagtgcg

SEQ ID NO: 8014378 - DNA, 22 bp, Homo sapiens
tcatttgttgaactttagtgcg

SEQ ID NO: 8014379 - DNA, 22 bp, Homo sapiens
tcatttgttgaactttagtgcg

SEQ ID NO: 8014380 - DNA, 17 bp, Homo sapiens
tcatttgttgtgactag

SEQ ID NO: 8014381 - DNA, 17 bp, Homo sapiens
tcatttgttgtgactag

SEQ ID NO: 8014382 - DNA, 22 bp, Homo sapiens
tcatttgttgctgttacctgag

SEQ ID NO: 8014383 - DNA, 22 bp, Homo sapiens
tcatttgttgctgttacctgag

SEQ ID NO: 8014384 - DNA, 17 bp, Homo sapiens
tcatttgttgtgactag

SEQ ID NO: 8014385 - DNA, 18 bp, Homo sapiens
tcatttgttttgcatgaa

SEQ ID NO: 8014386 - DNA, 22 bp, Homo sapiens
tcatttgtttaggtagcaccat

SEQ ID NO: 8014387 - DNA, 22 bp, Homo sapiens
tcatttgtttctgtttggggct

SEQ ID NO: 8014388 - DNA, 18 bp, Homo sapiens
tcatttgttttgcatgaa

SEQ ID NO: 8014389 - DNA, 22 bp, Homo sapiens
tcatgtacatgtaagtcagaaa

SEQ ID NO: 8014390 - DNA, 22 bp, Homo sapiens
tcatgtacatgtaagtcagaaa

SEQ ID NO: 8014391 - DNA, 22 bp, Homo sapiens
tcatgtaagtatagaaagcagt

SEQ ID NO: 8014392 - DNA, 21 bp, Homo sapiens
tcatgtaatgcatgaagtaaa

SEQ ID NO: 8014393 - DNA, 22 bp, Homo sapiens
tcatgtatttgtgatagatgac

SEQ ID NO: 8014394 - DNA, 22 bp, Homo sapiens
tcatgtattgaaaagcatttta

SEQ ID NO: 8014395 - DNA, 22 bp, Homo sapiens
tcatgtattgaaaagcatttta

SEQ ID NO: 8014396 - DNA, 22 bp, Homo sapiens
tcatgtattgaaaagcatttta

SEQ ID NO: 8014397 - DNA, 22 bp, Homo sapiens
tcatggggtttggctggatgtc

SEQ ID NO: 8014398 - DNA, 22 bp, Homo sapiens
tcatggttcatgagtgtccttt

SEQ ID NO: 8014399 - DNA, 22 bp, Homo sapiens
tcatgtaaatgtggatgcttcc

SEQ ID NO: 8014400 - DNA, 22 bp, Homo sapiens
catgatttactaaaatttgttt

SEQ ID NO: 8014401 - DNA, 22 bp, Homo sapiens
catgatttactaaaatttgttt

SEQ ID NO: 8014402 - DNA, 22 bp, Homo sapiens
catgattatgtgttagagtttg

SEQ ID NO: 8014403 - DNA, 22 bp, Homo sapiens
tcatgggcagctactggttccc

SEQ ID NO: 8014404 - DNA, 22 bp, Homo sapiens
tcatggctttttcactgttcgc

SEQ ID NO: 8014405 - DNA, 22 bp, Homo sapiens
tcatggctttttcactgttcgc

SEQ ID NO: 8014406 - DNA, 22 bp, Homo sapiens
tcatggggccacagctgccagc

SEQ ID NO: 8014407 - DNA, 22 bp, Homo sapiens
tcatggggctcttcaagtggag

SEQ ID NO: 8014408 - DNA, 22 bp, Homo sapiens
tcatgggaacaccagtattctc

SEQ ID NO: 8014409 - DNA, 22 bp, Homo sapiens
catctttagttattgaatatag

SEQ ID NO: 8014410 - DNA, 22 bp, Homo sapiens
catctttagttattgaatatag

SEQ ID NO: 8014411 - DNA, 22 bp, Homo sapiens
catctttagtaggttctggaga

SEQ ID NO: 8014412 - DNA, 22 bp, Homo sapiens
catctttagttattgaatatag

SEQ ID NO: 8014413 - DNA, 22 bp, Homo sapiens
catctttagttattgaatatag

SEQ ID NO: 8014414 - DNA, 22 bp, Homo sapiens
catctttagttattgaatatag

SEQ ID NO: 8014415 - DNA, 22 bp, Homo sapiens
catctttagggaccattattct

SEQ ID NO: 8014416 - DNA, 22 bp, Homo sapiens
catctttagggaccattattct

SEQ ID NO: 8014417 - DNA, 22 bp, Homo sapiens
catctttaacagaatggatttg

SEQ ID NO: 8014418 - DNA, 22 bp, Homo sapiens
catctttaatttgtgacaacta

SEQ ID NO: 8014419 - DNA, 22 bp, Homo sapiens
catctttaatttgtgacaacta

SEQ ID NO: 8014420 - DNA, 22 bp, Homo sapiens
catctttaatttgtgacaacta

SEQ ID NO: 8014421 - DNA, 22 bp, Homo sapiens
catctttaatttgtgacaacta

SEQ ID NO: 8014422 - DNA, 22 bp, Homo sapiens
catctttatttatatagacagg

SEQ ID NO: 8014423 - DNA, 22 bp, Homo sapiens
catctttatttatatagacagg

SEQ ID NO: 8014424 - DNA, 22 bp, Homo sapiens
catctttatttatatagacagg

SEQ ID NO: 8014425 - DNA, 22 bp, Homo sapiens
catctttatttatatagacagg

SEQ ID NO: 8014426 - DNA, 22 bp, Homo sapiens
catctttatttatatagacagg

SEQ ID NO: 8014427 - DNA, 22 bp, Homo sapiens
catctttatttatatagacagg

SEQ ID NO: 8014428 - DNA, 22 bp, Homo sapiens
catctttgaactctgtataaac

SEQ ID NO: 8014429 - DNA, 22 bp, Homo sapiens
catctttgaactctgtataaac

SEQ ID NO: 8014430 - DNA, 22 bp, Homo sapiens
catctttcttagaactttcagt

SEQ ID NO: 8014431 - DNA, 22 bp, Homo sapiens
catctttcttagaactttcagt

SEQ ID NO: 8014432 - DNA, 22 bp, Homo sapiens
catctttatttatatagacagg

SEQ ID NO: 8014433 - DNA, 22 bp, Homo sapiens
catctttcagtttataagtctg

SEQ ID NO: 8014434 - DNA, 22 bp, Homo sapiens
catctttcagtttataagtctg

SEQ ID NO: 8014435 - DNA, 22 bp, Homo sapiens
catctttgagacagcattaccc

SEQ ID NO: 8014436 - DNA, 22 bp, Homo sapiens
catctttgagacagcattaccc

SEQ ID NO: 8014437 - DNA, 22 bp, Homo sapiens
catctttgagacagcattaccc

SEQ ID NO: 8014438 - DNA, 22 bp, Homo sapiens
catctttgaactctgtataaac

SEQ ID NO: 8014439 - DNA, 22 bp, Homo sapiens
tcagttcttagtaatgcagtct

SEQ ID NO: 8014440 - DNA, 22 bp, Homo sapiens
tcagtttaagatgactaacaat

SEQ ID NO: 8014441 - DNA, 22 bp, Homo sapiens
tcagtttaagatgactaacaat

SEQ ID NO: 8014442 - DNA, 22 bp, Homo sapiens
tcagttgctaaatggtgtagtg

SEQ ID NO: 8014443 - DNA, 21 bp, Homo sapiens
tcagttgccaaagtgatgtca

SEQ ID NO: 8014444 - DNA, 22 bp, Homo sapiens
tcagttctaacagtttagaaca

SEQ ID NO: 8014445 - DNA, 22 bp, Homo sapiens
tcagttctctcatgcctgccct

SEQ ID NO: 8014446 - DNA, 21 bp, Homo sapiens
tcagttctctgcctgtgcttg

SEQ ID NO: 8014447 - DNA, 22 bp, Homo sapiens
catctttgcccatccacttcca

SEQ ID NO: 8014448 - DNA, 22 bp, Homo sapiens
catctttgccatatgatgtaat

SEQ ID NO: 8014449 - DNA, 22 bp, Homo sapiens
catctttgccatatgatgtaat

SEQ ID NO: 8014450 - DNA, 22 bp, Homo sapiens
catctttgcaccctcaaaacct

SEQ ID NO: 8014451 - DNA, 22 bp, Homo sapiens
catctttgcaccctcaaaacct

SEQ ID NO: 8014452 - DNA, 22 bp, Homo sapiens
tcagttctggctgctgctgtca

SEQ ID NO: 8014453 - DNA, 22 bp, Homo sapiens
tcagttctggctgctgctgtca

SEQ ID NO: 8014454 - DNA, 22 bp, Homo sapiens
tcagttcttagtaatgcagtct

SEQ ID NO: 8014455 - DNA, 22 bp, Homo sapiens
tcagttctgaagttctgcctcc

SEQ ID NO: 8014456 - DNA, 22 bp, Homo sapiens
tcagttctgaagttctgcctcc

SEQ ID NO: 8014457 - DNA, 21 bp, Homo sapiens
tcagttctctgcctgtgcttg

SEQ ID NO: 8014458 - DNA, 21 bp, Homo sapiens
tcagttctctgcctgtgcttg

SEQ ID NO: 8014459 - DNA, 22 bp, Homo sapiens
catctttaaaggggagacaccc

SEQ ID NO: 8014460 - DNA, 22 bp, Homo sapiens
catctttaaaggggagacaccc

SEQ ID NO: 8014461 - DNA, 22 bp, Homo sapiens
catctttaaaggggagacaccc

SEQ ID NO: 8014462 - DNA, 22 bp, Homo sapiens
catctttaaaggggagacaccc

SEQ ID NO: 8014463 - DNA, 22 bp, Homo sapiens
catctttaacaatttacaatgt

SEQ ID NO: 8014464 - DNA, 22 bp, Homo sapiens
catctttaacaatttacaatgt

SEQ ID NO: 8014465 - DNA, 22 bp, Homo sapiens
catctttaacaatttacaatgt

SEQ ID NO: 8014466 - DNA, 22 bp, Homo sapiens
catctttaacaatttacaatgt

SEQ ID NO: 8014467 - DNA, 22 bp, Homo sapiens
catctttaacaatttacaatgt

SEQ ID NO: 8014468 - DNA, 22 bp, Homo sapiens
catctttaacaatttacaatgt

SEQ ID NO: 8014469 - DNA, 22 bp, Homo sapiens
catctttaaaggggagacaccc

SEQ ID NO: 8014470 - DNA, 22 bp, Homo sapiens
catctttaaaatgggaacaaca

SEQ ID NO: 8014471 - DNA, 21 bp, Homo sapiens
catcttaattgaaagcagaga

SEQ ID NO: 8014472 - DNA, 22 bp, Homo sapiens
tcaggtgggcgttccggtgcgg

SEQ ID NO: 8014473 - DNA, 22 bp, Homo sapiens
tcaggtggtcctaagtgccatc

SEQ ID NO: 8014474 - DNA, 22 bp, Homo sapiens
tcaggtggtcctaagtgccatc

SEQ ID NO: 8014475 - DNA, 22 bp, Homo sapiens
catccattcattaattctaaag

SEQ ID NO: 8014476 - DNA, 22 bp, Homo sapiens
catccattcagtgcaaatcaca

SEQ ID NO: 8014477 - DNA, 22 bp, Homo sapiens
catccattcagtgcaaatcaca

SEQ ID NO: 8014478 - DNA, 22 bp, Homo sapiens
catccattaactcatttgtttc

SEQ ID NO: 8014479 - DNA, 22 bp, Homo sapiens
catccatcacaagtttgttcat

SEQ ID NO: 8014480 - DNA, 22 bp, Homo sapiens
catccatagcctcaataaatag

SEQ ID NO: 8014481 - DNA, 22 bp, Homo sapiens
catccatagcctcaataaatag

SEQ ID NO: 8014482 - DNA, 22 bp, Homo sapiens
catccccagagcagttccacta

SEQ ID NO: 8014483 - DNA, 22 bp, Homo sapiens
catccctgacttctaggtgaca

SEQ ID NO: 8014484 - DNA, 22 bp, Homo sapiens
catcccctgatgctcttgagta

SEQ ID NO: 8014485 - DNA, 22 bp, Homo sapiens
catccccaattagcgcccagct

SEQ ID NO: 8014486 - DNA, 22 bp, Homo sapiens
catccccaattagcgcccagct

SEQ ID NO: 8014487 - DNA, 22 bp, Homo sapiens
catccccaattagcgcccagct

SEQ ID NO: 8014488 - DNA, 22 bp, Homo sapiens
catccattcattaattctaaag

SEQ ID NO: 8014489 - DNA, 22 bp, Homo sapiens
catcccattggctaaggcaaat

SEQ ID NO: 8014490 - DNA, 22 bp, Homo sapiens
catccctgctggtggaaggggt

SEQ ID NO: 8014491 - DNA, 22 bp, Homo sapiens
catccctggttcctgtgtttaa

SEQ ID NO: 8014492 - DNA, 22 bp, Homo sapiens
tcaggtggctggttgctggcta

SEQ ID NO: 8014493 - DNA, 22 bp, Homo sapiens
catccctggttcctgtgtttaa

SEQ ID NO: 8014494 - DNA, 22 bp, Homo sapiens
tcaggtggcttcggggagtggc

SEQ ID NO: 8014495 - DNA, 22 bp, Homo sapiens
tcaggtggcttggagggggacg

SEQ ID NO: 8014496 - DNA, 22 bp, Homo sapiens
tcattttcacacataaatagca

SEQ ID NO: 8014497 - DNA, 22 bp, Homo sapiens
tcattttcaagtttgaacagga

SEQ ID NO: 8014498 - DNA, 22 bp, Homo sapiens
tcattttcaagtttgaacagga

SEQ ID NO: 8014499 - DNA, 22 bp, Homo sapiens
tcattttcccactgaagctgtc

SEQ ID NO: 8014500 - DNA, 22 bp, Homo sapiens
tcattttcacacataaatagca

SEQ ID NO: 8014501 - DNA, 22 bp, Homo sapiens
tcattttgcctgccatttgagt

SEQ ID NO: 8014502 - DNA, 22 bp, Homo sapiens
tcattttgcctgccatttgagt

SEQ ID NO: 8014503 - DNA, 22 bp, Homo sapiens
tcattttgcagagctgaggaac

SEQ ID NO: 8014504 - DNA, 22 bp, Homo sapiens
tcattttggggtttgtcatctt

SEQ ID NO: 8014505 - DNA, 22 bp, Homo sapiens
tcattttggccatgatacagac

SEQ ID NO: 8014506 - DNA, 22 bp, Homo sapiens
tcattttggccatgatacagac

SEQ ID NO: 8014507 - DNA, 22 bp, Homo sapiens
tcattttgcctgccatttgagt

SEQ ID NO: 8014508 - DNA, 22 bp, Homo sapiens
tcatttttagcgcgcaaaagtt

SEQ ID NO: 8014509 - DNA, 22 bp, Homo sapiens
tcattttggggtttgtcatctt

SEQ ID NO: 8014510 - DNA, 22 bp, Homo sapiens
catgcaaaggtcaagatcagga

SEQ ID NO: 8014511 - DNA, 22 bp, Homo sapiens
catgcaaaggtcaagatcagga

SEQ ID NO: 8014512 - DNA, 22 bp, Homo sapiens
catgcaaatgtgctaatctgaa

SEQ ID NO: 8014513 - DNA, 22 bp, Homo sapiens
catgcaaatgtgctaatctgaa

SEQ ID NO: 8014514 - DNA, 22 bp, Homo sapiens
catgcaaatggtggctaaatgg

SEQ ID NO: 8014515 - DNA, 22 bp, Homo sapiens
catgcaaatggtggctaaatgg

SEQ ID NO: 8014516 - DNA, 22 bp, Homo sapiens
catgattttgtcttgtgttaat

SEQ ID NO: 8014517 - DNA, 22 bp, Homo sapiens
catgattttgtcttgtgttaat

SEQ ID NO: 8014518 - DNA, 22 bp, Homo sapiens
catgattttgtcttgtgttaat

SEQ ID NO: 8014519 - DNA, 22 bp, Homo sapiens
catgatttactaaaatttgttt

SEQ ID NO: 8014520 - DNA, 22 bp, Homo sapiens
catgatttactaaaatttgttt

SEQ ID NO: 8014521 - DNA, 22 bp, Homo sapiens
tcatttttagcgcgcaaaagtt

SEQ ID NO: 8014522 - DNA, 23 bp, Homo sapiens
catgcaaacactattgcatttgg

SEQ ID NO: 8014523 - DNA, 23 bp, Homo sapiens
catgcaaacactattgcatttgg

SEQ ID NO: 8014524 - DNA, 23 bp, Homo sapiens
catgcaaacactattgcatttgg

SEQ ID NO: 8014525 - DNA, 22 bp, Homo sapiens
catgcaaacacgtaaacattca

SEQ ID NO: 8014526 - DNA, 22 bp, Homo sapiens
catgcaaacacgtaaacattca

SEQ ID NO: 8014527 - DNA, 22 bp, Homo sapiens
catggcttaccccaggagcagc

SEQ ID NO: 8014528 - DNA, 22 bp, Homo sapiens
catggcttactttcagggagta

SEQ ID NO: 8014529 - DNA, 20 bp, Homo sapiens
catggctgtgagcccacagg

SEQ ID NO: 8014530 - DNA, 22 bp, Homo sapiens
catggctggtgcacctctggga

SEQ ID NO: 8014531 - DNA, 20 bp, Homo sapiens
catggctgtgagcccacagg

SEQ ID NO: 8014532 - DNA, 22 bp, Homo sapiens
catggcttcgtcacagagggca

SEQ ID NO: 8014533 - DNA, 22 bp, Homo sapiens
catggcttagaagttccagccc

SEQ ID NO: 8014534 - DNA, 22 bp, Homo sapiens
catggcttgctagtggcccaag

SEQ ID NO: 8014535 - DNA, 22 bp, Homo sapiens
catggcttctgatcaaggaact

SEQ ID NO: 8014536 - DNA, 22 bp, Homo sapiens
catggctttccagtcctccact

SEQ ID NO: 8014537 - DNA, 22 bp, Homo sapiens
catggctgcgagaagagtgggt

SEQ ID NO: 8014538 - DNA, 19 bp, Homo sapiens
catggctgctgcttgggag

SEQ ID NO: 8014539 - DNA, 19 bp, Homo sapiens
catggctgctgcttgggag

SEQ ID NO: 8014540 - DNA, 19 bp, Homo sapiens
catggctgctgcttgggag

SEQ ID NO: 8014541 - DNA, 22 bp, Homo sapiens
catggctggcacacagcaacca

SEQ ID NO: 8014542 - DNA, 22 bp, Homo sapiens
catggctggcacacagcaacca

SEQ ID NO: 8014543 - DNA, 22 bp, Homo sapiens
catggctggcacacagcaacca

SEQ ID NO: 8014544 - DNA, 22 bp, Homo sapiens
catggctgctggctcggtccct

SEQ ID NO: 8014545 - DNA, 19 bp, Homo sapiens
catggctgctgcttgggag

SEQ ID NO: 8014546 - DNA, 22 bp, Homo sapiens
catggctggccagtgggagtgg

SEQ ID NO: 8014547 - DNA, 22 bp, Homo sapiens
catggctggccagtgggagtgg

SEQ ID NO: 8014548 - DNA, 22 bp, Homo sapiens
catggctggccagtgggagtgg

SEQ ID NO: 8014549 - DNA, 22 bp, Homo sapiens
catggctggccagtgggagtgg

SEQ ID NO: 8014550 - DNA, 22 bp, Homo sapiens
catggctggccagtgggagtgg

SEQ ID NO: 8014551 - DNA, 22 bp, Homo sapiens
catggctgggagacggctgagg

SEQ ID NO: 8014552 - DNA, 22 bp, Homo sapiens
catggctggtgcacctctggga

SEQ ID NO: 8014553 - DNA, 22 bp, Homo sapiens
catggctggtgcacctctggga

SEQ ID NO: 8014554 - DNA, 22 bp, Homo sapiens
catggctggtgcacctctggga

SEQ ID NO: 8014555 - DNA, 22 bp, Homo sapiens
catggctgggagacggctgagg

SEQ ID NO: 8014556 - DNA, 22 bp, Homo sapiens
catggctgggagacggctgagg

SEQ ID NO: 8014557 - DNA, 22 bp, Homo sapiens
catggctggtgcacctctggga

SEQ ID NO: 8014558 - DNA, 22 bp, Homo sapiens
catggccagccctgaggttcag

SEQ ID NO: 8014559 - DNA, 22 bp, Homo sapiens
catgcacacacagttctaatta

SEQ ID NO: 8014560 - DNA, 22 bp, Homo sapiens
catgcacaagggatgatgaaat

SEQ ID NO: 8014561 - DNA, 22 bp, Homo sapiens
catgcacaagggatgatgaaat

SEQ ID NO: 8014562 - DNA, 22 bp, Homo sapiens
catgcacaagggatgatgaaat

SEQ ID NO: 8014563 - DNA, 22 bp, Homo sapiens
catgcacaagggatgatgaaat

SEQ ID NO: 8014564 - DNA, 22 bp, Homo sapiens
catgcacaaaggtaagatgcgt

SEQ ID NO: 8014565 - DNA, 22 bp, Homo sapiens
catgcacaaaggtaagatgcgt

SEQ ID NO: 8014566 - DNA, 22 bp, Homo sapiens
catgcacaaaggtaagatgcgt

SEQ ID NO: 8014567 - DNA, 22 bp, Homo sapiens
catgcacaaaggtaagatgcgt

SEQ ID NO: 8014568 - DNA, 22 bp, Homo sapiens
catgcacaacatactcaagagg

SEQ ID NO: 8014569 - DNA, 22 bp, Homo sapiens
catggctgcctgtggacactgc

SEQ ID NO: 8014570 - DNA, 22 bp, Homo sapiens
catggctgcgagaagagtgggt

SEQ ID NO: 8014571 - DNA, 22 bp, Homo sapiens
catggctgcgagaagagtgggt

SEQ ID NO: 8014572 - DNA, 22 bp, Homo sapiens
catggctgcctgtggacactgc

SEQ ID NO: 8014573 - DNA, 22 bp, Homo sapiens
catggctgcctgtggacactgc

SEQ ID NO: 8014574 - DNA, 22 bp, Homo sapiens
catggctgcgagaagagtgggt

SEQ ID NO: 8014575 - DNA, 22 bp, Homo sapiens
catggctgcgagaagagtgggt

SEQ ID NO: 8014576 - DNA, 23 bp, Homo sapiens
catggctgatttcaagctaccac

SEQ ID NO: 8014577 - DNA, 22 bp, Homo sapiens
catggctgcattggaatgggtt

SEQ ID NO: 8014578 - DNA, 22 bp, Homo sapiens
catggctgcattggaatgggtt

SEQ ID NO: 8014579 - DNA, 23 bp, Homo sapiens
catggctgatttcaagctaccac

SEQ ID NO: 8014580 - DNA, 19 bp, Homo sapiens
catggctgccccatatagc

SEQ ID NO: 8014581 - DNA, 22 bp, Homo sapiens
catggctgaggcagaggactga

SEQ ID NO: 8014582 - DNA, 22 bp, Homo sapiens
catggctgaggcagaggactga

SEQ ID NO: 8014583 - DNA, 22 bp, Homo sapiens
catggctgaggcagaggactga

SEQ ID NO: 8014584 - DNA, 22 bp, Homo sapiens
catggctgaggcagaggactga

SEQ ID NO: 8014585 - DNA, 22 bp, Homo sapiens
catggccagccctgaggttcag

SEQ ID NO: 8014586 - DNA, 22 bp, Homo sapiens
catggccaggcacgcgcatagc

SEQ ID NO: 8014587 - DNA, 22 bp, Homo sapiens
catggctgaacactcagtgact

SEQ ID NO: 8014588 - DNA, 22 bp, Homo sapiens
catgtacatgcctactatcaat

SEQ ID NO: 8014589 - DNA, 22 bp, Homo sapiens
catgtacatgcctactatcaat

SEQ ID NO: 8014590 - DNA, 22 bp, Homo sapiens
catgtacatgcctactatcaat

SEQ ID NO: 8014591 - DNA, 20 bp, Homo sapiens
tccagcccagcagcctgaca

SEQ ID NO: 8014592 - DNA, 22 bp, Homo sapiens
tccagcccagctcctctcagaa

SEQ ID NO: 8014593 - DNA, 22 bp, Homo sapiens
tccagcccagctcctctcagaa

SEQ ID NO: 8014594 - DNA, 22 bp, Homo sapiens
tccagcccagctcctctcagaa

SEQ ID NO: 8014595 - DNA, 22 bp, Homo sapiens
tccagcccagctcctctcagaa

SEQ ID NO: 8014596 - DNA, 20 bp, Homo sapiens
tccagcccagcagcctgaca

SEQ ID NO: 8014597 - DNA, 20 bp, Homo sapiens
tccagcccagcagcctgaca

SEQ ID NO: 8014598 - DNA, 20 bp, Homo sapiens
tccagcccagcagcctgaca

SEQ ID NO: 8014599 - DNA, 18 bp, Homo sapiens
tccagcccacattttctg

SEQ ID NO: 8014600 - DNA, 18 bp, Homo sapiens
tccagcccacattttctg

SEQ ID NO: 8014601 - DNA, 20 bp, Homo sapiens
tccagcccagcagcctgaca

SEQ ID NO: 8014602 - DNA, 22 bp, Homo sapiens
catgtctgggtatatgcatatg

SEQ ID NO: 8014603 - DNA, 22 bp, Homo sapiens
catgtcttaattggagcccaga

SEQ ID NO: 8014604 - DNA, 22 bp, Homo sapiens
catgtcttaattggagcccaga

SEQ ID NO: 8014605 - DNA, 22 bp, Homo sapiens
catgtcttaggaaagcagagga

SEQ ID NO: 8014606 - DNA, 22 bp, Homo sapiens
catgtcttatatcctgtcttca

SEQ ID NO: 8014607 - DNA, 22 bp, Homo sapiens
catgtcttatatcctgtcttca

SEQ ID NO: 8014608 - DNA, 22 bp, Homo sapiens
catgtcttatgcggaactttca

SEQ ID NO: 8014609 - DNA, 22 bp, Homo sapiens
catgtctgccaatttggaagga

SEQ ID NO: 8014610 - DNA, 18 bp, Homo sapiens
catgtctgcgccacaagg

SEQ ID NO: 8014611 - DNA, 22 bp, Homo sapiens
catgtacatgcctactatcaat

SEQ ID NO: 8014612 - DNA, 22 bp, Homo sapiens
catgtctgagtagagtgtgatt

SEQ ID NO: 8014613 - DNA, 22 bp, Homo sapiens
tccagccacttgcacagttaaa

SEQ ID NO: 8014614 - DNA, 22 bp, Homo sapiens
tccagccaggatggcccaggga

SEQ ID NO: 8014615 - DNA, 22 bp, Homo sapiens
tccagccaggatggcccaggga

SEQ ID NO: 8014616 - DNA, 21 bp, Homo sapiens
tccagccagtaaatgctcagc

SEQ ID NO: 8014617 - DNA, 21 bp, Homo sapiens
tccagccagtaaatgctcagc

SEQ ID NO: 8014618 - DNA, 21 bp, Homo sapiens
tccagccagtaaatgctcagc

SEQ ID NO: 8014619 - DNA, 22 bp, Homo sapiens
tccagccacttgcacagttaaa

SEQ ID NO: 8014620 - DNA, 22 bp, Homo sapiens
tccagccaggatggcccaggga

SEQ ID NO: 8014621 - DNA, 22 bp, Homo sapiens
tccagccatgcatgacaatcac

SEQ ID NO: 8014622 - DNA, 22 bp, Homo sapiens
tccagccatgcatgacaatcac

SEQ ID NO: 8014623 - DNA, 22 bp, Homo sapiens
tccagccatgcatgacaatcac

SEQ ID NO: 8014624 - DNA, 22 bp, Homo sapiens
tccagccattcattatgacacc

SEQ ID NO: 8014625 - DNA, 22 bp, Homo sapiens
tccagccattcattatgacacc

SEQ ID NO: 8014626 - DNA, 22 bp, Homo sapiens
tccagccattcattatgacacc

SEQ ID NO: 8014627 - DNA, 22 bp, Homo sapiens
tccagcccacacctgaagctgg

SEQ ID NO: 8014628 - DNA, 22 bp, Homo sapiens
tccagccattcattatgacacc

SEQ ID NO: 8014629 - DNA, 22 bp, Homo sapiens
tccagcccacacctgaagctgg

SEQ ID NO: 8014630 - DNA, 22 bp, Homo sapiens
tccagcccacacctgaagctgg

SEQ ID NO: 8014631 - DNA, 22 bp, Homo sapiens
tccagcccacacctgaagctgg

SEQ ID NO: 8014632 - DNA, 22 bp, Homo sapiens
tccagccatgactcggacagtg

SEQ ID NO: 8014633 - DNA, 22 bp, Homo sapiens
tccagccatgactcggacagtg

SEQ ID NO: 8014634 - DNA, 22 bp, Homo sapiens
tccagccatgcatgacaatcac

SEQ ID NO: 8014635 - DNA, 22 bp, Homo sapiens
tccagccatgcatgacaatcac

SEQ ID NO: 8014636 - DNA, 21 bp, Homo sapiens
tccagccagtaaatgctcagc

SEQ ID NO: 8014637 - DNA, 21 bp, Homo sapiens
tccagccagtaaatgctcagc

SEQ ID NO: 8014638 - DNA, 22 bp, Homo sapiens
tccagccatatcttgtagccct

SEQ ID NO: 8014639 - DNA, 22 bp, Homo sapiens
tccagccatatcttgtagccct

SEQ ID NO: 8014640 - DNA, 22 bp, Homo sapiens
tccagccatatcttgtagccct

SEQ ID NO: 8014641 - DNA, 22 bp, Homo sapiens
catgtgcagactctgacaggct

SEQ ID NO: 8014642 - DNA, 23 bp, Homo sapiens
catgtgcaggaactgtgcttttg

SEQ ID NO: 8014643 - DNA, 22 bp, Homo sapiens
catgtgcagggccaggcattgc

SEQ ID NO: 8014644 - DNA, 22 bp, Homo sapiens
catgtgcatccttaatctccct

SEQ ID NO: 8014645 - DNA, 22 bp, Homo sapiens
catgtgcatccttaatctccct

SEQ ID NO: 8014646 - DNA, 22 bp, Homo sapiens
catgtgcatccttaatctccct

SEQ ID NO: 8014647 - DNA, 22 bp, Homo sapiens
catgtgcagtgtaagacatgct

SEQ ID NO: 8014648 - DNA, 22 bp, Homo sapiens
catgtgcagtgtaagacatgct

SEQ ID NO: 8014649 - DNA, 22 bp, Homo sapiens
catgtgcagtgtaagacatgct

SEQ ID NO: 8014650 - DNA, 22 bp, Homo sapiens
catgtgcagacggtgggctgga

SEQ ID NO: 8014651 - DNA, 19 bp, Homo sapiens
catgtgcacatgtgaatgc

SEQ ID NO: 8014652 - DNA, 19 bp, Homo sapiens
catgtgcacatgtgaatgc

SEQ ID NO: 8014653 - DNA, 22 bp, Homo sapiens
catgtgcagactctgacaggct

SEQ ID NO: 8014654 - DNA, 22 bp, Homo sapiens
catgtgcagactctgacaggct

SEQ ID NO: 8014655 - DNA, 22 bp, Homo sapiens
catgtgcagactctgacaggct

SEQ ID NO: 8014656 - DNA, 22 bp, Homo sapiens
catgtgcagacggtgggctgga

SEQ ID NO: 8014657 - DNA, 22 bp, Homo sapiens
catgtgagaaacagtgatgtcg

SEQ ID NO: 8014658 - DNA, 22 bp, Homo sapiens
catgtgacaggagcagctctaa

SEQ ID NO: 8014659 - DNA, 22 bp, Homo sapiens
catgtctttcaaaccacacagt

SEQ ID NO: 8014660 - DNA, 22 bp, Homo sapiens
catgtctttcaaaccacacagt

SEQ ID NO: 8014661 - DNA, 22 bp, Homo sapiens
catgtcttccttgcacacacac

SEQ ID NO: 8014662 - DNA, 22 bp, Homo sapiens
catgtcttgccctgattagtag

SEQ ID NO: 8014663 - DNA, 22 bp, Homo sapiens
catgtcttggcttaggcacaga

SEQ ID NO: 8014664 - DNA, 21 bp, Homo sapiens
catgtcttccacactgtagta

SEQ ID NO: 8014665 - DNA, 22 bp, Homo sapiens
catgtcttatgcggaactttca

SEQ ID NO: 8014666 - DNA, 22 bp, Homo sapiens
catgtcttatttatgcttctta

SEQ ID NO: 8014667 - DNA, 22 bp, Homo sapiens
catgtcttatttatgcttctta

SEQ ID NO: 8014668 - DNA, 22 bp, Homo sapiens
catgtgaattccaaagctaggt

SEQ ID NO: 8014669 - DNA, 22 bp, Homo sapiens
catgtctttctcatcacatcta

SEQ ID NO: 8014670 - DNA, 22 bp, Homo sapiens
catgtctttgttatgctcacca

SEQ ID NO: 8014671 - DNA, 22 bp, Homo sapiens
catgtctttgttatgctcacca

SEQ ID NO: 8014672 - DNA, 22 bp, Homo sapiens
tccaggcaaagggactagcagg

SEQ ID NO: 8014673 - DNA, 22 bp, Homo sapiens
tccaggcaaagggactagcagg

SEQ ID NO: 8014674 - DNA, 22 bp, Homo sapiens
tccaggcaaagccttgtagacg

SEQ ID NO: 8014675 - DNA, 22 bp, Homo sapiens
tccaggcaaaaggaactgcttg

SEQ ID NO: 8014676 - DNA, 22 bp, Homo sapiens
tccaggcaaaaggaactgcttg

SEQ ID NO: 8014677 - DNA, 22 bp, Homo sapiens
tccaggcaaaaggaactgcttg

SEQ ID NO: 8014678 - DNA, 22 bp, Homo sapiens
tccaggcaaaaggaactgcttg

SEQ ID NO: 8014679 - DNA, 22 bp, Homo sapiens
tccaggcaaaaaccaactacag

SEQ ID NO: 8014680 - DNA, 22 bp, Homo sapiens
tccaggcaaaaaccaactacag

SEQ ID NO: 8014681 - DNA, 22 bp, Homo sapiens
tccaggcaaaaaccaactacag

SEQ ID NO: 8014682 - DNA, 22 bp, Homo sapiens
tccaggcaaaaaccaactacag

SEQ ID NO: 8014683 - DNA, 22 bp, Homo sapiens
tccaggcaaaaaccaactacag

SEQ ID NO: 8014684 - DNA, 19 bp, Homo sapiens
catgtgcatgagcacagga

SEQ ID NO: 8014685 - DNA, 22 bp, Homo sapiens
catgtgcattggggccagggag

SEQ ID NO: 8014686 - DNA, 22 bp, Homo sapiens
catgtgcattggggccagggag

SEQ ID NO: 8014687 - DNA, 19 bp, Homo sapiens
catgtgcatgagcacagga

SEQ ID NO: 8014688 - DNA, 19 bp, Homo sapiens
catgtgcatgagcacagga

SEQ ID NO: 8014689 - DNA, 22 bp, Homo sapiens
tccaggcaaagtgctgggctgc

SEQ ID NO: 8014690 - DNA, 22 bp, Homo sapiens
tccaggcaaagtgctgggctgc

SEQ ID NO: 8014691 - DNA, 22 bp, Homo sapiens
tccaggcaaagtgctgggctgc

SEQ ID NO: 8014692 - DNA, 22 bp, Homo sapiens
tccaggcaaagtgctgggctgc

SEQ ID NO: 8014693 - DNA, 22 bp, Homo sapiens
tccaggcaaagtgctgggctgc

SEQ ID NO: 8014694 - DNA, 22 bp, Homo sapiens
tccaggcaaagtgctgggctgc

SEQ ID NO: 8014695 - DNA, 22 bp, Homo sapiens
tccaggcaaagtgctgggctgc

SEQ ID NO: 8014696 - DNA, 22 bp, Homo sapiens
tccaggcaaagtgctgggctgc

SEQ ID NO: 8014697 - DNA, 22 bp, Homo sapiens
tccaggcaagggaggagcatgg

SEQ ID NO: 8014698 - DNA, 22 bp, Homo sapiens
tccaggcaagggaggagcatgg

SEQ ID NO: 8014699 - DNA, 22 bp, Homo sapiens
tccaggcaagggaggagcatgg

SEQ ID NO: 8014700 - DNA, 22 bp, Homo sapiens
tccaggcaaggataataaacat

SEQ ID NO: 8014701 - DNA, 22 bp, Homo sapiens
tccaggcaaggataataaacat

SEQ ID NO: 8014702 - DNA, 22 bp, Homo sapiens
tccaggcaaagtgctgggctgc

SEQ ID NO: 8014703 - DNA, 22 bp, Homo sapiens
tccaggcaagggaggagcatgg

SEQ ID NO: 8014704 - DNA, 22 bp, Homo sapiens
tccaggcacagagttggtcagt

SEQ ID NO: 8014705 - DNA, 22 bp, Homo sapiens
catatcatttgcttataaatct

SEQ ID NO: 8014706 - DNA, 22 bp, Homo sapiens
catatcatttgcttataaatct

SEQ ID NO: 8014707 - DNA, 22 bp, Homo sapiens
catatattctggttttcactgg

SEQ ID NO: 8014708 - DNA, 22 bp, Homo sapiens
catatcttctgacatgatcagg

SEQ ID NO: 8014709 - DNA, 22 bp, Homo sapiens
catatccaggtttctttggttt

SEQ ID NO: 8014710 - DNA, 22 bp, Homo sapiens
catatccaatatgactagtgtt

SEQ ID NO: 8014711 - DNA, 22 bp, Homo sapiens
catatgaaatatgagttgaaca

SEQ ID NO: 8014712 - DNA, 23 bp, Homo sapiens
catatgaattttagaggcagttt

SEQ ID NO: 8014713 - DNA, 20 bp, Homo sapiens
catatggaaagatattgttc

SEQ ID NO: 8014714 - DNA, 23 bp, Homo sapiens
catatgaattttagaggcagttt

SEQ ID NO: 8014715 - DNA, 22 bp, Homo sapiens
catatgaagttcaacagagatg

SEQ ID NO: 8014716 - DNA, 22 bp, Homo sapiens
catatgaaatatgagttgaaca

SEQ ID NO: 8014717 - DNA, 22 bp, Homo sapiens
catatgaaatatgagttgaaca

SEQ ID NO: 8014718 - DNA, 22 bp, Homo sapiens
catatgaagttcaacagagatg

SEQ ID NO: 8014719 - DNA, 22 bp, Homo sapiens
catatgaagttcaacagagatg

SEQ ID NO: 8014720 - DNA, 22 bp, Homo sapiens
catatatgtagatgtatgtgaa

SEQ ID NO: 8014721 - DNA, 20 bp, Homo sapiens
catatatacctagaagtgga

SEQ ID NO: 8014722 - DNA, 22 bp, Homo sapiens
catatatgtagatgtatgtgaa

SEQ ID NO: 8014723 - DNA, 22 bp, Homo sapiens
catatattatggactgcagaat

SEQ ID NO: 8014724 - DNA, 22 bp, Homo sapiens
catatattctggttttcactgg

SEQ ID NO: 8014725 - DNA, 22 bp, Homo sapiens
catatattctggttttcactgg

SEQ ID NO: 8014726 - DNA, 22 bp, Homo sapiens
catatattatggactgcagaat

SEQ ID NO: 8014727 - DNA, 22 bp, Homo sapiens
catatattctggttttcactgg

SEQ ID NO: 8014728 - DNA, 22 bp, Homo sapiens
catatattctggttttcactgg

SEQ ID NO: 8014729 - DNA, 22 bp, Homo sapiens
catatattctggttttcactgg

SEQ ID NO: 8014730 - DNA, 22 bp, Homo sapiens
catatattctggttttcactgg

SEQ ID NO: 8014731 - DNA, 22 bp, Homo sapiens
catatactgcatacatatgtgt

SEQ ID NO: 8014732 - DNA, 22 bp, Homo sapiens
catatacacttccacctctgtg

SEQ ID NO: 8014733 - DNA, 22 bp, Homo sapiens
catatacacttccacctctgtg

SEQ ID NO: 8014734 - DNA, 22 bp, Homo sapiens
catatactgcatacatatgtgt

SEQ ID NO: 8014735 - DNA, 20 bp, Homo sapiens
catatatacctagaagtgga

SEQ ID NO: 8014736 - DNA, 22 bp, Homo sapiens
catatacttttctatagctttc

SEQ ID NO: 8014737 - DNA, 20 bp, Homo sapiens
catatatacctagaagtgga

SEQ ID NO: 8014738 - DNA, 22 bp, Homo sapiens
tcaggaagtgctgaggctgctt

SEQ ID NO: 8014739 - DNA, 22 bp, Homo sapiens
tcaggaagtgctgaggctgctt

SEQ ID NO: 8014740 - DNA, 22 bp, Homo sapiens
tcaggaagtgctgaggctgctt

SEQ ID NO: 8014741 - DNA, 22 bp, Homo sapiens
tcaggaagtggtaaaggatgtt

SEQ ID NO: 8014742 - DNA, 22 bp, Homo sapiens
tcaggaagtgctgaggctgctt

SEQ ID NO: 8014743 - DNA, 22 bp, Homo sapiens
tcaggaagtgctgaggctgctt

SEQ ID NO: 8014744 - DNA, 22 bp, Homo sapiens
tcaggaagtggtaaaggatgtt

SEQ ID NO: 8014745 - DNA, 22 bp, Homo sapiens
tcaggaagtggtaaaggatgtt

SEQ ID NO: 8014746 - DNA, 22 bp, Homo sapiens
tcaggaagtggtaaaggatgtt

SEQ ID NO: 8014747 - DNA, 22 bp, Homo sapiens
tcaggaagtggtaaaggatgtt

SEQ ID NO: 8014748 - DNA, 22 bp, Homo sapiens
tcaggaagttgaggcgtagaga

SEQ ID NO: 8014749 - DNA, 22 bp, Homo sapiens
tcaggaagttgaggcgtagaga

SEQ ID NO: 8014750 - DNA, 22 bp, Homo sapiens
tcaggaagtggtaaaggatgtt

SEQ ID NO: 8014751 - DNA, 22 bp, Homo sapiens
tcaggaagtggtaaaggatgtt

SEQ ID NO: 8014752 - DNA, 22 bp, Homo sapiens
tcaggaagtggtaaaggatgtt

SEQ ID NO: 8014753 - DNA, 22 bp, Homo sapiens
tcaggaagtggtaaaggatgtt

SEQ ID NO: 8014754 - DNA, 22 bp, Homo sapiens
tcaggaagtggtaaaggatgtt

SEQ ID NO: 8014755 - DNA, 22 bp, Homo sapiens
tcaggaagtgctgaggctgctt

SEQ ID NO: 8014756 - DNA, 22 bp, Homo sapiens
tcaggaagtgctgaggctgctt

SEQ ID NO: 8014757 - DNA, 22 bp, Homo sapiens
tcaggaagtgctgaggctgctt

SEQ ID NO: 8014758 - DNA, 22 bp, Homo sapiens
tcaggaagtgctgaggctgctt

SEQ ID NO: 8014759 - DNA, 22 bp, Homo sapiens
tcaggaagtgcctaggctggcc

SEQ ID NO: 8014760 - DNA, 22 bp, Homo sapiens
tcaggaagtgcctaggctggcc

SEQ ID NO: 8014761 - DNA, 22 bp, Homo sapiens
tcaggaagtgcctaggctggcc

SEQ ID NO: 8014762 - DNA, 22 bp, Homo sapiens
tcaggaagtgcctaggctggcc

SEQ ID NO: 8014763 - DNA, 22 bp, Homo sapiens
tcaggaagtctcaattagctac

SEQ ID NO: 8014764 - DNA, 22 bp, Homo sapiens
tcaggaagtctcaattagctac

SEQ ID NO: 8014765 - DNA, 22 bp, Homo sapiens
tcaggaagtctcaattagctac

SEQ ID NO: 8014766 - DNA, 22 bp, Homo sapiens
tcaggaagtgcctaggctggcc

SEQ ID NO: 8014767 - DNA, 22 bp, Homo sapiens
tcaggaagtgcctaggctggcc

SEQ ID NO: 8014768 - DNA, 22 bp, Homo sapiens
tcaggaagtgcctaggctggcc

SEQ ID NO: 8014769 - DNA, 22 bp, Homo sapiens
catatacacttccacctctgtg

SEQ ID NO: 8014770 - DNA, 22 bp, Homo sapiens
catatacacttccacctctgtg

SEQ ID NO: 8014771 - DNA, 22 bp, Homo sapiens
catataatgtttgaagatgtgg

SEQ ID NO: 8014772 - DNA, 22 bp, Homo sapiens
catatacacttccacctctgtg

SEQ ID NO: 8014773 - DNA, 22 bp, Homo sapiens
catatacacttccacctctgtg

SEQ ID NO: 8014774 - DNA, 22 bp, Homo sapiens
catataatgtttgaagatgtgg

SEQ ID NO: 8014775 - DNA, 22 bp, Homo sapiens
catataaatacaacatgtgtta

SEQ ID NO: 8014776 - DNA, 22 bp, Homo sapiens
catataaatacaacatgtgtta

SEQ ID NO: 8014777 - DNA, 22 bp, Homo sapiens
catataaatacaacatgtgtta

SEQ ID NO: 8014778 - DNA, 22 bp, Homo sapiens
catataaatacaacatgtgtta

SEQ ID NO: 8014779 - DNA, 22 bp, Homo sapiens
catataaatacaacatgtgtta

SEQ ID NO: 8014780 - DNA, 22 bp, Homo sapiens
catagacaaagatcagaagagt

SEQ ID NO: 8014781 - DNA, 22 bp, Homo sapiens
catagacagatggtaagaagct

SEQ ID NO: 8014782 - DNA, 22 bp, Homo sapiens
catagacagatggtaagaagct

SEQ ID NO: 8014783 - DNA, 22 bp, Homo sapiens
catagacaaagatcagaagagt

SEQ ID NO: 8014784 - DNA, 22 bp, Homo sapiens
catagaatggattgacaagatt

SEQ ID NO: 8014785 - DNA, 22 bp, Homo sapiens
catagaatgtaataaagagtag

SEQ ID NO: 8014786 - DNA, 22 bp, Homo sapiens
catagaatgtaataaagagtag

SEQ ID NO: 8014787 - DNA, 19 bp, Homo sapiens
tcaggaagttgatgaggtg

SEQ ID NO: 8014788 - DNA, 19 bp, Homo sapiens
tcaggaagttgatgaggtg

SEQ ID NO: 8014789 - DNA, 22 bp, Homo sapiens
tcaggaagttgaggcgtagaga

SEQ ID NO: 8014790 - DNA, 19 bp, Homo sapiens
tcaggaagttgatgaggtg

SEQ ID NO: 8014791 - DNA, 22 bp, Homo sapiens
tcagggattgcaaaattcatcc

SEQ ID NO: 8014792 - DNA, 22 bp, Homo sapiens
catatgtatttctcataattag

SEQ ID NO: 8014793 - DNA, 22 bp, Homo sapiens
catatgtatttctcataattag

SEQ ID NO: 8014794 - DNA, 22 bp, Homo sapiens
catatgtactgtttgctttcaa

SEQ ID NO: 8014795 - DNA, 22 bp, Homo sapiens
catatgtactgtttgctttcaa

SEQ ID NO: 8014796 - DNA, 23 bp, Homo sapiens
catatgaattttagaggcagttt

SEQ ID NO: 8014797 - DNA, 22 bp, Homo sapiens
catatggacaagaacatttatg

SEQ ID NO: 8014798 - DNA, 22 bp, Homo sapiens
catatgtactgtttgctttcaa

SEQ ID NO: 8014799 - DNA, 20 bp, Homo sapiens
tcagggcatgggacagcccc

SEQ ID NO: 8014800 - DNA, 22 bp, Homo sapiens
tcagggcatggctgcacttggc

SEQ ID NO: 8014801 - DNA, 22 bp, Homo sapiens
tcagggcatggctgcacttggc

SEQ ID NO: 8014802 - DNA, 22 bp, Homo sapiens
tcagggattgcaaaattcatcc

SEQ ID NO: 8014803 - DNA, 22 bp, Homo sapiens
tcagggcatggctgcacttggc

SEQ ID NO: 8014804 - DNA, 20 bp, Homo sapiens
tcagggcatgggacagcccc

SEQ ID NO: 8014805 - DNA, 20 bp, Homo sapiens
tcagggcatgggacagcccc

SEQ ID NO: 8014806 - DNA, 20 bp, Homo sapiens
tcagggcatgggacagcccc

SEQ ID NO: 8014807 - DNA, 20 bp, Homo sapiens
tcagggcatgggacagcccc

SEQ ID NO: 8014808 - DNA, 22 bp, Homo sapiens
tcagggccacgcggaggtgacg

SEQ ID NO: 8014809 - DNA, 22 bp, Homo sapiens
tcagggcattcaagaggcctgg

SEQ ID NO: 8014810 - DNA, 22 bp, Homo sapiens
tcagggccacaacaccagagtc

SEQ ID NO: 8014811 - DNA, 22 bp, Homo sapiens
tcagggcattcaagaggcctgg

SEQ ID NO: 8014812 - DNA, 22 bp, Homo sapiens
tcagggcattcaagaggcctgg

SEQ ID NO: 8014813 - DNA, 22 bp, Homo sapiens
tcagggcatgtatgtttcttta

SEQ ID NO: 8014814 - DNA, 22 bp, Homo sapiens
tcagggcattcaagaggcctgg

SEQ ID NO: 8014815 - DNA, 22 bp, Homo sapiens
catcacaaatgtaataatgtct

SEQ ID NO: 8014816 - DNA, 22 bp, Homo sapiens
tcagggccctggacaaccctcc

SEQ ID NO: 8014817 - DNA, 22 bp, Homo sapiens
tcagggccctcacttgcatagg

SEQ ID NO: 8014818 - DNA, 22 bp, Homo sapiens
tcagggccctcacttgcatagg

SEQ ID NO: 8014819 - DNA, 22 bp, Homo sapiens
tcagggcccagagctcaggcaa

SEQ ID NO: 8014820 - DNA, 22 bp, Homo sapiens
tcagggcccagtctgtgcatct

SEQ ID NO: 8014821 - DNA, 22 bp, Homo sapiens
catcacagaaataaacatacct

SEQ ID NO: 8014822 - DNA, 22 bp, Homo sapiens
catcacagatgttgtgtggagt

SEQ ID NO: 8014823 - DNA, 22 bp, Homo sapiens
catcacaggcattttgagtgtc

SEQ ID NO: 8014824 - DNA, 22 bp, Homo sapiens
catcacagaaataaacatacct

SEQ ID NO: 8014825 - DNA, 22 bp, Homo sapiens
catcacaaatgtaataatgtct

SEQ ID NO: 8014826 - DNA, 22 bp, Homo sapiens
catcacagaaataaacatacct

SEQ ID NO: 8014827 - DNA, 22 bp, Homo sapiens
catcacagaaataaacatacct

SEQ ID NO: 8014828 - DNA, 19 bp, Homo sapiens
tcagggccatgagcgccac

SEQ ID NO: 8014829 - DNA, 19 bp, Homo sapiens
tcagggccatgagcgccac

SEQ ID NO: 8014830 - DNA, 22 bp, Homo sapiens
tcagggcccagagctcaggcaa

SEQ ID NO: 8014831 - DNA, 22 bp, Homo sapiens
tcagggcccagagctcaggcaa

SEQ ID NO: 8014832 - DNA, 22 bp, Homo sapiens
tcagggccatcttttgcctcaa

SEQ ID NO: 8014833 - DNA, 22 bp, Homo sapiens
tcagggccacgcggaggtgacg

SEQ ID NO: 8014834 - DNA, 22 bp, Homo sapiens
tcagggccaggactaggatgag

SEQ ID NO: 8014835 - DNA, 22 bp, Homo sapiens
tcagggccatcttttgcctcaa

SEQ ID NO: 8014836 - DNA, 22 bp, Homo sapiens
tcagggccatcttttgcctcaa

SEQ ID NO: 8014837 - DNA, 22 bp, Homo sapiens
tcagggccatcttttgcctcaa

SEQ ID NO: 8014838 - DNA, 22 bp, Homo sapiens
catcacagggggctagaagtct

SEQ ID NO: 8014839 - DNA, 22 bp, Homo sapiens
catcacagggggctagaagtct

SEQ ID NO: 8014840 - DNA, 22 bp, Homo sapiens
catcacaggcattttgagtgtc

SEQ ID NO: 8014841 - DNA, 22 bp, Homo sapiens
catcacaggtcctgatgacatt

SEQ ID NO: 8014842 - DNA, 22 bp, Homo sapiens
catcacaggtcctgatgacatt

SEQ ID NO: 8014843 - DNA, 22 bp, Homo sapiens
catcacaggtcctgatgacatt

SEQ ID NO: 8014844 - DNA, 22 bp, Homo sapiens
catcacaggtcctgatgacatt

SEQ ID NO: 8014845 - DNA, 22 bp, Homo sapiens
catcacagtttgtcagaaatca

SEQ ID NO: 8014846 - DNA, 22 bp, Homo sapiens
catcacagtttgtcagaaatca

SEQ ID NO: 8014847 - DNA, 22 bp, Homo sapiens
catcacagtttgtcagaaatca

SEQ ID NO: 8014848 - DNA, 22 bp, Homo sapiens
catcacagtttgtcagaaatca

SEQ ID NO: 8014849 - DNA, 22 bp, Homo sapiens
catcacagtttgtcagaaatca

SEQ ID NO: 8014850 - DNA, 22 bp, Homo sapiens
catcacaggtcctgatgacatt

SEQ ID NO: 8014851 - DNA, 22 bp, Homo sapiens
catcacagtttgtcagaaatca

SEQ ID NO: 8014852 - DNA, 22 bp, Homo sapiens
catcacatgcctatcatgagct

SEQ ID NO: 8014853 - DNA, 22 bp, Homo sapiens
catcacatgcctatcatgagct

SEQ ID NO: 8014854 - DNA, 22 bp, Homo sapiens
catcacatcagtgtgaacagtt

SEQ ID NO: 8014855 - DNA, 22 bp, Homo sapiens
catcacatcagtgtgaacagtt

SEQ ID NO: 8014856 - DNA, 21 bp, Homo sapiens
catcacattactcaaagtcct

SEQ ID NO: 8014857 - DNA, 21 bp, Homo sapiens
catcacattactcaaagtcct

SEQ ID NO: 8014858 - DNA, 22 bp, Homo sapiens
catcacatgtaggcagcatcac

SEQ ID NO: 8014859 - DNA, 22 bp, Homo sapiens
catcacatgtaggcagcatcac

SEQ ID NO: 8014860 - DNA, 19 bp, Homo sapiens
catcacatggtctgatgaa

SEQ ID NO: 8014861 - DNA, 22 bp, Homo sapiens
catccagagtccaaggctgggc

SEQ ID NO: 8014862 - DNA, 22 bp, Homo sapiens
catccagagtccaaggctgggc

SEQ ID NO: 8014863 - DNA, 22 bp, Homo sapiens
catccagaccgtgccatgctgc

SEQ ID NO: 8014864 - DNA, 22 bp, Homo sapiens
catccagagtccaaggctgggc

SEQ ID NO: 8014865 - DNA, 22 bp, Homo sapiens
catccagaccgtgccatgctgc

SEQ ID NO: 8014866 - DNA, 22 bp, Homo sapiens
catccagaccgtgccatgctgc

SEQ ID NO: 8014867 - DNA, 22 bp, Homo sapiens
catccagaccgtgccatgctgc

SEQ ID NO: 8014868 - DNA, 22 bp, Homo sapiens
catccagaccgtgccatgctgc

SEQ ID NO: 8014869 - DNA, 22 bp, Homo sapiens
catccactagaatgacagagtt

SEQ ID NO: 8014870 - DNA, 22 bp, Homo sapiens
catccactagaatgacagagtt

SEQ ID NO: 8014871 - DNA, 22 bp, Homo sapiens
catccaatgtcctattaagact

SEQ ID NO: 8014872 - DNA, 22 bp, Homo sapiens
catcatcttgaatgactgtgat

SEQ ID NO: 8014873 - DNA, 22 bp, Homo sapiens
catcatgaagatgagaaagcat

SEQ ID NO: 8014874 - DNA, 22 bp, Homo sapiens
catccactagaatgacagagtt

SEQ ID NO: 8014875 - DNA, 22 bp, Homo sapiens
catccaatgtcctattaagact

SEQ ID NO: 8014876 - DNA, 22 bp, Homo sapiens
catcatctggcttttagaaaaa

SEQ ID NO: 8014877 - DNA, 22 bp, Homo sapiens
catcatctggcttttagaaaaa

SEQ ID NO: 8014878 - DNA, 22 bp, Homo sapiens
catcatctgtgctggagagcct

SEQ ID NO: 8014879 - DNA, 22 bp, Homo sapiens
catccaggcaccacaaccagct

SEQ ID NO: 8014880 - DNA, 22 bp, Homo sapiens
catccaggcaccacaaccagct

SEQ ID NO: 8014881 - DNA, 23 bp, Homo sapiens
catccaggagctgagtctgactg

SEQ ID NO: 8014882 - DNA, 22 bp, Homo sapiens
catccagcccacgataaagagg

SEQ ID NO: 8014883 - DNA, 23 bp, Homo sapiens
catccaggagctgagtctgactg

SEQ ID NO: 8014884 - DNA, 23 bp, Homo sapiens
catccaggagctgagtctgactg

SEQ ID NO: 8014885 - DNA, 22 bp, Homo sapiens
catccagggcagccatggcctg

SEQ ID NO: 8014886 - DNA, 22 bp, Homo sapiens
catccaggctggagtacagtgg

SEQ ID NO: 8014887 - DNA, 22 bp, Homo sapiens
catccagggcagccatggcctg

SEQ ID NO: 8014888 - DNA, 22 bp, Homo sapiens
catccagtgggacagagaaacc

SEQ ID NO: 8014889 - DNA, 22 bp, Homo sapiens
catccagggcagccatggcctg

SEQ ID NO: 8014890 - DNA, 22 bp, Homo sapiens
cagtttgtatttattactcata

SEQ ID NO: 8014891 - DNA, 19 bp, Homo sapiens
cagtttgtccagaggggac

SEQ ID NO: 8014892 - DNA, 22 bp, Homo sapiens
cagtttggcagcaacatggcga

SEQ ID NO: 8014893 - DNA, 22 bp, Homo sapiens
cagtttggggtcggagtcaggg

SEQ ID NO: 8014894 - DNA, 22 bp, Homo sapiens
cagtttggtcatttgtcttgta

SEQ ID NO: 8014895 - DNA, 22 bp, Homo sapiens
cagtttctttccattgttacct

SEQ ID NO: 8014896 - DNA, 22 bp, Homo sapiens
cagtttgcataacaagagattc

SEQ ID NO: 8014897 - DNA, 22 bp, Homo sapiens
cagtttctttccattgttacct

SEQ ID NO: 8014898 - DNA, 22 bp, Homo sapiens
cagtttgcataacaagagattc

SEQ ID NO: 8014899 - DNA, 22 bp, Homo sapiens
cagtttgcataacaagagattc

SEQ ID NO: 8014900 - DNA, 22 bp, Homo sapiens
cagtttcttggatgccaatttc

SEQ ID NO: 8014901 - DNA, 22 bp, Homo sapiens
cagtttcttggatgccaatttc

SEQ ID NO: 8014902 - DNA, 22 bp, Homo sapiens
cagtttcttctattttgaacta

SEQ ID NO: 8014903 - DNA, 22 bp, Homo sapiens
cagtttcttctattttgaacta

SEQ ID NO: 8014904 - DNA, 19 bp, Homo sapiens
tcagcccaggctgggaagc

SEQ ID NO: 8014905 - DNA, 19 bp, Homo sapiens
tcagcccaggctgggaagc

SEQ ID NO: 8014906 - DNA, 20 bp, Homo sapiens
tcagcccagggtgagcatct

SEQ ID NO: 8014907 - DNA, 20 bp, Homo sapiens
tcagcccagggtgagcatct

SEQ ID NO: 8014908 - DNA, 22 bp, Homo sapiens
tcagcccagggacagaggcccc

SEQ ID NO: 8014909 - DNA, 22 bp, Homo sapiens
tcagcagtggctctcatgcagt

SEQ ID NO: 8014910 - DNA, 22 bp, Homo sapiens
tcagcagtggctctcatgcagt

SEQ ID NO: 8014911 - DNA, 19 bp, Homo sapiens
cagtttgtccagaggggac

SEQ ID NO: 8014912 - DNA, 22 bp, Homo sapiens
tcagcagtggctctcatgcagt

SEQ ID NO: 8014913 - DNA, 22 bp, Homo sapiens
tcagcagtggctctcatgcagt

SEQ ID NO: 8014914 - DNA, 22 bp, Homo sapiens
tcagcagtgggtcctgagggtg

SEQ ID NO: 8014915 - DNA, 22 bp, Homo sapiens
cagtttcttctattttgaacta

SEQ ID NO: 8014916 - DNA, 22 bp, Homo sapiens
cagtttcttcctcccccagaga

SEQ ID NO: 8014917 - DNA, 22 bp, Homo sapiens
cagtttcttcatctgcagaatc

SEQ ID NO: 8014918 - DNA, 17 bp, Homo sapiens
cagtttcttccccctct

SEQ ID NO: 8014919 - DNA, 22 bp, Homo sapiens
cagtttcttcatcagttaagca

SEQ ID NO: 8014920 - DNA, 22 bp, Homo sapiens
cagtttcttcatctgcagaatc

SEQ ID NO: 8014921 - DNA, 22 bp, Homo sapiens
cagtttcttcaattcagacact

SEQ ID NO: 8014922 - DNA, 22 bp, Homo sapiens
cagtttcttcatcagttaagca

SEQ ID NO: 8014923 - DNA, 22 bp, Homo sapiens
cagtttcttcatcagttaagca

SEQ ID NO: 8014924 - DNA, 22 bp, Homo sapiens
cagtttcttcaattcagacact

SEQ ID NO: 8014925 - DNA, 22 bp, Homo sapiens
cagtttcttcatcagttaagca

SEQ ID NO: 8014926 - DNA, 22 bp, Homo sapiens
cagtttctgttttaaatagcag

SEQ ID NO: 8014927 - DNA, 22 bp, Homo sapiens
cagtttctgttttaaatagcag

SEQ ID NO: 8014928 - DNA, 22 bp, Homo sapiens
cagtttctgttttaaatagcag

SEQ ID NO: 8014929 - DNA, 22 bp, Homo sapiens
cagtttctgttttaaatagcag

SEQ ID NO: 8014930 - DNA, 22 bp, Homo sapiens
cagtttctgttttaaatagcag

SEQ ID NO: 8014931 - DNA, 22 bp, Homo sapiens
cagtttcttaagactgagatct

SEQ ID NO: 8014932 - DNA, 22 bp, Homo sapiens
cagtttcttaagactgagatct

SEQ ID NO: 8014933 - DNA, 22 bp, Homo sapiens
cagtttcttaagactgagatct

SEQ ID NO: 8014934 - DNA, 22 bp, Homo sapiens
cagtttcttaagactgagatct

SEQ ID NO: 8014935 - DNA, 22 bp, Homo sapiens
cagtttcttatcttcaaaattg

SEQ ID NO: 8014936 - DNA, 22 bp, Homo sapiens
cagtttcttatcttcaaaattg

SEQ ID NO: 8014937 - DNA, 22 bp, Homo sapiens
cagtttcttagtgacacaaatc

SEQ ID NO: 8014938 - DNA, 22 bp, Homo sapiens
cagtttcttagtgacacaaatc

SEQ ID NO: 8014939 - DNA, 22 bp, Homo sapiens
cagtttcttagtgacacaaatc

SEQ ID NO: 8014940 - DNA, 22 bp, Homo sapiens
cagtttcttagtgacacaaatc

SEQ ID NO: 8014941 - DNA, 22 bp, Homo sapiens
cagtttcttagtgacacaaatc

SEQ ID NO: 8014942 - DNA, 22 bp, Homo sapiens
cagtttatatgtcagagctgta

SEQ ID NO: 8014943 - DNA, 22 bp, Homo sapiens
cagtttatatgagggtatcaag

SEQ ID NO: 8014944 - DNA, 22 bp, Homo sapiens
cagtttatatgagggtatcaag

SEQ ID NO: 8014945 - DNA, 22 bp, Homo sapiens
cagtttatatgagggtatcaag

SEQ ID NO: 8014946 - DNA, 22 bp, Homo sapiens
cagtttctctcatacatatttg

SEQ ID NO: 8014947 - DNA, 22 bp, Homo sapiens
cagtttctctcatacatatttg

SEQ ID NO: 8014948 - DNA, 22 bp, Homo sapiens
cagtttctctcatacatatttg

SEQ ID NO: 8014949 - DNA, 22 bp, Homo sapiens
cagtttctgagccctgtcattt

SEQ ID NO: 8014950 - DNA, 22 bp, Homo sapiens
cagtttctgaggttccaggttt

SEQ ID NO: 8014951 - DNA, 22 bp, Homo sapiens
cagtttctgagccctgtcattt

SEQ ID NO: 8014952 - DNA, 22 bp, Homo sapiens
cagtttctgagccctgtcattt

SEQ ID NO: 8014953 - DNA, 22 bp, Homo sapiens
cagtttctgagccctgtcattt

SEQ ID NO: 8014954 - DNA, 22 bp, Homo sapiens
cagtttctgtctgttcttatcc

SEQ ID NO: 8014955 - DNA, 22 bp, Homo sapiens
cagtttctgtggtctcttttca

SEQ ID NO: 8014956 - DNA, 22 bp, Homo sapiens
cagtttctgtggtctcttttca

SEQ ID NO: 8014957 - DNA, 22 bp, Homo sapiens
cagtttctgggcgttcacaggt

SEQ ID NO: 8014958 - DNA, 22 bp, Homo sapiens
cagtttctgggcgttcacaggt

SEQ ID NO: 8014959 - DNA, 22 bp, Homo sapiens
cagtttctgccaggatgtgtta

SEQ ID NO: 8014960 - DNA, 22 bp, Homo sapiens
cagtttctgccaggatgtgtta

SEQ ID NO: 8014961 - DNA, 15 bp, Homo sapiens
cagtttctgatcatc

SEQ ID NO: 8014962 - DNA, 22 bp, Homo sapiens
cagtttctgccaggatgtgtta

SEQ ID NO: 8014963 - DNA, 22 bp, Homo sapiens
cagtttctgaggttccaggttt

SEQ ID NO: 8014964 - DNA, 22 bp, Homo sapiens
cagtttctgggcgttcacaggt

SEQ ID NO: 8014965 - DNA, 22 bp, Homo sapiens
cagtttctgggcgttcacaggt

SEQ ID NO: 8014966 - DNA, 15 bp, Homo sapiens
cagtttctgcttgaa

SEQ ID NO: 8014967 - DNA, 22 bp, Homo sapiens
cagtttctgggaggaaaggaag

SEQ ID NO: 8014968 - DNA, 22 bp, Homo sapiens
cagtttctgggaggaaaggaag

SEQ ID NO: 8014969 - DNA, 22 bp, Homo sapiens
tcagaaggtacagaagggaggt

SEQ ID NO: 8014970 - DNA, 22 bp, Homo sapiens
tcagaaggtactgaagacatgg

SEQ ID NO: 8014971 - DNA, 22 bp, Homo sapiens
tcagaaggtacagaagggaggt

SEQ ID NO: 8014972 - DNA, 20 bp, Homo sapiens
tcagaaggctccagagcaga

SEQ ID NO: 8014973 - DNA, 23 bp, Homo sapiens
tcagaaggtgccactgacgcttt

SEQ ID NO: 8014974 - DNA, 22 bp, Homo sapiens
tcagaaggtggaggttgcagtg

SEQ ID NO: 8014975 - DNA, 22 bp, Homo sapiens
tcagaaggtttttagcaaagga

SEQ ID NO: 8014976 - DNA, 22 bp, Homo sapiens
tcagaagtactgtgctacaata

SEQ ID NO: 8014977 - DNA, 22 bp, Homo sapiens
tcagaagtaaggttctcccaag

SEQ ID NO: 8014978 - DNA, 22 bp, Homo sapiens
tcagaagtactgtgctacaata

SEQ ID NO: 8014979 - DNA, 22 bp, Homo sapiens
tcagaagtcacttaggaaaggg

SEQ ID NO: 8014980 - DNA, 22 bp, Homo sapiens
tcagaagtcatgctcagtctgt

SEQ ID NO: 8014981 - DNA, 22 bp, Homo sapiens
tcagaagtccaataccatggga

SEQ ID NO: 8014982 - DNA, 22 bp, Homo sapiens
tcagaagtattatgctaaagga

SEQ ID NO: 8014983 - DNA, 22 bp, Homo sapiens
tcagaagtcacttaggaaaggg

SEQ ID NO: 8014984 - DNA, 22 bp, Homo sapiens
tcagaagtattatgctaaagga

SEQ ID NO: 8014985 - DNA, 22 bp, Homo sapiens
tcagaagtaggagacattcttg

SEQ ID NO: 8014986 - DNA, 22 bp, Homo sapiens
tcagaagtccccagtcaaggag

SEQ ID NO: 8014987 - DNA, 22 bp, Homo sapiens
tcagaagtccaattttcgcacc

SEQ ID NO: 8014988 - DNA, 22 bp, Homo sapiens
tcagaagtccaataccatggga

SEQ ID NO: 8014989 - DNA, 22 bp, Homo sapiens
tcagaagtctggactgcttctc

SEQ ID NO: 8014990 - DNA, 22 bp, Homo sapiens
catacattgctcattcagtatc

SEQ ID NO: 8014991 - DNA, 22 bp, Homo sapiens
catacatttatacacatctatg

SEQ ID NO: 8014992 - DNA, 22 bp, Homo sapiens
catacatttatacacatctatg

SEQ ID NO: 8014993 - DNA, 22 bp, Homo sapiens
catacatttatacacatctatg

SEQ ID NO: 8014994 - DNA, 22 bp, Homo sapiens
catacattttgcatatttacca

SEQ ID NO: 8014995 - DNA, 22 bp, Homo sapiens
catacatttatacacatctatg

SEQ ID NO: 8014996 - DNA, 22 bp, Homo sapiens
catacatttatacacatctatg

SEQ ID NO: 8014997 - DNA, 22 bp, Homo sapiens
catacattgctcattcagtatc

SEQ ID NO: 8014998 - DNA, 22 bp, Homo sapiens
catacattgaatttgcacgtgt

SEQ ID NO: 8014999 - DNA, 22 bp, Homo sapiens
catacattgaaggagaaaggaa

SEQ ID NO: 8015000 - DNA, 22 bp, Homo sapiens
catacattgaaggagaaaggaa

SEQ ID NO: 8015001 - DNA, 22 bp, Homo sapiens
catacattgctcattcagtatc

SEQ ID NO: 8015002 - DNA, 22 bp, Homo sapiens
catacattgctcattcagtatc

SEQ ID NO: 8015003 - DNA, 22 bp, Homo sapiens
catacattgctcattcagtatc

SEQ ID NO: 8015004 - DNA, 22 bp, Homo sapiens
catacattgctcattcagtatc

SEQ ID NO: 8015005 - DNA, 22 bp, Homo sapiens
tcagctgcagtttcacaagcac

SEQ ID NO: 8015006 - DNA, 22 bp, Homo sapiens
tcagctgcagtttcacaagcac

SEQ ID NO: 8015007 - DNA, 22 bp, Homo sapiens
tcagctgcagcaggcaccattt

SEQ ID NO: 8015008 - DNA, 22 bp, Homo sapiens
tcagctgcactgttctgaccca

SEQ ID NO: 8015009 - DNA, 22 bp, Homo sapiens
tcagctgcagcaggcaccattt

SEQ ID NO: 8015010 - DNA, 22 bp, Homo sapiens
tcagctgcagcaggcaccattt

SEQ ID NO: 8015011 - DNA, 22 bp, Homo sapiens
tcagctgcagcaggcaccattt

SEQ ID NO: 8015012 - DNA, 22 bp, Homo sapiens
tcagctgcataagtcaccttgc

SEQ ID NO: 8015013 - DNA, 22 bp, Homo sapiens
tcagctgcataacaaagtatga

SEQ ID NO: 8015014 - DNA, 22 bp, Homo sapiens
tcagctgcataacaaagtatga

SEQ ID NO: 8015015 - DNA, 22 bp, Homo sapiens
tcagctgcagtttcacaagcac

SEQ ID NO: 8015016 - DNA, 22 bp, Homo sapiens
tcagctgcagtttcacaagcac

SEQ ID NO: 8015017 - DNA, 22 bp, Homo sapiens
tcagctgcagtttcacaagcac

SEQ ID NO: 8015018 - DNA, 22 bp, Homo sapiens
catacattacctaacttaatgc

SEQ ID NO: 8015019 - DNA, 22 bp, Homo sapiens
cataatttttttaagtcagaac

SEQ ID NO: 8015020 - DNA, 22 bp, Homo sapiens
tcagctgcataagtcaccttgc

SEQ ID NO: 8015021 - DNA, 22 bp, Homo sapiens
tcagctgcataagtcaccttgc

SEQ ID NO: 8015022 - DNA, 22 bp, Homo sapiens
tcaggaagtataatcagattca

SEQ ID NO: 8015023 - DNA, 22 bp, Homo sapiens
tcaggaagtataatcagattca

SEQ ID NO: 8015024 - DNA, 22 bp, Homo sapiens
tcaggaagtataatcagattca

SEQ ID NO: 8015025 - DNA, 22 bp, Homo sapiens
catagaaaagagtaggtaatgt

SEQ ID NO: 8015026 - DNA, 22 bp, Homo sapiens
catagaaaagagtaggtaatgt

SEQ ID NO: 8015027 - DNA, 22 bp, Homo sapiens
catagaaaagagtaggtaatgt

SEQ ID NO: 8015028 - DNA, 22 bp, Homo sapiens
catacttttgccctgacattct

SEQ ID NO: 8015029 - DNA, 22 bp, Homo sapiens
catactttgggataagagtgga

SEQ ID NO: 8015030 - DNA, 22 bp, Homo sapiens
catactttttagatctgccttc

SEQ ID NO: 8015031 - DNA, 22 bp, Homo sapiens
catacttttgccctgacattct

SEQ ID NO: 8015032 - DNA, 22 bp, Homo sapiens
catacattttgcatatttacca

SEQ ID NO: 8015033 - DNA, 22 bp, Homo sapiens
catacattttgcatatttacca

SEQ ID NO: 8015034 - DNA, 22 bp, Homo sapiens
catacattttgcatatttacca

SEQ ID NO: 8015035 - DNA, 22 bp, Homo sapiens
catacattttgcatatttacca

SEQ ID NO: 8015036 - DNA, 22 bp, Homo sapiens
catacctttctcaagcacatgt

SEQ ID NO: 8015037 - DNA, 22 bp, Homo sapiens
catacctttctcaagcacatgt

SEQ ID NO: 8015038 - DNA, 21 bp, Homo sapiens
cataccattctctaagcaaaa

SEQ ID NO: 8015039 - DNA, 22 bp, Homo sapiens
cataccctcccctgtgtcacgt

SEQ ID NO: 8015040 - DNA, 22 bp, Homo sapiens
cataccctgaagggagttgcca

SEQ ID NO: 8015041 - DNA, 22 bp, Homo sapiens
catacttactgtgtaccaggtg

SEQ ID NO: 8015042 - DNA, 22 bp, Homo sapiens
catactaaactatccagttact

SEQ ID NO: 8015043 - DNA, 22 bp, Homo sapiens
catactattactaggagcagga

SEQ ID NO: 8015044 - DNA, 22 bp, Homo sapiens
catactaaactatccagttact

SEQ ID NO: 8015045 - DNA, 21 bp, Homo sapiens
catactcagtgtataacttct

SEQ ID NO: 8015046 - DNA, 22 bp, Homo sapiens
tcagccctacattaggtaagcc

SEQ ID NO: 8015047 - DNA, 22 bp, Homo sapiens
tcagccccacggggtcagccaa

SEQ ID NO: 8015048 - DNA, 22 bp, Homo sapiens
tcagccccacggggtcagccaa

SEQ ID NO: 8015049 - DNA, 22 bp, Homo sapiens
tcagcccatcactcacgtatta

SEQ ID NO: 8015050 - DNA, 21 bp, Homo sapiens
tcagcccaggtgtctttgccc

SEQ ID NO: 8015051 - DNA, 22 bp, Homo sapiens
tcagcccagttttatcatctgt

SEQ ID NO: 8015052 - DNA, 22 bp, Homo sapiens
tcagcccagttttatcatctgt

SEQ ID NO: 8015053 - DNA, 22 bp, Homo sapiens
tcagccctgggacccagggatg

SEQ ID NO: 8015054 - DNA, 22 bp, Homo sapiens
tcagccctgggacccagggatg

SEQ ID NO: 8015055 - DNA, 22 bp, Homo sapiens
tcagccctggcactgtctccca

SEQ ID NO: 8015056 - DNA, 20 bp, Homo sapiens
tcagccctgagtccaggctg

SEQ ID NO: 8015057 - DNA, 20 bp, Homo sapiens
tcagccctgagtccaggctg

SEQ ID NO: 8015058 - DNA, 22 bp, Homo sapiens
tcagccctggcactgtctccca

SEQ ID NO: 8015059 - DNA, 22 bp, Homo sapiens
tcagccctggcactgtctccca

SEQ ID NO: 8015060 - DNA, 22 bp, Homo sapiens
tcagccctagcctcagtccagg

SEQ ID NO: 8015061 - DNA, 22 bp, Homo sapiens
tcagccctagaaagtctaagca

SEQ ID NO: 8015062 - DNA, 22 bp, Homo sapiens
tcagccctagaaagtctaagca

SEQ ID NO: 8015063 - DNA, 22 bp, Homo sapiens
tcagccctagaaagtctaagca

SEQ ID NO: 8015064 - DNA, 22 bp, Homo sapiens
tcagccctagcctcagtccagg

SEQ ID NO: 8015065 - DNA, 22 bp, Homo sapiens
tcagccctgaggacagaggcag

SEQ ID NO: 8015066 - DNA, 20 bp, Homo sapiens
tcagccctgagtccaggctg

SEQ ID NO: 8015067 - DNA, 22 bp, Homo sapiens
tcagccctgaggacagaggcag

SEQ ID NO: 8015068 - DNA, 22 bp, Homo sapiens
tcagccctgaggacagaggcag

SEQ ID NO: 8015069 - DNA, 22 bp, Homo sapiens
tcagctgcactgttctgaccca

SEQ ID NO: 8015070 - DNA, 22 bp, Homo sapiens
tcagctgcactgttctgaccca

SEQ ID NO: 8015071 - DNA, 22 bp, Homo sapiens
tcagctcttccccccagccagg

SEQ ID NO: 8015072 - DNA, 22 bp, Homo sapiens
tcagctgaagtggagaagcaga

SEQ ID NO: 8015073 - DNA, 22 bp, Homo sapiens
tcagctcttaaccctctggcct

SEQ ID NO: 8015074 - DNA, 22 bp, Homo sapiens
tcagctcttaaccctctggcct

SEQ ID NO: 8015075 - DNA, 22 bp, Homo sapiens
tcagctcttccccccagccagg

SEQ ID NO: 8015076 - DNA, 20 bp, Homo sapiens
tcagctcttagaggtcgctt

SEQ ID NO: 8015077 - DNA, 20 bp, Homo sapiens
tcagctcttagaggtcgctt

SEQ ID NO: 8015078 - DNA, 20 bp, Homo sapiens
tcagctcttagaggtcgctt

SEQ ID NO: 8015079 - DNA, 22 bp, Homo sapiens
tcagccctgggcttcctcatgg

SEQ ID NO: 8015080 - DNA, 22 bp, Homo sapiens
tcagccctgggcttcctcatgg

SEQ ID NO: 8015081 - DNA, 22 bp, Homo sapiens
tcagccctgggcttcctcatgg

SEQ ID NO: 8015082 - DNA, 20 bp, Homo sapiens
tcagctctgtgcctgggatg

SEQ ID NO: 8015083 - DNA, 22 bp, Homo sapiens
tcagctctggttcatgtggtct

SEQ ID NO: 8015084 - DNA, 22 bp, Homo sapiens
tcagcccttcctggagctttta

SEQ ID NO: 8015085 - DNA, 22 bp, Homo sapiens
tcagctctgtgtacagttagca

SEQ ID NO: 8015086 - DNA, 20 bp, Homo sapiens
tcagctctgtgcctgggatg

SEQ ID NO: 8015087 - DNA, 20 bp, Homo sapiens
tcagctctgtgcctgggatg

SEQ ID NO: 8015088 - DNA, 20 bp, Homo sapiens
tcagctctgtgcctgggatg

SEQ ID NO: 8015089 - DNA, 22 bp, Homo sapiens
tcagctctgttttgagtggaac

SEQ ID NO: 8015090 - DNA, 22 bp, Homo sapiens
tcagctcttaaccctctggcct

SEQ ID NO: 8015091 - DNA, 23 bp, Homo sapiens
tggtggttgatctggggcacagc

SEQ ID NO: 8015092 - DNA, 22 bp, Homo sapiens
tggtgtcactcaagcccggccg

SEQ ID NO: 8015093 - DNA, 22 bp, Homo sapiens
tggtgtaatcagtttctagctc

SEQ ID NO: 8015094 - DNA, 22 bp, Homo sapiens
tggtgtcaggcactagcatgca

SEQ ID NO: 8015095 - DNA, 22 bp, Homo sapiens
tggtgtcatcatagagccttgt

SEQ ID NO: 8015096 - DNA, 22 bp, Homo sapiens
tggtgtcatggacctggtgcct

SEQ ID NO: 8015097 - DNA, 22 bp, Homo sapiens
tggtgggtcggctgggagagct

SEQ ID NO: 8015098 - DNA, 22 bp, Homo sapiens
tggtgggtcggctgggagagct

SEQ ID NO: 8015099 - DNA, 18 bp, Homo sapiens
tggtggtgacagggtcat

SEQ ID NO: 8015100 - DNA, 23 bp, Homo sapiens
tggtggggtcttggagacagcac

SEQ ID NO: 8015101 - DNA, 23 bp, Homo sapiens
tggtggggtcttggagacagcac

SEQ ID NO: 8015102 - DNA, 23 bp, Homo sapiens
tggtggggtcttggagacagcac

SEQ ID NO: 8015103 - DNA, 23 bp, Homo sapiens
tggtggggtcttggagacagcac

SEQ ID NO: 8015104 - DNA, 23 bp, Homo sapiens
tggtggggtcttggagacagcac

SEQ ID NO: 8015105 - DNA, 23 bp, Homo sapiens
tggtggggtcttggagacagcac

SEQ ID NO: 8015106 - DNA, 22 bp, Homo sapiens
tggtgggtcggctgggagagct

SEQ ID NO: 8015107 - DNA, 23 bp, Homo sapiens
tggtggggtcttggagacagcac

SEQ ID NO: 8015108 - DNA, 23 bp, Homo sapiens
tggtggggtcttggagacagcac

SEQ ID NO: 8015109 - DNA, 22 bp, Homo sapiens
tggtggggtcatcgtcagatgc

SEQ ID NO: 8015110 - DNA, 23 bp, Homo sapiens
tggtggggtcttggagacagcac

SEQ ID NO: 8015111 - DNA, 22 bp, Homo sapiens
tggtggggtcatcgtcagatgc

SEQ ID NO: 8015112 - DNA, 22 bp, Homo sapiens
tggtggggtcatcgtcagatgc

SEQ ID NO: 8015113 - DNA, 22 bp, Homo sapiens
tggtgtgtgagtcaagacaagt

SEQ ID NO: 8015114 - DNA, 22 bp, Homo sapiens
tggtgtgttagagctcagggca

SEQ ID NO: 8015115 - DNA, 22 bp, Homo sapiens
tggtgtgttagagctcagggca

SEQ ID NO: 8015116 - DNA, 22 bp, Homo sapiens
tggtgtggtccagtgacatact

SEQ ID NO: 8015117 - DNA, 22 bp, Homo sapiens
tggtgtggggataagcactctg

SEQ ID NO: 8015118 - DNA, 22 bp, Homo sapiens
tggtgtgtacatttttgcttct

SEQ ID NO: 8015119 - DNA, 22 bp, Homo sapiens
tggtgttttagcattaaagacc

SEQ ID NO: 8015120 - DNA, 22 bp, Homo sapiens
tggttaaaatgcagattcagta

SEQ ID NO: 8015121 - DNA, 22 bp, Homo sapiens
tggtgtttaatgggctgtttat

SEQ ID NO: 8015122 - DNA, 22 bp, Homo sapiens
tggtgttggagatggttgcatt

SEQ ID NO: 8015123 - DNA, 22 bp, Homo sapiens
tggtgttgcaaataaagtccaa

SEQ ID NO: 8015124 - DNA, 22 bp, Homo sapiens
tggtgttgaacctcagcagggg

SEQ ID NO: 8015125 - DNA, 21 bp, Homo sapiens
tggtgttgacatcaagttata

SEQ ID NO: 8015126 - DNA, 22 bp, Homo sapiens
tggtgtgaggcgggagtgtagt

SEQ ID NO: 8015127 - DNA, 22 bp, Homo sapiens
tggtgtgagcaggtcaagttca

SEQ ID NO: 8015128 - DNA, 22 bp, Homo sapiens
tggtgtgggcagcagcaggtac

SEQ ID NO: 8015129 - DNA, 22 bp, Homo sapiens
tggtgtcttggaagtaggtgct

SEQ ID NO: 8015130 - DNA, 22 bp, Homo sapiens
tggtgtctcttagtacatagat

SEQ ID NO: 8015131 - DNA, 22 bp, Homo sapiens
tggtgtctggcacacaggaagc

SEQ ID NO: 8015132 - DNA, 22 bp, Homo sapiens
tggtgtcttggaagtaggtgct

SEQ ID NO: 8015133 - DNA, 22 bp, Homo sapiens
tggtgtggggataagcactctg

SEQ ID NO: 8015134 - DNA, 22 bp, Homo sapiens
tggtgtggggataagcactctg

SEQ ID NO: 8015135 - DNA, 22 bp, Homo sapiens
tggtgtggggataagcactctg

SEQ ID NO: 8015136 - DNA, 22 bp, Homo sapiens
tggtgtgggcgtggcaggcaag

SEQ ID NO: 8015137 - DNA, 22 bp, Homo sapiens
tggtgtgggcagcagcaggtac

SEQ ID NO: 8015138 - DNA, 22 bp, Homo sapiens
tggtgtgggcagcagcaggtac

SEQ ID NO: 8015139 - DNA, 22 bp, Homo sapiens
tggtgtgggcgtggcaggcaag

SEQ ID NO: 8015140 - DNA, 22 bp, Homo sapiens
tggtgtgggcgtggcaggcaag

SEQ ID NO: 8015141 - DNA, 22 bp, Homo sapiens
tggtgtgggcgtggcaggcaag

SEQ ID NO: 8015142 - DNA, 22 bp, Homo sapiens
tggttaagtccagaaaggaagc

SEQ ID NO: 8015143 - DNA, 22 bp, Homo sapiens
tggttacacaagtgtgtgcagt

SEQ ID NO: 8015144 - DNA, 22 bp, Homo sapiens
tggttcctcagggcagctgtac

SEQ ID NO: 8015145 - DNA, 22 bp, Homo sapiens
tggttcctcaagcgctggcggc

SEQ ID NO: 8015146 - DNA, 22 bp, Homo sapiens
tggttaaatgggaagagcaaca

SEQ ID NO: 8015147 - DNA, 22 bp, Homo sapiens
tggttaagtccagaaaggaagc

SEQ ID NO: 8015148 - DNA, 22 bp, Homo sapiens
tggttaagtccagaaaggaagc

SEQ ID NO: 8015149 - DNA, 22 bp, Homo sapiens
tggttcctggttcacttggcag

SEQ ID NO: 8015150 - DNA, 22 bp, Homo sapiens
tggttccttctgcattttcagc

SEQ ID NO: 8015151 - DNA, 18 bp, Homo sapiens
tggttccttgaaggggca

SEQ ID NO: 8015152 - DNA, 19 bp, Homo sapiens
tggttgtgcacgggttggt

SEQ ID NO: 8015153 - DNA, 22 bp, Homo sapiens
tggttgtggtcctccacatcgc

SEQ ID NO: 8015154 - DNA, 22 bp, Homo sapiens
tggttgtggtcctccacatcgc

SEQ ID NO: 8015155 - DNA, 22 bp, Homo sapiens
tggttggctgagcagagtcact

SEQ ID NO: 8015156 - DNA, 22 bp, Homo sapiens
tggttgtgagcgatggatggag

SEQ ID NO: 8015157 - DNA, 22 bp, Homo sapiens
tggttgaacaagttgggtatat

SEQ ID NO: 8015158 - DNA, 22 bp, Homo sapiens
tggttgaataagatagttttat

SEQ ID NO: 8015159 - DNA, 22 bp, Homo sapiens
tggttctgctcaagccagactg

SEQ ID NO: 8015160 - DNA, 22 bp, Homo sapiens
tggtttctcagactctttgcag

SEQ ID NO: 8015161 - DNA, 22 bp, Homo sapiens
tggtttctctgaactctacgac

SEQ ID NO: 8015162 - DNA, 22 bp, Homo sapiens
tggtttcagtgccaatacagta

SEQ ID NO: 8015163 - DNA, 22 bp, Homo sapiens
tggtttctgccctcagagctca

SEQ ID NO: 8015164 - DNA, 22 bp, Homo sapiens
tggtttctgggtttgtctagga

SEQ ID NO: 8015165 - DNA, 18 bp, Homo sapiens
tggtttctggaggaataa

SEQ ID NO: 8015166 - DNA, 22 bp, Homo sapiens
tggtttctgggtttgtctagga

SEQ ID NO: 8015167 - DNA, 22 bp, Homo sapiens
tggtttatgctgttgcagctct

SEQ ID NO: 8015168 - DNA, 21 bp, Homo sapiens
tggtttatgtgcttagggtct

SEQ ID NO: 8015169 - DNA, 23 bp, Homo sapiens
tggtttatgatatgtatgggaat

SEQ ID NO: 8015170 - DNA, 22 bp, Homo sapiens
tggtttatatcttgattctagt

SEQ ID NO: 8015171 - DNA, 22 bp, Homo sapiens
tggtttatttctctgaaaggtt

SEQ ID NO: 8015172 - DNA, 22 bp, Homo sapiens
tggtttcacggagtgccttgct

SEQ ID NO: 8015173 - DNA, 21 bp, Homo sapiens
tggtttatttcactcagcata

SEQ ID NO: 8015174 - DNA, 21 bp, Homo sapiens
tggtttatttcactcagcata

SEQ ID NO: 8015175 - DNA, 22 bp, Homo sapiens
tggtttaatttccatttccttg

SEQ ID NO: 8015176 - DNA, 22 bp, Homo sapiens
tggtttataacatgtctcatga

SEQ ID NO: 8015177 - DNA, 22 bp, Homo sapiens
tggtttaatttccatttccttg

SEQ ID NO: 8015178 - DNA, 22 bp, Homo sapiens
tggtttaacctgtctcttatta

SEQ ID NO: 8015179 - DNA, 22 bp, Homo sapiens
tggttgtgtcacttagattaga

SEQ ID NO: 8015180 - DNA, 18 bp, Homo sapiens
tgtaaacactttcattct

SEQ ID NO: 8015181 - DNA, 18 bp, Homo sapiens
tgtaaacactttcattct

SEQ ID NO: 8015182 - DNA, 22 bp, Homo sapiens
tgtaaacaaatgcattcttgct

SEQ ID NO: 8015183 - DNA, 22 bp, Homo sapiens
tgtaaacaaatgcattcttgct

SEQ ID NO: 8015184 - DNA, 18 bp, Homo sapiens
tgtaaacactttcattct

SEQ ID NO: 8015185 - DNA, 22 bp, Homo sapiens
tgtaaacagccccatggagagc

SEQ ID NO: 8015186 - DNA, 22 bp, Homo sapiens
tgtaaacagccccatggagagc

SEQ ID NO: 8015187 - DNA, 22 bp, Homo sapiens
tgtaaagcatctctgtcatata

SEQ ID NO: 8015188 - DNA, 22 bp, Homo sapiens
tgtaaagcatttcctaaatcca

SEQ ID NO: 8015189 - DNA, 22 bp, Homo sapiens
tgtaaagcatttcctaaatcca

SEQ ID NO: 8015190 - DNA, 22 bp, Homo sapiens
tgtaaagatccttagcaacatc

SEQ ID NO: 8015191 - DNA, 22 bp, Homo sapiens
tgtaaagatccttagcaacatc

SEQ ID NO: 8015192 - DNA, 22 bp, Homo sapiens
tgtaaagagaatggtatatgga

SEQ ID NO: 8015193 - DNA, 22 bp, Homo sapiens
tgtaaagtattcccaaccaggg

SEQ ID NO: 8015194 - DNA, 22 bp, Homo sapiens
tgtaaagtatctgtgagctctc

SEQ ID NO: 8015195 - DNA, 22 bp, Homo sapiens
tgtaaagtccaagatcaaagag

SEQ ID NO: 8015196 - DNA, 22 bp, Homo sapiens
tgtaaagctttgagtgtttatc

SEQ ID NO: 8015197 - DNA, 22 bp, Homo sapiens
tgtaaagggtgttaaattactc

SEQ ID NO: 8015198 - DNA, 22 bp, Homo sapiens
tgtaaaggtaggtgcaaaatga

SEQ ID NO: 8015199 - DNA, 22 bp, Homo sapiens
tgtaaagggtgttaaattactc

SEQ ID NO: 8015200 - DNA, 22 bp, Homo sapiens
tgtaaatgaagtatgctttact

SEQ ID NO: 8015201 - DNA, 22 bp, Homo sapiens
tgtaaatgaagtatgctttact

SEQ ID NO: 8015202 - DNA, 22 bp, Homo sapiens
tgtaaatgaagtatgctttact

SEQ ID NO: 8015203 - DNA, 22 bp, Homo sapiens
tgtaaatggtcagataaaccta

SEQ ID NO: 8015204 - DNA, 22 bp, Homo sapiens
tgtaaatgtgaatttccttttc

SEQ ID NO: 8015205 - DNA, 22 bp, Homo sapiens
tgtaaatcactgaactaaatga

SEQ ID NO: 8015206 - DNA, 20 bp, Homo sapiens
tgtaaataggcattgtagtt

SEQ ID NO: 8015207 - DNA, 22 bp, Homo sapiens
tgtaaatcactgaactaaatga

SEQ ID NO: 8015208 - DNA, 22 bp, Homo sapiens
tgtaaatgaagtatgctttact

SEQ ID NO: 8015209 - DNA, 20 bp, Homo sapiens
tgtaaataggcattgtagtt

SEQ ID NO: 8015210 - DNA, 22 bp, Homo sapiens
tgtaaataatgcatgtaaatca

SEQ ID NO: 8015211 - DNA, 20 bp, Homo sapiens
tgtaaataggcattgtagtt

SEQ ID NO: 8015212 - DNA, 20 bp, Homo sapiens
tgtaaataggcattgtagtt

SEQ ID NO: 8015213 - DNA, 22 bp, Homo sapiens
tgtaaataatgcatgtaaatca

SEQ ID NO: 8015214 - DNA, 22 bp, Homo sapiens
tgtaaataatgcatgtaaatca

SEQ ID NO: 8015215 - DNA, 22 bp, Homo sapiens
tgtaaagtgaggataagaacag

SEQ ID NO: 8015216 - DNA, 22 bp, Homo sapiens
tgtaaagttacttttgaaagga

SEQ ID NO: 8015217 - DNA, 22 bp, Homo sapiens
tgtaaataatgcatgtaaatca

SEQ ID NO: 8015218 - DNA, 22 bp, Homo sapiens
tgtaaataatgcatgtaaatca

SEQ ID NO: 8015219 - DNA, 22 bp, Homo sapiens
tgtaaataatgcatgtaaatca

SEQ ID NO: 8015220 - DNA, 22 bp, Homo sapiens
tgtaaataatgcatgtaaatca

SEQ ID NO: 8015221 - DNA, 22 bp, Homo sapiens
tgtaaaataattctccatgttt

SEQ ID NO: 8015222 - DNA, 22 bp, Homo sapiens
tgtaaaataattctccatgttt

SEQ ID NO: 8015223 - DNA, 22 bp, Homo sapiens
tgtaaaataattctccatgttt

SEQ ID NO: 8015224 - DNA, 23 bp, Homo sapiens
tgtaaaatggggtagtgttacca

SEQ ID NO: 8015225 - DNA, 23 bp, Homo sapiens
tgtaaaatggggtagtgttacca

SEQ ID NO: 8015226 - DNA, 23 bp, Homo sapiens
tgtaaaatggggtagtgttacca

SEQ ID NO: 8015227 - DNA, 22 bp, Homo sapiens
tgtaaaataccattccttgtca

SEQ ID NO: 8015228 - DNA, 22 bp, Homo sapiens
tgtaaaataccattccttgtca

SEQ ID NO: 8015229 - DNA, 22 bp, Homo sapiens
tgtaaaataccattccttgtca

SEQ ID NO: 8015230 - DNA, 23 bp, Homo sapiens
tgtaaaagcatttgtcagcctgg

SEQ ID NO: 8015231 - DNA, 22 bp, Homo sapiens
tgtaaaaccaaatcaatctagt

SEQ ID NO: 8015232 - DNA, 22 bp, Homo sapiens
tgtaaaaccaaatcaatctagt

SEQ ID NO: 8015233 - DNA, 22 bp, Homo sapiens
tgtaaaacaaaatttgtggaga

SEQ ID NO: 8015234 - DNA, 22 bp, Homo sapiens
tgtaaaaagcccagccgctgag

SEQ ID NO: 8015235 - DNA, 22 bp, Homo sapiens
tggtttttggtttaacactatg

SEQ ID NO: 8015236 - DNA, 22 bp, Homo sapiens
tggtttttggtgttcacagagg

SEQ ID NO: 8015237 - DNA, 22 bp, Homo sapiens
tggttttttgttccctactctg

SEQ ID NO: 8015238 - DNA, 22 bp, Homo sapiens
tggttttaaaaacatgctgcat

SEQ ID NO: 8015239 - DNA, 18 bp, Homo sapiens
tggtttgtcatgagaatt

SEQ ID NO: 8015240 - DNA, 22 bp, Homo sapiens
tggtttctttccactctccacc

SEQ ID NO: 8015241 - DNA, 22 bp, Homo sapiens
tggtttgagagtgtgagctttt

SEQ ID NO: 8015242 - DNA, 22 bp, Homo sapiens
tggtttgtatatgtttgtgaga

SEQ ID NO: 8015243 - DNA, 22 bp, Homo sapiens
tggtttgggtagttattattat

SEQ ID NO: 8015244 - DNA, 22 bp, Homo sapiens
tggtttgggcgctggagcaagg

SEQ ID NO: 8015245 - DNA, 22 bp, Homo sapiens
tggttttgctccagtataaata

SEQ ID NO: 8015246 - DNA, 22 bp, Homo sapiens
tggttttgctaaaatagaaaga

SEQ ID NO: 8015247 - DNA, 22 bp, Homo sapiens
tggtttttggtgttcacagagg

SEQ ID NO: 8015248 - DNA, 17 bp, Homo sapiens
tggttttgtttaaaggc

SEQ ID NO: 8015249 - DNA, 22 bp, Homo sapiens
tgtaaattgaaggaaatttgtg

SEQ ID NO: 8015250 - DNA, 22 bp, Homo sapiens
tgtaaattggaaatcaatcaag

SEQ ID NO: 8015251 - DNA, 22 bp, Homo sapiens
tgtaaattctatacacttaaaa

SEQ ID NO: 8015252 - DNA, 22 bp, Homo sapiens
tgtaaattgaaggaaatttgtg

SEQ ID NO: 8015253 - DNA, 22 bp, Homo sapiens
tgtaaattgaaggaaatttgtg

SEQ ID NO: 8015254 - DNA, 23 bp, Homo sapiens
tgtaaattttgtagtcacatttt

SEQ ID NO: 8015255 - DNA, 22 bp, Homo sapiens
tgtaacaaaataccttggattg

SEQ ID NO: 8015256 - DNA, 23 bp, Homo sapiens
tgtaaattttgtagtcacatttt

SEQ ID NO: 8015257 - DNA, 22 bp, Homo sapiens
tgtaacaaaataccttggattg

SEQ ID NO: 8015258 - DNA, 21 bp, Homo sapiens
tgtaacaaaatactgcagatt

SEQ ID NO: 8015259 - DNA, 23 bp, Homo sapiens
tgtaacaattcccagcctttgcc

SEQ ID NO: 8015260 - DNA, 22 bp, Homo sapiens
tgtaacaatgaatatagtgact

SEQ ID NO: 8015261 - DNA, 22 bp, Homo sapiens
tgtaacaagtgcttactttggg

SEQ ID NO: 8015262 - DNA, 22 bp, Homo sapiens
tgtaacaatgaatatagtgact

SEQ ID NO: 8015263 - DNA, 22 bp, Homo sapiens
tgtaacaacatttgatttttag

SEQ ID NO: 8015264 - DNA, 17 bp, Homo sapiens
tgtaacaactcctatta

SEQ ID NO: 8015265 - DNA, 22 bp, Homo sapiens
tgtaacaaatacccttgaagtt

SEQ ID NO: 8015266 - DNA, 22 bp, Homo sapiens
tgtaactaagcacattatctaa

SEQ ID NO: 8015267 - DNA, 22 bp, Homo sapiens
tgtaactaagcacattatctaa

SEQ ID NO: 8015268 - DNA, 22 bp, Homo sapiens
tgtaacatcactaccatgtggt

SEQ ID NO: 8015269 - DNA, 22 bp, Homo sapiens
tgtaacatcacagtgatgtttg

SEQ ID NO: 8015270 - DNA, 22 bp, Homo sapiens
tgtaacatatgtaaaagcacct

SEQ ID NO: 8015271 - DNA, 22 bp, Homo sapiens
tgtaacatatagcatgttcttg

SEQ ID NO: 8015272 - DNA, 22 bp, Homo sapiens
tgtaacagtaagcctgtgagct

SEQ ID NO: 8015273 - DNA, 22 bp, Homo sapiens
tgtaacactcaatctgtttaac

SEQ ID NO: 8015274 - DNA, 23 bp, Homo sapiens
tgtaacagagcactgattgacaa

SEQ ID NO: 8015275 - DNA, 22 bp, Homo sapiens
tgtaacagttataacaatgtgg

SEQ ID NO: 8015276 - DNA, 22 bp, Homo sapiens
tgtaacatatagcatgttcttg

SEQ ID NO: 8015277 - DNA, 22 bp, Homo sapiens
tgtaacagtagttactattctt

SEQ ID NO: 8015278 - DNA, 22 bp, Homo sapiens
tgtaacactcaatctgtttaac

SEQ ID NO: 8015279 - DNA, 22 bp, Homo sapiens
tgtaacaatttcttactattgt

SEQ ID NO: 8015280 - DNA, 22 bp, Homo sapiens
tgtaacaatttcttactattgt

SEQ ID NO: 8015281 - DNA, 22 bp, Homo sapiens
tgtaacaatttcttactattgt

SEQ ID NO: 8015282 - DNA, 22 bp, Homo sapiens
tgtaacaatttcttactattgt

SEQ ID NO: 8015283 - DNA, 23 bp, Homo sapiens
tgtaacaatttcatatacatgca

SEQ ID NO: 8015284 - DNA, 23 bp, Homo sapiens
tgtaacaatttcatatacatgca

SEQ ID NO: 8015285 - DNA, 23 bp, Homo sapiens
tgtaacaatttcatatacatgca

SEQ ID NO: 8015286 - DNA, 22 bp, Homo sapiens
tgtaacaatgaatatagtgact

SEQ ID NO: 8015287 - DNA, 23 bp, Homo sapiens
tgtaacaatttcatatacatgca

SEQ ID NO: 8015288 - DNA, 23 bp, Homo sapiens
tgtaacaatttcatatacatgca

SEQ ID NO: 8015289 - DNA, 23 bp, Homo sapiens
tgtaacaatttcatatacatgca

SEQ ID NO: 8015290 - DNA, 23 bp, Homo sapiens
tgtaacaatttcatatacatgca

SEQ ID NO: 8015291 - DNA, 22 bp, Homo sapiens
tgtaattttctcaagtttctac

SEQ ID NO: 8015292 - DNA, 22 bp, Homo sapiens
tgtacaaaacaagatgggggta

SEQ ID NO: 8015293 - DNA, 22 bp, Homo sapiens
tgtaattttctcaagtttctac

SEQ ID NO: 8015294 - DNA, 22 bp, Homo sapiens
tgtacaaagagtatagctttga

SEQ ID NO: 8015295 - DNA, 22 bp, Homo sapiens
tgtacaaaacaagatgggggta

SEQ ID NO: 8015296 - DNA, 22 bp, Homo sapiens
tgtacaaagagtatagctttga

SEQ ID NO: 8015297 - DNA, 22 bp, Homo sapiens
tgtacaaagagtatagctttga

SEQ ID NO: 8015298 - DNA, 22 bp, Homo sapiens
tgtacaaagagtatagctttga

SEQ ID NO: 8015299 - DNA, 22 bp, Homo sapiens
tgtacaaagagtatagctttga

SEQ ID NO: 8015300 - DNA, 22 bp, Homo sapiens
tgtacaaagagtatagctttga

SEQ ID NO: 8015301 - DNA, 22 bp, Homo sapiens
tgtacaaagagtatagctttga

SEQ ID NO: 8015302 - DNA, 22 bp, Homo sapiens
tgtaattttacgtgacacagtt

SEQ ID NO: 8015303 - DNA, 22 bp, Homo sapiens
tgtaattttacgtgacacagtt

SEQ ID NO: 8015304 - DNA, 22 bp, Homo sapiens
tgtaagtagaacaacataatct

SEQ ID NO: 8015305 - DNA, 22 bp, Homo sapiens
tgtacaaagccagaactcccaa

SEQ ID NO: 8015306 - DNA, 22 bp, Homo sapiens
tgtacaaagccagaactcccaa

SEQ ID NO: 8015307 - DNA, 22 bp, Homo sapiens
tgtacaaaggtactttgatgtt

SEQ ID NO: 8015308 - DNA, 22 bp, Homo sapiens
tgtacaaaggtactttgatgtt

SEQ ID NO: 8015309 - DNA, 22 bp, Homo sapiens
tgtacaaaggtactttgatgtt

SEQ ID NO: 8015310 - DNA, 22 bp, Homo sapiens
tgtacaaagccagaactcccaa

SEQ ID NO: 8015311 - DNA, 22 bp, Homo sapiens
tgtacaaagccagaactcccaa

SEQ ID NO: 8015312 - DNA, 22 bp, Homo sapiens
tgtaaggcacttggtctaatac

SEQ ID NO: 8015313 - DNA, 22 bp, Homo sapiens
tgtacaaagagtatagctttga

SEQ ID NO: 8015314 - DNA, 22 bp, Homo sapiens
tgtacaaagccagaactcccaa

SEQ ID NO: 8015315 - DNA, 22 bp, Homo sapiens
tgtacaaaggtactttgatgtt

SEQ ID NO: 8015316 - DNA, 22 bp, Homo sapiens
tgtacaaagttaaacctatata

SEQ ID NO: 8015317 - DNA, 22 bp, Homo sapiens
tgtacaaagttaaacctatata

SEQ ID NO: 8015318 - DNA, 22 bp, Homo sapiens
tgtacaaagttaaacctatata

SEQ ID NO: 8015319 - DNA, 22 bp, Homo sapiens
tgtacaaagttaaacctatata

SEQ ID NO: 8015320 - DNA, 22 bp, Homo sapiens
tgtacaaagttaaacctatata

SEQ ID NO: 8015321 - DNA, 22 bp, Homo sapiens
tgtaagaataatgatttctaag

SEQ ID NO: 8015322 - DNA, 20 bp, Homo sapiens
tgtaagaagtaggagggtta

SEQ ID NO: 8015323 - DNA, 22 bp, Homo sapiens
tgtaagatttgctatgtgttgt

SEQ ID NO: 8015324 - DNA, 22 bp, Homo sapiens
tgtaagcttcaaatatctgtga

SEQ ID NO: 8015325 - DNA, 22 bp, Homo sapiens
tgtaagatgctgggatagatga

SEQ ID NO: 8015326 - DNA, 22 bp, Homo sapiens
tgtaagatatgagtacatgtaa

SEQ ID NO: 8015327 - DNA, 22 bp, Homo sapiens
tgtaagacatatcttagtgatg

SEQ ID NO: 8015328 - DNA, 22 bp, Homo sapiens
tgtaagatatgagtacatgtaa

SEQ ID NO: 8015329 - DNA, 22 bp, Homo sapiens
tgtaagatattcagcttattga

SEQ ID NO: 8015330 - DNA, 22 bp, Homo sapiens
tgtaagaaaagtaaatagtgac

SEQ ID NO: 8015331 - DNA, 22 bp, Homo sapiens
tgtaagaacaactgtcaaatgt

SEQ ID NO: 8015332 - DNA, 23 bp, Homo sapiens
tgtaacttcttaaattcttcact

SEQ ID NO: 8015333 - DNA, 22 bp, Homo sapiens
tgtaagaaaacctgtacaaaga

SEQ ID NO: 8015334 - DNA, 22 bp, Homo sapiens
tgtaactataaaattaattgct

SEQ ID NO: 8015335 - DNA, 22 bp, Homo sapiens
tgtaactataaaattaattgct

SEQ ID NO: 8015336 - DNA, 22 bp, Homo sapiens
tgtaactgtggtctagggactg

SEQ ID NO: 8015337 - DNA, 22 bp, Homo sapiens
tgtaactggttataatttttga

SEQ ID NO: 8015338 - DNA, 23 bp, Homo sapiens
tgtaacttcttaaattcttcact

SEQ ID NO: 8015339 - DNA, 23 bp, Homo sapiens
tgtaacttcttaaattcttcact

SEQ ID NO: 8015340 - DNA, 22 bp, Homo sapiens
tgtaagaaaacctgtacaaaga

SEQ ID NO: 8015341 - DNA, 19 bp, Homo sapiens
tgtacaaggattatgcagg

SEQ ID NO: 8015342 - DNA, 19 bp, Homo sapiens
tgtacaaggattatgcagg

SEQ ID NO: 8015343 - DNA, 22 bp, Homo sapiens
tgtacaagcaaatagaccttca

SEQ ID NO: 8015344 - DNA, 22 bp, Homo sapiens
tgtacaagcaaatagaccttca

SEQ ID NO: 8015345 - DNA, 22 bp, Homo sapiens
tgtacaaattcattgaactgta

SEQ ID NO: 8015346 - DNA, 22 bp, Homo sapiens
tgtacaagaataattttatata

SEQ ID NO: 8015347 - DNA, 22 bp, Homo sapiens
tgtacaagaataattttatata

SEQ ID NO: 8015348 - DNA, 22 bp, Homo sapiens
tgtacaagaataattttatata

SEQ ID NO: 8015349 - DNA, 17 bp, Homo sapiens
tgtacaacagtaccttc

SEQ ID NO: 8015350 - DNA, 22 bp, Homo sapiens
tgtacaaattcattgaactgta

SEQ ID NO: 8015351 - DNA, 22 bp, Homo sapiens
tgtacaaattcattgaactgta

SEQ ID NO: 8015352 - DNA, 22 bp, Homo sapiens
tgtacaaattcattgaactgta

SEQ ID NO: 8015353 - DNA, 22 bp, Homo sapiens
tgtacaaattcattgaactgta

SEQ ID NO: 8015354 - DNA, 22 bp, Homo sapiens
tgtacaaattcagttctagggt

SEQ ID NO: 8015355 - DNA, 22 bp, Homo sapiens
tgtacaaattcagttctagggt

SEQ ID NO: 8015356 - DNA, 22 bp, Homo sapiens
tgtacaaattcagttctagggt

SEQ ID NO: 8015357 - DNA, 22 bp, Homo sapiens
tgtacaaattcagttctagggt

SEQ ID NO: 8015358 - DNA, 22 bp, Homo sapiens
tgtacaaattcagttctagggt

SEQ ID NO: 8015359 - DNA, 22 bp, Homo sapiens
tgtacaatctgatgatgtatgg

SEQ ID NO: 8015360 - DNA, 22 bp, Homo sapiens
tgtacaatctgatgatgtatgg

SEQ ID NO: 8015361 - DNA, 22 bp, Homo sapiens
tgtacaatctgatgatgtatgg

SEQ ID NO: 8015362 - DNA, 22 bp, Homo sapiens
tgtacaagttgcctgctatctc

SEQ ID NO: 8015363 - DNA, 22 bp, Homo sapiens
tgtacaagttgcctgctatctc

SEQ ID NO: 8015364 - DNA, 22 bp, Homo sapiens
tgtacaatagctattatctcca

SEQ ID NO: 8015365 - DNA, 22 bp, Homo sapiens
tgtacaaggccatctacatgct

SEQ ID NO: 8015366 - DNA, 22 bp, Homo sapiens
tgtacaaggccatctacatgct

SEQ ID NO: 8015367 - DNA, 22 bp, Homo sapiens
tgtacacaacctacagtctgct

SEQ ID NO: 8015368 - DNA, 22 bp, Homo sapiens
tgtacacaacctacagtctgct

SEQ ID NO: 8015369 - DNA, 22 bp, Homo sapiens
tgtacacaacctacagtctgct

SEQ ID NO: 8015370 - DNA, 22 bp, Homo sapiens
tgtacacaatgataaattatta

SEQ ID NO: 8015371 - DNA, 22 bp, Homo sapiens
tgtacacaacgtgcaggtttgt

SEQ ID NO: 8015372 - DNA, 22 bp, Homo sapiens
tgtacacaacgtgcaggtttgt

SEQ ID NO: 8015373 - DNA, 22 bp, Homo sapiens
tgtacacaatgataaattatta

SEQ ID NO: 8015374 - DNA, 22 bp, Homo sapiens
tgtacacaacgtgcaggtttgt

SEQ ID NO: 8015375 - DNA, 22 bp, Homo sapiens
tgtacacaatgataaattatta

SEQ ID NO: 8015376 - DNA, 22 bp, Homo sapiens
tgtacacaatgataaattatta

SEQ ID NO: 8015377 - DNA, 22 bp, Homo sapiens
tgtacaatgccgagactaactc

SEQ ID NO: 8015378 - DNA, 22 bp, Homo sapiens
tgtacaatgccgagactaactc

SEQ ID NO: 8015379 - DNA, 22 bp, Homo sapiens
tgtacaatggctataataccct

SEQ ID NO: 8015380 - DNA, 22 bp, Homo sapiens
tgtacaatggctataataccct

SEQ ID NO: 8015381 - DNA, 22 bp, Homo sapiens
tgtacaatgtggccagtgttaa

SEQ ID NO: 8015382 - DNA, 22 bp, Homo sapiens
tgtacaatgtggccagtgttaa

SEQ ID NO: 8015383 - DNA, 20 bp, Homo sapiens
tgtacacagtactttacaat

SEQ ID NO: 8015384 - DNA, 20 bp, Homo sapiens
tgtacacagtactttacaat

SEQ ID NO: 8015385 - DNA, 20 bp, Homo sapiens
tgtacacagtactttacaat

SEQ ID NO: 8015386 - DNA, 20 bp, Homo sapiens
tgtacacagtactttacaat

SEQ ID NO: 8015387 - DNA, 22 bp, Homo sapiens
tgtacacacacgtgtgtatcta

SEQ ID NO: 8015388 - DNA, 22 bp, Homo sapiens
tgtacacacacgtgtgtatcta

SEQ ID NO: 8015389 - DNA, 22 bp, Homo sapiens
tgtacacagtatgaggcatctt

SEQ ID NO: 8015390 - DNA, 20 bp, Homo sapiens
tgtacacagtactttacaat

SEQ ID NO: 8015391 - DNA, 22 bp, Homo sapiens
tgtacacagtatgaggcatctt

SEQ ID NO: 8015392 - DNA, 22 bp, Homo sapiens
tgtacacatatcatttgtggga

SEQ ID NO: 8015393 - DNA, 22 bp, Homo sapiens
tgtacacaattcttaacataca

SEQ ID NO: 8015394 - DNA, 22 bp, Homo sapiens
tgtacacaatgtgcaggtttgt

SEQ ID NO: 8015395 - DNA, 22 bp, Homo sapiens
tgtacacaatgtgcaggtttgt

SEQ ID NO: 8015396 - DNA, 22 bp, Homo sapiens
tgtacacaatgtgcaggtttgt

SEQ ID NO: 8015397 - DNA, 22 bp, Homo sapiens
tgtacacaattcttaacataca

SEQ ID NO: 8015398 - DNA, 22 bp, Homo sapiens
tgtacacaattcttaacataca

SEQ ID NO: 8015399 - DNA, 22 bp, Homo sapiens
tgtacacaattcttaacataca

SEQ ID NO: 8015400 - DNA, 22 bp, Homo sapiens
tgtacacaattcttaacataca

SEQ ID NO: 8015401 - DNA, 22 bp, Homo sapiens
tgtacacaattcttaacataca

SEQ ID NO: 8015402 - DNA, 22 bp, Homo sapiens
tgtacagaggtgtacatatgat

SEQ ID NO: 8015403 - DNA, 22 bp, Homo sapiens
tgtacagaggtgtacatatgat

SEQ ID NO: 8015404 - DNA, 22 bp, Homo sapiens
tgtacagaggtgtacatatgat

SEQ ID NO: 8015405 - DNA, 22 bp, Homo sapiens
tgtacagactttgcagtgtgca

SEQ ID NO: 8015406 - DNA, 22 bp, Homo sapiens
tgtacagagactaccattaata

SEQ ID NO: 8015407 - DNA, 22 bp, Homo sapiens
tgtacagagactaccattaata

SEQ ID NO: 8015408 - DNA, 22 bp, Homo sapiens
tgtacagagactaccattaata

SEQ ID NO: 8015409 - DNA, 22 bp, Homo sapiens
tgtacagactgtatttacaagt

SEQ ID NO: 8015410 - DNA, 22 bp, Homo sapiens
tgtacagaaattcctactacat

SEQ ID NO: 8015411 - DNA, 22 bp, Homo sapiens
tgtacactgcaggatgcattgc

SEQ ID NO: 8015412 - DNA, 22 bp, Homo sapiens
tgtacactgcaggatgcattgc

SEQ ID NO: 8015413 - DNA, 23 bp, Homo sapiens
tgtacacttggtcaaggtactta

SEQ ID NO: 8015414 - DNA, 22 bp, Homo sapiens
tgtacacatggtgtacactccc

SEQ ID NO: 8015415 - DNA, 22 bp, Homo sapiens
tgtacacatggtgtacactccc

SEQ ID NO: 8015416 - DNA, 22 bp, Homo sapiens
tgtacacatggtgtacactccc

SEQ ID NO: 8015417 - DNA, 22 bp, Homo sapiens
tgtacacatggtgtacactccc

SEQ ID NO: 8015418 - DNA, 22 bp, Homo sapiens
tgtacacatgcccacttgaagc

SEQ ID NO: 8015419 - DNA, 22 bp, Homo sapiens
tgtacacataccactgagtgaa

SEQ ID NO: 8015420 - DNA, 22 bp, Homo sapiens
tgtacacatgcccacttgaagc

SEQ ID NO: 8015421 - DNA, 22 bp, Homo sapiens
tgtacacatgcccacttgaagc

SEQ ID NO: 8015422 - DNA, 22 bp, Homo sapiens
tgtacacatgcccacttgaagc

SEQ ID NO: 8015423 - DNA, 22 bp, Homo sapiens
tgtacacattaagctctttaga

SEQ ID NO: 8015424 - DNA, 22 bp, Homo sapiens
tgtacacattaagctctttaga

SEQ ID NO: 8015425 - DNA, 22 bp, Homo sapiens
tgtacacattaagctctttaga

SEQ ID NO: 8015426 - DNA, 22 bp, Homo sapiens
tgtacacatttattctctctca

SEQ ID NO: 8015427 - DNA, 22 bp, Homo sapiens
tgtacacatttttatgttaaca

SEQ ID NO: 8015428 - DNA, 22 bp, Homo sapiens
tgtacacatttttatgttaaca

SEQ ID NO: 8015429 - DNA, 22 bp, Homo sapiens
tgtacacatttttatgttaaca

SEQ ID NO: 8015430 - DNA, 22 bp, Homo sapiens
tgtacacctgtctttacacata

SEQ ID NO: 8015431 - DNA, 22 bp, Homo sapiens
tgtacacgtggccatctttaca

SEQ ID NO: 8015432 - DNA, 22 bp, Homo sapiens
tgtacagctgccttttttactt

SEQ ID NO: 8015433 - DNA, 22 bp, Homo sapiens
tgtacaggagaacaatgagaaa

SEQ ID NO: 8015434 - DNA, 22 bp, Homo sapiens
tgtacaggagaacaatgagaaa

SEQ ID NO: 8015435 - DNA, 22 bp, Homo sapiens
tgtacaggaggccacattggaa

SEQ ID NO: 8015436 - DNA, 22 bp, Homo sapiens
tgtacaggagaacaatgagaaa

SEQ ID NO: 8015437 - DNA, 22 bp, Homo sapiens
tgtacagtaggaacttgttatt

SEQ ID NO: 8015438 - DNA, 22 bp, Homo sapiens
tgtacagtatatttcaaagcca

SEQ ID NO: 8015439 - DNA, 22 bp, Homo sapiens
tgtacagattgatcatggagag

SEQ ID NO: 8015440 - DNA, 22 bp, Homo sapiens
tgtacagataaagactgtaaat

SEQ ID NO: 8015441 - DNA, 22 bp, Homo sapiens
tgtacagataaagactgtaaat

SEQ ID NO: 8015442 - DNA, 22 bp, Homo sapiens
tgtacagataaagactgtaaat

SEQ ID NO: 8015443 - DNA, 22 bp, Homo sapiens
tgtaccagtgttgagaatgaga

SEQ ID NO: 8015444 - DNA, 22 bp, Homo sapiens
tgtaccagtgttgagaatgaga

SEQ ID NO: 8015445 - DNA, 22 bp, Homo sapiens
tgtaccatgcgacgcctctcac

SEQ ID NO: 8015446 - DNA, 22 bp, Homo sapiens
tgtaccgcaaatgctgctgcct

SEQ ID NO: 8015447 - DNA, 22 bp, Homo sapiens
tgtaccgcaaatgctgctgcct

SEQ ID NO: 8015448 - DNA, 22 bp, Homo sapiens
tgtaccttaggtgccttgcttg

SEQ ID NO: 8015449 - DNA, 22 bp, Homo sapiens
tgtaccaggtgatggagtcata

SEQ ID NO: 8015450 - DNA, 22 bp, Homo sapiens
tgtaccaggccctgtggacatg

SEQ ID NO: 8015451 - DNA, 22 bp, Homo sapiens
tgtaccaggccctgtggacatg

SEQ ID NO: 8015452 - DNA, 22 bp, Homo sapiens
tgtacagtgccatgcagtttgc

SEQ ID NO: 8015453 - DNA, 23 bp, Homo sapiens
tgtaccaggagtttcagcagact

SEQ ID NO: 8015454 - DNA, 22 bp, Homo sapiens
tgtacagtcatgctttctgttc

SEQ ID NO: 8015455 - DNA, 22 bp, Homo sapiens
tgtacagtgccatgcagtttgc

SEQ ID NO: 8015456 - DNA, 22 bp, Homo sapiens
tggtcctgccccgtgcacagag

SEQ ID NO: 8015457 - DNA, 22 bp, Homo sapiens
tggtcctgctacaggggattag

SEQ ID NO: 8015458 - DNA, 22 bp, Homo sapiens
tggtcctgcttgctgcttaaga

SEQ ID NO: 8015459 - DNA, 22 bp, Homo sapiens
tggtcctggaaggtcctgaggg

SEQ ID NO: 8015460 - DNA, 22 bp, Homo sapiens
tggtcctgcttgctgcttaaga

SEQ ID NO: 8015461 - DNA, 22 bp, Homo sapiens
tggtcctggaaggtcctgaggg

SEQ ID NO: 8015462 - DNA, 23 bp, Homo sapiens
tggtcctgccaacggtgcccctc

SEQ ID NO: 8015463 - DNA, 22 bp, Homo sapiens
tggtcctgcagtaatagacatc

SEQ ID NO: 8015464 - DNA, 23 bp, Homo sapiens
tggtcctgccaacggtgcccctc

SEQ ID NO: 8015465 - DNA, 22 bp, Homo sapiens
tggtcctgcccacgcccatctg

SEQ ID NO: 8015466 - DNA, 22 bp, Homo sapiens
tggtcctgcccacgcccatctg

SEQ ID NO: 8015467 - DNA, 22 bp, Homo sapiens
tggtcctgccccgtgcacagag

SEQ ID NO: 8015468 - DNA, 22 bp, Homo sapiens
tggtcctgccccgtgcacagag

SEQ ID NO: 8015469 - DNA, 22 bp, Homo sapiens
tggtcctgccccgtgcacagag

SEQ ID NO: 8015470 - DNA, 22 bp, Homo sapiens
tggtcctggccttgaccccagg

SEQ ID NO: 8015471 - DNA, 22 bp, Homo sapiens
tggtcctggagatcaatatgca

SEQ ID NO: 8015472 - DNA, 22 bp, Homo sapiens
tggtcctggccttgaccccagg

SEQ ID NO: 8015473 - DNA, 22 bp, Homo sapiens
tggtcctgggcacagtatatgc

SEQ ID NO: 8015474 - DNA, 22 bp, Homo sapiens
tggtcctgggcacagtatatgc

SEQ ID NO: 8015475 - DNA, 22 bp, Homo sapiens
tggtcctggggatctgcagtga

SEQ ID NO: 8015476 - DNA, 22 bp, Homo sapiens
tggtcctggagagtgttccata

SEQ ID NO: 8015477 - DNA, 22 bp, Homo sapiens
tggtcctggagagtgttccata

SEQ ID NO: 8015478 - DNA, 22 bp, Homo sapiens
tggtcctggagagtgttccata

SEQ ID NO: 8015479 - DNA, 22 bp, Homo sapiens
tggtcctggagagtgttccata

SEQ ID NO: 8015480 - DNA, 22 bp, Homo sapiens
tggtcctggaaggtcctgaggg

SEQ ID NO: 8015481 - DNA, 22 bp, Homo sapiens
tggtcctggaaggtcctgaggg

SEQ ID NO: 8015482 - DNA, 22 bp, Homo sapiens
tggtcctggaaggtcctgaggg

SEQ ID NO: 8015483 - DNA, 22 bp, Homo sapiens
tggtcctggaaggtcctgaggg

SEQ ID NO: 8015484 - DNA, 20 bp, Homo sapiens
tggtcctcacatgccatctt

SEQ ID NO: 8015485 - DNA, 17 bp, Homo sapiens
tggtccaggtggagcca

SEQ ID NO: 8015486 - DNA, 17 bp, Homo sapiens
tggtccaggtggagcca

SEQ ID NO: 8015487 - DNA, 22 bp, Homo sapiens
tggtcctcaggttctctgtgcg

SEQ ID NO: 8015488 - DNA, 20 bp, Homo sapiens
tggtccaggacctggtgtcc

SEQ ID NO: 8015489 - DNA, 22 bp, Homo sapiens
tggtccagcttgattctcttct

SEQ ID NO: 8015490 - DNA, 22 bp, Homo sapiens
tggtccaggcacccttctagag

SEQ ID NO: 8015491 - DNA, 22 bp, Homo sapiens
tggtccagggtgtagtacagag

SEQ ID NO: 8015492 - DNA, 22 bp, Homo sapiens
tggtccagggtgtagtacagag

SEQ ID NO: 8015493 - DNA, 22 bp, Homo sapiens
tggtcctgagcaccagcctgac

SEQ ID NO: 8015494 - DNA, 22 bp, Homo sapiens
tggtcctgagcaccagcctgac

SEQ ID NO: 8015495 - DNA, 22 bp, Homo sapiens
tggtcctgagcaccagcctgac

SEQ ID NO: 8015496 - DNA, 22 bp, Homo sapiens
tggtcctgagaatcctgtcctc

SEQ ID NO: 8015497 - DNA, 22 bp, Homo sapiens
tggtcctgagaatcctgtcctc

SEQ ID NO: 8015498 - DNA, 22 bp, Homo sapiens
tggtcctgagaatcctgtcctc

SEQ ID NO: 8015499 - DNA, 22 bp, Homo sapiens
tggtcctcaggttctctgtgcg

SEQ ID NO: 8015500 - DNA, 22 bp, Homo sapiens
tggtcctgatcaccgctgggca

SEQ ID NO: 8015501 - DNA, 22 bp, Homo sapiens
tggtcctgcagtaatagacatc

SEQ ID NO: 8015502 - DNA, 22 bp, Homo sapiens
tggtcctgatcaccgctgggca

SEQ ID NO: 8015503 - DNA, 22 bp, Homo sapiens
tggtcctgaggcttgtttccac

SEQ ID NO: 8015504 - DNA, 22 bp, Homo sapiens
tggtcatgtagtagagacagct

SEQ ID NO: 8015505 - DNA, 22 bp, Homo sapiens
tggtcagttgcatcagagaagt

SEQ ID NO: 8015506 - DNA, 22 bp, Homo sapiens
tggtcagttgatcaggcagcag

SEQ ID NO: 8015507 - DNA, 22 bp, Homo sapiens
tggtcaggtacctctggctgtc

SEQ ID NO: 8015508 - DNA, 22 bp, Homo sapiens
tggtcaggtacctctggctgtc

SEQ ID NO: 8015509 - DNA, 22 bp, Homo sapiens
tggtcaggtacctctggctgtc

SEQ ID NO: 8015510 - DNA, 21 bp, Homo sapiens
tggtcagtatttcagttacat

SEQ ID NO: 8015511 - DNA, 23 bp, Homo sapiens
tggtcagtgccttgcatgtggga

SEQ ID NO: 8015512 - DNA, 22 bp, Homo sapiens
tggtcagttgagcagaagggaa

SEQ ID NO: 8015513 - DNA, 22 bp, Homo sapiens
tggtcagtgtgacattttttaa

SEQ ID NO: 8015514 - DNA, 22 bp, Homo sapiens
tggtccacagggagtccgtgct

SEQ ID NO: 8015515 - DNA, 22 bp, Homo sapiens
tggtccagaagatattcaacca

SEQ ID NO: 8015516 - DNA, 22 bp, Homo sapiens
tggtccagactttgacctctca

SEQ ID NO: 8015517 - DNA, 22 bp, Homo sapiens
tggtcagaaggaagggctccta

SEQ ID NO: 8015518 - DNA, 22 bp, Homo sapiens
tggtcacttttgccagtggatg

SEQ ID NO: 8015519 - DNA, 22 bp, Homo sapiens
tggtcagaactcagcgtgcttg

SEQ ID NO: 8015520 - DNA, 22 bp, Homo sapiens
tggtcagaactcagcgtgcttg

SEQ ID NO: 8015521 - DNA, 22 bp, Homo sapiens
tggtcacttttgccagtggatg

SEQ ID NO: 8015522 - DNA, 18 bp, Homo sapiens
tggtcactgtggatagtg

SEQ ID NO: 8015523 - DNA, 22 bp, Homo sapiens
tggtcacccactgggactgcgg

SEQ ID NO: 8015524 - DNA, 22 bp, Homo sapiens
tggtcactatatttaaatatct

SEQ ID NO: 8015525 - DNA, 18 bp, Homo sapiens
tggtcactgtggatagtg

SEQ ID NO: 8015526 - DNA, 22 bp, Homo sapiens
tggtcacagtgtattgatcagg

SEQ ID NO: 8015527 - DNA, 22 bp, Homo sapiens
tggtcagacaaaggagaatgtt

SEQ ID NO: 8015528 - DNA, 22 bp, Homo sapiens
tggtcagaaggaagggctccta

SEQ ID NO: 8015529 - DNA, 22 bp, Homo sapiens
tggtcagactaggacactccgg

SEQ ID NO: 8015530 - DNA, 22 bp, Homo sapiens
tggtcagagaagtagggacaat

SEQ ID NO: 8015531 - DNA, 22 bp, Homo sapiens
tggtcagatgctgagtggatct

SEQ ID NO: 8015532 - DNA, 22 bp, Homo sapiens
tggtcagaggaccaaactagtg

SEQ ID NO: 8015533 - DNA, 22 bp, Homo sapiens
tggtcagagcccctttcataga

SEQ ID NO: 8015534 - DNA, 22 bp, Homo sapiens
tggtcagagcccctttcataga

SEQ ID NO: 8015535 - DNA, 22 bp, Homo sapiens
tggtcagagcaactttcctaga

SEQ ID NO: 8015536 - DNA, 22 bp, Homo sapiens
tggtcagaggaccaaactagtg

SEQ ID NO: 8015537 - DNA, 19 bp, Homo sapiens
tggtcagatttcagaagtc

SEQ ID NO: 8015538 - DNA, 19 bp, Homo sapiens
tggtcagatttcagaagtc

SEQ ID NO: 8015539 - DNA, 19 bp, Homo sapiens
tggtcagatttcagaagtc

SEQ ID NO: 8015540 - DNA, 19 bp, Homo sapiens
tggtcagcattaggatttg

SEQ ID NO: 8015541 - DNA, 22 bp, Homo sapiens
tggtcagcgtttgtcagagcag

SEQ ID NO: 8015542 - DNA, 22 bp, Homo sapiens
tggtcaggattctcagcccttc

SEQ ID NO: 8015543 - DNA, 22 bp, Homo sapiens
tggtcagcttcagagtgttcca

SEQ ID NO: 8015544 - DNA, 22 bp, Homo sapiens
tggtcaggattctcagcccttc

SEQ ID NO: 8015545 - DNA, 22 bp, Homo sapiens
tggtcaggctgctctgcggcgt

SEQ ID NO: 8015546 - DNA, 22 bp, Homo sapiens
tggtcagcgtttgtcagagcag

SEQ ID NO: 8015547 - DNA, 22 bp, Homo sapiens
tggtcagcgtttgtcagagcag

SEQ ID NO: 8015548 - DNA, 22 bp, Homo sapiens
tggtcagcttcagagtgttcca

SEQ ID NO: 8015549 - DNA, 22 bp, Homo sapiens
tggtcagcgtttgtcagagcag

SEQ ID NO: 8015550 - DNA, 22 bp, Homo sapiens
tggtcagcgtttgtcagagcag

SEQ ID NO: 8015551 - DNA, 22 bp, Homo sapiens
tggtcaggggcttctgagctgt

SEQ ID NO: 8015552 - DNA, 22 bp, Homo sapiens
tggtcaggggcttctgagctgt

SEQ ID NO: 8015553 - DNA, 22 bp, Homo sapiens
tggtcaggggcttctgagctgt

SEQ ID NO: 8015554 - DNA, 22 bp, Homo sapiens
tggtcaggctgctctgcggcgt

SEQ ID NO: 8015555 - DNA, 22 bp, Homo sapiens
tggtcaggctgctctgcggcgt

SEQ ID NO: 8015556 - DNA, 22 bp, Homo sapiens
tggtcaggctgctctgcggcgt

SEQ ID NO: 8015557 - DNA, 22 bp, Homo sapiens
tggtcaggctgctctgcggcgt

SEQ ID NO: 8015558 - DNA, 22 bp, Homo sapiens
tggtcctgtgttcttcctgcct

SEQ ID NO: 8015559 - DNA, 22 bp, Homo sapiens
tggtcctgtctcaaggagcctt

SEQ ID NO: 8015560 - DNA, 22 bp, Homo sapiens
tggtcctgtctcaaggagcctt

SEQ ID NO: 8015561 - DNA, 22 bp, Homo sapiens
tggtcctgtctcaaggagcctt

SEQ ID NO: 8015562 - DNA, 22 bp, Homo sapiens
tggtcctgtgttcttcctgcct

SEQ ID NO: 8015563 - DNA, 22 bp, Homo sapiens
tggtccttcacagccacactct

SEQ ID NO: 8015564 - DNA, 20 bp, Homo sapiens
tggtcctgtcccacccactc

SEQ ID NO: 8015565 - DNA, 22 bp, Homo sapiens
tggtcctgtagctctctaagtt

SEQ ID NO: 8015566 - DNA, 20 bp, Homo sapiens
tggtcctgtcccacccactc

SEQ ID NO: 8015567 - DNA, 22 bp, Homo sapiens
tggtcctgtagctctctaagtt

SEQ ID NO: 8015568 - DNA, 22 bp, Homo sapiens
tggtcctgtagctctctaagtt

SEQ ID NO: 8015569 - DNA, 22 bp, Homo sapiens
tggtcctgtagcacttgattag

SEQ ID NO: 8015570 - DNA, 23 bp, Homo sapiens
tggtcctggttgaggtgggcccc

SEQ ID NO: 8015571 - DNA, 22 bp, Homo sapiens
tggtcctggggatctgcagtga

SEQ ID NO: 8015572 - DNA, 22 bp, Homo sapiens
tggtcctggggtgcaggctgac

SEQ ID NO: 8015573 - DNA, 22 bp, Homo sapiens
tggtcctggggtgcaggctgac

SEQ ID NO: 8015574 - DNA, 22 bp, Homo sapiens
tggtcctggtagcggtgtgctt

SEQ ID NO: 8015575 - DNA, 22 bp, Homo sapiens
tggtcctggtcatctgggctgg

SEQ ID NO: 8015576 - DNA, 22 bp, Homo sapiens
tggtcctggtcatctgggctgg

SEQ ID NO: 8015577 - DNA, 22 bp, Homo sapiens
tggtcctggtagcggtgtgctt

SEQ ID NO: 8015578 - DNA, 23 bp, Homo sapiens
tggtcctggttgaggtgggcccc

SEQ ID NO: 8015579 - DNA, 22 bp, Homo sapiens
tggtcctggtgcaagtgcattt

SEQ ID NO: 8015580 - DNA, 22 bp, Homo sapiens
tggtcctggtgcaagtgcattt

SEQ ID NO: 8015581 - DNA, 22 bp, Homo sapiens
tggtcctggtgcaagtgcattt

SEQ ID NO: 8015582 - DNA, 22 bp, Homo sapiens
tggtcctggtgcaagtgcattt

SEQ ID NO: 8015583 - DNA, 22 bp, Homo sapiens
tggtctctgcaggccaggctca

SEQ ID NO: 8015584 - DNA, 22 bp, Homo sapiens
tggtctctgagccttcctgtgg

SEQ ID NO: 8015585 - DNA, 22 bp, Homo sapiens
tggtctctgcaggccaggctca

SEQ ID NO: 8015586 - DNA, 22 bp, Homo sapiens
tggtctctctcctgcaacaact

SEQ ID NO: 8015587 - DNA, 22 bp, Homo sapiens
tggtctctctcctgcaacaact

SEQ ID NO: 8015588 - DNA, 22 bp, Homo sapiens
tggtctctctcctgcaacaact

SEQ ID NO: 8015589 - DNA, 22 bp, Homo sapiens
tggtctctgactctgaagaccc

SEQ ID NO: 8015590 - DNA, 22 bp, Homo sapiens
tggtctctgagccttcctgtgg

SEQ ID NO: 8015591 - DNA, 23 bp, Homo sapiens
tggtctcagcctgtgagagctga

SEQ ID NO: 8015592 - DNA, 23 bp, Homo sapiens
tggtctcagcctgtgagagctga

SEQ ID NO: 8015593 - DNA, 22 bp, Homo sapiens
tggtctcaggagagtctcttca

SEQ ID NO: 8015594 - DNA, 22 bp, Homo sapiens
tggtctcccagagcagggacgc

SEQ ID NO: 8015595 - DNA, 22 bp, Homo sapiens
tggtctctccatgccctccacc

SEQ ID NO: 8015596 - DNA, 22 bp, Homo sapiens
tggtctctccatgccctccacc

SEQ ID NO: 8015597 - DNA, 22 bp, Homo sapiens
tggtctctacggaggaaagctg

SEQ ID NO: 8015598 - DNA, 22 bp, Homo sapiens
tggtctctacggaggaaagctg

SEQ ID NO: 8015599 - DNA, 23 bp, Homo sapiens
tggtctcagcctgtgagagctga

SEQ ID NO: 8015600 - DNA, 22 bp, Homo sapiens
tggtcgggagcgagcagctatt

SEQ ID NO: 8015601 - DNA, 22 bp, Homo sapiens
tggtctaagagcctaactgctg

SEQ ID NO: 8015602 - DNA, 19 bp, Homo sapiens
tggtctaaatgtgtgcccc

SEQ ID NO: 8015603 - DNA, 23 bp, Homo sapiens
tggtctcacttggtaagatgaag

SEQ ID NO: 8015604 - DNA, 23 bp, Homo sapiens
tggtctcacttggtaagatgaag

SEQ ID NO: 8015605 - DNA, 22 bp, Homo sapiens
tggtccttgctatagagtgata

SEQ ID NO: 8015606 - DNA, 21 bp, Homo sapiens
tggtccttctttactgcctcc

SEQ ID NO: 8015607 - DNA, 22 bp, Homo sapiens
tggtccttcttgaagagtgagt

SEQ ID NO: 8015608 - DNA, 22 bp, Homo sapiens
tggtcctttaagtctttctctg

SEQ ID NO: 8015609 - DNA, 22 bp, Homo sapiens
tggtcctttaagtctttctctg

SEQ ID NO: 8015610 - DNA, 22 bp, Homo sapiens
tggtgagagctgaccgtgcgag

SEQ ID NO: 8015611 - DNA, 22 bp, Homo sapiens
tggtgagatgtatggagggttg

SEQ ID NO: 8015612 - DNA, 22 bp, Homo sapiens
tggtgagatgcagcaacagaca

SEQ ID NO: 8015613 - DNA, 22 bp, Homo sapiens
tggtgagctctttagactggga

SEQ ID NO: 8015614 - DNA, 22 bp, Homo sapiens
tggtgagctctttagactggga

SEQ ID NO: 8015615 - DNA, 22 bp, Homo sapiens
tggtgagctctggcagtctgtg

SEQ ID NO: 8015616 - DNA, 22 bp, Homo sapiens
tggtgaggccaaagccatgaca

SEQ ID NO: 8015617 - DNA, 22 bp, Homo sapiens
tggtgaggtcatagagaactgt

SEQ ID NO: 8015618 - DNA, 22 bp, Homo sapiens
tggtgaggccaaagccatgaca

SEQ ID NO: 8015619 - DNA, 22 bp, Homo sapiens
tggtgaggaagacctgctcctg

SEQ ID NO: 8015620 - DNA, 22 bp, Homo sapiens
tggtgaggaagacctgctcctg

SEQ ID NO: 8015621 - DNA, 22 bp, Homo sapiens
tggtgcaaaactaattgcggtt

SEQ ID NO: 8015622 - DNA, 22 bp, Homo sapiens
tggtgatcagtcaactgtcttc

SEQ ID NO: 8015623 - DNA, 22 bp, Homo sapiens
tggtgatcagtcaactgtcttc

SEQ ID NO: 8015624 - DNA, 22 bp, Homo sapiens
tggtgaggtcatagagaactgt

SEQ ID NO: 8015625 - DNA, 22 bp, Homo sapiens
tggtgaggtcatagagaactgt

SEQ ID NO: 8015626 - DNA, 22 bp, Homo sapiens
tggtgaggtcatagagaactgt

SEQ ID NO: 8015627 - DNA, 22 bp, Homo sapiens
tggtgcaagtctctgaggaggg

SEQ ID NO: 8015628 - DNA, 22 bp, Homo sapiens
tggtgcagacaggagccccgct

SEQ ID NO: 8015629 - DNA, 22 bp, Homo sapiens
tggtgcagagagggatctaggg

SEQ ID NO: 8015630 - DNA, 22 bp, Homo sapiens
tggtgcagagagggatctaggg

SEQ ID NO: 8015631 - DNA, 22 bp, Homo sapiens
tggtgcagatagtggtgtagta

SEQ ID NO: 8015632 - DNA, 22 bp, Homo sapiens
tggtgcagatagtggtgtagta

SEQ ID NO: 8015633 - DNA, 22 bp, Homo sapiens
tggtgagaccttgttccttatg

SEQ ID NO: 8015634 - DNA, 20 bp, Homo sapiens
tggtgagagcacctgatggg

SEQ ID NO: 8015635 - DNA, 20 bp, Homo sapiens
tggtgagagcacctgatggg

SEQ ID NO: 8015636 - DNA, 22 bp, Homo sapiens
tggtgagagctgaccgtgcgag

SEQ ID NO: 8015637 - DNA, 22 bp, Homo sapiens
tggtgagataactttcggcaag

SEQ ID NO: 8015638 - DNA, 22 bp, Homo sapiens
tggtgactgggactggatatga

SEQ ID NO: 8015639 - DNA, 22 bp, Homo sapiens
tggtgacctgcagagaaaattt

SEQ ID NO: 8015640 - DNA, 22 bp, Homo sapiens
tggtgagaagttttgagattct

SEQ ID NO: 8015641 - DNA, 22 bp, Homo sapiens
tggtgactgggactggatatga

SEQ ID NO: 8015642 - DNA, 22 bp, Homo sapiens
tggtgacctgcagagaaaattt

SEQ ID NO: 8015643 - DNA, 21 bp, Homo sapiens
tggtgacccctgtctgttccc

SEQ ID NO: 8015644 - DNA, 22 bp, Homo sapiens
tggtgacaccccatctctaaag

SEQ ID NO: 8015645 - DNA, 22 bp, Homo sapiens
tggtgacagcatggaagaagtg

SEQ ID NO: 8015646 - DNA, 22 bp, Homo sapiens
tggtgacagcatggaagaagtg

SEQ ID NO: 8015647 - DNA, 21 bp, Homo sapiens
tggtgacccctgtctgttccc

SEQ ID NO: 8015648 - DNA, 22 bp, Homo sapiens
tggtgaccaatgctatggccag

SEQ ID NO: 8015649 - DNA, 22 bp, Homo sapiens
tggtgaccaatgctatggccag

SEQ ID NO: 8015650 - DNA, 19 bp, Homo sapiens
tggtctctgtctctttgca

SEQ ID NO: 8015651 - DNA, 19 bp, Homo sapiens
tggtctctgtctctttgca

SEQ ID NO: 8015652 - DNA, 22 bp, Homo sapiens
tggtctctgtaggctaccccat

SEQ ID NO: 8015653 - DNA, 22 bp, Homo sapiens
tggtctctgtaggctaccccat

SEQ ID NO: 8015654 - DNA, 22 bp, Homo sapiens
tggtctctgtaggctaccccat

SEQ ID NO: 8015655 - DNA, 22 bp, Homo sapiens
tggtctctgctgcagcttctca

SEQ ID NO: 8015656 - DNA, 22 bp, Homo sapiens
tggtctctgcaggccaggctca

SEQ ID NO: 8015657 - DNA, 22 bp, Homo sapiens
tggtctctgctgcagcttctca

SEQ ID NO: 8015658 - DNA, 22 bp, Homo sapiens
tggtctctgtgctcgggcatgg

SEQ ID NO: 8015659 - DNA, 18 bp, Homo sapiens
tggtgaagggtggaggag

SEQ ID NO: 8015660 - DNA, 22 bp, Homo sapiens
tggtctctgtgctcgggcatgg

SEQ ID NO: 8015661 - DNA, 22 bp, Homo sapiens
tggtgacaccccatctctaaag

SEQ ID NO: 8015662 - DNA, 22 bp, Homo sapiens
tggtgacacgaagtttgctatc

SEQ ID NO: 8015663 - DNA, 22 bp, Homo sapiens
tggtgggggaggctgtctagca

SEQ ID NO: 8015664 - DNA, 22 bp, Homo sapiens
tggtgggggaggctgtctagca

SEQ ID NO: 8015665 - DNA, 22 bp, Homo sapiens
tggtgggggaggctgtctagca

SEQ ID NO: 8015666 - DNA, 22 bp, Homo sapiens
tggtggggctttccttctgctt

SEQ ID NO: 8015667 - DNA, 22 bp, Homo sapiens
tggtgggggaggctgtctagca

SEQ ID NO: 8015668 - DNA, 22 bp, Homo sapiens
tggtgggggaggctgtctagca

SEQ ID NO: 8015669 - DNA, 22 bp, Homo sapiens
tggtggggtcatcgtcagatgc

SEQ ID NO: 8015670 - DNA, 22 bp, Homo sapiens
tggtggggtcatcgtcagatgc

SEQ ID NO: 8015671 - DNA, 22 bp, Homo sapiens
tggtggggtcatcgtcagatgc

SEQ ID NO: 8015672 - DNA, 22 bp, Homo sapiens
tggtggggattccctccctggc

SEQ ID NO: 8015673 - DNA, 22 bp, Homo sapiens
tggtggggattccctccctggc

SEQ ID NO: 8015674 - DNA, 22 bp, Homo sapiens
tggtggggccagacttcagctc

SEQ ID NO: 8015675 - DNA, 22 bp, Homo sapiens
tggtggggctttccttctgctt

SEQ ID NO: 8015676 - DNA, 22 bp, Homo sapiens
tggtggggctttccttctgctt

SEQ ID NO: 8015677 - DNA, 22 bp, Homo sapiens
tggtggggctttccttctgctt

SEQ ID NO: 8015678 - DNA, 22 bp, Homo sapiens
tggtggggccagacttcagctc

SEQ ID NO: 8015679 - DNA, 22 bp, Homo sapiens
tggtggggccagacttcagctc

SEQ ID NO: 8015680 - DNA, 22 bp, Homo sapiens
tggtggggccagacttcagctc

SEQ ID NO: 8015681 - DNA, 22 bp, Homo sapiens
tggtgggagtccgctgtgctgc

SEQ ID NO: 8015682 - DNA, 22 bp, Homo sapiens
tggtgggagtccgctgtgctgc

SEQ ID NO: 8015683 - DNA, 16 bp, Homo sapiens
tggtggccatagttat

SEQ ID NO: 8015684 - DNA, 20 bp, Homo sapiens
tggtggccagtgctgcaggc

SEQ ID NO: 8015685 - DNA, 22 bp, Homo sapiens
tggtgggagtgagggcatgcca

SEQ ID NO: 8015686 - DNA, 22 bp, Homo sapiens
tggtgggagtgacgttgccttc

SEQ ID NO: 8015687 - DNA, 22 bp, Homo sapiens
tggtgggagtgacgttgccttc

SEQ ID NO: 8015688 - DNA, 22 bp, Homo sapiens
tggtgggcacagtgcccaggct

SEQ ID NO: 8015689 - DNA, 22 bp, Homo sapiens
tggtgggcacagtgcccaggct

SEQ ID NO: 8015690 - DNA, 22 bp, Homo sapiens
tggtgggagtgagggcatgcca

SEQ ID NO: 8015691 - DNA, 22 bp, Homo sapiens
tggtgggagtgagggcatgcca

SEQ ID NO: 8015692 - DNA, 22 bp, Homo sapiens
tggtgggagtgagggcatgcca

SEQ ID NO: 8015693 - DNA, 22 bp, Homo sapiens
tggtgggagtgagggcatgcca

SEQ ID NO: 8015694 - DNA, 16 bp, Homo sapiens
tggtggggaggacagc

SEQ ID NO: 8015695 - DNA, 16 bp, Homo sapiens
tggtggggaggacagc

SEQ ID NO: 8015696 - DNA, 16 bp, Homo sapiens
tggtggggaggacagc

SEQ ID NO: 8015697 - DNA, 22 bp, Homo sapiens
tggtggggattccctccctggc

SEQ ID NO: 8015698 - DNA, 22 bp, Homo sapiens
tggtgggcacagtgcccaggct

SEQ ID NO: 8015699 - DNA, 22 bp, Homo sapiens
tggtgggcacagtgcccaggct

SEQ ID NO: 8015700 - DNA, 22 bp, Homo sapiens
tggtgggcacagtgcccaggct

SEQ ID NO: 8015701 - DNA, 16 bp, Homo sapiens
tggtggggaggacagc

SEQ ID NO: 8015702 - DNA, 22 bp, Homo sapiens
tggtggcagtgagaaggagagg

SEQ ID NO: 8015703 - DNA, 22 bp, Homo sapiens
tggtggcagtgagaaggagagg

SEQ ID NO: 8015704 - DNA, 22 bp, Homo sapiens
tggtggcagtctcctggctgtg

SEQ ID NO: 8015705 - DNA, 22 bp, Homo sapiens
tggtggcagtctcctggctgtg

SEQ ID NO: 8015706 - DNA, 22 bp, Homo sapiens
tggtggcagctgagtgtcaggt

SEQ ID NO: 8015707 - DNA, 22 bp, Homo sapiens
tggtggcagctgagtgtcaggt

SEQ ID NO: 8015708 - DNA, 22 bp, Homo sapiens
tggtggcagctgggacagaggt

SEQ ID NO: 8015709 - DNA, 22 bp, Homo sapiens
tggtggccaattcacagggctc

SEQ ID NO: 8015710 - DNA, 22 bp, Homo sapiens
tggtggccacgtgggcgcgagc

SEQ ID NO: 8015711 - DNA, 22 bp, Homo sapiens
tggtggccacgtgggcgcgagc

SEQ ID NO: 8015712 - DNA, 20 bp, Homo sapiens
tggtggccagtgctgcaggc

SEQ ID NO: 8015713 - DNA, 20 bp, Homo sapiens
tggtggccagtgctgcaggc

SEQ ID NO: 8015714 - DNA, 20 bp, Homo sapiens
tggtggccagtgctgcaggc

SEQ ID NO: 8015715 - DNA, 20 bp, Homo sapiens
tggtggccagtgctgcaggc

SEQ ID NO: 8015716 - DNA, 22 bp, Homo sapiens
tggtggccacgtgggcgcgagc

SEQ ID NO: 8015717 - DNA, 22 bp, Homo sapiens
tggtggcatgatagtgtgaatg

SEQ ID NO: 8015718 - DNA, 22 bp, Homo sapiens
tggtggcatgatagtgtgaatg

SEQ ID NO: 8015719 - DNA, 22 bp, Homo sapiens
tggtggcatgatagtgtgaatg

SEQ ID NO: 8015720 - DNA, 22 bp, Homo sapiens
tggtggcatcagtgaagtacac

SEQ ID NO: 8015721 - DNA, 22 bp, Homo sapiens
tggtggccaattcacagggctc

SEQ ID NO: 8015722 - DNA, 22 bp, Homo sapiens
tggtggcatcaattgacttctc

SEQ ID NO: 8015723 - DNA, 22 bp, Homo sapiens
tggtggcatcactcagcctccc

SEQ ID NO: 8015724 - DNA, 22 bp, Homo sapiens
tggtggcatgatagtgtgaatg

SEQ ID NO: 8015725 - DNA, 22 bp, Homo sapiens
tggtggcatcagtgaagtacac

SEQ ID NO: 8015726 - DNA, 22 bp, Homo sapiens
tggtggcatcagtgaagtacac

SEQ ID NO: 8015727 - DNA, 22 bp, Homo sapiens
tggtggcagagcaagagctgga

SEQ ID NO: 8015728 - DNA, 22 bp, Homo sapiens
tggtggcagagcaagagctgga

SEQ ID NO: 8015729 - DNA, 22 bp, Homo sapiens
tggtggcagagcaagagctgga

SEQ ID NO: 8015730 - DNA, 22 bp, Homo sapiens
tggtggcagagcaagagctgga

SEQ ID NO: 8015731 - DNA, 23 bp, Homo sapiens
tggtggcagaagtagcagatgac

SEQ ID NO: 8015732 - DNA, 23 bp, Homo sapiens
tggtggcagaagtagcagatgac

SEQ ID NO: 8015733 - DNA, 23 bp, Homo sapiens
tggtggcagaagtagcagatgac

SEQ ID NO: 8015734 - DNA, 22 bp, Homo sapiens
tggtggcagagcaagagctgga

SEQ ID NO: 8015735 - DNA, 22 bp, Homo sapiens
tggtggcagagcaagagctgga

SEQ ID NO: 8015736 - DNA, 22 bp, Homo sapiens
tggtggcagagcaagagctgga

SEQ ID NO: 8015737 - DNA, 22 bp, Homo sapiens
tggtggcacaagggagagaatc

SEQ ID NO: 8015738 - DNA, 23 bp, Homo sapiens
tggtggcagaagtagcagatgac

SEQ ID NO: 8015739 - DNA, 23 bp, Homo sapiens
tggtggcagaagtagcagatgac

SEQ ID NO: 8015740 - DNA, 23 bp, Homo sapiens
tggtggcagaagtagcagatgac

SEQ ID NO: 8015741 - DNA, 22 bp, Homo sapiens
tggtggcaatgtcctggagaag

SEQ ID NO: 8015742 - DNA, 22 bp, Homo sapiens
tggtggcaatgtcctggagaag

SEQ ID NO: 8015743 - DNA, 22 bp, Homo sapiens
tggtggcaaggtgataagtggg

SEQ ID NO: 8015744 - DNA, 19 bp, Homo sapiens
tggtggcaatgtcagctaa

SEQ ID NO: 8015745 - DNA, 22 bp, Homo sapiens
tggtggcaatgtcctggagaag

SEQ ID NO: 8015746 - DNA, 22 bp, Homo sapiens
tggtggcaatgtcctggagaag

SEQ ID NO: 8015747 - DNA, 22 bp, Homo sapiens
tggtgcagtccaaagggagcag

SEQ ID NO: 8015748 - DNA, 22 bp, Homo sapiens
tggtgcagtccaaagggagcag

SEQ ID NO: 8015749 - DNA, 22 bp, Homo sapiens
tggtgcagtccaaagggagcag

SEQ ID NO: 8015750 - DNA, 22 bp, Homo sapiens
tggtgcagtccaaagggagcag

SEQ ID NO: 8015751 - DNA, 22 bp, Homo sapiens
tggtgcagtccaaagggagcag

SEQ ID NO: 8015752 - DNA, 22 bp, Homo sapiens
tggtgcagtccaaagggagcag

SEQ ID NO: 8015753 - DNA, 22 bp, Homo sapiens
tggtgcagtccaaagggagcag

SEQ ID NO: 8015754 - DNA, 22 bp, Homo sapiens
tggtgcagttcccagggccggg

SEQ ID NO: 8015755 - DNA, 22 bp, Homo sapiens
tggtgcagttcccagggccggg

SEQ ID NO: 8015756 - DNA, 22 bp, Homo sapiens
tggtgcagttcccagggccggg

SEQ ID NO: 8015757 - DNA, 22 bp, Homo sapiens
tggtgcagttcccagggccggg

SEQ ID NO: 8015758 - DNA, 22 bp, Homo sapiens
tggtgccaagcatgaggactct

SEQ ID NO: 8015759 - DNA, 22 bp, Homo sapiens
tggtgccaagcatgaggactct

SEQ ID NO: 8015760 - DNA, 22 bp, Homo sapiens
tggtgccaccctccttcagctg

SEQ ID NO: 8015761 - DNA, 22 bp, Homo sapiens
tggtgccaccctccttcagctg

SEQ ID NO: 8015762 - DNA, 22 bp, Homo sapiens
tggtgccaagtggtttttggct

SEQ ID NO: 8015763 - DNA, 22 bp, Homo sapiens
tggtgccacaagaatacaaagc

SEQ ID NO: 8015764 - DNA, 23 bp, Homo sapiens
tggtgccacagctgaagtcaggt

SEQ ID NO: 8015765 - DNA, 22 bp, Homo sapiens
tggtgccatcatagctcactgc

SEQ ID NO: 8015766 - DNA, 22 bp, Homo sapiens
tggtgccacttcttaggctggt

SEQ ID NO: 8015767 - DNA, 22 bp, Homo sapiens
tggtgccatcatagctcactgc

SEQ ID NO: 8015768 - DNA, 22 bp, Homo sapiens
tggtgccaagcatgaggactct

SEQ ID NO: 8015769 - DNA, 22 bp, Homo sapiens
tggtgccacttcttaggctggt

SEQ ID NO: 8015770 - DNA, 22 bp, Homo sapiens
tggtgccacttcttaggctggt

SEQ ID NO: 8015771 - DNA, 22 bp, Homo sapiens
tggtgccattagccctgctgtt

SEQ ID NO: 8015772 - DNA, 22 bp, Homo sapiens
tggtgcccactccagacaccta

SEQ ID NO: 8015773 - DNA, 22 bp, Homo sapiens
tggtgccattagccctgctgtt

SEQ ID NO: 8015774 - DNA, 22 bp, Homo sapiens
tggtgccattagccctgctgtt

SEQ ID NO: 8015775 - DNA, 22 bp, Homo sapiens
tggtgcccattctggtcccatg

SEQ ID NO: 8015776 - DNA, 22 bp, Homo sapiens
tggtgcccactctggacccagc

SEQ ID NO: 8015777 - DNA, 22 bp, Homo sapiens
tggtgcccttgacagagccagc

SEQ ID NO: 8015778 - DNA, 22 bp, Homo sapiens
tggtgcaggagttggcagggac

SEQ ID NO: 8015779 - DNA, 22 bp, Homo sapiens
tggtgcaggccaagctgcgagc

SEQ ID NO: 8015780 - DNA, 22 bp, Homo sapiens
tggtgcaggccaagctgcgagc

SEQ ID NO: 8015781 - DNA, 22 bp, Homo sapiens
tggtgcaggccaagctgcgagc

SEQ ID NO: 8015782 - DNA, 22 bp, Homo sapiens
tggtgcaggtgttgatgcagga

SEQ ID NO: 8015783 - DNA, 22 bp, Homo sapiens
tggtgcagatgcaggtcactgg

SEQ ID NO: 8015784 - DNA, 22 bp, Homo sapiens
tggtgcagatagtggtgtagta

SEQ ID NO: 8015785 - DNA, 22 bp, Homo sapiens
tggtgcagatagtggtgtagta

SEQ ID NO: 8015786 - DNA, 22 bp, Homo sapiens
tggtgcaggagttggcagggac

SEQ ID NO: 8015787 - DNA, 22 bp, Homo sapiens
tggtgcaggagttggcagggac

SEQ ID NO: 8015788 - DNA, 22 bp, Homo sapiens
tggtgcaggagttggcagggac

SEQ ID NO: 8015789 - DNA, 22 bp, Homo sapiens
tggtgcaggagttggcagggac

SEQ ID NO: 8015790 - DNA, 22 bp, Homo sapiens
tggtgcagatgcaggtcactgg

SEQ ID NO: 8015791 - DNA, 22 bp, Homo sapiens
tggtgcaggtgttgatgcagga

SEQ ID NO: 8015792 - DNA, 22 bp, Homo sapiens
tggtgcaggtgttgatgcagga

SEQ ID NO: 8015793 - DNA, 22 bp, Homo sapiens
tggtgcaggtgttgatgcagga

SEQ ID NO: 8015794 - DNA, 22 bp, Homo sapiens
tggtgcagtagagctgtctggg

SEQ ID NO: 8015795 - DNA, 22 bp, Homo sapiens
tggtgcagtagagctgtctggg

SEQ ID NO: 8015796 - DNA, 22 bp, Homo sapiens
tggtgcagtagagctgtctggg

SEQ ID NO: 8015797 - DNA, 22 bp, Homo sapiens
tggtgcagtcattggcccaggg

SEQ ID NO: 8015798 - DNA, 22 bp, Homo sapiens
tggtgcagtcattggcccaggg

SEQ ID NO: 8015799 - DNA, 22 bp, Homo sapiens
tggtgcagtcattggcccaggg

SEQ ID NO: 8015800 - DNA, 22 bp, Homo sapiens
tggtgcagtcattggcccaggg

SEQ ID NO: 8015801 - DNA, 22 bp, Homo sapiens
tggtgcagtcattggcccaggg

SEQ ID NO: 8015802 - DNA, 22 bp, Homo sapiens
tggtgcagtagagctgtctggg

SEQ ID NO: 8015803 - DNA, 22 bp, Homo sapiens
tggtgcagtagagctgtctggg

SEQ ID NO: 8015804 - DNA, 22 bp, Homo sapiens
tggtgcagtagagctgtctggg

SEQ ID NO: 8015805 - DNA, 22 bp, Homo sapiens
tggtgcagtagagctgtctggg

SEQ ID NO: 8015806 - DNA, 22 bp, Homo sapiens
tggtggagcctaggctaagtct

SEQ ID NO: 8015807 - DNA, 22 bp, Homo sapiens
tggtggagcctaggctaagtct

SEQ ID NO: 8015808 - DNA, 22 bp, Homo sapiens
tggtggagcctaggctaagtct

SEQ ID NO: 8015809 - DNA, 22 bp, Homo sapiens
tggtggagcctaggctaagtct

SEQ ID NO: 8015810 - DNA, 22 bp, Homo sapiens
tggtggagcctaggctaagtct

SEQ ID NO: 8015811 - DNA, 22 bp, Homo sapiens
tggtggagggaactatttccag

SEQ ID NO: 8015812 - DNA, 19 bp, Homo sapiens
tggtggaggccccatgttc

SEQ ID NO: 8015813 - DNA, 22 bp, Homo sapiens
tggtggagctgtggccacgacc

SEQ ID NO: 8015814 - DNA, 22 bp, Homo sapiens
tggtggagctgtggccacgacc

SEQ ID NO: 8015815 - DNA, 19 bp, Homo sapiens
tggtggaggccccatgttc

SEQ ID NO: 8015816 - DNA, 22 bp, Homo sapiens
tggtggagacctcgctaacccc

SEQ ID NO: 8015817 - DNA, 20 bp, Homo sapiens
tggtggactttggcatggct

SEQ ID NO: 8015818 - DNA, 20 bp, Homo sapiens
tggtggactttggcatggct

SEQ ID NO: 8015819 - DNA, 20 bp, Homo sapiens
tggtggactttggcatggct

SEQ ID NO: 8015820 - DNA, 21 bp, Homo sapiens
tggtggaccagtgctgggaga

SEQ ID NO: 8015821 - DNA, 22 bp, Homo sapiens
tggtggacgatgcccagctgga

SEQ ID NO: 8015822 - DNA, 21 bp, Homo sapiens
tggtggaccagtgctgggaga

SEQ ID NO: 8015823 - DNA, 22 bp, Homo sapiens
tggtggacctggcattgaacct

SEQ ID NO: 8015824 - DNA, 22 bp, Homo sapiens
tggtggacattctggatgtgct

SEQ ID NO: 8015825 - DNA, 22 bp, Homo sapiens
tggtgcctccagctgcttctcc

SEQ ID NO: 8015826 - DNA, 22 bp, Homo sapiens
tggtgcctccagctgcttctcc

SEQ ID NO: 8015827 - DNA, 21 bp, Homo sapiens
tggtgccttcagctgtctttt

SEQ ID NO: 8015828 - DNA, 21 bp, Homo sapiens
tggtgccttcagctgtctttt

SEQ ID NO: 8015829 - DNA, 21 bp, Homo sapiens
tggtgccttcagctgtctttt

SEQ ID NO: 8015830 - DNA, 22 bp, Homo sapiens
tggtgcctccagctgcttctcc

SEQ ID NO: 8015831 - DNA, 23 bp, Homo sapiens
tggtgcctcagaagcagtgggct

SEQ ID NO: 8015832 - DNA, 23 bp, Homo sapiens
tggtgcctcagaagcagtgggct

SEQ ID NO: 8015833 - DNA, 22 bp, Homo sapiens
tggtggaattgtaaaatagtgt

SEQ ID NO: 8015834 - DNA, 22 bp, Homo sapiens
tggtggacaccgcagccatgaa

SEQ ID NO: 8015835 - DNA, 22 bp, Homo sapiens
tggtggacaccgcagccatgaa

SEQ ID NO: 8015836 - DNA, 19 bp, Homo sapiens
tggtggaggtgcacctgac

SEQ ID NO: 8015837 - DNA, 19 bp, Homo sapiens
tggtggaggtgcacctgac

SEQ ID NO: 8015838 - DNA, 19 bp, Homo sapiens
tggtggaggtgcacctgac

SEQ ID NO: 8015839 - DNA, 19 bp, Homo sapiens
tggtggaggtgcacctgac

SEQ ID NO: 8015840 - DNA, 19 bp, Homo sapiens
tggtggaggtgcacctgac

SEQ ID NO: 8015841 - DNA, 19 bp, Homo sapiens
tggtggaggtgcacctgac

SEQ ID NO: 8015842 - DNA, 21 bp, Homo sapiens
tggtggagtgtgctgagcatg

SEQ ID NO: 8015843 - DNA, 21 bp, Homo sapiens
tggtggagtgtgctgagcatg

SEQ ID NO: 8015844 - DNA, 21 bp, Homo sapiens
tggtggagtgtgctgagcatg

SEQ ID NO: 8015845 - DNA, 21 bp, Homo sapiens
tggtggagtgtgctgagcatg

SEQ ID NO: 8015846 - DNA, 21 bp, Homo sapiens
tggtggagtgtgctgagcatg

SEQ ID NO: 8015847 - DNA, 21 bp, Homo sapiens
tggtggagtgtgctgagcatg

SEQ ID NO: 8015848 - DNA, 21 bp, Homo sapiens
tggtggagtgtgctgagcatg

SEQ ID NO: 8015849 - DNA, 22 bp, Homo sapiens
tggtggcaaaagaggcaaagtg

SEQ ID NO: 8015850 - DNA, 22 bp, Homo sapiens
tggtggcaaagtacaaagtgac

SEQ ID NO: 8015851 - DNA, 22 bp, Homo sapiens
tggtggcaaagtacaaagtgac

SEQ ID NO: 8015852 - DNA, 22 bp, Homo sapiens
tggtggcaaatcaggacacttc

SEQ ID NO: 8015853 - DNA, 22 bp, Homo sapiens
tggtggcaaatcaggacacttc

SEQ ID NO: 8015854 - DNA, 22 bp, Homo sapiens
tggtggcaacattgctggagtg

SEQ ID NO: 8015855 - DNA, 22 bp, Homo sapiens
tggtggcaacattgctggagtg

SEQ ID NO: 8015856 - DNA, 22 bp, Homo sapiens
tggtggcaacattgctggagtg

SEQ ID NO: 8015857 - DNA, 22 bp, Homo sapiens
tggtggcaacattgctggagtg

SEQ ID NO: 8015858 - DNA, 22 bp, Homo sapiens
tggtggcaacattgctggagtg

SEQ ID NO: 8015859 - DNA, 22 bp, Homo sapiens
tggtggcaacattgctggagtg

SEQ ID NO: 8015860 - DNA, 22 bp, Homo sapiens
tggtggcaaatcaggacacttc

SEQ ID NO: 8015861 - DNA, 22 bp, Homo sapiens
tgtcatttggactttggtatta

SEQ ID NO: 8015862 - DNA, 22 bp, Homo sapiens
tgtcatttggtgccaggaaaga

SEQ ID NO: 8015863 - DNA, 22 bp, Homo sapiens
tgtcatttggtgccaggaaaga

SEQ ID NO: 8015864 - DNA, 22 bp, Homo sapiens
tgtcatttgtttaggcaataat

SEQ ID NO: 8015865 - DNA, 22 bp, Homo sapiens
tgtcattttagtgcatcactca

SEQ ID NO: 8015866 - DNA, 22 bp, Homo sapiens
tgtcatttattttgctgtctgt

SEQ ID NO: 8015867 - DNA, 22 bp, Homo sapiens
tgtcatttcacaatatcactca

SEQ ID NO: 8015868 - DNA, 22 bp, Homo sapiens
tgtcatttcacaatatcactca

SEQ ID NO: 8015869 - DNA, 22 bp, Homo sapiens
tgtcatttcctgaatgctgagt

SEQ ID NO: 8015870 - DNA, 22 bp, Homo sapiens
tgtcatttcacaatatcactca

SEQ ID NO: 8015871 - DNA, 22 bp, Homo sapiens
tgtcatttcacaatatcactca

SEQ ID NO: 8015872 - DNA, 22 bp, Homo sapiens
tgtcatttcacaatatcactca

SEQ ID NO: 8015873 - DNA, 22 bp, Homo sapiens
tgtcattttctaatctgttgtc

SEQ ID NO: 8015874 - DNA, 22 bp, Homo sapiens
tgtcattttcatcctaaggagc

SEQ ID NO: 8015875 - DNA, 22 bp, Homo sapiens
tgtcattttcatcctaaggagc

SEQ ID NO: 8015876 - DNA, 22 bp, Homo sapiens
tgtcattttctaatctgttgtc

SEQ ID NO: 8015877 - DNA, 22 bp, Homo sapiens
tgtcattttctaatctgttgtc

SEQ ID NO: 8015878 - DNA, 22 bp, Homo sapiens
tgtcattttctaatctgttgtc

SEQ ID NO: 8015879 - DNA, 22 bp, Homo sapiens
tgtcattttcagcttatgcttc

SEQ ID NO: 8015880 - DNA, 22 bp, Homo sapiens
tgtcattttcagcttatgcttc

SEQ ID NO: 8015881 - DNA, 22 bp, Homo sapiens
tgtcattttcagcttatgcttc

SEQ ID NO: 8015882 - DNA, 22 bp, Homo sapiens
tgtcattttatgtatgtggtct

SEQ ID NO: 8015883 - DNA, 22 bp, Homo sapiens
tgtcattttatgtatgtggtct

SEQ ID NO: 8015884 - DNA, 22 bp, Homo sapiens
tgtcattttagtgcatcactca

SEQ ID NO: 8015885 - DNA, 22 bp, Homo sapiens
tgtcattttagtgcatcactca

SEQ ID NO: 8015886 - DNA, 22 bp, Homo sapiens
tgtccagaatgtgtggaaattc

SEQ ID NO: 8015887 - DNA, 22 bp, Homo sapiens
tgtccactttgtcagtgtcata

SEQ ID NO: 8015888 - DNA, 22 bp, Homo sapiens
tgtccaccgttcagcaccagag

SEQ ID NO: 8015889 - DNA, 22 bp, Homo sapiens
tgtccactttgtcagtgtcata

SEQ ID NO: 8015890 - DNA, 22 bp, Homo sapiens
tgtccaccggtcctgtgatggg

SEQ ID NO: 8015891 - DNA, 22 bp, Homo sapiens
tgtccacatcactcacttgtca

SEQ ID NO: 8015892 - DNA, 22 bp, Homo sapiens
tgtccacatcactcacttgtca

SEQ ID NO: 8015893 - DNA, 22 bp, Homo sapiens
tgtcattttgtctcactgctat

SEQ ID NO: 8015894 - DNA, 22 bp, Homo sapiens
tgtcattttgtctcactgctat

SEQ ID NO: 8015895 - DNA, 21 bp, Homo sapiens
tgtccaaggtatgcactgggg

SEQ ID NO: 8015896 - DNA, 21 bp, Homo sapiens
tgtccaaggtatgcactgggg

SEQ ID NO: 8015897 - DNA, 22 bp, Homo sapiens
tgtccaggaccctattctcact

SEQ ID NO: 8015898 - DNA, 22 bp, Homo sapiens
tgtccaggagtaaaaagacctg

SEQ ID NO: 8015899 - DNA, 22 bp, Homo sapiens
tgtccaggaccctattctcact

SEQ ID NO: 8015900 - DNA, 22 bp, Homo sapiens
tgtccaggaccctattctcact

SEQ ID NO: 8015901 - DNA, 22 bp, Homo sapiens
tgtccaggaattgaccctgcaa

SEQ ID NO: 8015902 - DNA, 22 bp, Homo sapiens
tgtccaggaattgaccctgcaa

SEQ ID NO: 8015903 - DNA, 22 bp, Homo sapiens
tgtccagctcgagacactatct

SEQ ID NO: 8015904 - DNA, 22 bp, Homo sapiens
tgtccagcggcctggctgctga

SEQ ID NO: 8015905 - DNA, 22 bp, Homo sapiens
tgtccagagtcacagagctcaa

SEQ ID NO: 8015906 - DNA, 22 bp, Homo sapiens
tgtcatatgttgatgaaagaga

SEQ ID NO: 8015907 - DNA, 22 bp, Homo sapiens
tgtcatatgttgatgaaagaga

SEQ ID NO: 8015908 - DNA, 22 bp, Homo sapiens
tgtcatatagatattagacagg

SEQ ID NO: 8015909 - DNA, 22 bp, Homo sapiens
tgtcatatctattaaatgtcta

SEQ ID NO: 8015910 - DNA, 22 bp, Homo sapiens
tgtcatcagcatataagacagt

SEQ ID NO: 8015911 - DNA, 22 bp, Homo sapiens
tgtcatcagggtgcaagagtta

SEQ ID NO: 8015912 - DNA, 22 bp, Homo sapiens
tgtcatcaactcacagagccaa

SEQ ID NO: 8015913 - DNA, 22 bp, Homo sapiens
tgtcatcaactcacagagccaa

SEQ ID NO: 8015914 - DNA, 21 bp, Homo sapiens
tgtcatatttcaatacagttt

SEQ ID NO: 8015915 - DNA, 22 bp, Homo sapiens
tgtcatcatttgagagaagaaa

SEQ ID NO: 8015916 - DNA, 22 bp, Homo sapiens
tgtcatcagggtgcaagagtta

SEQ ID NO: 8015917 - DNA, 22 bp, Homo sapiens
tgtcatccaagagtttccagca

SEQ ID NO: 8015918 - DNA, 22 bp, Homo sapiens
tgtcatcatttgagagaagaaa

SEQ ID NO: 8015919 - DNA, 22 bp, Homo sapiens
tgtcatctcactgatatagatg

SEQ ID NO: 8015920 - DNA, 22 bp, Homo sapiens
tgtcatctcttgcaggaagcct

SEQ ID NO: 8015921 - DNA, 22 bp, Homo sapiens
tgtcatctgcgggtggcactgc

SEQ ID NO: 8015922 - DNA, 22 bp, Homo sapiens
tgtcatctgaatttctcatcac

SEQ ID NO: 8015923 - DNA, 22 bp, Homo sapiens
tgtcatcttaaatcattcccac

SEQ ID NO: 8015924 - DNA, 22 bp, Homo sapiens
tgtcatctgcgggtggcactgc

SEQ ID NO: 8015925 - DNA, 22 bp, Homo sapiens
tgtcatctgtgttttgctggag

SEQ ID NO: 8015926 - DNA, 22 bp, Homo sapiens
tgtcatctggcctgattggtgt

SEQ ID NO: 8015927 - DNA, 22 bp, Homo sapiens
tgtcattccttcaatgtagata

SEQ ID NO: 8015928 - DNA, 22 bp, Homo sapiens
tgtcatcttgtccagccaggca

SEQ ID NO: 8015929 - DNA, 22 bp, Homo sapiens
tgtcatctttttaaagaagaga

SEQ ID NO: 8015930 - DNA, 22 bp, Homo sapiens
tgtcatttaatagatatgatgg

SEQ ID NO: 8015931 - DNA, 22 bp, Homo sapiens
tgtcatttaatagatatgatgg

SEQ ID NO: 8015932 - DNA, 22 bp, Homo sapiens
tgtcatttactccataccctca

SEQ ID NO: 8015933 - DNA, 22 bp, Homo sapiens
tgtcatttagtcctctgtgtgt

SEQ ID NO: 8015934 - DNA, 22 bp, Homo sapiens
tgtcatttagtcctctgtgtgt

SEQ ID NO: 8015935 - DNA, 22 bp, Homo sapiens
tgtcatttagtcctctgtgtgt

SEQ ID NO: 8015936 - DNA, 22 bp, Homo sapiens
tgtcatttaaagctttccagat

SEQ ID NO: 8015937 - DNA, 22 bp, Homo sapiens
tgtcatttaaagctttccagat

SEQ ID NO: 8015938 - DNA, 22 bp, Homo sapiens
tgtcattggtacaaattgattg

SEQ ID NO: 8015939 - DNA, 20 bp, Homo sapiens
tgtcattcttctttcacagg

SEQ ID NO: 8015940 - DNA, 20 bp, Homo sapiens
tgtcatttatttatcaaatg

SEQ ID NO: 8015941 - DNA, 22 bp, Homo sapiens
tgtcatttattctcttattcta

SEQ ID NO: 8015942 - DNA, 22 bp, Homo sapiens
tgtcatttattctcttattcta

SEQ ID NO: 8015943 - DNA, 22 bp, Homo sapiens
tgtcatttatgcttcttcagtg

SEQ ID NO: 8015944 - DNA, 20 bp, Homo sapiens
tgtcatttatttatcaaatg

SEQ ID NO: 8015945 - DNA, 20 bp, Homo sapiens
tgtcatttatttatcaaatg

SEQ ID NO: 8015946 - DNA, 22 bp, Homo sapiens
tgtcatttattttgctgtctgt

SEQ ID NO: 8015947 - DNA, 22 bp, Homo sapiens
tgtcatttattctcttattcta

SEQ ID NO: 8015948 - DNA, 22 bp, Homo sapiens
tgtcatttatgcttcttcagtg

SEQ ID NO: 8015949 - DNA, 22 bp, Homo sapiens
tgtcatttatcttatagtaatc

SEQ ID NO: 8015950 - DNA, 22 bp, Homo sapiens
tgtcatttatcttatagtaatc

SEQ ID NO: 8015951 - DNA, 22 bp, Homo sapiens
tgtcatttatcttatagtaatc

SEQ ID NO: 8015952 - DNA, 22 bp, Homo sapiens
tgtcacttcagttttgaaacaa

SEQ ID NO: 8015953 - DNA, 22 bp, Homo sapiens
tgtcactttggggagagttttg

SEQ ID NO: 8015954 - DNA, 21 bp, Homo sapiens
tgtcagaaataagcatgtgat

SEQ ID NO: 8015955 - DNA, 21 bp, Homo sapiens
tgtcagaaataagcatgtgat

SEQ ID NO: 8015956 - DNA, 22 bp, Homo sapiens
tgtcagaactctattgatgtcc

SEQ ID NO: 8015957 - DNA, 22 bp, Homo sapiens
tgtcaggagccaccagcactcc

SEQ ID NO: 8015958 - DNA, 22 bp, Homo sapiens
tgtcactttggggagagttttg

SEQ ID NO: 8015959 - DNA, 19 bp, Homo sapiens
tgtcactgtcatggcccag

SEQ ID NO: 8015960 - DNA, 18 bp, Homo sapiens
tgtcactggataatggtc

SEQ ID NO: 8015961 - DNA, 19 bp, Homo sapiens
tgtcaccttctgtcagttt

SEQ ID NO: 8015962 - DNA, 18 bp, Homo sapiens
tgtcactggataatggtc

SEQ ID NO: 8015963 - DNA, 22 bp, Homo sapiens
tgtcactgtgctctgttcattt

SEQ ID NO: 8015964 - DNA, 22 bp, Homo sapiens
tgtcactgttacatgaactctt

SEQ ID NO: 8015965 - DNA, 22 bp, Homo sapiens
tgtcactgtgctctgttcattt

SEQ ID NO: 8015966 - DNA, 22 bp, Homo sapiens
tgtcactgtgctctgttcattt

SEQ ID NO: 8015967 - DNA, 19 bp, Homo sapiens
tgtcaccttctgtcagttt

SEQ ID NO: 8015968 - DNA, 22 bp, Homo sapiens
tgtcaccttgcagggctggggc

SEQ ID NO: 8015969 - DNA, 22 bp, Homo sapiens
tgtcactacatcataaatatat

SEQ ID NO: 8015970 - DNA, 22 bp, Homo sapiens
tgtcaggcaaaggaaggtattt

SEQ ID NO: 8015971 - DNA, 22 bp, Homo sapiens
tgtcagggcatgcggtccagcc

SEQ ID NO: 8015972 - DNA, 19 bp, Homo sapiens
tgtcaggggtgtgctgtgc

SEQ ID NO: 8015973 - DNA, 22 bp, Homo sapiens
tgtcagggctggacacagctgc

SEQ ID NO: 8015974 - DNA, 22 bp, Homo sapiens
tgtcaggtctaaaatgggtctc

SEQ ID NO: 8015975 - DNA, 22 bp, Homo sapiens
tgtcaggtctaaaatgggtctc

SEQ ID NO: 8015976 - DNA, 22 bp, Homo sapiens
tgtcaggttggttttcagagaa

SEQ ID NO: 8015977 - DNA, 18 bp, Homo sapiens
tgtcagtaaagtgacaga

SEQ ID NO: 8015978 - DNA, 22 bp, Homo sapiens
tgtcaggtgacacactaggagc

SEQ ID NO: 8015979 - DNA, 22 bp, Homo sapiens
tgtcaggtctctgtgatggtaa

SEQ ID NO: 8015980 - DNA, 22 bp, Homo sapiens
tgtcagtgagttgggtcctgag

SEQ ID NO: 8015981 - DNA, 19 bp, Homo sapiens
tgtcagtgatacatgcttt

SEQ ID NO: 8015982 - DNA, 22 bp, Homo sapiens
tgtcagtgatttgtagggaatt

SEQ ID NO: 8015983 - DNA, 22 bp, Homo sapiens
tgtcagtgatttgtagggaatt

SEQ ID NO: 8015984 - DNA, 22 bp, Homo sapiens
tgtcagtgcacagatggttgat

SEQ ID NO: 8015985 - DNA, 22 bp, Homo sapiens
tgtcagtgcacagatggttgat

SEQ ID NO: 8015986 - DNA, 22 bp, Homo sapiens
tgtcagtgccaactttgctggt

SEQ ID NO: 8015987 - DNA, 20 bp, Homo sapiens
tgtcagtgcctgaggcacag

SEQ ID NO: 8015988 - DNA, 20 bp, Homo sapiens
tgtcagtgcctgaggcacag

SEQ ID NO: 8015989 - DNA, 22 bp, Homo sapiens
tgtcagtgacagatttatgatc

SEQ ID NO: 8015990 - DNA, 22 bp, Homo sapiens
tgtcagtgacctagcacggtgc

SEQ ID NO: 8015991 - DNA, 22 bp, Homo sapiens
tgtcagtgagttagttgcaagt

SEQ ID NO: 8015992 - DNA, 19 bp, Homo sapiens
tgtcagtagttgtctaggg

SEQ ID NO: 8015993 - DNA, 22 bp, Homo sapiens
tgtcagtgaaaaattgtgatag

SEQ ID NO: 8015994 - DNA, 22 bp, Homo sapiens
tgtcagtgacagatttatgatc

SEQ ID NO: 8015995 - DNA, 22 bp, Homo sapiens
tgtcagtgaaaaattgtgatag

SEQ ID NO: 8015996 - DNA, 22 bp, Homo sapiens
tgtcagtgaactggaaggcctg

SEQ ID NO: 8015997 - DNA, 22 bp, Homo sapiens
tgtcagtgtctatgaagaattt

SEQ ID NO: 8015998 - DNA, 22 bp, Homo sapiens
tgtcagtgtctatgaagaattt

SEQ ID NO: 8015999 - DNA, 22 bp, Homo sapiens
tgtcagtgtatacatacagtat

SEQ ID NO: 8016000 - DNA, 22 bp, Homo sapiens
tgtcagtggtcatagtagaaaa

SEQ ID NO: 8016001 - DNA, 22 bp, Homo sapiens
tgtcagtgtaactcttatagca

SEQ ID NO: 8016002 - DNA, 22 bp, Homo sapiens
tgtcagtgtaactcttatagca

SEQ ID NO: 8016003 - DNA, 22 bp, Homo sapiens
tgtcagtggtagacccagaggt

SEQ ID NO: 8016004 - DNA, 22 bp, Homo sapiens
tgtcagtggtcatagtagaaaa

SEQ ID NO: 8016005 - DNA, 22 bp, Homo sapiens
tgtcagtggtaaggttgggagt

SEQ ID NO: 8016006 - DNA, 22 bp, Homo sapiens
tgtcagtggacctggagaggcc

SEQ ID NO: 8016007 - DNA, 22 bp, Homo sapiens
tgtcagtgctatagtgggaata

SEQ ID NO: 8016008 - DNA, 22 bp, Homo sapiens
tgtcagtttggctctaaagttt

SEQ ID NO: 8016009 - DNA, 22 bp, Homo sapiens
tgtcagtttagttgaagaaaga

SEQ ID NO: 8016010 - DNA, 22 bp, Homo sapiens
tgtcagtttagttgaagaaaga

SEQ ID NO: 8016011 - DNA, 22 bp, Homo sapiens
tgtcagttacctagcacaagaa

SEQ ID NO: 8016012 - DNA, 22 bp, Homo sapiens
tgtcagttaaatgaggtacaag

SEQ ID NO: 8016013 - DNA, 22 bp, Homo sapiens
tgtcagtgttttatgtgccctt

SEQ ID NO: 8016014 - DNA, 22 bp, Homo sapiens
tgtcagtgtctgaggttttata

SEQ ID NO: 8016015 - DNA, 22 bp, Homo sapiens
tgtcagtgtgcaccgggaggcc

SEQ ID NO: 8016016 - DNA, 22 bp, Homo sapiens
tgtcagttcagtgattacaaaa

SEQ ID NO: 8016017 - DNA, 22 bp, Homo sapiens
tgtcagttcaattatagtaatt

SEQ ID NO: 8016018 - DNA, 22 bp, Homo sapiens
tgtcagttcaattatagtaatt

SEQ ID NO: 8016019 - DNA, 22 bp, Homo sapiens
tgtcatagtgtggtagcagtgg

SEQ ID NO: 8016020 - DNA, 23 bp, Homo sapiens
tgtcatacattctatgggtttgg

SEQ ID NO: 8016021 - DNA, 22 bp, Homo sapiens
tgtcatagtgtggtagcagtgg

SEQ ID NO: 8016022 - DNA, 22 bp, Homo sapiens
tgtcataatgctgctagaaatt

SEQ ID NO: 8016023 - DNA, 22 bp, Homo sapiens
tgtcatagtgtggtagcagtgg

SEQ ID NO: 8016024 - DNA, 22 bp, Homo sapiens
tgtcatatagaatgttctatga

SEQ ID NO: 8016025 - DNA, 22 bp, Homo sapiens
tgtcataaaacacaagctgttg

SEQ ID NO: 8016026 - DNA, 22 bp, Homo sapiens
tgtcataagattaactttttgt

SEQ ID NO: 8016027 - DNA, 22 bp, Homo sapiens
tgtcataacttagtgacaaatc

SEQ ID NO: 8016028 - DNA, 22 bp, Homo sapiens
tgtcataatcagttttgcatgt

SEQ ID NO: 8016029 - DNA, 22 bp, Homo sapiens
tgtcataatcagttttgcatgt

SEQ ID NO: 8016030 - DNA, 18 bp, Homo sapiens
tgtcataatatatcacct

SEQ ID NO: 8016031 - DNA, 22 bp, Homo sapiens
tgtcataagtgtttgcacccag

SEQ ID NO: 8016032 - DNA, 18 bp, Homo sapiens
tgtcataatatatcacct

SEQ ID NO: 8016033 - DNA, 22 bp, Homo sapiens
tgtcataagtgtttgcacccag

SEQ ID NO: 8016034 - DNA, 22 bp, Homo sapiens
tgtcataacttagtgacaaatc

SEQ ID NO: 8016035 - DNA, 22 bp, Homo sapiens
tgtccccaaggttcagcccaca

SEQ ID NO: 8016036 - DNA, 20 bp, Homo sapiens
tgtccccaccaaaatttcat

SEQ ID NO: 8016037 - DNA, 22 bp, Homo sapiens
tgtccccaaggttcagcccaca

SEQ ID NO: 8016038 - DNA, 22 bp, Homo sapiens
tgtcccatggacacaacttctt

SEQ ID NO: 8016039 - DNA, 22 bp, Homo sapiens
tgtcccatggacacaacttctt

SEQ ID NO: 8016040 - DNA, 22 bp, Homo sapiens
tgtcccatggataccaggctat

SEQ ID NO: 8016041 - DNA, 22 bp, Homo sapiens
tgtcccatggcttttctggtgg

SEQ ID NO: 8016042 - DNA, 22 bp, Homo sapiens
tgtccccagcactcactctcca

SEQ ID NO: 8016043 - DNA, 22 bp, Homo sapiens
tgtccccagagcctgttcctgc

SEQ ID NO: 8016044 - DNA, 22 bp, Homo sapiens
tgtccccaggtcctctgccgtc

SEQ ID NO: 8016045 - DNA, 22 bp, Homo sapiens
tgtccccacccaaatctcatct

SEQ ID NO: 8016046 - DNA, 22 bp, Homo sapiens
tgtccccagagcctgttcctgc

SEQ ID NO: 8016047 - DNA, 20 bp, Homo sapiens
tgtcccctagatcccagctc

SEQ ID NO: 8016048 - DNA, 20 bp, Homo sapiens
tgtcccctagatcccagctc

SEQ ID NO: 8016049 - DNA, 20 bp, Homo sapiens
tgtcccctagatcccagctc

SEQ ID NO: 8016050 - DNA, 22 bp, Homo sapiens
tgtcccctgcccagggatggga

SEQ ID NO: 8016051 - DNA, 22 bp, Homo sapiens
tgtccctatcctcatgcaggcc

SEQ ID NO: 8016052 - DNA, 22 bp, Homo sapiens
tgtcccctttctttccttcgta

SEQ ID NO: 8016053 - DNA, 22 bp, Homo sapiens
tgtcccctttctttccttcgta

SEQ ID NO: 8016054 - DNA, 22 bp, Homo sapiens
tgtcccctttctttccttcgta

SEQ ID NO: 8016055 - DNA, 22 bp, Homo sapiens
tgtccctcattgacgctgtgcc

SEQ ID NO: 8016056 - DNA, 22 bp, Homo sapiens
tgtcccctttacctccgcagcc

SEQ ID NO: 8016057 - DNA, 22 bp, Homo sapiens
tgtcccctttacctccgcagcc

SEQ ID NO: 8016058 - DNA, 22 bp, Homo sapiens
tgtcccctttctttccttcgta

SEQ ID NO: 8016059 - DNA, 22 bp, Homo sapiens
tgtcccctttacctccgcagcc

SEQ ID NO: 8016060 - DNA, 22 bp, Homo sapiens
tgtcccctttctttccttcgta

SEQ ID NO: 8016061 - DNA, 22 bp, Homo sapiens
tgtccctggactccaggagcca

SEQ ID NO: 8016062 - DNA, 22 bp, Homo sapiens
tgtccctggagcttctgtcccc

SEQ ID NO: 8016063 - DNA, 22 bp, Homo sapiens
tgtccctggactccaggagcca

SEQ ID NO: 8016064 - DNA, 22 bp, Homo sapiens
tgtccctggactccaggagcca

SEQ ID NO: 8016065 - DNA, 22 bp, Homo sapiens
tgtccctggaactatggctcca

SEQ ID NO: 8016066 - DNA, 22 bp, Homo sapiens
tgtccctggtggaggctggcag

SEQ ID NO: 8016067 - DNA, 22 bp, Homo sapiens
tgtccctggtggaggctggcag

SEQ ID NO: 8016068 - DNA, 22 bp, Homo sapiens
tgtccctggtggaggctggcag

SEQ ID NO: 8016069 - DNA, 19 bp, Homo sapiens
tgtccgtggccttctggat

SEQ ID NO: 8016070 - DNA, 19 bp, Homo sapiens
tgtccgtggccttctggat

SEQ ID NO: 8016071 - DNA, 22 bp, Homo sapiens
tgtccctggtggaggctggcag

SEQ ID NO: 8016072 - DNA, 19 bp, Homo sapiens
tgtccctggtcaccagact

SEQ ID NO: 8016073 - DNA, 22 bp, Homo sapiens
tgtccctgatccactggacccc

SEQ ID NO: 8016074 - DNA, 22 bp, Homo sapiens
tgtccctgatccactggacccc

SEQ ID NO: 8016075 - DNA, 22 bp, Homo sapiens
tgtccctctgaggcttccctgg

SEQ ID NO: 8016076 - DNA, 22 bp, Homo sapiens
tgtccctgatccactggacccc

SEQ ID NO: 8016077 - DNA, 22 bp, Homo sapiens
tgtccctctgaggcttccctgg

SEQ ID NO: 8016078 - DNA, 22 bp, Homo sapiens
tgtccctcattgacgctgtgcc

SEQ ID NO: 8016079 - DNA, 22 bp, Homo sapiens
tgtccctgctgtacttagagca

SEQ ID NO: 8016080 - DNA, 18 bp, Homo sapiens
tgtccctgcaaataacat

SEQ ID NO: 8016081 - DNA, 18 bp, Homo sapiens
tgtccctgcaaataacat

SEQ ID NO: 8016082 - DNA, 18 bp, Homo sapiens
tgtccctgcaaataacat

SEQ ID NO: 8016083 - DNA, 18 bp, Homo sapiens
tgtccctgcaaataacat

SEQ ID NO: 8016084 - DNA, 22 bp, Homo sapiens
tgtccagggggcttacctggag

SEQ ID NO: 8016085 - DNA, 22 bp, Homo sapiens
tgtccagggggcttacctggag

SEQ ID NO: 8016086 - DNA, 22 bp, Homo sapiens
tgtccagggggcttacctggag

SEQ ID NO: 8016087 - DNA, 20 bp, Homo sapiens
tgtccaggggatcgttggcc

SEQ ID NO: 8016088 - DNA, 20 bp, Homo sapiens
tgtccaggggatcgttggcc

SEQ ID NO: 8016089 - DNA, 22 bp, Homo sapiens
tgtccaggtcagcagcagggac

SEQ ID NO: 8016090 - DNA, 22 bp, Homo sapiens
tgtccaggtcagcagcagggac

SEQ ID NO: 8016091 - DNA, 22 bp, Homo sapiens
tgtccaggtcagcagcagggac

SEQ ID NO: 8016092 - DNA, 22 bp, Homo sapiens
tgtccaggtcagcagcagggac

SEQ ID NO: 8016093 - DNA, 22 bp, Homo sapiens
tgtccaggtggcctctgctgct

SEQ ID NO: 8016094 - DNA, 22 bp, Homo sapiens
tgtccaggtggcctctgctgct

SEQ ID NO: 8016095 - DNA, 22 bp, Homo sapiens
tgtccaggtggcctctgctgct

SEQ ID NO: 8016096 - DNA, 22 bp, Homo sapiens
tgtccaggtggcctctgctgct

SEQ ID NO: 8016097 - DNA, 22 bp, Homo sapiens
tgtccaggtggcctctgctgct

SEQ ID NO: 8016098 - DNA, 22 bp, Homo sapiens
tgtccaggtgtgtctaaagaga

SEQ ID NO: 8016099 - DNA, 22 bp, Homo sapiens
tgtccaggtgtgtctaaagaga

SEQ ID NO: 8016100 - DNA, 22 bp, Homo sapiens
tgtcccagcagctgggttctct

SEQ ID NO: 8016101 - DNA, 22 bp, Homo sapiens
tgtccaggcggccttgcctgtt

SEQ ID NO: 8016102 - DNA, 22 bp, Homo sapiens
tgtccaggcactgggactctag

SEQ ID NO: 8016103 - DNA, 22 bp, Homo sapiens
tgtccaggcactgggactctag

SEQ ID NO: 8016104 - DNA, 22 bp, Homo sapiens
tgtccaggcactgggactctag

SEQ ID NO: 8016105 - DNA, 22 bp, Homo sapiens
tgtccaggagtaaaaagacctg

SEQ ID NO: 8016106 - DNA, 22 bp, Homo sapiens
tgtccaggctcccttggtgctg

SEQ ID NO: 8016107 - DNA, 22 bp, Homo sapiens
tgtccaggctaaagtgcagtgg

SEQ ID NO: 8016108 - DNA, 22 bp, Homo sapiens
tgtccaggctaaagtgcagtgg

SEQ ID NO: 8016109 - DNA, 22 bp, Homo sapiens
tgtccaggctaaagtgcagtgg

SEQ ID NO: 8016110 - DNA, 22 bp, Homo sapiens
tgtccaggcggccttgcctgtt

SEQ ID NO: 8016111 - DNA, 22 bp, Homo sapiens
tgtccaggcggccttgcctgtt

SEQ ID NO: 8016112 - DNA, 20 bp, Homo sapiens
tgtccaggggatcgttggcc

SEQ ID NO: 8016113 - DNA, 22 bp, Homo sapiens
tgtccagggatggggtcaggga

SEQ ID NO: 8016114 - DNA, 22 bp, Homo sapiens
tgtccagggatggggtcaggga

SEQ ID NO: 8016115 - DNA, 22 bp, Homo sapiens
tgtccagggatggggtcaggga

SEQ ID NO: 8016116 - DNA, 22 bp, Homo sapiens
tgtccagggatggggtcaggga

SEQ ID NO: 8016117 - DNA, 22 bp, Homo sapiens
tgtccagggatggggtcaggga

SEQ ID NO: 8016118 - DNA, 22 bp, Homo sapiens
tgtccaggctggagtgcagtgg

SEQ ID NO: 8016119 - DNA, 22 bp, Homo sapiens
tgtccaggctggagtgcagtgg

SEQ ID NO: 8016120 - DNA, 22 bp, Homo sapiens
tgtccaggctggagtgcagtgg

SEQ ID NO: 8016121 - DNA, 22 bp, Homo sapiens
tgtccaggctcccttggtgctg

SEQ ID NO: 8016122 - DNA, 22 bp, Homo sapiens
tgtccaggctcccttggtgctg

SEQ ID NO: 8016123 - DNA, 22 bp, Homo sapiens
tgtcccagggaaggcccagcac

SEQ ID NO: 8016124 - DNA, 22 bp, Homo sapiens
tgtcccaggctgaagtacagtg

SEQ ID NO: 8016125 - DNA, 22 bp, Homo sapiens
tgtcccaggtcctagatgacca

SEQ ID NO: 8016126 - DNA, 17 bp, Homo sapiens
tgtcccaggctcaacgc

SEQ ID NO: 8016127 - DNA, 22 bp, Homo sapiens
tgtcccaggcctcatgttgcca

SEQ ID NO: 8016128 - DNA, 22 bp, Homo sapiens
tgtcccaggcctcatgttgcca

SEQ ID NO: 8016129 - DNA, 22 bp, Homo sapiens
tgtcccagcactttgggagtct

SEQ ID NO: 8016130 - DNA, 22 bp, Homo sapiens
tgtcccagctgtctctgttttt

SEQ ID NO: 8016131 - DNA, 22 bp, Homo sapiens
tgtcccagttttgcaggttaga

SEQ ID NO: 8016132 - DNA, 22 bp, Homo sapiens
tgtcccagttgggtattgaatt

SEQ ID NO: 8016133 - DNA, 22 bp, Homo sapiens
tgtcccaggtcctagatgacca

SEQ ID NO: 8016134 - DNA, 22 bp, Homo sapiens
tgtcccagtcaaggctgtcatc

SEQ ID NO: 8016135 - DNA, 22 bp, Homo sapiens
tgtcccagtcaaggctgtcatc

SEQ ID NO: 8016136 - DNA, 22 bp, Homo sapiens
tgtcctgggtcaaccaggtcga

SEQ ID NO: 8016137 - DNA, 22 bp, Homo sapiens
tgtcctgggtcaaccaggtcga

SEQ ID NO: 8016138 - DNA, 22 bp, Homo sapiens
tgtcctgggtcaaatcctggtc

SEQ ID NO: 8016139 - DNA, 22 bp, Homo sapiens
tgtcctgggtcaaatcctggtc

SEQ ID NO: 8016140 - DNA, 22 bp, Homo sapiens
tgtcctgggtcaaatcctggtc

SEQ ID NO: 8016141 - DNA, 22 bp, Homo sapiens
tgtcctggggcgacttggggcc

SEQ ID NO: 8016142 - DNA, 22 bp, Homo sapiens
tgtcctggggcgacttggggcc

SEQ ID NO: 8016143 - DNA, 22 bp, Homo sapiens
tgtcctggggacaagaggccct

SEQ ID NO: 8016144 - DNA, 22 bp, Homo sapiens
tgtcctggggacaagaggccct

SEQ ID NO: 8016145 - DNA, 22 bp, Homo sapiens
tgtcctggggacaagaggccct

SEQ ID NO: 8016146 - DNA, 22 bp, Homo sapiens
tgtcctggggacaagaggccct

SEQ ID NO: 8016147 - DNA, 22 bp, Homo sapiens
tgtcctggggacaagaggccct

SEQ ID NO: 8016148 - DNA, 22 bp, Homo sapiens
tgtcctgggccggcgactggtc

SEQ ID NO: 8016149 - DNA, 22 bp, Homo sapiens
tgtcctggggacaagaggccct

SEQ ID NO: 8016150 - DNA, 22 bp, Homo sapiens
tgtcctgggaatgggatgcagt

SEQ ID NO: 8016151 - DNA, 22 bp, Homo sapiens
tgtcctgggaatgggatgcagt

SEQ ID NO: 8016152 - DNA, 22 bp, Homo sapiens
tgtcctgggaatgggatgcagt

SEQ ID NO: 8016153 - DNA, 22 bp, Homo sapiens
tgtcctgggaatgggatgcagt

SEQ ID NO: 8016154 - DNA, 22 bp, Homo sapiens
tgtcctgggaatgggatgcagt

SEQ ID NO: 8016155 - DNA, 22 bp, Homo sapiens
tgtcctgggaactcacagtcca

SEQ ID NO: 8016156 - DNA, 22 bp, Homo sapiens
tgtcctgggaaatcccttaggc

SEQ ID NO: 8016157 - DNA, 22 bp, Homo sapiens
tgtcctgggaactcacagtcca

SEQ ID NO: 8016158 - DNA, 22 bp, Homo sapiens
tgtcctgggccggcgactggtc

SEQ ID NO: 8016159 - DNA, 22 bp, Homo sapiens
tgtcctgggccggcgactggtc

SEQ ID NO: 8016160 - DNA, 22 bp, Homo sapiens
tgtcctgggccggcgactggtc

SEQ ID NO: 8016161 - DNA, 22 bp, Homo sapiens
tgtcctgggaggcggggtccag

SEQ ID NO: 8016162 - DNA, 22 bp, Homo sapiens
tgtcctgggaggcggggtccag

SEQ ID NO: 8016163 - DNA, 22 bp, Homo sapiens
tgtcctgggaggcggggtccag

SEQ ID NO: 8016164 - DNA, 22 bp, Homo sapiens
tgtcctcacaggaatgaacttt

SEQ ID NO: 8016165 - DNA, 19 bp, Homo sapiens
tgtcctcacagagcataac

SEQ ID NO: 8016166 - DNA, 19 bp, Homo sapiens
tgtcctcacagagcataac

SEQ ID NO: 8016167 - DNA, 22 bp, Homo sapiens
tgtcctcaaggagcttcagtct

SEQ ID NO: 8016168 - DNA, 22 bp, Homo sapiens
tgtcctcacacgtagggagtaa

SEQ ID NO: 8016169 - DNA, 22 bp, Homo sapiens
tgtcctagagacatcagatgtt

SEQ ID NO: 8016170 - DNA, 20 bp, Homo sapiens
tgtcctaatagacaagcaga

SEQ ID NO: 8016171 - DNA, 22 bp, Homo sapiens
tgtcctatttctctgtgcatga

SEQ ID NO: 8016172 - DNA, 22 bp, Homo sapiens
tgtcctcagatatgtctactct

SEQ ID NO: 8016173 - DNA, 19 bp, Homo sapiens
tgtcctcacagagcataac

SEQ ID NO: 8016174 - DNA, 22 bp, Homo sapiens
tgtcctcacatggtggggagag

SEQ ID NO: 8016175 - DNA, 22 bp, Homo sapiens
tgtcctcagatatgtctactct

SEQ ID NO: 8016176 - DNA, 22 bp, Homo sapiens
tgtcctcagatatgtctactct

SEQ ID NO: 8016177 - DNA, 22 bp, Homo sapiens
tgtcctcaggacctggcacagt

SEQ ID NO: 8016178 - DNA, 22 bp, Homo sapiens
tgtcctggccaaggccttgctt

SEQ ID NO: 8016179 - DNA, 22 bp, Homo sapiens
tgtcctggccaaggccttgctt

SEQ ID NO: 8016180 - DNA, 22 bp, Homo sapiens
tgtcctggcctccagaaagtcg

SEQ ID NO: 8016181 - DNA, 22 bp, Homo sapiens
tgtcctggcctccagaaagtcg

SEQ ID NO: 8016182 - DNA, 22 bp, Homo sapiens
tgtcctgggtggatgcttcatt

SEQ ID NO: 8016183 - DNA, 22 bp, Homo sapiens
tgtcctgggtccctgctagaag

SEQ ID NO: 8016184 - DNA, 22 bp, Homo sapiens
tgtcctgggtccctgctagaag

SEQ ID NO: 8016185 - DNA, 22 bp, Homo sapiens
tgtcctgggtcaaccaggtcga

SEQ ID NO: 8016186 - DNA, 22 bp, Homo sapiens
tgtcctgggtccctgctagaag

SEQ ID NO: 8016187 - DNA, 22 bp, Homo sapiens
tgtcctgggtccctgctagaag

SEQ ID NO: 8016188 - DNA, 22 bp, Homo sapiens
tgtcctgggtccctgctagaag

SEQ ID NO: 8016189 - DNA, 22 bp, Homo sapiens
tgtcctggtgctccaggtggct

SEQ ID NO: 8016190 - DNA, 22 bp, Homo sapiens
tgtcctggtgctccaggtggct

SEQ ID NO: 8016191 - DNA, 22 bp, Homo sapiens
tgtcctggtgctccaggtggct

SEQ ID NO: 8016192 - DNA, 22 bp, Homo sapiens
tgtcctggtgctccaggtggct

SEQ ID NO: 8016193 - DNA, 21 bp, Homo sapiens
tgtcctggtcactgctctccc

SEQ ID NO: 8016194 - DNA, 21 bp, Homo sapiens
tgtcctggtcactgctctccc

SEQ ID NO: 8016195 - DNA, 22 bp, Homo sapiens
tgtcctgtgcactgtagcatgt

SEQ ID NO: 8016196 - DNA, 22 bp, Homo sapiens
tgtcctgtgattccagctcttc

SEQ ID NO: 8016197 - DNA, 22 bp, Homo sapiens
tgtcctgtgccaccttcctgag

SEQ ID NO: 8016198 - DNA, 22 bp, Homo sapiens
tgtcctgtgtagaatgtttata

SEQ ID NO: 8016199 - DNA, 22 bp, Homo sapiens
tgtcctgtgccaccttcctgag

SEQ ID NO: 8016200 - DNA, 22 bp, Homo sapiens
tgtcctgtgccaccttcctgag

SEQ ID NO: 8016201 - DNA, 22 bp, Homo sapiens
tgtcctgtctctttcctaattg

SEQ ID NO: 8016202 - DNA, 22 bp, Homo sapiens
tgtcctgtccttcctggaagtc

SEQ ID NO: 8016203 - DNA, 19 bp, Homo sapiens
tgtcctgtcctgctctgac

SEQ ID NO: 8016204 - DNA, 19 bp, Homo sapiens
tgtcctgtcctgctctgac

SEQ ID NO: 8016205 - DNA, 19 bp, Homo sapiens
tgtcctgtcctgctctgac

SEQ ID NO: 8016206 - DNA, 22 bp, Homo sapiens
tgtcctgtacgaagccggagaa

SEQ ID NO: 8016207 - DNA, 22 bp, Homo sapiens
tgtcctgtacgaagccggagaa

SEQ ID NO: 8016208 - DNA, 22 bp, Homo sapiens
tgtcctgtaggtttatttgtgt

SEQ ID NO: 8016209 - DNA, 22 bp, Homo sapiens
tgtcctggtgcttcttgggatt

SEQ ID NO: 8016210 - DNA, 22 bp, Homo sapiens
tgtcctggtgcttcttgggatt

SEQ ID NO: 8016211 - DNA, 22 bp, Homo sapiens
tgtcctggtgctccaggtggct

SEQ ID NO: 8016212 - DNA, 22 bp, Homo sapiens
tgtcctggtgcttcttgggatt

SEQ ID NO: 8016213 - DNA, 22 bp, Homo sapiens
tgtcctggtgcttcttgggatt

SEQ ID NO: 8016214 - DNA, 22 bp, Homo sapiens
tgtcctggtgctccaggtggct

SEQ ID NO: 8016215 - DNA, 22 bp, Homo sapiens
tgtcctggtgctccaggtggct

SEQ ID NO: 8016216 - DNA, 22 bp, Homo sapiens
tgtcctttttcttaggaaatat

SEQ ID NO: 8016217 - DNA, 22 bp, Homo sapiens
tgtccttttggctgtctatggt

SEQ ID NO: 8016218 - DNA, 22 bp, Homo sapiens
tgtccttttccccaaattcact

SEQ ID NO: 8016219 - DNA, 22 bp, Homo sapiens
tgtccttttccccaaattcact

SEQ ID NO: 8016220 - DNA, 22 bp, Homo sapiens
tgtccttgttcctaatgtaaaa

SEQ ID NO: 8016221 - DNA, 22 bp, Homo sapiens
tgtcctttgtgtatctatagta

SEQ ID NO: 8016222 - DNA, 22 bp, Homo sapiens
tgtcctttgttccctgtctctg

SEQ ID NO: 8016223 - DNA, 22 bp, Homo sapiens
tgtcctttgtgtatctatagta

SEQ ID NO: 8016224 - DNA, 22 bp, Homo sapiens
tgtcctttgggagggcacagct

SEQ ID NO: 8016225 - DNA, 22 bp, Homo sapiens
tgtccttgatgaatatgaaatt

SEQ ID NO: 8016226 - DNA, 22 bp, Homo sapiens
tgtccttatctccaaacaatca

SEQ ID NO: 8016227 - DNA, 22 bp, Homo sapiens
tgtcctgttcttgctgtgtcct

SEQ ID NO: 8016228 - DNA, 22 bp, Homo sapiens
tgtcctgttcttgctgtgtcct

SEQ ID NO: 8016229 - DNA, 22 bp, Homo sapiens
tgtcctgttcatggctctggac

SEQ ID NO: 8016230 - DNA, 22 bp, Homo sapiens
tgtcctgttctggcgtgagtgg

SEQ ID NO: 8016231 - DNA, 22 bp, Homo sapiens
tgtcctgtgtctaggggtcttc

SEQ ID NO: 8016232 - DNA, 22 bp, Homo sapiens
tgtcctgttatatgttgggtag

SEQ ID NO: 8016233 - DNA, 22 bp, Homo sapiens
tgtcctgttcatggctctggac

SEQ ID NO: 8016234 - DNA, 21 bp, Homo sapiens
tgtatacacacatatatgtac

SEQ ID NO: 8016235 - DNA, 22 bp, Homo sapiens
tgtatacaattcacacttccca

SEQ ID NO: 8016236 - DNA, 19 bp, Homo sapiens
tgtataagaatgtatctgt

SEQ ID NO: 8016237 - DNA, 23 bp, Homo sapiens
tgtatacaccctgtgcatctggg

SEQ ID NO: 8016238 - DNA, 23 bp, Homo sapiens
tgtatacaccctgtgcatctggg

SEQ ID NO: 8016239 - DNA, 21 bp, Homo sapiens
tgtatacacacatatatgtac

SEQ ID NO: 8016240 - DNA, 22 bp, Homo sapiens
tgtatacactatgctatatggt

SEQ ID NO: 8016241 - DNA, 22 bp, Homo sapiens
tgtatacactatgctatatggt

SEQ ID NO: 8016242 - DNA, 22 bp, Homo sapiens
tgtatacactatgctatatggt

SEQ ID NO: 8016243 - DNA, 22 bp, Homo sapiens
tgtataacacgcagttgagagg

SEQ ID NO: 8016244 - DNA, 22 bp, Homo sapiens
tgtataaatttaaattcctgct

SEQ ID NO: 8016245 - DNA, 22 bp, Homo sapiens
tgtataaatttaaattcctgct

SEQ ID NO: 8016246 - DNA, 22 bp, Homo sapiens
tgtataaacttaagcaggaacc

SEQ ID NO: 8016247 - DNA, 22 bp, Homo sapiens
tgtataaacttaagcaggaacc

SEQ ID NO: 8016248 - DNA, 22 bp, Homo sapiens
tgtataaacttaagcaggaacc

SEQ ID NO: 8016249 - DNA, 22 bp, Homo sapiens
tgtataaacttaagcaggaacc

SEQ ID NO: 8016250 - DNA, 22 bp, Homo sapiens
tgtataaatttaaattcctgct

SEQ ID NO: 8016251 - DNA, 22 bp, Homo sapiens
tgtatacatttaactagataga

SEQ ID NO: 8016252 - DNA, 22 bp, Homo sapiens
tgtatacatgtgttcatgcatg

SEQ ID NO: 8016253 - DNA, 22 bp, Homo sapiens
tgtatacatgtgttcatgcatg

SEQ ID NO: 8016254 - DNA, 22 bp, Homo sapiens
tgtatacatgtctgtgtgcaca

SEQ ID NO: 8016255 - DNA, 22 bp, Homo sapiens
tgtatacaggcataagagatac

SEQ ID NO: 8016256 - DNA, 22 bp, Homo sapiens
tgtatacatacatatgtgtgtg

SEQ ID NO: 8016257 - DNA, 22 bp, Homo sapiens
tgtatacatttggtgcatattt

SEQ ID NO: 8016258 - DNA, 22 bp, Homo sapiens
tgtatacatttggtgcatattt

SEQ ID NO: 8016259 - DNA, 22 bp, Homo sapiens
tgtatagagttggaagatgact

SEQ ID NO: 8016260 - DNA, 22 bp, Homo sapiens
tgtatagagttggaagatgact

SEQ ID NO: 8016261 - DNA, 22 bp, Homo sapiens
tgtatacattctcttgggtttg

SEQ ID NO: 8016262 - DNA, 22 bp, Homo sapiens
tgtatacatttaactagataga

SEQ ID NO: 8016263 - DNA, 22 bp, Homo sapiens
tgtatacatttggtgcatattt

SEQ ID NO: 8016264 - DNA, 22 bp, Homo sapiens
tgtatacatttggtgcatattt

SEQ ID NO: 8016265 - DNA, 22 bp, Homo sapiens
tgtatataagcatttacttgtt

SEQ ID NO: 8016266 - DNA, 22 bp, Homo sapiens
tgtatatacatacacacatgaa

SEQ ID NO: 8016267 - DNA, 22 bp, Homo sapiens
tgtatagatgaggaagctgtta

SEQ ID NO: 8016268 - DNA, 22 bp, Homo sapiens
tgtatatatttctttcattcta

SEQ ID NO: 8016269 - DNA, 22 bp, Homo sapiens
tgtatatgagtctgagtgtaca

SEQ ID NO: 8016270 - DNA, 22 bp, Homo sapiens
tgtatatatttctttcattcta

SEQ ID NO: 8016271 - DNA, 22 bp, Homo sapiens
tgtatatacatacacacatgaa

SEQ ID NO: 8016272 - DNA, 22 bp, Homo sapiens
tgtatatgtgatgtacatgtac

SEQ ID NO: 8016273 - DNA, 22 bp, Homo sapiens
tgtatatgtgatgtacatgtac

SEQ ID NO: 8016274 - DNA, 22 bp, Homo sapiens
tgtatattctgcctaaaagctt

SEQ ID NO: 8016275 - DNA, 20 bp, Homo sapiens
tgtatattttctggtgtaaa

SEQ ID NO: 8016276 - DNA, 22 bp, Homo sapiens
tgtatattgcctgagtctttcc

SEQ ID NO: 8016277 - DNA, 22 bp, Homo sapiens
tgtatattgcctgagtctttcc

SEQ ID NO: 8016278 - DNA, 22 bp, Homo sapiens
tgtatattgcctgagtctttcc

SEQ ID NO: 8016279 - DNA, 22 bp, Homo sapiens
tgtatcaaaccaaattaattct

SEQ ID NO: 8016280 - DNA, 22 bp, Homo sapiens
tgtatcaaaccaaattaattct

SEQ ID NO: 8016281 - DNA, 22 bp, Homo sapiens
tgtatcaagggtttatgtaagc

SEQ ID NO: 8016282 - DNA, 22 bp, Homo sapiens
tgtatcaagatcagcagctgtt

SEQ ID NO: 8016283 - DNA, 22 bp, Homo sapiens
tgtatcaagggtttatgtaagc

SEQ ID NO: 8016284 - DNA, 22 bp, Homo sapiens
tgtatgaacctttaatatagtg

SEQ ID NO: 8016285 - DNA, 22 bp, Homo sapiens
tgtatgaacctttaatatagtg

SEQ ID NO: 8016286 - DNA, 22 bp, Homo sapiens
tgtatgaaaaggaatagattga

SEQ ID NO: 8016287 - DNA, 22 bp, Homo sapiens
tgtatcttcagtttgtctttcc

SEQ ID NO: 8016288 - DNA, 22 bp, Homo sapiens
tgtatcttcagtttgtctttcc

SEQ ID NO: 8016289 - DNA, 22 bp, Homo sapiens
tgtatcttagtgtgaaaatatt

SEQ ID NO: 8016290 - DNA, 22 bp, Homo sapiens
tgtatcccctgcaggttgctat

SEQ ID NO: 8016291 - DNA, 22 bp, Homo sapiens
tgtatccatggtggtcaatgac

SEQ ID NO: 8016292 - DNA, 22 bp, Homo sapiens
tgtatctgtaatcccagatcaa

SEQ ID NO: 8016293 - DNA, 22 bp, Homo sapiens
tgtatctgtgatgtaggggttt

SEQ ID NO: 8016294 - DNA, 22 bp, Homo sapiens
tgtatcacatgactctgcacta

SEQ ID NO: 8016295 - DNA, 22 bp, Homo sapiens
tgtatcaatcatgtaatttggt

SEQ ID NO: 8016296 - DNA, 22 bp, Homo sapiens
tgtatgcaaatttattagcaca

SEQ ID NO: 8016297 - DNA, 22 bp, Homo sapiens
tgtatgcaaatttattagcaca

SEQ ID NO: 8016298 - DNA, 22 bp, Homo sapiens
tgtatgcaataataactatgtg

SEQ ID NO: 8016299 - DNA, 22 bp, Homo sapiens
tgtatgaatgggaaaaggaaac

SEQ ID NO: 8016300 - DNA, 22 bp, Homo sapiens
tgtatgaggcatacatcaggca

SEQ ID NO: 8016301 - DNA, 22 bp, Homo sapiens
tgtatgaatgggaaaaggaaac

SEQ ID NO: 8016302 - DNA, 22 bp, Homo sapiens
tgtatgaatctcatttgtttaa

SEQ ID NO: 8016303 - DNA, 22 bp, Homo sapiens
tgtatgaatatgttggggaggt

SEQ ID NO: 8016304 - DNA, 22 bp, Homo sapiens
tgtatgaatatgtattttcata

SEQ ID NO: 8016305 - DNA, 23 bp, Homo sapiens
tgtatgaatatgccacagtttaa

SEQ ID NO: 8016306 - DNA, 23 bp, Homo sapiens
tgtatgaatatgccacagtttaa

SEQ ID NO: 8016307 - DNA, 22 bp, Homo sapiens
tgtatgaagttactgagcctct

SEQ ID NO: 8016308 - DNA, 22 bp, Homo sapiens
tgtatgaagacttcttctgtgt

SEQ ID NO: 8016309 - DNA, 22 bp, Homo sapiens
tgtatgaaagaacaagggctta

SEQ ID NO: 8016310 - DNA, 16 bp, Homo sapiens
tgtatgaacgtctcca

SEQ ID NO: 8016311 - DNA, 22 bp, Homo sapiens
tgtatgaagccagaatctgttt

SEQ ID NO: 8016312 - DNA, 22 bp, Homo sapiens
tgtatgaaggtttacctgctgt

SEQ ID NO: 8016313 - DNA, 22 bp, Homo sapiens
tgtatgaaggtttacctgctgt

SEQ ID NO: 8016314 - DNA, 17 bp, Homo sapiens
tgtagcttctccttctc

SEQ ID NO: 8016315 - DNA, 22 bp, Homo sapiens
tgtaggaaaaacaatgatctgc

SEQ ID NO: 8016316 - DNA, 17 bp, Homo sapiens
tgtagcttctccttctc

SEQ ID NO: 8016317 - DNA, 22 bp, Homo sapiens
tgtaggaaaaacaatgatctgc

SEQ ID NO: 8016318 - DNA, 22 bp, Homo sapiens
tgtaggaaaaacaatgatctgc

SEQ ID NO: 8016319 - DNA, 22 bp, Homo sapiens
tgtaggaaagttgtgagtctgg

SEQ ID NO: 8016320 - DNA, 22 bp, Homo sapiens
tgtaggaatggattctagaagg

SEQ ID NO: 8016321 - DNA, 22 bp, Homo sapiens
tgtagctctccagccagcaagg

SEQ ID NO: 8016322 - DNA, 18 bp, Homo sapiens
tgtagctggaggccaggc

SEQ ID NO: 8016323 - DNA, 22 bp, Homo sapiens
tgtagctctccagccagcaagg

SEQ ID NO: 8016324 - DNA, 23 bp, Homo sapiens
tgtagctgtctgagcagacactg

SEQ ID NO: 8016325 - DNA, 18 bp, Homo sapiens
tgtagctggaggccaggc

SEQ ID NO: 8016326 - DNA, 18 bp, Homo sapiens
tgtagctggaggccaggc

SEQ ID NO: 8016327 - DNA, 22 bp, Homo sapiens
tgtagccaagattggagatcgt

SEQ ID NO: 8016328 - DNA, 22 bp, Homo sapiens
tgtagccagaagtcatagggtg

SEQ ID NO: 8016329 - DNA, 22 bp, Homo sapiens
tgtagccagattgataatttga

SEQ ID NO: 8016330 - DNA, 20 bp, Homo sapiens
tgtagccagcctctcaatgc

SEQ ID NO: 8016331 - DNA, 22 bp, Homo sapiens
tgtagccaccaggctggatctg

SEQ ID NO: 8016332 - DNA, 22 bp, Homo sapiens
tgtagccagaagtcatagggtg

SEQ ID NO: 8016333 - DNA, 22 bp, Homo sapiens
tgtagatatagaaaaagactga

SEQ ID NO: 8016334 - DNA, 22 bp, Homo sapiens
tgtagatattaattattccttt

SEQ ID NO: 8016335 - DNA, 22 bp, Homo sapiens
tgtagatatagaaaaagactga

SEQ ID NO: 8016336 - DNA, 22 bp, Homo sapiens
tgtagatgtagacacaggtcta

SEQ ID NO: 8016337 - DNA, 22 bp, Homo sapiens
tgtagatgagtcagggtgcatg

SEQ ID NO: 8016338 - DNA, 22 bp, Homo sapiens
tgtagatgagtcagggtgcatg

SEQ ID NO: 8016339 - DNA, 22 bp, Homo sapiens
tgtagatgagtcagggtgcacc

SEQ ID NO: 8016340 - DNA, 22 bp, Homo sapiens
tgtagatgagtcagggtgcacc

SEQ ID NO: 8016341 - DNA, 22 bp, Homo sapiens
tgtagactttctttgtgttagt

SEQ ID NO: 8016342 - DNA, 18 bp, Homo sapiens
tgtagagccaggtttgcc

SEQ ID NO: 8016343 - DNA, 22 bp, Homo sapiens
tgtagatagtgatttatgacca

SEQ ID NO: 8016344 - DNA, 22 bp, Homo sapiens
tgtagataagtaaaagcccagt

SEQ ID NO: 8016345 - DNA, 22 bp, Homo sapiens
tgtagatacacacatatagtgg

SEQ ID NO: 8016346 - DNA, 19 bp, Homo sapiens
tgtagcagtttaaaacaac

SEQ ID NO: 8016347 - DNA, 19 bp, Homo sapiens
tgtagcagtttaaaacaac

SEQ ID NO: 8016348 - DNA, 22 bp, Homo sapiens
tgtagcagtgtctaccacatta

SEQ ID NO: 8016349 - DNA, 22 bp, Homo sapiens
tgtagcactatgcactacacat

SEQ ID NO: 8016350 - DNA, 22 bp, Homo sapiens
tgtagattttggagtctacaag

SEQ ID NO: 8016351 - DNA, 22 bp, Homo sapiens
tgtagcaagagcaatccattgt

SEQ ID NO: 8016352 - DNA, 22 bp, Homo sapiens
tgtagcaagagcaatccattgt

SEQ ID NO: 8016353 - DNA, 22 bp, Homo sapiens
tgtagcacaagatagatacttc

SEQ ID NO: 8016354 - DNA, 22 bp, Homo sapiens
tgtagcacactcataatctttc

SEQ ID NO: 8016355 - DNA, 22 bp, Homo sapiens
tgtagcacatgcattagagtgt

SEQ ID NO: 8016356 - DNA, 22 bp, Homo sapiens
tgtagaaagaatatgtttcata

SEQ ID NO: 8016357 - DNA, 22 bp, Homo sapiens
tgtagaaagctcttctgaaatc

SEQ ID NO: 8016358 - DNA, 22 bp, Homo sapiens
tgtagaaattagtaagatcaac

SEQ ID NO: 8016359 - DNA, 22 bp, Homo sapiens
tgtagaaattagtaagatcaac

SEQ ID NO: 8016360 - DNA, 22 bp, Homo sapiens
tgtagaaattagtaagatcaac

SEQ ID NO: 8016361 - DNA, 22 bp, Homo sapiens
tgtagaaattagtaagatcaac

SEQ ID NO: 8016362 - DNA, 22 bp, Homo sapiens
tgtagaagctagcctggagcca

SEQ ID NO: 8016363 - DNA, 22 bp, Homo sapiens
tgtagaacctgtttattataga

SEQ ID NO: 8016364 - DNA, 22 bp, Homo sapiens
tgtagaactgacattttggact

SEQ ID NO: 8016365 - DNA, 22 bp, Homo sapiens
tgtagaagtaggagtcatctca

SEQ ID NO: 8016366 - DNA, 22 bp, Homo sapiens
tgtagaagtaggagtcatctca

SEQ ID NO: 8016367 - DNA, 22 bp, Homo sapiens
tgtagaagttcttcaggagaat

SEQ ID NO: 8016368 - DNA, 22 bp, Homo sapiens
tgtagaagtttatgaacacatt

SEQ ID NO: 8016369 - DNA, 22 bp, Homo sapiens
tgtagaagttcttcaggagaat

SEQ ID NO: 8016370 - DNA, 18 bp, Homo sapiens
tgtagacagggcatggaa

SEQ ID NO: 8016371 - DNA, 22 bp, Homo sapiens
tgtagacaggatctagttaaaa

SEQ ID NO: 8016372 - DNA, 22 bp, Homo sapiens
tgtagacagtgggatctctggg

SEQ ID NO: 8016373 - DNA, 22 bp, Homo sapiens
tgtagacatgaccattaacatt

SEQ ID NO: 8016374 - DNA, 22 bp, Homo sapiens
tgtagactttctttgtgttagt

SEQ ID NO: 8016375 - DNA, 22 bp, Homo sapiens
tgtagacatgcttttctgatga

SEQ ID NO: 8016376 - DNA, 18 bp, Homo sapiens
tgtagagccaggtttgcc

SEQ ID NO: 8016377 - DNA, 22 bp, Homo sapiens
tgtagaaaattggagcattcat

SEQ ID NO: 8016378 - DNA, 22 bp, Homo sapiens
tgtagaaaattggagcattcat

SEQ ID NO: 8016379 - DNA, 22 bp, Homo sapiens
tgtagaaactacacatgcaaca

SEQ ID NO: 8016380 - DNA, 22 bp, Homo sapiens
tgtagaaactacacatgcaaca

SEQ ID NO: 8016381 - DNA, 22 bp, Homo sapiens
tgtagaaagaatatgtttcata

SEQ ID NO: 8016382 - DNA, 22 bp, Homo sapiens
tgtagaaagaatatgtttcata

SEQ ID NO: 8016383 - DNA, 22 bp, Homo sapiens
tgtagaaactacacatgcaaca

SEQ ID NO: 8016384 - DNA, 22 bp, Homo sapiens
tgtagaaactacacatgcaaca

SEQ ID NO: 8016385 - DNA, 18 bp, Homo sapiens
tgtagaaaagataggaat

SEQ ID NO: 8016386 - DNA, 18 bp, Homo sapiens
tgtagaaaagataggaat

SEQ ID NO: 8016387 - DNA, 22 bp, Homo sapiens
tgtacttgcttattagaaatct

SEQ ID NO: 8016388 - DNA, 22 bp, Homo sapiens
tgtacttgcttattagaaatct

SEQ ID NO: 8016389 - DNA, 18 bp, Homo sapiens
tgtagaaaagataggaat

SEQ ID NO: 8016390 - DNA, 22 bp, Homo sapiens
tgtagaaaattggagcattcat

SEQ ID NO: 8016391 - DNA, 22 bp, Homo sapiens
tgtagaaaattggagcattcat

SEQ ID NO: 8016392 - DNA, 18 bp, Homo sapiens
tgtagaaaagataggaat

SEQ ID NO: 8016393 - DNA, 22 bp, Homo sapiens
tgtacttgaacttgactgtaga

SEQ ID NO: 8016394 - DNA, 22 bp, Homo sapiens
tgtacttgaacttgactgtaga

SEQ ID NO: 8016395 - DNA, 22 bp, Homo sapiens
tgtactgtattcatctttaact

SEQ ID NO: 8016396 - DNA, 22 bp, Homo sapiens
tgtacttattttatgtcagcac

SEQ ID NO: 8016397 - DNA, 22 bp, Homo sapiens
tgtactgtattcatctttaact

SEQ ID NO: 8016398 - DNA, 22 bp, Homo sapiens
tgtactacatgattattgacca

SEQ ID NO: 8016399 - DNA, 22 bp, Homo sapiens
tgtactaatgcatttaactaac

SEQ ID NO: 8016400 - DNA, 22 bp, Homo sapiens
tgtactaatgcatttaactaac

SEQ ID NO: 8016401 - DNA, 22 bp, Homo sapiens
tgtactaatgcatttaactaac

SEQ ID NO: 8016402 - DNA, 22 bp, Homo sapiens
tgtactaaggctgtgtagatgt

SEQ ID NO: 8016403 - DNA, 22 bp, Homo sapiens
tgtactaaggctgtgtagatgt

SEQ ID NO: 8016404 - DNA, 19 bp, Homo sapiens
tgtacgtgtgggtgtttaa

SEQ ID NO: 8016405 - DNA, 20 bp, Homo sapiens
tgtactgcttgataaatggt

SEQ ID NO: 8016406 - DNA, 22 bp, Homo sapiens
tgtactgtatcattgcaacttt

SEQ ID NO: 8016407 - DNA, 22 bp, Homo sapiens
tgtactgtatgccaggcactat

SEQ ID NO: 8016408 - DNA, 22 bp, Homo sapiens
tgtcacatgacacaaatatcta

SEQ ID NO: 8016409 - DNA, 22 bp, Homo sapiens
tgtcacatgtttaatgtggact

SEQ ID NO: 8016410 - DNA, 22 bp, Homo sapiens
tgtcacattgaatatgatttat

SEQ ID NO: 8016411 - DNA, 22 bp, Homo sapiens
tgtcacattctgatgtgaggtg

SEQ ID NO: 8016412 - DNA, 22 bp, Homo sapiens
tgtcacattgaatatgatttat

SEQ ID NO: 8016413 - DNA, 22 bp, Homo sapiens
tgtcacattatatgtgaggata

SEQ ID NO: 8016414 - DNA, 22 bp, Homo sapiens
tgtcacattgaatatgatttat

SEQ ID NO: 8016415 - DNA, 22 bp, Homo sapiens
tgtcaccaagttgatgaatgca

SEQ ID NO: 8016416 - DNA, 22 bp, Homo sapiens
tgtcaccaccggaagaaactgc

SEQ ID NO: 8016417 - DNA, 22 bp, Homo sapiens
tgtcaccactggctgaaacacc

SEQ ID NO: 8016418 - DNA, 22 bp, Homo sapiens
tgtcaccatgccagcttctgcc

SEQ ID NO: 8016419 - DNA, 22 bp, Homo sapiens
tgtcaccatgccagcttctgcc

SEQ ID NO: 8016420 - DNA, 22 bp, Homo sapiens
tgtcaccatgcgaggctaattt

SEQ ID NO: 8016421 - DNA, 22 bp, Homo sapiens
tgtcacatgaagccaacatagc

SEQ ID NO: 8016422 - DNA, 22 bp, Homo sapiens
tgtcacatgaagccaacatagc

SEQ ID NO: 8016423 - DNA, 22 bp, Homo sapiens
tgtcacatgaaacttgctcatc

SEQ ID NO: 8016424 - DNA, 22 bp, Homo sapiens
tgtcacatgaaacttgctcatc

SEQ ID NO: 8016425 - DNA, 22 bp, Homo sapiens
tgtcacatatataatgttcaat

SEQ ID NO: 8016426 - DNA, 22 bp, Homo sapiens
tgtcacatatataatgttcaat

SEQ ID NO: 8016427 - DNA, 22 bp, Homo sapiens
tgtcacataggcaaaatgtttt

SEQ ID NO: 8016428 - DNA, 22 bp, Homo sapiens
tgtcacataatttatctgtagg

SEQ ID NO: 8016429 - DNA, 22 bp, Homo sapiens
tgtcacagagcgtgcaacagaa

SEQ ID NO: 8016430 - DNA, 22 bp, Homo sapiens
tgtcacagagcgtgcaacagaa

SEQ ID NO: 8016431 - DNA, 22 bp, Homo sapiens
tgtcacagagcgtgcaacagaa

SEQ ID NO: 8016432 - DNA, 22 bp, Homo sapiens
tgtcacagatcgtttttgagct

SEQ ID NO: 8016433 - DNA, 22 bp, Homo sapiens
tgtcacagatcgtttttgagct

SEQ ID NO: 8016434 - DNA, 21 bp, Homo sapiens
tgtcacagattctcagcttgc

SEQ ID NO: 8016435 - DNA, 22 bp, Homo sapiens
tgtcacagggataccatggggc

SEQ ID NO: 8016436 - DNA, 22 bp, Homo sapiens
tgtcacagggataccatggggc

SEQ ID NO: 8016437 - DNA, 22 bp, Homo sapiens
tgtcacagtctcgtgagcatct

SEQ ID NO: 8016438 - DNA, 22 bp, Homo sapiens
tgtcacagtctcgtgagcatct

SEQ ID NO: 8016439 - DNA, 22 bp, Homo sapiens
tgtcacagtctcgtgagcatct

SEQ ID NO: 8016440 - DNA, 22 bp, Homo sapiens
tgtcacagtgcacagctaagaa

SEQ ID NO: 8016441 - DNA, 22 bp, Homo sapiens
tgtcacagtttgtactttatag

SEQ ID NO: 8016442 - DNA, 22 bp, Homo sapiens
tgtcaaaaataagagagattgt

SEQ ID NO: 8016443 - DNA, 22 bp, Homo sapiens
tgtcaaaaataagagagattgt

SEQ ID NO: 8016444 - DNA, 22 bp, Homo sapiens
tgtatttttaggaatgcgctat

SEQ ID NO: 8016445 - DNA, 22 bp, Homo sapiens
tgtcaaaaccagcaattttgtt

SEQ ID NO: 8016446 - DNA, 22 bp, Homo sapiens
tgtcaaaaccagcaattttgtt

SEQ ID NO: 8016447 - DNA, 22 bp, Homo sapiens
tgtcaaaaccttggaggcaagg

SEQ ID NO: 8016448 - DNA, 22 bp, Homo sapiens
tgtcaaaaccttggaggcaagg

SEQ ID NO: 8016449 - DNA, 22 bp, Homo sapiens
tgtcaaaatgactttactacag

SEQ ID NO: 8016450 - DNA, 22 bp, Homo sapiens
tgtcaaaatgactttactacag

SEQ ID NO: 8016451 - DNA, 22 bp, Homo sapiens
tgtcaaagacagaaggaaatgg

SEQ ID NO: 8016452 - DNA, 22 bp, Homo sapiens
tgtcaaagcaaggattaaatgt

SEQ ID NO: 8016453 - DNA, 22 bp, Homo sapiens
tgtcaaactgtgacttctaatg

SEQ ID NO: 8016454 - DNA, 22 bp, Homo sapiens
tgtcaaagcaaggattaaatgt

SEQ ID NO: 8016455 - DNA, 22 bp, Homo sapiens
tgtatttttagacctttagacc

SEQ ID NO: 8016456 - DNA, 22 bp, Homo sapiens
tgtatttttagacctttagacc

SEQ ID NO: 8016457 - DNA, 22 bp, Homo sapiens
tgtatttttagacctttagacc

SEQ ID NO: 8016458 - DNA, 22 bp, Homo sapiens
tgtatttttagacctttagacc

SEQ ID NO: 8016459 - DNA, 22 bp, Homo sapiens
tgtcaaaaataagagagattgt

SEQ ID NO: 8016460 - DNA, 22 bp, Homo sapiens
tgtcaaaaagctgggacaagca

SEQ ID NO: 8016461 - DNA, 22 bp, Homo sapiens
tgtcaaaaagctgggacaagca

SEQ ID NO: 8016462 - DNA, 22 bp, Homo sapiens
tgtatttttagacctttagacc

SEQ ID NO: 8016463 - DNA, 22 bp, Homo sapiens
tgtatttttagacctttagacc

SEQ ID NO: 8016464 - DNA, 22 bp, Homo sapiens
tgtcacaaaaatcagtaattgc

SEQ ID NO: 8016465 - DNA, 22 bp, Homo sapiens
tgtcacaaaaatcagtaattgc

SEQ ID NO: 8016466 - DNA, 22 bp, Homo sapiens
tgtcaatgtgtacaggagctca

SEQ ID NO: 8016467 - DNA, 22 bp, Homo sapiens
tgtcacaaacatacattataga

SEQ ID NO: 8016468 - DNA, 22 bp, Homo sapiens
tgtcacaaaaatcagtaattgc

SEQ ID NO: 8016469 - DNA, 22 bp, Homo sapiens
tgtcacaaacatacattataga

SEQ ID NO: 8016470 - DNA, 22 bp, Homo sapiens
tgtcacaaacatacattataga

SEQ ID NO: 8016471 - DNA, 22 bp, Homo sapiens
tgtcaaagcctgaatcacatag

SEQ ID NO: 8016472 - DNA, 22 bp, Homo sapiens
tgtcaatgaagatatgaataat

SEQ ID NO: 8016473 - DNA, 22 bp, Homo sapiens
tgtcaatgaagatatgaataat

SEQ ID NO: 8016474 - DNA, 22 bp, Homo sapiens
tgtcaatgtgtacaggagctca

SEQ ID NO: 8016475 - DNA, 22 bp, Homo sapiens
tgtcacaacagaggaactgaat

SEQ ID NO: 8016476 - DNA, 22 bp, Homo sapiens
tgtcacaagtaactggcaatgc

SEQ ID NO: 8016477 - DNA, 22 bp, Homo sapiens
tgtcacaagtaactggcaatgc

SEQ ID NO: 8016478 - DNA, 22 bp, Homo sapiens
tgtcacacctcgtttagcattc

SEQ ID NO: 8016479 - DNA, 22 bp, Homo sapiens
tgtcacagagcgtgcaacagaa

SEQ ID NO: 8016480 - DNA, 22 bp, Homo sapiens
tgtcacagagcgtgcaacagaa

SEQ ID NO: 8016481 - DNA, 22 bp, Homo sapiens
tgtcacacctcgtttagcattc

SEQ ID NO: 8016482 - DNA, 22 bp, Homo sapiens
tgtcacactgaccacatctgta

SEQ ID NO: 8016483 - DNA, 22 bp, Homo sapiens
tgtcacacttggtggttttggt

SEQ ID NO: 8016484 - DNA, 22 bp, Homo sapiens
tgtatttaattgtatcatcaca

SEQ ID NO: 8016485 - DNA, 22 bp, Homo sapiens
tgtatttaattgtatcatcaca

SEQ ID NO: 8016486 - DNA, 22 bp, Homo sapiens
tgtatttaattgtatcatcaca

SEQ ID NO: 8016487 - DNA, 22 bp, Homo sapiens
tgtatttaattgtatcatcaca

SEQ ID NO: 8016488 - DNA, 20 bp, Homo sapiens
tgtatttaatgaaggctttt

SEQ ID NO: 8016489 - DNA, 22 bp, Homo sapiens
tgtatttatattagaatggttg

SEQ ID NO: 8016490 - DNA, 22 bp, Homo sapiens
tgtatttagtccagtctctcat

SEQ ID NO: 8016491 - DNA, 22 bp, Homo sapiens
tgtatttatattagaatggttg

SEQ ID NO: 8016492 - DNA, 22 bp, Homo sapiens
tgtatttaattgtatcatcaca

SEQ ID NO: 8016493 - DNA, 22 bp, Homo sapiens
tgtattgttataatttgtatgt

SEQ ID NO: 8016494 - DNA, 22 bp, Homo sapiens
tgtatttaagctttacctaaaa

SEQ ID NO: 8016495 - DNA, 23 bp, Homo sapiens
tgtattgaaggtgtagtttgtag

SEQ ID NO: 8016496 - DNA, 22 bp, Homo sapiens
tgtattgaggattcatttttgt

SEQ ID NO: 8016497 - DNA, 22 bp, Homo sapiens
tgtatttaagctttacctaaaa

SEQ ID NO: 8016498 - DNA, 22 bp, Homo sapiens
tgtatttaagctttacctaaaa

SEQ ID NO: 8016499 - DNA, 20 bp, Homo sapiens
tgtattgttattgggacaga

SEQ ID NO: 8016500 - DNA, 22 bp, Homo sapiens
tgtatttaagctttacctaaaa

SEQ ID NO: 8016501 - DNA, 22 bp, Homo sapiens
tgtatgtatacactgatcatca

SEQ ID NO: 8016502 - DNA, 22 bp, Homo sapiens
tgtattcttagttttaatcaga

SEQ ID NO: 8016503 - DNA, 22 bp, Homo sapiens
tgtattcttagttttaatcaga

SEQ ID NO: 8016504 - DNA, 22 bp, Homo sapiens
tgtatgctttccttctttctgg

SEQ ID NO: 8016505 - DNA, 22 bp, Homo sapiens
tgtatgtaaagtttgtaataga

SEQ ID NO: 8016506 - DNA, 22 bp, Homo sapiens
tgtatgcataaaattatttaca

SEQ ID NO: 8016507 - DNA, 17 bp, Homo sapiens
tgtatgcatatgctttt

SEQ ID NO: 8016508 - DNA, 17 bp, Homo sapiens
tgtatgcataaaattta

SEQ ID NO: 8016509 - DNA, 17 bp, Homo sapiens
tgtatgcatatgctttt

SEQ ID NO: 8016510 - DNA, 22 bp, Homo sapiens
tgtatgcatctttgataaatag

SEQ ID NO: 8016511 - DNA, 22 bp, Homo sapiens
tgtatgcaccattgtattacct

SEQ ID NO: 8016512 - DNA, 22 bp, Homo sapiens
tgtatgcagggcttgtatgcag

SEQ ID NO: 8016513 - DNA, 22 bp, Homo sapiens
tgtatgcagcaaaacaattagt

SEQ ID NO: 8016514 - DNA, 22 bp, Homo sapiens
tgtatgcaccattgtattacct

SEQ ID NO: 8016515 - DNA, 22 bp, Homo sapiens
tgtatgcaccattgtattacct

SEQ ID NO: 8016516 - DNA, 22 bp, Homo sapiens
tgtatgcacatatataggtaca

SEQ ID NO: 8016517 - DNA, 22 bp, Homo sapiens
tgtatttggtgtatttaatgag

SEQ ID NO: 8016518 - DNA, 22 bp, Homo sapiens
tgtatttgggtcacaagatggg

SEQ ID NO: 8016519 - DNA, 22 bp, Homo sapiens
tgtatttgggtcacaagatggg

SEQ ID NO: 8016520 - DNA, 22 bp, Homo sapiens
tgtatttgatgagaggagggtc

SEQ ID NO: 8016521 - DNA, 22 bp, Homo sapiens
tgtatttgagttatgaaagaga

SEQ ID NO: 8016522 - DNA, 22 bp, Homo sapiens
tgtatttgatgagaggagggtc

SEQ ID NO: 8016523 - DNA, 22 bp, Homo sapiens
tgtatttgtgataacgacctga

SEQ ID NO: 8016524 - DNA, 22 bp, Homo sapiens
tgtatttgttgttaaatggaga

SEQ ID NO: 8016525 - DNA, 17 bp, Homo sapiens
tgtatttgtaccacagc

SEQ ID NO: 8016526 - DNA, 22 bp, Homo sapiens
tgtatttgtgataacgacctga

SEQ ID NO: 8016527 - DNA, 22 bp, Homo sapiens
tgtatttggtgtatttaatgag

SEQ ID NO: 8016528 - DNA, 22 bp, Homo sapiens
tgtatttgggtcacaagatggg

SEQ ID NO: 8016529 - DNA, 22 bp, Homo sapiens
tgtatttggtgtatttaatgag

SEQ ID NO: 8016530 - DNA, 22 bp, Homo sapiens
tgtatttgagttatgaaagaga

SEQ ID NO: 8016531 - DNA, 22 bp, Homo sapiens
tgtatttgaaacagtgcatggg

SEQ ID NO: 8016532 - DNA, 22 bp, Homo sapiens
tgtatttctgctttctctagta

SEQ ID NO: 8016533 - DNA, 18 bp, Homo sapiens
tgtatttctaacagctaa

SEQ ID NO: 8016534 - DNA, 22 bp, Homo sapiens
tgtatttcgctaggtactccct

SEQ ID NO: 8016535 - DNA, 22 bp, Homo sapiens
tgtatttcctggtttagatcaa

SEQ ID NO: 8016536 - DNA, 22 bp, Homo sapiens
tgtatttattcaggatgtaact

SEQ ID NO: 8016537 - DNA, 17 bp, Homo sapiens
tgtatttatcatgtcag

SEQ ID NO: 8016538 - DNA, 22 bp, Homo sapiens
tgtatttattcaggatgtaact

SEQ ID NO: 8016539 - DNA, 17 bp, Homo sapiens
tgtatttatcatgtcag

SEQ ID NO: 8016540 - DNA, 17 bp, Homo sapiens
tgtatttatcatgtcag

SEQ ID NO: 8016541 - DNA, 22 bp, Homo sapiens
tgtatttcctggtttagatcaa

SEQ ID NO: 8016542 - DNA, 20 bp, Homo sapiens
tgtatttcatgcattcctgg

SEQ ID NO: 8016543 - DNA, 22 bp, Homo sapiens
tgtatttattcttctggtgttt

SEQ ID NO: 8016544 - DNA, 22 bp, Homo sapiens
tgtatttattcaggatgtaact

SEQ ID NO: 8016545 - DNA, 22 bp, Homo sapiens
tgtatttattcttctggtgttt

SEQ ID NO: 8016546 - DNA, 22 bp, Homo sapiens
tgtattttgtgaggatcactct

SEQ ID NO: 8016547 - DNA, 22 bp, Homo sapiens
tgtattttgtgaggatcactct

SEQ ID NO: 8016548 - DNA, 22 bp, Homo sapiens
tgtattttgagtccaatctcct

SEQ ID NO: 8016549 - DNA, 22 bp, Homo sapiens
tgtattttgagtccaatctcct

SEQ ID NO: 8016550 - DNA, 22 bp, Homo sapiens
tgtattttgtgaggatcactct

SEQ ID NO: 8016551 - DNA, 22 bp, Homo sapiens
tgtattttcttctggaagctta

SEQ ID NO: 8016552 - DNA, 22 bp, Homo sapiens
tgtattttcttctggaagctta

SEQ ID NO: 8016553 - DNA, 22 bp, Homo sapiens
tgtattttcttctggaagctta

SEQ ID NO: 8016554 - DNA, 22 bp, Homo sapiens
tgtattttctgaggagcattag

SEQ ID NO: 8016555 - DNA, 22 bp, Homo sapiens
tgtattttctgaggagcattag

SEQ ID NO: 8016556 - DNA, 22 bp, Homo sapiens
tgtattttgagtccaatctcct

SEQ ID NO: 8016557 - DNA, 22 bp, Homo sapiens
tgtattttgagtccaatctcct

SEQ ID NO: 8016558 - DNA, 22 bp, Homo sapiens
tgtattttgagtccaatctcct

SEQ ID NO: 8016559 - DNA, 22 bp, Homo sapiens
tgtattttctgaagataatcaa

SEQ ID NO: 8016560 - DNA, 22 bp, Homo sapiens
tgtattttctgaagataatcaa

SEQ ID NO: 8016561 - DNA, 22 bp, Homo sapiens
tgtattttctgaagataatcaa

SEQ ID NO: 8016562 - DNA, 22 bp, Homo sapiens
tgtattttctgaggagcattag

SEQ ID NO: 8016563 - DNA, 22 bp, Homo sapiens
tgtattttctgaggagcattag

SEQ ID NO: 8016564 - DNA, 22 bp, Homo sapiens
tgtattttctgaggagcattag

SEQ ID NO: 8016565 - DNA, 22 bp, Homo sapiens
tgtattttctgaggagcattag

SEQ ID NO: 8016566 - DNA, 22 bp, Homo sapiens
tgtattttcagagtggcatttc

SEQ ID NO: 8016567 - DNA, 22 bp, Homo sapiens
tgtattttcagagtggcatttc

SEQ ID NO: 8016568 - DNA, 22 bp, Homo sapiens
tgtattttcagagtggcatttc

SEQ ID NO: 8016569 - DNA, 22 bp, Homo sapiens
tgtattttcagagtggcatttc

SEQ ID NO: 8016570 - DNA, 22 bp, Homo sapiens
tgggggcagccaggctgtcaag

SEQ ID NO: 8016571 - DNA, 22 bp, Homo sapiens
tgggggcagccaggctgtcaag

SEQ ID NO: 8016572 - DNA, 22 bp, Homo sapiens
tgggggcagccaggctgtcaag

SEQ ID NO: 8016573 - DNA, 22 bp, Homo sapiens
tgggggcatggaccagcctggc

SEQ ID NO: 8016574 - DNA, 22 bp, Homo sapiens
tgggggcatggaccagcctggc

SEQ ID NO: 8016575 - DNA, 22 bp, Homo sapiens
tgggggcatggaccagcctggc

SEQ ID NO: 8016576 - DNA, 22 bp, Homo sapiens
tgggggcatggaccagcctggc

SEQ ID NO: 8016577 - DNA, 22 bp, Homo sapiens
tgggggcatggaccagcctggc

SEQ ID NO: 8016578 - DNA, 22 bp, Homo sapiens
tgggggcagaggattcaggaat

SEQ ID NO: 8016579 - DNA, 22 bp, Homo sapiens
tgggggcacttcgaggtcgcct

SEQ ID NO: 8016580 - DNA, 22 bp, Homo sapiens
tgggggcagccaggctgtcaag

SEQ ID NO: 8016581 - DNA, 22 bp, Homo sapiens
tgggggcagccaggctgtcaag

SEQ ID NO: 8016582 - DNA, 22 bp, Homo sapiens
tgggggcagccaggctgtcaag

SEQ ID NO: 8016583 - DNA, 22 bp, Homo sapiens
tgggggctgagtaagatgagat

SEQ ID NO: 8016584 - DNA, 22 bp, Homo sapiens
tgggggctgagtaagatgagat

SEQ ID NO: 8016585 - DNA, 22 bp, Homo sapiens
tgggggctccaggctccaggga

SEQ ID NO: 8016586 - DNA, 17 bp, Homo sapiens
tgggggcgccagggtct

SEQ ID NO: 8016587 - DNA, 22 bp, Homo sapiens
tgggggctccaggctccaggga

SEQ ID NO: 8016588 - DNA, 22 bp, Homo sapiens
tgggggctccaggctccaggga

SEQ ID NO: 8016589 - DNA, 22 bp, Homo sapiens
tgggggctagaacccagggatt

SEQ ID NO: 8016590 - DNA, 22 bp, Homo sapiens
tgggggagccttcacagtagct

SEQ ID NO: 8016591 - DNA, 22 bp, Homo sapiens
tgggggagccttcacagtagct

SEQ ID NO: 8016592 - DNA, 22 bp, Homo sapiens
tgggggagccttcacagtagct

SEQ ID NO: 8016593 - DNA, 22 bp, Homo sapiens
tgggggagccttcacagtagct

SEQ ID NO: 8016594 - DNA, 22 bp, Homo sapiens
tgggggagccttcacagtagct

SEQ ID NO: 8016595 - DNA, 22 bp, Homo sapiens
tgggggagccttcacagtagct

SEQ ID NO: 8016596 - DNA, 22 bp, Homo sapiens
tgggggagccttcacagtagct

SEQ ID NO: 8016597 - DNA, 22 bp, Homo sapiens
tgggggagattgtgcatctcta

SEQ ID NO: 8016598 - DNA, 22 bp, Homo sapiens
tgggggagattgtgcatctcta

SEQ ID NO: 8016599 - DNA, 22 bp, Homo sapiens
tgggggagcgacagacataatt

SEQ ID NO: 8016600 - DNA, 22 bp, Homo sapiens
tgggggagctcagtccagccca

SEQ ID NO: 8016601 - DNA, 22 bp, Homo sapiens
tgggggagctcagtccagccca

SEQ ID NO: 8016602 - DNA, 22 bp, Homo sapiens
tgggggagctcagtccagccca

SEQ ID NO: 8016603 - DNA, 22 bp, Homo sapiens
tgggggagctcagtccagccca

SEQ ID NO: 8016604 - DNA, 22 bp, Homo sapiens
tgggggagcgacagacataatt

SEQ ID NO: 8016605 - DNA, 22 bp, Homo sapiens
tgggggagcgacagacataatt

SEQ ID NO: 8016606 - DNA, 22 bp, Homo sapiens
tgggggagcgacagacataatt

SEQ ID NO: 8016607 - DNA, 22 bp, Homo sapiens
tgggggagccttcacagtagct

SEQ ID NO: 8016608 - DNA, 22 bp, Homo sapiens
tgggggcacttcgaggtcgcct

SEQ ID NO: 8016609 - DNA, 22 bp, Homo sapiens
tgggggcacttcgaggtcgcct

SEQ ID NO: 8016610 - DNA, 22 bp, Homo sapiens
tgggggcacttcgaggtcgcct

SEQ ID NO: 8016611 - DNA, 22 bp, Homo sapiens
tgggggcacttcgaggtcgcct

SEQ ID NO: 8016612 - DNA, 22 bp, Homo sapiens
tgggggcacttcgaggtcgcct

SEQ ID NO: 8016613 - DNA, 22 bp, Homo sapiens
tgggggcacttcgaggtcgcct

SEQ ID NO: 8016614 - DNA, 22 bp, Homo sapiens
tgggggagtatagtctggcctc

SEQ ID NO: 8016615 - DNA, 22 bp, Homo sapiens
tgggggagtatagtctggcctc

SEQ ID NO: 8016616 - DNA, 22 bp, Homo sapiens
tgggggagctcagtccagccca

SEQ ID NO: 8016617 - DNA, 22 bp, Homo sapiens
tgggggagctcagtccagccca

SEQ ID NO: 8016618 - DNA, 22 bp, Homo sapiens
tgggggagctcagtccagccca

SEQ ID NO: 8016619 - DNA, 22 bp, Homo sapiens
tgggggagtatagtctggcctc

SEQ ID NO: 8016620 - DNA, 22 bp, Homo sapiens
tgggggagtatagtctggcctc

SEQ ID NO: 8016621 - DNA, 22 bp, Homo sapiens
tggggctggctattgtctccct

SEQ ID NO: 8016622 - DNA, 22 bp, Homo sapiens
tggggctggctattgtctccct

SEQ ID NO: 8016623 - DNA, 22 bp, Homo sapiens
tggggctggctattgtctccct

SEQ ID NO: 8016624 - DNA, 22 bp, Homo sapiens
tggggctggggatcttgagcct

SEQ ID NO: 8016625 - DNA, 22 bp, Homo sapiens
tggggctggcacagtctctatt

SEQ ID NO: 8016626 - DNA, 22 bp, Homo sapiens
tggggctggcacagtctctatt

SEQ ID NO: 8016627 - DNA, 22 bp, Homo sapiens
tggggctggcacagtctctatt

SEQ ID NO: 8016628 - DNA, 22 bp, Homo sapiens
tggggctggctattgtctccct

SEQ ID NO: 8016629 - DNA, 22 bp, Homo sapiens
tggggctggctattgtctccct

SEQ ID NO: 8016630 - DNA, 22 bp, Homo sapiens
tggggctggctattgtctccct

SEQ ID NO: 8016631 - DNA, 22 bp, Homo sapiens
tggggctgtcccggtttggcga

SEQ ID NO: 8016632 - DNA, 22 bp, Homo sapiens
tggggctggggatcttgagcct

SEQ ID NO: 8016633 - DNA, 22 bp, Homo sapiens
tggggctggggatcttgagcct

SEQ ID NO: 8016634 - DNA, 22 bp, Homo sapiens
tggggctgtcccggtttggcga

SEQ ID NO: 8016635 - DNA, 22 bp, Homo sapiens
tggggctgtccttagtctgaga

SEQ ID NO: 8016636 - DNA, 22 bp, Homo sapiens
tggggctgtccttagtctgaga

SEQ ID NO: 8016637 - DNA, 22 bp, Homo sapiens
tggggctgtccttagtctgaga

SEQ ID NO: 8016638 - DNA, 22 bp, Homo sapiens
tggggctgtccttagtctgaga

SEQ ID NO: 8016639 - DNA, 22 bp, Homo sapiens
tggggctgtccttagtctgaga

SEQ ID NO: 8016640 - DNA, 22 bp, Homo sapiens
tggggctgtccttagtctgaga

SEQ ID NO: 8016641 - DNA, 22 bp, Homo sapiens
tgggggagagtgcaagcatgaa

SEQ ID NO: 8016642 - DNA, 22 bp, Homo sapiens
tgggggagagtgcaagcatgaa

SEQ ID NO: 8016643 - DNA, 22 bp, Homo sapiens
tgggggagagtgcaagcatgaa

SEQ ID NO: 8016644 - DNA, 22 bp, Homo sapiens
tgggggagagtgcaagcatgaa

SEQ ID NO: 8016645 - DNA, 22 bp, Homo sapiens
tgggggagagtttagatgattt

SEQ ID NO: 8016646 - DNA, 22 bp, Homo sapiens
tgggggagagtttagatgattt

SEQ ID NO: 8016647 - DNA, 22 bp, Homo sapiens
tgggggagagtttagatgattt

SEQ ID NO: 8016648 - DNA, 22 bp, Homo sapiens
tgggggagagtttagatgattt

SEQ ID NO: 8016649 - DNA, 22 bp, Homo sapiens
tgggggagagtgcaagcatgaa

SEQ ID NO: 8016650 - DNA, 22 bp, Homo sapiens
tgggggagagtgcaagcatgaa

SEQ ID NO: 8016651 - DNA, 22 bp, Homo sapiens
tgggggagagtgcaagcatgaa

SEQ ID NO: 8016652 - DNA, 22 bp, Homo sapiens
tgggggagattgtgcatctcta

SEQ ID NO: 8016653 - DNA, 22 bp, Homo sapiens
tgggggagattgtgcatctcta

SEQ ID NO: 8016654 - DNA, 22 bp, Homo sapiens
tgggggagattgtgcatctcta

SEQ ID NO: 8016655 - DNA, 22 bp, Homo sapiens
tgggggagattgtgcatctcta

SEQ ID NO: 8016656 - DNA, 22 bp, Homo sapiens
tgggggagattgtgcatctcta

SEQ ID NO: 8016657 - DNA, 22 bp, Homo sapiens
tgggggagattagagcttctta

SEQ ID NO: 8016658 - DNA, 22 bp, Homo sapiens
tgggggagattagagcttctta

SEQ ID NO: 8016659 - DNA, 22 bp, Homo sapiens
tgggggagattgtgcatctcta

SEQ ID NO: 8016660 - DNA, 22 bp, Homo sapiens
tgggggagattagagcttctta

SEQ ID NO: 8016661 - DNA, 22 bp, Homo sapiens
tgggggagattagagcttctta

SEQ ID NO: 8016662 - DNA, 22 bp, Homo sapiens
tgggggagattagagcttctta

SEQ ID NO: 8016663 - DNA, 22 bp, Homo sapiens
tgggggagatagagtctgatgg

SEQ ID NO: 8016664 - DNA, 22 bp, Homo sapiens
tgggggagatagagtctgatgg

SEQ ID NO: 8016665 - DNA, 22 bp, Homo sapiens
tggggcgcgaggtcctggctcc

SEQ ID NO: 8016666 - DNA, 20 bp, Homo sapiens
tggggcctgtttctgtggtt

SEQ ID NO: 8016667 - DNA, 22 bp, Homo sapiens
tggggctaacgagagagcagag

SEQ ID NO: 8016668 - DNA, 22 bp, Homo sapiens
tggggctaacgagagagcagag

SEQ ID NO: 8016669 - DNA, 22 bp, Homo sapiens
tggggctaaacacgcctggcct

SEQ ID NO: 8016670 - DNA, 22 bp, Homo sapiens
tggggctaaacacgcctggcct

SEQ ID NO: 8016671 - DNA, 22 bp, Homo sapiens
tggggctaaacacgcctggcct

SEQ ID NO: 8016672 - DNA, 22 bp, Homo sapiens
tggggctagaatcctgcaggaa

SEQ ID NO: 8016673 - DNA, 22 bp, Homo sapiens
tggggctcacctaggctggaag

SEQ ID NO: 8016674 - DNA, 22 bp, Homo sapiens
tggggctcacctaggctggaag

SEQ ID NO: 8016675 - DNA, 22 bp, Homo sapiens
tggggcctgaggtggagctgca

SEQ ID NO: 8016676 - DNA, 22 bp, Homo sapiens
tggggcctgaggtggagctgca

SEQ ID NO: 8016677 - DNA, 22 bp, Homo sapiens
tggggcctgaggtggagctgca

SEQ ID NO: 8016678 - DNA, 22 bp, Homo sapiens
tggggcctgcacaggctgaatg

SEQ ID NO: 8016679 - DNA, 22 bp, Homo sapiens
tggggcctgcacaggctgaatg

SEQ ID NO: 8016680 - DNA, 22 bp, Homo sapiens
tggggcctggtcagagctgcac

SEQ ID NO: 8016681 - DNA, 22 bp, Homo sapiens
tggggcctggtcagagctgcac

SEQ ID NO: 8016682 - DNA, 20 bp, Homo sapiens
tggggcctgtttctgtggtt

SEQ ID NO: 8016683 - DNA, 22 bp, Homo sapiens
tggggcctgtgacgggtccaga

SEQ ID NO: 8016684 - DNA, 22 bp, Homo sapiens
tggggcctgtgacgggtccaga

SEQ ID NO: 8016685 - DNA, 22 bp, Homo sapiens
tggggcctggtcagagctgcac

SEQ ID NO: 8016686 - DNA, 22 bp, Homo sapiens
tggggctgaggagcctcactct

SEQ ID NO: 8016687 - DNA, 22 bp, Homo sapiens
tggggctgaggagcctcactct

SEQ ID NO: 8016688 - DNA, 23 bp, Homo sapiens
tggggctctggcaggcctgaggt

SEQ ID NO: 8016689 - DNA, 22 bp, Homo sapiens
tggggctggcacagtctctatt

SEQ ID NO: 8016690 - DNA, 23 bp, Homo sapiens
tggggctgatggagacggaccag

SEQ ID NO: 8016691 - DNA, 23 bp, Homo sapiens
tggggctgatggagacggaccag

SEQ ID NO: 8016692 - DNA, 23 bp, Homo sapiens
tggggctgatggagacggaccag

SEQ ID NO: 8016693 - DNA, 23 bp, Homo sapiens
tggggctgatggagacggaccag

SEQ ID NO: 8016694 - DNA, 22 bp, Homo sapiens
tggggctctccacagtgtctca

SEQ ID NO: 8016695 - DNA, 22 bp, Homo sapiens
tggggctctccacagtgtctca

SEQ ID NO: 8016696 - DNA, 23 bp, Homo sapiens
tggggctctggcaggcctgaggt

SEQ ID NO: 8016697 - DNA, 23 bp, Homo sapiens
tggggctctggcaggcctgaggt

SEQ ID NO: 8016698 - DNA, 22 bp, Homo sapiens
tggggctctccacagtgtctca

SEQ ID NO: 8016699 - DNA, 22 bp, Homo sapiens
tggggctcatgcctgctggaac

SEQ ID NO: 8016700 - DNA, 22 bp, Homo sapiens
tggggctcatgcctgctggaac

SEQ ID NO: 8016701 - DNA, 22 bp, Homo sapiens
tggggctcctcctggcaggagg

SEQ ID NO: 8016702 - DNA, 22 bp, Homo sapiens
tggggctcctcctggcaggagg

SEQ ID NO: 8016703 - DNA, 22 bp, Homo sapiens
tggggcacttatgatgtgccac

SEQ ID NO: 8016704 - DNA, 22 bp, Homo sapiens
tggggcagagtaggattttggc

SEQ ID NO: 8016705 - DNA, 22 bp, Homo sapiens
tggggcagagtaggattttggc

SEQ ID NO: 8016706 - DNA, 22 bp, Homo sapiens
tggggcacttatgatgtgccac

SEQ ID NO: 8016707 - DNA, 22 bp, Homo sapiens
tggggcacttatgatgtgccac

SEQ ID NO: 8016708 - DNA, 22 bp, Homo sapiens
tggggcacagtctgaatgtttc

SEQ ID NO: 8016709 - DNA, 22 bp, Homo sapiens
tggggcacagctgagaaagcac

SEQ ID NO: 8016710 - DNA, 22 bp, Homo sapiens
tggggcaagaagtgccctgaag

SEQ ID NO: 8016711 - DNA, 20 bp, Homo sapiens
tggggcacatgcagattggt

SEQ ID NO: 8016712 - DNA, 22 bp, Homo sapiens
tggggcaccttgtatctctaag

SEQ ID NO: 8016713 - DNA, 20 bp, Homo sapiens
tggggcacatgcagattggt

SEQ ID NO: 8016714 - DNA, 22 bp, Homo sapiens
tggggcagcagacctttcttgg

SEQ ID NO: 8016715 - DNA, 22 bp, Homo sapiens
tggggcagcagacctttcttgg

SEQ ID NO: 8016716 - DNA, 22 bp, Homo sapiens
tggggcagagtaggattttggc

SEQ ID NO: 8016717 - DNA, 22 bp, Homo sapiens
tggggccagagatggggcgcag

SEQ ID NO: 8016718 - DNA, 22 bp, Homo sapiens
tggggccagagctgcagggagc

SEQ ID NO: 8016719 - DNA, 22 bp, Homo sapiens
tggggccagagctgcagggagc

SEQ ID NO: 8016720 - DNA, 22 bp, Homo sapiens
tggggccagagctgcagggagc

SEQ ID NO: 8016721 - DNA, 22 bp, Homo sapiens
tggggccagagctgcagggagc

SEQ ID NO: 8016722 - DNA, 22 bp, Homo sapiens
tggggccagagctgcagggagc

SEQ ID NO: 8016723 - DNA, 22 bp, Homo sapiens
tggggccacagcctcctagctt

SEQ ID NO: 8016724 - DNA, 22 bp, Homo sapiens
tggggccacagcctcctagctt

SEQ ID NO: 8016725 - DNA, 22 bp, Homo sapiens
tggggccacagcctcctagctt

SEQ ID NO: 8016726 - DNA, 22 bp, Homo sapiens
tggggccagagatggggcgcag

SEQ ID NO: 8016727 - DNA, 22 bp, Homo sapiens
tggggccaggtggctgcaggtc

SEQ ID NO: 8016728 - DNA, 22 bp, Homo sapiens
tggggccaggtggctgcaggtc

SEQ ID NO: 8016729 - DNA, 22 bp, Homo sapiens
tggggccaggtggctgcaggtc

SEQ ID NO: 8016730 - DNA, 22 bp, Homo sapiens
tggggccatctcacccactgtt

SEQ ID NO: 8016731 - DNA, 22 bp, Homo sapiens
tggggcctgaggtggagctgca

SEQ ID NO: 8016732 - DNA, 22 bp, Homo sapiens
tggggcctgaaaggttctcgcc

SEQ ID NO: 8016733 - DNA, 22 bp, Homo sapiens
tggggcctgaaaggttctcgcc

SEQ ID NO: 8016734 - DNA, 19 bp, Homo sapiens
tggggcctcctgtccctgg

SEQ ID NO: 8016735 - DNA, 22 bp, Homo sapiens
tggggcctgaaaggttctcgcc

SEQ ID NO: 8016736 - DNA, 19 bp, Homo sapiens
tggggcctcctgtccctgg

SEQ ID NO: 8016737 - DNA, 22 bp, Homo sapiens
tggggccagcggggaggactca

SEQ ID NO: 8016738 - DNA, 22 bp, Homo sapiens
tggggccagcggggaggactca

SEQ ID NO: 8016739 - DNA, 22 bp, Homo sapiens
tggggccagcggggaggactca

SEQ ID NO: 8016740 - DNA, 22 bp, Homo sapiens
tggggccagcggggaggactca

SEQ ID NO: 8016741 - DNA, 22 bp, Homo sapiens
tggggccagggaggaccagaca

SEQ ID NO: 8016742 - DNA, 22 bp, Homo sapiens
tggggccaggtggctgcaggtc

SEQ ID NO: 8016743 - DNA, 22 bp, Homo sapiens
tggggccaggtggctgcaggtc

SEQ ID NO: 8016744 - DNA, 22 bp, Homo sapiens
tggggacagggctcagcaattt

SEQ ID NO: 8016745 - DNA, 22 bp, Homo sapiens
tggggacatagccagtctggct

SEQ ID NO: 8016746 - DNA, 22 bp, Homo sapiens
tggggacaggagacttacagct

SEQ ID NO: 8016747 - DNA, 22 bp, Homo sapiens
tggggacagggctcagcaattt

SEQ ID NO: 8016748 - DNA, 22 bp, Homo sapiens
tggggacagggctcagcaattt

SEQ ID NO: 8016749 - DNA, 22 bp, Homo sapiens
tggggacagggctcagcaattt

SEQ ID NO: 8016750 - DNA, 22 bp, Homo sapiens
tggggacattcatgcaggttgt

SEQ ID NO: 8016751 - DNA, 22 bp, Homo sapiens
tggggacattcatgcaggttgt

SEQ ID NO: 8016752 - DNA, 22 bp, Homo sapiens
tggggacattcatgcaggttgt

SEQ ID NO: 8016753 - DNA, 22 bp, Homo sapiens
tggggacatagccagtctggct

SEQ ID NO: 8016754 - DNA, 22 bp, Homo sapiens
tggggacatagccagtctggct

SEQ ID NO: 8016755 - DNA, 22 bp, Homo sapiens
tggggacatagccagtctggct

SEQ ID NO: 8016756 - DNA, 22 bp, Homo sapiens
tggggacatagccagtctggct

SEQ ID NO: 8016757 - DNA, 22 bp, Homo sapiens
tggggacatagccagtctggct

SEQ ID NO: 8016758 - DNA, 22 bp, Homo sapiens
tggggaggaagtcagatttcag

SEQ ID NO: 8016759 - DNA, 22 bp, Homo sapiens
tggggactgacagccaggcctc

SEQ ID NO: 8016760 - DNA, 22 bp, Homo sapiens
tggggactgacagccaggcctc

SEQ ID NO: 8016761 - DNA, 22 bp, Homo sapiens
tggggacccggactcctgggtc

SEQ ID NO: 8016762 - DNA, 22 bp, Homo sapiens
tggggacgtactgagaggtccg

SEQ ID NO: 8016763 - DNA, 22 bp, Homo sapiens
tggggacgtactgagaggtccg

SEQ ID NO: 8016764 - DNA, 22 bp, Homo sapiens
tggggaccagattagaccatgg

SEQ ID NO: 8016765 - DNA, 22 bp, Homo sapiens
tggggacattcatgcaggttgt

SEQ ID NO: 8016766 - DNA, 22 bp, Homo sapiens
tggggaggaagtcagatttcag

SEQ ID NO: 8016767 - DNA, 22 bp, Homo sapiens
tggggaggaagtcagatttcag

SEQ ID NO: 8016768 - DNA, 22 bp, Homo sapiens
tggggaggaagtcagatttcag

SEQ ID NO: 8016769 - DNA, 22 bp, Homo sapiens
tggggaggaagtcagatttcag

SEQ ID NO: 8016770 - DNA, 22 bp, Homo sapiens
tggggaggaagtcagatttcag

SEQ ID NO: 8016771 - DNA, 22 bp, Homo sapiens
tggggaggaagtcagatttcag

SEQ ID NO: 8016772 - DNA, 22 bp, Homo sapiens
tggggaggaagtcagatttcag

SEQ ID NO: 8016773 - DNA, 22 bp, Homo sapiens
tggggaggaagtcagatttcag

SEQ ID NO: 8016774 - DNA, 23 bp, Homo sapiens
tggggagggaagtcatttctgta

SEQ ID NO: 8016775 - DNA, 23 bp, Homo sapiens
tggggagggaagtcatttctgta

SEQ ID NO: 8016776 - DNA, 23 bp, Homo sapiens
tggggagggaagtcatttctgta

SEQ ID NO: 8016777 - DNA, 23 bp, Homo sapiens
tggggagggaagtcatttctgta

SEQ ID NO: 8016778 - DNA, 23 bp, Homo sapiens
tggggagggaagtcatttctgta

SEQ ID NO: 8016779 - DNA, 22 bp, Homo sapiens
tggggaggatatgtgagttatt

SEQ ID NO: 8016780 - DNA, 22 bp, Homo sapiens
tggggaggatatgtgagttatt

SEQ ID NO: 8016781 - DNA, 22 bp, Homo sapiens
tggggaggatatgtgagttatt

SEQ ID NO: 8016782 - DNA, 21 bp, Homo sapiens
tggggaggggacctgattatg

SEQ ID NO: 8016783 - DNA, 21 bp, Homo sapiens
tggggaggggacctgattatg

SEQ ID NO: 8016784 - DNA, 21 bp, Homo sapiens
tggggaggggacctgattatg

SEQ ID NO: 8016785 - DNA, 21 bp, Homo sapiens
tggggaggggacctgattatg

SEQ ID NO: 8016786 - DNA, 21 bp, Homo sapiens
tggggaggggacctgattatg

SEQ ID NO: 8016787 - DNA, 23 bp, Homo sapiens
tggggagggaagtcatttctgta

SEQ ID NO: 8016788 - DNA, 23 bp, Homo sapiens
tggggagggaagtcatttctgta

SEQ ID NO: 8016789 - DNA, 23 bp, Homo sapiens
tggggagggaagtcatttctgta

SEQ ID NO: 8016790 - DNA, 22 bp, Homo sapiens
tggggaggatatgtgagttatt

SEQ ID NO: 8016791 - DNA, 22 bp, Homo sapiens
tggggaggatatgtgagttatt

SEQ ID NO: 8016792 - DNA, 22 bp, Homo sapiens
tggggaggatatgtgagttatt

SEQ ID NO: 8016793 - DNA, 22 bp, Homo sapiens
tggggaggatatgtgagttatt

SEQ ID NO: 8016794 - DNA, 22 bp, Homo sapiens
tggggaggatatgtgagttatt

SEQ ID NO: 8016795 - DNA, 22 bp, Homo sapiens
tggggaggatatgtgagttatt

SEQ ID NO: 8016796 - DNA, 22 bp, Homo sapiens
tggggaggatatgtgagttatt

SEQ ID NO: 8016797 - DNA, 22 bp, Homo sapiens
tggggaggatatgtgagttatt

SEQ ID NO: 8016798 - DNA, 22 bp, Homo sapiens
tggggaggacgggcgccttcct

SEQ ID NO: 8016799 - DNA, 22 bp, Homo sapiens
tggggaggacgggcgccttcct

SEQ ID NO: 8016800 - DNA, 22 bp, Homo sapiens
tggggaggacgggcgccttcct

SEQ ID NO: 8016801 - DNA, 22 bp, Homo sapiens
tggggaggacgggcgccttcct

SEQ ID NO: 8016802 - DNA, 22 bp, Homo sapiens
tggggaggacgggcgccttcct

SEQ ID NO: 8016803 - DNA, 22 bp, Homo sapiens
tggggaggacgggcgccttcct

SEQ ID NO: 8016804 - DNA, 22 bp, Homo sapiens
tggggaggttcgggaatcttgt

SEQ ID NO: 8016805 - DNA, 22 bp, Homo sapiens
tggggaggttcgggaatcttgt

SEQ ID NO: 8016806 - DNA, 22 bp, Homo sapiens
tggggaggttcgggaatcttgt

SEQ ID NO: 8016807 - DNA, 22 bp, Homo sapiens
tggggaggttcgggaatcttgt

SEQ ID NO: 8016808 - DNA, 22 bp, Homo sapiens
tggggaggttcgggaatcttgt

SEQ ID NO: 8016809 - DNA, 22 bp, Homo sapiens
tggggaggttcgggaatcttgt

SEQ ID NO: 8016810 - DNA, 22 bp, Homo sapiens
tggggaggttcgggaatcttgt

SEQ ID NO: 8016811 - DNA, 22 bp, Homo sapiens
tggggagtgatgcctcggataa

SEQ ID NO: 8016812 - DNA, 22 bp, Homo sapiens
tggggaggttcgggaatcttgt

SEQ ID NO: 8016813 - DNA, 22 bp, Homo sapiens
tggggaggttcgggaatcttgt

SEQ ID NO: 8016814 - DNA, 22 bp, Homo sapiens
tggggaggttcgggaatcttgt

SEQ ID NO: 8016815 - DNA, 21 bp, Homo sapiens
tggggaggggacctgattatg

SEQ ID NO: 8016816 - DNA, 21 bp, Homo sapiens
tggggaggggacctgattatg

SEQ ID NO: 8016817 - DNA, 21 bp, Homo sapiens
tggggaggggacctgattatg

SEQ ID NO: 8016818 - DNA, 21 bp, Homo sapiens
tggggaggggacctgattatg

SEQ ID NO: 8016819 - DNA, 21 bp, Homo sapiens
tggggaggggacctgattatg

SEQ ID NO: 8016820 - DNA, 21 bp, Homo sapiens
tggggaggggacctgattatg

SEQ ID NO: 8016821 - DNA, 22 bp, Homo sapiens
tggggaggtaacaatttcaggc

SEQ ID NO: 8016822 - DNA, 22 bp, Homo sapiens
tggggaggtaacaatttcaggc

SEQ ID NO: 8016823 - DNA, 22 bp, Homo sapiens
tggggaggtaacaatttcaggc

SEQ ID NO: 8016824 - DNA, 22 bp, Homo sapiens
tggggaggtaacaatttcaggc

SEQ ID NO: 8016825 - DNA, 22 bp, Homo sapiens
tggggaggtaacaatttcaggc

SEQ ID NO: 8016826 - DNA, 22 bp, Homo sapiens
tggggaggtaacaatttcaggc

SEQ ID NO: 8016827 - DNA, 22 bp, Homo sapiens
tggggagtgatgcctcggataa

SEQ ID NO: 8016828 - DNA, 22 bp, Homo sapiens
tggggagtgatgcctcggataa

SEQ ID NO: 8016829 - DNA, 22 bp, Homo sapiens
tggggagtgatgcctcggataa

SEQ ID NO: 8016830 - DNA, 20 bp, Homo sapiens
tggggagttgagcacgagca

SEQ ID NO: 8016831 - DNA, 22 bp, Homo sapiens
tggggatcataaattgatggag

SEQ ID NO: 8016832 - DNA, 22 bp, Homo sapiens
tggggatgaaacccaggcatct

SEQ ID NO: 8016833 - DNA, 20 bp, Homo sapiens
tggggagttgagcacgagca

SEQ ID NO: 8016834 - DNA, 22 bp, Homo sapiens
tggggatgaaacccaggcatct

SEQ ID NO: 8016835 - DNA, 19 bp, Homo sapiens
tggggatgctgatgaccaa

SEQ ID NO: 8016836 - DNA, 22 bp, Homo sapiens
tggggatggatgaatctttgct

SEQ ID NO: 8016837 - DNA, 22 bp, Homo sapiens
tggggatgtcatataagaggaa

SEQ ID NO: 8016838 - DNA, 22 bp, Homo sapiens
tggggatgtcatataagaggaa

SEQ ID NO: 8016839 - DNA, 22 bp, Homo sapiens
tggggatgtaaatgaggtgata

SEQ ID NO: 8016840 - DNA, 22 bp, Homo sapiens
tggggatgtagaaatgaacaac

SEQ ID NO: 8016841 - DNA, 16 bp, Homo sapiens
tggggatggggaagag

SEQ ID NO: 8016842 - DNA, 16 bp, Homo sapiens
tggggatggggaagag

SEQ ID NO: 8016843 - DNA, 22 bp, Homo sapiens
tggggatgtaaatgaggtgata

SEQ ID NO: 8016844 - DNA, 22 bp, Homo sapiens
tggggatgtaaatgaggtgata

SEQ ID NO: 8016845 - DNA, 22 bp, Homo sapiens
tggggatgtaaatgaggtgata

SEQ ID NO: 8016846 - DNA, 22 bp, Homo sapiens
tggggatgtaaatgaggtgata

SEQ ID NO: 8016847 - DNA, 22 bp, Homo sapiens
tggggatgtaaatgaggtgata

SEQ ID NO: 8016848 - DNA, 17 bp, Homo sapiens
tggggatggttcatgag

SEQ ID NO: 8016849 - DNA, 22 bp, Homo sapiens
tggggaagggcaccctggagac

SEQ ID NO: 8016850 - DNA, 22 bp, Homo sapiens
tggggaagggcaccctggagac

SEQ ID NO: 8016851 - DNA, 22 bp, Homo sapiens
tggggaagggcaccctggagac

SEQ ID NO: 8016852 - DNA, 22 bp, Homo sapiens
tggggaagggcaccctggagac

SEQ ID NO: 8016853 - DNA, 22 bp, Homo sapiens
tggggaagggcaccctggagac

SEQ ID NO: 8016854 - DNA, 22 bp, Homo sapiens
tggggacacagagccaaactat

SEQ ID NO: 8016855 - DNA, 22 bp, Homo sapiens
tggggacacagagccaaactat

SEQ ID NO: 8016856 - DNA, 22 bp, Homo sapiens
tggggacacagaggttcgttgg

SEQ ID NO: 8016857 - DNA, 22 bp, Homo sapiens
tggggacacagaggttcgttgg

SEQ ID NO: 8016858 - DNA, 22 bp, Homo sapiens
tggggacaggagacttacagct

SEQ ID NO: 8016859 - DNA, 17 bp, Homo sapiens
tggggaagctcagattt

SEQ ID NO: 8016860 - DNA, 17 bp, Homo sapiens
tggggaagctcagattt

SEQ ID NO: 8016861 - DNA, 17 bp, Homo sapiens
tggggaagctcagattt

SEQ ID NO: 8016862 - DNA, 17 bp, Homo sapiens
tggggaagctcagattt

SEQ ID NO: 8016863 - DNA, 16 bp, Homo sapiens
tggggaagctcgtgag

SEQ ID NO: 8016864 - DNA, 16 bp, Homo sapiens
tggggaagctcgtgag

SEQ ID NO: 8016865 - DNA, 22 bp, Homo sapiens
tggggaaggatcaccacaatct

SEQ ID NO: 8016866 - DNA, 22 bp, Homo sapiens
tggggaaggcggagcttgcagc

SEQ ID NO: 8016867 - DNA, 22 bp, Homo sapiens
tggggaaggcggagcttgcagc

SEQ ID NO: 8016868 - DNA, 22 bp, Homo sapiens
tggggaaggcggagcttgcagc

SEQ ID NO: 8016869 - DNA, 22 bp, Homo sapiens
tggggaaggcggagcttgcagc

SEQ ID NO: 8016870 - DNA, 22 bp, Homo sapiens
tggggaaggcggagcttgcagc

SEQ ID NO: 8016871 - DNA, 22 bp, Homo sapiens
tggggaaggcggagcttgcagc

SEQ ID NO: 8016872 - DNA, 22 bp, Homo sapiens
tggggaagacagcagacactgt

SEQ ID NO: 8016873 - DNA, 22 bp, Homo sapiens
tggggaagacagcagacactgt

SEQ ID NO: 8016874 - DNA, 22 bp, Homo sapiens
tggggaagacagcagacactgt

SEQ ID NO: 8016875 - DNA, 22 bp, Homo sapiens
tggggaagacagcagacactgt

SEQ ID NO: 8016876 - DNA, 22 bp, Homo sapiens
tggggaagcactttgaacttaa

SEQ ID NO: 8016877 - DNA, 22 bp, Homo sapiens
tggggaagcactttgaacttaa

SEQ ID NO: 8016878 - DNA, 17 bp, Homo sapiens
tggggaagctcagattt

SEQ ID NO: 8016879 - DNA, 17 bp, Homo sapiens
tggggaagctcagattt

SEQ ID NO: 8016880 - DNA, 22 bp, Homo sapiens
tggggaaagttcttgaaagtaa

SEQ ID NO: 8016881 - DNA, 22 bp, Homo sapiens
tggggaagaataatgtatgtac

SEQ ID NO: 8016882 - DNA, 22 bp, Homo sapiens
tggggaagaataatgtatgtac

SEQ ID NO: 8016883 - DNA, 22 bp, Homo sapiens
tggggaagacagcagacactgt

SEQ ID NO: 8016884 - DNA, 22 bp, Homo sapiens
tggggaagacagcagacactgt

SEQ ID NO: 8016885 - DNA, 22 bp, Homo sapiens
tggggaagacagcagacactgt

SEQ ID NO: 8016886 - DNA, 22 bp, Homo sapiens
tggggaagacagcagacactgt

SEQ ID NO: 8016887 - DNA, 22 bp, Homo sapiens
tggggaaaggagagcattattt

SEQ ID NO: 8016888 - DNA, 20 bp, Homo sapiens
tggggaaagccatcgatgag

SEQ ID NO: 8016889 - DNA, 22 bp, Homo sapiens
tggggaaaggagagcattattt

SEQ ID NO: 8016890 - DNA, 22 bp, Homo sapiens
tggggaaagatagttttctcta

SEQ ID NO: 8016891 - DNA, 22 bp, Homo sapiens
tggggaaagacattcatacagt

SEQ ID NO: 8016892 - DNA, 22 bp, Homo sapiens
tggggaaaatgcttgtagtcag

SEQ ID NO: 8016893 - DNA, 22 bp, Homo sapiens
tgggcttcataattggtcctag

SEQ ID NO: 8016894 - DNA, 22 bp, Homo sapiens
tgggcttaggtcggaggcggcc

SEQ ID NO: 8016895 - DNA, 22 bp, Homo sapiens
tgggctgtggagaggagctgga

SEQ ID NO: 8016896 - DNA, 22 bp, Homo sapiens
tgggctgtggagcacctttgca

SEQ ID NO: 8016897 - DNA, 23 bp, Homo sapiens
tgggcttctgagaaagcacctaa

SEQ ID NO: 8016898 - DNA, 23 bp, Homo sapiens
tgggcttctgagaaagcacctaa

SEQ ID NO: 8016899 - DNA, 22 bp, Homo sapiens
tgggcttcctggagcctgtgct

SEQ ID NO: 8016900 - DNA, 19 bp, Homo sapiens
tgggcttccccagggcaga

SEQ ID NO: 8016901 - DNA, 22 bp, Homo sapiens
tggggaaaatgcttgtagtcag

SEQ ID NO: 8016902 - DNA, 22 bp, Homo sapiens
tggggaaaatgcagaagattac

SEQ ID NO: 8016903 - DNA, 22 bp, Homo sapiens
tggggaaaatgcagaagattac

SEQ ID NO: 8016904 - DNA, 22 bp, Homo sapiens
tggggaaaatgcagaagattac

SEQ ID NO: 8016905 - DNA, 22 bp, Homo sapiens
tggggaaaacagaggaaattag

SEQ ID NO: 8016906 - DNA, 22 bp, Homo sapiens
tgggcttctgatgttgagtgct

SEQ ID NO: 8016907 - DNA, 22 bp, Homo sapiens
tgggctttatcatgggtctggt

SEQ ID NO: 8016908 - DNA, 22 bp, Homo sapiens
tggggaaaagcgttaggagttc

SEQ ID NO: 8016909 - DNA, 18 bp, Homo sapiens
tgggcttgaaagcaaggt

SEQ ID NO: 8016910 - DNA, 22 bp, Homo sapiens
tgggcttctggagtggggcaga

SEQ ID NO: 8016911 - DNA, 22 bp, Homo sapiens
tgggcttggtttctaggtaggt

SEQ ID NO: 8016912 - DNA, 22 bp, Homo sapiens
tgggcttggtttctaggtaggt

SEQ ID NO: 8016913 - DNA, 22 bp, Homo sapiens
tgggcttggaaagctgctgtgc

SEQ ID NO: 8016914 - DNA, 18 bp, Homo sapiens
tgggctgcctggcctctg

SEQ ID NO: 8016915 - DNA, 18 bp, Homo sapiens
tgggctgcctggcctctg

SEQ ID NO: 8016916 - DNA, 22 bp, Homo sapiens
tgggctggcccaccacacctcg

SEQ ID NO: 8016917 - DNA, 22 bp, Homo sapiens
tgggctggcgtggagagtttag

SEQ ID NO: 8016918 - DNA, 22 bp, Homo sapiens
tgggctggcgtggagagtttag

SEQ ID NO: 8016919 - DNA, 22 bp, Homo sapiens
tgggctggcgtggagagtttag

SEQ ID NO: 8016920 - DNA, 22 bp, Homo sapiens
tgggctggcgtggagagtttag

SEQ ID NO: 8016921 - DNA, 22 bp, Homo sapiens
tgggctggcgtggagagtttag

SEQ ID NO: 8016922 - DNA, 22 bp, Homo sapiens
tgggctggcgtggagagtttag

SEQ ID NO: 8016923 - DNA, 22 bp, Homo sapiens
tgggctggcgtggagagtttag

SEQ ID NO: 8016924 - DNA, 22 bp, Homo sapiens
tgggctggctgaacttcaacct

SEQ ID NO: 8016925 - DNA, 22 bp, Homo sapiens
tgggctggctgaacttcaacct

SEQ ID NO: 8016926 - DNA, 22 bp, Homo sapiens
tgggctggcgtggagagtttag

SEQ ID NO: 8016927 - DNA, 22 bp, Homo sapiens
tgggctggctgaacttcaacct

SEQ ID NO: 8016928 - DNA, 22 bp, Homo sapiens
tgggctggctgaggcattcact

SEQ ID NO: 8016929 - DNA, 22 bp, Homo sapiens
tgggctggctgaggcattcact

SEQ ID NO: 8016930 - DNA, 22 bp, Homo sapiens
tgggctggctgaacttcaacct

SEQ ID NO: 8016931 - DNA, 22 bp, Homo sapiens
tgggctggctgaggcattcact

SEQ ID NO: 8016932 - DNA, 22 bp, Homo sapiens
tgggctggctgaggcattcact

SEQ ID NO: 8016933 - DNA, 22 bp, Homo sapiens
tgggctggtgagggatcattta

SEQ ID NO: 8016934 - DNA, 22 bp, Homo sapiens
tgggctggtgagggatcattta

SEQ ID NO: 8016935 - DNA, 22 bp, Homo sapiens
tgggctggtgagggatcattta

SEQ ID NO: 8016936 - DNA, 22 bp, Homo sapiens
tgggctggctgaggcattcact

SEQ ID NO: 8016937 - DNA, 22 bp, Homo sapiens
tgggctggtgagggatcattta

SEQ ID NO: 8016938 - DNA, 22 bp, Homo sapiens
tgggctggtgagggatcattta

SEQ ID NO: 8016939 - DNA, 22 bp, Homo sapiens
tgggctgtccagcacctgggct

SEQ ID NO: 8016940 - DNA, 22 bp, Homo sapiens
tgggctgtggagaggagctgga

SEQ ID NO: 8016941 - DNA, 22 bp, Homo sapiens
tgggctggtgagggatcattta

SEQ ID NO: 8016942 - DNA, 22 bp, Homo sapiens
tggtattacttctagacacaag

SEQ ID NO: 8016943 - DNA, 22 bp, Homo sapiens
tggtattacttctagacacaag

SEQ ID NO: 8016944 - DNA, 22 bp, Homo sapiens
tggtatttccaggcttatggta

SEQ ID NO: 8016945 - DNA, 22 bp, Homo sapiens
tggtatttctgtgcccagctca

SEQ ID NO: 8016946 - DNA, 22 bp, Homo sapiens
tggtatttcagcttttgtatct

SEQ ID NO: 8016947 - DNA, 22 bp, Homo sapiens
tggtatttaatatatgagagtt

SEQ ID NO: 8016948 - DNA, 22 bp, Homo sapiens
tggtatttaatatatgagagtt

SEQ ID NO: 8016949 - DNA, 22 bp, Homo sapiens
tggtcacacatgtatctcaatg

SEQ ID NO: 8016950 - DNA, 22 bp, Homo sapiens
tggtcacacatgtatctcaatg

SEQ ID NO: 8016951 - DNA, 22 bp, Homo sapiens
tggtcaagttaagataaggtga

SEQ ID NO: 8016952 - DNA, 22 bp, Homo sapiens
tggtcaagattacacactggtg

SEQ ID NO: 8016953 - DNA, 22 bp, Homo sapiens
tggtcaaggcttggagatagta

SEQ ID NO: 8016954 - DNA, 22 bp, Homo sapiens
tggtcaaggcttggagatagta

SEQ ID NO: 8016955 - DNA, 22 bp, Homo sapiens
tggtcaaggcttggagatagta

SEQ ID NO: 8016956 - DNA, 22 bp, Homo sapiens
tggtcaagggacagagctgaac

SEQ ID NO: 8016957 - DNA, 22 bp, Homo sapiens
tggtcaagggacagagctgaac

SEQ ID NO: 8016958 - DNA, 22 bp, Homo sapiens
tggtcaaaagaaagctcagaac

SEQ ID NO: 8016959 - DNA, 22 bp, Homo sapiens
tggtcaaaaaggcctagacaca

SEQ ID NO: 8016960 - DNA, 22 bp, Homo sapiens
tggtcaacaggcagggatgaaa

SEQ ID NO: 8016961 - DNA, 22 bp, Homo sapiens
tggtatgaccgtggtgcaagca

SEQ ID NO: 8016962 - DNA, 22 bp, Homo sapiens
tggtatgaccgtggtgcaagca

SEQ ID NO: 8016963 - DNA, 22 bp, Homo sapiens
tggtatgcaaatgttgggttag

SEQ ID NO: 8016964 - DNA, 22 bp, Homo sapiens
tggtatgcctacctcagccgct

SEQ ID NO: 8016965 - DNA, 20 bp, Homo sapiens
tggtatgctgcaggcagcag

SEQ ID NO: 8016966 - DNA, 22 bp, Homo sapiens
tggtatgcttattatcttcaac

SEQ ID NO: 8016967 - DNA, 22 bp, Homo sapiens
tggtatatgtgttagcacaagt

SEQ ID NO: 8016968 - DNA, 22 bp, Homo sapiens
tggtatgaccgtggtgcaagca

SEQ ID NO: 8016969 - DNA, 22 bp, Homo sapiens
tggtatcgtgttggcactcagt

SEQ ID NO: 8016970 - DNA, 22 bp, Homo sapiens
tggtagtcggcctcggtggctc

SEQ ID NO: 8016971 - DNA, 22 bp, Homo sapiens
tggtagtcggcctcggtggctc

SEQ ID NO: 8016972 - DNA, 21 bp, Homo sapiens
tggtaggtactggcttcaggc

SEQ ID NO: 8016973 - DNA, 21 bp, Homo sapiens
tggtaggtactggcttcaggc

SEQ ID NO: 8016974 - DNA, 21 bp, Homo sapiens
tggtaggtactggcttcaggc

SEQ ID NO: 8016975 - DNA, 22 bp, Homo sapiens
tggtataaaactttttattgaa

SEQ ID NO: 8016976 - DNA, 22 bp, Homo sapiens
tggtaaagttgattggtgctct

SEQ ID NO: 8016977 - DNA, 22 bp, Homo sapiens
tggtaaatgctccaagcagtac

SEQ ID NO: 8016978 - DNA, 22 bp, Homo sapiens
tggtaaagtggcttcacagtgt

SEQ ID NO: 8016979 - DNA, 22 bp, Homo sapiens
tggtaaagtggcttcacagtgt

SEQ ID NO: 8016980 - DNA, 22 bp, Homo sapiens
tggtaaagtgctctaacttcat

SEQ ID NO: 8016981 - DNA, 22 bp, Homo sapiens
tggtaaagttgattggtgctct

SEQ ID NO: 8016982 - DNA, 22 bp, Homo sapiens
tggtaaagtgtactgaatatga

SEQ ID NO: 8016983 - DNA, 22 bp, Homo sapiens
tggtaaagtggcttcacagtgt

SEQ ID NO: 8016984 - DNA, 22 bp, Homo sapiens
tggtaaagaaatgtcagggcag

SEQ ID NO: 8016985 - DNA, 22 bp, Homo sapiens
tggtaaaatattacaaggcact

SEQ ID NO: 8016986 - DNA, 22 bp, Homo sapiens
tggtaaaaactgcaattacttt

SEQ ID NO: 8016987 - DNA, 22 bp, Homo sapiens
tggtaaaaactgcaattacttt

SEQ ID NO: 8016988 - DNA, 22 bp, Homo sapiens
tggtaaaaactgcaattacttt

SEQ ID NO: 8016989 - DNA, 22 bp, Homo sapiens
tggtaaagaaatgtcagggcag

SEQ ID NO: 8016990 - DNA, 22 bp, Homo sapiens
tggtaaagaaggctagatctga

SEQ ID NO: 8016991 - DNA, 22 bp, Homo sapiens
tggtaaagaaatgtcagggcag

SEQ ID NO: 8016992 - DNA, 19 bp, Homo sapiens
tggtaaagactgtccccca

SEQ ID NO: 8016993 - DNA, 20 bp, Homo sapiens
tggtaaaggagggctggagg

SEQ ID NO: 8016994 - DNA, 19 bp, Homo sapiens
tggtaaagactgtccccca

SEQ ID NO: 8016995 - DNA, 22 bp, Homo sapiens
tggtaaagcacattgcatttaa

SEQ ID NO: 8016996 - DNA, 22 bp, Homo sapiens
tggtaactttcagcatggtgac

SEQ ID NO: 8016997 - DNA, 22 bp, Homo sapiens
tggtaagaataggggctttgga

SEQ ID NO: 8016998 - DNA, 22 bp, Homo sapiens
tggtaacacaggcattaaagtt

SEQ ID NO: 8016999 - DNA, 22 bp, Homo sapiens
tggtaagataagagccaggcct

SEQ ID NO: 8017000 - DNA, 22 bp, Homo sapiens
tggtaaggcccagctggagtcc

SEQ ID NO: 8017001 - DNA, 22 bp, Homo sapiens
tggtaaggcccagctggagtcc

SEQ ID NO: 8017002 - DNA, 19 bp, Homo sapiens
tgggttggaagggaatgaa

SEQ ID NO: 8017003 - DNA, 22 bp, Homo sapiens
tgggttggaagcaggaggcacc

SEQ ID NO: 8017004 - DNA, 22 bp, Homo sapiens
tgggttctttcacttctcagtt

SEQ ID NO: 8017005 - DNA, 22 bp, Homo sapiens
tgggttctttcacttctcagtt

SEQ ID NO: 8017006 - DNA, 22 bp, Homo sapiens
tgggttctttcacttctcagtt

SEQ ID NO: 8017007 - DNA, 22 bp, Homo sapiens
tgggttctagagggaccagaac

SEQ ID NO: 8017008 - DNA, 22 bp, Homo sapiens
tgggttctagagggaccagaac

SEQ ID NO: 8017009 - DNA, 22 bp, Homo sapiens
tgggttcacgccattctcctgc

SEQ ID NO: 8017010 - DNA, 22 bp, Homo sapiens
tgggttcagatcccagctctgt

SEQ ID NO: 8017011 - DNA, 22 bp, Homo sapiens
tgggttggtcagcataagatgg

SEQ ID NO: 8017012 - DNA, 22 bp, Homo sapiens
tgggttttccatctatttactc

SEQ ID NO: 8017013 - DNA, 22 bp, Homo sapiens
tgggttttccacatatgccatg

SEQ ID NO: 8017014 - DNA, 22 bp, Homo sapiens
tgggtttgattctcagccaagg

SEQ ID NO: 8017015 - DNA, 22 bp, Homo sapiens
tggtaaaaaccgcaattacatt

SEQ ID NO: 8017016 - DNA, 22 bp, Homo sapiens
tggtaaaaaccgcaattacatt

SEQ ID NO: 8017017 - DNA, 22 bp, Homo sapiens
tgggtgtgcccagatggtgtcc

SEQ ID NO: 8017018 - DNA, 22 bp, Homo sapiens
tgggtgtgagcccgggagccgc

SEQ ID NO: 8017019 - DNA, 22 bp, Homo sapiens
tgggtgtgcccagatggtgtcc

SEQ ID NO: 8017020 - DNA, 22 bp, Homo sapiens
tgggtggttgctgaggctcctt

SEQ ID NO: 8017021 - DNA, 22 bp, Homo sapiens
tgggtggttgctgaggctcctt

SEQ ID NO: 8017022 - DNA, 22 bp, Homo sapiens
tgggtggttatagagatcaact

SEQ ID NO: 8017023 - DNA, 22 bp, Homo sapiens
tgggtggttgctgaggctcctt

SEQ ID NO: 8017024 - DNA, 22 bp, Homo sapiens
tgggtggtggcagtaatgagaa

SEQ ID NO: 8017025 - DNA, 22 bp, Homo sapiens
tgggtggtcttgcttcccagga

SEQ ID NO: 8017026 - DNA, 22 bp, Homo sapiens
tgggtggtccaggctcagcaga

SEQ ID NO: 8017027 - DNA, 22 bp, Homo sapiens
tgggtggtccaggctcagcaga

SEQ ID NO: 8017028 - DNA, 22 bp, Homo sapiens
tgggtggtttatgagtgggttt

SEQ ID NO: 8017029 - DNA, 22 bp, Homo sapiens
tgggtggtttatgagtgggttt

SEQ ID NO: 8017030 - DNA, 22 bp, Homo sapiens
tgggtggtttatgagtgggttt

SEQ ID NO: 8017031 - DNA, 22 bp, Homo sapiens
tgggtgtgaagtctgttggcct

SEQ ID NO: 8017032 - DNA, 22 bp, Homo sapiens
tgggtgtccagaccctgcacat

SEQ ID NO: 8017033 - DNA, 22 bp, Homo sapiens
tgggtgtgaagtctgttggcct

SEQ ID NO: 8017034 - DNA, 22 bp, Homo sapiens
tgggtgtgaagtctgttggcct

SEQ ID NO: 8017035 - DNA, 21 bp, Homo sapiens
tgggtgggcagagtctcttca

SEQ ID NO: 8017036 - DNA, 21 bp, Homo sapiens
tgggtgggcagagtctcttca

SEQ ID NO: 8017037 - DNA, 21 bp, Homo sapiens
tgggtgggcagagtctcttca

SEQ ID NO: 8017038 - DNA, 21 bp, Homo sapiens
tgggtgggcagagtctcttca

SEQ ID NO: 8017039 - DNA, 21 bp, Homo sapiens
tgggtgggcagagtctcttca

SEQ ID NO: 8017040 - DNA, 21 bp, Homo sapiens
tgggtgggcagagtctcttca

SEQ ID NO: 8017041 - DNA, 21 bp, Homo sapiens
tgggtgggcagagtctcttca

SEQ ID NO: 8017042 - DNA, 21 bp, Homo sapiens
tgggtgggcagagtctcttca

SEQ ID NO: 8017043 - DNA, 16 bp, Homo sapiens
tgggtgggaggagcgg

SEQ ID NO: 8017044 - DNA, 22 bp, Homo sapiens
tgggtggtccaggctcagcaga

SEQ ID NO: 8017045 - DNA, 17 bp, Homo sapiens
tgggtggtagggagagg

SEQ ID NO: 8017046 - DNA, 21 bp, Homo sapiens
tgggtgggcagagtctcttca

SEQ ID NO: 8017047 - DNA, 21 bp, Homo sapiens
tgggtgggcagagtctcttca

SEQ ID NO: 8017048 - DNA, 17 bp, Homo sapiens
tgggtggtagggagagg

SEQ ID NO: 8017049 - DNA, 21 bp, Homo sapiens
tgggtgggcagagtctcttca

SEQ ID NO: 8017050 - DNA, 22 bp, Homo sapiens
tgggtgggagcgccctgtctgg

SEQ ID NO: 8017051 - DNA, 22 bp, Homo sapiens
tgggtgggagcgccctgtctgg

SEQ ID NO: 8017052 - DNA, 22 bp, Homo sapiens
tgggtgggagcgccctgtctgg

SEQ ID NO: 8017053 - DNA, 22 bp, Homo sapiens
tgggtgggagcgccctgtctgg

SEQ ID NO: 8017054 - DNA, 22 bp, Homo sapiens
tgggtgggagcgccctgtctgg

SEQ ID NO: 8017055 - DNA, 22 bp, Homo sapiens
tgggtgggagcgccctgtctgg

SEQ ID NO: 8017056 - DNA, 22 bp, Homo sapiens
tgggtgggagcgccctgtctgg

SEQ ID NO: 8017057 - DNA, 22 bp, Homo sapiens
tgggtgggagcgccctgtctgg

SEQ ID NO: 8017058 - DNA, 16 bp, Homo sapiens
tgggtgggaggagcgg

SEQ ID NO: 8017059 - DNA, 16 bp, Homo sapiens
tgggtgggaggagcgg

SEQ ID NO: 8017060 - DNA, 16 bp, Homo sapiens
tgggtgggaggagcgg

SEQ ID NO: 8017061 - DNA, 16 bp, Homo sapiens
tgggtgggaggagcgg

SEQ ID NO: 8017062 - DNA, 16 bp, Homo sapiens
tgggtgggaggagcgg

SEQ ID NO: 8017063 - DNA, 16 bp, Homo sapiens
tgggtgggaggagcgg

SEQ ID NO: 8017064 - DNA, 16 bp, Homo sapiens
tgggtgggaggagcgg

SEQ ID NO: 8017065 - DNA, 16 bp, Homo sapiens
tgggtgggaggagcgg

SEQ ID NO: 8017066 - DNA, 16 bp, Homo sapiens
tgggtgggaggagcgg

SEQ ID NO: 8017067 - DNA, 22 bp, Homo sapiens
tgggtgcaggatgagtgctggc

SEQ ID NO: 8017068 - DNA, 22 bp, Homo sapiens
tgggtgcaggatgagtgctggc

SEQ ID NO: 8017069 - DNA, 22 bp, Homo sapiens
tgggtgcaggatgagtgctggc

SEQ ID NO: 8017070 - DNA, 21 bp, Homo sapiens
tgggtgcaagctgcggatgct

SEQ ID NO: 8017071 - DNA, 22 bp, Homo sapiens
tgggtgcaggtcttgtgccagg

SEQ ID NO: 8017072 - DNA, 22 bp, Homo sapiens
tgggtgcatgtgagcacgtgca

SEQ ID NO: 8017073 - DNA, 22 bp, Homo sapiens
tgggtgcatgtgagcacgtgca

SEQ ID NO: 8017074 - DNA, 22 bp, Homo sapiens
tgggtgccaacctctggtggcc

SEQ ID NO: 8017075 - DNA, 22 bp, Homo sapiens
tgggtgccaacctctggtggcc

SEQ ID NO: 8017076 - DNA, 20 bp, Homo sapiens
tgggtgcctgccacggggcc

SEQ ID NO: 8017077 - DNA, 22 bp, Homo sapiens
tgggtgctctgcgaccgtaggg

SEQ ID NO: 8017078 - DNA, 22 bp, Homo sapiens
tgggtgctctgcgaccgtaggg

SEQ ID NO: 8017079 - DNA, 22 bp, Homo sapiens
tgggtgctctgcgaccgtaggg

SEQ ID NO: 8017080 - DNA, 22 bp, Homo sapiens
tgggtgctctgcgaccgtaggg

SEQ ID NO: 8017081 - DNA, 22 bp, Homo sapiens
tgggtgcttcgtcagctctgag

SEQ ID NO: 8017082 - DNA, 21 bp, Homo sapiens
tgggtggaagcgggaggccgc

SEQ ID NO: 8017083 - DNA, 22 bp, Homo sapiens
tgggtgcttcgtcagctctgag

SEQ ID NO: 8017084 - DNA, 21 bp, Homo sapiens
tgggtggaagcgggaggccgc

SEQ ID NO: 8017085 - DNA, 21 bp, Homo sapiens
tgggtggaagcgggaggccgc

SEQ ID NO: 8017086 - DNA, 22 bp, Homo sapiens
tgggtgctctgcgaccgtaggg

SEQ ID NO: 8017087 - DNA, 22 bp, Homo sapiens
tgggtgctctgcgaccgtaggg

SEQ ID NO: 8017088 - DNA, 22 bp, Homo sapiens
tgggtgctctgcgaccgtaggg

SEQ ID NO: 8017089 - DNA, 22 bp, Homo sapiens
tgggtgctctgcgaccgtaggg

SEQ ID NO: 8017090 - DNA, 20 bp, Homo sapiens
tgggtgagagtgtttgctct

SEQ ID NO: 8017091 - DNA, 22 bp, Homo sapiens
tgggtgagccacaggagttgtc

SEQ ID NO: 8017092 - DNA, 22 bp, Homo sapiens
tgggtgagccacaggagttgtc

SEQ ID NO: 8017093 - DNA, 22 bp, Homo sapiens
tgggtgagcggctgcacacccg

SEQ ID NO: 8017094 - DNA, 22 bp, Homo sapiens
tgggtgagccacaggagttgtc

SEQ ID NO: 8017095 - DNA, 22 bp, Homo sapiens
tgggtgagccacaggagttgtc

SEQ ID NO: 8017096 - DNA, 22 bp, Homo sapiens
tgggtgaggagaggctgtctaa

SEQ ID NO: 8017097 - DNA, 22 bp, Homo sapiens
tgggtgaggatgatgaggcagc

SEQ ID NO: 8017098 - DNA, 22 bp, Homo sapiens
tgggtgaggagaggctgtctaa

SEQ ID NO: 8017099 - DNA, 22 bp, Homo sapiens
tgggtgaggagaggctgtctaa

SEQ ID NO: 8017100 - DNA, 22 bp, Homo sapiens
tgggtgagtggagggcattcta

SEQ ID NO: 8017101 - DNA, 22 bp, Homo sapiens
tgggtgagtggagggcattcta

SEQ ID NO: 8017102 - DNA, 22 bp, Homo sapiens
tgggtgaggatgatgaggcagc

SEQ ID NO: 8017103 - DNA, 22 bp, Homo sapiens
tgggtgagtggagggcattcta

SEQ ID NO: 8017104 - DNA, 22 bp, Homo sapiens
tgggtgagtggagggcattcta

SEQ ID NO: 8017105 - DNA, 22 bp, Homo sapiens
tgggtgaggatgatgaggcagc

SEQ ID NO: 8017106 - DNA, 22 bp, Homo sapiens
tgggtgaggatgatgaggcagc

SEQ ID NO: 8017107 - DNA, 22 bp, Homo sapiens
tgggtgaggatgatgaggcagc

SEQ ID NO: 8017108 - DNA, 22 bp, Homo sapiens
tgggtgaggatgatgaggcagc

SEQ ID NO: 8017109 - DNA, 22 bp, Homo sapiens
tggggggatacttgctactggc

SEQ ID NO: 8017110 - DNA, 22 bp, Homo sapiens
tggggggcacttcagcacaatg

SEQ ID NO: 8017111 - DNA, 22 bp, Homo sapiens
tggggggcacttcagcacaatg

SEQ ID NO: 8017112 - DNA, 22 bp, Homo sapiens
tggggggcacttcagcacaatg

SEQ ID NO: 8017113 - DNA, 22 bp, Homo sapiens
tgggggctgtgcacaggctcac

SEQ ID NO: 8017114 - DNA, 22 bp, Homo sapiens
tgggggctgtgcacaggctcac

SEQ ID NO: 8017115 - DNA, 22 bp, Homo sapiens
tgggggctgtgcacaggctcac

SEQ ID NO: 8017116 - DNA, 21 bp, Homo sapiens
tgggggtgaggcctaggaatc

SEQ ID NO: 8017117 - DNA, 21 bp, Homo sapiens
tgggggtgaggcctaggaatc

SEQ ID NO: 8017118 - DNA, 22 bp, Homo sapiens
tgggggtgactatctcgggaat

SEQ ID NO: 8017119 - DNA, 22 bp, Homo sapiens
tgggggtgactatctcgggaat

SEQ ID NO: 8017120 - DNA, 22 bp, Homo sapiens
tgggggtgactatctcgggaat

SEQ ID NO: 8017121 - DNA, 22 bp, Homo sapiens
tgggggtgactatctcgggaat

SEQ ID NO: 8017122 - DNA, 22 bp, Homo sapiens
tgggggtgaaagtctggacagt

SEQ ID NO: 8017123 - DNA, 22 bp, Homo sapiens
tgggggtgaaagtctggacagt

SEQ ID NO: 8017124 - DNA, 22 bp, Homo sapiens
tgggggtgaaagtctggacagt

SEQ ID NO: 8017125 - DNA, 22 bp, Homo sapiens
tgggggtgaaagtctggacagt

SEQ ID NO: 8017126 - DNA, 22 bp, Homo sapiens
tgggggtgccctatgaggaagc

SEQ ID NO: 8017127 - DNA, 22 bp, Homo sapiens
tgggggtgccctatgaggaagc

SEQ ID NO: 8017128 - DNA, 22 bp, Homo sapiens
tgggggtgccctatgaggaagc

SEQ ID NO: 8017129 - DNA, 22 bp, Homo sapiens
tgggggtgctgagaagacagga

SEQ ID NO: 8017130 - DNA, 22 bp, Homo sapiens
tgggggtgctgagaagacagga

SEQ ID NO: 8017131 - DNA, 22 bp, Homo sapiens
tgggggtgctgagaagacagga

SEQ ID NO: 8017132 - DNA, 22 bp, Homo sapiens
tgggggtgctgagaagacagga

SEQ ID NO: 8017133 - DNA, 21 bp, Homo sapiens
tgggggtgaggcctaggaatc

SEQ ID NO: 8017134 - DNA, 23 bp, Homo sapiens
tgggggtgcacgggccacatctt

SEQ ID NO: 8017135 - DNA, 23 bp, Homo sapiens
tgggggtgcacgggccacatctt

SEQ ID NO: 8017136 - DNA, 23 bp, Homo sapiens
tgggggtgcacgggccacatctt

SEQ ID NO: 8017137 - DNA, 22 bp, Homo sapiens
tgggggtgccctatgaggaagc

SEQ ID NO: 8017138 - DNA, 23 bp, Homo sapiens
tgggggtgcacgggccacatctt

SEQ ID NO: 8017139 - DNA, 22 bp, Homo sapiens
tggggtgaatctttgttgtccg

SEQ ID NO: 8017140 - DNA, 22 bp, Homo sapiens
tggggtctggagttgcccatga

SEQ ID NO: 8017141 - DNA, 22 bp, Homo sapiens
tggggtctgagtatctgcattt

SEQ ID NO: 8017142 - DNA, 22 bp, Homo sapiens
tgggggtggttcttgcctccag

SEQ ID NO: 8017143 - DNA, 22 bp, Homo sapiens
tgggggtggttcttgcctccag

SEQ ID NO: 8017144 - DNA, 22 bp, Homo sapiens
tgggggtggttcttgcctccag

SEQ ID NO: 8017145 - DNA, 20 bp, Homo sapiens
tggggtctagttggcctggg

SEQ ID NO: 8017146 - DNA, 20 bp, Homo sapiens
tggggtctagttggcctggg

SEQ ID NO: 8017147 - DNA, 22 bp, Homo sapiens
tgggggtggttcttgcctccag

SEQ ID NO: 8017148 - DNA, 22 bp, Homo sapiens
tggggtcgagggttctctggca

SEQ ID NO: 8017149 - DNA, 20 bp, Homo sapiens
tggggtctagttggcctggg

SEQ ID NO: 8017150 - DNA, 18 bp, Homo sapiens
tggggtctctcaggtaag

SEQ ID NO: 8017151 - DNA, 22 bp, Homo sapiens
tggggtggaacccttctgctgg

SEQ ID NO: 8017152 - DNA, 22 bp, Homo sapiens
tggggtggaacccttctgctgg

SEQ ID NO: 8017153 - DNA, 22 bp, Homo sapiens
tggggtggaacccttctgctgg

SEQ ID NO: 8017154 - DNA, 22 bp, Homo sapiens
tggggtggaacccttctgctgg

SEQ ID NO: 8017155 - DNA, 22 bp, Homo sapiens
tggggtggatagaaagtgatgt

SEQ ID NO: 8017156 - DNA, 22 bp, Homo sapiens
tggggtggatagaaagtgatgt

SEQ ID NO: 8017157 - DNA, 22 bp, Homo sapiens
tggggtggaacccttctgctgg

SEQ ID NO: 8017158 - DNA, 22 bp, Homo sapiens
tggggtggatagaaagtgatgt

SEQ ID NO: 8017159 - DNA, 22 bp, Homo sapiens
tggggtggatagaaagtgatgt

SEQ ID NO: 8017160 - DNA, 22 bp, Homo sapiens
tggggtggatagaaagtgatgt

SEQ ID NO: 8017161 - DNA, 22 bp, Homo sapiens
tggggtggatagaaagtgatgt

SEQ ID NO: 8017162 - DNA, 22 bp, Homo sapiens
tggggtggatagaaagtgatgt

SEQ ID NO: 8017163 - DNA, 22 bp, Homo sapiens
tggggtgggcatgcgctgtcct

SEQ ID NO: 8017164 - DNA, 22 bp, Homo sapiens
tggggtgggcatgcgctgtcct

SEQ ID NO: 8017165 - DNA, 22 bp, Homo sapiens
tggggtgacagtgcagtggtca

SEQ ID NO: 8017166 - DNA, 22 bp, Homo sapiens
tggggtgccgacagggagggca

SEQ ID NO: 8017167 - DNA, 22 bp, Homo sapiens
tggggtgccgacagggagggca

SEQ ID NO: 8017168 - DNA, 22 bp, Homo sapiens
tggggtgccgacagggagggca

SEQ ID NO: 8017169 - DNA, 22 bp, Homo sapiens
tggggtggaacccttctgctgg

SEQ ID NO: 8017170 - DNA, 22 bp, Homo sapiens
tggggtgctttcttgcctgtac

SEQ ID NO: 8017171 - DNA, 22 bp, Homo sapiens
tggggtggaacccttctgctgg

SEQ ID NO: 8017172 - DNA, 22 bp, Homo sapiens
tggggtgctttcttgcctgtac

SEQ ID NO: 8017173 - DNA, 22 bp, Homo sapiens
tggggtgccgacagggagggca

SEQ ID NO: 8017174 - DNA, 22 bp, Homo sapiens
tggggtggggttactcattctg

SEQ ID NO: 8017175 - DNA, 22 bp, Homo sapiens
tggggtggtaatacaccgttct

SEQ ID NO: 8017176 - DNA, 22 bp, Homo sapiens
tggggtggggttactcattctg

SEQ ID NO: 8017177 - DNA, 22 bp, Homo sapiens
tggggtggggttactcattctg

SEQ ID NO: 8017178 - DNA, 22 bp, Homo sapiens
tggggtggggttactcattctg

SEQ ID NO: 8017179 - DNA, 22 bp, Homo sapiens
tggggtggggttactcattctg

SEQ ID NO: 8017180 - DNA, 22 bp, Homo sapiens
tggggtggggttactcattctg

SEQ ID NO: 8017181 - DNA, 22 bp, Homo sapiens
tggggtgggcatgcgctgtcct

SEQ ID NO: 8017182 - DNA, 22 bp, Homo sapiens
tggggtgggcatgcgctgtcct

SEQ ID NO: 8017183 - DNA, 22 bp, Homo sapiens
tggggtgggcatgcgctgtcct

SEQ ID NO: 8017184 - DNA, 22 bp, Homo sapiens
tggggtgggcatgcgctgtcct

SEQ ID NO: 8017185 - DNA, 22 bp, Homo sapiens
tggggtgggcatgcgctgtcct

SEQ ID NO: 8017186 - DNA, 22 bp, Homo sapiens
tggggtgtgctcagagcagggg

SEQ ID NO: 8017187 - DNA, 17 bp, Homo sapiens
tggggtgttgaagggtt

SEQ ID NO: 8017188 - DNA, 17 bp, Homo sapiens
tggggtgttgaagggtt

SEQ ID NO: 8017189 - DNA, 22 bp, Homo sapiens
tggggtgtgagaagtagaggga

SEQ ID NO: 8017190 - DNA, 22 bp, Homo sapiens
tggggtgtgagaagtagaggga

SEQ ID NO: 8017191 - DNA, 22 bp, Homo sapiens
tggggtgtgctcagagcagggg

SEQ ID NO: 8017192 - DNA, 22 bp, Homo sapiens
tggggtggtgggaaccaagtag

SEQ ID NO: 8017193 - DNA, 22 bp, Homo sapiens
tggggtggtgggaaccaagtag

SEQ ID NO: 8017194 - DNA, 22 bp, Homo sapiens
tggggtggtgggaaccaagtag

SEQ ID NO: 8017195 - DNA, 22 bp, Homo sapiens
tggggtggtgggaaccaagtag

SEQ ID NO: 8017196 - DNA, 22 bp, Homo sapiens
tggggtggtaatacaccgttct

SEQ ID NO: 8017197 - DNA, 22 bp, Homo sapiens
tggggtggtaatacaccgttct

SEQ ID NO: 8017198 - DNA, 22 bp, Homo sapiens
tggggtggtaatacaccgttct

SEQ ID NO: 8017199 - DNA, 22 bp, Homo sapiens
tgggtagaggaattgggctacc

SEQ ID NO: 8017200 - DNA, 22 bp, Homo sapiens
tgggtagagtggagggataaga

SEQ ID NO: 8017201 - DNA, 22 bp, Homo sapiens
tgggtagcagggctgagctgtg

SEQ ID NO: 8017202 - DNA, 22 bp, Homo sapiens
tgggtaggaatcgagtgtatgg

SEQ ID NO: 8017203 - DNA, 22 bp, Homo sapiens
tgggtagcagggctgagctgtg

SEQ ID NO: 8017204 - DNA, 22 bp, Homo sapiens
tgggtaggaatcgagtgtatgg

SEQ ID NO: 8017205 - DNA, 22 bp, Homo sapiens
tgggtagaaacaaggctggact

SEQ ID NO: 8017206 - DNA, 22 bp, Homo sapiens
tgggtactgttacatgtaggac

SEQ ID NO: 8017207 - DNA, 22 bp, Homo sapiens
tgggtagagcaggctggggctt

SEQ ID NO: 8017208 - DNA, 22 bp, Homo sapiens
tgggtactcctattagttcagt

SEQ ID NO: 8017209 - DNA, 22 bp, Homo sapiens
tgggtactcctattagttcagt

SEQ ID NO: 8017210 - DNA, 22 bp, Homo sapiens
tgggtactcctattagttcagt

SEQ ID NO: 8017211 - DNA, 23 bp, Homo sapiens
tggggttgaattgtagctgtgcc

SEQ ID NO: 8017212 - DNA, 22 bp, Homo sapiens
tggggttctttgtttcctgcct

SEQ ID NO: 8017213 - DNA, 23 bp, Homo sapiens
tggggttgaattgtagctgtgcc

SEQ ID NO: 8017214 - DNA, 23 bp, Homo sapiens
tggggttgaattgtagctgtgcc

SEQ ID NO: 8017215 - DNA, 23 bp, Homo sapiens
tggggttgaattgtagctgtgcc

SEQ ID NO: 8017216 - DNA, 22 bp, Homo sapiens
tgggtaaaatgagttaggagaa

SEQ ID NO: 8017217 - DNA, 22 bp, Homo sapiens
tgggtactcctattagttcagt

SEQ ID NO: 8017218 - DNA, 22 bp, Homo sapiens
tgggtaagaattgggggctctg

SEQ ID NO: 8017219 - DNA, 22 bp, Homo sapiens
tgggtaaactgggtctggagag

SEQ ID NO: 8017220 - DNA, 22 bp, Homo sapiens
tgggtagggacttagctggctg

SEQ ID NO: 8017221 - DNA, 22 bp, Homo sapiens
tgggtagggacttagctggctg

SEQ ID NO: 8017222 - DNA, 22 bp, Homo sapiens
tgggtagggacttagctggctg

SEQ ID NO: 8017223 - DNA, 22 bp, Homo sapiens
tgggtagggacttagctggctg

SEQ ID NO: 8017224 - DNA, 22 bp, Homo sapiens
tgggtagggacttagctggctg

SEQ ID NO: 8017225 - DNA, 22 bp, Homo sapiens
tgggtaggaccagaaatgcact

SEQ ID NO: 8017226 - DNA, 22 bp, Homo sapiens
tgggtaggccaggaagcagtgt

SEQ ID NO: 8017227 - DNA, 22 bp, Homo sapiens
tgggtaggccaggaagcagtgt

SEQ ID NO: 8017228 - DNA, 22 bp, Homo sapiens
tgggtccacttctgcactgtgg

SEQ ID NO: 8017229 - DNA, 22 bp, Homo sapiens
tgggtccacttctgcactgtgg

SEQ ID NO: 8017230 - DNA, 22 bp, Homo sapiens
tgggtccacttctgcactgtgg

SEQ ID NO: 8017231 - DNA, 22 bp, Homo sapiens
tgggtccacggaagacttaggg

SEQ ID NO: 8017232 - DNA, 22 bp, Homo sapiens
tgggtccagtgcagctgcgcgt

SEQ ID NO: 8017233 - DNA, 22 bp, Homo sapiens
tgggtccagtgtcctggctatg

SEQ ID NO: 8017234 - DNA, 22 bp, Homo sapiens
tgggtccagtgcagctgcgcgt

SEQ ID NO: 8017235 - DNA, 22 bp, Homo sapiens
tgggtaggggacgtggaagaaa

SEQ ID NO: 8017236 - DNA, 22 bp, Homo sapiens
tgggtaggggacgtggaagaaa

SEQ ID NO: 8017237 - DNA, 22 bp, Homo sapiens
tgggtaggggacgtggaagaaa

SEQ ID NO: 8017238 - DNA, 22 bp, Homo sapiens
tgggtaggggacgtggaagaaa

SEQ ID NO: 8017239 - DNA, 22 bp, Homo sapiens
tgggtccacggaagacttaggg

SEQ ID NO: 8017240 - DNA, 22 bp, Homo sapiens
tgggtgaccccagaagaggatc

SEQ ID NO: 8017241 - DNA, 22 bp, Homo sapiens
tgggtgacagagcaagactctg

SEQ ID NO: 8017242 - DNA, 20 bp, Homo sapiens
tgggtgagagtgtttgctct

SEQ ID NO: 8017243 - DNA, 22 bp, Homo sapiens
tgggtctgtagggctgtccaat

SEQ ID NO: 8017244 - DNA, 22 bp, Homo sapiens
tgggtctgtagggctgtccaat

SEQ ID NO: 8017245 - DNA, 20 bp, Homo sapiens
tgggtctgcttggcttcagt

SEQ ID NO: 8017246 - DNA, 22 bp, Homo sapiens
tgggtctgtagggctgtccaat

SEQ ID NO: 8017247 - DNA, 22 bp, Homo sapiens
tgggtctgtagggctgtccaat

SEQ ID NO: 8017248 - DNA, 20 bp, Homo sapiens
tgggtctgcttggcttcagt

SEQ ID NO: 8017249 - DNA, 23 bp, Homo sapiens
tgggtctctagtacaggcaggca

SEQ ID NO: 8017250 - DNA, 23 bp, Homo sapiens
tgggtctctagtacaggcaggca

SEQ ID NO: 8017251 - DNA, 22 bp, Homo sapiens
tgggtctcctgtgcctgggagg

SEQ ID NO: 8017252 - DNA, 23 bp, Homo sapiens
tgggtctctagtacaggcaggca

SEQ ID NO: 8017253 - DNA, 22 bp, Homo sapiens
tgggtctccagttcagggcagg

SEQ ID NO: 8017254 - DNA, 22 bp, Homo sapiens
tgggtctcctgtgcctgggagg

SEQ ID NO: 8017255 - DNA, 22 bp, Homo sapiens
tgggtccttcaaagctgggtct

SEQ ID NO: 8017256 - DNA, 22 bp, Homo sapiens
tgggtccttgctaacttctatg

SEQ ID NO: 8017257 - DNA, 22 bp, Homo sapiens
tgggtccttgccatcttggagt

SEQ ID NO: 8017258 - DNA, 20 bp, Homo sapiens
tgggtcctgtgggagaagaa

SEQ ID NO: 8017259 - DNA, 22 bp, Homo sapiens
tgggtcctgtctccttgttctg

SEQ ID NO: 8017260 - DNA, 22 bp, Homo sapiens
tgggtccttcaaagctgggtct

SEQ ID NO: 8017261 - DNA, 22 bp, Homo sapiens
tgggtccttcaaagctgggtct

SEQ ID NO: 8017262 - DNA, 22 bp, Homo sapiens
tgggtccttgctggcttcaaag

SEQ ID NO: 8017263 - DNA, 22 bp, Homo sapiens
tgggtcctttttggacttcttc

SEQ ID NO: 8017264 - DNA, 22 bp, Homo sapiens
tgggtccttgctgattgctgag

SEQ ID NO: 8017265 - DNA, 22 bp, Homo sapiens
tgggtccttgctgattgctgag

SEQ ID NO: 8017266 - DNA, 22 bp, Homo sapiens
tgggtctccagttcagggcagg

SEQ ID NO: 8017267 - DNA, 22 bp, Homo sapiens
tgggtctccagttcagggcagg

SEQ ID NO: 8017268 - DNA, 22 bp, Homo sapiens
tgggtctccagttcagggcagg

SEQ ID NO: 8017269 - DNA, 22 bp, Homo sapiens
tgggtcctttttggacttcttc

SEQ ID NO: 8017270 - DNA, 22 bp, Homo sapiens
tgggtctccagttcagggcagg

SEQ ID NO: 8017271 - DNA, 22 bp, Homo sapiens
tgggtccatggaacagaggtgc

SEQ ID NO: 8017272 - DNA, 22 bp, Homo sapiens
tgggtccatggaacagaggtgc

SEQ ID NO: 8017273 - DNA, 22 bp, Homo sapiens
tgggtccatggaacagaggtgc

SEQ ID NO: 8017274 - DNA, 22 bp, Homo sapiens
tgggtcccaatctgaaatgtca

SEQ ID NO: 8017275 - DNA, 22 bp, Homo sapiens
tgggtcccaaactcctagaggt

SEQ ID NO: 8017276 - DNA, 21 bp, Homo sapiens
tgggtccccgacacgctacct

SEQ ID NO: 8017277 - DNA, 22 bp, Homo sapiens
tgggtcccaggaaggaccagca

SEQ ID NO: 8017278 - DNA, 22 bp, Homo sapiens
tgggtcctcgtcttccaaggca

SEQ ID NO: 8017279 - DNA, 22 bp, Homo sapiens
tgggtcctcgtcttccaaggca

SEQ ID NO: 8017280 - DNA, 22 bp, Homo sapiens
tgggtcctaaatgcagtcacat

SEQ ID NO: 8017281 - DNA, 22 bp, Homo sapiens
tgggtccctcatgagaggcatt

SEQ ID NO: 8017282 - DNA, 22 bp, Homo sapiens
tgggtcccttcagctctcatgg

SEQ ID NO: 8017283 - DNA, 22 bp, Homo sapiens
tgggtccctctggagtagtaca

SEQ ID NO: 8017284 - DNA, 22 bp, Homo sapiens
tgggtcctctggagcagcagca

SEQ ID NO: 8017285 - DNA, 22 bp, Homo sapiens
tgggtcctctgagagggcagcg

SEQ ID NO: 8017286 - DNA, 20 bp, Homo sapiens
tgggtcctgcacattctcca

SEQ ID NO: 8017287 - DNA, 20 bp, Homo sapiens
tgggtcctgcacattctcca

SEQ ID NO: 8017288 - DNA, 20 bp, Homo sapiens
tgggtcctgcacattctcca

SEQ ID NO: 8017289 - DNA, 22 bp, Homo sapiens
tgggtcctggaaggcgacaggt

SEQ ID NO: 8017290 - DNA, 22 bp, Homo sapiens
tgggtcctggctttgtcagggt

SEQ ID NO: 8017291 - DNA, 22 bp, Homo sapiens
tgggtcctgtctccttgttctg

SEQ ID NO: 8017292 - DNA, 20 bp, Homo sapiens
tgggtcctgcttcttcctga

SEQ ID NO: 8017293 - DNA, 22 bp, Homo sapiens
tgggtcctgcactgcaagcacc

SEQ ID NO: 8017294 - DNA, 20 bp, Homo sapiens
tgggtcctgcttcttcctga

SEQ ID NO: 8017295 - DNA, 22 bp, Homo sapiens
tgggcctgactcacctgcctcc

SEQ ID NO: 8017296 - DNA, 22 bp, Homo sapiens
tgggcctgactcacctgcctcc

SEQ ID NO: 8017297 - DNA, 20 bp, Homo sapiens
tgggcctgagcctgtgggct

SEQ ID NO: 8017298 - DNA, 20 bp, Homo sapiens
tgggcctgagcctgtgggct

SEQ ID NO: 8017299 - DNA, 20 bp, Homo sapiens
tgggcctgagcctgtgggct

SEQ ID NO: 8017300 - DNA, 22 bp, Homo sapiens
tgggcctgacacttactaggga

SEQ ID NO: 8017301 - DNA, 22 bp, Homo sapiens
tgggcctgacacttactaggga

SEQ ID NO: 8017302 - DNA, 22 bp, Homo sapiens
tgggcctgacacttactaggga

SEQ ID NO: 8017303 - DNA, 22 bp, Homo sapiens
tgggcctgactcacctgcctcc

SEQ ID NO: 8017304 - DNA, 22 bp, Homo sapiens
tgggcctgactcacctgcctcc

SEQ ID NO: 8017305 - DNA, 22 bp, Homo sapiens
tgggcctgactcacctgcctcc

SEQ ID NO: 8017306 - DNA, 22 bp, Homo sapiens
tgggcctgagctcaccaggggc

SEQ ID NO: 8017307 - DNA, 22 bp, Homo sapiens
tgggcctgagctcaccaggggc

SEQ ID NO: 8017308 - DNA, 22 bp, Homo sapiens
tgggcctgagctcaccaggggc

SEQ ID NO: 8017309 - DNA, 22 bp, Homo sapiens
tgggcctgagctcaccaggggc

SEQ ID NO: 8017310 - DNA, 22 bp, Homo sapiens
tgggcctgagtttgggaactgg

SEQ ID NO: 8017311 - DNA, 22 bp, Homo sapiens
tgggcctgagtttgggaactgg

SEQ ID NO: 8017312 - DNA, 21 bp, Homo sapiens
tgggcctgattcccagggtca

SEQ ID NO: 8017313 - DNA, 21 bp, Homo sapiens
tgggcctgattcccagggtca

SEQ ID NO: 8017314 - DNA, 21 bp, Homo sapiens
tgggcctgattcccagggtca

SEQ ID NO: 8017315 - DNA, 22 bp, Homo sapiens
tgggcctgagtttgggaactgg

SEQ ID NO: 8017316 - DNA, 22 bp, Homo sapiens
tgggcctgagtttgggaactgg

SEQ ID NO: 8017317 - DNA, 20 bp, Homo sapiens
tgggcctctggtgcctctgg

SEQ ID NO: 8017318 - DNA, 22 bp, Homo sapiens
tgggcctctgtttcctcatctg

SEQ ID NO: 8017319 - DNA, 20 bp, Homo sapiens
tgggcctctggtgcctctgg

SEQ ID NO: 8017320 - DNA, 22 bp, Homo sapiens
tgggcctctgtttcctcatctg

SEQ ID NO: 8017321 - DNA, 22 bp, Homo sapiens
tgggcctctgtttcctcatctg

SEQ ID NO: 8017322 - DNA, 22 bp, Homo sapiens
tgggcctgaaggagctgcgccc

SEQ ID NO: 8017323 - DNA, 22 bp, Homo sapiens
tgggcctgaaggagctgcgccc

SEQ ID NO: 8017324 - DNA, 22 bp, Homo sapiens
tgggcctgaaggagctgcgccc

SEQ ID NO: 8017325 - DNA, 22 bp, Homo sapiens
tgggcctgaaggagctgcgccc

SEQ ID NO: 8017326 - DNA, 22 bp, Homo sapiens
tgggcctgaaattcccatttta

SEQ ID NO: 8017327 - DNA, 22 bp, Homo sapiens
tgggcctcctttccattcagag

SEQ ID NO: 8017328 - DNA, 22 bp, Homo sapiens
tgggcctcctttccattcagag

SEQ ID NO: 8017329 - DNA, 22 bp, Homo sapiens
tgggcctcggagcacaggagac

SEQ ID NO: 8017330 - DNA, 22 bp, Homo sapiens
tgggcctcggagcacaggagac

SEQ ID NO: 8017331 - DNA, 19 bp, Homo sapiens
tgggcctctcatatctgcc

SEQ ID NO: 8017332 - DNA, 22 bp, Homo sapiens
tgggcctcggggaagcccgtgt

SEQ ID NO: 8017333 - DNA, 22 bp, Homo sapiens
tgggcctcggggaagcccgtgt

SEQ ID NO: 8017334 - DNA, 22 bp, Homo sapiens
tgggcctctgccacgctccccc

SEQ ID NO: 8017335 - DNA, 22 bp, Homo sapiens
tgggcctctgggttagtcccta

SEQ ID NO: 8017336 - DNA, 22 bp, Homo sapiens
tgggcctctgggttagtcccta

SEQ ID NO: 8017337 - DNA, 20 bp, Homo sapiens
tgggcctctggtgcctctgg

SEQ ID NO: 8017338 - DNA, 23 bp, Homo sapiens
tgggcctctccacccttttctgt

SEQ ID NO: 8017339 - DNA, 23 bp, Homo sapiens
tgggcctctccacccttttctgt

SEQ ID NO: 8017340 - DNA, 22 bp, Homo sapiens
tgggcctctgccacgctccccc

SEQ ID NO: 8017341 - DNA, 23 bp, Homo sapiens
tgggcctctccacccttttctgt

SEQ ID NO: 8017342 - DNA, 22 bp, Homo sapiens
tgggcctctgccacgctccccc

SEQ ID NO: 8017343 - DNA, 22 bp, Homo sapiens
tgggcctgattcttgaatcctg

SEQ ID NO: 8017344 - DNA, 18 bp, Homo sapiens
tgggcctgcatcctagtc

SEQ ID NO: 8017345 - DNA, 18 bp, Homo sapiens
tgggcctgcatcctagtc

SEQ ID NO: 8017346 - DNA, 18 bp, Homo sapiens
tgggcctgcatcctagtc

SEQ ID NO: 8017347 - DNA, 18 bp, Homo sapiens
tgggcctgcatcctagtc

SEQ ID NO: 8017348 - DNA, 18 bp, Homo sapiens
tgggcctgcatcctagtc

SEQ ID NO: 8017349 - DNA, 21 bp, Homo sapiens
tgggcctgattcccagggtca

SEQ ID NO: 8017350 - DNA, 21 bp, Homo sapiens
tgggcctgattcccagggtca

SEQ ID NO: 8017351 - DNA, 21 bp, Homo sapiens
tgggcctgattcccagggtca

SEQ ID NO: 8017352 - DNA, 22 bp, Homo sapiens
tgggcctgattcttgaatcctg

SEQ ID NO: 8017353 - DNA, 21 bp, Homo sapiens
tgggcctgattcccagggtca

SEQ ID NO: 8017354 - DNA, 22 bp, Homo sapiens
tgggcctgccccaggcttcagc

SEQ ID NO: 8017355 - DNA, 22 bp, Homo sapiens
tgggcctgccccaggcttcagc

SEQ ID NO: 8017356 - DNA, 22 bp, Homo sapiens
tgggcctgccccaggcttcagc

SEQ ID NO: 8017357 - DNA, 22 bp, Homo sapiens
tgggcctgccccaggcttcagc

SEQ ID NO: 8017358 - DNA, 22 bp, Homo sapiens
tgggcctgccccaggcttcagc

SEQ ID NO: 8017359 - DNA, 22 bp, Homo sapiens
tgggcctgccccaggcttcagc

SEQ ID NO: 8017360 - DNA, 22 bp, Homo sapiens
tgggcctgccccaggcttcagc

SEQ ID NO: 8017361 - DNA, 19 bp, Homo sapiens
tgggcctgcatctgggtct

SEQ ID NO: 8017362 - DNA, 22 bp, Homo sapiens
tgggcctgccccaggcttcagc

SEQ ID NO: 8017363 - DNA, 18 bp, Homo sapiens
tgggcctgcatcctagtc

SEQ ID NO: 8017364 - DNA, 19 bp, Homo sapiens
tgggcctgcatctgggtct

SEQ ID NO: 8017365 - DNA, 23 bp, Homo sapiens
tgggcctggaaagccttagagag

SEQ ID NO: 8017366 - DNA, 23 bp, Homo sapiens
tgggcctggaaagccttagagag

SEQ ID NO: 8017367 - DNA, 23 bp, Homo sapiens
tgggcctggaaagccttagagag

SEQ ID NO: 8017368 - DNA, 22 bp, Homo sapiens
tgggcctgctggggcattttca

SEQ ID NO: 8017369 - DNA, 22 bp, Homo sapiens
tgggcctgccccaggcttcagc

SEQ ID NO: 8017370 - DNA, 23 bp, Homo sapiens
tgggcctggaaagccttagagag

SEQ ID NO: 8017371 - DNA, 23 bp, Homo sapiens
tgggcctggaaagccttagagag

SEQ ID NO: 8017372 - DNA, 23 bp, Homo sapiens
tgggcctggaaagccttagagag

SEQ ID NO: 8017373 - DNA, 22 bp, Homo sapiens
tgggcctggacaaggccactag

SEQ ID NO: 8017374 - DNA, 22 bp, Homo sapiens
tgggcctgggctcctgtcctct

SEQ ID NO: 8017375 - DNA, 22 bp, Homo sapiens
tgggcctggacaaggccactag

SEQ ID NO: 8017376 - DNA, 22 bp, Homo sapiens
tgggcctggacaaggccactag

SEQ ID NO: 8017377 - DNA, 22 bp, Homo sapiens
tgggcctgggctcctgtcctct

SEQ ID NO: 8017378 - DNA, 22 bp, Homo sapiens
tgggcctgggctcctgtcctct

SEQ ID NO: 8017379 - DNA, 22 bp, Homo sapiens
tgggcctgggctcctgtcctct

SEQ ID NO: 8017380 - DNA, 22 bp, Homo sapiens
tgggcctgggctcctgtcctct

SEQ ID NO: 8017381 - DNA, 22 bp, Homo sapiens
tgggcctgggctggacagcctg

SEQ ID NO: 8017382 - DNA, 22 bp, Homo sapiens
tgggcctgggctggacagcctg

SEQ ID NO: 8017383 - DNA, 22 bp, Homo sapiens
tgggcctgggctggacagcctg

SEQ ID NO: 8017384 - DNA, 22 bp, Homo sapiens
tgggcctgggctggacagcctg

SEQ ID NO: 8017385 - DNA, 22 bp, Homo sapiens
tgggcctgggctggacagcctg

SEQ ID NO: 8017386 - DNA, 22 bp, Homo sapiens
tgggcctgggctggacagcctg

SEQ ID NO: 8017387 - DNA, 22 bp, Homo sapiens
tgggcctgggctcctgtcctct

SEQ ID NO: 8017388 - DNA, 22 bp, Homo sapiens
tgggcctgggctggacagcctg

SEQ ID NO: 8017389 - DNA, 22 bp, Homo sapiens
tgggcctggggcagcccaaatc

SEQ ID NO: 8017390 - DNA, 22 bp, Homo sapiens
tgggcctggggcagcccaaatc

SEQ ID NO: 8017391 - DNA, 22 bp, Homo sapiens
tgggcctggggcagcccaaatc

SEQ ID NO: 8017392 - DNA, 22 bp, Homo sapiens
tgggcctgggctggacagcctg

SEQ ID NO: 8017393 - DNA, 22 bp, Homo sapiens
tgggcctgggtctttgctgcca

SEQ ID NO: 8017394 - DNA, 22 bp, Homo sapiens
tgggcctgggtctttgctgcca

SEQ ID NO: 8017395 - DNA, 22 bp, Homo sapiens
tgggcctggggcagcccaaatc

SEQ ID NO: 8017396 - DNA, 22 bp, Homo sapiens
tgggcctcaccttcttggcagc

SEQ ID NO: 8017397 - DNA, 22 bp, Homo sapiens
tgggcctcaccttcttggcagc

SEQ ID NO: 8017398 - DNA, 22 bp, Homo sapiens
tgggcctcaccttcttggcagc

SEQ ID NO: 8017399 - DNA, 19 bp, Homo sapiens
tgggcctcacaatgctccc

SEQ ID NO: 8017400 - DNA, 22 bp, Homo sapiens
tgggcctcaccttcttggcagc

SEQ ID NO: 8017401 - DNA, 22 bp, Homo sapiens
tgggcctcaccttcttggcagc

SEQ ID NO: 8017402 - DNA, 22 bp, Homo sapiens
tgggccagtttctcattgaaat

SEQ ID NO: 8017403 - DNA, 19 bp, Homo sapiens
tgggcctcacaatgctccc

SEQ ID NO: 8017404 - DNA, 22 bp, Homo sapiens
tgggccagtttctcattgaaat

SEQ ID NO: 8017405 - DNA, 22 bp, Homo sapiens
tgggccagttggtgactacaaa

SEQ ID NO: 8017406 - DNA, 22 bp, Homo sapiens
tgggccagtttctcattgaaat

SEQ ID NO: 8017407 - DNA, 22 bp, Homo sapiens
tgggccagttggaatggatact

SEQ ID NO: 8017408 - DNA, 22 bp, Homo sapiens
tgggccagttggaatggatact

SEQ ID NO: 8017409 - DNA, 22 bp, Homo sapiens
tgggccagttggtgactacaaa

SEQ ID NO: 8017410 - DNA, 22 bp, Homo sapiens
tgggccagttggtgactacaaa

SEQ ID NO: 8017411 - DNA, 22 bp, Homo sapiens
tgggccagttggtgactacaaa

SEQ ID NO: 8017412 - DNA, 22 bp, Homo sapiens
tgggccagtcctgcctaaggtg

SEQ ID NO: 8017413 - DNA, 22 bp, Homo sapiens
tgggccagtcctgcctaaggtg

SEQ ID NO: 8017414 - DNA, 22 bp, Homo sapiens
tgggccagtcctgcctaaggtg

SEQ ID NO: 8017415 - DNA, 22 bp, Homo sapiens
tgggccagtcctgcctaaggtg

SEQ ID NO: 8017416 - DNA, 22 bp, Homo sapiens
tgggccagtcctgcctaaggtg

SEQ ID NO: 8017417 - DNA, 22 bp, Homo sapiens
tgggccagtcctgcctaaggtg

SEQ ID NO: 8017418 - DNA, 22 bp, Homo sapiens
tgggccagttatttcacctctg

SEQ ID NO: 8017419 - DNA, 23 bp, Homo sapiens
tgggccagttctgttgaaagcca

SEQ ID NO: 8017420 - DNA, 22 bp, Homo sapiens
tgggccagttctttactcgtcc

SEQ ID NO: 8017421 - DNA, 22 bp, Homo sapiens
tgggccagttctttactcgtcc

SEQ ID NO: 8017422 - DNA, 23 bp, Homo sapiens
tgggccagttctgttgaaagcca

SEQ ID NO: 8017423 - DNA, 22 bp, Homo sapiens
tgggcctcatgcccagccaccc

SEQ ID NO: 8017424 - DNA, 22 bp, Homo sapiens
tgggcctccaattccagcggga

SEQ ID NO: 8017425 - DNA, 22 bp, Homo sapiens
tgggcctcatcttcaatgagtc

SEQ ID NO: 8017426 - DNA, 22 bp, Homo sapiens
tgggcctcatgcccagccaccc

SEQ ID NO: 8017427 - DNA, 22 bp, Homo sapiens
tgggcctcatcttcaatgagtc

SEQ ID NO: 8017428 - DNA, 22 bp, Homo sapiens
tgggcctcatgcccagccaccc

SEQ ID NO: 8017429 - DNA, 22 bp, Homo sapiens
tgggcctcagtttgcttaatgt

SEQ ID NO: 8017430 - DNA, 22 bp, Homo sapiens
tgggcctcatcttcaatgagtc

SEQ ID NO: 8017431 - DNA, 22 bp, Homo sapiens
tgggcctcagtttgcttaatgt

SEQ ID NO: 8017432 - DNA, 22 bp, Homo sapiens
tgggcctcatcttcaatgagtc

SEQ ID NO: 8017433 - DNA, 21 bp, Homo sapiens
tgggcctcaggcagctgtgac

SEQ ID NO: 8017434 - DNA, 22 bp, Homo sapiens
tgggcctcagtttccttaggat

SEQ ID NO: 8017435 - DNA, 22 bp, Homo sapiens
tgggcctcagtttccttaggat

SEQ ID NO: 8017436 - DNA, 21 bp, Homo sapiens
tgggcctcaggcagctgtgac

SEQ ID NO: 8017437 - DNA, 22 bp, Homo sapiens
tgggcctcctgccctggcctag

SEQ ID NO: 8017438 - DNA, 22 bp, Homo sapiens
tgggcctcctggaagaatgtgg

SEQ ID NO: 8017439 - DNA, 22 bp, Homo sapiens
tgggcctcctggaagaatgtgg

SEQ ID NO: 8017440 - DNA, 22 bp, Homo sapiens
tgggcctcctttccattcagag

SEQ ID NO: 8017441 - DNA, 22 bp, Homo sapiens
tgggcctcctttccattcagag

SEQ ID NO: 8017442 - DNA, 22 bp, Homo sapiens
tgggcctcctgccctggcctag

SEQ ID NO: 8017443 - DNA, 22 bp, Homo sapiens
tgggcctcctgccctggcctag

SEQ ID NO: 8017444 - DNA, 22 bp, Homo sapiens
tgggcctcctgccctggcctag

SEQ ID NO: 8017445 - DNA, 22 bp, Homo sapiens
tgggcctcctgccctggcctag

SEQ ID NO: 8017446 - DNA, 22 bp, Homo sapiens
tgggcctcctccgacagccggg

SEQ ID NO: 8017447 - DNA, 22 bp, Homo sapiens
tgggcctccgcatggcccagcg

SEQ ID NO: 8017448 - DNA, 22 bp, Homo sapiens
tgggcctcccatgtcttaggga

SEQ ID NO: 8017449 - DNA, 22 bp, Homo sapiens
tgggcctcccatgtcttaggga

SEQ ID NO: 8017450 - DNA, 22 bp, Homo sapiens
tgggcctcccatgtcttaggga

SEQ ID NO: 8017451 - DNA, 22 bp, Homo sapiens
tgggcctccgcatggcccagcg

SEQ ID NO: 8017452 - DNA, 21 bp, Homo sapiens
tgggccagtagaaaggaaggc

SEQ ID NO: 8017453 - DNA, 21 bp, Homo sapiens
tgggccagtagaaaggaaggc

SEQ ID NO: 8017454 - DNA, 21 bp, Homo sapiens
tgggccagtagaaaggaaggc

SEQ ID NO: 8017455 - DNA, 21 bp, Homo sapiens
tgggccagtagaaaggaaggc

SEQ ID NO: 8017456 - DNA, 22 bp, Homo sapiens
tgggccaggtgcagtgctttag

SEQ ID NO: 8017457 - DNA, 22 bp, Homo sapiens
tgggccaggtctgtgtcagctg

SEQ ID NO: 8017458 - DNA, 22 bp, Homo sapiens
tgggccaggtgcagtgctttag

SEQ ID NO: 8017459 - DNA, 22 bp, Homo sapiens
tgggccaggtgcagtgctttag

SEQ ID NO: 8017460 - DNA, 17 bp, Homo sapiens
tgggccagtagaaggga

SEQ ID NO: 8017461 - DNA, 17 bp, Homo sapiens
tgggccagtagaaggga

SEQ ID NO: 8017462 - DNA, 17 bp, Homo sapiens
tgggccagtagaaggga

SEQ ID NO: 8017463 - DNA, 17 bp, Homo sapiens
tgggccagtagaaggga

SEQ ID NO: 8017464 - DNA, 17 bp, Homo sapiens
tgggccagtagaaggga

SEQ ID NO: 8017465 - DNA, 17 bp, Homo sapiens
tgggccagtagaaggga

SEQ ID NO: 8017466 - DNA, 22 bp, Homo sapiens
tgggccagtagctactcgcaag

SEQ ID NO: 8017467 - DNA, 22 bp, Homo sapiens
tgggccagtagctactcgcaag

SEQ ID NO: 8017468 - DNA, 22 bp, Homo sapiens
tgggccagtagctactcgcaag

SEQ ID NO: 8017469 - DNA, 22 bp, Homo sapiens
tgggccagtagctactcgcaag

SEQ ID NO: 8017470 - DNA, 22 bp, Homo sapiens
tgggccagtagctactcgcaag

SEQ ID NO: 8017471 - DNA, 22 bp, Homo sapiens
tgggccagtccagccccaggga

SEQ ID NO: 8017472 - DNA, 22 bp, Homo sapiens
tgggccagtccagccccaggga

SEQ ID NO: 8017473 - DNA, 22 bp, Homo sapiens
tgggccagtccagccccaggga

SEQ ID NO: 8017474 - DNA, 22 bp, Homo sapiens
tgggccagtccagccccaggga

SEQ ID NO: 8017475 - DNA, 22 bp, Homo sapiens
tgggccagtccagccccaggga

SEQ ID NO: 8017476 - DNA, 22 bp, Homo sapiens
tgggccagtcctgcctaaggtg

SEQ ID NO: 8017477 - DNA, 22 bp, Homo sapiens
tgggccagtccagccccaggga

SEQ ID NO: 8017478 - DNA, 22 bp, Homo sapiens
tgggccagtccagccccaggga

SEQ ID NO: 8017479 - DNA, 22 bp, Homo sapiens
tgggccaggcatgtgatcagca

SEQ ID NO: 8017480 - DNA, 22 bp, Homo sapiens
tgggccaggcatgtgatcagca

SEQ ID NO: 8017481 - DNA, 22 bp, Homo sapiens
tgggccaggcatgtgatcagca

SEQ ID NO: 8017482 - DNA, 22 bp, Homo sapiens
tgggccaggcatgtgatcagca

SEQ ID NO: 8017483 - DNA, 22 bp, Homo sapiens
tgggccaggcatgtgatcagca

SEQ ID NO: 8017484 - DNA, 22 bp, Homo sapiens
tgggccagggcacccagtccag

SEQ ID NO: 8017485 - DNA, 22 bp, Homo sapiens
tgggccagggcacccagtccag

SEQ ID NO: 8017486 - DNA, 22 bp, Homo sapiens
tgggccagggcacccagtccag

SEQ ID NO: 8017487 - DNA, 23 bp, Homo sapiens
tgggccagggagtccggtttctt

SEQ ID NO: 8017488 - DNA, 22 bp, Homo sapiens
tgggccagggcacccagtccag

SEQ ID NO: 8017489 - DNA, 22 bp, Homo sapiens
tgggccaggggcctcttctgat

SEQ ID NO: 8017490 - DNA, 22 bp, Homo sapiens
tgggccaggggcctcttctgat

SEQ ID NO: 8017491 - DNA, 22 bp, Homo sapiens
tgggccagggcacccagtccag

SEQ ID NO: 8017492 - DNA, 22 bp, Homo sapiens
tgggccaggtctgcggtcattt

SEQ ID NO: 8017493 - DNA, 22 bp, Homo sapiens
tgggccaggggcctcttctgat

SEQ ID NO: 8017494 - DNA, 22 bp, Homo sapiens
tgggccaggtctgtgtcagctg

SEQ ID NO: 8017495 - DNA, 22 bp, Homo sapiens
tgggccaggtctgtgtcagctg

SEQ ID NO: 8017496 - DNA, 22 bp, Homo sapiens
tgggccaggtctgtgtcagctg

SEQ ID NO: 8017497 - DNA, 22 bp, Homo sapiens
tgggccaggtctgtgtcagctg

SEQ ID NO: 8017498 - DNA, 22 bp, Homo sapiens
tgggccaggtctgtgtcagctg

SEQ ID NO: 8017499 - DNA, 22 bp, Homo sapiens
tgggccaggtctgtgtcagctg

SEQ ID NO: 8017500 - DNA, 22 bp, Homo sapiens
tgggccaggtctgtgtcagctg

SEQ ID NO: 8017501 - DNA, 22 bp, Homo sapiens
tgggcctgtgatgctgggctat

SEQ ID NO: 8017502 - DNA, 21 bp, Homo sapiens
tgggcctgtccctcttggagg

SEQ ID NO: 8017503 - DNA, 21 bp, Homo sapiens
tgggcctgtccctcttggagg

SEQ ID NO: 8017504 - DNA, 21 bp, Homo sapiens
tgggcctgtccctcttggagg

SEQ ID NO: 8017505 - DNA, 22 bp, Homo sapiens
tgggcctgtgatgctgggctat

SEQ ID NO: 8017506 - DNA, 22 bp, Homo sapiens
tgggcctgtgatgctgggctat

SEQ ID NO: 8017507 - DNA, 22 bp, Homo sapiens
tgggcctgggttcctcctgggc

SEQ ID NO: 8017508 - DNA, 22 bp, Homo sapiens
tgggcctgggttcctcctgggc

SEQ ID NO: 8017509 - DNA, 22 bp, Homo sapiens
tgggcctgggttcctcctgggc

SEQ ID NO: 8017510 - DNA, 22 bp, Homo sapiens
tgggcctgggttcctcctgggc

SEQ ID NO: 8017511 - DNA, 22 bp, Homo sapiens
tgggcctgtggcttggctctag

SEQ ID NO: 8017512 - DNA, 22 bp, Homo sapiens
tgggcctgtggcttggctctag

SEQ ID NO: 8017513 - DNA, 22 bp, Homo sapiens
tgggcctgtggcttggctctag

SEQ ID NO: 8017514 - DNA, 22 bp, Homo sapiens
tgggcctgtggcttggctctag

SEQ ID NO: 8017515 - DNA, 22 bp, Homo sapiens
tgggcctgtggcttggctctag

SEQ ID NO: 8017516 - DNA, 22 bp, Homo sapiens
tgggcctgtggcttggctctag

SEQ ID NO: 8017517 - DNA, 22 bp, Homo sapiens
tgggcctgtgatgctgggctat

SEQ ID NO: 8017518 - DNA, 20 bp, Homo sapiens
tgggcctgtggcagaagtct

SEQ ID NO: 8017519 - DNA, 20 bp, Homo sapiens
tgggcctgtggcagaagtct

SEQ ID NO: 8017520 - DNA, 22 bp, Homo sapiens
tgggcgacagagcaagactccg

SEQ ID NO: 8017521 - DNA, 22 bp, Homo sapiens
tgggcgacagagcaagactccg

SEQ ID NO: 8017522 - DNA, 22 bp, Homo sapiens
tgggcgacagagcaagactccg

SEQ ID NO: 8017523 - DNA, 23 bp, Homo sapiens
tgggcgaggcaggagtggagcac

SEQ ID NO: 8017524 - DNA, 22 bp, Homo sapiens
tgggcgaggagaatgctgtgaa

SEQ ID NO: 8017525 - DNA, 22 bp, Homo sapiens
tgggcgacagagcaagactccg

SEQ ID NO: 8017526 - DNA, 22 bp, Homo sapiens
tgggccttctcaatgcactgga

SEQ ID NO: 8017527 - DNA, 22 bp, Homo sapiens
tgggccttctcaatgcactgga

SEQ ID NO: 8017528 - DNA, 22 bp, Homo sapiens
tgggccttctaatctggtccct

SEQ ID NO: 8017529 - DNA, 22 bp, Homo sapiens
tgggccttacttggggctgact

SEQ ID NO: 8017530 - DNA, 22 bp, Homo sapiens
tgggcctgtttcccttcagggc

SEQ ID NO: 8017531 - DNA, 22 bp, Homo sapiens
tgggcctgtttcccttcagggc

SEQ ID NO: 8017532 - DNA, 22 bp, Homo sapiens
tgggcctgttggggttgagtta

SEQ ID NO: 8017533 - DNA, 22 bp, Homo sapiens
tgggcctgtttcccttcagggc

SEQ ID NO: 8017534 - DNA, 22 bp, Homo sapiens
tgggcctgtttcccttcagggc

SEQ ID NO: 8017535 - DNA, 22 bp, Homo sapiens
tgggcctgtttcccttcagggc

SEQ ID NO: 8017536 - DNA, 22 bp, Homo sapiens
tgggcctgttggggttgagtta

SEQ ID NO: 8017537 - DNA, 22 bp, Homo sapiens
tgggcctgttgcctgagtccat

SEQ ID NO: 8017538 - DNA, 22 bp, Homo sapiens
tgggcctgtggggatcttgaag

SEQ ID NO: 8017539 - DNA, 22 bp, Homo sapiens
tgggcctgttgcctgagtccat

SEQ ID NO: 8017540 - DNA, 22 bp, Homo sapiens
tgggcctgtggcttggctctag

SEQ ID NO: 8017541 - DNA, 22 bp, Homo sapiens
tgggctcaatctgcttctgttt

SEQ ID NO: 8017542 - DNA, 22 bp, Homo sapiens
tgggctcaagtgatgctcctgt

SEQ ID NO: 8017543 - DNA, 22 bp, Homo sapiens
tgggctcaagtgatgctcctgt

SEQ ID NO: 8017544 - DNA, 22 bp, Homo sapiens
tgggctcaagtgatgctcctgt

SEQ ID NO: 8017545 - DNA, 22 bp, Homo sapiens
tgggctagatttggtgacccag

SEQ ID NO: 8017546 - DNA, 22 bp, Homo sapiens
tgggctagcagggaagagagac

SEQ ID NO: 8017547 - DNA, 22 bp, Homo sapiens
tgggctagcagggaagagagac

SEQ ID NO: 8017548 - DNA, 22 bp, Homo sapiens
tgggctaaatagagaaaggata

SEQ ID NO: 8017549 - DNA, 22 bp, Homo sapiens
tgggctattaggaccaggccat

SEQ ID NO: 8017550 - DNA, 22 bp, Homo sapiens
tgggctcaaactggaggttgtt

SEQ ID NO: 8017551 - DNA, 22 bp, Homo sapiens
tgggctagcagggaagagagac

SEQ ID NO: 8017552 - DNA, 22 bp, Homo sapiens
tgggcgaggcccagggctgcgt

SEQ ID NO: 8017553 - DNA, 23 bp, Homo sapiens
tgggcgaggcaggagtggagcac

SEQ ID NO: 8017554 - DNA, 23 bp, Homo sapiens
tgggcgaggcaggagtggagcac

SEQ ID NO: 8017555 - DNA, 22 bp, Homo sapiens
tgggcgctgtgctcctctttgt

SEQ ID NO: 8017556 - DNA, 22 bp, Homo sapiens
tgggcgctgtgctcctctttgt

SEQ ID NO: 8017557 - DNA, 21 bp, Homo sapiens
tgggcgcttgacctctgcact

SEQ ID NO: 8017558 - DNA, 22 bp, Homo sapiens
tgggcgggcaggagcgcacctg

SEQ ID NO: 8017559 - DNA, 23 bp, Homo sapiens
tgggcggggcttttcactctgcc

SEQ ID NO: 8017560 - DNA, 22 bp, Homo sapiens
tgggcggactcgggcatggaat

SEQ ID NO: 8017561 - DNA, 22 bp, Homo sapiens
tgggcggtgtgcaggctctgct

SEQ ID NO: 8017562 - DNA, 22 bp, Homo sapiens
tgggctcagcctcagtctgtgg

SEQ ID NO: 8017563 - DNA, 22 bp, Homo sapiens
tgggctcagccttcatgtggcc

SEQ ID NO: 8017564 - DNA, 22 bp, Homo sapiens
tgggctcagccttcatgtggcc

SEQ ID NO: 8017565 - DNA, 22 bp, Homo sapiens
tgggctcagccttcatgtggcc

SEQ ID NO: 8017566 - DNA, 22 bp, Homo sapiens
tgggctcagccatgacctccac

SEQ ID NO: 8017567 - DNA, 21 bp, Homo sapiens
tgggctcagccccagccctgc

SEQ ID NO: 8017568 - DNA, 21 bp, Homo sapiens
tgggctcagccccagccctgc

SEQ ID NO: 8017569 - DNA, 22 bp, Homo sapiens
tgggctcagccatgacctccac

SEQ ID NO: 8017570 - DNA, 22 bp, Homo sapiens
tgggctcactggggcagggacc

SEQ ID NO: 8017571 - DNA, 22 bp, Homo sapiens
tgggctcactggggcagggacc

SEQ ID NO: 8017572 - DNA, 22 bp, Homo sapiens
tgggctcactggggcagggacc

SEQ ID NO: 8017573 - DNA, 23 bp, Homo sapiens
tgggctcagcttccagtggggag

SEQ ID NO: 8017574 - DNA, 23 bp, Homo sapiens
tgggctcagcttccagtggggag

SEQ ID NO: 8017575 - DNA, 22 bp, Homo sapiens
tgggctcagctcccaagggaag

SEQ ID NO: 8017576 - DNA, 22 bp, Homo sapiens
tgggctcagctcccaagggaag

SEQ ID NO: 8017577 - DNA, 22 bp, Homo sapiens
tgggctcaggaccccagaggcc

SEQ ID NO: 8017578 - DNA, 22 bp, Homo sapiens
tgggctcagtctgcacctgcgg

SEQ ID NO: 8017579 - DNA, 22 bp, Homo sapiens
tgggctcagtctgcacctgcgg

SEQ ID NO: 8017580 - DNA, 22 bp, Homo sapiens
tgggctcaggaccccagaggcc

SEQ ID NO: 8017581 - DNA, 22 bp, Homo sapiens
tgggctcagggaagcttggcct

SEQ ID NO: 8017582 - DNA, 22 bp, Homo sapiens
tgggctcagggtcgaggacttt

SEQ ID NO: 8017583 - DNA, 20 bp, Homo sapiens
tgggctctgcttcctggagt

SEQ ID NO: 8017584 - DNA, 22 bp, Homo sapiens
tgggctctgctgcgtaccagtt

SEQ ID NO: 8017585 - DNA, 22 bp, Homo sapiens
tgggctctgctgcgtaccagtt

SEQ ID NO: 8017586 - DNA, 22 bp, Homo sapiens
tgggctctgctgcgtaccagtt

SEQ ID NO: 8017587 - DNA, 22 bp, Homo sapiens
tgggctctgctgcgtaccagtt

SEQ ID NO: 8017588 - DNA, 22 bp, Homo sapiens
tgggctctgctgcgtaccagtt

SEQ ID NO: 8017589 - DNA, 22 bp, Homo sapiens
tgggctctgctgcgtaccagtt

SEQ ID NO: 8017590 - DNA, 22 bp, Homo sapiens
tgggctctgaagtcagtctgct

SEQ ID NO: 8017591 - DNA, 22 bp, Homo sapiens
tgggctctgcatcagtgcccat

SEQ ID NO: 8017592 - DNA, 22 bp, Homo sapiens
tgggctctgcatcagtgcccat

SEQ ID NO: 8017593 - DNA, 22 bp, Homo sapiens
tgggctctgggtggcctgagca

SEQ ID NO: 8017594 - DNA, 22 bp, Homo sapiens
tgggctctgggtggcctgagca

SEQ ID NO: 8017595 - DNA, 22 bp, Homo sapiens
tgggctctgggtggcctgagca

SEQ ID NO: 8017596 - DNA, 22 bp, Homo sapiens
tgggctctggggaaactgtgat

SEQ ID NO: 8017597 - DNA, 22 bp, Homo sapiens
tgggctctggtttcctggctgg

SEQ ID NO: 8017598 - DNA, 22 bp, Homo sapiens
tgggctctgggtggcctgagca

SEQ ID NO: 8017599 - DNA, 22 bp, Homo sapiens
tgggctctggagggcctaggat

SEQ ID NO: 8017600 - DNA, 22 bp, Homo sapiens
tgggctctggagggcctaggat

SEQ ID NO: 8017601 - DNA, 22 bp, Homo sapiens
tgggctctggagggcctaggat

SEQ ID NO: 8017602 - DNA, 22 bp, Homo sapiens
tgggctctggagggcctaggat

SEQ ID NO: 8017603 - DNA, 22 bp, Homo sapiens
tgggctctggaattgagtggcc

SEQ ID NO: 8017604 - DNA, 22 bp, Homo sapiens
tgggctctggaattgagtggcc

SEQ ID NO: 8017605 - DNA, 22 bp, Homo sapiens
tgggctctggaattgagtggcc

SEQ ID NO: 8017606 - DNA, 22 bp, Homo sapiens
tgggctctggacaaacccttgc

SEQ ID NO: 8017607 - DNA, 22 bp, Homo sapiens
tgggctctctcacctggaggct

SEQ ID NO: 8017608 - DNA, 22 bp, Homo sapiens
tgggctctctcacctggaggct

SEQ ID NO: 8017609 - DNA, 22 bp, Homo sapiens
tgggctctctggcaggaaggct

SEQ ID NO: 8017610 - DNA, 22 bp, Homo sapiens
tgggctctcgtccctgcagaag

SEQ ID NO: 8017611 - DNA, 22 bp, Homo sapiens
tgggctctcgtccctgcagaag

SEQ ID NO: 8017612 - DNA, 22 bp, Homo sapiens
tgggctctcgtccctgcagaag

SEQ ID NO: 8017613 - DNA, 22 bp, Homo sapiens
tgggctctgaagtcagtctgct

SEQ ID NO: 8017614 - DNA, 22 bp, Homo sapiens
tgggctctgaagtcagtctgct

SEQ ID NO: 8017615 - DNA, 22 bp, Homo sapiens
tgggctctgaagggtcccggat

SEQ ID NO: 8017616 - DNA, 22 bp, Homo sapiens
tgggctcagtctgcacctgcgg

SEQ ID NO: 8017617 - DNA, 22 bp, Homo sapiens
tgggctcagtctgcttggtcct

SEQ ID NO: 8017618 - DNA, 22 bp, Homo sapiens
tgggctctcaaagtgcggcttg

SEQ ID NO: 8017619 - DNA, 22 bp, Homo sapiens
tgggctctcaaagtgcggcttg

SEQ ID NO: 8017620 - DNA, 22 bp, Homo sapiens
tgggctctcaaagtgcggcttg

SEQ ID NO: 8017621 - DNA, 22 bp, Homo sapiens
tgggctctattcagagtttttc

SEQ ID NO: 8017622 - DNA, 22 bp, Homo sapiens
tgggctctcacacatgttctga

SEQ ID NO: 8017623 - DNA, 22 bp, Homo sapiens
tgggctctcacacatgttctga

SEQ ID NO: 8017624 - DNA, 22 bp, Homo sapiens
tgggctctcacacatgttctga

SEQ ID NO: 8017625 - DNA, 22 bp, Homo sapiens
tgggctctcagtcagactggca

SEQ ID NO: 8017626 - DNA, 22 bp, Homo sapiens
tgggctctcagtcagactggca

SEQ ID NO: 8017627 - DNA, 22 bp, Homo sapiens
tgggctctcagtcagactggca

SEQ ID NO: 8017628 - DNA, 22 bp, Homo sapiens
tgggctctcagtcagactggca

SEQ ID NO: 8017629 - DNA, 22 bp, Homo sapiens
tgggctgagtgtggaactagtt

SEQ ID NO: 8017630 - DNA, 22 bp, Homo sapiens
tgggctgagtgtggaactagtt

SEQ ID NO: 8017631 - DNA, 22 bp, Homo sapiens
tgggctgagtgtggaactagtt

SEQ ID NO: 8017632 - DNA, 22 bp, Homo sapiens
tgggctgcaccctcagcctctg

SEQ ID NO: 8017633 - DNA, 22 bp, Homo sapiens
tgggctgcaccctcagcctctg

SEQ ID NO: 8017634 - DNA, 22 bp, Homo sapiens
tgggctgcaccctcagcctctg

SEQ ID NO: 8017635 - DNA, 22 bp, Homo sapiens
tgggctgcaccctcagcctctg

SEQ ID NO: 8017636 - DNA, 22 bp, Homo sapiens
tgggctgccggcaggctctgcc

SEQ ID NO: 8017637 - DNA, 22 bp, Homo sapiens
tgggctgccggcaggctctgcc

SEQ ID NO: 8017638 - DNA, 22 bp, Homo sapiens
tgggctgccggcaggctctgcc

SEQ ID NO: 8017639 - DNA, 22 bp, Homo sapiens
tgggctgccggcaggctctgcc

SEQ ID NO: 8017640 - DNA, 22 bp, Homo sapiens
tgggctgccggcaggctctgcc

SEQ ID NO: 8017641 - DNA, 22 bp, Homo sapiens
tgggctgccctgatggtcctca

SEQ ID NO: 8017642 - DNA, 22 bp, Homo sapiens
tgggctgcccaaggtggccatg

SEQ ID NO: 8017643 - DNA, 22 bp, Homo sapiens
tgggctgccagctctccagatg

SEQ ID NO: 8017644 - DNA, 20 bp, Homo sapiens
tgggctgaggatcaggtgcc

SEQ ID NO: 8017645 - DNA, 20 bp, Homo sapiens
tgggctgaggatcaggtgcc

SEQ ID NO: 8017646 - DNA, 22 bp, Homo sapiens
tgggctgaggggccttgatgac

SEQ ID NO: 8017647 - DNA, 22 bp, Homo sapiens
tgggctgagtggcagccagagt

SEQ ID NO: 8017648 - DNA, 22 bp, Homo sapiens
tgggctgagtggcagccagagt

SEQ ID NO: 8017649 - DNA, 22 bp, Homo sapiens
tgggctgagtggcagccagagt

SEQ ID NO: 8017650 - DNA, 22 bp, Homo sapiens
tgggctgagtgtggaactagtt

SEQ ID NO: 8017651 - DNA, 22 bp, Homo sapiens
tgggctgagtggcagccagagt

SEQ ID NO: 8017652 - DNA, 22 bp, Homo sapiens
tgggctgagcactgaggaagga

SEQ ID NO: 8017653 - DNA, 22 bp, Homo sapiens
tgggctgagcactgaggaagga

SEQ ID NO: 8017654 - DNA, 22 bp, Homo sapiens
tgggctgagcactgaggaagga

SEQ ID NO: 8017655 - DNA, 20 bp, Homo sapiens
tgggctgaggatcaggtgcc

SEQ ID NO: 8017656 - DNA, 22 bp, Homo sapiens
tgggctgagcactgaggaagga

SEQ ID NO: 8017657 - DNA, 22 bp, Homo sapiens
tgggctgaaatgctgtggacta

SEQ ID NO: 8017658 - DNA, 22 bp, Homo sapiens
tgggctctggtttcctggctgg

SEQ ID NO: 8017659 - DNA, 22 bp, Homo sapiens
tgggctctggtttcctggctgg

SEQ ID NO: 8017660 - DNA, 22 bp, Homo sapiens
tgggctctggtttcctggctgg

SEQ ID NO: 8017661 - DNA, 22 bp, Homo sapiens
tgggctctggtttcctggctgg

SEQ ID NO: 8017662 - DNA, 22 bp, Homo sapiens
tgggctctggtttcctggctgg

SEQ ID NO: 8017663 - DNA, 22 bp, Homo sapiens
tgggctcttcagctttgatcag

SEQ ID NO: 8017664 - DNA, 22 bp, Homo sapiens
tgggctcttcctatagtttata

SEQ ID NO: 8017665 - DNA, 22 bp, Homo sapiens
tgggctctgtgccaggttggtg

SEQ ID NO: 8017666 - DNA, 22 bp, Homo sapiens
tgggctctgtgccaggttggtg

SEQ ID NO: 8017667 - DNA, 21 bp, Homo sapiens
tgggctctttaacccaggcac

SEQ ID NO: 8017668 - DNA, 21 bp, Homo sapiens
tgggctctttaacccaggcac

SEQ ID NO: 8017669 - DNA, 21 bp, Homo sapiens
tgggctctttaacccaggcac

SEQ ID NO: 8017670 - DNA, 22 bp, Homo sapiens
tgggctgaaatgctgtggacta

SEQ ID NO: 8017671 - DNA, 22 bp, Homo sapiens
tgggccagctgaagtgccgccc

SEQ ID NO: 8017672 - DNA, 22 bp, Homo sapiens
tgggccagctgaagtgccgccc

SEQ ID NO: 8017673 - DNA, 22 bp, Homo sapiens
tgggccagctgaagtgccgccc

SEQ ID NO: 8017674 - DNA, 22 bp, Homo sapiens
tgggccagctgaagtgccgccc

SEQ ID NO: 8017675 - DNA, 22 bp, Homo sapiens
tgggccagctgaagtgccgccc

SEQ ID NO: 8017676 - DNA, 22 bp, Homo sapiens
tgggccagctgaagtgccgccc

SEQ ID NO: 8017677 - DNA, 22 bp, Homo sapiens
tgggccagctgaagtgccgccc

SEQ ID NO: 8017678 - DNA, 22 bp, Homo sapiens
tgggccaggatttcaagaccct

SEQ ID NO: 8017679 - DNA, 22 bp, Homo sapiens
tgggccaggatttcaagaccct

SEQ ID NO: 8017680 - DNA, 22 bp, Homo sapiens
tgggccaggatttcaagaccct

SEQ ID NO: 8017681 - DNA, 22 bp, Homo sapiens
tgggccagctgaagtgccgccc

SEQ ID NO: 8017682 - DNA, 22 bp, Homo sapiens
tgggccagcactgggtgctcat

SEQ ID NO: 8017683 - DNA, 22 bp, Homo sapiens
tgggccagcactgggtgctcat

SEQ ID NO: 8017684 - DNA, 22 bp, Homo sapiens
tgggccagcactgggtgctcat

SEQ ID NO: 8017685 - DNA, 22 bp, Homo sapiens
tgggccagcactgggtgctcat

SEQ ID NO: 8017686 - DNA, 22 bp, Homo sapiens
tgggccagcactgggtgctcat

SEQ ID NO: 8017687 - DNA, 22 bp, Homo sapiens
tgggccagcactgggtgctcat

SEQ ID NO: 8017688 - DNA, 22 bp, Homo sapiens
tgggccagcactgggtgctcat

SEQ ID NO: 8017689 - DNA, 22 bp, Homo sapiens
tgggccagctccctgcccctgg

SEQ ID NO: 8017690 - DNA, 22 bp, Homo sapiens
tgggccagctccctgcccctgg

SEQ ID NO: 8017691 - DNA, 22 bp, Homo sapiens
tgggccagctccctgcccctgg

SEQ ID NO: 8017692 - DNA, 22 bp, Homo sapiens
tgggccagctccctgcccctgg

SEQ ID NO: 8017693 - DNA, 22 bp, Homo sapiens
tgggccagctccctgcccctgg

SEQ ID NO: 8017694 - DNA, 22 bp, Homo sapiens
tgggccagctccctgcccctgg

SEQ ID NO: 8017695 - DNA, 22 bp, Homo sapiens
tgggccagctccctgcccctgg

SEQ ID NO: 8017696 - DNA, 22 bp, Homo sapiens
tgggccacaagccatgggacca

SEQ ID NO: 8017697 - DNA, 22 bp, Homo sapiens
tgggccacaagccatgggacca

SEQ ID NO: 8017698 - DNA, 22 bp, Homo sapiens
tgggccacacacagaagaatca

SEQ ID NO: 8017699 - DNA, 22 bp, Homo sapiens
tgggccacaagccatgggacca

SEQ ID NO: 8017700 - DNA, 22 bp, Homo sapiens
tgggccaagttaaatgccaggg

SEQ ID NO: 8017701 - DNA, 22 bp, Homo sapiens
tgggccacgggggtggagagct

SEQ ID NO: 8017702 - DNA, 22 bp, Homo sapiens
tgggccacagctcacacatcca

SEQ ID NO: 8017703 - DNA, 22 bp, Homo sapiens
tgggccagcactgggtgctcat

SEQ ID NO: 8017704 - DNA, 22 bp, Homo sapiens
tgggccagcactgggtgctcat

SEQ ID NO: 8017705 - DNA, 22 bp, Homo sapiens
tgggccagcaattgctgctcag

SEQ ID NO: 8017706 - DNA, 22 bp, Homo sapiens
tgggccagcaattgctgctcag

SEQ ID NO: 8017707 - DNA, 22 bp, Homo sapiens
tgggccacgggggtggagagct

SEQ ID NO: 8017708 - DNA, 22 bp, Homo sapiens
tgggccacgggggtggagagct

SEQ ID NO: 8017709 - DNA, 22 bp, Homo sapiens
tgggccacgtcatctcccacaa

SEQ ID NO: 8017710 - DNA, 22 bp, Homo sapiens
tgggcagggtctctgttatcag

SEQ ID NO: 8017711 - DNA, 22 bp, Homo sapiens
tgggcagggtctctgttatcag

SEQ ID NO: 8017712 - DNA, 22 bp, Homo sapiens
tgggcagggtctctgttatcag

SEQ ID NO: 8017713 - DNA, 22 bp, Homo sapiens
tgggcaggggccctgcttccgt

SEQ ID NO: 8017714 - DNA, 22 bp, Homo sapiens
tgggcaggggccctgcttccgt

SEQ ID NO: 8017715 - DNA, 22 bp, Homo sapiens
tgggcaggggccctgcttccgt

SEQ ID NO: 8017716 - DNA, 22 bp, Homo sapiens
tgggcagggtctctgttatcag

SEQ ID NO: 8017717 - DNA, 19 bp, Homo sapiens
tgggcaggttcagtaatgg

SEQ ID NO: 8017718 - DNA, 19 bp, Homo sapiens
tgggcaggttcagtaatgg

SEQ ID NO: 8017719 - DNA, 22 bp, Homo sapiens
tgggcaggtgctattttccatg

SEQ ID NO: 8017720 - DNA, 22 bp, Homo sapiens
tgggcaggtgctattttccatg

SEQ ID NO: 8017721 - DNA, 22 bp, Homo sapiens
tgggcaggtgctattttccatg

SEQ ID NO: 8017722 - DNA, 19 bp, Homo sapiens
tgggcaggttcagtaatgg

SEQ ID NO: 8017723 - DNA, 19 bp, Homo sapiens
tgggcaggttcagtaatgg

SEQ ID NO: 8017724 - DNA, 19 bp, Homo sapiens
tgggcaggttcagtaatgg

SEQ ID NO: 8017725 - DNA, 19 bp, Homo sapiens
tgggcaggttcagtaatgg

SEQ ID NO: 8017726 - DNA, 22 bp, Homo sapiens
tgggcagtggcgcaatctctgg

SEQ ID NO: 8017727 - DNA, 19 bp, Homo sapiens
tgggcagtgccagggctta

SEQ ID NO: 8017728 - DNA, 22 bp, Homo sapiens
tgggcagtgagaaaggtcaggt

SEQ ID NO: 8017729 - DNA, 22 bp, Homo sapiens
tgggcagtgagaaaggtcaggt

SEQ ID NO: 8017730 - DNA, 19 bp, Homo sapiens
tgggcagtgccagggctta

SEQ ID NO: 8017731 - DNA, 19 bp, Homo sapiens
tgggcagtgccagggctta

SEQ ID NO: 8017732 - DNA, 19 bp, Homo sapiens
tgggcagtgccagggctta

SEQ ID NO: 8017733 - DNA, 19 bp, Homo sapiens
tgggcagtgccagggctta

SEQ ID NO: 8017734 - DNA, 22 bp, Homo sapiens
tgggcaggttgttatttgacat

SEQ ID NO: 8017735 - DNA, 22 bp, Homo sapiens
tgggcaggttgttatttgacat

SEQ ID NO: 8017736 - DNA, 22 bp, Homo sapiens
tgggcaggttgttatttgacat

SEQ ID NO: 8017737 - DNA, 22 bp, Homo sapiens
tgggcaggttgttatttgacat

SEQ ID NO: 8017738 - DNA, 22 bp, Homo sapiens
tgggcaggttgttatttgacat

SEQ ID NO: 8017739 - DNA, 22 bp, Homo sapiens
tgggcagtccagctggaaacgg

SEQ ID NO: 8017740 - DNA, 22 bp, Homo sapiens
tgggcagtcatcagcacaccgg

SEQ ID NO: 8017741 - DNA, 22 bp, Homo sapiens
tgggcagtatttgcagaataat

SEQ ID NO: 8017742 - DNA, 22 bp, Homo sapiens
tgggcatctctgctgccggcct

SEQ ID NO: 8017743 - DNA, 22 bp, Homo sapiens
tgggcatgaagaaggaagtggg

SEQ ID NO: 8017744 - DNA, 22 bp, Homo sapiens
tgggcatgagtggacagagaag

SEQ ID NO: 8017745 - DNA, 22 bp, Homo sapiens
tgggcatgaagaaggaagtggg

SEQ ID NO: 8017746 - DNA, 22 bp, Homo sapiens
tgggccaacaggaggtctagga

SEQ ID NO: 8017747 - DNA, 22 bp, Homo sapiens
tgggccaacaggaggtctagga

SEQ ID NO: 8017748 - DNA, 22 bp, Homo sapiens
tgggcatgagtggacagagaag

SEQ ID NO: 8017749 - DNA, 22 bp, Homo sapiens
tgggcatcatggacagcagagg

SEQ ID NO: 8017750 - DNA, 22 bp, Homo sapiens
tgggcagttgctcctcagaccc

SEQ ID NO: 8017751 - DNA, 22 bp, Homo sapiens
tgggcagtgggcctaggtgtga

SEQ ID NO: 8017752 - DNA, 22 bp, Homo sapiens
tgggcagtgtgtaatgcataga

SEQ ID NO: 8017753 - DNA, 22 bp, Homo sapiens
tgggcagttgctcctcagaccc

SEQ ID NO: 8017754 - DNA, 22 bp, Homo sapiens
tgggcagggatctcttttgcaa

SEQ ID NO: 8017755 - DNA, 22 bp, Homo sapiens
tgggcagggatctcttttgcaa

SEQ ID NO: 8017756 - DNA, 22 bp, Homo sapiens
tgggcagggatctcttttgcaa

SEQ ID NO: 8017757 - DNA, 22 bp, Homo sapiens
tgggcagggatctcttttgcaa

SEQ ID NO: 8017758 - DNA, 22 bp, Homo sapiens
tgggcaggggccctgcttccgt

SEQ ID NO: 8017759 - DNA, 22 bp, Homo sapiens
tgggcagggatctcttttgcaa

SEQ ID NO: 8017760 - DNA, 22 bp, Homo sapiens
tgggcaggggccctgcttccgt

SEQ ID NO: 8017761 - DNA, 22 bp, Homo sapiens
tgggcaggggccctgcttccgt

SEQ ID NO: 8017762 - DNA, 22 bp, Homo sapiens
tgggcaggggccctgcttccgt

SEQ ID NO: 8017763 - DNA, 22 bp, Homo sapiens
tgggcaggggccctgcttccgt

SEQ ID NO: 8017764 - DNA, 22 bp, Homo sapiens
tgggcaggggccctgcttccgt

SEQ ID NO: 8017765 - DNA, 22 bp, Homo sapiens
tgggcaggggccctgcttccgt

SEQ ID NO: 8017766 - DNA, 22 bp, Homo sapiens
tgggcaggggccctgcttccgt

SEQ ID NO: 8017767 - DNA, 22 bp, Homo sapiens
tgggcagggagctggaaccaca

SEQ ID NO: 8017768 - DNA, 22 bp, Homo sapiens
tgggcagggagctggaaccaca

SEQ ID NO: 8017769 - DNA, 22 bp, Homo sapiens
tgggcagggagctggaaccaca

SEQ ID NO: 8017770 - DNA, 22 bp, Homo sapiens
tgggcagggagctggaaccaca

SEQ ID NO: 8017771 - DNA, 22 bp, Homo sapiens
tgggcagggagctggaaccaca

SEQ ID NO: 8017772 - DNA, 22 bp, Homo sapiens
tgggcagggatctcttttgcaa

SEQ ID NO: 8017773 - DNA, 22 bp, Homo sapiens
tgggcagggagctggaaccaca

SEQ ID NO: 8017774 - DNA, 22 bp, Homo sapiens
tgggcagggatctcttttgcaa

SEQ ID NO: 8017775 - DNA, 22 bp, Homo sapiens
tgggcagcttccacttagttag

SEQ ID NO: 8017776 - DNA, 23 bp, Homo sapiens
tgggcagcttctgcatgcccacc

SEQ ID NO: 8017777 - DNA, 23 bp, Homo sapiens
tgggcagcttctgcatgcccacc

SEQ ID NO: 8017778 - DNA, 23 bp, Homo sapiens
tgggcagcttctgcatgcccacc

SEQ ID NO: 8017779 - DNA, 19 bp, Homo sapiens
tgggcagctccctctgtcc

SEQ ID NO: 8017780 - DNA, 22 bp, Homo sapiens
tgggcagcttccacttagttag

SEQ ID NO: 8017781 - DNA, 23 bp, Homo sapiens
tgggcagcttctgcatgcccacc

SEQ ID NO: 8017782 - DNA, 19 bp, Homo sapiens
tgggcagctccctctgtcc

SEQ ID NO: 8017783 - DNA, 19 bp, Homo sapiens
tgggcagctccctctgtcc

SEQ ID NO: 8017784 - DNA, 19 bp, Homo sapiens
tgggcagctccctctgtcc

SEQ ID NO: 8017785 - DNA, 22 bp, Homo sapiens
tgggcagccatcccagcctctc

SEQ ID NO: 8017786 - DNA, 22 bp, Homo sapiens
tgggcagccatcccagcctctc

SEQ ID NO: 8017787 - DNA, 22 bp, Homo sapiens
tgggcagccatcccagcctctc

SEQ ID NO: 8017788 - DNA, 22 bp, Homo sapiens
tgggcagcatcctccacagtca

SEQ ID NO: 8017789 - DNA, 22 bp, Homo sapiens
tgggcagcatcctccacagtca

SEQ ID NO: 8017790 - DNA, 22 bp, Homo sapiens
tgggcagccatcccagcctctc

SEQ ID NO: 8017791 - DNA, 22 bp, Homo sapiens
tgggcagggagctggaaccaca

SEQ ID NO: 8017792 - DNA, 22 bp, Homo sapiens
tgggcagggagctggaaccaca

SEQ ID NO: 8017793 - DNA, 22 bp, Homo sapiens
tgggcagggagctggaaccaca

SEQ ID NO: 8017794 - DNA, 22 bp, Homo sapiens
tgggcagggagctggaaccaca

SEQ ID NO: 8017795 - DNA, 22 bp, Homo sapiens
tgggcagggagctggaaccaca

SEQ ID NO: 8017796 - DNA, 22 bp, Homo sapiens
tgggcagggagctggaaccaca

SEQ ID NO: 8017797 - DNA, 22 bp, Homo sapiens
tgggcagggagctggaaccaca

SEQ ID NO: 8017798 - DNA, 22 bp, Homo sapiens
tgggcagggagctggaaccaca

SEQ ID NO: 8017799 - DNA, 22 bp, Homo sapiens
tgggcaggagagaagctaaaga

SEQ ID NO: 8017800 - DNA, 22 bp, Homo sapiens
tgggcaggagagaagctaaaga

SEQ ID NO: 8017801 - DNA, 22 bp, Homo sapiens
tgggcaggagagaagctaaaga

SEQ ID NO: 8017802 - DNA, 22 bp, Homo sapiens
tgggcaggagagaagctaaaga

SEQ ID NO: 8017803 - DNA, 22 bp, Homo sapiens
tgggcagcagcaaagccagact

SEQ ID NO: 8017804 - DNA, 22 bp, Homo sapiens
tgggcagcagaaccaggccgac

SEQ ID NO: 8017805 - DNA, 22 bp, Homo sapiens
tgggcagcagcaaagccagact

SEQ ID NO: 8017806 - DNA, 22 bp, Homo sapiens
tgggcagcagcaaagccagact

SEQ ID NO: 8017807 - DNA, 22 bp, Homo sapiens
tgggcagcatcctccacagtca

SEQ ID NO: 8017808 - DNA, 22 bp, Homo sapiens
tgggcagcagcaaagccagact

SEQ ID NO: 8017809 - DNA, 22 bp, Homo sapiens
tgggcagcatcctccacagtca

SEQ ID NO: 8017810 - DNA, 22 bp, Homo sapiens
tgggcagcagaaccaggccgac

SEQ ID NO: 8017811 - DNA, 22 bp, Homo sapiens
tgggcagcagaaccaggccgac

SEQ ID NO: 8017812 - DNA, 22 bp, Homo sapiens
tgggcagcagaaccaggccgac

SEQ ID NO: 8017813 - DNA, 20 bp, Homo sapiens
tgggcagcactgctggctgg

SEQ ID NO: 8017814 - DNA, 22 bp, Homo sapiens
tgggcagcagaaccaggccgac

SEQ ID NO: 8017815 - DNA, 22 bp, Homo sapiens
tgggcagcagaaccaggccgac

SEQ ID NO: 8017816 - DNA, 22 bp, Homo sapiens
tgggcagcagaaccaggccgac

SEQ ID NO: 8017817 - DNA, 22 bp, Homo sapiens
tgggcagcaaagactgtgtgct

SEQ ID NO: 8017818 - DNA, 22 bp, Homo sapiens
tgggcagcaaagactgtgtgct

SEQ ID NO: 8017819 - DNA, 22 bp, Homo sapiens
tgggcagcaaagactgtgtgct

SEQ ID NO: 8017820 - DNA, 22 bp, Homo sapiens
tgggcagcaaagactgtgtgct

SEQ ID NO: 8017821 - DNA, 22 bp, Homo sapiens
tgggcagcaaagactgtgtgct

SEQ ID NO: 8017822 - DNA, 22 bp, Homo sapiens
tgggcagattaatgcagtggct

SEQ ID NO: 8017823 - DNA, 22 bp, Homo sapiens
tgggcagcaaagactgtgtgct

SEQ ID NO: 8017824 - DNA, 22 bp, Homo sapiens
tgggcagcaaagactgtgtgct

SEQ ID NO: 8017825 - DNA, 20 bp, Homo sapiens
tgggcagcactgctggctgg

SEQ ID NO: 8017826 - DNA, 20 bp, Homo sapiens
tgggcagcactgctggctgg

SEQ ID NO: 8017827 - DNA, 20 bp, Homo sapiens
tgggcagcactgctggctgg

SEQ ID NO: 8017828 - DNA, 20 bp, Homo sapiens
tgggcagcactgctggctgg

SEQ ID NO: 8017829 - DNA, 20 bp, Homo sapiens
tgggcagcactgctggctgg

SEQ ID NO: 8017830 - DNA, 22 bp, Homo sapiens
tgggcagatgtggctctccttg

SEQ ID NO: 8017831 - DNA, 22 bp, Homo sapiens
tgggcagatgtggctctccttg

SEQ ID NO: 8017832 - DNA, 22 bp, Homo sapiens
tgggcagatgtggctctccttg

SEQ ID NO: 8017833 - DNA, 22 bp, Homo sapiens
tgggcagattaatgcagtggct

SEQ ID NO: 8017834 - DNA, 22 bp, Homo sapiens
tgggcagattaatgcagtggct

SEQ ID NO: 8017835 - DNA, 22 bp, Homo sapiens
tgggcagattaatgcagtggct

SEQ ID NO: 8017836 - DNA, 22 bp, Homo sapiens
tgggcagattaatgcagtggct

SEQ ID NO: 8017837 - DNA, 22 bp, Homo sapiens
tgggcagattaatgcagtggct

SEQ ID NO: 8017838 - DNA, 22 bp, Homo sapiens
tgggcagattaatgcagtggct

SEQ ID NO: 8017839 - DNA, 21 bp, Homo sapiens
tgggcagatggcagtgtggct

SEQ ID NO: 8017840 - DNA, 21 bp, Homo sapiens
tgggcagatggcagtgtggct

SEQ ID NO: 8017841 - DNA, 21 bp, Homo sapiens
tgggcagatggcagtgtggct

SEQ ID NO: 8017842 - DNA, 22 bp, Homo sapiens
tgggcagatgtcctctgaagtg

SEQ ID NO: 8017843 - DNA, 22 bp, Homo sapiens
tgggcagatgtcctctgaagtg

SEQ ID NO: 8017844 - DNA, 21 bp, Homo sapiens
tgggcagatggcagtgtggct

SEQ ID NO: 8017845 - DNA, 21 bp, Homo sapiens
tgggcagatggcagtgtggct

SEQ ID NO: 8017846 - DNA, 16 bp, Homo sapiens
tgggcagatgagaaga

SEQ ID NO: 8017847 - DNA, 16 bp, Homo sapiens
tgggcagatgagaaga

SEQ ID NO: 8017848 - DNA, 22 bp, Homo sapiens
tgggcagatctttggtggctag

SEQ ID NO: 8017849 - DNA, 22 bp, Homo sapiens
tgggcagatctttggtggctag

SEQ ID NO: 8017850 - DNA, 22 bp, Homo sapiens
tgggcagatctttggtggctag

SEQ ID NO: 8017851 - DNA, 22 bp, Homo sapiens
tgggcagatctttggtggctag

SEQ ID NO: 8017852 - DNA, 15 bp, Homo sapiens
tgggcagatcacttg

SEQ ID NO: 8017853 - DNA, 22 bp, Homo sapiens
tgggcagagttgtgatgaactg

SEQ ID NO: 8017854 - DNA, 22 bp, Homo sapiens
tgggcagagttgtgatgaactg

SEQ ID NO: 8017855 - DNA, 21 bp, Homo sapiens
tgggcaccaaaacctaggagt

SEQ ID NO: 8017856 - DNA, 22 bp, Homo sapiens
tgggcacatagttttatggtca

SEQ ID NO: 8017857 - DNA, 22 bp, Homo sapiens
tgggcacctagcaacccttctc

SEQ ID NO: 8017858 - DNA, 21 bp, Homo sapiens
tgggcaccaaaacctaggagt

SEQ ID NO: 8017859 - DNA, 22 bp, Homo sapiens
tgggcacctagcaacccttctc

SEQ ID NO: 8017860 - DNA, 20 bp, Homo sapiens
tgggcaccagatgggatgcc

SEQ ID NO: 8017861 - DNA, 22 bp, Homo sapiens
tgggcacaggggtaggaatgag

SEQ ID NO: 8017862 - DNA, 22 bp, Homo sapiens
tgggcacaggggtaggaatgag

SEQ ID NO: 8017863 - DNA, 22 bp, Homo sapiens
tgggcacaggggaatggatgaa

SEQ ID NO: 8017864 - DNA, 22 bp, Homo sapiens
tgggcacaggggtaggaatgag

SEQ ID NO: 8017865 - DNA, 22 bp, Homo sapiens
tgggcacaggggtaggaatgag

SEQ ID NO: 8017866 - DNA, 22 bp, Homo sapiens
tgggcacaggggaatggatgaa

SEQ ID NO: 8017867 - DNA, 20 bp, Homo sapiens
tgggcacagctttggagggc

SEQ ID NO: 8017868 - DNA, 22 bp, Homo sapiens
tgggcacaggggaatggatgaa

SEQ ID NO: 8017869 - DNA, 22 bp, Homo sapiens
tgggcactatggctctgtgcac

SEQ ID NO: 8017870 - DNA, 22 bp, Homo sapiens
tgggcactatggctctgtgcac

SEQ ID NO: 8017871 - DNA, 22 bp, Homo sapiens
tgggcacctgaggcctggcagg

SEQ ID NO: 8017872 - DNA, 22 bp, Homo sapiens
tgggcactatggctctgtgcac

SEQ ID NO: 8017873 - DNA, 22 bp, Homo sapiens
tgggcactcaggctgaggccgt

SEQ ID NO: 8017874 - DNA, 22 bp, Homo sapiens
tgggcactcaggctgaggccgt

SEQ ID NO: 8017875 - DNA, 22 bp, Homo sapiens
tgggcactcctggggacagctg

SEQ ID NO: 8017876 - DNA, 22 bp, Homo sapiens
tgggcactcaggctgaggccgt

SEQ ID NO: 8017877 - DNA, 22 bp, Homo sapiens
tgggcactcaggctgaggccgt

SEQ ID NO: 8017878 - DNA, 22 bp, Homo sapiens
tgggcactcagagttttcaaga

SEQ ID NO: 8017879 - DNA, 22 bp, Homo sapiens
tgggcagagagtagaggcaacg

SEQ ID NO: 8017880 - DNA, 22 bp, Homo sapiens
tgggcagagagtagaggcaacg

SEQ ID NO: 8017881 - DNA, 22 bp, Homo sapiens
tgggcagagagtagaggcaacg

SEQ ID NO: 8017882 - DNA, 22 bp, Homo sapiens
tgggcagagagtagaggcaacg

SEQ ID NO: 8017883 - DNA, 22 bp, Homo sapiens
tgggcagagagtagaggcaacg

SEQ ID NO: 8017884 - DNA, 22 bp, Homo sapiens
tgggcagactgagccctgtccc

SEQ ID NO: 8017885 - DNA, 22 bp, Homo sapiens
tgggcagaggacagggaagatc

SEQ ID NO: 8017886 - DNA, 22 bp, Homo sapiens
tgggcagaggacagggaagatc

SEQ ID NO: 8017887 - DNA, 22 bp, Homo sapiens
tgggcagaggcagcagaaacct

SEQ ID NO: 8017888 - DNA, 22 bp, Homo sapiens
tgggcagaggctctgaagtcca

SEQ ID NO: 8017889 - DNA, 22 bp, Homo sapiens
tgggcagaggctctgaagtcca

SEQ ID NO: 8017890 - DNA, 22 bp, Homo sapiens
tgggcagagatctggatcaaac

SEQ ID NO: 8017891 - DNA, 22 bp, Homo sapiens
tgggcagagatctggatcaaac

SEQ ID NO: 8017892 - DNA, 22 bp, Homo sapiens
tgggcagagatctggatcaaac

SEQ ID NO: 8017893 - DNA, 22 bp, Homo sapiens
tgggcagagatctggatcaaac

SEQ ID NO: 8017894 - DNA, 22 bp, Homo sapiens
tgggcagaggacagggaagatc

SEQ ID NO: 8017895 - DNA, 22 bp, Homo sapiens
tgggcagaggacagggaagatc

SEQ ID NO: 8017896 - DNA, 22 bp, Homo sapiens
tgggcagagtagctcagaagaa

SEQ ID NO: 8017897 - DNA, 22 bp, Homo sapiens
tgggcagagtagctcagaagaa

SEQ ID NO: 8017898 - DNA, 22 bp, Homo sapiens
tgggcagagtcatacaggagac

SEQ ID NO: 8017899 - DNA, 22 bp, Homo sapiens
tgggcagagtcatacaggagac

SEQ ID NO: 8017900 - DNA, 22 bp, Homo sapiens
tgggcagagtcatacaggagac

SEQ ID NO: 8017901 - DNA, 22 bp, Homo sapiens
tgggcagagtcatacaggagac

SEQ ID NO: 8017902 - DNA, 22 bp, Homo sapiens
tgggcagagtagctcagaagaa

SEQ ID NO: 8017903 - DNA, 22 bp, Homo sapiens
tgggcagagtcatacaggagac

SEQ ID NO: 8017904 - DNA, 22 bp, Homo sapiens
tgggcagagtcatacaggagac

SEQ ID NO: 8017905 - DNA, 22 bp, Homo sapiens
tgggcagagtcgtggggaatag

SEQ ID NO: 8017906 - DNA, 22 bp, Homo sapiens
tgggcagagtcgtggggaatag

SEQ ID NO: 8017907 - DNA, 21 bp, Homo sapiens
tgggatgggtctgggaccagc

SEQ ID NO: 8017908 - DNA, 22 bp, Homo sapiens
tgggatgtggccatggttctct

SEQ ID NO: 8017909 - DNA, 21 bp, Homo sapiens
tgggatgggtctgggaccagc

SEQ ID NO: 8017910 - DNA, 22 bp, Homo sapiens
tgggatgggatctcgctgtgtc

SEQ ID NO: 8017911 - DNA, 21 bp, Homo sapiens
tgggatgggtctgggaccagc

SEQ ID NO: 8017912 - DNA, 22 bp, Homo sapiens
tgggatgggatctcgctgtgtc

SEQ ID NO: 8017913 - DNA, 22 bp, Homo sapiens
tgggatggcctttgaaagccag

SEQ ID NO: 8017914 - DNA, 22 bp, Homo sapiens
tgggatgggatctcgctgtgtc

SEQ ID NO: 8017915 - DNA, 22 bp, Homo sapiens
tgggatggcatcctgggccttg

SEQ ID NO: 8017916 - DNA, 22 bp, Homo sapiens
tgggatggcctttgaaagccag

SEQ ID NO: 8017917 - DNA, 22 bp, Homo sapiens
tgggatggcctttgaaagccag

SEQ ID NO: 8017918 - DNA, 22 bp, Homo sapiens
tgggcaaatgtcactttctttt

SEQ ID NO: 8017919 - DNA, 22 bp, Homo sapiens
tgggcaaatgtcactttctttt

SEQ ID NO: 8017920 - DNA, 22 bp, Homo sapiens
tgggcaagctctgggtggacac

SEQ ID NO: 8017921 - DNA, 22 bp, Homo sapiens
tgggcaaagtcacatacatgat

SEQ ID NO: 8017922 - DNA, 22 bp, Homo sapiens
tgggcaaatgctttttagtcaa

SEQ ID NO: 8017923 - DNA, 22 bp, Homo sapiens
tgggcaaagtcacatacatgat

SEQ ID NO: 8017924 - DNA, 22 bp, Homo sapiens
tgggcaaaggctgtaacccatc

SEQ ID NO: 8017925 - DNA, 22 bp, Homo sapiens
tgggatttttaaatgtattaag

SEQ ID NO: 8017926 - DNA, 22 bp, Homo sapiens
tgggattcaccatgggcttcag

SEQ ID NO: 8017927 - DNA, 22 bp, Homo sapiens
tgggatgtggccatggttctct

SEQ ID NO: 8017928 - DNA, 22 bp, Homo sapiens
tgggcaaactgtcaaccatgtc

SEQ ID NO: 8017929 - DNA, 22 bp, Homo sapiens
tgggattcaccatgggcttcag

SEQ ID NO: 8017930 - DNA, 22 bp, Homo sapiens
tgggattcaccatgggcttcag

SEQ ID NO: 8017931 - DNA, 22 bp, Homo sapiens
tgggattcaccatgggcttcag

SEQ ID NO: 8017932 - DNA, 22 bp, Homo sapiens
tgggattcaccatgggcttcag

SEQ ID NO: 8017933 - DNA, 22 bp, Homo sapiens
tgggattcaccatgggcttcag

SEQ ID NO: 8017934 - DNA, 18 bp, Homo sapiens
tgggcacaatgaacagca

SEQ ID NO: 8017935 - DNA, 22 bp, Homo sapiens
tgggcacagaatagatggccca

SEQ ID NO: 8017936 - DNA, 22 bp, Homo sapiens
tgggcacagaatagatggccca

SEQ ID NO: 8017937 - DNA, 22 bp, Homo sapiens
tgggcacaaacatctgcctgtt

SEQ ID NO: 8017938 - DNA, 22 bp, Homo sapiens
tgggcacaaacatctgcctgtt

SEQ ID NO: 8017939 - DNA, 22 bp, Homo sapiens
tgggcacaaacatctgcctgtt

SEQ ID NO: 8017940 - DNA, 22 bp, Homo sapiens
tgggcacagagtcccatctgcc

SEQ ID NO: 8017941 - DNA, 22 bp, Homo sapiens
tgggcacagagtcccatctgcc

SEQ ID NO: 8017942 - DNA, 22 bp, Homo sapiens
tgggcacagagtcccatctgcc

SEQ ID NO: 8017943 - DNA, 22 bp, Homo sapiens
tgggcacagaatagatggccca

SEQ ID NO: 8017944 - DNA, 22 bp, Homo sapiens
tgggcacagaatagatggccca

SEQ ID NO: 8017945 - DNA, 22 bp, Homo sapiens
tgggcacagaatagatggccca

SEQ ID NO: 8017946 - DNA, 22 bp, Homo sapiens
tgggcacagagtcccatctgcc

SEQ ID NO: 8017947 - DNA, 22 bp, Homo sapiens
tgggcacaaacatctgcctgtt

SEQ ID NO: 8017948 - DNA, 22 bp, Homo sapiens
tgggcaagtcacttctgtcttt

SEQ ID NO: 8017949 - DNA, 21 bp, Homo sapiens
tgggcaagtttgggggtcctc

SEQ ID NO: 8017950 - DNA, 22 bp, Homo sapiens
tgggcaagtatcggactctgag

SEQ ID NO: 8017951 - DNA, 22 bp, Homo sapiens
tgggcaagggacaggcctggct

SEQ ID NO: 8017952 - DNA, 22 bp, Homo sapiens
tgggcaagtatcggactctgag

SEQ ID NO: 8017953 - DNA, 22 bp, Homo sapiens
tgggcaagggacaggcctggct

SEQ ID NO: 8017954 - DNA, 22 bp, Homo sapiens
tgggcaaggctggagcctgcag

SEQ ID NO: 8017955 - DNA, 22 bp, Homo sapiens
tgggcaagggacaggcctggct

SEQ ID NO: 8017956 - DNA, 22 bp, Homo sapiens
tgggagtgatacagtatggaat

SEQ ID NO: 8017957 - DNA, 22 bp, Homo sapiens
tgggagtgatacagtatggaat

SEQ ID NO: 8017958 - DNA, 22 bp, Homo sapiens
tgggagtgcacctgggacacga

SEQ ID NO: 8017959 - DNA, 22 bp, Homo sapiens
tgggagtgcacctgggacacga

SEQ ID NO: 8017960 - DNA, 22 bp, Homo sapiens
tgggagtgcacctgggacacga

SEQ ID NO: 8017961 - DNA, 22 bp, Homo sapiens
tgggagtgcacctgggacacga

SEQ ID NO: 8017962 - DNA, 18 bp, Homo sapiens
tgggagtgggagtggata

SEQ ID NO: 8017963 - DNA, 18 bp, Homo sapiens
tgggagtgggagtggata

SEQ ID NO: 8017964 - DNA, 23 bp, Homo sapiens
tgggatagaatttcatggctgct

SEQ ID NO: 8017965 - DNA, 22 bp, Homo sapiens
tgggatagattgatggatagag

SEQ ID NO: 8017966 - DNA, 22 bp, Homo sapiens
tgggatagattgatggatagag

SEQ ID NO: 8017967 - DNA, 22 bp, Homo sapiens
tgggatagggctattgctcaca

SEQ ID NO: 8017968 - DNA, 22 bp, Homo sapiens
tgggatagtagctgagagacaa

SEQ ID NO: 8017969 - DNA, 22 bp, Homo sapiens
tgggatgagaagtgcgagggtt

SEQ ID NO: 8017970 - DNA, 20 bp, Homo sapiens
tgggatcgaatcaagtctgt

SEQ ID NO: 8017971 - DNA, 22 bp, Homo sapiens
tgggatctgcagtttaacaaaa

SEQ ID NO: 8017972 - DNA, 22 bp, Homo sapiens
tgggatcttttgagatactgtg

SEQ ID NO: 8017973 - DNA, 22 bp, Homo sapiens
tgggatataatctgaaaagtat

SEQ ID NO: 8017974 - DNA, 17 bp, Homo sapiens
tgggatccgtctctgtg

SEQ ID NO: 8017975 - DNA, 22 bp, Homo sapiens
tgggatagtagctgagagacaa

SEQ ID NO: 8017976 - DNA, 22 bp, Homo sapiens
tgggatagtagctgagagacaa

SEQ ID NO: 8017977 - DNA, 22 bp, Homo sapiens
tgggatggcatcctgggccttg

SEQ ID NO: 8017978 - DNA, 22 bp, Homo sapiens
tgggatggcatcctgggccttg

SEQ ID NO: 8017979 - DNA, 22 bp, Homo sapiens
tgggatggcatcctgggccttg

SEQ ID NO: 8017980 - DNA, 23 bp, Homo sapiens
tgggatggattcaccagtgtgct

SEQ ID NO: 8017981 - DNA, 22 bp, Homo sapiens
tgggatggcatcctgggccttg

SEQ ID NO: 8017982 - DNA, 23 bp, Homo sapiens
tgggatggattcaccagtgtgct

SEQ ID NO: 8017983 - DNA, 23 bp, Homo sapiens
tgggatggattcaccagtgtgct

SEQ ID NO: 8017984 - DNA, 22 bp, Homo sapiens
tgggatggagcctgagtatagt

SEQ ID NO: 8017985 - DNA, 23 bp, Homo sapiens
tgggatggattcaccagtgtgct

SEQ ID NO: 8017986 - DNA, 22 bp, Homo sapiens
tgggatggagcctgagtatagt

SEQ ID NO: 8017987 - DNA, 23 bp, Homo sapiens
tgggatggattcaccagtgtgct

SEQ ID NO: 8017988 - DNA, 22 bp, Homo sapiens
tgggatgagttgttaggactga

SEQ ID NO: 8017989 - DNA, 22 bp, Homo sapiens
tgggatgaggcctctgttgtga

SEQ ID NO: 8017990 - DNA, 22 bp, Homo sapiens
tgggatgataggtaagtaatta

SEQ ID NO: 8017991 - DNA, 19 bp, Homo sapiens
tgggatgatgcagaaggta

SEQ ID NO: 8017992 - DNA, 18 bp, Homo sapiens
tgggatggagagtaactg

SEQ ID NO: 8017993 - DNA, 18 bp, Homo sapiens
tgggatggagagtaactg

SEQ ID NO: 8017994 - DNA, 18 bp, Homo sapiens
tgggatggagagtaactg

SEQ ID NO: 8017995 - DNA, 22 bp, Homo sapiens
tgggatggagcctgagtatagt

SEQ ID NO: 8017996 - DNA, 22 bp, Homo sapiens
tgggatggagcctgagtatagt

SEQ ID NO: 8017997 - DNA, 22 bp, Homo sapiens
tgggatggagcctgagtatagt

SEQ ID NO: 8017998 - DNA, 18 bp, Homo sapiens
tgggatggagagtaactg

SEQ ID NO: 8017999 - DNA, 22 bp, Homo sapiens
tgggatgccggcaggaggcaat

SEQ ID NO: 8018000 - DNA, 22 bp, Homo sapiens
tgggagtcaaccctcacgagca

SEQ ID NO: 8018001 - DNA, 22 bp, Homo sapiens
tgggagtagatgaggagtgggc

SEQ ID NO: 8018002 - DNA, 22 bp, Homo sapiens
tgggagtcagacagcctgagat

SEQ ID NO: 8018003 - DNA, 22 bp, Homo sapiens
tgggagtcactgttgttgaggg

SEQ ID NO: 8018004 - DNA, 22 bp, Homo sapiens
tgggagtcatcgtgtttggatc

SEQ ID NO: 8018005 - DNA, 22 bp, Homo sapiens
tgggagtcagtcgttctcagag

SEQ ID NO: 8018006 - DNA, 22 bp, Homo sapiens
tgggagtccaaggtttttatag

SEQ ID NO: 8018007 - DNA, 22 bp, Homo sapiens
tgggagtgatacagtatggaat

SEQ ID NO: 8018008 - DNA, 22 bp, Homo sapiens
tgggagtgaggcagagtctatc

SEQ ID NO: 8018009 - DNA, 22 bp, Homo sapiens
tgggagtccattgtcccaggca

SEQ ID NO: 8018010 - DNA, 22 bp, Homo sapiens
tgggaggcttccagaccttgct

SEQ ID NO: 8018011 - DNA, 22 bp, Homo sapiens
tgggaggcttccagaccttgct

SEQ ID NO: 8018012 - DNA, 22 bp, Homo sapiens
tgggaggcttccagaccttgct

SEQ ID NO: 8018013 - DNA, 22 bp, Homo sapiens
tgggaggcttccagaccttgct

SEQ ID NO: 8018014 - DNA, 22 bp, Homo sapiens
tgggaggcttccagaccttgct

SEQ ID NO: 8018015 - DNA, 22 bp, Homo sapiens
tgggaggccgaggcaggtggat

SEQ ID NO: 8018016 - DNA, 22 bp, Homo sapiens
tgggaggccgaggcaggtggat

SEQ ID NO: 8018017 - DNA, 22 bp, Homo sapiens
tgggaggtctcttgcggcctag

SEQ ID NO: 8018018 - DNA, 20 bp, Homo sapiens
tgggagtacaatcatgagca

SEQ ID NO: 8018019 - DNA, 22 bp, Homo sapiens
tgggaggtctcttgcggcctag

SEQ ID NO: 8018020 - DNA, 22 bp, Homo sapiens
tgggaggtctcttgcggcctag

SEQ ID NO: 8018021 - DNA, 22 bp, Homo sapiens
tgggaggccgaggcaggtggat

SEQ ID NO: 8018022 - DNA, 22 bp, Homo sapiens
tgggaggccgaggcaggtggat

SEQ ID NO: 8018023 - DNA, 22 bp, Homo sapiens
tgggaggccgaggcaggtggat

SEQ ID NO: 8018024 - DNA, 22 bp, Homo sapiens
tgggaggccgaggcaggtggat

SEQ ID NO: 8018025 - DNA, 22 bp, Homo sapiens
tgggaggccgaggcaggtggat

SEQ ID NO: 8018026 - DNA, 22 bp, Homo sapiens
tgggaggccgaggcaggtggat

SEQ ID NO: 8018027 - DNA, 22 bp, Homo sapiens
tgggaggccgaggcaggtggat

SEQ ID NO: 8018028 - DNA, 22 bp, Homo sapiens
tgggaggcccaggcctggcagg

SEQ ID NO: 8018029 - DNA, 22 bp, Homo sapiens
tgggaggccgaggcaggtggat

SEQ ID NO: 8018030 - DNA, 22 bp, Homo sapiens
tgggaggccgaggcaggtggat

SEQ ID NO: 8018031 - DNA, 22 bp, Homo sapiens
tgggaggcccaggcctggcagg

SEQ ID NO: 8018032 - DNA, 22 bp, Homo sapiens
tgggaggcccaggcctggcagg

SEQ ID NO: 8018033 - DNA, 22 bp, Homo sapiens
tgggaggcccaggcctggcagg

SEQ ID NO: 8018034 - DNA, 22 bp, Homo sapiens
tgggaggcccaggcctggcagg

SEQ ID NO: 8018035 - DNA, 22 bp, Homo sapiens
tgggaggccaaggcaggcggat

SEQ ID NO: 8018036 - DNA, 22 bp, Homo sapiens
tgggaggccaaggcaggcggat

SEQ ID NO: 8018037 - DNA, 22 bp, Homo sapiens
tgggaggccaaggcaggcggat

SEQ ID NO: 8018038 - DNA, 22 bp, Homo sapiens
tgggaggccaaggcaggcggat

SEQ ID NO: 8018039 - DNA, 22 bp, Homo sapiens
tgggaggccaaggcaggcggat

SEQ ID NO: 8018040 - DNA, 22 bp, Homo sapiens
tgggaggccaaggcaggcggat

SEQ ID NO: 8018041 - DNA, 22 bp, Homo sapiens
tgggaggccaaggcaggcggat

SEQ ID NO: 8018042 - DNA, 22 bp, Homo sapiens
tgggaggccaaggcaggcggat

SEQ ID NO: 8018043 - DNA, 22 bp, Homo sapiens
tgggaggcaggtaggtgatgat

SEQ ID NO: 8018044 - DNA, 22 bp, Homo sapiens
tgggaggcaggtaggtgatgat

SEQ ID NO: 8018045 - DNA, 22 bp, Homo sapiens
tgggaggcaggtaggtgatgat

SEQ ID NO: 8018046 - DNA, 22 bp, Homo sapiens
tgggaggcaggtaggtgatgat

SEQ ID NO: 8018047 - DNA, 22 bp, Homo sapiens
tgggaggcaggtaggtgatgat

SEQ ID NO: 8018048 - DNA, 22 bp, Homo sapiens
tgtctgagctggggcagacaga

SEQ ID NO: 8018049 - DNA, 22 bp, Homo sapiens
tgtctgaattttggaatcaagt

SEQ ID NO: 8018050 - DNA, 22 bp, Homo sapiens
tgtctgaattttggaatcaagt

SEQ ID NO: 8018051 - DNA, 18 bp, Homo sapiens
tgtctgagagctgggcgc

SEQ ID NO: 8018052 - DNA, 22 bp, Homo sapiens
tgtctgagactgttttactttc

SEQ ID NO: 8018053 - DNA, 18 bp, Homo sapiens
tgtctgagagctgggcgc

SEQ ID NO: 8018054 - DNA, 21 bp, Homo sapiens
tgtctgagtgactgggtctgc

SEQ ID NO: 8018055 - DNA, 22 bp, Homo sapiens
tgtctgaggaagtcagcccttt

SEQ ID NO: 8018056 - DNA, 22 bp, Homo sapiens
tgtctgaggaagtcagcccttt

SEQ ID NO: 8018057 - DNA, 22 bp, Homo sapiens
tgtctgaggaagtcagcccttt

SEQ ID NO: 8018058 - DNA, 18 bp, Homo sapiens
tgtctgaagccacttttt

SEQ ID NO: 8018059 - DNA, 22 bp, Homo sapiens
tgtctgaagcagccagtgctgt

SEQ ID NO: 8018060 - DNA, 22 bp, Homo sapiens
tgtctgaactgcactgaaagac

SEQ ID NO: 8018061 - DNA, 22 bp, Homo sapiens
tgtctgaactgcatttgctcct

SEQ ID NO: 8018062 - DNA, 22 bp, Homo sapiens
tgtctgaagcactgggcgttgc

SEQ ID NO: 8018063 - DNA, 22 bp, Homo sapiens
tgtctgaagcagccagtgctgt

SEQ ID NO: 8018064 - DNA, 22 bp, Homo sapiens
tgtctgaactgcactgaaagac

SEQ ID NO: 8018065 - DNA, 22 bp, Homo sapiens
tgtctgaacgaagtaggtccac

SEQ ID NO: 8018066 - DNA, 22 bp, Homo sapiens
tgtctgaacaaactctgcctcc

SEQ ID NO: 8018067 - DNA, 22 bp, Homo sapiens
tgtctgaaccctggccctgcct

SEQ ID NO: 8018068 - DNA, 22 bp, Homo sapiens
tgtctgaacgaagtaggtccac

SEQ ID NO: 8018069 - DNA, 22 bp, Homo sapiens
tgtctgaattcaagaaattcaa

SEQ ID NO: 8018070 - DNA, 22 bp, Homo sapiens
tgtctgaattccacatcgttct

SEQ ID NO: 8018071 - DNA, 22 bp, Homo sapiens
tgtctgaattcaagaaattcaa

SEQ ID NO: 8018072 - DNA, 22 bp, Homo sapiens
tgtctgaatctcggtttcctca

SEQ ID NO: 8018073 - DNA, 22 bp, Homo sapiens
tgtctgaatcgcttcctagagg

SEQ ID NO: 8018074 - DNA, 22 bp, Homo sapiens
tgtctgaatctcggtttcctca

SEQ ID NO: 8018075 - DNA, 22 bp, Homo sapiens
tgtctgaatcgcttcctagagg

SEQ ID NO: 8018076 - DNA, 22 bp, Homo sapiens
tgtctgaaggcctgacctacat

SEQ ID NO: 8018077 - DNA, 22 bp, Homo sapiens
tgtctgaaggcaggtggagaac

SEQ ID NO: 8018078 - DNA, 22 bp, Homo sapiens
tgtctgaaggcaggtggagaac

SEQ ID NO: 8018079 - DNA, 22 bp, Homo sapiens
tgtctgctcggggttcccacct

SEQ ID NO: 8018080 - DNA, 22 bp, Homo sapiens
tgtctgctagctggtggcaatt

SEQ ID NO: 8018081 - DNA, 22 bp, Homo sapiens
tgtctgctacttggttctacca

SEQ ID NO: 8018082 - DNA, 22 bp, Homo sapiens
tgtctgcctgcgggccggcaca

SEQ ID NO: 8018083 - DNA, 22 bp, Homo sapiens
tgtctgccctcaacccagaggc

SEQ ID NO: 8018084 - DNA, 22 bp, Homo sapiens
tgtctgagtggtgcaaggctga

SEQ ID NO: 8018085 - DNA, 22 bp, Homo sapiens
tgtctgagtgtgcctgggcatt

SEQ ID NO: 8018086 - DNA, 22 bp, Homo sapiens
tgtctgagttagctcttctcag

SEQ ID NO: 8018087 - DNA, 18 bp, Homo sapiens
tgtctgagttcttccatt

SEQ ID NO: 8018088 - DNA, 23 bp, Homo sapiens
tgtctgagttggaaggccacctc

SEQ ID NO: 8018089 - DNA, 22 bp, Homo sapiens
tgtctgcagaagatggcatggg

SEQ ID NO: 8018090 - DNA, 22 bp, Homo sapiens
tgtctgcaccctgtgattgttt

SEQ ID NO: 8018091 - DNA, 22 bp, Homo sapiens
tgtctgcaaagtccagcacagg

SEQ ID NO: 8018092 - DNA, 22 bp, Homo sapiens
tgtctgcaaagtccagcacagg

SEQ ID NO: 8018093 - DNA, 22 bp, Homo sapiens
tgtctgcaaagtccagcacagg

SEQ ID NO: 8018094 - DNA, 22 bp, Homo sapiens
tgtctgccaaagcttcctcctg

SEQ ID NO: 8018095 - DNA, 22 bp, Homo sapiens
tgtctgcagtgccacagtggga

SEQ ID NO: 8018096 - DNA, 22 bp, Homo sapiens
tgtctgcagtgccacagtggga

SEQ ID NO: 8018097 - DNA, 21 bp, Homo sapiens
tgtctgcagacttgcttgttg

SEQ ID NO: 8018098 - DNA, 22 bp, Homo sapiens
tgtctgccattagcccagtcca

SEQ ID NO: 8018099 - DNA, 22 bp, Homo sapiens
tgtctctgaggtgagggtcagc

SEQ ID NO: 8018100 - DNA, 22 bp, Homo sapiens
tgtctctgaggtgagggtcagc

SEQ ID NO: 8018101 - DNA, 22 bp, Homo sapiens
tgtctctgagatgactcccacc

SEQ ID NO: 8018102 - DNA, 18 bp, Homo sapiens
tgtctctgaattccagtg

SEQ ID NO: 8018103 - DNA, 22 bp, Homo sapiens
tgtctctgccagctagcagaat

SEQ ID NO: 8018104 - DNA, 22 bp, Homo sapiens
tgtctctgataagtagttcagt

SEQ ID NO: 8018105 - DNA, 22 bp, Homo sapiens
tgtctctgataagtagttcagt

SEQ ID NO: 8018106 - DNA, 22 bp, Homo sapiens
tgtctctgaggtgagggtcagc

SEQ ID NO: 8018107 - DNA, 22 bp, Homo sapiens
tgtctctgataagtagttcagt

SEQ ID NO: 8018108 - DNA, 22 bp, Homo sapiens
tgtctctgctgcaccttctggg

SEQ ID NO: 8018109 - DNA, 22 bp, Homo sapiens
tgtctctgccagctagcagaat

SEQ ID NO: 8018110 - DNA, 22 bp, Homo sapiens
tgtctctgccagctagcagaat

SEQ ID NO: 8018111 - DNA, 22 bp, Homo sapiens
tgtctctgccagctagcagaat

SEQ ID NO: 8018112 - DNA, 22 bp, Homo sapiens
tgtctctgaaatatgtggctcc

SEQ ID NO: 8018113 - DNA, 22 bp, Homo sapiens
tgtctctgaaatatgtggctcc

SEQ ID NO: 8018114 - DNA, 22 bp, Homo sapiens
tgtctctgaaatatgtggctcc

SEQ ID NO: 8018115 - DNA, 22 bp, Homo sapiens
tgtctctgaaatatgtggctcc

SEQ ID NO: 8018116 - DNA, 22 bp, Homo sapiens
tgtctctgaactgggttttctt

SEQ ID NO: 8018117 - DNA, 22 bp, Homo sapiens
tgtctctgaactgggttttctt

SEQ ID NO: 8018118 - DNA, 18 bp, Homo sapiens
tgtctctgaattccagtg

SEQ ID NO: 8018119 - DNA, 18 bp, Homo sapiens
tgtctctgaattccagtg

SEQ ID NO: 8018120 - DNA, 19 bp, Homo sapiens
tgtctctgaaagatgagct

SEQ ID NO: 8018121 - DNA, 19 bp, Homo sapiens
tgtctctgaaagatgagct

SEQ ID NO: 8018122 - DNA, 22 bp, Homo sapiens
tgtctctgaaatatgtggctcc

SEQ ID NO: 8018123 - DNA, 19 bp, Homo sapiens
tgtctctgaaagatgagct

SEQ ID NO: 8018124 - DNA, 22 bp, Homo sapiens
tgtctctctgcccccattgctc

SEQ ID NO: 8018125 - DNA, 22 bp, Homo sapiens
tgtctctctgcccccattgctc

SEQ ID NO: 8018126 - DNA, 22 bp, Homo sapiens
tgtctctctgcccccattgctc

SEQ ID NO: 8018127 - DNA, 22 bp, Homo sapiens
tgtctctctagctcttggtttg

SEQ ID NO: 8018128 - DNA, 22 bp, Homo sapiens
tgtctctctagctcttggtttg

SEQ ID NO: 8018129 - DNA, 22 bp, Homo sapiens
tgtctctctgcccccattgctc

SEQ ID NO: 8018130 - DNA, 22 bp, Homo sapiens
tgtctctctagctcttggtttg

SEQ ID NO: 8018131 - DNA, 22 bp, Homo sapiens
tgtctgaaagaggacgagctgg

SEQ ID NO: 8018132 - DNA, 22 bp, Homo sapiens
tgtctgaaacttggtcctatgc

SEQ ID NO: 8018133 - DNA, 22 bp, Homo sapiens
tgtctgaacaaactctgcctcc

SEQ ID NO: 8018134 - DNA, 22 bp, Homo sapiens
tgtctgaaagaggacgagctgg

SEQ ID NO: 8018135 - DNA, 22 bp, Homo sapiens
tgtctgaaaggctttttctcac

SEQ ID NO: 8018136 - DNA, 20 bp, Homo sapiens
tgtctgaaaaggaagctatc

SEQ ID NO: 8018137 - DNA, 20 bp, Homo sapiens
tgtctgaaaaggaagctatc

SEQ ID NO: 8018138 - DNA, 22 bp, Homo sapiens
tgtctgaaacttatgatatact

SEQ ID NO: 8018139 - DNA, 22 bp, Homo sapiens
tgtctgaaacttggtcctatgc

SEQ ID NO: 8018140 - DNA, 22 bp, Homo sapiens
tgtctgaaacttggtcctatgc

SEQ ID NO: 8018141 - DNA, 22 bp, Homo sapiens
tgtctcttttcaagctaccctt

SEQ ID NO: 8018142 - DNA, 22 bp, Homo sapiens
tgtctcttttcaagctaccctt

SEQ ID NO: 8018143 - DNA, 22 bp, Homo sapiens
tgtctctttgggttcctcttgg

SEQ ID NO: 8018144 - DNA, 22 bp, Homo sapiens
tgtctctttggcctcccatatg

SEQ ID NO: 8018145 - DNA, 22 bp, Homo sapiens
tgtctctttgggttcctcttgg

SEQ ID NO: 8018146 - DNA, 22 bp, Homo sapiens
tgtctctttgggttcctcttgg

SEQ ID NO: 8018147 - DNA, 22 bp, Homo sapiens
tgtctctgctttccttgcaggg

SEQ ID NO: 8018148 - DNA, 22 bp, Homo sapiens
tgtctctgctttccttgcaggg

SEQ ID NO: 8018149 - DNA, 22 bp, Homo sapiens
tgtctctgctttccttgcaggg

SEQ ID NO: 8018150 - DNA, 22 bp, Homo sapiens
tgtctctgctttccttgcaggg

SEQ ID NO: 8018151 - DNA, 22 bp, Homo sapiens
tgtctctgctgcaccttctggg

SEQ ID NO: 8018152 - DNA, 22 bp, Homo sapiens
tgtctctgctgcaccttctggg

SEQ ID NO: 8018153 - DNA, 22 bp, Homo sapiens
tgtctctgctgcaccttctggg

SEQ ID NO: 8018154 - DNA, 22 bp, Homo sapiens
tgtctctgctttccttgcaggg

SEQ ID NO: 8018155 - DNA, 22 bp, Homo sapiens
tgtctctggcccatgagcagag

SEQ ID NO: 8018156 - DNA, 22 bp, Homo sapiens
tgtctctggcccatgagcagag

SEQ ID NO: 8018157 - DNA, 22 bp, Homo sapiens
tgtctcttggctctatcactta

SEQ ID NO: 8018158 - DNA, 22 bp, Homo sapiens
tgtctcttggctctatcactta

SEQ ID NO: 8018159 - DNA, 22 bp, Homo sapiens
tgtctcttggctctatcactta

SEQ ID NO: 8018160 - DNA, 22 bp, Homo sapiens
tgtctcttggctctatcactta

SEQ ID NO: 8018161 - DNA, 23 bp, Homo sapiens
tgtctccatctcattacttgggg

SEQ ID NO: 8018162 - DNA, 23 bp, Homo sapiens
tgtctccatctcattacttgggg

SEQ ID NO: 8018163 - DNA, 22 bp, Homo sapiens
tgtctcccaggtgtgcccagtg

SEQ ID NO: 8018164 - DNA, 22 bp, Homo sapiens
tgtctccattttcaagtagcag

SEQ ID NO: 8018165 - DNA, 22 bp, Homo sapiens
tgtctccatgtgatagtggcct

SEQ ID NO: 8018166 - DNA, 22 bp, Homo sapiens
tgtctccatgtgatagtggcct

SEQ ID NO: 8018167 - DNA, 22 bp, Homo sapiens
tgtctccattttcaagtagcag

SEQ ID NO: 8018168 - DNA, 22 bp, Homo sapiens
tgtctcctaatgtctgtttcct

SEQ ID NO: 8018169 - DNA, 22 bp, Homo sapiens
tgtctcctactgcctgtggatc

SEQ ID NO: 8018170 - DNA, 22 bp, Homo sapiens
tgtctcctactgcctgtggatc

SEQ ID NO: 8018171 - DNA, 22 bp, Homo sapiens
tgtctcctactgcctgtggatc

SEQ ID NO: 8018172 - DNA, 22 bp, Homo sapiens
tgtctcctcaactcatgctcga

SEQ ID NO: 8018173 - DNA, 22 bp, Homo sapiens
tgtctcctcaactcatgctcga

SEQ ID NO: 8018174 - DNA, 22 bp, Homo sapiens
tgtctcctcaactcatgctcga

SEQ ID NO: 8018175 - DNA, 22 bp, Homo sapiens
tgtctcctcaactcatgctcga

SEQ ID NO: 8018176 - DNA, 22 bp, Homo sapiens
tgtctcctatttcctgctaagg

SEQ ID NO: 8018177 - DNA, 22 bp, Homo sapiens
tgtctcctatttcctgctaagg

SEQ ID NO: 8018178 - DNA, 22 bp, Homo sapiens
tgtctcctatttcctgctaagg

SEQ ID NO: 8018179 - DNA, 22 bp, Homo sapiens
tgtctcctcggctgtccagcca

SEQ ID NO: 8018180 - DNA, 19 bp, Homo sapiens
tgtctcctccccgccgtct

SEQ ID NO: 8018181 - DNA, 19 bp, Homo sapiens
tgtctcctcatgcaagtgt

SEQ ID NO: 8018182 - DNA, 19 bp, Homo sapiens
tgtctcctcatgcaagtgt

SEQ ID NO: 8018183 - DNA, 22 bp, Homo sapiens
tgtctcctcaactcatgctcga

SEQ ID NO: 8018184 - DNA, 22 bp, Homo sapiens
tgtctcctcatactgtcatatt

SEQ ID NO: 8018185 - DNA, 22 bp, Homo sapiens
tgtctctagggcaatgtgaact

SEQ ID NO: 8018186 - DNA, 20 bp, Homo sapiens
tgtctctcagtgtcagtgca

SEQ ID NO: 8018187 - DNA, 22 bp, Homo sapiens
tgtctctcatttagttttgcac

SEQ ID NO: 8018188 - DNA, 22 bp, Homo sapiens
tgtctctcatttagttttgcac

SEQ ID NO: 8018189 - DNA, 20 bp, Homo sapiens
tgtctctcagtgtcagtgca

SEQ ID NO: 8018190 - DNA, 20 bp, Homo sapiens
tgtctctcagtgtcagtgca

SEQ ID NO: 8018191 - DNA, 22 bp, Homo sapiens
tgtctccttgcttttccctgta

SEQ ID NO: 8018192 - DNA, 22 bp, Homo sapiens
tgtctccttgcttttccctgta

SEQ ID NO: 8018193 - DNA, 22 bp, Homo sapiens
tgtctctagggcaatgtgaact

SEQ ID NO: 8018194 - DNA, 22 bp, Homo sapiens
tgtctccttgcttttccctgta

SEQ ID NO: 8018195 - DNA, 21 bp, Homo sapiens
tgtctcctgttggcacatggc

SEQ ID NO: 8018196 - DNA, 22 bp, Homo sapiens
tgtctccttgcttttccctgta

SEQ ID NO: 8018197 - DNA, 18 bp, Homo sapiens
tgtctctcctttctgtgt

SEQ ID NO: 8018198 - DNA, 18 bp, Homo sapiens
tgtctctcctttctgtgt

SEQ ID NO: 8018199 - DNA, 20 bp, Homo sapiens
tgtctctcggttttgtgact

SEQ ID NO: 8018200 - DNA, 22 bp, Homo sapiens
tgtctctcctgatgatctggtg

SEQ ID NO: 8018201 - DNA, 22 bp, Homo sapiens
tgtctctcctgatgatctggtg

SEQ ID NO: 8018202 - DNA, 22 bp, Homo sapiens
tgtctctcctgatgatctggtg

SEQ ID NO: 8018203 - DNA, 22 bp, Homo sapiens
tgtctctccacacagccagtgc

SEQ ID NO: 8018204 - DNA, 22 bp, Homo sapiens
tgtctctccacacagccagtgc

SEQ ID NO: 8018205 - DNA, 22 bp, Homo sapiens
tgtctcctgggccctggccctg

SEQ ID NO: 8018206 - DNA, 22 bp, Homo sapiens
tgtctcctgggccctggccctg

SEQ ID NO: 8018207 - DNA, 22 bp, Homo sapiens
tgtctcctgcaggggtgtgggc

SEQ ID NO: 8018208 - DNA, 22 bp, Homo sapiens
tgtctcctgagagctggacaga

SEQ ID NO: 8018209 - DNA, 22 bp, Homo sapiens
tgtctcctgagagctggacaga

SEQ ID NO: 8018210 - DNA, 22 bp, Homo sapiens
tgtctcctgagagctggacaga

SEQ ID NO: 8018211 - DNA, 22 bp, Homo sapiens
tgtctcctctgtcctgtcagga

SEQ ID NO: 8018212 - DNA, 22 bp, Homo sapiens
tgtctcctctgtcctgtcagga

SEQ ID NO: 8018213 - DNA, 22 bp, Homo sapiens
tgtctcctctgtcctgtcagga

SEQ ID NO: 8018214 - DNA, 21 bp, Homo sapiens
tgtctcctgttggcacatggc

SEQ ID NO: 8018215 - DNA, 21 bp, Homo sapiens
tgtctcctgttggcacatggc

SEQ ID NO: 8018216 - DNA, 21 bp, Homo sapiens
tgtctcctgttggcacatggc

SEQ ID NO: 8018217 - DNA, 22 bp, Homo sapiens
tgtctcctgggtcccttccacc

SEQ ID NO: 8018218 - DNA, 22 bp, Homo sapiens
tgtctcctgggtcccttccacc

SEQ ID NO: 8018219 - DNA, 22 bp, Homo sapiens
tgtctcctgggtcccttccacc

SEQ ID NO: 8018220 - DNA, 18 bp, Homo sapiens
tgtctaggtacgatggat

SEQ ID NO: 8018221 - DNA, 22 bp, Homo sapiens
tgtctaggtctaggttggcaat

SEQ ID NO: 8018222 - DNA, 22 bp, Homo sapiens
tgtctatagaatcatgcagttt

SEQ ID NO: 8018223 - DNA, 22 bp, Homo sapiens
tgtctatagaatcatgcagttt

SEQ ID NO: 8018224 - DNA, 22 bp, Homo sapiens
tgtctataagagttgtttattt

SEQ ID NO: 8018225 - DNA, 22 bp, Homo sapiens
tgtctccaaaacaatctcagat

SEQ ID NO: 8018226 - DNA, 22 bp, Homo sapiens
tgtctccaaaacaatctcagat

SEQ ID NO: 8018227 - DNA, 22 bp, Homo sapiens
tgtctccaaaacaatctcagat

SEQ ID NO: 8018228 - DNA, 22 bp, Homo sapiens
tgtctccaaaacaatctcagat

SEQ ID NO: 8018229 - DNA, 22 bp, Homo sapiens
tgtctatccagtcagtgccggt

SEQ ID NO: 8018230 - DNA, 22 bp, Homo sapiens
tgtctccaactcactgtatact

SEQ ID NO: 8018231 - DNA, 22 bp, Homo sapiens
tgtctccacaggtgtcagctca

SEQ ID NO: 8018232 - DNA, 22 bp, Homo sapiens
tgtctccacaggtgtcagctca

SEQ ID NO: 8018233 - DNA, 22 bp, Homo sapiens
tgtctccaccatcatcttacca

SEQ ID NO: 8018234 - DNA, 22 bp, Homo sapiens
tgtctccagaaagcaccaggag

SEQ ID NO: 8018235 - DNA, 22 bp, Homo sapiens
tgtctccagaaagcaccaggag

SEQ ID NO: 8018236 - DNA, 22 bp, Homo sapiens
tgtctccagaaagcaccaggag

SEQ ID NO: 8018237 - DNA, 20 bp, Homo sapiens
tgtctccagggctgagtgga

SEQ ID NO: 8018238 - DNA, 20 bp, Homo sapiens
tgtctccagggctgagtgga

SEQ ID NO: 8018239 - DNA, 22 bp, Homo sapiens
tgtctccaggggcaggccagcc

SEQ ID NO: 8018240 - DNA, 22 bp, Homo sapiens
tgtctccaggggcaggccagcc

SEQ ID NO: 8018241 - DNA, 22 bp, Homo sapiens
tgtctccatagaagagactgca

SEQ ID NO: 8018242 - DNA, 22 bp, Homo sapiens
tgtctccatagaagagactgca

SEQ ID NO: 8018243 - DNA, 22 bp, Homo sapiens
tgtctccatagagtagcttgat

SEQ ID NO: 8018244 - DNA, 22 bp, Homo sapiens
tgtctaatgaattaattaatta

SEQ ID NO: 8018245 - DNA, 22 bp, Homo sapiens
tgtctaatggcaatttcatgtg

SEQ ID NO: 8018246 - DNA, 22 bp, Homo sapiens
tgtctaagagtgcaatgcatga

SEQ ID NO: 8018247 - DNA, 22 bp, Homo sapiens
tgtctaagggaagatgcaatgt

SEQ ID NO: 8018248 - DNA, 22 bp, Homo sapiens
tgtctacaaacgtgtacacatt

SEQ ID NO: 8018249 - DNA, 22 bp, Homo sapiens
tgtcgcagctgaaaatctcaat

SEQ ID NO: 8018250 - DNA, 22 bp, Homo sapiens
tgtcgggcatgcattctgagaa

SEQ ID NO: 8018251 - DNA, 22 bp, Homo sapiens
tgtcggactatggttcacagtg

SEQ ID NO: 8018252 - DNA, 22 bp, Homo sapiens
tgtctaaatgaaaagagatgcc

SEQ ID NO: 8018253 - DNA, 22 bp, Homo sapiens
tgtctaaacttgttttatctca

SEQ ID NO: 8018254 - DNA, 22 bp, Homo sapiens
tgtctaaatgcaatggatttcc

SEQ ID NO: 8018255 - DNA, 19 bp, Homo sapiens
tgtctagctgcacagctga

SEQ ID NO: 8018256 - DNA, 15 bp, Homo sapiens
tgtctagattgttgt

SEQ ID NO: 8018257 - DNA, 19 bp, Homo sapiens
tgtctagctgcacagctga

SEQ ID NO: 8018258 - DNA, 22 bp, Homo sapiens
tgtctagggagctgctcaggct

SEQ ID NO: 8018259 - DNA, 22 bp, Homo sapiens
tgtctagggcgagaatgtgtag

SEQ ID NO: 8018260 - DNA, 22 bp, Homo sapiens
tgtctagaggccaacaggaaag

SEQ ID NO: 8018261 - DNA, 22 bp, Homo sapiens
tgtctagaggccaacaggaaag

SEQ ID NO: 8018262 - DNA, 22 bp, Homo sapiens
tgtctagaggccaacaggaaag

SEQ ID NO: 8018263 - DNA, 22 bp, Homo sapiens
tgtctagaggccaacaggaaag

SEQ ID NO: 8018264 - DNA, 22 bp, Homo sapiens
tgtctagacattagcttcagct

SEQ ID NO: 8018265 - DNA, 22 bp, Homo sapiens
tgtctagacattagcttcagct

SEQ ID NO: 8018266 - DNA, 21 bp, Homo sapiens
tgtctagacctcatcctacag

SEQ ID NO: 8018267 - DNA, 22 bp, Homo sapiens
tgtctactgctgacactaacag

SEQ ID NO: 8018268 - DNA, 19 bp, Homo sapiens
tgtctacataatagattga

SEQ ID NO: 8018269 - DNA, 22 bp, Homo sapiens
tgtctagaaatgctgagtctca

SEQ ID NO: 8018270 - DNA, 22 bp, Homo sapiens
tgtctagacaagaagtattgcc

SEQ ID NO: 8018271 - DNA, 22 bp, Homo sapiens
tgtctagacaagaagtattgcc

SEQ ID NO: 8018272 - DNA, 22 bp, Homo sapiens
tgtctacttgggctctacagca

SEQ ID NO: 8018273 - DNA, 22 bp, Homo sapiens
tgtctttgttattgtggacagg

SEQ ID NO: 8018274 - DNA, 22 bp, Homo sapiens
tgtcttttacctaatgagctgg

SEQ ID NO: 8018275 - DNA, 19 bp, Homo sapiens
tgtctttggtctgagtttc

SEQ ID NO: 8018276 - DNA, 22 bp, Homo sapiens
tgtctttacttaataaatatac

SEQ ID NO: 8018277 - DNA, 22 bp, Homo sapiens
tgtctttaattctacatatctc

SEQ ID NO: 8018278 - DNA, 22 bp, Homo sapiens
tgtctttaattctacatatctc

SEQ ID NO: 8018279 - DNA, 22 bp, Homo sapiens
tgtctttaattctacatatctc

SEQ ID NO: 8018280 - DNA, 22 bp, Homo sapiens
tgtctttacttaataaatatac

SEQ ID NO: 8018281 - DNA, 22 bp, Homo sapiens
tgtcttttataactgacatata

SEQ ID NO: 8018282 - DNA, 22 bp, Homo sapiens
tgtcttttataactgacatata

SEQ ID NO: 8018283 - DNA, 22 bp, Homo sapiens
tgtcttttgccaaagatcagtt

SEQ ID NO: 8018284 - DNA, 22 bp, Homo sapiens
tgtcttttgccaaagatcagtt

SEQ ID NO: 8018285 - DNA, 22 bp, Homo sapiens
tgtgaaaaaagttctagaagga

SEQ ID NO: 8018286 - DNA, 22 bp, Homo sapiens
tgtgaaaaaagttctagaagga

SEQ ID NO: 8018287 - DNA, 22 bp, Homo sapiens
tgtgaaaaaagttctagaagga

SEQ ID NO: 8018288 - DNA, 22 bp, Homo sapiens
tgtcttttggagcatctttctt

SEQ ID NO: 8018289 - DNA, 22 bp, Homo sapiens
tgtcttttggagcatctttctt

SEQ ID NO: 8018290 - DNA, 22 bp, Homo sapiens
tgtcttttggagcatctttctt

SEQ ID NO: 8018291 - DNA, 22 bp, Homo sapiens
tgtctttttacctgtgatgagt

SEQ ID NO: 8018292 - DNA, 22 bp, Homo sapiens
tgtgaaaagcaggctactttct

SEQ ID NO: 8018293 - DNA, 22 bp, Homo sapiens
tgtgaaaagcaggctactttct

SEQ ID NO: 8018294 - DNA, 22 bp, Homo sapiens
tgtgaaaagcaggctactttct

SEQ ID NO: 8018295 - DNA, 22 bp, Homo sapiens
tgtgaaaagcgtgtgttctagg

SEQ ID NO: 8018296 - DNA, 22 bp, Homo sapiens
tgtgaaaagcgtgtgttctagg

SEQ ID NO: 8018297 - DNA, 22 bp, Homo sapiens
tgtgaaaagcgtgtgttctagg

SEQ ID NO: 8018298 - DNA, 22 bp, Homo sapiens
tgtgaaaagggctttgtacaaa

SEQ ID NO: 8018299 - DNA, 22 bp, Homo sapiens
tgtgaaaagggctttgtacaaa

SEQ ID NO: 8018300 - DNA, 22 bp, Homo sapiens
tgtgaaaagggctttgtacaaa

SEQ ID NO: 8018301 - DNA, 22 bp, Homo sapiens
tgtgaaacggagtcagggaagg

SEQ ID NO: 8018302 - DNA, 22 bp, Homo sapiens
tgtgaaaagcgtgtgttctagg

SEQ ID NO: 8018303 - DNA, 22 bp, Homo sapiens
tgtctttaaaattaaacacatc

SEQ ID NO: 8018304 - DNA, 22 bp, Homo sapiens
tgtctttaaaattaaacacatc

SEQ ID NO: 8018305 - DNA, 22 bp, Homo sapiens
tgtctttaaaattaaacacatc

SEQ ID NO: 8018306 - DNA, 22 bp, Homo sapiens
tgtctttaaaattaaacacatc

SEQ ID NO: 8018307 - DNA, 22 bp, Homo sapiens
tgtctttaattctacatatctc

SEQ ID NO: 8018308 - DNA, 22 bp, Homo sapiens
tgtctttaagcaaacagtgttt

SEQ ID NO: 8018309 - DNA, 19 bp, Homo sapiens
tgtctttaactggaaccac

SEQ ID NO: 8018310 - DNA, 22 bp, Homo sapiens
tgtcttggccactaggagtgcc

SEQ ID NO: 8018311 - DNA, 22 bp, Homo sapiens
tgtcttggattatctgtgcaac

SEQ ID NO: 8018312 - DNA, 22 bp, Homo sapiens
tgtcttggattatctgtgcaac

SEQ ID NO: 8018313 - DNA, 22 bp, Homo sapiens
tgtcttgattgaagagatagaa

SEQ ID NO: 8018314 - DNA, 22 bp, Homo sapiens
tgtcttgattagaatgatgggc

SEQ ID NO: 8018315 - DNA, 23 bp, Homo sapiens
tgtcttggtttcttcaccctagt

SEQ ID NO: 8018316 - DNA, 22 bp, Homo sapiens
tgtcttggttcttctgaaacac

SEQ ID NO: 8018317 - DNA, 22 bp, Homo sapiens
tgtcttggccactaggagtgcc

SEQ ID NO: 8018318 - DNA, 22 bp, Homo sapiens
tgtcttggctctggagggggat

SEQ ID NO: 8018319 - DNA, 22 bp, Homo sapiens
tgtcttgtctgtgagggcattg

SEQ ID NO: 8018320 - DNA, 22 bp, Homo sapiens
tgtcttctaccttgacagcatt

SEQ ID NO: 8018321 - DNA, 22 bp, Homo sapiens
tgtcttctaccttgacagcatt

SEQ ID NO: 8018322 - DNA, 22 bp, Homo sapiens
tgtcttctaccttgacagcatt

SEQ ID NO: 8018323 - DNA, 17 bp, Homo sapiens
tgtcttctgaagagagc

SEQ ID NO: 8018324 - DNA, 17 bp, Homo sapiens
tgtcttctgaagagagc

SEQ ID NO: 8018325 - DNA, 22 bp, Homo sapiens
tgtcttctaccttgacagcatt

SEQ ID NO: 8018326 - DNA, 22 bp, Homo sapiens
tgtcttgactttagagccagga

SEQ ID NO: 8018327 - DNA, 22 bp, Homo sapiens
tgtcttcttcataaggagagtg

SEQ ID NO: 8018328 - DNA, 22 bp, Homo sapiens
tgtcttctgtattcaagtctat

SEQ ID NO: 8018329 - DNA, 17 bp, Homo sapiens
tgtcttctgaagagagc

SEQ ID NO: 8018330 - DNA, 17 bp, Homo sapiens
tgtcttctgaagagagc

SEQ ID NO: 8018331 - DNA, 22 bp, Homo sapiens
tgtcttcattctgtatgtccag

SEQ ID NO: 8018332 - DNA, 22 bp, Homo sapiens
tgtcttcattccccatgaagtc

SEQ ID NO: 8018333 - DNA, 22 bp, Homo sapiens
tgtcttccatggttttgacact

SEQ ID NO: 8018334 - DNA, 22 bp, Homo sapiens
tgtcttccatggttttgacact

SEQ ID NO: 8018335 - DNA, 22 bp, Homo sapiens
tgtcttcatctccatgcacaga

SEQ ID NO: 8018336 - DNA, 22 bp, Homo sapiens
tgtcttcgctacaatgaaaagg

SEQ ID NO: 8018337 - DNA, 23 bp, Homo sapiens
tgtcttcgactcctgcgtgcttc

SEQ ID NO: 8018338 - DNA, 22 bp, Homo sapiens
tgtcttcatggcggaacaactt

SEQ ID NO: 8018339 - DNA, 22 bp, Homo sapiens
tgtcttcatgcctgaaagaaga

SEQ ID NO: 8018340 - DNA, 22 bp, Homo sapiens
tgtcttcatgcctgaaagaaga

SEQ ID NO: 8018341 - DNA, 22 bp, Homo sapiens
tgtcttcatgcctgaaagaaga

SEQ ID NO: 8018342 - DNA, 22 bp, Homo sapiens
tgtcttcatctccatgcacaga

SEQ ID NO: 8018343 - DNA, 22 bp, Homo sapiens
tgtcttcatggcggaacaactt

SEQ ID NO: 8018344 - DNA, 22 bp, Homo sapiens
tgtcttcatggcggaacaactt

SEQ ID NO: 8018345 - DNA, 20 bp, Homo sapiens
tgtcttcattatggtgccct

SEQ ID NO: 8018346 - DNA, 20 bp, Homo sapiens
tgtcttcattatggtgccct

SEQ ID NO: 8018347 - DNA, 22 bp, Homo sapiens
tgtcttcattccccatgaagtc

SEQ ID NO: 8018348 - DNA, 22 bp, Homo sapiens
tgtcttcattccccatgaagtc

SEQ ID NO: 8018349 - DNA, 22 bp, Homo sapiens
tgtcttcaggagtaaatatcat

SEQ ID NO: 8018350 - DNA, 22 bp, Homo sapiens
tgtcttcagtaaaatacactat

SEQ ID NO: 8018351 - DNA, 22 bp, Homo sapiens
tgtcttcagtaaaatacactat

SEQ ID NO: 8018352 - DNA, 22 bp, Homo sapiens
tgtcttcagtaaaatacactat

SEQ ID NO: 8018353 - DNA, 22 bp, Homo sapiens
tgtcttcatctccatgcacaga

SEQ ID NO: 8018354 - DNA, 22 bp, Homo sapiens
tgtcttcatctcagacacagtt

SEQ ID NO: 8018355 - DNA, 22 bp, Homo sapiens
tgtcttcatctcagacacagtt

SEQ ID NO: 8018356 - DNA, 22 bp, Homo sapiens
tgtcttcatctcagacacagtt

SEQ ID NO: 8018357 - DNA, 22 bp, Homo sapiens
tgtcttcatctcagacacagtt

SEQ ID NO: 8018358 - DNA, 22 bp, Homo sapiens
tgtcttcatctcagacacagtt

SEQ ID NO: 8018359 - DNA, 21 bp, Homo sapiens
tgtcttcatatgagatggtgt

SEQ ID NO: 8018360 - DNA, 21 bp, Homo sapiens
tgtcttcatatgagatggtgt

SEQ ID NO: 8018361 - DNA, 22 bp, Homo sapiens
tgtctggctcattttctgcagt

SEQ ID NO: 8018362 - DNA, 22 bp, Homo sapiens
tgtctggctcattttctgcagt

SEQ ID NO: 8018363 - DNA, 22 bp, Homo sapiens
tgtctgggagactgatcacccg

SEQ ID NO: 8018364 - DNA, 22 bp, Homo sapiens
tgtctgggagactgatcacccg

SEQ ID NO: 8018365 - DNA, 22 bp, Homo sapiens
tgtctgggagggacagggctac

SEQ ID NO: 8018366 - DNA, 22 bp, Homo sapiens
tgtctgggagggacagggctac

SEQ ID NO: 8018367 - DNA, 22 bp, Homo sapiens
tgtctgggagggacagggctac

SEQ ID NO: 8018368 - DNA, 22 bp, Homo sapiens
tgtctgggagggacagggctac

SEQ ID NO: 8018369 - DNA, 22 bp, Homo sapiens
tgtctgggagggacagggctac

SEQ ID NO: 8018370 - DNA, 22 bp, Homo sapiens
tgtctggcctcaaaagccattt

SEQ ID NO: 8018371 - DNA, 22 bp, Homo sapiens
tgtctggatgtctggagcatcg

SEQ ID NO: 8018372 - DNA, 22 bp, Homo sapiens
tgtctggatgtctggagcatcg

SEQ ID NO: 8018373 - DNA, 22 bp, Homo sapiens
tgtctgtgacctcttaggcaag

SEQ ID NO: 8018374 - DNA, 22 bp, Homo sapiens
tgtctgtgacagacctttgcta

SEQ ID NO: 8018375 - DNA, 22 bp, Homo sapiens
tgtctgtgacctcttaggcaag

SEQ ID NO: 8018376 - DNA, 22 bp, Homo sapiens
tgtctgtgacctcttaggcaag

SEQ ID NO: 8018377 - DNA, 22 bp, Homo sapiens
tgtctgtgacctctttggagcc

SEQ ID NO: 8018378 - DNA, 22 bp, Homo sapiens
tgtctggggaactgtgcatcca

SEQ ID NO: 8018379 - DNA, 22 bp, Homo sapiens
tgtctgtgatttaggccagggc

SEQ ID NO: 8018380 - DNA, 22 bp, Homo sapiens
tgtctgtgacctctttggagcc

SEQ ID NO: 8018381 - DNA, 22 bp, Homo sapiens
tgtctgggagggacagggctac

SEQ ID NO: 8018382 - DNA, 22 bp, Homo sapiens
tgtctgggatgttggcagccac

SEQ ID NO: 8018383 - DNA, 22 bp, Homo sapiens
tgtctgtgacagacctttgcta

SEQ ID NO: 8018384 - DNA, 22 bp, Homo sapiens
tgtctgggatgttggcagccac

SEQ ID NO: 8018385 - DNA, 18 bp, Homo sapiens
tgtctgcttctccaactc

SEQ ID NO: 8018386 - DNA, 22 bp, Homo sapiens
tgtctgctggttgggagcttaa

SEQ ID NO: 8018387 - DNA, 18 bp, Homo sapiens
tgtctgcttctccaactc

SEQ ID NO: 8018388 - DNA, 18 bp, Homo sapiens
tgtctgcttctccaactc

SEQ ID NO: 8018389 - DNA, 19 bp, Homo sapiens
tgtctggaagagctgcagg

SEQ ID NO: 8018390 - DNA, 19 bp, Homo sapiens
tgtctggaagagctgcagg

SEQ ID NO: 8018391 - DNA, 22 bp, Homo sapiens
tgtctggaagtaccagggaagc

SEQ ID NO: 8018392 - DNA, 22 bp, Homo sapiens
tgtctggacagagattctcaat

SEQ ID NO: 8018393 - DNA, 22 bp, Homo sapiens
tgtctggacattgacaatcatg

SEQ ID NO: 8018394 - DNA, 22 bp, Homo sapiens
tgtctggacattgacaatcatg

SEQ ID NO: 8018395 - DNA, 23 bp, Homo sapiens
tgtctggagcctgagcaggtgct

SEQ ID NO: 8018396 - DNA, 22 bp, Homo sapiens
tgtctggagggctggctccctg

SEQ ID NO: 8018397 - DNA, 22 bp, Homo sapiens
tgtctggaggtcaggtcctggg

SEQ ID NO: 8018398 - DNA, 22 bp, Homo sapiens
tgtctggatggtggagattgag

SEQ ID NO: 8018399 - DNA, 22 bp, Homo sapiens
tgtctggatggtggagattgag

SEQ ID NO: 8018400 - DNA, 22 bp, Homo sapiens
tgtcttaatttccctttgtcat

SEQ ID NO: 8018401 - DNA, 22 bp, Homo sapiens
tgtcttaatttggatgatgttt

SEQ ID NO: 8018402 - DNA, 22 bp, Homo sapiens
tgtcttaatttggatgatgttt

SEQ ID NO: 8018403 - DNA, 19 bp, Homo sapiens
tgtcttaattaactcagag

SEQ ID NO: 8018404 - DNA, 22 bp, Homo sapiens
tgtctgtgtgagcaaatgactt

SEQ ID NO: 8018405 - DNA, 22 bp, Homo sapiens
tgtctgttattggtgtataaga

SEQ ID NO: 8018406 - DNA, 22 bp, Homo sapiens
tgtcttaaacttgtgggacttc

SEQ ID NO: 8018407 - DNA, 22 bp, Homo sapiens
tgtcttaagaaattgcatttgt

SEQ ID NO: 8018408 - DNA, 22 bp, Homo sapiens
tgtcttaagtagattacagcct

SEQ ID NO: 8018409 - DNA, 22 bp, Homo sapiens
tgtcttaagtagattacagcct

SEQ ID NO: 8018410 - DNA, 22 bp, Homo sapiens
tgtcttaagtagattacagcct

SEQ ID NO: 8018411 - DNA, 22 bp, Homo sapiens
tgtctgttattggtgtataaga

SEQ ID NO: 8018412 - DNA, 22 bp, Homo sapiens
tgtctgtgtgagcaaatgactt

SEQ ID NO: 8018413 - DNA, 22 bp, Homo sapiens
tgtctgtgtccaaatttcctct

SEQ ID NO: 8018414 - DNA, 22 bp, Homo sapiens
tgtctgtggcaattgtgggtaa

SEQ ID NO: 8018415 - DNA, 22 bp, Homo sapiens
tgtctgtggcaattgtgggtaa

SEQ ID NO: 8018416 - DNA, 22 bp, Homo sapiens
tgtctgtgggcaacgcctccca

SEQ ID NO: 8018417 - DNA, 22 bp, Homo sapiens
tgtctgtgatttaggccagggc

SEQ ID NO: 8018418 - DNA, 22 bp, Homo sapiens
tgtctgtgatttaggccagggc

SEQ ID NO: 8018419 - DNA, 22 bp, Homo sapiens
tgtctgtgacctctttggagcc

SEQ ID NO: 8018420 - DNA, 22 bp, Homo sapiens
tgtctgtgatttaggccagggc

SEQ ID NO: 8018421 - DNA, 22 bp, Homo sapiens
tgtctgtgcccaaggctcccgg

SEQ ID NO: 8018422 - DNA, 20 bp, Homo sapiens
tgtctgtgccacggcactcc

SEQ ID NO: 8018423 - DNA, 22 bp, Homo sapiens
tgtctgtggcaattgtgggtaa

SEQ ID NO: 8018424 - DNA, 22 bp, Homo sapiens
tgtctgtgatttaggccagggc

SEQ ID NO: 8018425 - DNA, 22 bp, Homo sapiens
tgtctgtggcaattgtgggtaa

SEQ ID NO: 8018426 - DNA, 22 bp, Homo sapiens
tgtcttattttgaagtgttcac

SEQ ID NO: 8018427 - DNA, 22 bp, Homo sapiens
tgtcttcaaatattgaaatcct

SEQ ID NO: 8018428 - DNA, 22 bp, Homo sapiens
tgtcttattgcctttgtaattt

SEQ ID NO: 8018429 - DNA, 22 bp, Homo sapiens
tgtcttattttaaaagggaagt

SEQ ID NO: 8018430 - DNA, 22 bp, Homo sapiens
tgtcttattccttctgttcagc

SEQ ID NO: 8018431 - DNA, 20 bp, Homo sapiens
tgtcttattccagtgtttac

SEQ ID NO: 8018432 - DNA, 22 bp, Homo sapiens
tgtcttatgtagatactgagaa

SEQ ID NO: 8018433 - DNA, 22 bp, Homo sapiens
tgtcttattaagaccagtgact

SEQ ID NO: 8018434 - DNA, 22 bp, Homo sapiens
tgtcttatgctgcatagactat

SEQ ID NO: 8018435 - DNA, 22 bp, Homo sapiens
tgtcttatgctgcatagactat

SEQ ID NO: 8018436 - DNA, 22 bp, Homo sapiens
tgtcttatgtagatactgagaa

SEQ ID NO: 8018437 - DNA, 22 bp, Homo sapiens
tgtcttatgtagatactgagaa

SEQ ID NO: 8018438 - DNA, 22 bp, Homo sapiens
tgtcttatgctgcatagactat

SEQ ID NO: 8018439 - DNA, 17 bp, Homo sapiens
tgtcttatctgtcctgt

SEQ ID NO: 8018440 - DNA, 22 bp, Homo sapiens
tgtcttcagcaaatgcctttct

SEQ ID NO: 8018441 - DNA, 22 bp, Homo sapiens
tgtcttcagcagtcatctgggg

SEQ ID NO: 8018442 - DNA, 22 bp, Homo sapiens
tgtcttcagataggcattcttc

SEQ ID NO: 8018443 - DNA, 22 bp, Homo sapiens
tgtcttcaggagtaaatatcat

SEQ ID NO: 8018444 - DNA, 22 bp, Homo sapiens
tgtcttcaggagtaaatatcat

SEQ ID NO: 8018445 - DNA, 22 bp, Homo sapiens
tgtcttcagataggcattcttc

SEQ ID NO: 8018446 - DNA, 22 bp, Homo sapiens
tgtcttcagaattaagagtatg

SEQ ID NO: 8018447 - DNA, 22 bp, Homo sapiens
tgtcttcagaattaagagtatg

SEQ ID NO: 8018448 - DNA, 22 bp, Homo sapiens
tgtcttcactcaagtctcttgg

SEQ ID NO: 8018449 - DNA, 22 bp, Homo sapiens
tgtcttcactcaagtctcttgg

SEQ ID NO: 8018450 - DNA, 22 bp, Homo sapiens
tgtcttcacatgataagccatt

SEQ ID NO: 8018451 - DNA, 22 bp, Homo sapiens
tgtcttcacaaagcagaaggga

SEQ ID NO: 8018452 - DNA, 22 bp, Homo sapiens
tgtcttcacaaagcagaaggga

SEQ ID NO: 8018453 - DNA, 22 bp, Homo sapiens
tgtcttcacaaagcagaaggga

SEQ ID NO: 8018454 - DNA, 22 bp, Homo sapiens
tgtcttcaaatattgaaatcct

SEQ ID NO: 8018455 - DNA, 22 bp, Homo sapiens
tgtcttcaaatattgaaatcct

SEQ ID NO: 8018456 - DNA, 22 bp, Homo sapiens
tgtgaaatgctattgtgacaaa

SEQ ID NO: 8018457 - DNA, 22 bp, Homo sapiens
tgtgaaatgctattgtgacaaa

SEQ ID NO: 8018458 - DNA, 22 bp, Homo sapiens
tgtgaaatgctattgtgacaaa

SEQ ID NO: 8018459 - DNA, 22 bp, Homo sapiens
tgtgaaatgctattgtgacaaa

SEQ ID NO: 8018460 - DNA, 22 bp, Homo sapiens
tgtgaaatgtgtgtataattaa

SEQ ID NO: 8018461 - DNA, 22 bp, Homo sapiens
tgtgaaatgagtatatttgaat

SEQ ID NO: 8018462 - DNA, 22 bp, Homo sapiens
tgtgaaatgagtatatttgaat

SEQ ID NO: 8018463 - DNA, 22 bp, Homo sapiens
tgtgaaatgagtatatttgaat

SEQ ID NO: 8018464 - DNA, 23 bp, Homo sapiens
tgtgaaatttgaggtcagtgctt

SEQ ID NO: 8018465 - DNA, 18 bp, Homo sapiens
tgtgaacacatttttctg

SEQ ID NO: 8018466 - DNA, 22 bp, Homo sapiens
tgtgaaattcttgaaatgcaca

SEQ ID NO: 8018467 - DNA, 22 bp, Homo sapiens
tgtgaaattcttgaaatgcaca

SEQ ID NO: 8018468 - DNA, 22 bp, Homo sapiens
tgtgaaatgtgtgtataattaa

SEQ ID NO: 8018469 - DNA, 22 bp, Homo sapiens
tgtgaaagcaagtctagttctc

SEQ ID NO: 8018470 - DNA, 22 bp, Homo sapiens
tgtgaaagagtcttatagtttc

SEQ ID NO: 8018471 - DNA, 22 bp, Homo sapiens
tgtgaaagagtcttatagtttc

SEQ ID NO: 8018472 - DNA, 22 bp, Homo sapiens
tgtgaaagtcaaattaattgaa

SEQ ID NO: 8018473 - DNA, 22 bp, Homo sapiens
tgtgaaagtcaaattaattgaa

SEQ ID NO: 8018474 - DNA, 22 bp, Homo sapiens
tgtgaaaggagccatagacagt

SEQ ID NO: 8018475 - DNA, 22 bp, Homo sapiens
tgtgaaatatttatatactcaa

SEQ ID NO: 8018476 - DNA, 22 bp, Homo sapiens
tgtgaaatctgatgaattgacc

SEQ ID NO: 8018477 - DNA, 22 bp, Homo sapiens
tgtgacagatctctatacatga

SEQ ID NO: 8018478 - DNA, 22 bp, Homo sapiens
tgtgacagatctttaaataatg

SEQ ID NO: 8018479 - DNA, 20 bp, Homo sapiens
tgtgacaaaggcatatttta

SEQ ID NO: 8018480 - DNA, 22 bp, Homo sapiens
tgtgacaagcattgtatattgg

SEQ ID NO: 8018481 - DNA, 22 bp, Homo sapiens
tgtgacagaattggtctgttct

SEQ ID NO: 8018482 - DNA, 22 bp, Homo sapiens
tgtgacagaattggtctgttct

SEQ ID NO: 8018483 - DNA, 22 bp, Homo sapiens
tgtgacagaaagtggatgggac

SEQ ID NO: 8018484 - DNA, 22 bp, Homo sapiens
tgtgacactggccatctgggtt

SEQ ID NO: 8018485 - DNA, 22 bp, Homo sapiens
tgtgacaggaactatgtggatg

SEQ ID NO: 8018486 - DNA, 22 bp, Homo sapiens
tgtgacagccagtaaagtaagc

SEQ ID NO: 8018487 - DNA, 23 bp, Homo sapiens
tgtgacagggtcattgaaaaggg

SEQ ID NO: 8018488 - DNA, 23 bp, Homo sapiens
tgtgacagggtcattgaaaaggg

SEQ ID NO: 8018489 - DNA, 23 bp, Homo sapiens
tgtgacagggtcattgaaaaggg

SEQ ID NO: 8018490 - DNA, 22 bp, Homo sapiens
tgtgacagtcgttaggagctca

SEQ ID NO: 8018491 - DNA, 23 bp, Homo sapiens
tgtgacagggtcattgaaaaggg

SEQ ID NO: 8018492 - DNA, 23 bp, Homo sapiens
tgtgacagtgacaatactgactt

SEQ ID NO: 8018493 - DNA, 22 bp, Homo sapiens
tgtgacagtcgttaggagctca

SEQ ID NO: 8018494 - DNA, 22 bp, Homo sapiens
tgtgacagtgccagcttcatag

SEQ ID NO: 8018495 - DNA, 22 bp, Homo sapiens
tgtgacataaaaacagcaatca

SEQ ID NO: 8018496 - DNA, 19 bp, Homo sapiens
tgtgacatcactgggcagc

SEQ ID NO: 8018497 - DNA, 22 bp, Homo sapiens
tgtgaatggcagttggatagca

SEQ ID NO: 8018498 - DNA, 22 bp, Homo sapiens
tgtgaatgttaatattggatta

SEQ ID NO: 8018499 - DNA, 23 bp, Homo sapiens
tgtgaattgaggacatcaaaagc

SEQ ID NO: 8018500 - DNA, 22 bp, Homo sapiens
tgtgaatgttaatattggatta

SEQ ID NO: 8018501 - DNA, 22 bp, Homo sapiens
tgtgaatggacaattaaatcta

SEQ ID NO: 8018502 - DNA, 22 bp, Homo sapiens
tgtgaatggcagttggatagca

SEQ ID NO: 8018503 - DNA, 22 bp, Homo sapiens
tgtgaatggacaattaaatcta

SEQ ID NO: 8018504 - DNA, 22 bp, Homo sapiens
tgtgaatatacttaatgccact

SEQ ID NO: 8018505 - DNA, 22 bp, Homo sapiens
tgtgaatatttccttctttgga

SEQ ID NO: 8018506 - DNA, 22 bp, Homo sapiens
tgtgaatatccatttgtttcag

SEQ ID NO: 8018507 - DNA, 22 bp, Homo sapiens
tgtgaatggacaattaaatcta

SEQ ID NO: 8018508 - DNA, 22 bp, Homo sapiens
tgtgaatggacaattaaatcta

SEQ ID NO: 8018509 - DNA, 22 bp, Homo sapiens
tgtgaatggacaattaaatcta

SEQ ID NO: 8018510 - DNA, 22 bp, Homo sapiens
tgtgaatggacaattaaatcta

SEQ ID NO: 8018511 - DNA, 22 bp, Homo sapiens
tgtgaatggacaattaaatcta

SEQ ID NO: 8018512 - DNA, 22 bp, Homo sapiens
tgtgaatatttccttctttgga

SEQ ID NO: 8018513 - DNA, 22 bp, Homo sapiens
tgtgaatatttccttctttgga

SEQ ID NO: 8018514 - DNA, 22 bp, Homo sapiens
tgtgaatgcttgttatggagtg

SEQ ID NO: 8018515 - DNA, 22 bp, Homo sapiens
tgtgaatgcttgttatggagtg

SEQ ID NO: 8018516 - DNA, 22 bp, Homo sapiens
tgtgaatacattggtagaagca

SEQ ID NO: 8018517 - DNA, 22 bp, Homo sapiens
tgtgaatacagcatgtgcttct

SEQ ID NO: 8018518 - DNA, 22 bp, Homo sapiens
tgtgaataccttgaattcatca

SEQ ID NO: 8018519 - DNA, 22 bp, Homo sapiens
tgtgaataccttgaattcatca

SEQ ID NO: 8018520 - DNA, 22 bp, Homo sapiens
tgtgaataccttgaattcatca

SEQ ID NO: 8018521 - DNA, 22 bp, Homo sapiens
tgtgaataccttgaattcatca

SEQ ID NO: 8018522 - DNA, 22 bp, Homo sapiens
tgtgaatagtgccgcaataaac

SEQ ID NO: 8018523 - DNA, 22 bp, Homo sapiens
tgtgaatagtcagcattttgtt

SEQ ID NO: 8018524 - DNA, 22 bp, Homo sapiens
tgtgaacatttctggttatttg

SEQ ID NO: 8018525 - DNA, 22 bp, Homo sapiens
tgtgaacattcagatcaagctc

SEQ ID NO: 8018526 - DNA, 23 bp, Homo sapiens
tgtgaaggtgggtccaagggctg

SEQ ID NO: 8018527 - DNA, 22 bp, Homo sapiens
tgtgaataatgccgcaataaac

SEQ ID NO: 8018528 - DNA, 22 bp, Homo sapiens
tgtgaatacagcatgtgcttct

SEQ ID NO: 8018529 - DNA, 22 bp, Homo sapiens
tgtgaaggtttttatgggatat

SEQ ID NO: 8018530 - DNA, 22 bp, Homo sapiens
tgtgaaggtttttatgggatat

SEQ ID NO: 8018531 - DNA, 22 bp, Homo sapiens
tgtgaagtccagagaagtcagg

SEQ ID NO: 8018532 - DNA, 22 bp, Homo sapiens
tgtgattagctgaatacactgg

SEQ ID NO: 8018533 - DNA, 22 bp, Homo sapiens
tgtgattagctgaatacactgg

SEQ ID NO: 8018534 - DNA, 22 bp, Homo sapiens
tgtgattatattgtagtacatt

SEQ ID NO: 8018535 - DNA, 22 bp, Homo sapiens
tgtgattgtagtatacatatta

SEQ ID NO: 8018536 - DNA, 22 bp, Homo sapiens
tgtgatttattgaaaagagctt

SEQ ID NO: 8018537 - DNA, 22 bp, Homo sapiens
tgtgatttcatctgaggccagg

SEQ ID NO: 8018538 - DNA, 22 bp, Homo sapiens
tgtgatttccagccattaaaaa

SEQ ID NO: 8018539 - DNA, 22 bp, Homo sapiens
tgtgatttcatctgaggccagg

SEQ ID NO: 8018540 - DNA, 22 bp, Homo sapiens
tgtgcaaagtgtacaaattaat

SEQ ID NO: 8018541 - DNA, 22 bp, Homo sapiens
tgtgatatttgagtattgtcaa

SEQ ID NO: 8018542 - DNA, 22 bp, Homo sapiens
tgtgataagttaaattaaacct

SEQ ID NO: 8018543 - DNA, 22 bp, Homo sapiens
tgtgatactggtttatatcatt

SEQ ID NO: 8018544 - DNA, 22 bp, Homo sapiens
tgtgatactggtttatatcatt

SEQ ID NO: 8018545 - DNA, 22 bp, Homo sapiens
tgtgatgtcagtggtatcaaag

SEQ ID NO: 8018546 - DNA, 22 bp, Homo sapiens
tgtgatggttcactgggcatga

SEQ ID NO: 8018547 - DNA, 20 bp, Homo sapiens
tgtgatgggttctttcctgg

SEQ ID NO: 8018548 - DNA, 22 bp, Homo sapiens
tgtgatctgccttggatctgca

SEQ ID NO: 8018549 - DNA, 22 bp, Homo sapiens
tgtgatcaggtgatcatgtgag

SEQ ID NO: 8018550 - DNA, 22 bp, Homo sapiens
tgtgatgcatagtttttattgc

SEQ ID NO: 8018551 - DNA, 22 bp, Homo sapiens
tgtgatcttagacaactcactg

SEQ ID NO: 8018552 - DNA, 22 bp, Homo sapiens
tgtgatgctggagtgcgaatat

SEQ ID NO: 8018553 - DNA, 22 bp, Homo sapiens
tgtgagtgacagttcccttggt

SEQ ID NO: 8018554 - DNA, 22 bp, Homo sapiens
tgtgagttattttcaggagttt

SEQ ID NO: 8018555 - DNA, 22 bp, Homo sapiens
tgtgagttcttagaaagtcagt

SEQ ID NO: 8018556 - DNA, 22 bp, Homo sapiens
tgtgagttcttattgctcatct

SEQ ID NO: 8018557 - DNA, 22 bp, Homo sapiens
tgtgagttgctcttttgctact

SEQ ID NO: 8018558 - DNA, 22 bp, Homo sapiens
tgtgagtgaatgggtctgaagt

SEQ ID NO: 8018559 - DNA, 22 bp, Homo sapiens
tgtgagtactgctatttatata

SEQ ID NO: 8018560 - DNA, 22 bp, Homo sapiens
tgtgagtactgctatttatata

SEQ ID NO: 8018561 - DNA, 22 bp, Homo sapiens
tgtgagtagctgaagcagaaca

SEQ ID NO: 8018562 - DNA, 22 bp, Homo sapiens
tgtgagcactggctgggaaagt

SEQ ID NO: 8018563 - DNA, 22 bp, Homo sapiens
tgtgagcactggctgggaaagt

SEQ ID NO: 8018564 - DNA, 22 bp, Homo sapiens
tgtgagcactgtgatgctgttc

SEQ ID NO: 8018565 - DNA, 22 bp, Homo sapiens
tgtgagcactgtgatgctgttc

SEQ ID NO: 8018566 - DNA, 22 bp, Homo sapiens
tgtgagcagagacatgaaaagc

SEQ ID NO: 8018567 - DNA, 22 bp, Homo sapiens
tgtgagtaataaagtcattttt

SEQ ID NO: 8018568 - DNA, 20 bp, Homo sapiens
tgtgagagggtggcttgccc

SEQ ID NO: 8018569 - DNA, 22 bp, Homo sapiens
tgtgagagttgagatattttgc

SEQ ID NO: 8018570 - DNA, 22 bp, Homo sapiens
tgtgagagttgagatattttgc

SEQ ID NO: 8018571 - DNA, 19 bp, Homo sapiens
tgtgagaggctagctgccc

SEQ ID NO: 8018572 - DNA, 22 bp, Homo sapiens
tgtgagaggagaaatgcattaa

SEQ ID NO: 8018573 - DNA, 20 bp, Homo sapiens
tgtgagagggtggcttgccc

SEQ ID NO: 8018574 - DNA, 19 bp, Homo sapiens
tgtgagaggctagctgccc

SEQ ID NO: 8018575 - DNA, 22 bp, Homo sapiens
tgtgagaggagaaatgcattaa

SEQ ID NO: 8018576 - DNA, 22 bp, Homo sapiens
tgtgagagctgcttcagccagg

SEQ ID NO: 8018577 - DNA, 22 bp, Homo sapiens
tgtgagcaagattcagagattc

SEQ ID NO: 8018578 - DNA, 22 bp, Homo sapiens
tgtgagcaagattcagagattc

SEQ ID NO: 8018579 - DNA, 22 bp, Homo sapiens
tgtgagattgttttactataat

SEQ ID NO: 8018580 - DNA, 22 bp, Homo sapiens
tgtgagcaagtgactggtgaga

SEQ ID NO: 8018581 - DNA, 22 bp, Homo sapiens
tgtgagcaagtgactggtgaga

SEQ ID NO: 8018582 - DNA, 22 bp, Homo sapiens
tgtgactggcttatttcactta

SEQ ID NO: 8018583 - DNA, 22 bp, Homo sapiens
tgtgactggcttatttcactta

SEQ ID NO: 8018584 - DNA, 22 bp, Homo sapiens
tgtgactggttgggaagaggct

SEQ ID NO: 8018585 - DNA, 22 bp, Homo sapiens
tgtgactggcagaggtgtctgg

SEQ ID NO: 8018586 - DNA, 22 bp, Homo sapiens
tgtgactggagtccagcccact

SEQ ID NO: 8018587 - DNA, 22 bp, Homo sapiens
tgtgactgagctgcagagtgtc

SEQ ID NO: 8018588 - DNA, 22 bp, Homo sapiens
tgtgactgagctgcagagtgtc

SEQ ID NO: 8018589 - DNA, 22 bp, Homo sapiens
tgtgactgaagtgtctagacct

SEQ ID NO: 8018590 - DNA, 22 bp, Homo sapiens
tgtgactaggcctgagctcttg

SEQ ID NO: 8018591 - DNA, 22 bp, Homo sapiens
tgtgactaggcctgagctcttg

SEQ ID NO: 8018592 - DNA, 22 bp, Homo sapiens
tgtgactaggcctgagctcttg

SEQ ID NO: 8018593 - DNA, 22 bp, Homo sapiens
tgtgactaggcctgagctcttg

SEQ ID NO: 8018594 - DNA, 22 bp, Homo sapiens
tgtgacccccgtcacggctgct

SEQ ID NO: 8018595 - DNA, 22 bp, Homo sapiens
tgtgacccagactcatcttctt

SEQ ID NO: 8018596 - DNA, 19 bp, Homo sapiens
tgtgaccccagacaagctg

SEQ ID NO: 8018597 - DNA, 17 bp, Homo sapiens
tgtgacattgggacatt

SEQ ID NO: 8018598 - DNA, 21 bp, Homo sapiens
tgtgaccaggtctactttccc

SEQ ID NO: 8018599 - DNA, 22 bp, Homo sapiens
tgtgaccctctccgatgggcag

SEQ ID NO: 8018600 - DNA, 23 bp, Homo sapiens
tgtgacccctaggagtggggacc

SEQ ID NO: 8018601 - DNA, 22 bp, Homo sapiens
tgtgacccccgtcacggctgct

SEQ ID NO: 8018602 - DNA, 22 bp, Homo sapiens
tgtgacctcatcttaactggaa

SEQ ID NO: 8018603 - DNA, 20 bp, Homo sapiens
tgtgacgacatcaaaatatt

SEQ ID NO: 8018604 - DNA, 22 bp, Homo sapiens
tgtgacgttcctgctggcgacc

SEQ ID NO: 8018605 - DNA, 22 bp, Homo sapiens
tgtgacgttgttctggattccc

SEQ ID NO: 8018606 - DNA, 22 bp, Homo sapiens
tgtgaccttatttagaaatacc

SEQ ID NO: 8018607 - DNA, 21 bp, Homo sapiens
tgtgacctccctctatctttc

SEQ ID NO: 8018608 - DNA, 22 bp, Homo sapiens
tgtgagaagggcatgcagggag

SEQ ID NO: 8018609 - DNA, 22 bp, Homo sapiens
tgtgagaattcctgatcacagg

SEQ ID NO: 8018610 - DNA, 22 bp, Homo sapiens
tgtgagaagggtgaggctttta

SEQ ID NO: 8018611 - DNA, 22 bp, Homo sapiens
tgtgagaagggtgaggctttta

SEQ ID NO: 8018612 - DNA, 22 bp, Homo sapiens
tgtgagacaggatttagagcag

SEQ ID NO: 8018613 - DNA, 22 bp, Homo sapiens
tgtgagacaattgcatcagggc

SEQ ID NO: 8018614 - DNA, 22 bp, Homo sapiens
tgtgagacacactgctgcttca

SEQ ID NO: 8018615 - DNA, 22 bp, Homo sapiens
tgtgagagagtgcatttgcata

SEQ ID NO: 8018616 - DNA, 22 bp, Homo sapiens
tgtgagagaagtgtgtgctccc

SEQ ID NO: 8018617 - DNA, 22 bp, Homo sapiens
tgtgagagaagtgtgtgctccc

SEQ ID NO: 8018618 - DNA, 22 bp, Homo sapiens
tgtgagagagtgcatttgcata

SEQ ID NO: 8018619 - DNA, 22 bp, Homo sapiens
tgtgagagcagaagacacatag

SEQ ID NO: 8018620 - DNA, 22 bp, Homo sapiens
tgtgagagctccatcctcatga

SEQ ID NO: 8018621 - DNA, 22 bp, Homo sapiens
tgtgacttttcacaggctggtc

SEQ ID NO: 8018622 - DNA, 22 bp, Homo sapiens
tgtgacttctttttgagttcaa

SEQ ID NO: 8018623 - DNA, 22 bp, Homo sapiens
tgtgacttgatgtttgcaccag

SEQ ID NO: 8018624 - DNA, 22 bp, Homo sapiens
tgtgacttataacatagaattt

SEQ ID NO: 8018625 - DNA, 22 bp, Homo sapiens
tgtgacttctttttgagttcaa

SEQ ID NO: 8018626 - DNA, 22 bp, Homo sapiens
tgtgacttagggcaggtgagat

SEQ ID NO: 8018627 - DNA, 22 bp, Homo sapiens
tgtgactggttgtcccgctttc

SEQ ID NO: 8018628 - DNA, 22 bp, Homo sapiens
tgtgactggttgtcccgctttc

SEQ ID NO: 8018629 - DNA, 22 bp, Homo sapiens
tgtgactggttgtcccgctttc

SEQ ID NO: 8018630 - DNA, 22 bp, Homo sapiens
tgtgactgtggacttttgtggg

SEQ ID NO: 8018631 - DNA, 22 bp, Homo sapiens
tgtgacttaatccttgggtggg

SEQ ID NO: 8018632 - DNA, 22 bp, Homo sapiens
tgtgactgtggtgagatttaag

SEQ ID NO: 8018633 - DNA, 22 bp, Homo sapiens
tgtgctgacaagatcagaaggt

SEQ ID NO: 8018634 - DNA, 22 bp, Homo sapiens
tgtgctcttgtctgtgactaac

SEQ ID NO: 8018635 - DNA, 22 bp, Homo sapiens
tgtgctcttgggcaatagctgc

SEQ ID NO: 8018636 - DNA, 22 bp, Homo sapiens
tgtgctcttctgttacttgtag

SEQ ID NO: 8018637 - DNA, 22 bp, Homo sapiens
tgtgctctggagttgccttcac

SEQ ID NO: 8018638 - DNA, 22 bp, Homo sapiens
tgtgctcttctgttacttgtag

SEQ ID NO: 8018639 - DNA, 22 bp, Homo sapiens
tgtgctgagtgatcccattcct

SEQ ID NO: 8018640 - DNA, 22 bp, Homo sapiens
tgtgctgagcaaatccatctgt

SEQ ID NO: 8018641 - DNA, 22 bp, Homo sapiens
tgtgctgctctcagtgacagcc

SEQ ID NO: 8018642 - DNA, 22 bp, Homo sapiens
tgtgctgctctcagtgacagcc

SEQ ID NO: 8018643 - DNA, 22 bp, Homo sapiens
tgtgctgctctcagtgacagcc

SEQ ID NO: 8018644 - DNA, 22 bp, Homo sapiens
tgtgctgagcaaatccatctgt

SEQ ID NO: 8018645 - DNA, 22 bp, Homo sapiens
tgtgctgacaattcacagagaa

SEQ ID NO: 8018646 - DNA, 22 bp, Homo sapiens
tgtgctgacaattcacagagaa

SEQ ID NO: 8018647 - DNA, 22 bp, Homo sapiens
tgtgctgacaattcacagagaa

SEQ ID NO: 8018648 - DNA, 22 bp, Homo sapiens
tgtgctgacaagatcagaaggt

SEQ ID NO: 8018649 - DNA, 22 bp, Homo sapiens
tgtggaaagtggtctaagcaca

SEQ ID NO: 8018650 - DNA, 22 bp, Homo sapiens
tgtggaaagtggtctaagcaca

SEQ ID NO: 8018651 - DNA, 22 bp, Homo sapiens
tgtgctgagtgatcccattcct

SEQ ID NO: 8018652 - DNA, 22 bp, Homo sapiens
tgtgctggagatcagcttattt

SEQ ID NO: 8018653 - DNA, 22 bp, Homo sapiens
tgtgctggagatcagcttattt

SEQ ID NO: 8018654 - DNA, 22 bp, Homo sapiens
tgtgctgctgtgaataagacct

SEQ ID NO: 8018655 - DNA, 23 bp, Homo sapiens
tgtgctggcatctcaggctttgg

SEQ ID NO: 8018656 - DNA, 23 bp, Homo sapiens
tgtgctggcatctcaggctttgg

SEQ ID NO: 8018657 - DNA, 22 bp, Homo sapiens
tgtgctccaacaatttatattc

SEQ ID NO: 8018658 - DNA, 22 bp, Homo sapiens
tgtgctctgactttctcctggt

SEQ ID NO: 8018659 - DNA, 22 bp, Homo sapiens
tgtgctctgactttctcctggt

SEQ ID NO: 8018660 - DNA, 22 bp, Homo sapiens
tgtgctctgcaatcagttcttt

SEQ ID NO: 8018661 - DNA, 22 bp, Homo sapiens
tgtgctctggagttgccttcac

SEQ ID NO: 8018662 - DNA, 22 bp, Homo sapiens
tgtgctccatcatccataatct

SEQ ID NO: 8018663 - DNA, 23 bp, Homo sapiens
tgtgctcccaaatgtaggtctat

SEQ ID NO: 8018664 - DNA, 22 bp, Homo sapiens
tgtgctcatggtccagcatggt

SEQ ID NO: 8018665 - DNA, 22 bp, Homo sapiens
tgtgctcagtctttggctggga

SEQ ID NO: 8018666 - DNA, 22 bp, Homo sapiens
tgtgctcatggtccagcatggt

SEQ ID NO: 8018667 - DNA, 22 bp, Homo sapiens
tgtgctcatggtccagcatggt

SEQ ID NO: 8018668 - DNA, 22 bp, Homo sapiens
tgtgctcagtctttggctggga

SEQ ID NO: 8018669 - DNA, 22 bp, Homo sapiens
tgtgctcatggtccagcatggt

SEQ ID NO: 8018670 - DNA, 22 bp, Homo sapiens
tgtgctaagtattttcttattt

SEQ ID NO: 8018671 - DNA, 22 bp, Homo sapiens
tgtgcgtgatggaccgggcctg

SEQ ID NO: 8018672 - DNA, 22 bp, Homo sapiens
tgtgcgtgggcacacacatatg

SEQ ID NO: 8018673 - DNA, 22 bp, Homo sapiens
tgtgcgtggttcccggggccat

SEQ ID NO: 8018674 - DNA, 22 bp, Homo sapiens
tgtgcgtggattcctgtactca

SEQ ID NO: 8018675 - DNA, 22 bp, Homo sapiens
tgtgcgtggttcccggggccat

SEQ ID NO: 8018676 - DNA, 22 bp, Homo sapiens
tgtgctattacacatttattta

SEQ ID NO: 8018677 - DNA, 22 bp, Homo sapiens
tgtgctcactctaaattaagat

SEQ ID NO: 8018678 - DNA, 22 bp, Homo sapiens
tgtgctatttttgcatatgtgt

SEQ ID NO: 8018679 - DNA, 22 bp, Homo sapiens
tgtgcctgtgacagcgacctgg

SEQ ID NO: 8018680 - DNA, 22 bp, Homo sapiens
tgtgcctgtgacagcgacctgg

SEQ ID NO: 8018681 - DNA, 22 bp, Homo sapiens
tgtgcctgttggtgtagacata

SEQ ID NO: 8018682 - DNA, 19 bp, Homo sapiens
tgtgccttatactcacatt

SEQ ID NO: 8018683 - DNA, 22 bp, Homo sapiens
tgtgccttccctctgctgattt

SEQ ID NO: 8018684 - DNA, 22 bp, Homo sapiens
tgtgcctgtcaccctcagagag

SEQ ID NO: 8018685 - DNA, 22 bp, Homo sapiens
tgtgcctgtcaccctcagagag

SEQ ID NO: 8018686 - DNA, 22 bp, Homo sapiens
tgtgcctgtcccgcattctggt

SEQ ID NO: 8018687 - DNA, 22 bp, Homo sapiens
tgtgcctgtcccgcattctggt

SEQ ID NO: 8018688 - DNA, 22 bp, Homo sapiens
tgtgcctgtcccgcattctggt

SEQ ID NO: 8018689 - DNA, 22 bp, Homo sapiens
tgtgcctggtccctgagtcgag

SEQ ID NO: 8018690 - DNA, 22 bp, Homo sapiens
tgtgcctgtcaccctcagagag

SEQ ID NO: 8018691 - DNA, 22 bp, Homo sapiens
tgtgcctgtcaccctcagagag

SEQ ID NO: 8018692 - DNA, 22 bp, Homo sapiens
tgtgcgctccggcgagtcagcg

SEQ ID NO: 8018693 - DNA, 22 bp, Homo sapiens
tgtgcgcgtgcagcggagtgtt

SEQ ID NO: 8018694 - DNA, 22 bp, Homo sapiens
tgtgccttatgaattctttctg

SEQ ID NO: 8018695 - DNA, 22 bp, Homo sapiens
tgtgccttctcagtcctgctca

SEQ ID NO: 8018696 - DNA, 22 bp, Homo sapiens
tgtgcgtgggcacacacatatg

SEQ ID NO: 8018697 - DNA, 22 bp, Homo sapiens
tgtgcgtggattcctgtactca

SEQ ID NO: 8018698 - DNA, 22 bp, Homo sapiens
tgtgcgtgatggaccgggcctg

SEQ ID NO: 8018699 - DNA, 23 bp, Homo sapiens
tgtgcgtgatgctttgttgaagg

SEQ ID NO: 8018700 - DNA, 17 bp, Homo sapiens
tgtgcgcttgtgtgagg

SEQ ID NO: 8018701 - DNA, 22 bp, Homo sapiens
tgtgcggggaagggctcactca

SEQ ID NO: 8018702 - DNA, 22 bp, Homo sapiens
tgtgcctgatggtcacgtggcc

SEQ ID NO: 8018703 - DNA, 22 bp, Homo sapiens
tgtgcctgctagatggttgtcg

SEQ ID NO: 8018704 - DNA, 22 bp, Homo sapiens
tgtgcctgatggtcacgtggcc

SEQ ID NO: 8018705 - DNA, 22 bp, Homo sapiens
tgtgcctggagtccctgaggag

SEQ ID NO: 8018706 - DNA, 22 bp, Homo sapiens
tgtgcctggagtccctgaggag

SEQ ID NO: 8018707 - DNA, 22 bp, Homo sapiens
tgtgcctggagtccctgaggag

SEQ ID NO: 8018708 - DNA, 22 bp, Homo sapiens
tgtgcctggagtccctgaggag

SEQ ID NO: 8018709 - DNA, 22 bp, Homo sapiens
tgtgcctgagtctcggcccacc

SEQ ID NO: 8018710 - DNA, 22 bp, Homo sapiens
tgtgcctgagtctcggcccacc

SEQ ID NO: 8018711 - DNA, 22 bp, Homo sapiens
tgtgcctgagttggctgagtac

SEQ ID NO: 8018712 - DNA, 22 bp, Homo sapiens
tgtgcctgagttggctgagtac

SEQ ID NO: 8018713 - DNA, 22 bp, Homo sapiens
tgtgcctgagttggctgagtac

SEQ ID NO: 8018714 - DNA, 22 bp, Homo sapiens
tgtgcctgagttggctgagtac

SEQ ID NO: 8018715 - DNA, 22 bp, Homo sapiens
tgtgcctggcattctgggcttc

SEQ ID NO: 8018716 - DNA, 22 bp, Homo sapiens
tgtgcctggcattctgggcttc

SEQ ID NO: 8018717 - DNA, 22 bp, Homo sapiens
tgtgcctggcattctgggcttc

SEQ ID NO: 8018718 - DNA, 22 bp, Homo sapiens
tgtgcctggcccagtggtgtca

SEQ ID NO: 8018719 - DNA, 22 bp, Homo sapiens
tgtgcctggcccagtggtgtca

SEQ ID NO: 8018720 - DNA, 22 bp, Homo sapiens
tgtgcctggtccctgagtcgag

SEQ ID NO: 8018721 - DNA, 22 bp, Homo sapiens
tgtgcctggatctctgtgacaa

SEQ ID NO: 8018722 - DNA, 22 bp, Homo sapiens
tgtgcctggatctctgtgacaa

SEQ ID NO: 8018723 - DNA, 22 bp, Homo sapiens
tgtgcctggatctctgtgacaa

SEQ ID NO: 8018724 - DNA, 22 bp, Homo sapiens
tgtgcctggatctctgtgacaa

SEQ ID NO: 8018725 - DNA, 22 bp, Homo sapiens
tgtgcctggagtccctgaggag

SEQ ID NO: 8018726 - DNA, 22 bp, Homo sapiens
tgtgcctggatctctgtgacaa

SEQ ID NO: 8018727 - DNA, 22 bp, Homo sapiens
tgtgcctggatctctgtgacaa

SEQ ID NO: 8018728 - DNA, 22 bp, Homo sapiens
tgtgcctggcattctgggcttc

SEQ ID NO: 8018729 - DNA, 22 bp, Homo sapiens
tgtgcctggcattctgggcttc

SEQ ID NO: 8018730 - DNA, 22 bp, Homo sapiens
tgtgcctggcattctgggcttc

SEQ ID NO: 8018731 - DNA, 22 bp, Homo sapiens
tgtgcatagactttcaccacct

SEQ ID NO: 8018732 - DNA, 22 bp, Homo sapiens
tgtgcatagactttcaccacct

SEQ ID NO: 8018733 - DNA, 22 bp, Homo sapiens
tgtgcagttttaagtggtctaa

SEQ ID NO: 8018734 - DNA, 22 bp, Homo sapiens
tgtgcagtttctatgttgtcca

SEQ ID NO: 8018735 - DNA, 22 bp, Homo sapiens
tgtgcagtttctatgttgtcca

SEQ ID NO: 8018736 - DNA, 22 bp, Homo sapiens
tgtgcagttttaagtggtctaa

SEQ ID NO: 8018737 - DNA, 22 bp, Homo sapiens
tgtgcatcttgcctggatgttt

SEQ ID NO: 8018738 - DNA, 22 bp, Homo sapiens
tgtgcatcaagagaaaacagtg

SEQ ID NO: 8018739 - DNA, 22 bp, Homo sapiens
tgtgcatcttgcctggatgttt

SEQ ID NO: 8018740 - DNA, 20 bp, Homo sapiens
tgtgcatgaactgagggatt

SEQ ID NO: 8018741 - DNA, 22 bp, Homo sapiens
tgtgcatgtaccttattctgga

SEQ ID NO: 8018742 - DNA, 16 bp, Homo sapiens
tgtgcatgttctgtgt

SEQ ID NO: 8018743 - DNA, 22 bp, Homo sapiens
tgtgcatgtctgggcctgtaag

SEQ ID NO: 8018744 - DNA, 22 bp, Homo sapiens
tgtgccaagactatattgtgct

SEQ ID NO: 8018745 - DNA, 22 bp, Homo sapiens
tgtgccaagatcaaacttttct

SEQ ID NO: 8018746 - DNA, 22 bp, Homo sapiens
tgtgccaatctgctgactgtct

SEQ ID NO: 8018747 - DNA, 23 bp, Homo sapiens
tgtgccaagcttagaaagaacct

SEQ ID NO: 8018748 - DNA, 22 bp, Homo sapiens
tgtgcatgttgcttgaactcct

SEQ ID NO: 8018749 - DNA, 20 bp, Homo sapiens
tgtgccaaaactgtttgctt

SEQ ID NO: 8018750 - DNA, 20 bp, Homo sapiens
tgtgccaaaactgtttgctt

SEQ ID NO: 8018751 - DNA, 22 bp, Homo sapiens
tgtgcctctgaagggcggacgg

SEQ ID NO: 8018752 - DNA, 19 bp, Homo sapiens
tgtgcctcctcgtctccta

SEQ ID NO: 8018753 - DNA, 22 bp, Homo sapiens
tgtgcctctgcctcatgccctg

SEQ ID NO: 8018754 - DNA, 18 bp, Homo sapiens
tgtgcctctgcaggacgt

SEQ ID NO: 8018755 - DNA, 18 bp, Homo sapiens
tgtgcctctgcaggacgt

SEQ ID NO: 8018756 - DNA, 22 bp, Homo sapiens
tgtgcctgactaggtgaatcaa

SEQ ID NO: 8018757 - DNA, 22 bp, Homo sapiens
tgtgcctcatgtatctggatga

SEQ ID NO: 8018758 - DNA, 22 bp, Homo sapiens
tgtgcctcaccctgctcttggc

SEQ ID NO: 8018759 - DNA, 22 bp, Homo sapiens
tgtgcctagttctgtatttaca

SEQ ID NO: 8018760 - DNA, 22 bp, Homo sapiens
tgtgcctactgatagagccaag

SEQ ID NO: 8018761 - DNA, 22 bp, Homo sapiens
tgtgcctactgatagagccaag

SEQ ID NO: 8018762 - DNA, 22 bp, Homo sapiens
tgtgcctactgatagagccaag

SEQ ID NO: 8018763 - DNA, 22 bp, Homo sapiens
tgtgcccttttgacagtgagag

SEQ ID NO: 8018764 - DNA, 22 bp, Homo sapiens
tgtgccctgttaaatgcacagt

SEQ ID NO: 8018765 - DNA, 19 bp, Homo sapiens
tgtgcccttggcaatggga

SEQ ID NO: 8018766 - DNA, 19 bp, Homo sapiens
tgtgcccttggcaatggga

SEQ ID NO: 8018767 - DNA, 22 bp, Homo sapiens
tgtgccctttcctgctcctcca

SEQ ID NO: 8018768 - DNA, 22 bp, Homo sapiens
tgtgccctttcctgctcctcca

SEQ ID NO: 8018769 - DNA, 20 bp, Homo sapiens
tgtgccctgcagacttcttt

SEQ ID NO: 8018770 - DNA, 22 bp, Homo sapiens
tgtgccctcctgccaggggctg

SEQ ID NO: 8018771 - DNA, 22 bp, Homo sapiens
tgtgccctcctgccaggggctg

SEQ ID NO: 8018772 - DNA, 22 bp, Homo sapiens
tgtgccctctctgagccataaa

SEQ ID NO: 8018773 - DNA, 22 bp, Homo sapiens
tgtgccaatttgttcaggtaag

SEQ ID NO: 8018774 - DNA, 22 bp, Homo sapiens
tgtgccacatacacagtacatt

SEQ ID NO: 8018775 - DNA, 22 bp, Homo sapiens
tgtgccagaaaatatgctgagg

SEQ ID NO: 8018776 - DNA, 22 bp, Homo sapiens
tgtgccacatacacagtacatt

SEQ ID NO: 8018777 - DNA, 19 bp, Homo sapiens
tgtgccccctccagcctgc

SEQ ID NO: 8018778 - DNA, 22 bp, Homo sapiens
tgtgcccgaagtattttaaaat

SEQ ID NO: 8018779 - DNA, 18 bp, Homo sapiens
tgtgcccggaaaatacct

SEQ ID NO: 8018780 - DNA, 22 bp, Homo sapiens
tgtgccctcagaagagtacatc

SEQ ID NO: 8018781 - DNA, 22 bp, Homo sapiens
tgtgcccgtttataaatatttg

SEQ ID NO: 8018782 - DNA, 18 bp, Homo sapiens
tgtgcaatattaaccacc

SEQ ID NO: 8018783 - DNA, 22 bp, Homo sapiens
tgtgcaatcatattttaaaatg

SEQ ID NO: 8018784 - DNA, 22 bp, Homo sapiens
tgtgcaatcatattttaaaatg

SEQ ID NO: 8018785 - DNA, 22 bp, Homo sapiens
tgtgcaatttcaatttacacag

SEQ ID NO: 8018786 - DNA, 22 bp, Homo sapiens
tgtgcaatttagagacttggga

SEQ ID NO: 8018787 - DNA, 22 bp, Homo sapiens
tgtgcaataatcatagtgattt

SEQ ID NO: 8018788 - DNA, 22 bp, Homo sapiens
tgtgcaactccttccacagaca

SEQ ID NO: 8018789 - DNA, 22 bp, Homo sapiens
tgtgcaatagaaagtggcatgg

SEQ ID NO: 8018790 - DNA, 22 bp, Homo sapiens
tgtgcaaattaagtagattttc

SEQ ID NO: 8018791 - DNA, 22 bp, Homo sapiens
tgtgcaaattaagtagattttc

SEQ ID NO: 8018792 - DNA, 22 bp, Homo sapiens
tgtgcaaagtgtacaaattaat

SEQ ID NO: 8018793 - DNA, 22 bp, Homo sapiens
tgtgcacattctaggactagta

SEQ ID NO: 8018794 - DNA, 23 bp, Homo sapiens
tgtgcacatctgacgggtgaagg

SEQ ID NO: 8018795 - DNA, 22 bp, Homo sapiens
tgtgcacattctaggactagta

SEQ ID NO: 8018796 - DNA, 22 bp, Homo sapiens
tgtgcacattctaggactagta

SEQ ID NO: 8018797 - DNA, 22 bp, Homo sapiens
tgtgcacattctaggactagta

SEQ ID NO: 8018798 - DNA, 22 bp, Homo sapiens
tgtgcacattctaggactagta

SEQ ID NO: 8018799 - DNA, 22 bp, Homo sapiens
tgtgcagagaagccactggggg

SEQ ID NO: 8018800 - DNA, 22 bp, Homo sapiens
tgtgcacataaaacagtactag

SEQ ID NO: 8018801 - DNA, 22 bp, Homo sapiens
tgtgcacataaaacagtactag

SEQ ID NO: 8018802 - DNA, 22 bp, Homo sapiens
tgtgcagagcccacaggcagct

SEQ ID NO: 8018803 - DNA, 22 bp, Homo sapiens
tgtgcagagcccacaggcagct

SEQ ID NO: 8018804 - DNA, 22 bp, Homo sapiens
tgtgcagagcggggaagagcac

SEQ ID NO: 8018805 - DNA, 22 bp, Homo sapiens
tgtgcagagtaaggcagctgtt

SEQ ID NO: 8018806 - DNA, 22 bp, Homo sapiens
tgtgcagctctagagccaagcc

SEQ ID NO: 8018807 - DNA, 22 bp, Homo sapiens
tgtgcagctctagagccaagcc

SEQ ID NO: 8018808 - DNA, 20 bp, Homo sapiens
tgtgcaggagagtgaggctg

SEQ ID NO: 8018809 - DNA, 22 bp, Homo sapiens
tgtgcagatagtgatttcagaa

SEQ ID NO: 8018810 - DNA, 20 bp, Homo sapiens
tgtgcaggagagtgaggctg

SEQ ID NO: 8018811 - DNA, 22 bp, Homo sapiens
tgtgcagcagcagctgtggaga

SEQ ID NO: 8018812 - DNA, 22 bp, Homo sapiens
tgtgcagcagcagctgtggaga

SEQ ID NO: 8018813 - DNA, 22 bp, Homo sapiens
tgtgcagctagtcctggacttg

SEQ ID NO: 8018814 - DNA, 22 bp, Homo sapiens
tgtgcagggaagggcatgctat

SEQ ID NO: 8018815 - DNA, 20 bp, Homo sapiens
tgtgcaggagagtgaggctg

SEQ ID NO: 8018816 - DNA, 20 bp, Homo sapiens
tgtgcaggagagtgaggctg

SEQ ID NO: 8018817 - DNA, 20 bp, Homo sapiens
tgtgcaggagagtgaggctg

SEQ ID NO: 8018818 - DNA, 22 bp, Homo sapiens
tgtgcagggaagggcatgctat

SEQ ID NO: 8018819 - DNA, 22 bp, Homo sapiens
tgtgcaggtgcaggaagggggc

SEQ ID NO: 8018820 - DNA, 22 bp, Homo sapiens
tgtgcagggaagggcatgctat

SEQ ID NO: 8018821 - DNA, 22 bp, Homo sapiens
tgtgcagggaagggcatgctat

SEQ ID NO: 8018822 - DNA, 22 bp, Homo sapiens
tgtgcagggaagggcatgctat

SEQ ID NO: 8018823 - DNA, 22 bp, Homo sapiens
tgtgcagtttctatgttgtcca

SEQ ID NO: 8018824 - DNA, 22 bp, Homo sapiens
tgtgcagttcaaacccgtgttg

SEQ ID NO: 8018825 - DNA, 22 bp, Homo sapiens
tgtgcagtttctatgttgtcca

SEQ ID NO: 8018826 - DNA, 22 bp, Homo sapiens
tgtgcagtggcctcggcacgca

SEQ ID NO: 8018827 - DNA, 22 bp, Homo sapiens
tgtgcagtgtgaccagggctgc

SEQ ID NO: 8018828 - DNA, 22 bp, Homo sapiens
tgtgcagttcaaacccgtgttg

SEQ ID NO: 8018829 - DNA, 21 bp, Homo sapiens
tgtgcagtccaatgtgctagc

SEQ ID NO: 8018830 - DNA, 21 bp, Homo sapiens
tgtgcagtccaatgtgctagc

SEQ ID NO: 8018831 - DNA, 21 bp, Homo sapiens
tgtgcagtccaatgtgctagc

SEQ ID NO: 8018832 - DNA, 22 bp, Homo sapiens
tgtgcaggtgcaggaagggggc

SEQ ID NO: 8018833 - DNA, 22 bp, Homo sapiens
tgtgcaggtgcaggaagggggc

SEQ ID NO: 8018834 - DNA, 22 bp, Homo sapiens
tgtgcaggtgcaggaagggggc

SEQ ID NO: 8018835 - DNA, 22 bp, Homo sapiens
tgttaaatgtattatgtgttct

SEQ ID NO: 8018836 - DNA, 22 bp, Homo sapiens
tgttaaatgtattatgtgttct

SEQ ID NO: 8018837 - DNA, 22 bp, Homo sapiens
tgttaaatgctcagctcgggga

SEQ ID NO: 8018838 - DNA, 22 bp, Homo sapiens
tgttaaatgttcctttactgga

SEQ ID NO: 8018839 - DNA, 22 bp, Homo sapiens
tgttaaatgttcctttactgga

SEQ ID NO: 8018840 - DNA, 22 bp, Homo sapiens
tgttaaagttatatgccgtcct

SEQ ID NO: 8018841 - DNA, 18 bp, Homo sapiens
tgttaaatgaagatttgc

SEQ ID NO: 8018842 - DNA, 18 bp, Homo sapiens
tgttaaatgaagatttgc

SEQ ID NO: 8018843 - DNA, 22 bp, Homo sapiens
tgttaaatgagattggaatttg

SEQ ID NO: 8018844 - DNA, 22 bp, Homo sapiens
tgttaaatgttttgctagtgtc

SEQ ID NO: 8018845 - DNA, 22 bp, Homo sapiens
tgttaaattgattcacctttct

SEQ ID NO: 8018846 - DNA, 22 bp, Homo sapiens
tgttaaattgattcacctttct

SEQ ID NO: 8018847 - DNA, 22 bp, Homo sapiens
tgttaaattgattcacctttct

SEQ ID NO: 8018848 - DNA, 22 bp, Homo sapiens
tgttaaatgttcctttactgga

SEQ ID NO: 8018849 - DNA, 22 bp, Homo sapiens
tgttaaatgttttgctagtgtc

SEQ ID NO: 8018850 - DNA, 22 bp, Homo sapiens
tgttaaatgttcctttactgga

SEQ ID NO: 8018851 - DNA, 22 bp, Homo sapiens
tgttaacacaattctggagaga

SEQ ID NO: 8018852 - DNA, 22 bp, Homo sapiens
tgttaacaataagtccaggcat

SEQ ID NO: 8018853 - DNA, 22 bp, Homo sapiens
tgttaacttgcaagctgaagaa

SEQ ID NO: 8018854 - DNA, 22 bp, Homo sapiens
tgttaagaagaggcagtactta

SEQ ID NO: 8018855 - DNA, 22 bp, Homo sapiens
tgttaacttcctcctcctctgc

SEQ ID NO: 8018856 - DNA, 22 bp, Homo sapiens
tgttaaggagacacatgaaaaa

SEQ ID NO: 8018857 - DNA, 22 bp, Homo sapiens
tgttacatttctctttcttgga

SEQ ID NO: 8018858 - DNA, 22 bp, Homo sapiens
tgttacatttctctttcttgga

SEQ ID NO: 8018859 - DNA, 22 bp, Homo sapiens
tgttactattagtttgagcata

SEQ ID NO: 8018860 - DNA, 22 bp, Homo sapiens
tgttaccaaggctgcttctagt

SEQ ID NO: 8018861 - DNA, 22 bp, Homo sapiens
tgttacagtgactaatgtttta

SEQ ID NO: 8018862 - DNA, 22 bp, Homo sapiens
tgttacagtggctttttaaaca

SEQ ID NO: 8018863 - DNA, 22 bp, Homo sapiens
tgttacatcgttggctaggaga

SEQ ID NO: 8018864 - DNA, 22 bp, Homo sapiens
tgttacattggagttgtttaga

SEQ ID NO: 8018865 - DNA, 22 bp, Homo sapiens
tgttactccttccctactcatg

SEQ ID NO: 8018866 - DNA, 22 bp, Homo sapiens
tgttactctggggttgtggtga

SEQ ID NO: 8018867 - DNA, 22 bp, Homo sapiens
tgttactgatttgatatacagt

SEQ ID NO: 8018868 - DNA, 22 bp, Homo sapiens
tgttactgtggttaccagaagc

SEQ ID NO: 8018869 - DNA, 22 bp, Homo sapiens
tgttactgggcatctagtgggt

SEQ ID NO: 8018870 - DNA, 22 bp, Homo sapiens
tgttactgatttgatatacagt

SEQ ID NO: 8018871 - DNA, 22 bp, Homo sapiens
tgttagaaattattagtaatat

SEQ ID NO: 8018872 - DNA, 22 bp, Homo sapiens
tgttagaaattattagtaatat

SEQ ID NO: 8018873 - DNA, 22 bp, Homo sapiens
tgttagaaattattagtaatat

SEQ ID NO: 8018874 - DNA, 22 bp, Homo sapiens
tgttagaaattattagtaatat

SEQ ID NO: 8018875 - DNA, 22 bp, Homo sapiens
tgttacttcttggtaaaggaga

SEQ ID NO: 8018876 - DNA, 22 bp, Homo sapiens
tgttactgtctcatcattggat

SEQ ID NO: 8018877 - DNA, 22 bp, Homo sapiens
tgttacttatctcacgtgatgc

SEQ ID NO: 8018878 - DNA, 22 bp, Homo sapiens
tgttacttcttatttcttacat

SEQ ID NO: 8018879 - DNA, 22 bp, Homo sapiens
tgttcttaacttttgtgtatat

SEQ ID NO: 8018880 - DNA, 22 bp, Homo sapiens
tgttcttaacttttgtgtatat

SEQ ID NO: 8018881 - DNA, 17 bp, Homo sapiens
tgttctgttggaaagca

SEQ ID NO: 8018882 - DNA, 22 bp, Homo sapiens
tgttagtcagacacacctaaat

SEQ ID NO: 8018883 - DNA, 21 bp, Homo sapiens
tgttagtctgacaaagaccta

SEQ ID NO: 8018884 - DNA, 22 bp, Homo sapiens
tgttcttacggaacttatcttt

SEQ ID NO: 8018885 - DNA, 22 bp, Homo sapiens
tgttcttacggaacttatcttt

SEQ ID NO: 8018886 - DNA, 22 bp, Homo sapiens
tgttcttacggaacttatcttt

SEQ ID NO: 8018887 - DNA, 22 bp, Homo sapiens
tgttcttatgatgaagcactga

SEQ ID NO: 8018888 - DNA, 22 bp, Homo sapiens
tgttcttatgatgaagcactga

SEQ ID NO: 8018889 - DNA, 22 bp, Homo sapiens
tgttcttatgaattcaagacac

SEQ ID NO: 8018890 - DNA, 22 bp, Homo sapiens
tgttcttatgaattcaagacac

SEQ ID NO: 8018891 - DNA, 22 bp, Homo sapiens
tgttcttaggtatttgacagtc

SEQ ID NO: 8018892 - DNA, 22 bp, Homo sapiens
tgttcttagcatgcaaaatatg

SEQ ID NO: 8018893 - DNA, 22 bp, Homo sapiens
tgttcttagcaggagcatctat

SEQ ID NO: 8018894 - DNA, 22 bp, Homo sapiens
tgttcttagcaggagcatctat

SEQ ID NO: 8018895 - DNA, 22 bp, Homo sapiens
tgttcttagcaggagcatctat

SEQ ID NO: 8018896 - DNA, 22 bp, Homo sapiens
tgttcttagcatgcaaaatatg

SEQ ID NO: 8018897 - DNA, 22 bp, Homo sapiens
tgttcttagcaggagcatctat

SEQ ID NO: 8018898 - DNA, 22 bp, Homo sapiens
tgttcttagcatgcaaaatatg

SEQ ID NO: 8018899 - DNA, 22 bp, Homo sapiens
tgttaggactccccagaagctg

SEQ ID NO: 8018900 - DNA, 22 bp, Homo sapiens
tgttaggcccatctctgaaggt

SEQ ID NO: 8018901 - DNA, 22 bp, Homo sapiens
tgttaggactccccagaagctg

SEQ ID NO: 8018902 - DNA, 22 bp, Homo sapiens
tgttagcagagcagctgacaga

SEQ ID NO: 8018903 - DNA, 22 bp, Homo sapiens
tgttagcatagctcagaaggag

SEQ ID NO: 8018904 - DNA, 22 bp, Homo sapiens
tgttagcagagcagctgacaga

SEQ ID NO: 8018905 - DNA, 22 bp, Homo sapiens
tgttagcaaggataattatgat

SEQ ID NO: 8018906 - DNA, 22 bp, Homo sapiens
tgttagcaaggataattatgat

SEQ ID NO: 8018907 - DNA, 22 bp, Homo sapiens
tgttagatacacgaaaaaactt

SEQ ID NO: 8018908 - DNA, 22 bp, Homo sapiens
tgttagatacacgaaaaaactt

SEQ ID NO: 8018909 - DNA, 22 bp, Homo sapiens
tgttagattcctgatgaattta

SEQ ID NO: 8018910 - DNA, 22 bp, Homo sapiens
tgttagaatattgtaatattcg

SEQ ID NO: 8018911 - DNA, 22 bp, Homo sapiens
tgttagaatattgtaatattcg

SEQ ID NO: 8018912 - DNA, 22 bp, Homo sapiens
tgttagaagttaatcactaatt

SEQ ID NO: 8018913 - DNA, 22 bp, Homo sapiens
tgttagaagttaatcactaatt

SEQ ID NO: 8018914 - DNA, 22 bp, Homo sapiens
tgttctttgccagtgatttaat

SEQ ID NO: 8018915 - DNA, 22 bp, Homo sapiens
tgttctttgccagtgatttaat

SEQ ID NO: 8018916 - DNA, 22 bp, Homo sapiens
tgttctttgccagtgatttaat

SEQ ID NO: 8018917 - DNA, 22 bp, Homo sapiens
tgttctttgccagtgatttaat

SEQ ID NO: 8018918 - DNA, 22 bp, Homo sapiens
tgttctttggcttcacagctct

SEQ ID NO: 8018919 - DNA, 22 bp, Homo sapiens
tgttctttgctgttgatgtaga

SEQ ID NO: 8018920 - DNA, 22 bp, Homo sapiens
tgttctttggcttcacagctct

SEQ ID NO: 8018921 - DNA, 22 bp, Homo sapiens
tgttctttgctgttgatgtaga

SEQ ID NO: 8018922 - DNA, 22 bp, Homo sapiens
tgttctttggcttcacagctct

SEQ ID NO: 8018923 - DNA, 22 bp, Homo sapiens
tgttctttggcttcacagctct

SEQ ID NO: 8018924 - DNA, 22 bp, Homo sapiens
tgttctttggcttcacagctct

SEQ ID NO: 8018925 - DNA, 22 bp, Homo sapiens
tgttcttgagcctttagaccta

SEQ ID NO: 8018926 - DNA, 22 bp, Homo sapiens
tgttcttgagcctttagaccta

SEQ ID NO: 8018927 - DNA, 22 bp, Homo sapiens
tgttcttctagattgcctttta

SEQ ID NO: 8018928 - DNA, 22 bp, Homo sapiens
tgttcttatggctatttctccc

SEQ ID NO: 8018929 - DNA, 22 bp, Homo sapiens
tgttcttatggctatttctccc

SEQ ID NO: 8018930 - DNA, 22 bp, Homo sapiens
tgttcttgagcctttagaccta

SEQ ID NO: 8018931 - DNA, 22 bp, Homo sapiens
tgttcttgagcctttagaccta

SEQ ID NO: 8018932 - DNA, 22 bp, Homo sapiens
tgttctttagcagaccatgttg

SEQ ID NO: 8018933 - DNA, 22 bp, Homo sapiens
tgttctttagcagaccatgttg

SEQ ID NO: 8018934 - DNA, 22 bp, Homo sapiens
tgttctttcagttagacacagt

SEQ ID NO: 8018935 - DNA, 22 bp, Homo sapiens
tgttcttgggaatcttacagtt

SEQ ID NO: 8018936 - DNA, 22 bp, Homo sapiens
tgttctttcagttagacacagt

SEQ ID NO: 8018937 - DNA, 22 bp, Homo sapiens
tgttctttcagttagacacagt

SEQ ID NO: 8018938 - DNA, 22 bp, Homo sapiens
tgttctttcagttagacacagt

SEQ ID NO: 8018939 - DNA, 22 bp, Homo sapiens
tgtttattcatggctaatgaaa

SEQ ID NO: 8018940 - DNA, 22 bp, Homo sapiens
tgtttattcatggctaatgaaa

SEQ ID NO: 8018941 - DNA, 22 bp, Homo sapiens
tgtttattcatggctaatgaaa

SEQ ID NO: 8018942 - DNA, 22 bp, Homo sapiens
tgtttattcatggctaatgaaa

SEQ ID NO: 8018943 - DNA, 22 bp, Homo sapiens
tgtttattcatggctaatgaaa

SEQ ID NO: 8018944 - DNA, 22 bp, Homo sapiens
tgtttattcatggctaatgaaa

SEQ ID NO: 8018945 - DNA, 22 bp, Homo sapiens
tgtttattcatggctaatgaaa

SEQ ID NO: 8018946 - DNA, 22 bp, Homo sapiens
tgtttattacagttcttggaat

SEQ ID NO: 8018947 - DNA, 22 bp, Homo sapiens
tgtttattacagttcttggaat

SEQ ID NO: 8018948 - DNA, 22 bp, Homo sapiens
tgtttattacagttcttggaat

SEQ ID NO: 8018949 - DNA, 22 bp, Homo sapiens
tgtttattacagttcttggaat

SEQ ID NO: 8018950 - DNA, 22 bp, Homo sapiens
tgtttatgtgtgtgcatatata

SEQ ID NO: 8018951 - DNA, 22 bp, Homo sapiens
tgtttatgtgtgtgcatatata

SEQ ID NO: 8018952 - DNA, 21 bp, Homo sapiens
tgtttatggaaaagagacaaa

SEQ ID NO: 8018953 - DNA, 22 bp, Homo sapiens
tgtttatgtgtgtgcatatata

SEQ ID NO: 8018954 - DNA, 22 bp, Homo sapiens
tgtttattacagttcttggaat

SEQ ID NO: 8018955 - DNA, 22 bp, Homo sapiens
tgtttattacagttcttggaat

SEQ ID NO: 8018956 - DNA, 22 bp, Homo sapiens
tgtttatagggtctgtcacttg

SEQ ID NO: 8018957 - DNA, 22 bp, Homo sapiens
tgtttatgcatcgttaatacca

SEQ ID NO: 8018958 - DNA, 22 bp, Homo sapiens
tgtttatcttaaatccactggg

SEQ ID NO: 8018959 - DNA, 22 bp, Homo sapiens
tgtttatcagggtaaagtgtag

SEQ ID NO: 8018960 - DNA, 22 bp, Homo sapiens
tgtttatagggtctgtcacttg

SEQ ID NO: 8018961 - DNA, 22 bp, Homo sapiens
tgtttatagatggccacaatga

SEQ ID NO: 8018962 - DNA, 22 bp, Homo sapiens
tgtttatagggtctgtcacttg

SEQ ID NO: 8018963 - DNA, 22 bp, Homo sapiens
tgtttatgcatcgttaatacca

SEQ ID NO: 8018964 - DNA, 22 bp, Homo sapiens
tgtttatgcatcgttaatacca

SEQ ID NO: 8018965 - DNA, 22 bp, Homo sapiens
tgtttatgcatcgttaatacca

SEQ ID NO: 8018966 - DNA, 21 bp, Homo sapiens
tgtttatggaaaagagacaaa

SEQ ID NO: 8018967 - DNA, 21 bp, Homo sapiens
tgtttatggaaaagagacaaa

SEQ ID NO: 8018968 - DNA, 22 bp, Homo sapiens
tgtttactgcattctatttgct

SEQ ID NO: 8018969 - DNA, 22 bp, Homo sapiens
tgtttactcctgatatattttt

SEQ ID NO: 8018970 - DNA, 22 bp, Homo sapiens
tgtttatagatggccacaatga

SEQ ID NO: 8018971 - DNA, 22 bp, Homo sapiens
tgtttatagggtctgtcacttg

SEQ ID NO: 8018972 - DNA, 22 bp, Homo sapiens
tgtttatagatggccacaatga

SEQ ID NO: 8018973 - DNA, 22 bp, Homo sapiens
tgtttatagatggccacaatga

SEQ ID NO: 8018974 - DNA, 22 bp, Homo sapiens
tgtttatagggtctgtcacttg

SEQ ID NO: 8018975 - DNA, 22 bp, Homo sapiens
tgtttattgagtgcctactata

SEQ ID NO: 8018976 - DNA, 22 bp, Homo sapiens
tgtttattgagtgcctactata

SEQ ID NO: 8018977 - DNA, 22 bp, Homo sapiens
tgtttattgagtgcctactata

SEQ ID NO: 8018978 - DNA, 22 bp, Homo sapiens
tgtttattgagtgcctactata

SEQ ID NO: 8018979 - DNA, 22 bp, Homo sapiens
tgtttattgagtgcctactata

SEQ ID NO: 8018980 - DNA, 22 bp, Homo sapiens
tgtttattgcagtgctgggctg

SEQ ID NO: 8018981 - DNA, 18 bp, Homo sapiens
tgtttattctcctgacag

SEQ ID NO: 8018982 - DNA, 18 bp, Homo sapiens
tgtttattctcctgacag

SEQ ID NO: 8018983 - DNA, 18 bp, Homo sapiens
tgtttattctcctgacag

SEQ ID NO: 8018984 - DNA, 18 bp, Homo sapiens
tgtttattctcctgacag

SEQ ID NO: 8018985 - DNA, 18 bp, Homo sapiens
tgtttattctcctgacag

SEQ ID NO: 8018986 - DNA, 22 bp, Homo sapiens
tgtttattgctgcaattgtgcc

SEQ ID NO: 8018987 - DNA, 22 bp, Homo sapiens
tgtttattttcaggatggattg

SEQ ID NO: 8018988 - DNA, 22 bp, Homo sapiens
tgtttattgctgcaattgtgcc

SEQ ID NO: 8018989 - DNA, 22 bp, Homo sapiens
tgtttattttcaggatggattg

SEQ ID NO: 8018990 - DNA, 22 bp, Homo sapiens
tgtttattttcaggatggattg

SEQ ID NO: 8018991 - DNA, 22 bp, Homo sapiens
tgtttattttcaggatggattg

SEQ ID NO: 8018992 - DNA, 22 bp, Homo sapiens
tgtttattttcaggatggattg

SEQ ID NO: 8018993 - DNA, 22 bp, Homo sapiens
tgtttattgctgcaattgtgcc

SEQ ID NO: 8018994 - DNA, 22 bp, Homo sapiens
tgtttattgctgcaattgtgcc

SEQ ID NO: 8018995 - DNA, 22 bp, Homo sapiens
tgtttattgctgcaattgtgcc

SEQ ID NO: 8018996 - DNA, 22 bp, Homo sapiens
tgtttattgctgcaattgtgcc

SEQ ID NO: 8018997 - DNA, 22 bp, Homo sapiens
tgtttattgcagtgctgggctg

SEQ ID NO: 8018998 - DNA, 22 bp, Homo sapiens
tgtttattgcagtgctgggctg

SEQ ID NO: 8018999 - DNA, 22 bp, Homo sapiens
tgtttattgcagtgctgggctg

SEQ ID NO: 8019000 - DNA, 22 bp, Homo sapiens
tgtttattgcagtgctgggctg

SEQ ID NO: 8019001 - DNA, 22 bp, Homo sapiens
tgtttattgcagtgctgggctg

SEQ ID NO: 8019002 - DNA, 22 bp, Homo sapiens
tgttgtaatcattttatgaaaa

SEQ ID NO: 8019003 - DNA, 22 bp, Homo sapiens
tgttgtaatcattttatgaaaa

SEQ ID NO: 8019004 - DNA, 22 bp, Homo sapiens
tgttgtaaaatttgagatgtca

SEQ ID NO: 8019005 - DNA, 22 bp, Homo sapiens
tgttggtgaagtctctctgctg

SEQ ID NO: 8019006 - DNA, 22 bp, Homo sapiens
tgttgggaagctctgccagggg

SEQ ID NO: 8019007 - DNA, 22 bp, Homo sapiens
tgttggcttgaccttcgctgtt

SEQ ID NO: 8019008 - DNA, 22 bp, Homo sapiens
tgttgattagtgtttagactta

SEQ ID NO: 8019009 - DNA, 22 bp, Homo sapiens
tgttgggaagctctgccagggg

SEQ ID NO: 8019010 - DNA, 22 bp, Homo sapiens
tgttggggtcaggagctagcct

SEQ ID NO: 8019011 - DNA, 22 bp, Homo sapiens
tgttggtaaatagcttagcaat

SEQ ID NO: 8019012 - DNA, 22 bp, Homo sapiens
tgttggggtcaggagctagcct

SEQ ID NO: 8019013 - DNA, 22 bp, Homo sapiens
tgttgagactgagggagtcagc

SEQ ID NO: 8019014 - DNA, 22 bp, Homo sapiens
tgttgagacacagacacaagcc

SEQ ID NO: 8019015 - DNA, 22 bp, Homo sapiens
tgttgacttgaaccaaagtgtt

SEQ ID NO: 8019016 - DNA, 22 bp, Homo sapiens
tgttgactggtaactttaaaca

SEQ ID NO: 8019017 - DNA, 22 bp, Homo sapiens
tgttgactggtaactttaaaca

SEQ ID NO: 8019018 - DNA, 22 bp, Homo sapiens
tgttgactcaacactgtgggca

SEQ ID NO: 8019019 - DNA, 22 bp, Homo sapiens
tgttgagtatatacctacaagt

SEQ ID NO: 8019020 - DNA, 22 bp, Homo sapiens
tgttgagtatatacctacaagt

SEQ ID NO: 8019021 - DNA, 22 bp, Homo sapiens
tgttgagtatatacctacaagt

SEQ ID NO: 8019022 - DNA, 22 bp, Homo sapiens
tgttgattagtgtttagactta

SEQ ID NO: 8019023 - DNA, 20 bp, Homo sapiens
tgttgaattcatggtgactt

SEQ ID NO: 8019024 - DNA, 22 bp, Homo sapiens
tgttcttttctctaaactgata

SEQ ID NO: 8019025 - DNA, 22 bp, Homo sapiens
tgttcttttctctaaactgata

SEQ ID NO: 8019026 - DNA, 22 bp, Homo sapiens
tgtttaagctgatgaggtatcg

SEQ ID NO: 8019027 - DNA, 21 bp, Homo sapiens
tgtttactccctgcaagcacg

SEQ ID NO: 8019028 - DNA, 21 bp, Homo sapiens
tgtttactccctgcaagcacg

SEQ ID NO: 8019029 - DNA, 21 bp, Homo sapiens
tgtttactccctgcaagcacg

SEQ ID NO: 8019030 - DNA, 22 bp, Homo sapiens
tgtttactcctgatatattttt

SEQ ID NO: 8019031 - DNA, 20 bp, Homo sapiens
tgtttactctagagggtaga

SEQ ID NO: 8019032 - DNA, 22 bp, Homo sapiens
tgtttactgcattctatttgct

SEQ ID NO: 8019033 - DNA, 22 bp, Homo sapiens
tgtttaaatagaacatactgca

SEQ ID NO: 8019034 - DNA, 22 bp, Homo sapiens
tgtttaaatagaacatactgca

SEQ ID NO: 8019035 - DNA, 15 bp, Homo sapiens
tgtttaagccacatt

SEQ ID NO: 8019036 - DNA, 22 bp, Homo sapiens
tgtttaagcctgtggtgtcatc

SEQ ID NO: 8019037 - DNA, 22 bp, Homo sapiens
tgtttaagatccgtcagtcact

SEQ ID NO: 8019038 - DNA, 22 bp, Homo sapiens
tgtttaactagttttcacactt

SEQ ID NO: 8019039 - DNA, 22 bp, Homo sapiens
tgtttaaatagaacatactgca

SEQ ID NO: 8019040 - DNA, 22 bp, Homo sapiens
tgtttaaatagaacatactgca

SEQ ID NO: 8019041 - DNA, 22 bp, Homo sapiens
tgtttaaatagaacatactgca

SEQ ID NO: 8019042 - DNA, 22 bp, Homo sapiens
tgtttaaatagaacatactgca

SEQ ID NO: 8019043 - DNA, 22 bp, Homo sapiens
tgtttaaatagaacatactgca

SEQ ID NO: 8019044 - DNA, 22 bp, Homo sapiens
tgttgttttctcatggagaata

SEQ ID NO: 8019045 - DNA, 22 bp, Homo sapiens
tgttgtagcttgacagcagcca

SEQ ID NO: 8019046 - DNA, 22 bp, Homo sapiens
tgttgtcaggtacaaaatatat

SEQ ID NO: 8019047 - DNA, 22 bp, Homo sapiens
tgttgtcagtattaatttcaca

SEQ ID NO: 8019048 - DNA, 22 bp, Homo sapiens
tgttgtcagtattaatttcaca

SEQ ID NO: 8019049 - DNA, 19 bp, Homo sapiens
tgttgtctaccatgaagtc

SEQ ID NO: 8019050 - DNA, 23 bp, Homo sapiens
tgttgtgactggatgctttgtcc

SEQ ID NO: 8019051 - DNA, 21 bp, Homo sapiens
tgttgttttatggctatgaat

SEQ ID NO: 8019052 - DNA, 22 bp, Homo sapiens
tgttgttagacccactgcccga

SEQ ID NO: 8019053 - DNA, 22 bp, Homo sapiens
tgtttgcttacttgtatgctgc

SEQ ID NO: 8019054 - DNA, 22 bp, Homo sapiens
tgtttggtcatgaatgtcagtg

SEQ ID NO: 8019055 - DNA, 22 bp, Homo sapiens
tgtttggagaaaggctgtgaac

SEQ ID NO: 8019056 - DNA, 22 bp, Homo sapiens
tgtttgtcatcattgtgagaga

SEQ ID NO: 8019057 - DNA, 22 bp, Homo sapiens
tgtttgtcatcattgtgagaga

SEQ ID NO: 8019058 - DNA, 20 bp, Homo sapiens
tgtttgtgccagctttgtca

SEQ ID NO: 8019059 - DNA, 22 bp, Homo sapiens
tgtttgtagagacagctgatgc

SEQ ID NO: 8019060 - DNA, 22 bp, Homo sapiens
tgtttgtactcaaagccatgag

SEQ ID NO: 8019061 - DNA, 22 bp, Homo sapiens
tgtttgttccctctctttcctg

SEQ ID NO: 8019062 - DNA, 20 bp, Homo sapiens
tgtttgtgtggggccttggc

SEQ ID NO: 8019063 - DNA, 22 bp, Homo sapiens
tgtttgtgctgcctggtgggca

SEQ ID NO: 8019064 - DNA, 20 bp, Homo sapiens
tgtttgtgccagctttgtca

SEQ ID NO: 8019065 - DNA, 22 bp, Homo sapiens
tgtttgtggaatattctttaag

SEQ ID NO: 8019066 - DNA, 22 bp, Homo sapiens
tgtttgctctgactatcttgcg

SEQ ID NO: 8019067 - DNA, 22 bp, Homo sapiens
tgtttgctatatcctacttcat

SEQ ID NO: 8019068 - DNA, 22 bp, Homo sapiens
tgtttgctctgactatcttgcg

SEQ ID NO: 8019069 - DNA, 22 bp, Homo sapiens
tgtttgctagggttggtattta

SEQ ID NO: 8019070 - DNA, 22 bp, Homo sapiens
tgtttcaaagaaagaaaatata

SEQ ID NO: 8019071 - DNA, 22 bp, Homo sapiens
tgtttcaaagaaagaaaatata

SEQ ID NO: 8019072 - DNA, 22 bp, Homo sapiens
tgtttcaaaggttatacagtca

SEQ ID NO: 8019073 - DNA, 22 bp, Homo sapiens
tgtttcaaaggttatacagtca

SEQ ID NO: 8019074 - DNA, 22 bp, Homo sapiens
tgtttcaaattacttgaggatt

SEQ ID NO: 8019075 - DNA, 22 bp, Homo sapiens
tgtttcaactgttaagatatgc

SEQ ID NO: 8019076 - DNA, 22 bp, Homo sapiens
tgtttcaactgttaagatatgc

SEQ ID NO: 8019077 - DNA, 18 bp, Homo sapiens
tgtttatttttctcttac

SEQ ID NO: 8019078 - DNA, 18 bp, Homo sapiens
tgtttatttttctcttac

SEQ ID NO: 8019079 - DNA, 18 bp, Homo sapiens
tgtttatttttctcttac

SEQ ID NO: 8019080 - DNA, 18 bp, Homo sapiens
tgtttatttttctcttac

SEQ ID NO: 8019081 - DNA, 18 bp, Homo sapiens
tgtttatttttctcttac

SEQ ID NO: 8019082 - DNA, 18 bp, Homo sapiens
tgtttatttttctcttac

SEQ ID NO: 8019083 - DNA, 18 bp, Homo sapiens
tgtttatttttctcttac

SEQ ID NO: 8019084 - DNA, 18 bp, Homo sapiens
tgtttatttttctcttac

SEQ ID NO: 8019085 - DNA, 18 bp, Homo sapiens
tgtttatttttctcttac

SEQ ID NO: 8019086 - DNA, 22 bp, Homo sapiens
tgtttcaaaacagtgataattt

SEQ ID NO: 8019087 - DNA, 22 bp, Homo sapiens
tgtttcaaaacagtgataattt

SEQ ID NO: 8019088 - DNA, 22 bp, Homo sapiens
tgtttcaaaataacaagagggt

SEQ ID NO: 8019089 - DNA, 22 bp, Homo sapiens
tgtttcaaaataacaagagggt

SEQ ID NO: 8019090 - DNA, 22 bp, Homo sapiens
tgtttcaaaacagtgataattt

SEQ ID NO: 8019091 - DNA, 22 bp, Homo sapiens
tgtttcaaaacagtgataattt

SEQ ID NO: 8019092 - DNA, 18 bp, Homo sapiens
tgtttatttttctcttac

SEQ ID NO: 8019093 - DNA, 23 bp, Homo sapiens
tgtttgtttctatgagagatagc

SEQ ID NO: 8019094 - DNA, 22 bp, Homo sapiens
tgttttaaagccattgcctttc

SEQ ID NO: 8019095 - DNA, 23 bp, Homo sapiens
tgtttgtttctatgagagatagc

SEQ ID NO: 8019096 - DNA, 22 bp, Homo sapiens
tgttttaaagccattgcctttc

SEQ ID NO: 8019097 - DNA, 22 bp, Homo sapiens
tgttttaaagccattgcctttc

SEQ ID NO: 8019098 - DNA, 22 bp, Homo sapiens
tgttttaagagcgcactttata

SEQ ID NO: 8019099 - DNA, 22 bp, Homo sapiens
tgttttaagagcgcactttata

SEQ ID NO: 8019100 - DNA, 22 bp, Homo sapiens
tgttttaagagcgcactttata

SEQ ID NO: 8019101 - DNA, 22 bp, Homo sapiens
tgttttaagagcgcactttata

SEQ ID NO: 8019102 - DNA, 22 bp, Homo sapiens
tgttttaagagcgcactttata

SEQ ID NO: 8019103 - DNA, 22 bp, Homo sapiens
tgttttaagagcgcactttata

SEQ ID NO: 8019104 - DNA, 22 bp, Homo sapiens
tgttttaagagcgcactttata

SEQ ID NO: 8019105 - DNA, 22 bp, Homo sapiens
tgttttaagctctagaagggga

SEQ ID NO: 8019106 - DNA, 22 bp, Homo sapiens
tgttttaagctctagaagggga

SEQ ID NO: 8019107 - DNA, 22 bp, Homo sapiens
tgttttaatctcccattgctct

SEQ ID NO: 8019108 - DNA, 22 bp, Homo sapiens
tgttttaatctcccattgctct

SEQ ID NO: 8019109 - DNA, 22 bp, Homo sapiens
tgttttaatctcccattgctct

SEQ ID NO: 8019110 - DNA, 22 bp, Homo sapiens
tgttttaatctcccattgctct

SEQ ID NO: 8019111 - DNA, 22 bp, Homo sapiens
tgttttaatctcccattgctct

SEQ ID NO: 8019112 - DNA, 22 bp, Homo sapiens
tgttttaatctcccattgctct

SEQ ID NO: 8019113 - DNA, 22 bp, Homo sapiens
tgttttagttctgtcttgcatg

SEQ ID NO: 8019114 - DNA, 22 bp, Homo sapiens
tgttttaagggtcaactgtcac

SEQ ID NO: 8019115 - DNA, 22 bp, Homo sapiens
tgttttaagggtcaactgtcac

SEQ ID NO: 8019116 - DNA, 22 bp, Homo sapiens
tgttttaagggtcaactgtcac

SEQ ID NO: 8019117 - DNA, 22 bp, Homo sapiens
tgttttaagggtcaactgtcac

SEQ ID NO: 8019118 - DNA, 22 bp, Homo sapiens
tgttttaagggtcaactgtcac

SEQ ID NO: 8019119 - DNA, 22 bp, Homo sapiens
tgttttaatctcccattgctct

SEQ ID NO: 8019120 - DNA, 22 bp, Homo sapiens
tgttttatgagccatataacct

SEQ ID NO: 8019121 - DNA, 22 bp, Homo sapiens
tgttttatgagccatataacct

SEQ ID NO: 8019122 - DNA, 22 bp, Homo sapiens
tgttttatgagccatataacct

SEQ ID NO: 8019123 - DNA, 22 bp, Homo sapiens
tgttttatcaagatggcatgtc

SEQ ID NO: 8019124 - DNA, 22 bp, Homo sapiens
tgttttatgagccatataacct

SEQ ID NO: 8019125 - DNA, 22 bp, Homo sapiens
tgttttatataagcagagcggt

SEQ ID NO: 8019126 - DNA, 22 bp, Homo sapiens
tgttttatcaagatggcatgtc

SEQ ID NO: 8019127 - DNA, 22 bp, Homo sapiens
tgttttatataagcagagcggt

SEQ ID NO: 8019128 - DNA, 22 bp, Homo sapiens
tgttttatgagccatataacct

SEQ ID NO: 8019129 - DNA, 22 bp, Homo sapiens
tgttttatttctccaagaggga

SEQ ID NO: 8019130 - DNA, 22 bp, Homo sapiens
tgttttatttctccaagaggga

SEQ ID NO: 8019131 - DNA, 22 bp, Homo sapiens
tgttttatgagccatataacct

SEQ ID NO: 8019132 - DNA, 22 bp, Homo sapiens
tgttttatttctccaagaggga

SEQ ID NO: 8019133 - DNA, 22 bp, Homo sapiens
tgtttttccatgtgcagaacaa

SEQ ID NO: 8019134 - DNA, 22 bp, Homo sapiens
tgtttttgtctccttgtctgct

SEQ ID NO: 8019135 - DNA, 22 bp, Homo sapiens
tgtttttccatgtgcagaacaa

SEQ ID NO: 8019136 - DNA, 22 bp, Homo sapiens
ttaaaatgcagattctgattca

SEQ ID NO: 8019137 - DNA, 22 bp, Homo sapiens
ttaaaatgcagattctgattca

SEQ ID NO: 8019138 - DNA, 22 bp, Homo sapiens
ttaaaatgcagattctgattca

SEQ ID NO: 8019139 - DNA, 22 bp, Homo sapiens
ttaaaatgtacaggggaaagtg

SEQ ID NO: 8019140 - DNA, 22 bp, Homo sapiens
ttaaaagagacttcctttgttt

SEQ ID NO: 8019141 - DNA, 22 bp, Homo sapiens
ttaaaagagacttcctttgttt

SEQ ID NO: 8019142 - DNA, 22 bp, Homo sapiens
ttaaaagagacttcctttgttt

SEQ ID NO: 8019143 - DNA, 22 bp, Homo sapiens
ttaaaagagacttcctttgttt

SEQ ID NO: 8019144 - DNA, 22 bp, Homo sapiens
ttaaaagaatcctgttatcctc

SEQ ID NO: 8019145 - DNA, 22 bp, Homo sapiens
ttaaaagaatcctgttatcctc

SEQ ID NO: 8019146 - DNA, 22 bp, Homo sapiens
ttaaaagaatcctgttatcctc

SEQ ID NO: 8019147 - DNA, 22 bp, Homo sapiens
ttaaaacagcgtgaatctggca

SEQ ID NO: 8019148 - DNA, 22 bp, Homo sapiens
ttaaaacagcgtgaatctggca

SEQ ID NO: 8019149 - DNA, 22 bp, Homo sapiens
ttaaaacagcgtgaatctggca

SEQ ID NO: 8019150 - DNA, 22 bp, Homo sapiens
ttaaaaccatcagctgtaagat

SEQ ID NO: 8019151 - DNA, 22 bp, Homo sapiens
ttaaaactgcaaatcctactga

SEQ ID NO: 8019152 - DNA, 20 bp, Homo sapiens
ttaaaaagagtcacaggaga

SEQ ID NO: 8019153 - DNA, 20 bp, Homo sapiens
ttaaaaagagtcacaggaga

SEQ ID NO: 8019154 - DNA, 22 bp, Homo sapiens
ttaaaaaccatcttcctttcct

SEQ ID NO: 8019155 - DNA, 20 bp, Homo sapiens
ttaaaaagagtcacaggaga

SEQ ID NO: 8019156 - DNA, 22 bp, Homo sapiens
ttaaaacagcgtgaatctggca

SEQ ID NO: 8019157 - DNA, 22 bp, Homo sapiens
ttaaaacagcgtgaatctggca

SEQ ID NO: 8019158 - DNA, 22 bp, Homo sapiens
ttaaaacagcgtgaatctggca

SEQ ID NO: 8019159 - DNA, 22 bp, Homo sapiens
ttaaaaatatgtagggcccgat

SEQ ID NO: 8019160 - DNA, 20 bp, Homo sapiens
ttaaaaagagtcacaggaga

SEQ ID NO: 8019161 - DNA, 22 bp, Homo sapiens
ttaaaaaccatcttcctttcct

SEQ ID NO: 8019162 - DNA, 22 bp, Homo sapiens
ttaaaaaccatcttcctttcct

SEQ ID NO: 8019163 - DNA, 22 bp, Homo sapiens
tgtttttttatatacctgaagt

SEQ ID NO: 8019164 - DNA, 22 bp, Homo sapiens
tgtttttttatatacctgaagt

SEQ ID NO: 8019165 - DNA, 22 bp, Homo sapiens
tgttttttccttatgcaatctg

SEQ ID NO: 8019166 - DNA, 22 bp, Homo sapiens
tgtttttttatatacctgaagt

SEQ ID NO: 8019167 - DNA, 22 bp, Homo sapiens
tgtttttttatatacctgaagt

SEQ ID NO: 8019168 - DNA, 22 bp, Homo sapiens
tgtttttttatatacctgaagt

SEQ ID NO: 8019169 - DNA, 22 bp, Homo sapiens
tgtttttttatatacctgaagt

SEQ ID NO: 8019170 - DNA, 22 bp, Homo sapiens
tgttttttccttatgcaatctg

SEQ ID NO: 8019171 - DNA, 22 bp, Homo sapiens
tgttttttccttatgcaatctg

SEQ ID NO: 8019172 - DNA, 17 bp, Homo sapiens
tgttttttccctgttct

SEQ ID NO: 8019173 - DNA, 17 bp, Homo sapiens
tgttttttccctgttct

SEQ ID NO: 8019174 - DNA, 17 bp, Homo sapiens
tgttttttccctgttct

SEQ ID NO: 8019175 - DNA, 17 bp, Homo sapiens
tgttttttccctgttct

SEQ ID NO: 8019176 - DNA, 22 bp, Homo sapiens
tgtttttgttcaatgctaggtc

SEQ ID NO: 8019177 - DNA, 22 bp, Homo sapiens
tgtttttgttcaatgctaggtc

SEQ ID NO: 8019178 - DNA, 22 bp, Homo sapiens
ttaaaatttccccaccatgtat

SEQ ID NO: 8019179 - DNA, 22 bp, Homo sapiens
ttaaaatttccccaccatgtat

SEQ ID NO: 8019180 - DNA, 22 bp, Homo sapiens
ttaaacacactgagatttatgt

SEQ ID NO: 8019181 - DNA, 22 bp, Homo sapiens
ttaaaatttccccaccatgtat

SEQ ID NO: 8019182 - DNA, 22 bp, Homo sapiens
ttaaaatttccccaccatgtat

SEQ ID NO: 8019183 - DNA, 22 bp, Homo sapiens
ttaaaatttccccaccatgtat

SEQ ID NO: 8019184 - DNA, 22 bp, Homo sapiens
ttaaacacctgtctagtgtagc

SEQ ID NO: 8019185 - DNA, 22 bp, Homo sapiens
ttaaaattatggcccatttgga

SEQ ID NO: 8019186 - DNA, 22 bp, Homo sapiens
ttaaaattatggcccatttgga

SEQ ID NO: 8019187 - DNA, 22 bp, Homo sapiens
ttaaaattatggcccatttgga

SEQ ID NO: 8019188 - DNA, 23 bp, Homo sapiens
ttaaaatgtggtctctccctagt

SEQ ID NO: 8019189 - DNA, 22 bp, Homo sapiens
ttaaacaggtttttgaatggcc

SEQ ID NO: 8019190 - DNA, 22 bp, Homo sapiens
ttaaacagagtctgaaatgtaa

SEQ ID NO: 8019191 - DNA, 22 bp, Homo sapiens
ttaaacagtcccagaggctgac

SEQ ID NO: 8019192 - DNA, 22 bp, Homo sapiens
ttaaacagtgaagttgggagga

SEQ ID NO: 8019193 - DNA, 22 bp, Homo sapiens
ttaaacatttatggaggcagca

SEQ ID NO: 8019194 - DNA, 22 bp, Homo sapiens
ttaaacagtgtttcatgtgggg

SEQ ID NO: 8019195 - DNA, 22 bp, Homo sapiens
ttaaacatttatggaggcagca

SEQ ID NO: 8019196 - DNA, 22 bp, Homo sapiens
ttaaacagaggtagcagactgg

SEQ ID NO: 8019197 - DNA, 22 bp, Homo sapiens
ttaaacagacagtaaatgaaac

SEQ ID NO: 8019198 - DNA, 22 bp, Homo sapiens
ttaaacagacagtaaatgaaac

SEQ ID NO: 8019199 - DNA, 22 bp, Homo sapiens
ttaaacagtatatctgagcaag

SEQ ID NO: 8019200 - DNA, 22 bp, Homo sapiens
ttaaacatttatggaggcagca

SEQ ID NO: 8019201 - DNA, 22 bp, Homo sapiens
ttaaacatttttgatgatcgat

SEQ ID NO: 8019202 - DNA, 22 bp, Homo sapiens
ttaaacatttttgatgatcgat

SEQ ID NO: 8019203 - DNA, 22 bp, Homo sapiens
ttaaaccaccagaagccattat

SEQ ID NO: 8019204 - DNA, 22 bp, Homo sapiens
ttaaaccacaaggcaagttttg

SEQ ID NO: 8019205 - DNA, 22 bp, Homo sapiens
ttaaaccacaaggcaagttttg

SEQ ID NO: 8019206 - DNA, 22 bp, Homo sapiens
ttaaaccactgagtggagacta

SEQ ID NO: 8019207 - DNA, 22 bp, Homo sapiens
ttaaaccactttgttgcaagta

SEQ ID NO: 8019208 - DNA, 22 bp, Homo sapiens
ttaaaccactttgttgcaagta

SEQ ID NO: 8019209 - DNA, 22 bp, Homo sapiens
ttaaaccactttgttgcaagta

SEQ ID NO: 8019210 - DNA, 22 bp, Homo sapiens
ttaaaccatagtttaacataag

SEQ ID NO: 8019211 - DNA, 22 bp, Homo sapiens
ttaaaccatagtttaacataag

SEQ ID NO: 8019212 - DNA, 17 bp, Homo sapiens
ttaaaccataaagaagg

SEQ ID NO: 8019213 - DNA, 17 bp, Homo sapiens
ttaaaccataaagaagg

SEQ ID NO: 8019214 - DNA, 17 bp, Homo sapiens
ttaaaccataaagaagg

SEQ ID NO: 8019215 - DNA, 22 bp, Homo sapiens
ttaaaccatagtttaacataag

SEQ ID NO: 8019216 - DNA, 22 bp, Homo sapiens
ttaaaccatagtttaacataag

SEQ ID NO: 8019217 - DNA, 22 bp, Homo sapiens
ttaaaccatagtttaacataag

SEQ ID NO: 8019218 - DNA, 22 bp, Homo sapiens
tgtggggactgagtggaggctt

SEQ ID NO: 8019219 - DNA, 22 bp, Homo sapiens
tgtggggactgagtggaggctt

SEQ ID NO: 8019220 - DNA, 22 bp, Homo sapiens
tgtggggactgagtggaggctt

SEQ ID NO: 8019221 - DNA, 22 bp, Homo sapiens
tgtggggactgagtggaggctt

SEQ ID NO: 8019222 - DNA, 22 bp, Homo sapiens
tgtggggacctggctgccaccc

SEQ ID NO: 8019223 - DNA, 22 bp, Homo sapiens
tgtggggacctggctgccaccc

SEQ ID NO: 8019224 - DNA, 22 bp, Homo sapiens
tgtggggacctggctgccaccc

SEQ ID NO: 8019225 - DNA, 22 bp, Homo sapiens
tgtggggaagagtatgacttgg

SEQ ID NO: 8019226 - DNA, 22 bp, Homo sapiens
tgtgggctttggagtcaggaag

SEQ ID NO: 8019227 - DNA, 22 bp, Homo sapiens
tgtgggctttggagtcaggaag

SEQ ID NO: 8019228 - DNA, 22 bp, Homo sapiens
tgtgtacaagcctgagtacaga

SEQ ID NO: 8019229 - DNA, 22 bp, Homo sapiens
tgtgtacaagcctgagtacaga

SEQ ID NO: 8019230 - DNA, 22 bp, Homo sapiens
tgtgtacaagcctgagtacaga

SEQ ID NO: 8019231 - DNA, 22 bp, Homo sapiens
tgtgtacaaatttagccagcag

SEQ ID NO: 8019232 - DNA, 22 bp, Homo sapiens
tgtggggactgagtggaggctt

SEQ ID NO: 8019233 - DNA, 22 bp, Homo sapiens
tgtgtacacaagtatatataca

SEQ ID NO: 8019234 - DNA, 22 bp, Homo sapiens
tgtgtacacaagtatatataca

SEQ ID NO: 8019235 - DNA, 22 bp, Homo sapiens
tgtgtacacaagtatatataca

SEQ ID NO: 8019236 - DNA, 22 bp, Homo sapiens
tgtgtacacaagtatatataca

SEQ ID NO: 8019237 - DNA, 22 bp, Homo sapiens
tgtgtacacaagtatatataca

SEQ ID NO: 8019238 - DNA, 22 bp, Homo sapiens
tgtgtacacaagtatatataca

SEQ ID NO: 8019239 - DNA, 23 bp, Homo sapiens
tgtgtacacaatagatgaggttt

SEQ ID NO: 8019240 - DNA, 23 bp, Homo sapiens
tgtgtacacaatagatgaggttt

SEQ ID NO: 8019241 - DNA, 22 bp, Homo sapiens
tgtgtacacaatgattgcagag

SEQ ID NO: 8019242 - DNA, 22 bp, Homo sapiens
tgtgtacatatacacaaataca

SEQ ID NO: 8019243 - DNA, 22 bp, Homo sapiens
tgtgtacatatacacaaataca

SEQ ID NO: 8019244 - DNA, 22 bp, Homo sapiens
tgtgtacatatacacaaataca

SEQ ID NO: 8019245 - DNA, 23 bp, Homo sapiens
tgtgtacatacatatgtacacac

SEQ ID NO: 8019246 - DNA, 23 bp, Homo sapiens
tgtgtacatacatatgtacacac

SEQ ID NO: 8019247 - DNA, 22 bp, Homo sapiens
tgtgtacatatctatcctagat

SEQ ID NO: 8019248 - DNA, 22 bp, Homo sapiens
tgtgtacatctcttctcacatt

SEQ ID NO: 8019249 - DNA, 22 bp, Homo sapiens
tgtgtacatctcttctcacatt

SEQ ID NO: 8019250 - DNA, 22 bp, Homo sapiens
tgtgtacattgccttttaaagg

SEQ ID NO: 8019251 - DNA, 22 bp, Homo sapiens
tgtgtactaaacttccatatat

SEQ ID NO: 8019252 - DNA, 22 bp, Homo sapiens
tgtgtactcaattgagccattt

SEQ ID NO: 8019253 - DNA, 22 bp, Homo sapiens
tgtgtacagcatggtccagcag

SEQ ID NO: 8019254 - DNA, 22 bp, Homo sapiens
tgtgtacagcatggtccagcag

SEQ ID NO: 8019255 - DNA, 22 bp, Homo sapiens
tgtgtacaggaactgatcagat

SEQ ID NO: 8019256 - DNA, 22 bp, Homo sapiens
tgtgtacagcatggtccagcag

SEQ ID NO: 8019257 - DNA, 22 bp, Homo sapiens
tgtgtacaggacagaaaggagg

SEQ ID NO: 8019258 - DNA, 22 bp, Homo sapiens
tgtgtacaggccttgctagact

SEQ ID NO: 8019259 - DNA, 22 bp, Homo sapiens
tgtgtacacacagatatataca

SEQ ID NO: 8019260 - DNA, 22 bp, Homo sapiens
tgtgtacacacagatatataca

SEQ ID NO: 8019261 - DNA, 22 bp, Homo sapiens
tgtgtacacagatagtaatggc

SEQ ID NO: 8019262 - DNA, 22 bp, Homo sapiens
tgtgtacacatgacaggcaccc

SEQ ID NO: 8019263 - DNA, 22 bp, Homo sapiens
tgtgtacacatgacaggcaccc

SEQ ID NO: 8019264 - DNA, 22 bp, Homo sapiens
tgtgtacacacagatatataca

SEQ ID NO: 8019265 - DNA, 22 bp, Homo sapiens
tgtgtacacacagatatataca

SEQ ID NO: 8019266 - DNA, 22 bp, Homo sapiens
tgtgtacacacagatatataca

SEQ ID NO: 8019267 - DNA, 22 bp, Homo sapiens
tgtgtacacacagatatataca

SEQ ID NO: 8019268 - DNA, 22 bp, Homo sapiens
tgtgtacacaatgattgcagag

SEQ ID NO: 8019269 - DNA, 22 bp, Homo sapiens
tgtgggaggattcagaattggg

SEQ ID NO: 8019270 - DNA, 22 bp, Homo sapiens
tgtgggaggattcagaattggg

SEQ ID NO: 8019271 - DNA, 22 bp, Homo sapiens
tgtgggaggattcagaattggg

SEQ ID NO: 8019272 - DNA, 22 bp, Homo sapiens
tgtgggaggattcagaattggg

SEQ ID NO: 8019273 - DNA, 22 bp, Homo sapiens
tgtgggaggaattagaatggga

SEQ ID NO: 8019274 - DNA, 22 bp, Homo sapiens
tgtgggaggaattagaatggga

SEQ ID NO: 8019275 - DNA, 22 bp, Homo sapiens
tgtgggaggtctggaaggctcc

SEQ ID NO: 8019276 - DNA, 22 bp, Homo sapiens
tgtgggaggtctggaaggctcc

SEQ ID NO: 8019277 - DNA, 22 bp, Homo sapiens
tgtgggaggtctggaaggctcc

SEQ ID NO: 8019278 - DNA, 22 bp, Homo sapiens
tgtgggaggtctggaaggctcc

SEQ ID NO: 8019279 - DNA, 22 bp, Homo sapiens
tgtgggcaaagggtagctgggt

SEQ ID NO: 8019280 - DNA, 22 bp, Homo sapiens
tgtgggaggtctggaaggctcc

SEQ ID NO: 8019281 - DNA, 22 bp, Homo sapiens
tgtgggaggtctggaaggctcc

SEQ ID NO: 8019282 - DNA, 19 bp, Homo sapiens
tgtgggcaagggatggcag

SEQ ID NO: 8019283 - DNA, 19 bp, Homo sapiens
tgtgggcaagggatggcag

SEQ ID NO: 8019284 - DNA, 22 bp, Homo sapiens
tgtgggattcatttggatcagc

SEQ ID NO: 8019285 - DNA, 22 bp, Homo sapiens
tgtgggcagctggagctgttca

SEQ ID NO: 8019286 - DNA, 22 bp, Homo sapiens
tgtgggcactaatgacatgcag

SEQ ID NO: 8019287 - DNA, 22 bp, Homo sapiens
tgtgggcactaatgacatgcag

SEQ ID NO: 8019288 - DNA, 22 bp, Homo sapiens
tgtgggccctaggcaccttgtc

SEQ ID NO: 8019289 - DNA, 20 bp, Homo sapiens
tgtgggcccttggctggcaa

SEQ ID NO: 8019290 - DNA, 20 bp, Homo sapiens
tgtgggcccttggctggcaa

SEQ ID NO: 8019291 - DNA, 22 bp, Homo sapiens
tgtgggcctcagcaggactcca

SEQ ID NO: 8019292 - DNA, 22 bp, Homo sapiens
tgtgggcctgggaaggtgacac

SEQ ID NO: 8019293 - DNA, 22 bp, Homo sapiens
tgtgggcaggcccgggtctgag

SEQ ID NO: 8019294 - DNA, 22 bp, Homo sapiens
tgtgggccaggaggcctcagtg

SEQ ID NO: 8019295 - DNA, 22 bp, Homo sapiens
tgtgggccaggaggcctcagtg

SEQ ID NO: 8019296 - DNA, 22 bp, Homo sapiens
tgtgggcccagattctgaggct

SEQ ID NO: 8019297 - DNA, 22 bp, Homo sapiens
tgtgggccctaggcaccttgtc

SEQ ID NO: 8019298 - DNA, 22 bp, Homo sapiens
tgtgggccctaggcaccttgtc

SEQ ID NO: 8019299 - DNA, 23 bp, Homo sapiens
tgtgggcgcattgtaagggtagc

SEQ ID NO: 8019300 - DNA, 22 bp, Homo sapiens
tgtgggctccccctcactctgt

SEQ ID NO: 8019301 - DNA, 20 bp, Homo sapiens
tgtgggcctgtgaagcggcg

SEQ ID NO: 8019302 - DNA, 20 bp, Homo sapiens
tgtgggccttcggcgtgctc

SEQ ID NO: 8019303 - DNA, 22 bp, Homo sapiens
tgtgggctctaatggcagcaga

SEQ ID NO: 8019304 - DNA, 22 bp, Homo sapiens
tgtgggctctaatggcagcaga

SEQ ID NO: 8019305 - DNA, 20 bp, Homo sapiens
tgtgggctttgaaatgtgtg

SEQ ID NO: 8019306 - DNA, 20 bp, Homo sapiens
tgtgggctttgaaatgtgtg

SEQ ID NO: 8019307 - DNA, 20 bp, Homo sapiens
tgtgggctttgaaatgtgtg

SEQ ID NO: 8019308 - DNA, 22 bp, Homo sapiens
tgtgggctgtactgagggcagg

SEQ ID NO: 8019309 - DNA, 19 bp, Homo sapiens
tgtgggctgggaaatgtct

SEQ ID NO: 8019310 - DNA, 19 bp, Homo sapiens
tgtgggctgggaaatgtct

SEQ ID NO: 8019311 - DNA, 22 bp, Homo sapiens
tgtggctctcctcctgctgccc

SEQ ID NO: 8019312 - DNA, 22 bp, Homo sapiens
tgtggctctgccccctggtaag

SEQ ID NO: 8019313 - DNA, 22 bp, Homo sapiens
tgtggctctcctcctgctgccc

SEQ ID NO: 8019314 - DNA, 21 bp, Homo sapiens
tgtggctgacaccctttggga

SEQ ID NO: 8019315 - DNA, 21 bp, Homo sapiens
tgtggctgacaccctttggga

SEQ ID NO: 8019316 - DNA, 22 bp, Homo sapiens
tgtggctctgcctggcagtatt

SEQ ID NO: 8019317 - DNA, 22 bp, Homo sapiens
tgtggctctgcctggcagtatt

SEQ ID NO: 8019318 - DNA, 21 bp, Homo sapiens
tgtggctgacaccctttggga

SEQ ID NO: 8019319 - DNA, 22 bp, Homo sapiens
tgtggctctcagatcctccaat

SEQ ID NO: 8019320 - DNA, 22 bp, Homo sapiens
tgtggctctcagatcctccaat

SEQ ID NO: 8019321 - DNA, 22 bp, Homo sapiens
tgtggctctcagatcctccaat

SEQ ID NO: 8019322 - DNA, 22 bp, Homo sapiens
tgtggctcggccagctgctgaa

SEQ ID NO: 8019323 - DNA, 22 bp, Homo sapiens
tgtggctctcatgcactcccag

SEQ ID NO: 8019324 - DNA, 22 bp, Homo sapiens
tgtggctctcatgcactcccag

SEQ ID NO: 8019325 - DNA, 22 bp, Homo sapiens
tgtggctctcatgcactcccag

SEQ ID NO: 8019326 - DNA, 22 bp, Homo sapiens
tgtggctcggccagctgctgaa

SEQ ID NO: 8019327 - DNA, 22 bp, Homo sapiens
tgtggctccactccacattaat

SEQ ID NO: 8019328 - DNA, 22 bp, Homo sapiens
tgtggctccactccacattaat

SEQ ID NO: 8019329 - DNA, 22 bp, Homo sapiens
tgtggctgactcctggtcccca

SEQ ID NO: 8019330 - DNA, 23 bp, Homo sapiens
tgtggctgagaaattgacaactt

SEQ ID NO: 8019331 - DNA, 22 bp, Homo sapiens
tgtggctgactcctggtcccca

SEQ ID NO: 8019332 - DNA, 22 bp, Homo sapiens
tgtggctgactcctggtcccca

SEQ ID NO: 8019333 - DNA, 22 bp, Homo sapiens
tgtggctgactcctggtcccca

SEQ ID NO: 8019334 - DNA, 22 bp, Homo sapiens
tgtggctgatcaaagcgctcag

SEQ ID NO: 8019335 - DNA, 22 bp, Homo sapiens
tgtggctgcaaaggaaggctgc

SEQ ID NO: 8019336 - DNA, 22 bp, Homo sapiens
tgtggctgatcaaagcgctcag

SEQ ID NO: 8019337 - DNA, 22 bp, Homo sapiens
tgtggctgatcaaagcgctcag

SEQ ID NO: 8019338 - DNA, 19 bp, Homo sapiens
tgtggctgagcactcctta

SEQ ID NO: 8019339 - DNA, 19 bp, Homo sapiens
tgtggctgagcactcctta

SEQ ID NO: 8019340 - DNA, 19 bp, Homo sapiens
tgtggctgagcactcctta

SEQ ID NO: 8019341 - DNA, 22 bp, Homo sapiens
tgtggaagggacactggactgg

SEQ ID NO: 8019342 - DNA, 22 bp, Homo sapiens
tgtggaagggacactggactgg

SEQ ID NO: 8019343 - DNA, 22 bp, Homo sapiens
tgtggaagcctgggccccaggg

SEQ ID NO: 8019344 - DNA, 22 bp, Homo sapiens
tgtggaagaacttcttgcttgg

SEQ ID NO: 8019345 - DNA, 22 bp, Homo sapiens
tgtggaagtgccaatgacaaat

SEQ ID NO: 8019346 - DNA, 22 bp, Homo sapiens
tgtggaagaaacaagacacttt

SEQ ID NO: 8019347 - DNA, 22 bp, Homo sapiens
tgtggaagaaacaagacacttt

SEQ ID NO: 8019348 - DNA, 22 bp, Homo sapiens
tgtggaagaacactggccaggc

SEQ ID NO: 8019349 - DNA, 22 bp, Homo sapiens
tgtggaagaacactggccaggc

SEQ ID NO: 8019350 - DNA, 22 bp, Homo sapiens
tgtggaagaacttcttgcttgg

SEQ ID NO: 8019351 - DNA, 22 bp, Homo sapiens
tgtggaagaacttcttgcttgg

SEQ ID NO: 8019352 - DNA, 22 bp, Homo sapiens
tgtggacaccactgggaggtct

SEQ ID NO: 8019353 - DNA, 22 bp, Homo sapiens
tgtggacaccactgggactgga

SEQ ID NO: 8019354 - DNA, 22 bp, Homo sapiens
tgtggacaccactgggactgga

SEQ ID NO: 8019355 - DNA, 22 bp, Homo sapiens
tgtggacaagatgccaattgat

SEQ ID NO: 8019356 - DNA, 22 bp, Homo sapiens
tgtggccttgcagcctggaggt

SEQ ID NO: 8019357 - DNA, 22 bp, Homo sapiens
tgtggccttgcagcctggaggt

SEQ ID NO: 8019358 - DNA, 22 bp, Homo sapiens
tgtggctcaggcggcttctcct

SEQ ID NO: 8019359 - DNA, 22 bp, Homo sapiens
tgtggctcaggcggcttctcct

SEQ ID NO: 8019360 - DNA, 22 bp, Homo sapiens
tgtggcgagaacattggaccat

SEQ ID NO: 8019361 - DNA, 22 bp, Homo sapiens
tgtgggagaaggaagcaagctg

SEQ ID NO: 8019362 - DNA, 22 bp, Homo sapiens
tgtgggagaaggaagcaagctg

SEQ ID NO: 8019363 - DNA, 23 bp, Homo sapiens
tgtgggaatgttggagaggaaac

SEQ ID NO: 8019364 - DNA, 22 bp, Homo sapiens
tgtgggacagggacagcaagag

SEQ ID NO: 8019365 - DNA, 22 bp, Homo sapiens
tgtgggaatgacgaggaagagg

SEQ ID NO: 8019366 - DNA, 22 bp, Homo sapiens
tgtgggaatgacgaggaagagg

SEQ ID NO: 8019367 - DNA, 23 bp, Homo sapiens
tgtgggaatgttggagaggaaac

SEQ ID NO: 8019368 - DNA, 22 bp, Homo sapiens
tgtgggaatgctgatgggatct

SEQ ID NO: 8019369 - DNA, 22 bp, Homo sapiens
tgtgggagaaggaagcaagctg

SEQ ID NO: 8019370 - DNA, 22 bp, Homo sapiens
tgtgggaggaacacagccagaa

SEQ ID NO: 8019371 - DNA, 22 bp, Homo sapiens
tgtgggagaaggaagcaagctg

SEQ ID NO: 8019372 - DNA, 22 bp, Homo sapiens
tgtgggagaaggaagcaagctg

SEQ ID NO: 8019373 - DNA, 22 bp, Homo sapiens
tgtgggagaaggaagcaagctg

SEQ ID NO: 8019374 - DNA, 22 bp, Homo sapiens
tgtgggaggaacacagccagaa

SEQ ID NO: 8019375 - DNA, 22 bp, Homo sapiens
tgtgggaggaacacagccagaa

SEQ ID NO: 8019376 - DNA, 22 bp, Homo sapiens
tgtgggaggaacacagccagaa

SEQ ID NO: 8019377 - DNA, 22 bp, Homo sapiens
tgtgggaggaattagaatggga

SEQ ID NO: 8019378 - DNA, 22 bp, Homo sapiens
tgtgggaggaattagaatggga

SEQ ID NO: 8019379 - DNA, 22 bp, Homo sapiens
tgtgggaggaacacagccagaa

SEQ ID NO: 8019380 - DNA, 22 bp, Homo sapiens
tgtgggaaatgggagtggaaga

SEQ ID NO: 8019381 - DNA, 22 bp, Homo sapiens
tgtggctgccaccctgaagccg

SEQ ID NO: 8019382 - DNA, 22 bp, Homo sapiens
tgtggctgccaccctgaagccg

SEQ ID NO: 8019383 - DNA, 21 bp, Homo sapiens
tgtggctgcctctggccctgg

SEQ ID NO: 8019384 - DNA, 21 bp, Homo sapiens
tgtggctgcctctggccctgg

SEQ ID NO: 8019385 - DNA, 22 bp, Homo sapiens
tgtgggaagatgttgcaggaga

SEQ ID NO: 8019386 - DNA, 22 bp, Homo sapiens
tgtgggaagatgttgcaggaga

SEQ ID NO: 8019387 - DNA, 22 bp, Homo sapiens
tgtgggaagtttggagggaaag

SEQ ID NO: 8019388 - DNA, 22 bp, Homo sapiens
tgtgggaatcagccaggggggc

SEQ ID NO: 8019389 - DNA, 22 bp, Homo sapiens
tgtggctgcagacactggagcc

SEQ ID NO: 8019390 - DNA, 22 bp, Homo sapiens
tgtggctgcagacactggagcc

SEQ ID NO: 8019391 - DNA, 22 bp, Homo sapiens
tgtggctgcagacactggagcc

SEQ ID NO: 8019392 - DNA, 22 bp, Homo sapiens
tgtggctgcaaaggaaggctgc

SEQ ID NO: 8019393 - DNA, 22 bp, Homo sapiens
tgtggctgcaaaggaaggctgc

SEQ ID NO: 8019394 - DNA, 22 bp, Homo sapiens
tgtggctgcaaaggaaggctgc

SEQ ID NO: 8019395 - DNA, 22 bp, Homo sapiens
tgtggctgcaaaggaaggctgc

SEQ ID NO: 8019396 - DNA, 22 bp, Homo sapiens
tgtggctgcaaaggaaggctgc

SEQ ID NO: 8019397 - DNA, 22 bp, Homo sapiens
tgtggctgcaaaggaaggctgc

SEQ ID NO: 8019398 - DNA, 22 bp, Homo sapiens
tgtggctgcaggcgatggagga

SEQ ID NO: 8019399 - DNA, 22 bp, Homo sapiens
tgtggctgcaggcgatggagga

SEQ ID NO: 8019400 - DNA, 22 bp, Homo sapiens
tgtggctgccaccctgaagccg

SEQ ID NO: 8019401 - DNA, 22 bp, Homo sapiens
tgtggctgcaggcgatggagga

SEQ ID NO: 8019402 - DNA, 22 bp, Homo sapiens
tgtggctgcaggcgatggagga

SEQ ID NO: 8019403 - DNA, 22 bp, Homo sapiens
tgtggctgcaggcgatggagga

SEQ ID NO: 8019404 - DNA, 22 bp, Homo sapiens
tgtggctgcaggcgatggagga

SEQ ID NO: 8019405 - DNA, 22 bp, Homo sapiens
tgtggctgcaggcgatggagga

SEQ ID NO: 8019406 - DNA, 19 bp, Homo sapiens
tgtgttaacaggaattggt

SEQ ID NO: 8019407 - DNA, 21 bp, Homo sapiens
tgtgttaaaggctgaggtccc

SEQ ID NO: 8019408 - DNA, 19 bp, Homo sapiens
tgtgtgtttatatatgtat

SEQ ID NO: 8019409 - DNA, 19 bp, Homo sapiens
tgtgtgtttatatatgtat

SEQ ID NO: 8019410 - DNA, 19 bp, Homo sapiens
tgtgtgtttatatatgtat

SEQ ID NO: 8019411 - DNA, 19 bp, Homo sapiens
tgtgtgtttatatatgtat

SEQ ID NO: 8019412 - DNA, 22 bp, Homo sapiens
tgttaaaaatgcagattcctat

SEQ ID NO: 8019413 - DNA, 22 bp, Homo sapiens
tgttaaaaattcagctctagat

SEQ ID NO: 8019414 - DNA, 22 bp, Homo sapiens
tgttaaaaattcagctctagat

SEQ ID NO: 8019415 - DNA, 22 bp, Homo sapiens
tgttaaaaattcagctctagat

SEQ ID NO: 8019416 - DNA, 22 bp, Homo sapiens
tgttaaaaattcagctctagat

SEQ ID NO: 8019417 - DNA, 22 bp, Homo sapiens
tgttaaaaattcagctctagat

SEQ ID NO: 8019418 - DNA, 22 bp, Homo sapiens
tgttaaaaattcagctctagat

SEQ ID NO: 8019419 - DNA, 22 bp, Homo sapiens
tgttaaaaccacaggtgaggac

SEQ ID NO: 8019420 - DNA, 22 bp, Homo sapiens
tgttaaaaccacaggtgaggac

SEQ ID NO: 8019421 - DNA, 22 bp, Homo sapiens
tgttaaaaccacaggtgaggac

SEQ ID NO: 8019422 - DNA, 22 bp, Homo sapiens
tgttaaagtggataagctgaat

SEQ ID NO: 8019423 - DNA, 22 bp, Homo sapiens
tgttaaacagctgtcttcttca

SEQ ID NO: 8019424 - DNA, 22 bp, Homo sapiens
tgttaaacctagtacaggtcct

SEQ ID NO: 8019425 - DNA, 22 bp, Homo sapiens
tgtgtgttattttcagccatta

SEQ ID NO: 8019426 - DNA, 22 bp, Homo sapiens
tgtgtgttcagagatagatata

SEQ ID NO: 8019427 - DNA, 22 bp, Homo sapiens
tgtgtgttctcaattattgatg

SEQ ID NO: 8019428 - DNA, 19 bp, Homo sapiens
tgtgtgtttatatatgtat

SEQ ID NO: 8019429 - DNA, 22 bp, Homo sapiens
tgtgtgttggctggagagggct

SEQ ID NO: 8019430 - DNA, 22 bp, Homo sapiens
tgtgtgttggctggagagggct

SEQ ID NO: 8019431 - DNA, 22 bp, Homo sapiens
tgtgtgtgtttctgctcataca

SEQ ID NO: 8019432 - DNA, 22 bp, Homo sapiens
tgtgtgttaacttatttaatgt

SEQ ID NO: 8019433 - DNA, 22 bp, Homo sapiens
tgtgtgttagtctcaaagccgt

SEQ ID NO: 8019434 - DNA, 22 bp, Homo sapiens
tgtgtgttatcttagttcatct

SEQ ID NO: 8019435 - DNA, 22 bp, Homo sapiens
tgtgtgttatcttagttcatct

SEQ ID NO: 8019436 - DNA, 22 bp, Homo sapiens
tgtgtgtgtttataaatctaaa

SEQ ID NO: 8019437 - DNA, 22 bp, Homo sapiens
tgtgtgtgtttataaatctaaa

SEQ ID NO: 8019438 - DNA, 22 bp, Homo sapiens
tgtgtgtgtttataaatctaaa

SEQ ID NO: 8019439 - DNA, 22 bp, Homo sapiens
tgtgtgtgtttctgctcataca

SEQ ID NO: 8019440 - DNA, 22 bp, Homo sapiens
tgtgtgtgtttctgctcataca

SEQ ID NO: 8019441 - DNA, 22 bp, Homo sapiens
tgtgtgtgtttacagtttctca

SEQ ID NO: 8019442 - DNA, 22 bp, Homo sapiens
tgtgtgtgtttacagtttctca

SEQ ID NO: 8019443 - DNA, 22 bp, Homo sapiens
tgtgtgtgttcctcctcagcta

SEQ ID NO: 8019444 - DNA, 22 bp, Homo sapiens
tgtgtgtgtttacagtttctca

SEQ ID NO: 8019445 - DNA, 22 bp, Homo sapiens
tgtgtgtgtttataaatctaaa

SEQ ID NO: 8019446 - DNA, 21 bp, Homo sapiens
tgtgtgtgcaggcacacacac

SEQ ID NO: 8019447 - DNA, 21 bp, Homo sapiens
tgtgtgtgcaggcacacacac

SEQ ID NO: 8019448 - DNA, 21 bp, Homo sapiens
tgtgtgtgcaggcacacacac

SEQ ID NO: 8019449 - DNA, 22 bp, Homo sapiens
tgtgtgtgcaggagagcaggtg

SEQ ID NO: 8019450 - DNA, 22 bp, Homo sapiens
tgtgtgtgcaggagagcaggtg

SEQ ID NO: 8019451 - DNA, 22 bp, Homo sapiens
tgtgtgtgcaggagagcaggtg

SEQ ID NO: 8019452 - DNA, 22 bp, Homo sapiens
tgtgtgtgcaggagagcaggtg

SEQ ID NO: 8019453 - DNA, 22 bp, Homo sapiens
tgtgtgtgcacgtgcgcgcgag

SEQ ID NO: 8019454 - DNA, 22 bp, Homo sapiens
tgtgtgtgcacgtgcgcgcgag

SEQ ID NO: 8019455 - DNA, 22 bp, Homo sapiens
tgtgtgtggggaggcagcagat

SEQ ID NO: 8019456 - DNA, 22 bp, Homo sapiens
tgtgtgtgggcggaacggcccc

SEQ ID NO: 8019457 - DNA, 22 bp, Homo sapiens
tgtgtgtgggcggaacggcccc

SEQ ID NO: 8019458 - DNA, 22 bp, Homo sapiens
tgtgtgtgggcggaacggcccc

SEQ ID NO: 8019459 - DNA, 22 bp, Homo sapiens
tgtgtgtggggaggcagcagat

SEQ ID NO: 8019460 - DNA, 22 bp, Homo sapiens
tgtgtgtggggaggcagcagat

SEQ ID NO: 8019461 - DNA, 22 bp, Homo sapiens
tgtgtgtggggaggcagcagat

SEQ ID NO: 8019462 - DNA, 22 bp, Homo sapiens
tgtgtgtgtaaaagcatttata

SEQ ID NO: 8019463 - DNA, 22 bp, Homo sapiens
tgtgtgtgtaaaagcatttata

SEQ ID NO: 8019464 - DNA, 20 bp, Homo sapiens
tgtgtgtgtacttctaaata

SEQ ID NO: 8019465 - DNA, 20 bp, Homo sapiens
tgtgtgtgtacttctaaata

SEQ ID NO: 8019466 - DNA, 20 bp, Homo sapiens
tgtgtgtgtacttctaaata

SEQ ID NO: 8019467 - DNA, 22 bp, Homo sapiens
tgtgtgtgtaaaagcatttata

SEQ ID NO: 8019468 - DNA, 20 bp, Homo sapiens
tgtgtgtgtacttctaaata

SEQ ID NO: 8019469 - DNA, 23 bp, Homo sapiens
tgtgtgtgtattctacgcaaggt

SEQ ID NO: 8019470 - DNA, 23 bp, Homo sapiens
tgtgtgtgtattctacgcaaggt

SEQ ID NO: 8019471 - DNA, 22 bp, Homo sapiens
tgtgtgtgtcctcatttgcaga

SEQ ID NO: 8019472 - DNA, 23 bp, Homo sapiens
tgtgtgtgtattctacgcaaggt

SEQ ID NO: 8019473 - DNA, 23 bp, Homo sapiens
tgtgtgtgtattctacgcaaggt

SEQ ID NO: 8019474 - DNA, 22 bp, Homo sapiens
tgtgtgtgtgcgcgcacgcata

SEQ ID NO: 8019475 - DNA, 22 bp, Homo sapiens
tgtgtgtgtgcgcgcacgcata

SEQ ID NO: 8019476 - DNA, 22 bp, Homo sapiens
tgtgtgtgtgcgcgcacgcata

SEQ ID NO: 8019477 - DNA, 22 bp, Homo sapiens
tgtgtgtgtcctcatttgcaga

SEQ ID NO: 8019478 - DNA, 22 bp, Homo sapiens
tgtgtgtgtcctcatttgcaga

SEQ ID NO: 8019479 - DNA, 22 bp, Homo sapiens
tgtgtgtgtcctcatttgcaga

SEQ ID NO: 8019480 - DNA, 22 bp, Homo sapiens
tgtgtgtgttcctcctcagcta

SEQ ID NO: 8019481 - DNA, 22 bp, Homo sapiens
tgtgtgtgttcctcctcagcta

SEQ ID NO: 8019482 - DNA, 22 bp, Homo sapiens
tgtgtgtgtgcgcgcacgcata

SEQ ID NO: 8019483 - DNA, 22 bp, Homo sapiens
tgtgtgtgtgcgcgcacgcata

SEQ ID NO: 8019484 - DNA, 22 bp, Homo sapiens
tgtgtgtgttcctcctcagcta

SEQ ID NO: 8019485 - DNA, 22 bp, Homo sapiens
tgtgtgtgactcatactagaac

SEQ ID NO: 8019486 - DNA, 22 bp, Homo sapiens
tgtgtgtgagtcctggctttcc

SEQ ID NO: 8019487 - DNA, 22 bp, Homo sapiens
tgtgtgtgagtcctggctttcc

SEQ ID NO: 8019488 - DNA, 22 bp, Homo sapiens
tgtgtgtgagtcctggctttcc

SEQ ID NO: 8019489 - DNA, 22 bp, Homo sapiens
tgtgtgtgagtcctggctttcc

SEQ ID NO: 8019490 - DNA, 22 bp, Homo sapiens
tgtgtgtgcacatgcatataca

SEQ ID NO: 8019491 - DNA, 22 bp, Homo sapiens
tgtgtgtgcacatgcatataca

SEQ ID NO: 8019492 - DNA, 22 bp, Homo sapiens
tgtgtgtgagtcctggctttcc

SEQ ID NO: 8019493 - DNA, 22 bp, Homo sapiens
tgtgtgtgagtcctggctttcc

SEQ ID NO: 8019494 - DNA, 22 bp, Homo sapiens
tgtgtgtgcacatgcatataca

SEQ ID NO: 8019495 - DNA, 22 bp, Homo sapiens
tgtgtgtgacaacctagttcag

SEQ ID NO: 8019496 - DNA, 22 bp, Homo sapiens
tgtgtgtgacaacctagttcag

SEQ ID NO: 8019497 - DNA, 22 bp, Homo sapiens
tgtgtgtgactcatactagaac

SEQ ID NO: 8019498 - DNA, 22 bp, Homo sapiens
tgtgtgtgaaccattgagggct

SEQ ID NO: 8019499 - DNA, 22 bp, Homo sapiens
tgtgtgtgaaccattgagggct

SEQ ID NO: 8019500 - DNA, 22 bp, Homo sapiens
tgtgtgtgaaccattgagggct

SEQ ID NO: 8019501 - DNA, 22 bp, Homo sapiens
tgtgtgtctttgcctcctctca

SEQ ID NO: 8019502 - DNA, 22 bp, Homo sapiens
tgtgtggattcatctcaaagag

SEQ ID NO: 8019503 - DNA, 22 bp, Homo sapiens
tgtgtggattcatctcaaagag

SEQ ID NO: 8019504 - DNA, 22 bp, Homo sapiens
tgtgtggattcatctcaaagag

SEQ ID NO: 8019505 - DNA, 22 bp, Homo sapiens
tgtgtgcttatagtctagtagt

SEQ ID NO: 8019506 - DNA, 22 bp, Homo sapiens
tgtgtgcttatagtctagtagt

SEQ ID NO: 8019507 - DNA, 19 bp, Homo sapiens
tgtgtgctgactgccagag

SEQ ID NO: 8019508 - DNA, 22 bp, Homo sapiens
tgtgtgcttaagggctgaacct

SEQ ID NO: 8019509 - DNA, 22 bp, Homo sapiens
tgtgtgcttaagggctgaacct

SEQ ID NO: 8019510 - DNA, 22 bp, Homo sapiens
tgtgtgcttaagggctgaacct

SEQ ID NO: 8019511 - DNA, 19 bp, Homo sapiens
tgtgtgctgactgccagag

SEQ ID NO: 8019512 - DNA, 19 bp, Homo sapiens
tgtgtgctgactgccagag

SEQ ID NO: 8019513 - DNA, 22 bp, Homo sapiens
tgtgtgctctaatgcctagtac

SEQ ID NO: 8019514 - DNA, 22 bp, Homo sapiens
tgtgtgctcgatggccctgcag

SEQ ID NO: 8019515 - DNA, 20 bp, Homo sapiens
tgtgtgctaggactacagtg

SEQ ID NO: 8019516 - DNA, 22 bp, Homo sapiens
tgtgtgctcgatggccctgcag

SEQ ID NO: 8019517 - DNA, 22 bp, Homo sapiens
tgtgtgctctaatgcctagtac

SEQ ID NO: 8019518 - DNA, 22 bp, Homo sapiens
tgtgtgctctaatgcctagtac

SEQ ID NO: 8019519 - DNA, 22 bp, Homo sapiens
tgtgtggcaagctgtatgctag

SEQ ID NO: 8019520 - DNA, 22 bp, Homo sapiens
tgtgtggcgttgcgtggctagg

SEQ ID NO: 8019521 - DNA, 22 bp, Homo sapiens
tgtgtgggagcacgggctgttg

SEQ ID NO: 8019522 - DNA, 22 bp, Homo sapiens
tgtgtgggagcacgggctgttg

SEQ ID NO: 8019523 - DNA, 22 bp, Homo sapiens
tgtgtgggagcacgggctgttg

SEQ ID NO: 8019524 - DNA, 22 bp, Homo sapiens
tgtgtgggagcacgggctgttg

SEQ ID NO: 8019525 - DNA, 21 bp, Homo sapiens
tgtgtgggcatatctgctgca

SEQ ID NO: 8019526 - DNA, 21 bp, Homo sapiens
tgtgtgggcatatctgctgca

SEQ ID NO: 8019527 - DNA, 22 bp, Homo sapiens
tgtgtcaacaacagccttggat

SEQ ID NO: 8019528 - DNA, 22 bp, Homo sapiens
tgtgtcaaagtgtggagtattt

SEQ ID NO: 8019529 - DNA, 22 bp, Homo sapiens
tgtgtcaaattgttttacacag

SEQ ID NO: 8019530 - DNA, 22 bp, Homo sapiens
tgtgtcaacctgtggccgggtg

SEQ ID NO: 8019531 - DNA, 22 bp, Homo sapiens
tgtgtcaagacatttagtcatt

SEQ ID NO: 8019532 - DNA, 22 bp, Homo sapiens
tgtgtcaatttatgtcattcat

SEQ ID NO: 8019533 - DNA, 22 bp, Homo sapiens
tgtgtcaattttcattcctact

SEQ ID NO: 8019534 - DNA, 22 bp, Homo sapiens
tgtgtcaaggcatcagcccagc

SEQ ID NO: 8019535 - DNA, 22 bp, Homo sapiens
tgtgtcaagtggaatttcaggg

SEQ ID NO: 8019536 - DNA, 22 bp, Homo sapiens
tgtgtcaagtggaatttcaggg

SEQ ID NO: 8019537 - DNA, 22 bp, Homo sapiens
tgtgtcagaaatcagtgcctcg

SEQ ID NO: 8019538 - DNA, 22 bp, Homo sapiens
tgtgtcagaaggcaatggggat

SEQ ID NO: 8019539 - DNA, 22 bp, Homo sapiens
tgtgtcagaagtacttttggaa

SEQ ID NO: 8019540 - DNA, 22 bp, Homo sapiens
tgtgtcagaatttttgtggcaa

SEQ ID NO: 8019541 - DNA, 22 bp, Homo sapiens
tgtgtattctgaggtaggtata

SEQ ID NO: 8019542 - DNA, 22 bp, Homo sapiens
tgtgtcaaagtcaggtgtcact

SEQ ID NO: 8019543 - DNA, 22 bp, Homo sapiens
tgtgtatttctggaacagacta

SEQ ID NO: 8019544 - DNA, 22 bp, Homo sapiens
tgtgtattaccattttacagct

SEQ ID NO: 8019545 - DNA, 22 bp, Homo sapiens
tgtgtattaccattttacagct

SEQ ID NO: 8019546 - DNA, 22 bp, Homo sapiens
tgtgtagaaagatctccaagat

SEQ ID NO: 8019547 - DNA, 17 bp, Homo sapiens
tgtgtagagcatcgcca

SEQ ID NO: 8019548 - DNA, 22 bp, Homo sapiens
tgtgtagaggtaagtaacactt

SEQ ID NO: 8019549 - DNA, 22 bp, Homo sapiens
tgtgtacttttgtttctaagcc

SEQ ID NO: 8019550 - DNA, 22 bp, Homo sapiens
tgtgtacttttgtttctaagcc

SEQ ID NO: 8019551 - DNA, 17 bp, Homo sapiens
tgtgtacttgaacttga

SEQ ID NO: 8019552 - DNA, 17 bp, Homo sapiens
tgtgtacttgaacttga

SEQ ID NO: 8019553 - DNA, 22 bp, Homo sapiens
tgtgtacttgctgatcttatct

SEQ ID NO: 8019554 - DNA, 22 bp, Homo sapiens
tgtgtactgagggtgaattcac

SEQ ID NO: 8019555 - DNA, 22 bp, Homo sapiens
tgtgtactgagggtgaattcac

SEQ ID NO: 8019556 - DNA, 22 bp, Homo sapiens
tgtgtacttccccctgacctgt

SEQ ID NO: 8019557 - DNA, 22 bp, Homo sapiens
tgtgtagctttcttctgtgggg

SEQ ID NO: 8019558 - DNA, 22 bp, Homo sapiens
tgtgtagctcatattagtgtta

SEQ ID NO: 8019559 - DNA, 20 bp, Homo sapiens
tgtgtagcaggtgctgtgcc

SEQ ID NO: 8019560 - DNA, 20 bp, Homo sapiens
tgtgtagcaggtgctgtgcc

SEQ ID NO: 8019561 - DNA, 20 bp, Homo sapiens
tgtgtagcaggtgctgtgcc

SEQ ID NO: 8019562 - DNA, 22 bp, Homo sapiens
tgtgtgcattagcattctaggg

SEQ ID NO: 8019563 - DNA, 22 bp, Homo sapiens
tgtgtgcattcacatgcatgcc

SEQ ID NO: 8019564 - DNA, 22 bp, Homo sapiens
tgtgtgcattcacatgcatgcc

SEQ ID NO: 8019565 - DNA, 22 bp, Homo sapiens
tgtgtgcattcacatgcatgcc

SEQ ID NO: 8019566 - DNA, 22 bp, Homo sapiens
tgtgtgccagatacaagcactg

SEQ ID NO: 8019567 - DNA, 22 bp, Homo sapiens
tgtgtgccagatacaagcactg

SEQ ID NO: 8019568 - DNA, 22 bp, Homo sapiens
tgtgtgcatgttaatgagaaaa

SEQ ID NO: 8019569 - DNA, 22 bp, Homo sapiens
tgtgtgcatgttaatgagaaaa

SEQ ID NO: 8019570 - DNA, 22 bp, Homo sapiens
tgtgtgcattagcattctaggg

SEQ ID NO: 8019571 - DNA, 22 bp, Homo sapiens
tgtgtgcatgcttggggcagca

SEQ ID NO: 8019572 - DNA, 22 bp, Homo sapiens
tgtgtcagaggtagagatggca

SEQ ID NO: 8019573 - DNA, 22 bp, Homo sapiens
tgtgtcagaggtagagatggca

SEQ ID NO: 8019574 - DNA, 19 bp, Homo sapiens
tgtgtgcatgcgcacgtgt

SEQ ID NO: 8019575 - DNA, 22 bp, Homo sapiens
tgtgtgcctgagccgtgcctgg

SEQ ID NO: 8019576 - DNA, 19 bp, Homo sapiens
tgtgtgccctcaccacata

SEQ ID NO: 8019577 - DNA, 19 bp, Homo sapiens
tgtgtgccctcaccacata

SEQ ID NO: 8019578 - DNA, 22 bp, Homo sapiens
tgtgtgccccagatgagtagct

SEQ ID NO: 8019579 - DNA, 22 bp, Homo sapiens
tgtgtgccagggcatgcacagg

SEQ ID NO: 8019580 - DNA, 22 bp, Homo sapiens
tgtgtgccccagatgagtagct

SEQ ID NO: 8019581 - DNA, 19 bp, Homo sapiens
tgtgtgccctcaccacata

SEQ ID NO: 8019582 - DNA, 22 bp, Homo sapiens
tgtgtgccagcctacgaggagc

SEQ ID NO: 8019583 - DNA, 22 bp, Homo sapiens
tgtgtgccagggcatgcacagg

SEQ ID NO: 8019584 - DNA, 22 bp, Homo sapiens
tgtgtgccccagatgagtagct

SEQ ID NO: 8019585 - DNA, 22 bp, Homo sapiens
tgtgtgccagcctacgaggagc

SEQ ID NO: 8019586 - DNA, 22 bp, Homo sapiens
tgtgtgctaatgtatgctctaa

SEQ ID NO: 8019587 - DNA, 22 bp, Homo sapiens
tgtgtgctaatgtatgctctaa

SEQ ID NO: 8019588 - DNA, 22 bp, Homo sapiens
tgtgtgctaatgtatgctctaa

SEQ ID NO: 8019589 - DNA, 22 bp, Homo sapiens
tgtgtgctaatgtatgctctaa

SEQ ID NO: 8019590 - DNA, 20 bp, Homo sapiens
tgtgtgctaggactacagtg

SEQ ID NO: 8019591 - DNA, 22 bp, Homo sapiens
tgtgtgcctgagccgtgcctgg

SEQ ID NO: 8019592 - DNA, 22 bp, Homo sapiens
tgtgtgctaatgtatgctctaa

SEQ ID NO: 8019593 - DNA, 22 bp, Homo sapiens
tgtgtgcctgagccgtgcctgg

SEQ ID NO: 8019594 - DNA, 22 bp, Homo sapiens
ttcactgcagcccatgaaggga

SEQ ID NO: 8019595 - DNA, 22 bp, Homo sapiens
ttcactgcagcccatgaaggga

SEQ ID NO: 8019596 - DNA, 22 bp, Homo sapiens
ttcactgcagcccatgaaggga

SEQ ID NO: 8019597 - DNA, 22 bp, Homo sapiens
ttcactgagagacatgaaggtc

SEQ ID NO: 8019598 - DNA, 22 bp, Homo sapiens
ttcactgcaacctccgcctccc

SEQ ID NO: 8019599 - DNA, 22 bp, Homo sapiens
ttcactgaagtttcttccatgt

SEQ ID NO: 8019600 - DNA, 22 bp, Homo sapiens
ttcactgaattaaaaagagtat

SEQ ID NO: 8019601 - DNA, 22 bp, Homo sapiens
ttcactgaattaaaaagagtat

SEQ ID NO: 8019602 - DNA, 22 bp, Homo sapiens
ttcactgaattaaaaagagtat

SEQ ID NO: 8019603 - DNA, 22 bp, Homo sapiens
ttcactgaattaaaaagagtat

SEQ ID NO: 8019604 - DNA, 22 bp, Homo sapiens
ttcactgaagtttcttccatgt

SEQ ID NO: 8019605 - DNA, 19 bp, Homo sapiens
ttcactaattgtaagattt

SEQ ID NO: 8019606 - DNA, 22 bp, Homo sapiens
ttcactaattcagtgtttgcgg

SEQ ID NO: 8019607 - DNA, 22 bp, Homo sapiens
ttcacgttgttgaagaaaatac

SEQ ID NO: 8019608 - DNA, 19 bp, Homo sapiens
ttcacggccaggacaatgc

SEQ ID NO: 8019609 - DNA, 18 bp, Homo sapiens
ttcacctgtcctggcagg

SEQ ID NO: 8019610 - DNA, 22 bp, Homo sapiens
ttcaccttgaatatgtcttaaa

SEQ ID NO: 8019611 - DNA, 22 bp, Homo sapiens
ttcactataaagtttcaacttt

SEQ ID NO: 8019612 - DNA, 22 bp, Homo sapiens
ttcactatgcttggaaacttct

SEQ ID NO: 8019613 - DNA, 22 bp, Homo sapiens
ttcactagcaacattacaagaa

SEQ ID NO: 8019614 - DNA, 22 bp, Homo sapiens
ttcaccattacatacaaagatg

SEQ ID NO: 8019615 - DNA, 22 bp, Homo sapiens
ttcaccatgtaaaccatgtggc

SEQ ID NO: 8019616 - DNA, 22 bp, Homo sapiens
ttcaccattacatacaaagatg

SEQ ID NO: 8019617 - DNA, 22 bp, Homo sapiens
ttcaccatttcccactaaacca

SEQ ID NO: 8019618 - DNA, 22 bp, Homo sapiens
ttcaccatttcccactaaacca

SEQ ID NO: 8019619 - DNA, 22 bp, Homo sapiens
ttcacccactagagaactcagg

SEQ ID NO: 8019620 - DNA, 22 bp, Homo sapiens
ttcaccctggaccagaaattgg

SEQ ID NO: 8019621 - DNA, 22 bp, Homo sapiens
ttcaccccaaattcccagtgga

SEQ ID NO: 8019622 - DNA, 22 bp, Homo sapiens
ttcaccctggaccagaaattgg

SEQ ID NO: 8019623 - DNA, 22 bp, Homo sapiens
ttcagcagtgcagacacccagt

SEQ ID NO: 8019624 - DNA, 22 bp, Homo sapiens
ttcagcagtcgtccaggaaaag

SEQ ID NO: 8019625 - DNA, 19 bp, Homo sapiens
ttcagcagtgtctgctctt

SEQ ID NO: 8019626 - DNA, 22 bp, Homo sapiens
ttcagcagtgcagacacccagt

SEQ ID NO: 8019627 - DNA, 21 bp, Homo sapiens
ttcagcagtcctctagagata

SEQ ID NO: 8019628 - DNA, 21 bp, Homo sapiens
ttcagcagtcctctagagata

SEQ ID NO: 8019629 - DNA, 22 bp, Homo sapiens
ttcagcagtcgtccaggaaaag

SEQ ID NO: 8019630 - DNA, 22 bp, Homo sapiens
ttcagcagtcgtccaggaaaag

SEQ ID NO: 8019631 - DNA, 22 bp, Homo sapiens
ttcagcagtcgtccaggaaaag

SEQ ID NO: 8019632 - DNA, 22 bp, Homo sapiens
ttcagcagtttctgagaagcaa

SEQ ID NO: 8019633 - DNA, 22 bp, Homo sapiens
ttcagcagtttctgagaagcaa

SEQ ID NO: 8019634 - DNA, 22 bp, Homo sapiens
ttcagcagtttctgagaagcaa

SEQ ID NO: 8019635 - DNA, 19 bp, Homo sapiens
ttcagcagtgtctgctctt

SEQ ID NO: 8019636 - DNA, 17 bp, Homo sapiens
ttcagcagtgtttctcc

SEQ ID NO: 8019637 - DNA, 19 bp, Homo sapiens
ttcagcagtgtctgctctt

SEQ ID NO: 8019638 - DNA, 17 bp, Homo sapiens
ttcagcagtgtttctcc

SEQ ID NO: 8019639 - DNA, 22 bp, Homo sapiens
ttcagcagttcctattagatgt

SEQ ID NO: 8019640 - DNA, 17 bp, Homo sapiens
ttcagcagtgtttctcc

SEQ ID NO: 8019641 - DNA, 22 bp, Homo sapiens
ttcagcaggtggtgagttctgc

SEQ ID NO: 8019642 - DNA, 22 bp, Homo sapiens
ttcagcaggtggtgagttctgc

SEQ ID NO: 8019643 - DNA, 19 bp, Homo sapiens
ttcagcaggctgaagcttc

SEQ ID NO: 8019644 - DNA, 19 bp, Homo sapiens
ttcagcaggctgaagcttc

SEQ ID NO: 8019645 - DNA, 19 bp, Homo sapiens
ttcagcaggctgaagcttc

SEQ ID NO: 8019646 - DNA, 22 bp, Homo sapiens
ttcagcaggcggtagctgccac

SEQ ID NO: 8019647 - DNA, 22 bp, Homo sapiens
ttcagcaggcggtagctgccac

SEQ ID NO: 8019648 - DNA, 21 bp, Homo sapiens
ttcagcagtcctctagagata

SEQ ID NO: 8019649 - DNA, 21 bp, Homo sapiens
ttcagcagtcctctagagata

SEQ ID NO: 8019650 - DNA, 21 bp, Homo sapiens
ttcagcagtcctctagagata

SEQ ID NO: 8019651 - DNA, 22 bp, Homo sapiens
ttcactggtcctttataggaac

SEQ ID NO: 8019652 - DNA, 22 bp, Homo sapiens
ttcactgctacatccaggtgcc

SEQ ID NO: 8019653 - DNA, 22 bp, Homo sapiens
ttcactgctgggtgattgggtt

SEQ ID NO: 8019654 - DNA, 22 bp, Homo sapiens
ttcagcagcttttagtacattg

SEQ ID NO: 8019655 - DNA, 22 bp, Homo sapiens
ttcagcagcttttagtacattg

SEQ ID NO: 8019656 - DNA, 22 bp, Homo sapiens
ttcagcaggcggtagctgccac

SEQ ID NO: 8019657 - DNA, 22 bp, Homo sapiens
ttcagcagcttttagtacattg

SEQ ID NO: 8019658 - DNA, 22 bp, Homo sapiens
ttcagcagcttttagtacattg

SEQ ID NO: 8019659 - DNA, 22 bp, Homo sapiens
ttcagcagcttttagtacattg

SEQ ID NO: 8019660 - DNA, 20 bp, Homo sapiens
ttcaggaataagatagcagc

SEQ ID NO: 8019661 - DNA, 22 bp, Homo sapiens
ttcaggaataattatcatatga

SEQ ID NO: 8019662 - DNA, 22 bp, Homo sapiens
ttcaggaataattatcatatga

SEQ ID NO: 8019663 - DNA, 22 bp, Homo sapiens
ttcaggaaggtcctatagcaga

SEQ ID NO: 8019664 - DNA, 22 bp, Homo sapiens
ttcaggaagcctttcttggtct

SEQ ID NO: 8019665 - DNA, 22 bp, Homo sapiens
ttcaggaagtgctgcctggtgt

SEQ ID NO: 8019666 - DNA, 22 bp, Homo sapiens
ttcaggaaggtcctatagcaga

SEQ ID NO: 8019667 - DNA, 22 bp, Homo sapiens
ttcaggaagcctttcttggtct

SEQ ID NO: 8019668 - DNA, 22 bp, Homo sapiens
ttcaggaaattggagtccttct

SEQ ID NO: 8019669 - DNA, 22 bp, Homo sapiens
ttcaggaaatgtctgcctacca

SEQ ID NO: 8019670 - DNA, 22 bp, Homo sapiens
ttcaggaaatgtctgcctacca

SEQ ID NO: 8019671 - DNA, 23 bp, Homo sapiens
ttcaggaaatgaatacagacaca

SEQ ID NO: 8019672 - DNA, 23 bp, Homo sapiens
ttcaggaaatgaatacagacaca

SEQ ID NO: 8019673 - DNA, 22 bp, Homo sapiens
ttcagcttgcttagtctccttc

SEQ ID NO: 8019674 - DNA, 22 bp, Homo sapiens
ttcagctttgaggttgattttc

SEQ ID NO: 8019675 - DNA, 22 bp, Homo sapiens
ttcagcttggctgtaggtttta

SEQ ID NO: 8019676 - DNA, 23 bp, Homo sapiens
ttcaggaaatgaatacagacaca

SEQ ID NO: 8019677 - DNA, 23 bp, Homo sapiens
ttcaggaaatgaatacagacaca

SEQ ID NO: 8019678 - DNA, 22 bp, Homo sapiens
ttcagcttcatttgtctttatg

SEQ ID NO: 8019679 - DNA, 22 bp, Homo sapiens
ttcagcttgctgactgcggcag

SEQ ID NO: 8019680 - DNA, 22 bp, Homo sapiens
ttcagcttgaatctggctttga

SEQ ID NO: 8019681 - DNA, 22 bp, Homo sapiens
ttcagcttgctgactgcggcag

SEQ ID NO: 8019682 - DNA, 22 bp, Homo sapiens
ttcagcttgcttagtctccttc

SEQ ID NO: 8019683 - DNA, 22 bp, Homo sapiens
ttcagcttgctgactgcggcag

SEQ ID NO: 8019684 - DNA, 22 bp, Homo sapiens
ttcagcttgctgactgcggcag

SEQ ID NO: 8019685 - DNA, 22 bp, Homo sapiens
ttcagcctgttcatgctgttgc

SEQ ID NO: 8019686 - DNA, 22 bp, Homo sapiens
ttcagcctgtctgcagacccct

SEQ ID NO: 8019687 - DNA, 22 bp, Homo sapiens
ttcagcctgtctgcagacccct

SEQ ID NO: 8019688 - DNA, 21 bp, Homo sapiens
ttcagccctgtttgaggctac

SEQ ID NO: 8019689 - DNA, 22 bp, Homo sapiens
ttcagcccaggcatagggcaaa

SEQ ID NO: 8019690 - DNA, 22 bp, Homo sapiens
ttcagcccaggcatagggcaaa

SEQ ID NO: 8019691 - DNA, 22 bp, Homo sapiens
ttcagcccaggagttggaggct

SEQ ID NO: 8019692 - DNA, 22 bp, Homo sapiens
ttcagcatgggtgtgataaatg

SEQ ID NO: 8019693 - DNA, 22 bp, Homo sapiens
ttcagcatgggtgtgataaatg

SEQ ID NO: 8019694 - DNA, 22 bp, Homo sapiens
ttcagcattggtatgaaaaccc

SEQ ID NO: 8019695 - DNA, 22 bp, Homo sapiens
ttcagcattggtatgaaaaccc

SEQ ID NO: 8019696 - DNA, 22 bp, Homo sapiens
ttcagccagtcatcagtcttgt

SEQ ID NO: 8019697 - DNA, 22 bp, Homo sapiens
ttcagccaattagaagccccac

SEQ ID NO: 8019698 - DNA, 21 bp, Homo sapiens
ttcagctctgcttcagggaat

SEQ ID NO: 8019699 - DNA, 23 bp, Homo sapiens
ttcagctctgtgtatcctgcctc

SEQ ID NO: 8019700 - DNA, 23 bp, Homo sapiens
ttcagctctgtgtatcctgcctc

SEQ ID NO: 8019701 - DNA, 22 bp, Homo sapiens
ttcagctctgctagctctgtgc

SEQ ID NO: 8019702 - DNA, 21 bp, Homo sapiens
ttcagcttatgtgtcacttgc

SEQ ID NO: 8019703 - DNA, 22 bp, Homo sapiens
ttcagctctgctagctctgtgc

SEQ ID NO: 8019704 - DNA, 21 bp, Homo sapiens
ttcagctctgcttcagggaat

SEQ ID NO: 8019705 - DNA, 22 bp, Homo sapiens
ttcagctctagtaagcagacac

SEQ ID NO: 8019706 - DNA, 22 bp, Homo sapiens
ttcagctctagtaagcagacac

SEQ ID NO: 8019707 - DNA, 21 bp, Homo sapiens
ttcagctcggtctggcatgat

SEQ ID NO: 8019708 - DNA, 22 bp, Homo sapiens
ttcagctcctttcttccaccag

SEQ ID NO: 8019709 - DNA, 22 bp, Homo sapiens
ttcagctccttatttctgagca

SEQ ID NO: 8019710 - DNA, 22 bp, Homo sapiens
ttcagctcagtctgtgcagcag

SEQ ID NO: 8019711 - DNA, 22 bp, Homo sapiens
ttcagctcagcactgacaagat

SEQ ID NO: 8019712 - DNA, 22 bp, Homo sapiens
ttcagctcagcactgacaagat

SEQ ID NO: 8019713 - DNA, 22 bp, Homo sapiens
ttcagctcagtctgtgcagcag

SEQ ID NO: 8019714 - DNA, 22 bp, Homo sapiens
ttcagctcaacgcacttctgag

SEQ ID NO: 8019715 - DNA, 22 bp, Homo sapiens
ttcagctatggagtcttagtta

SEQ ID NO: 8019716 - DNA, 22 bp, Homo sapiens
ttcagcctgttcatgctgttgc

SEQ ID NO: 8019717 - DNA, 22 bp, Homo sapiens
ttcagcctgttcatgctgttgc

SEQ ID NO: 8019718 - DNA, 22 bp, Homo sapiens
ttatttcttgtctatgtagcca

SEQ ID NO: 8019719 - DNA, 22 bp, Homo sapiens
ttatttcttgtctatgtagcca

SEQ ID NO: 8019720 - DNA, 22 bp, Homo sapiens
ttatttcttgtctatgtagcca

SEQ ID NO: 8019721 - DNA, 22 bp, Homo sapiens
ttatttcttgtctatgtagcca

SEQ ID NO: 8019722 - DNA, 22 bp, Homo sapiens
ttatttgaaaagaaggttacgt

SEQ ID NO: 8019723 - DNA, 22 bp, Homo sapiens
ttatttgaatctggctagagaa

SEQ ID NO: 8019724 - DNA, 22 bp, Homo sapiens
ttatttgaaaagaaggttacgt

SEQ ID NO: 8019725 - DNA, 22 bp, Homo sapiens
ttatttgacttcttgctatgct

SEQ ID NO: 8019726 - DNA, 22 bp, Homo sapiens
ttatttctactattttgcctga

SEQ ID NO: 8019727 - DNA, 20 bp, Homo sapiens
ttatttctcattctcctact

SEQ ID NO: 8019728 - DNA, 20 bp, Homo sapiens
ttatttctcattctcctact

SEQ ID NO: 8019729 - DNA, 22 bp, Homo sapiens
ttatttctactattttgcctga

SEQ ID NO: 8019730 - DNA, 22 bp, Homo sapiens
ttatttcctctctaatagggta

SEQ ID NO: 8019731 - DNA, 22 bp, Homo sapiens
ttatttcctgacacagctgatt

SEQ ID NO: 8019732 - DNA, 22 bp, Homo sapiens
ttatttcctgacacagctgatt

SEQ ID NO: 8019733 - DNA, 22 bp, Homo sapiens
ttatttcctgacacagctgatt

SEQ ID NO: 8019734 - DNA, 22 bp, Homo sapiens
ttatttcctagggaatttgcct

SEQ ID NO: 8019735 - DNA, 22 bp, Homo sapiens
ttatttcctagggaatttgcct

SEQ ID NO: 8019736 - DNA, 22 bp, Homo sapiens
ttatttcctaaatctctttgtt

SEQ ID NO: 8019737 - DNA, 22 bp, Homo sapiens
ttatttgtgaatcatttatcta

SEQ ID NO: 8019738 - DNA, 22 bp, Homo sapiens
ttatttgtgaatcatttatcta

SEQ ID NO: 8019739 - DNA, 22 bp, Homo sapiens
ttatttgtaaggcagggccagt

SEQ ID NO: 8019740 - DNA, 22 bp, Homo sapiens
ttatttgtatcaaggacggttg

SEQ ID NO: 8019741 - DNA, 22 bp, Homo sapiens
ttatttgtgaatcatttatcta

SEQ ID NO: 8019742 - DNA, 22 bp, Homo sapiens
ttatttgtggcatatgagacga

SEQ ID NO: 8019743 - DNA, 22 bp, Homo sapiens
ttatttgtgaatcatttatcta

SEQ ID NO: 8019744 - DNA, 22 bp, Homo sapiens
ttatttgtaaaggtccatagta

SEQ ID NO: 8019745 - DNA, 22 bp, Homo sapiens
ttatttgtaaaggtccatagta

SEQ ID NO: 8019746 - DNA, 22 bp, Homo sapiens
ttatttgtaaaggtccatagta

SEQ ID NO: 8019747 - DNA, 22 bp, Homo sapiens
ttatttggttgctgacttggaa

SEQ ID NO: 8019748 - DNA, 22 bp, Homo sapiens
ttatttggttgctgacttggaa

SEQ ID NO: 8019749 - DNA, 23 bp, Homo sapiens
ttatttggattttagtggaaaga

SEQ ID NO: 8019750 - DNA, 23 bp, Homo sapiens
ttatttggattttagtggaaaga

SEQ ID NO: 8019751 - DNA, 22 bp, Homo sapiens
ttatttggaaatatggcttctg

SEQ ID NO: 8019752 - DNA, 22 bp, Homo sapiens
ttatttgctgatttcagtttca

SEQ ID NO: 8019753 - DNA, 22 bp, Homo sapiens
ttatttggaaatatggcttctg

SEQ ID NO: 8019754 - DNA, 22 bp, Homo sapiens
ttatttgccagaatttctcttg

SEQ ID NO: 8019755 - DNA, 22 bp, Homo sapiens
ttatttgccagaatttctcttg

SEQ ID NO: 8019756 - DNA, 22 bp, Homo sapiens
ttatttgattagtaaacctgta

SEQ ID NO: 8019757 - DNA, 22 bp, Homo sapiens
ttatttgccagaatttctcttg

SEQ ID NO: 8019758 - DNA, 22 bp, Homo sapiens
ttatttgccagaatttctcttg

SEQ ID NO: 8019759 - DNA, 20 bp, Homo sapiens
ttatttgctctttatctgca

SEQ ID NO: 8019760 - DNA, 22 bp, Homo sapiens
ttatttgcccatgtttagcaga

SEQ ID NO: 8019761 - DNA, 22 bp, Homo sapiens
ttatttgcccatgtttagcaga

SEQ ID NO: 8019762 - DNA, 22 bp, Homo sapiens
ttcacattggtgatatgtttct

SEQ ID NO: 8019763 - DNA, 22 bp, Homo sapiens
ttcacattggttcttgatagct

SEQ ID NO: 8019764 - DNA, 22 bp, Homo sapiens
ttcacattggtgatatgtttct

SEQ ID NO: 8019765 - DNA, 22 bp, Homo sapiens
ttcacattgtgcagattatggt

SEQ ID NO: 8019766 - DNA, 22 bp, Homo sapiens
ttcacattgtgcagattatggt

SEQ ID NO: 8019767 - DNA, 22 bp, Homo sapiens
ttcacattgtgcagattatggt

SEQ ID NO: 8019768 - DNA, 22 bp, Homo sapiens
ttcacattgtgcagattatggt

SEQ ID NO: 8019769 - DNA, 22 bp, Homo sapiens
ttcacattggttcttgatagct

SEQ ID NO: 8019770 - DNA, 22 bp, Homo sapiens
ttcacattggttcttgatagct

SEQ ID NO: 8019771 - DNA, 22 bp, Homo sapiens
ttcacattggttcttgatagct

SEQ ID NO: 8019772 - DNA, 22 bp, Homo sapiens
ttcacatttcataccacagctt

SEQ ID NO: 8019773 - DNA, 22 bp, Homo sapiens
ttcacatttctctgctgtttga

SEQ ID NO: 8019774 - DNA, 22 bp, Homo sapiens
ttcacatttcataccacagctt

SEQ ID NO: 8019775 - DNA, 22 bp, Homo sapiens
ttcacatttcataccacagctt

SEQ ID NO: 8019776 - DNA, 22 bp, Homo sapiens
ttcacattgttttaatgtgaat

SEQ ID NO: 8019777 - DNA, 22 bp, Homo sapiens
ttcacatttactggtttgtccg

SEQ ID NO: 8019778 - DNA, 22 bp, Homo sapiens
ttcacatttactggtttgtccg

SEQ ID NO: 8019779 - DNA, 22 bp, Homo sapiens
ttcacatttactggtttgtccg

SEQ ID NO: 8019780 - DNA, 22 bp, Homo sapiens
ttcacattgttttaatgtgaat

SEQ ID NO: 8019781 - DNA, 22 bp, Homo sapiens
ttcacattgttttaatgtgaat

SEQ ID NO: 8019782 - DNA, 22 bp, Homo sapiens
ttcacattgttttaatgtgaat

SEQ ID NO: 8019783 - DNA, 22 bp, Homo sapiens
ttcacattgtggttcatgtgaa

SEQ ID NO: 8019784 - DNA, 22 bp, Homo sapiens
ttcacattgtggttcatgtgaa

SEQ ID NO: 8019785 - DNA, 22 bp, Homo sapiens
ttcacattgtggttcatgtgaa

SEQ ID NO: 8019786 - DNA, 20 bp, Homo sapiens
ttcacatttctgtagtgatt

SEQ ID NO: 8019787 - DNA, 20 bp, Homo sapiens
ttcacatttctgtagtgatt

SEQ ID NO: 8019788 - DNA, 22 bp, Homo sapiens
ttcacatttctctgctgtttga

SEQ ID NO: 8019789 - DNA, 22 bp, Homo sapiens
ttcacatttgaaaggaaagata

SEQ ID NO: 8019790 - DNA, 22 bp, Homo sapiens
ttcacatttgcccttatgtgtg

SEQ ID NO: 8019791 - DNA, 20 bp, Homo sapiens
ttcacatttctgtagtgatt

SEQ ID NO: 8019792 - DNA, 20 bp, Homo sapiens
ttcacatttctgtagtgatt

SEQ ID NO: 8019793 - DNA, 22 bp, Homo sapiens
ttcacatttgaaaggaaagata

SEQ ID NO: 8019794 - DNA, 22 bp, Homo sapiens
ttcacatttgcccttatgtgtg

SEQ ID NO: 8019795 - DNA, 22 bp, Homo sapiens
ttcacatttgcccttatgtgtg

SEQ ID NO: 8019796 - DNA, 22 bp, Homo sapiens
ttcacatttgcccttatgtgtg

SEQ ID NO: 8019797 - DNA, 19 bp, Homo sapiens
ttcacatttttgtggcact

SEQ ID NO: 8019798 - DNA, 19 bp, Homo sapiens
ttcacatttttgtggcact

SEQ ID NO: 8019799 - DNA, 19 bp, Homo sapiens
ttcacattttgctctgagg

SEQ ID NO: 8019800 - DNA, 19 bp, Homo sapiens
ttcacatttttgtggcact

SEQ ID NO: 8019801 - DNA, 19 bp, Homo sapiens
ttcacattttgctctgagg

SEQ ID NO: 8019802 - DNA, 19 bp, Homo sapiens
ttcacattttgctctgagg

SEQ ID NO: 8019803 - DNA, 22 bp, Homo sapiens
ttcaccatgggatgacaacagt

SEQ ID NO: 8019804 - DNA, 22 bp, Homo sapiens
ttcaccatgggatgacaacagt

SEQ ID NO: 8019805 - DNA, 19 bp, Homo sapiens
ttcaccatctcaccaaacc

SEQ ID NO: 8019806 - DNA, 19 bp, Homo sapiens
ttcaccatctcaccaaacc

SEQ ID NO: 8019807 - DNA, 22 bp, Homo sapiens
ttcaccatcattaacttcatgt

SEQ ID NO: 8019808 - DNA, 22 bp, Homo sapiens
ttcaccatcattaacttcatgt

SEQ ID NO: 8019809 - DNA, 22 bp, Homo sapiens
ttcaccataatgcaaagtggga

SEQ ID NO: 8019810 - DNA, 18 bp, Homo sapiens
ttcaccagtgtgatgggt

SEQ ID NO: 8019811 - DNA, 22 bp, Homo sapiens
ttcaccagattttgtatagtca

SEQ ID NO: 8019812 - DNA, 22 bp, Homo sapiens
ttcaccagaggttagaatattt

SEQ ID NO: 8019813 - DNA, 22 bp, Homo sapiens
ttcaccacagtctcatctacgc

SEQ ID NO: 8019814 - DNA, 22 bp, Homo sapiens
ttcattcttgtctttgtatagt

SEQ ID NO: 8019815 - DNA, 20 bp, Homo sapiens
ttcattcattccacaacttc

SEQ ID NO: 8019816 - DNA, 22 bp, Homo sapiens
ttcattcattcatgaatgttaa

SEQ ID NO: 8019817 - DNA, 22 bp, Homo sapiens
ttcattcattacgtgccaggca

SEQ ID NO: 8019818 - DNA, 22 bp, Homo sapiens
ttcattcatgtattgtctatgg

SEQ ID NO: 8019819 - DNA, 22 bp, Homo sapiens
ttcattcatgtattgtctatgg

SEQ ID NO: 8019820 - DNA, 22 bp, Homo sapiens
ttcattcatggtcttctgagat

SEQ ID NO: 8019821 - DNA, 22 bp, Homo sapiens
ttcattcatgtattgtctatgg

SEQ ID NO: 8019822 - DNA, 22 bp, Homo sapiens
ttcattcattcatgaatgttaa

SEQ ID NO: 8019823 - DNA, 19 bp, Homo sapiens
ttcattctttctacttacc

SEQ ID NO: 8019824 - DNA, 19 bp, Homo sapiens
ttcattctttctacttacc

SEQ ID NO: 8019825 - DNA, 19 bp, Homo sapiens
ttcattctttctacttacc

SEQ ID NO: 8019826 - DNA, 22 bp, Homo sapiens
ttcattctttgaatctgaggta

SEQ ID NO: 8019827 - DNA, 22 bp, Homo sapiens
ttcattcttttacatgtgaata

SEQ ID NO: 8019828 - DNA, 22 bp, Homo sapiens
ttcattcttttacatgtgaata

SEQ ID NO: 8019829 - DNA, 22 bp, Homo sapiens
ttcattcttttacatgtgaata

SEQ ID NO: 8019830 - DNA, 22 bp, Homo sapiens
ttcattctttgaatctgaggta

SEQ ID NO: 8019831 - DNA, 22 bp, Homo sapiens
ttcattcttttacatgtgaata

SEQ ID NO: 8019832 - DNA, 22 bp, Homo sapiens
ttcattgaaatacagtcttgac

SEQ ID NO: 8019833 - DNA, 22 bp, Homo sapiens
ttcattgaaatacagtcttgac

SEQ ID NO: 8019834 - DNA, 22 bp, Homo sapiens
ttcattgaaatgtttctagctg

SEQ ID NO: 8019835 - DNA, 22 bp, Homo sapiens
ttcattgagttactgcctgggc

SEQ ID NO: 8019836 - DNA, 22 bp, Homo sapiens
ttcattgatagttttatgtatg

SEQ ID NO: 8019837 - DNA, 22 bp, Homo sapiens
ttcattgatgtggtttaatgta

SEQ ID NO: 8019838 - DNA, 22 bp, Homo sapiens
ttcattgatgtggtttaatgta

SEQ ID NO: 8019839 - DNA, 22 bp, Homo sapiens
ttcattgattccaggctcttct

SEQ ID NO: 8019840 - DNA, 22 bp, Homo sapiens
ttcattgactggttcgttaagt

SEQ ID NO: 8019841 - DNA, 22 bp, Homo sapiens
ttcattgatttaacaaacaagt

SEQ ID NO: 8019842 - DNA, 22 bp, Homo sapiens
ttccagaggaaagaaaatgact

SEQ ID NO: 8019843 - DNA, 22 bp, Homo sapiens
ttccagaggaaagaaaatgact

SEQ ID NO: 8019844 - DNA, 22 bp, Homo sapiens
ttccagagctttgcgcttggaa

SEQ ID NO: 8019845 - DNA, 23 bp, Homo sapiens
ttccagaggaagaagtcatgact

SEQ ID NO: 8019846 - DNA, 23 bp, Homo sapiens
ttccagaggaagaagtcatgact

SEQ ID NO: 8019847 - DNA, 23 bp, Homo sapiens
ttccagaggaagaagtcatgact

SEQ ID NO: 8019848 - DNA, 23 bp, Homo sapiens
ttccagaggaagaagtcatgact

SEQ ID NO: 8019849 - DNA, 22 bp, Homo sapiens
ttccagaggctctaggggagaa

SEQ ID NO: 8019850 - DNA, 22 bp, Homo sapiens
ttccagaggctctaggggagaa

SEQ ID NO: 8019851 - DNA, 22 bp, Homo sapiens
ttccagaggagtgattcagagg

SEQ ID NO: 8019852 - DNA, 22 bp, Homo sapiens
ttccagaggatctcaggtattt

SEQ ID NO: 8019853 - DNA, 22 bp, Homo sapiens
ttccagaggagtgattcagagg

SEQ ID NO: 8019854 - DNA, 22 bp, Homo sapiens
ttcattcaggtgtatttatggg

SEQ ID NO: 8019855 - DNA, 22 bp, Homo sapiens
ttcattcagtgagactaggacg

SEQ ID NO: 8019856 - DNA, 22 bp, Homo sapiens
ttcattcagtgagactaggacg

SEQ ID NO: 8019857 - DNA, 22 bp, Homo sapiens
ttcattcatcacatgcagctgg

SEQ ID NO: 8019858 - DNA, 22 bp, Homo sapiens
ttcattcatcacatgcagctgg

SEQ ID NO: 8019859 - DNA, 22 bp, Homo sapiens
ttcattcatcacatgcagctgg

SEQ ID NO: 8019860 - DNA, 22 bp, Homo sapiens
ttcattcatcacatgcagctgg

SEQ ID NO: 8019861 - DNA, 22 bp, Homo sapiens
ttcattcatggtcttctgagat

SEQ ID NO: 8019862 - DNA, 22 bp, Homo sapiens
ttcattcatctctaaaatgcct

SEQ ID NO: 8019863 - DNA, 21 bp, Homo sapiens
ttcattcatggcataatatag

SEQ ID NO: 8019864 - DNA, 23 bp, Homo sapiens
ttcattcaaaaggaaaagtcatg

SEQ ID NO: 8019865 - DNA, 22 bp, Homo sapiens
ttcattcaaagaggcatccaag

SEQ ID NO: 8019866 - DNA, 22 bp, Homo sapiens
ttcattcacccaggaaacatct

SEQ ID NO: 8019867 - DNA, 22 bp, Homo sapiens
ttcattcaaggggttcctgatt

SEQ ID NO: 8019868 - DNA, 22 bp, Homo sapiens
ttcattcaaagaggcatccaag

SEQ ID NO: 8019869 - DNA, 22 bp, Homo sapiens
ttcattcaaggggttcctgatt

SEQ ID NO: 8019870 - DNA, 22 bp, Homo sapiens
ttcattcacccaggaaacatct

SEQ ID NO: 8019871 - DNA, 22 bp, Homo sapiens
ttcattcacccaggaaacatct

SEQ ID NO: 8019872 - DNA, 20 bp, Homo sapiens
ttcattcacgtagctgttga

SEQ ID NO: 8019873 - DNA, 20 bp, Homo sapiens
ttcattcacgtagctgttga

SEQ ID NO: 8019874 - DNA, 22 bp, Homo sapiens
ttcattcaggtgtatttatggg

SEQ ID NO: 8019875 - DNA, 22 bp, Homo sapiens
ttcatgtttgtaggactgaggc

SEQ ID NO: 8019876 - DNA, 22 bp, Homo sapiens
ttcatgtttgtaggactgaggc

SEQ ID NO: 8019877 - DNA, 22 bp, Homo sapiens
ttcaggaagtgctgcctggtgt

SEQ ID NO: 8019878 - DNA, 22 bp, Homo sapiens
ttcatgttttattcagtaatta

SEQ ID NO: 8019879 - DNA, 22 bp, Homo sapiens
ttcatgttttattcagtaatta

SEQ ID NO: 8019880 - DNA, 22 bp, Homo sapiens
ttcatgttttattcagtaatta

SEQ ID NO: 8019881 - DNA, 22 bp, Homo sapiens
ttcatgttttattcagtaatta

SEQ ID NO: 8019882 - DNA, 22 bp, Homo sapiens
ttcaggaatataggcattgaca

SEQ ID NO: 8019883 - DNA, 22 bp, Homo sapiens
ttcaggaatcaaccaagtcatt

SEQ ID NO: 8019884 - DNA, 22 bp, Homo sapiens
ttcaggaatcaaccaagtcatt

SEQ ID NO: 8019885 - DNA, 22 bp, Homo sapiens
ttcatgtttgcctatttgactt

SEQ ID NO: 8019886 - DNA, 22 bp, Homo sapiens
ttcatgtttgcctatttgactt

SEQ ID NO: 8019887 - DNA, 21 bp, Homo sapiens
ttcaggacaggaaaaacaggg

SEQ ID NO: 8019888 - DNA, 22 bp, Homo sapiens
ttcattaagtataaaatgtggt

SEQ ID NO: 8019889 - DNA, 22 bp, Homo sapiens
ttcattacattcaaaaggcatt

SEQ ID NO: 8019890 - DNA, 22 bp, Homo sapiens
ttcattaattcattcagtgact

SEQ ID NO: 8019891 - DNA, 22 bp, Homo sapiens
ttcattaattcattcagtgact

SEQ ID NO: 8019892 - DNA, 22 bp, Homo sapiens
ttcattactgaattctcactac

SEQ ID NO: 8019893 - DNA, 22 bp, Homo sapiens
ttcattactgcggtagtcacac

SEQ ID NO: 8019894 - DNA, 22 bp, Homo sapiens
ttccagcagggtacttgtaatt

SEQ ID NO: 8019895 - DNA, 22 bp, Homo sapiens
ttccagcaggcagacaggagat

SEQ ID NO: 8019896 - DNA, 22 bp, Homo sapiens
ttccagcaggcagacaggagat

SEQ ID NO: 8019897 - DNA, 22 bp, Homo sapiens
ttccagcagcgtgggagaagta

SEQ ID NO: 8019898 - DNA, 22 bp, Homo sapiens
ttccagcagcgtgggagaagta

SEQ ID NO: 8019899 - DNA, 22 bp, Homo sapiens
ttccagcaggcagacaggagat

SEQ ID NO: 8019900 - DNA, 22 bp, Homo sapiens
ttccagatatttttatgtggaa

SEQ ID NO: 8019901 - DNA, 22 bp, Homo sapiens
ttccagatatttttatgtggaa

SEQ ID NO: 8019902 - DNA, 22 bp, Homo sapiens
ttccagatgtttaagttctgct

SEQ ID NO: 8019903 - DNA, 22 bp, Homo sapiens
ttccagatgtttaagttctgct

SEQ ID NO: 8019904 - DNA, 22 bp, Homo sapiens
ttccagcacagaagtatacatt

SEQ ID NO: 8019905 - DNA, 22 bp, Homo sapiens
ttccagcacagaagtatacatt

SEQ ID NO: 8019906 - DNA, 22 bp, Homo sapiens
ttccagctaactcacatccctt

SEQ ID NO: 8019907 - DNA, 22 bp, Homo sapiens
ttccagctaactcacatccctt

SEQ ID NO: 8019908 - DNA, 22 bp, Homo sapiens
ttccagcctttatccatccaga

SEQ ID NO: 8019909 - DNA, 22 bp, Homo sapiens
ttccagctaactcacatccctt

SEQ ID NO: 8019910 - DNA, 22 bp, Homo sapiens
ttccagcccgcgacttgttcag

SEQ ID NO: 8019911 - DNA, 20 bp, Homo sapiens
ttccagccgccacttccgcc

SEQ ID NO: 8019912 - DNA, 22 bp, Homo sapiens
ttccagccatggtttccctatg

SEQ ID NO: 8019913 - DNA, 22 bp, Homo sapiens
ttccagcccgcgacttgttcag

SEQ ID NO: 8019914 - DNA, 22 bp, Homo sapiens
ttccagccactttatactgcta

SEQ ID NO: 8019915 - DNA, 22 bp, Homo sapiens
ttccagccagatttgctgggtt

SEQ ID NO: 8019916 - DNA, 22 bp, Homo sapiens
ttccagccatggtttccctatg

SEQ ID NO: 8019917 - DNA, 22 bp, Homo sapiens
ttccagaggggaggtggcagcc

SEQ ID NO: 8019918 - DNA, 22 bp, Homo sapiens
ttccagaggggaggtggcagcc

SEQ ID NO: 8019919 - DNA, 22 bp, Homo sapiens
ttccagaggggaggtggcagcc

SEQ ID NO: 8019920 - DNA, 22 bp, Homo sapiens
ttccagaggttctcagccctgt

SEQ ID NO: 8019921 - DNA, 22 bp, Homo sapiens
ttccagaggtagcaatgacttg

SEQ ID NO: 8019922 - DNA, 22 bp, Homo sapiens
ttccagaggtagcaatgacttg

SEQ ID NO: 8019923 - DNA, 22 bp, Homo sapiens
ttccagaggttctcagccctgt

SEQ ID NO: 8019924 - DNA, 22 bp, Homo sapiens
ttccagaggttctcagccctgt

SEQ ID NO: 8019925 - DNA, 22 bp, Homo sapiens
ttccagaggcttgaggaaaatt

SEQ ID NO: 8019926 - DNA, 22 bp, Homo sapiens
ttccagaggcttgaggaaaatt

SEQ ID NO: 8019927 - DNA, 22 bp, Homo sapiens
ttccagaggcttgaggaaaatt

SEQ ID NO: 8019928 - DNA, 22 bp, Homo sapiens
ttccagaggcttcagggaagaa

SEQ ID NO: 8019929 - DNA, 22 bp, Homo sapiens
ttccagaggcttcagggaagaa

SEQ ID NO: 8019930 - DNA, 22 bp, Homo sapiens
ttccagaggcttcagggaagaa

SEQ ID NO: 8019931 - DNA, 22 bp, Homo sapiens
ttccagaggcttcagggaagaa

SEQ ID NO: 8019932 - DNA, 22 bp, Homo sapiens
ttccagaggcttcagggaagaa

SEQ ID NO: 8019933 - DNA, 23 bp, Homo sapiens
ttccagagtccacatctgccacc

SEQ ID NO: 8019934 - DNA, 22 bp, Homo sapiens
ttccagagtccatgttggctca

SEQ ID NO: 8019935 - DNA, 23 bp, Homo sapiens
ttccagagtccacatctgccacc

SEQ ID NO: 8019936 - DNA, 22 bp, Homo sapiens
ttccagaggttctcagccctgt

SEQ ID NO: 8019937 - DNA, 22 bp, Homo sapiens
ttccagagtattggtagctata

SEQ ID NO: 8019938 - DNA, 22 bp, Homo sapiens
ttccagaggttctcagccctgt

SEQ ID NO: 8019939 - DNA, 22 bp, Homo sapiens
ttccagagtcagccactgggag

SEQ ID NO: 8019940 - DNA, 22 bp, Homo sapiens
ttccagagtctggttccatggt

SEQ ID NO: 8019941 - DNA, 22 bp, Homo sapiens
ttccagagtccatgttggctca

SEQ ID NO: 8019942 - DNA, 22 bp, Homo sapiens
ttccagagtctggttccatggt

SEQ ID NO: 8019943 - DNA, 22 bp, Homo sapiens
ttccagagttgggggagtggtt

SEQ ID NO: 8019944 - DNA, 22 bp, Homo sapiens
ttccagagtgactgtgccactt

SEQ ID NO: 8019945 - DNA, 22 bp, Homo sapiens
ttccagctaactcacatccctt

SEQ ID NO: 8019946 - DNA, 22 bp, Homo sapiens
ttccagctaactcacatccctt

SEQ ID NO: 8019947 - DNA, 22 bp, Homo sapiens
ttccaggaaaacagttggaagt

SEQ ID NO: 8019948 - DNA, 22 bp, Homo sapiens
ttccaggaaaacagttggaagt

SEQ ID NO: 8019949 - DNA, 22 bp, Homo sapiens
ttaattaattagttaagcatgt

SEQ ID NO: 8019950 - DNA, 22 bp, Homo sapiens
ttaattaattagttaagcatgt

SEQ ID NO: 8019951 - DNA, 22 bp, Homo sapiens
ttaattaagagatactgcagta

SEQ ID NO: 8019952 - DNA, 22 bp, Homo sapiens
ttaattaattagttaagcatgt

SEQ ID NO: 8019953 - DNA, 22 bp, Homo sapiens
ttacaaagaaaattaggcattt

SEQ ID NO: 8019954 - DNA, 20 bp, Homo sapiens
ttacaaagaggcatcgcttt

SEQ ID NO: 8019955 - DNA, 22 bp, Homo sapiens
ttacaaagagaagttgtagaat

SEQ ID NO: 8019956 - DNA, 22 bp, Homo sapiens
ttacaaagagaagttgtagaat

SEQ ID NO: 8019957 - DNA, 22 bp, Homo sapiens
ttaatgttttaagttatagaga

SEQ ID NO: 8019958 - DNA, 22 bp, Homo sapiens
ttaatgttttaagttatagaga

SEQ ID NO: 8019959 - DNA, 22 bp, Homo sapiens
ttaattaaattcatgagcattg

SEQ ID NO: 8019960 - DNA, 22 bp, Homo sapiens
ttaattaaattcatgagcattg

SEQ ID NO: 8019961 - DNA, 22 bp, Homo sapiens
ttaattaaattcatgagcattg

SEQ ID NO: 8019962 - DNA, 22 bp, Homo sapiens
ttaattaaattcatgagcattg

SEQ ID NO: 8019963 - DNA, 22 bp, Homo sapiens
ttaattaactagccaaccacta

SEQ ID NO: 8019964 - DNA, 22 bp, Homo sapiens
ttaattaaattcatgagcattg

SEQ ID NO: 8019965 - DNA, 22 bp, Homo sapiens
ttaattaactagccaaccacta

SEQ ID NO: 8019966 - DNA, 22 bp, Homo sapiens
ttaattaactagccaaccacta

SEQ ID NO: 8019967 - DNA, 22 bp, Homo sapiens
ttaattaagagatactgcagta

SEQ ID NO: 8019968 - DNA, 22 bp, Homo sapiens
ttaattaagagatactgcagta

SEQ ID NO: 8019969 - DNA, 21 bp, Homo sapiens
ttacaaagctacagatgttgc

SEQ ID NO: 8019970 - DNA, 21 bp, Homo sapiens
ttacaaagctacagatgttgc

SEQ ID NO: 8019971 - DNA, 21 bp, Homo sapiens
ttacaaagctacagatgttgc

SEQ ID NO: 8019972 - DNA, 22 bp, Homo sapiens
ttacaaaggtagttttgtctat

SEQ ID NO: 8019973 - DNA, 22 bp, Homo sapiens
ttacaaagtgctgcaccatttt

SEQ ID NO: 8019974 - DNA, 22 bp, Homo sapiens
ttacaaagtgttatgataaaca

SEQ ID NO: 8019975 - DNA, 22 bp, Homo sapiens
ttacaaagtgttatgataaaca

SEQ ID NO: 8019976 - DNA, 22 bp, Homo sapiens
ttacaaagtgttatgataaaca

SEQ ID NO: 8019977 - DNA, 22 bp, Homo sapiens
ttacaaagttctgagttcaaac

SEQ ID NO: 8019978 - DNA, 22 bp, Homo sapiens
ttacaaagttctgagttcaaac

SEQ ID NO: 8019979 - DNA, 22 bp, Homo sapiens
ttacaaagtgttatgataaaca

SEQ ID NO: 8019980 - DNA, 22 bp, Homo sapiens
ttacaaagtgttatgataaaca

SEQ ID NO: 8019981 - DNA, 22 bp, Homo sapiens
ttacaaagtgttatgataaaca

SEQ ID NO: 8019982 - DNA, 22 bp, Homo sapiens
ttacaaagtttaaggtggcact

SEQ ID NO: 8019983 - DNA, 22 bp, Homo sapiens
ttacaaagttctgagttcaaac

SEQ ID NO: 8019984 - DNA, 22 bp, Homo sapiens
ttacaaagttctgagttcaaac

SEQ ID NO: 8019985 - DNA, 22 bp, Homo sapiens
ttacaacagacacatattctaa

SEQ ID NO: 8019986 - DNA, 23 bp, Homo sapiens
ttacaacagtgtccatatttgta

SEQ ID NO: 8019987 - DNA, 23 bp, Homo sapiens
ttacaacagtgtccatatttgta

SEQ ID NO: 8019988 - DNA, 23 bp, Homo sapiens
ttacaacagtgtccatatttgta

SEQ ID NO: 8019989 - DNA, 22 bp, Homo sapiens
ttacaacagcgatttacctgtc

SEQ ID NO: 8019990 - DNA, 22 bp, Homo sapiens
ttacaacactacttatccttga

SEQ ID NO: 8019991 - DNA, 22 bp, Homo sapiens
ttacaacactacttatccttga

SEQ ID NO: 8019992 - DNA, 22 bp, Homo sapiens
ttacaacagacacatattctaa

SEQ ID NO: 8019993 - DNA, 22 bp, Homo sapiens
ttacaacagacacatattctaa

SEQ ID NO: 8019994 - DNA, 22 bp, Homo sapiens
ttacaacagacacatattctaa

SEQ ID NO: 8019995 - DNA, 22 bp, Homo sapiens
ttacaacagacacatattctaa

SEQ ID NO: 8019996 - DNA, 17 bp, Homo sapiens
ttacaacaattcatgag

SEQ ID NO: 8019997 - DNA, 17 bp, Homo sapiens
ttacaacaattcatgag

SEQ ID NO: 8019998 - DNA, 22 bp, Homo sapiens
ttacaacaccaggcagtatcct

SEQ ID NO: 8019999 - DNA, 22 bp, Homo sapiens
ttacaacaccaggcagtatcct

SEQ ID NO: 8020000 - DNA, 22 bp, Homo sapiens
ttacaacaccaggcagtatcct

SEQ ID NO: 8020001 - DNA, 17 bp, Homo sapiens
ttacaacaattcatgag

SEQ ID NO: 8020002 - DNA, 17 bp, Homo sapiens
ttacaacaattcatgag

SEQ ID NO: 8020003 - DNA, 17 bp, Homo sapiens
ttacaacaattcatgag

SEQ ID NO: 8020004 - DNA, 22 bp, Homo sapiens
ttacaacaaaggcacgtgcatg

SEQ ID NO: 8020005 - DNA, 22 bp, Homo sapiens
ttacaacaaaggcacgtgcatg

SEQ ID NO: 8020006 - DNA, 22 bp, Homo sapiens
ttacaacttgcagaggatgttg

SEQ ID NO: 8020007 - DNA, 22 bp, Homo sapiens
ttacaacttgcagaggatgttg

SEQ ID NO: 8020008 - DNA, 22 bp, Homo sapiens
ttacaagacacagtgctgaagg

SEQ ID NO: 8020009 - DNA, 22 bp, Homo sapiens
ttacaagacacagtgctgaagg

SEQ ID NO: 8020010 - DNA, 22 bp, Homo sapiens
ttacaagacacagtgctgaagg

SEQ ID NO: 8020011 - DNA, 22 bp, Homo sapiens
ttacaagacacagtgctgaagg

SEQ ID NO: 8020012 - DNA, 22 bp, Homo sapiens
ttacaactggtgaattttatgg

SEQ ID NO: 8020013 - DNA, 22 bp, Homo sapiens
ttacaactgaagctaatgtgct

SEQ ID NO: 8020014 - DNA, 22 bp, Homo sapiens
ttacaactgaagctaatgtgct

SEQ ID NO: 8020015 - DNA, 22 bp, Homo sapiens
ttacaactctgaactacagagg

SEQ ID NO: 8020016 - DNA, 21 bp, Homo sapiens
ttacaacatttgtgttctatg

SEQ ID NO: 8020017 - DNA, 17 bp, Homo sapiens
ttacaacgtcatctctg

SEQ ID NO: 8020018 - DNA, 21 bp, Homo sapiens
ttacaacatttgtgttctatg

SEQ ID NO: 8020019 - DNA, 21 bp, Homo sapiens
ttacaacatttgtgttctatg

SEQ ID NO: 8020020 - DNA, 22 bp, Homo sapiens
ttacaacatatttagcttgatt

SEQ ID NO: 8020021 - DNA, 22 bp, Homo sapiens
ttacaacatatgataggagtct

SEQ ID NO: 8020022 - DNA, 22 bp, Homo sapiens
ttacaacatatttagcttgatt

SEQ ID NO: 8020023 - DNA, 22 bp, Homo sapiens
ttacaacatatgataggagtct

SEQ ID NO: 8020024 - DNA, 22 bp, Homo sapiens
ttaataaagtatgaattggaaa

SEQ ID NO: 8020025 - DNA, 22 bp, Homo sapiens
ttaataaagtatgaattggaaa

SEQ ID NO: 8020026 - DNA, 22 bp, Homo sapiens
ttaataaagtatgaattggaaa

SEQ ID NO: 8020027 - DNA, 22 bp, Homo sapiens
ttaataaagtatgaattggaaa

SEQ ID NO: 8020028 - DNA, 22 bp, Homo sapiens
ttaataaagtatgaattggaaa

SEQ ID NO: 8020029 - DNA, 22 bp, Homo sapiens
ttaataataatgagcccatttt

SEQ ID NO: 8020030 - DNA, 22 bp, Homo sapiens
ttaataataatgagcccatttt

SEQ ID NO: 8020031 - DNA, 22 bp, Homo sapiens
ttaataataatgagcccatttt

SEQ ID NO: 8020032 - DNA, 22 bp, Homo sapiens
ttaatacaactgttgtcactgg

SEQ ID NO: 8020033 - DNA, 22 bp, Homo sapiens
ttaatacaactgttgtcactgg

SEQ ID NO: 8020034 - DNA, 22 bp, Homo sapiens
ttaataacattgtgtatcaccc

SEQ ID NO: 8020035 - DNA, 22 bp, Homo sapiens
ttaataacattgtgtatcaccc

SEQ ID NO: 8020036 - DNA, 22 bp, Homo sapiens
ttaatacaagcatatgcacaca

SEQ ID NO: 8020037 - DNA, 22 bp, Homo sapiens
ttaatacaagcatatgcacaca

SEQ ID NO: 8020038 - DNA, 22 bp, Homo sapiens
ttaatacaagcatatgcacaca

SEQ ID NO: 8020039 - DNA, 22 bp, Homo sapiens
ttaatacaactgttgtcactgg

SEQ ID NO: 8020040 - DNA, 22 bp, Homo sapiens
ttaatacaactgttgtcactgg

SEQ ID NO: 8020041 - DNA, 22 bp, Homo sapiens
ttaatacaactgttgtcactgg

SEQ ID NO: 8020042 - DNA, 22 bp, Homo sapiens
ttaatacaactgttgtcactgg

SEQ ID NO: 8020043 - DNA, 22 bp, Homo sapiens
ttaatacaactgttgtcactgg

SEQ ID NO: 8020044 - DNA, 22 bp, Homo sapiens
ttaatacaagcatatgcacaca

SEQ ID NO: 8020045 - DNA, 22 bp, Homo sapiens
ttaatacaagcatatgcacaca

SEQ ID NO: 8020046 - DNA, 22 bp, Homo sapiens
ttaatacaagcatatgcacaca

SEQ ID NO: 8020047 - DNA, 22 bp, Homo sapiens
ttaatacactatatgatcacat

SEQ ID NO: 8020048 - DNA, 22 bp, Homo sapiens
ttaatacactatatgatcacat

SEQ ID NO: 8020049 - DNA, 22 bp, Homo sapiens
ttaatacaagcatatgcacaca

SEQ ID NO: 8020050 - DNA, 22 bp, Homo sapiens
ttaatacaagcatatgcacaca

SEQ ID NO: 8020051 - DNA, 22 bp, Homo sapiens
ttaatacaagcatatgcacaca

SEQ ID NO: 8020052 - DNA, 21 bp, Homo sapiens
ttaatgctatgcagaaaatct

SEQ ID NO: 8020053 - DNA, 22 bp, Homo sapiens
ttaatacatttcagactgttat

SEQ ID NO: 8020054 - DNA, 22 bp, Homo sapiens
ttaatacatttcagactgttat

SEQ ID NO: 8020055 - DNA, 22 bp, Homo sapiens
ttaatgcttgtctagatcttct

SEQ ID NO: 8020056 - DNA, 22 bp, Homo sapiens
ttaatggaacagcatgcataga

SEQ ID NO: 8020057 - DNA, 22 bp, Homo sapiens
ttaatgcttacagtgtcctgcg

SEQ ID NO: 8020058 - DNA, 21 bp, Homo sapiens
ttaatgctatgcagaaaatct

SEQ ID NO: 8020059 - DNA, 22 bp, Homo sapiens
ttaatggccccattttatgtct

SEQ ID NO: 8020060 - DNA, 22 bp, Homo sapiens
ttaatggcagggcagaatatta

SEQ ID NO: 8020061 - DNA, 22 bp, Homo sapiens
ttaatggcagggcagaatatta

SEQ ID NO: 8020062 - DNA, 22 bp, Homo sapiens
ttaatggcagggcagaatatta

SEQ ID NO: 8020063 - DNA, 22 bp, Homo sapiens
ttaatgtcaacatttctgaaga

SEQ ID NO: 8020064 - DNA, 22 bp, Homo sapiens
ttaatacactatatgatcacat

SEQ ID NO: 8020065 - DNA, 22 bp, Homo sapiens
ttaatacactatatgatcacat

SEQ ID NO: 8020066 - DNA, 22 bp, Homo sapiens
ttaatacagaagcaagacactg

SEQ ID NO: 8020067 - DNA, 22 bp, Homo sapiens
ttaatacagaagcaagacactg

SEQ ID NO: 8020068 - DNA, 22 bp, Homo sapiens
ttaatacagaagcaagacactg

SEQ ID NO: 8020069 - DNA, 22 bp, Homo sapiens
ttaatacagtctccagaagtaa

SEQ ID NO: 8020070 - DNA, 22 bp, Homo sapiens
ttaatacagtctccagaagtaa

SEQ ID NO: 8020071 - DNA, 22 bp, Homo sapiens
ttaatacagtctccagaagtaa

SEQ ID NO: 8020072 - DNA, 22 bp, Homo sapiens
ttaatacagtctccagaagtaa

SEQ ID NO: 8020073 - DNA, 22 bp, Homo sapiens
ttaatacagtctccagaagtaa

SEQ ID NO: 8020074 - DNA, 22 bp, Homo sapiens
ttaatacatttcagactgttat

SEQ ID NO: 8020075 - DNA, 22 bp, Homo sapiens
ttaataaagtatgaattggaaa

SEQ ID NO: 8020076 - DNA, 22 bp, Homo sapiens
ttaataaagtatgaattggaaa

SEQ ID NO: 8020077 - DNA, 22 bp, Homo sapiens
ttaataaagtatgaattggaaa

SEQ ID NO: 8020078 - DNA, 22 bp, Homo sapiens
ttaataaagtatgaattggaaa

SEQ ID NO: 8020079 - DNA, 22 bp, Homo sapiens
ttaataaagtatgaattggaaa

SEQ ID NO: 8020080 - DNA, 22 bp, Homo sapiens
ttaataaagtatgaattggaaa

SEQ ID NO: 8020081 - DNA, 22 bp, Homo sapiens
ttaaagcactaaatgatgaggg

SEQ ID NO: 8020082 - DNA, 22 bp, Homo sapiens
ttaaagcacctccttggatgtg

SEQ ID NO: 8020083 - DNA, 22 bp, Homo sapiens
ttaaagcacctccttggatgtg

SEQ ID NO: 8020084 - DNA, 22 bp, Homo sapiens
ttaaagcaggcatcattcctca

SEQ ID NO: 8020085 - DNA, 22 bp, Homo sapiens
ttaaagcaggcatcattcctca

SEQ ID NO: 8020086 - DNA, 22 bp, Homo sapiens
ttaaagcagtttgtatacatgg

SEQ ID NO: 8020087 - DNA, 22 bp, Homo sapiens
ttaaagagtttattacttgtaa

SEQ ID NO: 8020088 - DNA, 22 bp, Homo sapiens
ttaaagatgcagctttagagaa

SEQ ID NO: 8020089 - DNA, 22 bp, Homo sapiens
ttaaagcaagtagaagcctgag

SEQ ID NO: 8020090 - DNA, 22 bp, Homo sapiens
ttaaagcaacctcagccctctt

SEQ ID NO: 8020091 - DNA, 22 bp, Homo sapiens
ttaaagcaacctcagccctctt

SEQ ID NO: 8020092 - DNA, 22 bp, Homo sapiens
ttaaagcaaccatcaatttgga

SEQ ID NO: 8020093 - DNA, 22 bp, Homo sapiens
ttaaagcaaaaactaggatgga

SEQ ID NO: 8020094 - DNA, 22 bp, Homo sapiens
ttaaagcaaccatcaatttgga

SEQ ID NO: 8020095 - DNA, 22 bp, Homo sapiens
ttaaagaggcaggttaaataat

SEQ ID NO: 8020096 - DNA, 22 bp, Homo sapiens
ttaaagaggcaggttaaataat

SEQ ID NO: 8020097 - DNA, 22 bp, Homo sapiens
ttaaagagaactcaatgaatga

SEQ ID NO: 8020098 - DNA, 22 bp, Homo sapiens
ttaaagaggcatgggaatgtat

SEQ ID NO: 8020099 - DNA, 22 bp, Homo sapiens
ttaaagaggcatgggaatgtat

SEQ ID NO: 8020100 - DNA, 22 bp, Homo sapiens
ttaaagaggcatgggaatgtat

SEQ ID NO: 8020101 - DNA, 22 bp, Homo sapiens
ttaaagagtctactgcacatcc

SEQ ID NO: 8020102 - DNA, 22 bp, Homo sapiens
ttaaagagtctactgcacatcc

SEQ ID NO: 8020103 - DNA, 22 bp, Homo sapiens
ttaaagagtaatcataggtcaa

SEQ ID NO: 8020104 - DNA, 22 bp, Homo sapiens
ttaaagagtaatcataggtcaa

SEQ ID NO: 8020105 - DNA, 22 bp, Homo sapiens
ttaaagaggtagttaggtttaa

SEQ ID NO: 8020106 - DNA, 22 bp, Homo sapiens
ttaaagagggaaagacttcaga

SEQ ID NO: 8020107 - DNA, 22 bp, Homo sapiens
ttaaactgcagactcagtgttc

SEQ ID NO: 8020108 - DNA, 22 bp, Homo sapiens
ttaaactgcttgaattgggttt

SEQ ID NO: 8020109 - DNA, 22 bp, Homo sapiens
ttaaactgcagactcagtgttc

SEQ ID NO: 8020110 - DNA, 22 bp, Homo sapiens
ttaaaccatagtttaacataag

SEQ ID NO: 8020111 - DNA, 22 bp, Homo sapiens
ttaaagagaactcaatgaatga

SEQ ID NO: 8020112 - DNA, 22 bp, Homo sapiens
ttaaagagaactcaatgaatga

SEQ ID NO: 8020113 - DNA, 22 bp, Homo sapiens
ttaaagagaactcaatgaatga

SEQ ID NO: 8020114 - DNA, 22 bp, Homo sapiens
ttaaagagaaagtgtttgtctt

SEQ ID NO: 8020115 - DNA, 22 bp, Homo sapiens
ttaaagaatagtgcccctattg

SEQ ID NO: 8020116 - DNA, 22 bp, Homo sapiens
ttacaattgagtctattgtatg

SEQ ID NO: 8020117 - DNA, 22 bp, Homo sapiens
ttacaattgagtctattgtatg

SEQ ID NO: 8020118 - DNA, 22 bp, Homo sapiens
ttacaattgagtctattgtatg

SEQ ID NO: 8020119 - DNA, 22 bp, Homo sapiens
ttacaatgtaaggcatggttct

SEQ ID NO: 8020120 - DNA, 22 bp, Homo sapiens
ttacaattgagtctattgtatg

SEQ ID NO: 8020121 - DNA, 22 bp, Homo sapiens
ttacaattgagtctattgtatg

SEQ ID NO: 8020122 - DNA, 22 bp, Homo sapiens
ttacaatgggtatacttccatt

SEQ ID NO: 8020123 - DNA, 22 bp, Homo sapiens
ttacaattacttgatctcagct

SEQ ID NO: 8020124 - DNA, 22 bp, Homo sapiens
ttacaattacttgatctcagct

SEQ ID NO: 8020125 - DNA, 22 bp, Homo sapiens
ttacaatgatgggattcagcca

SEQ ID NO: 8020126 - DNA, 22 bp, Homo sapiens
ttacaagtactgaatatgattt

SEQ ID NO: 8020127 - DNA, 22 bp, Homo sapiens
ttacaagtactgaatatgattt

SEQ ID NO: 8020128 - DNA, 22 bp, Homo sapiens
ttacaagtactgaatatgattt

SEQ ID NO: 8020129 - DNA, 22 bp, Homo sapiens
ttacaagtactgaatatgattt

SEQ ID NO: 8020130 - DNA, 22 bp, Homo sapiens
ttacaagtactgaatatgattt

SEQ ID NO: 8020131 - DNA, 21 bp, Homo sapiens
ttacaatgcattttctttggc

SEQ ID NO: 8020132 - DNA, 22 bp, Homo sapiens
ttacaatgggagcccttggact

SEQ ID NO: 8020133 - DNA, 19 bp, Homo sapiens
ttacaagcattgaaagaaa

SEQ ID NO: 8020134 - DNA, 22 bp, Homo sapiens
ttacaaggaggatagcatttcc

SEQ ID NO: 8020135 - DNA, 22 bp, Homo sapiens
ttacaagggtcagtgtgtttgt

SEQ ID NO: 8020136 - DNA, 20 bp, Homo sapiens
ttacaaggtagaggagggaa

SEQ ID NO: 8020137 - DNA, 22 bp, Homo sapiens
ttacaagacagtgtggtaaata

SEQ ID NO: 8020138 - DNA, 22 bp, Homo sapiens
ttacaagacagtgtggtaaata

SEQ ID NO: 8020139 - DNA, 22 bp, Homo sapiens
ttacaagacactgctgacacag

SEQ ID NO: 8020140 - DNA, 22 bp, Homo sapiens
ttacaagacacagtgctgaagg

SEQ ID NO: 8020141 - DNA, 22 bp, Homo sapiens
ttacaagacagtgtggtaaata

SEQ ID NO: 8020142 - DNA, 22 bp, Homo sapiens
ttacaagataacctgatgctgt

SEQ ID NO: 8020143 - DNA, 22 bp, Homo sapiens
ttacaagataacctgatgctgt

SEQ ID NO: 8020144 - DNA, 22 bp, Homo sapiens
ttacaagatatgtgagaactag

SEQ ID NO: 8020145 - DNA, 22 bp, Homo sapiens
ttacaagatatgtgagaactag

SEQ ID NO: 8020146 - DNA, 22 bp, Homo sapiens
ttacaagatatgtgagaactag

SEQ ID NO: 8020147 - DNA, 22 bp, Homo sapiens
ttacaagatatgtgagaactag

SEQ ID NO: 8020148 - DNA, 22 bp, Homo sapiens
ttacaagataacggagaaagca

SEQ ID NO: 8020149 - DNA, 22 bp, Homo sapiens
ttacaagataacggagaaagca

SEQ ID NO: 8020150 - DNA, 22 bp, Homo sapiens
ttacaagataacctgatgctgt

SEQ ID NO: 8020151 - DNA, 22 bp, Homo sapiens
ttacaagcagctacatatcaca

SEQ ID NO: 8020152 - DNA, 22 bp, Homo sapiens
ttacaagattaattattggagt

SEQ ID NO: 8020153 - DNA, 22 bp, Homo sapiens
ttacaagattgatttgcttggc

SEQ ID NO: 8020154 - DNA, 22 bp, Homo sapiens
ttacaagatctttgaaggcaag

SEQ ID NO: 8020155 - DNA, 22 bp, Homo sapiens
ttacaagatctttgaaggcaag

SEQ ID NO: 8020156 - DNA, 22 bp, Homo sapiens
ttacaagatgggaaagggaagt

SEQ ID NO: 8020157 - DNA, 22 bp, Homo sapiens
ttacaagatgggaaagggaagt

SEQ ID NO: 8020158 - DNA, 22 bp, Homo sapiens
ttacaagatgggaaagggaagt

SEQ ID NO: 8020159 - DNA, 22 bp, Homo sapiens
ttacaagatatgtgagaactag

SEQ ID NO: 8020160 - DNA, 22 bp, Homo sapiens
ttacaagatatgtgagaactag

SEQ ID NO: 8020161 - DNA, 22 bp, Homo sapiens
ttacaagatctttgaaggcaag

SEQ ID NO: 8020162 - DNA, 22 bp, Homo sapiens
ttacacaaaaataagatatggc

SEQ ID NO: 8020163 - DNA, 22 bp, Homo sapiens
ttacacaaaaataagatatggc

SEQ ID NO: 8020164 - DNA, 22 bp, Homo sapiens
ttacacaaaaataagatatggc

SEQ ID NO: 8020165 - DNA, 22 bp, Homo sapiens
ttacacaaaaataagatatggc

SEQ ID NO: 8020166 - DNA, 22 bp, Homo sapiens
ttacacttttgacaaacctgag

SEQ ID NO: 8020167 - DNA, 22 bp, Homo sapiens
ttacacaaacacattccagata

SEQ ID NO: 8020168 - DNA, 22 bp, Homo sapiens
ttacacaaaagcaagtgtgtgt

SEQ ID NO: 8020169 - DNA, 22 bp, Homo sapiens
ttacagaaaatgtgttttaact

SEQ ID NO: 8020170 - DNA, 22 bp, Homo sapiens
ttacagaatctactcgtggtga

SEQ ID NO: 8020171 - DNA, 22 bp, Homo sapiens
ttacagaaaagggctttaagag

SEQ ID NO: 8020172 - DNA, 22 bp, Homo sapiens
ttacagaaaagggctttaagag

SEQ ID NO: 8020173 - DNA, 22 bp, Homo sapiens
ttacagaaaagggctttaagag

SEQ ID NO: 8020174 - DNA, 22 bp, Homo sapiens
ttacagaaaaggggttgtcctt

SEQ ID NO: 8020175 - DNA, 22 bp, Homo sapiens
ttacagaatgtgccatttggtc

SEQ ID NO: 8020176 - DNA, 22 bp, Homo sapiens
ttacagaaaatgtgttttaact

SEQ ID NO: 8020177 - DNA, 22 bp, Homo sapiens
ttacagaatgtgccatttggtc

SEQ ID NO: 8020178 - DNA, 22 bp, Homo sapiens
ttacagaatgtgccatttggtc

SEQ ID NO: 8020179 - DNA, 22 bp, Homo sapiens
ttacagaatgttcttccaacag

SEQ ID NO: 8020180 - DNA, 22 bp, Homo sapiens
ttacagaatgttcttccaacag

SEQ ID NO: 8020181 - DNA, 22 bp, Homo sapiens
ttacagatacatttcttttgtt

SEQ ID NO: 8020182 - DNA, 22 bp, Homo sapiens
ttacagatacatttcttttgtt

SEQ ID NO: 8020183 - DNA, 22 bp, Homo sapiens
ttacagagtggtctggctatgt

SEQ ID NO: 8020184 - DNA, 22 bp, Homo sapiens
ttacagagtagtgcagaactca

SEQ ID NO: 8020185 - DNA, 22 bp, Homo sapiens
ttacagagctcatttctaaggg

SEQ ID NO: 8020186 - DNA, 22 bp, Homo sapiens
ttacatttggctatgtcctcta

SEQ ID NO: 8020187 - DNA, 22 bp, Homo sapiens
ttacattttagttaacctgtga

SEQ ID NO: 8020188 - DNA, 22 bp, Homo sapiens
ttacattttagttaacctgtga

SEQ ID NO: 8020189 - DNA, 22 bp, Homo sapiens
ttacattttagttaacctgtga

SEQ ID NO: 8020190 - DNA, 22 bp, Homo sapiens
ttacattttagttaacctgtga

SEQ ID NO: 8020191 - DNA, 22 bp, Homo sapiens
ttacattttgcacagatgtccc

SEQ ID NO: 8020192 - DNA, 22 bp, Homo sapiens
ttacatttcccccttggaggct

SEQ ID NO: 8020193 - DNA, 22 bp, Homo sapiens
ttacattgtccagaaattattg

SEQ ID NO: 8020194 - DNA, 22 bp, Homo sapiens
ttacatttggctatgtcctcta

SEQ ID NO: 8020195 - DNA, 22 bp, Homo sapiens
ttacatttggctatgtcctcta

SEQ ID NO: 8020196 - DNA, 22 bp, Homo sapiens
ttacatttggctatgtcctcta

SEQ ID NO: 8020197 - DNA, 22 bp, Homo sapiens
ttacattcaaggaactcattct

SEQ ID NO: 8020198 - DNA, 22 bp, Homo sapiens
ttacattcaatttctagaggta

SEQ ID NO: 8020199 - DNA, 22 bp, Homo sapiens
ttacattaggtcaagctgccaa

SEQ ID NO: 8020200 - DNA, 22 bp, Homo sapiens
ttacattcaaggaactcattct

SEQ ID NO: 8020201 - DNA, 22 bp, Homo sapiens
ttacattcagaaagatttgagt

SEQ ID NO: 8020202 - DNA, 21 bp, Homo sapiens
ttacattcagaggagtggaag

SEQ ID NO: 8020203 - DNA, 21 bp, Homo sapiens
ttacattcagaggagtggaag

SEQ ID NO: 8020204 - DNA, 22 bp, Homo sapiens
ttacattcaatttctagaggta

SEQ ID NO: 8020205 - DNA, 22 bp, Homo sapiens
ttacattcaatttctagaggta

SEQ ID NO: 8020206 - DNA, 22 bp, Homo sapiens
ttacattcagaaagatttgagt

SEQ ID NO: 8020207 - DNA, 22 bp, Homo sapiens
ttacattcattgaagtgattca

SEQ ID NO: 8020208 - DNA, 22 bp, Homo sapiens
ttacattcccagtgtgcagcat

SEQ ID NO: 8020209 - DNA, 22 bp, Homo sapiens
ttacattcccagtgtgcagcat

SEQ ID NO: 8020210 - DNA, 21 bp, Homo sapiens
ttacattcagaggagtggaag

SEQ ID NO: 8020211 - DNA, 22 bp, Homo sapiens
ttacattcattgaagtgattca

SEQ ID NO: 8020212 - DNA, 22 bp, Homo sapiens
ttacattcattgaagtgattca

SEQ ID NO: 8020213 - DNA, 22 bp, Homo sapiens
ttacattcttatctcagttatt

SEQ ID NO: 8020214 - DNA, 22 bp, Homo sapiens
ttacattcttggaatcttgttt

SEQ ID NO: 8020215 - DNA, 22 bp, Homo sapiens
ttacattcttatctcagttatt

SEQ ID NO: 8020216 - DNA, 22 bp, Homo sapiens
ttacattcttggaatcttgttt

SEQ ID NO: 8020217 - DNA, 22 bp, Homo sapiens
ttacattgtccagaaattattg

SEQ ID NO: 8020218 - DNA, 22 bp, Homo sapiens
ttacatgtggtgtgaagaagag

SEQ ID NO: 8020219 - DNA, 22 bp, Homo sapiens
ttacatgtggtgtgaagaagag

SEQ ID NO: 8020220 - DNA, 22 bp, Homo sapiens
ttacatgtggtgtgaagaagag

SEQ ID NO: 8020221 - DNA, 22 bp, Homo sapiens
ttacatgtggagtctgattgca

SEQ ID NO: 8020222 - DNA, 22 bp, Homo sapiens
ttacatgtattttggaaaaagt

SEQ ID NO: 8020223 - DNA, 22 bp, Homo sapiens
ttacatgtactggtttgactta

SEQ ID NO: 8020224 - DNA, 22 bp, Homo sapiens
ttacatgtacaaacaattctta

SEQ ID NO: 8020225 - DNA, 22 bp, Homo sapiens
ttacatgtactggtttgactta

SEQ ID NO: 8020226 - DNA, 22 bp, Homo sapiens
ttacatgtactggtttgactta

SEQ ID NO: 8020227 - DNA, 22 bp, Homo sapiens
ttacatgtattttggaaaaagt

SEQ ID NO: 8020228 - DNA, 22 bp, Homo sapiens
ttacatgtaatctaaaataatt

SEQ ID NO: 8020229 - DNA, 22 bp, Homo sapiens
ttacatgtaatctaaaataatt

SEQ ID NO: 8020230 - DNA, 22 bp, Homo sapiens
ttacatgtaatctaaaataatt

SEQ ID NO: 8020231 - DNA, 22 bp, Homo sapiens
ttacatgtaatctaaaataatt

SEQ ID NO: 8020232 - DNA, 22 bp, Homo sapiens
ttacatgtaatctaaaataatt

SEQ ID NO: 8020233 - DNA, 21 bp, Homo sapiens
ttacatggtttatcatatgga

SEQ ID NO: 8020234 - DNA, 22 bp, Homo sapiens
ttacatgttctcatacacagag

SEQ ID NO: 8020235 - DNA, 23 bp, Homo sapiens
ttacatgtgtgcacacattctgg

SEQ ID NO: 8020236 - DNA, 23 bp, Homo sapiens
ttacatgtgtgcacacattctgg

SEQ ID NO: 8020237 - DNA, 22 bp, Homo sapiens
ttacatgtttatgggggtacat

SEQ ID NO: 8020238 - DNA, 22 bp, Homo sapiens
ttacatgtttacggatacactt

SEQ ID NO: 8020239 - DNA, 22 bp, Homo sapiens
ttacatgttctcatacacagag

SEQ ID NO: 8020240 - DNA, 22 bp, Homo sapiens
ttacattaagccaatggattct

SEQ ID NO: 8020241 - DNA, 22 bp, Homo sapiens
ttacattagacccactttcatg

SEQ ID NO: 8020242 - DNA, 22 bp, Homo sapiens
ttacattaagccaatggattct

SEQ ID NO: 8020243 - DNA, 22 bp, Homo sapiens
ttacattagacccactttcatg

SEQ ID NO: 8020244 - DNA, 21 bp, Homo sapiens
ttacagcaatgttagcaggaa

SEQ ID NO: 8020245 - DNA, 21 bp, Homo sapiens
ttacagcaatgttagcaggaa

SEQ ID NO: 8020246 - DNA, 22 bp, Homo sapiens
ttacagcacagtgcttttactg

SEQ ID NO: 8020247 - DNA, 22 bp, Homo sapiens
ttacagcaaagtgcgcagacct

SEQ ID NO: 8020248 - DNA, 17 bp, Homo sapiens
ttacagcagcaatagag

SEQ ID NO: 8020249 - DNA, 18 bp, Homo sapiens
ttacagcagcaacaggaa

SEQ ID NO: 8020250 - DNA, 22 bp, Homo sapiens
ttacagattaaaatgctgaggt

SEQ ID NO: 8020251 - DNA, 22 bp, Homo sapiens
ttacagattaaaatgctgaggt

SEQ ID NO: 8020252 - DNA, 22 bp, Homo sapiens
ttacagatgtttcaggaatact

SEQ ID NO: 8020253 - DNA, 22 bp, Homo sapiens
ttacagatggggttgcaataaa

SEQ ID NO: 8020254 - DNA, 22 bp, Homo sapiens
ttacagatggggttgcaataaa

SEQ ID NO: 8020255 - DNA, 22 bp, Homo sapiens
ttacagatggcagtttcttgag

SEQ ID NO: 8020256 - DNA, 22 bp, Homo sapiens
ttacagatggatctagcaaaat

SEQ ID NO: 8020257 - DNA, 22 bp, Homo sapiens
ttacagatcatcaaggtataat

SEQ ID NO: 8020258 - DNA, 22 bp, Homo sapiens
ttacagatggatctagcaaaat

SEQ ID NO: 8020259 - DNA, 22 bp, Homo sapiens
ttacagatggatctagcaaaat

SEQ ID NO: 8020260 - DNA, 22 bp, Homo sapiens
ttacagcatttaatgagatctg

SEQ ID NO: 8020261 - DNA, 22 bp, Homo sapiens
ttacagcagtgggaaggagtca

SEQ ID NO: 8020262 - DNA, 22 bp, Homo sapiens
ttacagcagcagggacagacta

SEQ ID NO: 8020263 - DNA, 22 bp, Homo sapiens
ttacagcagcagggacagacta

SEQ ID NO: 8020264 - DNA, 22 bp, Homo sapiens
ttacagcagcagggacagacta

SEQ ID NO: 8020265 - DNA, 22 bp, Homo sapiens
ttacatgactgcccttgtcagg

SEQ ID NO: 8020266 - DNA, 19 bp, Homo sapiens
ttacatgacatatgaagga

SEQ ID NO: 8020267 - DNA, 22 bp, Homo sapiens
ttacagctagccaattatttag

SEQ ID NO: 8020268 - DNA, 22 bp, Homo sapiens
ttacagctagccaattatttag

SEQ ID NO: 8020269 - DNA, 23 bp, Homo sapiens
ttacagctaactgctgttattag

SEQ ID NO: 8020270 - DNA, 23 bp, Homo sapiens
ttacagctaactgctgttattag

SEQ ID NO: 8020271 - DNA, 22 bp, Homo sapiens
ttacagctagccaattatttag

SEQ ID NO: 8020272 - DNA, 22 bp, Homo sapiens
ttacatgggccatttagacatg

SEQ ID NO: 8020273 - DNA, 22 bp, Homo sapiens
ttacatgggcttgtgagtcctt

SEQ ID NO: 8020274 - DNA, 22 bp, Homo sapiens
ttacatgctctgtgtgtctccg

SEQ ID NO: 8020275 - DNA, 22 bp, Homo sapiens
ttacatgcatatatgtgtgtgt

SEQ ID NO: 8020276 - DNA, 22 bp, Homo sapiens
ttacatgcaggtcagactgcat

SEQ ID NO: 8020277 - DNA, 22 bp, Homo sapiens
ttacatgcatatatgtgtgtgt

SEQ ID NO: 8020278 - DNA, 22 bp, Homo sapiens
ttacatgatgatttcataaaca

SEQ ID NO: 8020279 - DNA, 22 bp, Homo sapiens
ttacatgatgatttcataaaca

SEQ ID NO: 8020280 - DNA, 22 bp, Homo sapiens
ttacatgcagagggaagggaga

SEQ ID NO: 8020281 - DNA, 22 bp, Homo sapiens
ttacatgatgatttcataaaca

SEQ ID NO: 8020282 - DNA, 22 bp, Homo sapiens
ttacatgatgatttcataaaca

SEQ ID NO: 8020283 - DNA, 22 bp, Homo sapiens
ttacatgaggttaattaagcat

SEQ ID NO: 8020284 - DNA, 22 bp, Homo sapiens
ttacatgactgcccttgtcagg

SEQ ID NO: 8020285 - DNA, 22 bp, Homo sapiens
ttagcaggaagagttggctgga

SEQ ID NO: 8020286 - DNA, 22 bp, Homo sapiens
ttagcaggtttctggctcttgg

SEQ ID NO: 8020287 - DNA, 22 bp, Homo sapiens
ttagcagttcattgattatcgt

SEQ ID NO: 8020288 - DNA, 22 bp, Homo sapiens
ttagcagtcacagtgctaacat

SEQ ID NO: 8020289 - DNA, 22 bp, Homo sapiens
ttagcagcttttaaatggttct

SEQ ID NO: 8020290 - DNA, 22 bp, Homo sapiens
ttagcagcttagactgcctggg

SEQ ID NO: 8020291 - DNA, 22 bp, Homo sapiens
ttagcagcttagactgcctggg

SEQ ID NO: 8020292 - DNA, 22 bp, Homo sapiens
ttagcattctgcctcctatatc

SEQ ID NO: 8020293 - DNA, 22 bp, Homo sapiens
ttagcaaacctggactacagat

SEQ ID NO: 8020294 - DNA, 22 bp, Homo sapiens
ttagcaaacctggactacagat

SEQ ID NO: 8020295 - DNA, 22 bp, Homo sapiens
ttagcactttgattcatgcaga

SEQ ID NO: 8020296 - DNA, 22 bp, Homo sapiens
ttagcactgtctggttatcttg

SEQ ID NO: 8020297 - DNA, 22 bp, Homo sapiens
ttagcagcatccctggcctgta

SEQ ID NO: 8020298 - DNA, 22 bp, Homo sapiens
ttagcagcaatggcatcaacta

SEQ ID NO: 8020299 - DNA, 22 bp, Homo sapiens
ttagcagctaaactgacagacc

SEQ ID NO: 8020300 - DNA, 22 bp, Homo sapiens
ttagcagcggtcagttttgaag

SEQ ID NO: 8020301 - DNA, 22 bp, Homo sapiens
ttagcagcatccctggcctgta

SEQ ID NO: 8020302 - DNA, 22 bp, Homo sapiens
ttagcagctaagtcatgctgca

SEQ ID NO: 8020303 - DNA, 22 bp, Homo sapiens
ttagcagctaaactgacagacc

SEQ ID NO: 8020304 - DNA, 22 bp, Homo sapiens
ttagcagctaagtcatgctgca

SEQ ID NO: 8020305 - DNA, 22 bp, Homo sapiens
ttagatttacaagcactgttta

SEQ ID NO: 8020306 - DNA, 22 bp, Homo sapiens
ttagatttacaagcactgttta

SEQ ID NO: 8020307 - DNA, 22 bp, Homo sapiens
ttagatttacaagcactgttta

SEQ ID NO: 8020308 - DNA, 22 bp, Homo sapiens
ttagattattgagcatccactg

SEQ ID NO: 8020309 - DNA, 22 bp, Homo sapiens
ttagatttatatgtgagaatgg

SEQ ID NO: 8020310 - DNA, 22 bp, Homo sapiens
ttagatttatatgtgagaatgg

SEQ ID NO: 8020311 - DNA, 22 bp, Homo sapiens
ttagatttatatgtgagaatgg

SEQ ID NO: 8020312 - DNA, 22 bp, Homo sapiens
ttagatttatatgtgagaatgg

SEQ ID NO: 8020313 - DNA, 22 bp, Homo sapiens
ttagatgtgcaggacttttatc

SEQ ID NO: 8020314 - DNA, 22 bp, Homo sapiens
ttagatcattttgaactaattt

SEQ ID NO: 8020315 - DNA, 22 bp, Homo sapiens
ttagatcattttgaactaattt

SEQ ID NO: 8020316 - DNA, 22 bp, Homo sapiens
ttagatgactgaaaagagcaca

SEQ ID NO: 8020317 - DNA, 22 bp, Homo sapiens
ttagatgtggacttatgttatt

SEQ ID NO: 8020318 - DNA, 22 bp, Homo sapiens
ttagatgttcactctatccccc

SEQ ID NO: 8020319 - DNA, 22 bp, Homo sapiens
ttagatttatatgtgagaatgg

SEQ ID NO: 8020320 - DNA, 22 bp, Homo sapiens
ttagattttaagaagggaggta

SEQ ID NO: 8020321 - DNA, 22 bp, Homo sapiens
ttagatttgtagtgagttcaga

SEQ ID NO: 8020322 - DNA, 22 bp, Homo sapiens
ttagcaaaaatatctcatatta

SEQ ID NO: 8020323 - DNA, 22 bp, Homo sapiens
ttagcaaaaatatctcatatta

SEQ ID NO: 8020324 - DNA, 22 bp, Homo sapiens
ttagcaaaaatatctcatatta

SEQ ID NO: 8020325 - DNA, 22 bp, Homo sapiens
ttagcaaaaatatctcatatta

SEQ ID NO: 8020326 - DNA, 17 bp, Homo sapiens
ttagcaaaatagcactt

SEQ ID NO: 8020327 - DNA, 17 bp, Homo sapiens
ttagcaaaatagcactt

SEQ ID NO: 8020328 - DNA, 17 bp, Homo sapiens
ttagcaaaatagcactt

SEQ ID NO: 8020329 - DNA, 22 bp, Homo sapiens
ttagcaaacctggactacagat

SEQ ID NO: 8020330 - DNA, 22 bp, Homo sapiens
ttagcaaacccttgctggtgag

SEQ ID NO: 8020331 - DNA, 22 bp, Homo sapiens
ttagcaaacatcttcgtgtgag

SEQ ID NO: 8020332 - DNA, 22 bp, Homo sapiens
ttagcaaacaaatgaaatggtt

SEQ ID NO: 8020333 - DNA, 22 bp, Homo sapiens
ttagcaaacaaatgaaatggtt

SEQ ID NO: 8020334 - DNA, 22 bp, Homo sapiens
ttagcaaacaaatgaaatggtt

SEQ ID NO: 8020335 - DNA, 22 bp, Homo sapiens
ttagcaaacaaatgaaatggtt

SEQ ID NO: 8020336 - DNA, 17 bp, Homo sapiens
ttagcaaaatagcactt

SEQ ID NO: 8020337 - DNA, 17 bp, Homo sapiens
ttagcaaaatagcactt

SEQ ID NO: 8020338 - DNA, 22 bp, Homo sapiens
ttaggaagaaggaggcagtatt

SEQ ID NO: 8020339 - DNA, 22 bp, Homo sapiens
ttaggaaattccacctgtattc

SEQ ID NO: 8020340 - DNA, 22 bp, Homo sapiens
ttaggaacttctgtctcagtgt

SEQ ID NO: 8020341 - DNA, 22 bp, Homo sapiens
ttaggaagaaggaggcagtatt

SEQ ID NO: 8020342 - DNA, 22 bp, Homo sapiens
ttaggaagagctttcaatcact

SEQ ID NO: 8020343 - DNA, 22 bp, Homo sapiens
ttagcatttctggaatcacaag

SEQ ID NO: 8020344 - DNA, 22 bp, Homo sapiens
ttaggaaattccacctgtattc

SEQ ID NO: 8020345 - DNA, 22 bp, Homo sapiens
ttagcatttcagtacacatgtt

SEQ ID NO: 8020346 - DNA, 22 bp, Homo sapiens
ttagcatttcagtacacatgtt

SEQ ID NO: 8020347 - DNA, 22 bp, Homo sapiens
ttagcatttcagtacacatgtt

SEQ ID NO: 8020348 - DNA, 22 bp, Homo sapiens
ttagggaaggctgctgtcagct

SEQ ID NO: 8020349 - DNA, 22 bp, Homo sapiens
ttagggaagtgttattctcagg

SEQ ID NO: 8020350 - DNA, 22 bp, Homo sapiens
ttagggaagtgttattctcagg

SEQ ID NO: 8020351 - DNA, 22 bp, Homo sapiens
ttagggagctcagtcctcagat

SEQ ID NO: 8020352 - DNA, 22 bp, Homo sapiens
ttagggttacaccagcctcctg

SEQ ID NO: 8020353 - DNA, 22 bp, Homo sapiens
ttagggttacaccagcctcctg

SEQ ID NO: 8020354 - DNA, 22 bp, Homo sapiens
ttagggttacaccagcctcctg

SEQ ID NO: 8020355 - DNA, 22 bp, Homo sapiens
ttagggcttttctgaataggcc

SEQ ID NO: 8020356 - DNA, 22 bp, Homo sapiens
ttagggaaatatttatatactt

SEQ ID NO: 8020357 - DNA, 22 bp, Homo sapiens
ttagggaaatatttatatactt

SEQ ID NO: 8020358 - DNA, 22 bp, Homo sapiens
ttaggaagcaggcctaaaattt

SEQ ID NO: 8020359 - DNA, 22 bp, Homo sapiens
ttagggaagtgttattctcagg

SEQ ID NO: 8020360 - DNA, 22 bp, Homo sapiens
ttagggaaggacagtgaagaaa

SEQ ID NO: 8020361 - DNA, 22 bp, Homo sapiens
ttagggaaatattgtaggttag

SEQ ID NO: 8020362 - DNA, 22 bp, Homo sapiens
ttagggaaatatttatatactt

SEQ ID NO: 8020363 - DNA, 22 bp, Homo sapiens
ttagggaactctcatcgtgaag

SEQ ID NO: 8020364 - DNA, 22 bp, Homo sapiens
ttagggaagcatggaggagatg

SEQ ID NO: 8020365 - DNA, 22 bp, Homo sapiens
ttagtaattagaaagtaattct

SEQ ID NO: 8020366 - DNA, 22 bp, Homo sapiens
ttagtaattagaaagtaattct

SEQ ID NO: 8020367 - DNA, 22 bp, Homo sapiens
ttagtaattagaaagtaattct

SEQ ID NO: 8020368 - DNA, 22 bp, Homo sapiens
ttagtacaagagattaattact

SEQ ID NO: 8020369 - DNA, 22 bp, Homo sapiens
ttagtacaagagattaattact

SEQ ID NO: 8020370 - DNA, 22 bp, Homo sapiens
ttagtacagaatcaaaagcaat

SEQ ID NO: 8020371 - DNA, 22 bp, Homo sapiens
ttagtaaataaagtctactttc

SEQ ID NO: 8020372 - DNA, 22 bp, Homo sapiens
ttagtaattagaaagtaattct

SEQ ID NO: 8020373 - DNA, 22 bp, Homo sapiens
ttagtaatgtgttaatatgaat

SEQ ID NO: 8020374 - DNA, 22 bp, Homo sapiens
ttagtacattgattcattatgt

SEQ ID NO: 8020375 - DNA, 22 bp, Homo sapiens
ttagtacatagatgatggttga

SEQ ID NO: 8020376 - DNA, 22 bp, Homo sapiens
ttagtacagaatcaaaagcaat

SEQ ID NO: 8020377 - DNA, 22 bp, Homo sapiens
ttagtacagaatcaaaagcaat

SEQ ID NO: 8020378 - DNA, 22 bp, Homo sapiens
ttagtacatagatgatggttga

SEQ ID NO: 8020379 - DNA, 22 bp, Homo sapiens
ttagtacaagagattaattact

SEQ ID NO: 8020380 - DNA, 22 bp, Homo sapiens
ttagtagattgtgatcagtact

SEQ ID NO: 8020381 - DNA, 22 bp, Homo sapiens
ttagtacattgattcattatgt

SEQ ID NO: 8020382 - DNA, 22 bp, Homo sapiens
ttaggtaagtaggatcaaaaaa

SEQ ID NO: 8020383 - DNA, 19 bp, Homo sapiens
ttaggtattattgctttcc

SEQ ID NO: 8020384 - DNA, 22 bp, Homo sapiens
ttaggtaagtaggatcaaaaaa

SEQ ID NO: 8020385 - DNA, 22 bp, Homo sapiens
ttaggtaagtaggatcaaaaaa

SEQ ID NO: 8020386 - DNA, 22 bp, Homo sapiens
ttaggtaaggatggtgacagta

SEQ ID NO: 8020387 - DNA, 22 bp, Homo sapiens
ttagggttacaccagcctcctg

SEQ ID NO: 8020388 - DNA, 22 bp, Homo sapiens
ttagggttacaccagcctcctg

SEQ ID NO: 8020389 - DNA, 22 bp, Homo sapiens
ttaggtcacatcggtgaccaaa

SEQ ID NO: 8020390 - DNA, 22 bp, Homo sapiens
ttaggtattcatttacatgttc

SEQ ID NO: 8020391 - DNA, 22 bp, Homo sapiens
ttaggtattttgttatgtcagc

SEQ ID NO: 8020392 - DNA, 22 bp, Homo sapiens
ttagtaaataaagtctactttc

SEQ ID NO: 8020393 - DNA, 22 bp, Homo sapiens
ttagtaaataaagtctactttc

SEQ ID NO: 8020394 - DNA, 22 bp, Homo sapiens
ttagtaaataaagtctactttc

SEQ ID NO: 8020395 - DNA, 22 bp, Homo sapiens
ttagtaaataaagtctactttc

SEQ ID NO: 8020396 - DNA, 22 bp, Homo sapiens
ttacattttgcacagatgtccc

SEQ ID NO: 8020397 - DNA, 22 bp, Homo sapiens
ttacattttggggtaaggataa

SEQ ID NO: 8020398 - DNA, 22 bp, Homo sapiens
ttacattttggggtaaggataa

SEQ ID NO: 8020399 - DNA, 22 bp, Homo sapiens
ttacattttgcacagatgtccc

SEQ ID NO: 8020400 - DNA, 22 bp, Homo sapiens
ttagaaaggagcttatttcttt

SEQ ID NO: 8020401 - DNA, 22 bp, Homo sapiens
ttagaaaggagcttatttcttt

SEQ ID NO: 8020402 - DNA, 22 bp, Homo sapiens
ttagaaaggggtgaatcaatgg

SEQ ID NO: 8020403 - DNA, 22 bp, Homo sapiens
ttagaaaggttttgctctgaaa

SEQ ID NO: 8020404 - DNA, 22 bp, Homo sapiens
ttagaaagggtgtctgaatctg

SEQ ID NO: 8020405 - DNA, 22 bp, Homo sapiens
ttagaaagggtgtctgaatctg

SEQ ID NO: 8020406 - DNA, 22 bp, Homo sapiens
ttagaaatacaagtgaggttga

SEQ ID NO: 8020407 - DNA, 22 bp, Homo sapiens
ttagaaatacaagtgaggttga

SEQ ID NO: 8020408 - DNA, 22 bp, Homo sapiens
ttagaaatacaagtgaggttga

SEQ ID NO: 8020409 - DNA, 22 bp, Homo sapiens
ttagaaatatggtgctgccgcc

SEQ ID NO: 8020410 - DNA, 22 bp, Homo sapiens
ttagaaaggttttgctctgaaa

SEQ ID NO: 8020411 - DNA, 22 bp, Homo sapiens
ttagaaaggttttgctctgaaa

SEQ ID NO: 8020412 - DNA, 22 bp, Homo sapiens
ttagaaaggttttgctctgaaa

SEQ ID NO: 8020413 - DNA, 22 bp, Homo sapiens
ttagaacaccattctatattac

SEQ ID NO: 8020414 - DNA, 22 bp, Homo sapiens
ttagaacaccattctatattac

SEQ ID NO: 8020415 - DNA, 21 bp, Homo sapiens
ttagaacaatatttggtatag

SEQ ID NO: 8020416 - DNA, 21 bp, Homo sapiens
ttagaacaatatttggtatag

SEQ ID NO: 8020417 - DNA, 21 bp, Homo sapiens
ttagaacaatatttggtatag

SEQ ID NO: 8020418 - DNA, 22 bp, Homo sapiens
ttagaacaatattctccctaca

SEQ ID NO: 8020419 - DNA, 22 bp, Homo sapiens
ttagaaatgtcacagatctgat

SEQ ID NO: 8020420 - DNA, 22 bp, Homo sapiens
ttagaaatgtcacagatctgat

SEQ ID NO: 8020421 - DNA, 22 bp, Homo sapiens
ttagaaatgtcacagatctgat

SEQ ID NO: 8020422 - DNA, 22 bp, Homo sapiens
ttagaaatgtcacagatctgat

SEQ ID NO: 8020423 - DNA, 22 bp, Homo sapiens
ttagaaatgtcacagatctgat

SEQ ID NO: 8020424 - DNA, 22 bp, Homo sapiens
ttagaaatgtcacagatctgat

SEQ ID NO: 8020425 - DNA, 22 bp, Homo sapiens
ttagaaatgtcacagatctgat

SEQ ID NO: 8020426 - DNA, 22 bp, Homo sapiens
ttagaaatgtcacagatctgat

SEQ ID NO: 8020427 - DNA, 22 bp, Homo sapiens
ttagaaatgtcacagatctgat

SEQ ID NO: 8020428 - DNA, 22 bp, Homo sapiens
ttagaaatcacctctgaagatc

SEQ ID NO: 8020429 - DNA, 22 bp, Homo sapiens
ttagaaatcacctctgaagatc

SEQ ID NO: 8020430 - DNA, 22 bp, Homo sapiens
ttagaaatcacctctgaagatc

SEQ ID NO: 8020431 - DNA, 22 bp, Homo sapiens
ttagaaatcacctctgaagatc

SEQ ID NO: 8020432 - DNA, 22 bp, Homo sapiens
ttagaaatcacctctgaagatc

SEQ ID NO: 8020433 - DNA, 22 bp, Homo sapiens
ttagaaatctgctgccatgcaa

SEQ ID NO: 8020434 - DNA, 22 bp, Homo sapiens
ttagaaatcacctctgaagatc

SEQ ID NO: 8020435 - DNA, 22 bp, Homo sapiens
ttagaaatgatttcacctcttt

SEQ ID NO: 8020436 - DNA, 22 bp, Homo sapiens
ttagaaatgatttcacctcttt

SEQ ID NO: 8020437 - DNA, 22 bp, Homo sapiens
ttagaaatgcacccaagaccta

SEQ ID NO: 8020438 - DNA, 22 bp, Homo sapiens
ttagaaatgcacccaagaccta

SEQ ID NO: 8020439 - DNA, 22 bp, Homo sapiens
ttagaaatgcacccaagaccta

SEQ ID NO: 8020440 - DNA, 22 bp, Homo sapiens
ttagaaatgcacccaagaccta

SEQ ID NO: 8020441 - DNA, 22 bp, Homo sapiens
ttagaaatgatttcacctcttt

SEQ ID NO: 8020442 - DNA, 22 bp, Homo sapiens
ttagaaatctgctgccatgcaa

SEQ ID NO: 8020443 - DNA, 22 bp, Homo sapiens
ttagaacatagcaacagaatta

SEQ ID NO: 8020444 - DNA, 22 bp, Homo sapiens
ttagaacatagcaacagaatta

SEQ ID NO: 8020445 - DNA, 21 bp, Homo sapiens
ttagaacatcaacagcaccta

SEQ ID NO: 8020446 - DNA, 19 bp, Homo sapiens
ttagaacatcctctaggga

SEQ ID NO: 8020447 - DNA, 22 bp, Homo sapiens
ttagaacatagcaacagaatta

SEQ ID NO: 8020448 - DNA, 22 bp, Homo sapiens
ttagaacatagcaacagaatta

SEQ ID NO: 8020449 - DNA, 22 bp, Homo sapiens
ttagaacatagcaacagaatta

SEQ ID NO: 8020450 - DNA, 22 bp, Homo sapiens
ttagaacactgagaaagtgatg

SEQ ID NO: 8020451 - DNA, 21 bp, Homo sapiens
ttagaacacttgctcttggaa

SEQ ID NO: 8020452 - DNA, 22 bp, Homo sapiens
ttagaacagtagaagaaagggt

SEQ ID NO: 8020453 - DNA, 22 bp, Homo sapiens
ttagaacactgagaaagtgatg

SEQ ID NO: 8020454 - DNA, 22 bp, Homo sapiens
ttagaacatctctcttctgcca

SEQ ID NO: 8020455 - DNA, 22 bp, Homo sapiens
ttagaacatctctcttctgcca

SEQ ID NO: 8020456 - DNA, 22 bp, Homo sapiens
ttagaacattccatcactgggt

SEQ ID NO: 8020457 - DNA, 22 bp, Homo sapiens
ttagaaccactgaagactcaca

SEQ ID NO: 8020458 - DNA, 22 bp, Homo sapiens
ttagaaccactgaagactcaca

SEQ ID NO: 8020459 - DNA, 22 bp, Homo sapiens
ttagaaccacctggagagcttt

SEQ ID NO: 8020460 - DNA, 22 bp, Homo sapiens
ttagaaccataatgaatcaatg

SEQ ID NO: 8020461 - DNA, 22 bp, Homo sapiens
ttagaactgaagaagattaagg

SEQ ID NO: 8020462 - DNA, 22 bp, Homo sapiens
ttagaacttaaacttcagaaag

SEQ ID NO: 8020463 - DNA, 22 bp, Homo sapiens
ttagaacttaaacttcagaaag

SEQ ID NO: 8020464 - DNA, 22 bp, Homo sapiens
ttagaacttaagaatactgtct

SEQ ID NO: 8020465 - DNA, 22 bp, Homo sapiens
ttagaacttaagaatactgtct

SEQ ID NO: 8020466 - DNA, 22 bp, Homo sapiens
ttagaaccagcatttgtcctgg

SEQ ID NO: 8020467 - DNA, 22 bp, Homo sapiens
ttagaaccagcatttgtcctgg

SEQ ID NO: 8020468 - DNA, 22 bp, Homo sapiens
ttagaaccaggaactctaatat

SEQ ID NO: 8020469 - DNA, 22 bp, Homo sapiens
ttagaaccagggttacgattct

SEQ ID NO: 8020470 - DNA, 22 bp, Homo sapiens
ttagaaccaggaactctaatat

SEQ ID NO: 8020471 - DNA, 22 bp, Homo sapiens
ttagaaccagggttacgattct

SEQ ID NO: 8020472 - DNA, 22 bp, Homo sapiens
ttagataatgtagagatatgag

SEQ ID NO: 8020473 - DNA, 22 bp, Homo sapiens
ttagataatgttattgtaattt

SEQ ID NO: 8020474 - DNA, 22 bp, Homo sapiens
ttagataatgttattgtaattt

SEQ ID NO: 8020475 - DNA, 22 bp, Homo sapiens
ttagaagcactaattactcaca

SEQ ID NO: 8020476 - DNA, 22 bp, Homo sapiens
ttagaagcactaattactcaca

SEQ ID NO: 8020477 - DNA, 22 bp, Homo sapiens
ttagaacttttcaactccattc

SEQ ID NO: 8020478 - DNA, 22 bp, Homo sapiens
ttagataaattgcaacttgatt

SEQ ID NO: 8020479 - DNA, 22 bp, Homo sapiens
ttagaacttaagaatactgtct

SEQ ID NO: 8020480 - DNA, 22 bp, Homo sapiens
ttagatcaatactaaagaagtt

SEQ ID NO: 8020481 - DNA, 22 bp, Homo sapiens
ttagatcaatagttctcaactc

SEQ ID NO: 8020482 - DNA, 22 bp, Homo sapiens
ttagatcaatactaaagaagtt

SEQ ID NO: 8020483 - DNA, 19 bp, Homo sapiens
ttagatcattaccatgagg

SEQ ID NO: 8020484 - DNA, 22 bp, Homo sapiens
ttagatcatatttaccacagta

SEQ ID NO: 8020485 - DNA, 22 bp, Homo sapiens
ttagatcatagtgtatatactg

SEQ ID NO: 8020486 - DNA, 22 bp, Homo sapiens
ttagatcatagtgtatatactg

SEQ ID NO: 8020487 - DNA, 22 bp, Homo sapiens
ttagatcattttagctaaatgg

SEQ ID NO: 8020488 - DNA, 22 bp, Homo sapiens
ttagatacattctcatttgttt

SEQ ID NO: 8020489 - DNA, 22 bp, Homo sapiens
ttagatacccaagtggatctgt

SEQ ID NO: 8020490 - DNA, 22 bp, Homo sapiens
ttagataggactcatagattgg

SEQ ID NO: 8020491 - DNA, 22 bp, Homo sapiens
ttagataggactcatagattgg

SEQ ID NO: 8020492 - DNA, 22 bp, Homo sapiens
ttagatatgtttttgctaatgc

SEQ ID NO: 8020493 - DNA, 22 bp, Homo sapiens
ttatgatttgccacagattggt

SEQ ID NO: 8020494 - DNA, 22 bp, Homo sapiens
ttatgatttagaaagattcact

SEQ ID NO: 8020495 - DNA, 22 bp, Homo sapiens
ttatgagactgttttacacact

SEQ ID NO: 8020496 - DNA, 22 bp, Homo sapiens
ttatgatttagaaagattcact

SEQ ID NO: 8020497 - DNA, 22 bp, Homo sapiens
ttatgatttgccacagattggt

SEQ ID NO: 8020498 - DNA, 22 bp, Homo sapiens
ttatgagactgttttacacact

SEQ ID NO: 8020499 - DNA, 22 bp, Homo sapiens
ttatgatttagaaagattcact

SEQ ID NO: 8020500 - DNA, 22 bp, Homo sapiens
ttatgagactgttttacacact

SEQ ID NO: 8020501 - DNA, 22 bp, Homo sapiens
ttattattgattcgctctcaaa

SEQ ID NO: 8020502 - DNA, 22 bp, Homo sapiens
ttattattccccaagtcattat

SEQ ID NO: 8020503 - DNA, 22 bp, Homo sapiens
ttattattccccaagtcattat

SEQ ID NO: 8020504 - DNA, 22 bp, Homo sapiens
ttattattccccaagtcattat

SEQ ID NO: 8020505 - DNA, 22 bp, Homo sapiens
ttatgatttgccacagattggt

SEQ ID NO: 8020506 - DNA, 18 bp, Homo sapiens
ttatgcaaaactgttttc

SEQ ID NO: 8020507 - DNA, 22 bp, Homo sapiens
ttatgcaacaggtgagcagaca

SEQ ID NO: 8020508 - DNA, 22 bp, Homo sapiens
ttatgcaacaggtgagcagaca

SEQ ID NO: 8020509 - DNA, 22 bp, Homo sapiens
ttatgcaaagaaatagactaat

SEQ ID NO: 8020510 - DNA, 22 bp, Homo sapiens
ttatgcaaagaaatagactaat

SEQ ID NO: 8020511 - DNA, 18 bp, Homo sapiens
ttatgcaaaactgttttc

SEQ ID NO: 8020512 - DNA, 19 bp, Homo sapiens
ttatgaatagcttcatcca

SEQ ID NO: 8020513 - DNA, 22 bp, Homo sapiens
ttatgaagttcctgttacagtg

SEQ ID NO: 8020514 - DNA, 22 bp, Homo sapiens
ttatgaagttcctgttacagtg

SEQ ID NO: 8020515 - DNA, 19 bp, Homo sapiens
ttatgaatagcttcatcca

SEQ ID NO: 8020516 - DNA, 22 bp, Homo sapiens
ttatgacagaaatgaaaagctg

SEQ ID NO: 8020517 - DNA, 22 bp, Homo sapiens
ttatgacaggaaaatcacagaa

SEQ ID NO: 8020518 - DNA, 22 bp, Homo sapiens
ttatgaaagacatttctgttgg

SEQ ID NO: 8020519 - DNA, 22 bp, Homo sapiens
ttatgaaagacatttctgttgg

SEQ ID NO: 8020520 - DNA, 22 bp, Homo sapiens
ttatgaacagtatccaaaatgt

SEQ ID NO: 8020521 - DNA, 17 bp, Homo sapiens
ttatcttgctgtttcta

SEQ ID NO: 8020522 - DNA, 17 bp, Homo sapiens
ttatcttgctgtttcta

SEQ ID NO: 8020523 - DNA, 22 bp, Homo sapiens
ttatcttggcaattctaaggta

SEQ ID NO: 8020524 - DNA, 22 bp, Homo sapiens
ttatcttgggtaactttgtgca

SEQ ID NO: 8020525 - DNA, 22 bp, Homo sapiens
ttatcttgggtaactttgtgca

SEQ ID NO: 8020526 - DNA, 22 bp, Homo sapiens
ttatgaaaacaatcagtaggca

SEQ ID NO: 8020527 - DNA, 22 bp, Homo sapiens
ttatcttgtagagatattttcg

SEQ ID NO: 8020528 - DNA, 22 bp, Homo sapiens
ttatcttgtagagatattttcg

SEQ ID NO: 8020529 - DNA, 22 bp, Homo sapiens
ttagtcttcttccttatatgtt

SEQ ID NO: 8020530 - DNA, 22 bp, Homo sapiens
ttagtctaagcttgttcccttc

SEQ ID NO: 8020531 - DNA, 22 bp, Homo sapiens
ttagtctccagcttagggtttg

SEQ ID NO: 8020532 - DNA, 22 bp, Homo sapiens
ttagtctctttgcattgccata

SEQ ID NO: 8020533 - DNA, 22 bp, Homo sapiens
ttagtctccagcttagggtttg

SEQ ID NO: 8020534 - DNA, 22 bp, Homo sapiens
ttagtcaaatcattctgtttct

SEQ ID NO: 8020535 - DNA, 22 bp, Homo sapiens
ttagtcaatagtgaatatagag

SEQ ID NO: 8020536 - DNA, 22 bp, Homo sapiens
ttagtattaggatcatatttga

SEQ ID NO: 8020537 - DNA, 22 bp, Homo sapiens
ttagtcaatagtgaatatagag

SEQ ID NO: 8020538 - DNA, 22 bp, Homo sapiens
ttagtcaatagtgaatatagag

SEQ ID NO: 8020539 - DNA, 22 bp, Homo sapiens
ttagtcaatagtgaatatagag

SEQ ID NO: 8020540 - DNA, 22 bp, Homo sapiens
ttagtagtaagagtcatatgta

SEQ ID NO: 8020541 - DNA, 22 bp, Homo sapiens
ttagtgcaattcagagaacaat

SEQ ID NO: 8020542 - DNA, 22 bp, Homo sapiens
ttagtgcaaacctcagagacac

SEQ ID NO: 8020543 - DNA, 22 bp, Homo sapiens
ttagtgcaaacctcagagacac

SEQ ID NO: 8020544 - DNA, 22 bp, Homo sapiens
ttagtgatcaaaatcaaaattg

SEQ ID NO: 8020545 - DNA, 22 bp, Homo sapiens
ttagtgaaagtaatacaaagta

SEQ ID NO: 8020546 - DNA, 22 bp, Homo sapiens
ttagtgaatcacagagtacata

SEQ ID NO: 8020547 - DNA, 22 bp, Homo sapiens
ttatctgaaaacctcaaaatat

SEQ ID NO: 8020548 - DNA, 22 bp, Homo sapiens
ttatctggtatagtggggaaga

SEQ ID NO: 8020549 - DNA, 22 bp, Homo sapiens
ttatatgtttctgtttggaggc

SEQ ID NO: 8020550 - DNA, 22 bp, Homo sapiens
ttatatgtatgcttataaacca

SEQ ID NO: 8020551 - DNA, 22 bp, Homo sapiens
ttatatgtatgcttataaacca

SEQ ID NO: 8020552 - DNA, 22 bp, Homo sapiens
ttatatgtatgcttataaacca

SEQ ID NO: 8020553 - DNA, 22 bp, Homo sapiens
ttatatgattgagcatcttggt

SEQ ID NO: 8020554 - DNA, 22 bp, Homo sapiens
ttatatgtatgcttataaacca

SEQ ID NO: 8020555 - DNA, 22 bp, Homo sapiens
ttatatgtttctgtttggaggc

SEQ ID NO: 8020556 - DNA, 22 bp, Homo sapiens
ttatatgattgagcatcttggt

SEQ ID NO: 8020557 - DNA, 22 bp, Homo sapiens
ttatctgttttctgtgcgtttc

SEQ ID NO: 8020558 - DNA, 22 bp, Homo sapiens
ttatcttagaggtgattgtatt

SEQ ID NO: 8020559 - DNA, 22 bp, Homo sapiens
ttatctgtttaacaaagtatct

SEQ ID NO: 8020560 - DNA, 22 bp, Homo sapiens
ttatctgttgttttagtacaat

SEQ ID NO: 8020561 - DNA, 22 bp, Homo sapiens
ttatctgtttaacaaagtatct

SEQ ID NO: 8020562 - DNA, 22 bp, Homo sapiens
ttatctgtttaacaaagtatct

SEQ ID NO: 8020563 - DNA, 19 bp, Homo sapiens
ttatctgtgttgcagtggt

SEQ ID NO: 8020564 - DNA, 19 bp, Homo sapiens
ttatctgtgttgcagtggt

SEQ ID NO: 8020565 - DNA, 22 bp, Homo sapiens
ttatctgttgttttagtacaat

SEQ ID NO: 8020566 - DNA, 22 bp, Homo sapiens
ttatctgttgttttagtacaat

SEQ ID NO: 8020567 - DNA, 22 bp, Homo sapiens
ttatctgttgcttaatgcgcat

SEQ ID NO: 8020568 - DNA, 22 bp, Homo sapiens
ttatctgtgatcctaaatgtct

SEQ ID NO: 8020569 - DNA, 22 bp, Homo sapiens
ttatctgtgatcctaaatgtct

SEQ ID NO: 8020570 - DNA, 22 bp, Homo sapiens
ttatctgtgacagccttgtatg

SEQ ID NO: 8020571 - DNA, 22 bp, Homo sapiens
ttatctgtgacagccttgtatg

SEQ ID NO: 8020572 - DNA, 22 bp, Homo sapiens
ttatctgtctatcaagactagc

SEQ ID NO: 8020573 - DNA, 20 bp, Homo sapiens
ttatctgtcaatctgtctca

SEQ ID NO: 8020574 - DNA, 20 bp, Homo sapiens
ttatctgtcaatctgtctca

SEQ ID NO: 8020575 - DNA, 22 bp, Homo sapiens
ttatctgtctatcaagactagc

SEQ ID NO: 8020576 - DNA, 22 bp, Homo sapiens
ttatctgtctatcaagactagc

SEQ ID NO: 8020577 - DNA, 22 bp, Homo sapiens
ttatctgtcatcaggcagacag

SEQ ID NO: 8020578 - DNA, 20 bp, Homo sapiens
ttatctgtcaatctgtctca

SEQ ID NO: 8020579 - DNA, 22 bp, Homo sapiens
ttatttatgttaacagtcgaga

SEQ ID NO: 8020580 - DNA, 22 bp, Homo sapiens
ttatttatgttaacagtcgaga

SEQ ID NO: 8020581 - DNA, 22 bp, Homo sapiens
ttatttatgttaacagtcgaga

SEQ ID NO: 8020582 - DNA, 22 bp, Homo sapiens
ttatttatggccctcacctgat

SEQ ID NO: 8020583 - DNA, 22 bp, Homo sapiens
ttatttatggccctcacctgat

SEQ ID NO: 8020584 - DNA, 22 bp, Homo sapiens
ttattcttggatctgagtctct

SEQ ID NO: 8020585 - DNA, 22 bp, Homo sapiens
ttattcttggatctgagtctct

SEQ ID NO: 8020586 - DNA, 22 bp, Homo sapiens
ttatttatggcactgttggtgg

SEQ ID NO: 8020587 - DNA, 22 bp, Homo sapiens
ttattcttggatctgagtctct

SEQ ID NO: 8020588 - DNA, 22 bp, Homo sapiens
ttattctttaaacatatatgtt

SEQ ID NO: 8020589 - DNA, 22 bp, Homo sapiens
ttatttccaaactggatatacc

SEQ ID NO: 8020590 - DNA, 22 bp, Homo sapiens
ttatttccaaactggatatacc

SEQ ID NO: 8020591 - DNA, 22 bp, Homo sapiens
ttatttcattgatttctaagac

SEQ ID NO: 8020592 - DNA, 22 bp, Homo sapiens
ttatttcattgatttctaagac

SEQ ID NO: 8020593 - DNA, 22 bp, Homo sapiens
ttatttatgttaacagtcgaga

SEQ ID NO: 8020594 - DNA, 20 bp, Homo sapiens
ttatttccagtccaggtcct

SEQ ID NO: 8020595 - DNA, 22 bp, Homo sapiens
ttatttccagtccagaaattta

SEQ ID NO: 8020596 - DNA, 22 bp, Homo sapiens
ttatttccacaatgtggtaggg

SEQ ID NO: 8020597 - DNA, 22 bp, Homo sapiens
ttatttccctgagggttgcagg

SEQ ID NO: 8020598 - DNA, 19 bp, Homo sapiens
ttattctgtcagagcacac

SEQ ID NO: 8020599 - DNA, 22 bp, Homo sapiens
ttattctgtcaaacttatacat

SEQ ID NO: 8020600 - DNA, 22 bp, Homo sapiens
ttattctgtcaaacttatacat

SEQ ID NO: 8020601 - DNA, 22 bp, Homo sapiens
ttattctgttgcttttacagta

SEQ ID NO: 8020602 - DNA, 17 bp, Homo sapiens
ttattctggcatatgtg

SEQ ID NO: 8020603 - DNA, 22 bp, Homo sapiens
ttattctggaggaagcaaatgg

SEQ ID NO: 8020604 - DNA, 22 bp, Homo sapiens
ttattctgttgcttttacagta

SEQ ID NO: 8020605 - DNA, 19 bp, Homo sapiens
ttattcttaaagtagctta

SEQ ID NO: 8020606 - DNA, 19 bp, Homo sapiens
ttattcttaaagtagctta

SEQ ID NO: 8020607 - DNA, 19 bp, Homo sapiens
ttattcttaaagtagctta

SEQ ID NO: 8020608 - DNA, 22 bp, Homo sapiens
ttattcttggatctgagtctct

SEQ ID NO: 8020609 - DNA, 22 bp, Homo sapiens
ttattattgattcgctctcaaa

SEQ ID NO: 8020610 - DNA, 22 bp, Homo sapiens
ttattattgattcgctctcaaa

SEQ ID NO: 8020611 - DNA, 22 bp, Homo sapiens
ttattattgattcgctctcaaa

SEQ ID NO: 8020612 - DNA, 22 bp, Homo sapiens
ttattattggtgagttaaggaa

SEQ ID NO: 8020613 - DNA, 22 bp, Homo sapiens
ttattattggtgagttaaggaa

SEQ ID NO: 8020614 - DNA, 22 bp, Homo sapiens
ttattattgattcgctctcaaa

SEQ ID NO: 8020615 - DNA, 22 bp, Homo sapiens
ttattattgattcgctctcaaa

SEQ ID NO: 8020616 - DNA, 22 bp, Homo sapiens
ttattcaggaggtgctcgaagg

SEQ ID NO: 8020617 - DNA, 22 bp, Homo sapiens
ttattcaggaggtgctcgaagg

SEQ ID NO: 8020618 - DNA, 22 bp, Homo sapiens
ttattcaggaaggtgttactta

SEQ ID NO: 8020619 - DNA, 22 bp, Homo sapiens
ttattattggtgagttaaggaa

SEQ ID NO: 8020620 - DNA, 22 bp, Homo sapiens
ttattcaggctctctttggcta

SEQ ID NO: 8020621 - DNA, 22 bp, Homo sapiens
ttattcagggataacatccagg

SEQ ID NO: 8020622 - DNA, 22 bp, Homo sapiens
ttattcagggataacatccagg

SEQ ID NO: 8020623 - DNA, 22 bp, Homo sapiens
ttattcaggtcatggactgtca

SEQ ID NO: 8020624 - DNA, 22 bp, Homo sapiens
ttattcagtgcatatattaaaa

SEQ ID NO: 8020625 - DNA, 22 bp, Homo sapiens
ttattcagtctgtctagggagt

SEQ ID NO: 8020626 - DNA, 22 bp, Homo sapiens
ttattcagtgcatatattaaaa

SEQ ID NO: 8020627 - DNA, 22 bp, Homo sapiens
ttattcagttcccttcactctc

SEQ ID NO: 8020628 - DNA, 22 bp, Homo sapiens
ttattcagttcccttcactctc

SEQ ID NO: 8020629 - DNA, 22 bp, Homo sapiens
ttattcagtgcctttgaaagaa

SEQ ID NO: 8020630 - DNA, 22 bp, Homo sapiens
ttattcattaacagggaccaaa

SEQ ID NO: 8020631 - DNA, 22 bp, Homo sapiens
ttattcattaacagggaccaaa

SEQ ID NO: 8020632 - DNA, 22 bp, Homo sapiens
ttattcatcagtgcattaattt

SEQ ID NO: 8020633 - DNA, 22 bp, Homo sapiens
ttattcatcagtgcattaattt

SEQ ID NO: 8020634 - DNA, 22 bp, Homo sapiens
ttattcatcagtgcattaattt

SEQ ID NO: 8020635 - DNA, 22 bp, Homo sapiens
ttattcatcagtgcattaattt

SEQ ID NO: 8020636 - DNA, 22 bp, Homo sapiens
ttattcagtttgtgtagaggtg

SEQ ID NO: 8020637 - DNA, 22 bp, Homo sapiens
ttattcatcagtgcattaattt

SEQ ID NO: 8020638 - DNA, 22 bp, Homo sapiens
ttattccacagctcagaatttt

SEQ ID NO: 8020639 - DNA, 22 bp, Homo sapiens
ttattccacagctcagaatttt

SEQ ID NO: 8020640 - DNA, 22 bp, Homo sapiens
ttattccacctccattttccta

SEQ ID NO: 8020641 - DNA, 22 bp, Homo sapiens
ttattccaatttctcctacaaa

SEQ ID NO: 8020642 - DNA, 22 bp, Homo sapiens
ttattccaatttctcctacaaa

SEQ ID NO: 8020643 - DNA, 22 bp, Homo sapiens
ttattccaatttctcctacaaa

SEQ ID NO: 8020644 - DNA, 22 bp, Homo sapiens
ttattccaaatcatggttgcat

SEQ ID NO: 8020645 - DNA, 22 bp, Homo sapiens
ttattctgagagttgaagtaat

SEQ ID NO: 8020646 - DNA, 22 bp, Homo sapiens
ttattctgagagttgaagtaat

SEQ ID NO: 8020647 - DNA, 22 bp, Homo sapiens
ttattctgccaggagcgtcagt

SEQ ID NO: 8020648 - DNA, 22 bp, Homo sapiens
ttattctgcacttttaaaatat

SEQ ID NO: 8020649 - DNA, 22 bp, Homo sapiens
ttattctgcacttttaaaatat

SEQ ID NO: 8020650 - DNA, 22 bp, Homo sapiens
ttattctcatctccctacttag

SEQ ID NO: 8020651 - DNA, 22 bp, Homo sapiens
ttattctcatctccctacttag

SEQ ID NO: 8020652 - DNA, 22 bp, Homo sapiens
ttattccattgtcttttgactt

SEQ ID NO: 8020653 - DNA, 22 bp, Homo sapiens
ttattctgagagttgaagtaat

SEQ ID NO: 8020654 - DNA, 22 bp, Homo sapiens
ttattccagtaatctctgtaat

SEQ ID NO: 8020655 - DNA, 22 bp, Homo sapiens
ttattccagtgggtggtttctc

SEQ ID NO: 8020656 - DNA, 22 bp, Homo sapiens
ttattccagtaatctctgtaat

SEQ ID NO: 8020657 - DNA, 22 bp, Homo sapiens
ttattccacctccattttccta

SEQ ID NO: 8020658 - DNA, 22 bp, Homo sapiens
ttattccagctaagagtcctgg

SEQ ID NO: 8020659 - DNA, 22 bp, Homo sapiens
ttattccaggtacttggtttct

SEQ ID NO: 8020660 - DNA, 22 bp, Homo sapiens
ttattccatagaagtcaaggaa

SEQ ID NO: 8020661 - DNA, 22 bp, Homo sapiens
ttattccatagaagtcaaggaa

SEQ ID NO: 8020662 - DNA, 22 bp, Homo sapiens
ttattccagtgggtggtttctc

SEQ ID NO: 8020663 - DNA, 22 bp, Homo sapiens
ttattccattatttcacttagg

SEQ ID NO: 8020664 - DNA, 22 bp, Homo sapiens
ttattccattatttcacttagg

SEQ ID NO: 8020665 - DNA, 22 bp, Homo sapiens
ttattccattcagttcaacaag

SEQ ID NO: 8020666 - DNA, 22 bp, Homo sapiens
ttattccattgtcttttgactt

SEQ ID NO: 8020667 - DNA, 19 bp, Homo sapiens
tggaacctgtgccagggct

SEQ ID NO: 8020668 - DNA, 22 bp, Homo sapiens
tggaacctggtgatgtacaagt

SEQ ID NO: 8020669 - DNA, 22 bp, Homo sapiens
tggaacgtcgtaatgttggtta

SEQ ID NO: 8020670 - DNA, 19 bp, Homo sapiens
tggaacctgtgccagggct

SEQ ID NO: 8020671 - DNA, 22 bp, Homo sapiens
tggaacctggcctgagctacca

SEQ ID NO: 8020672 - DNA, 22 bp, Homo sapiens
tggaacctggcctgagctacca

SEQ ID NO: 8020673 - DNA, 22 bp, Homo sapiens
tggaacctaaaaatgtcattgc

SEQ ID NO: 8020674 - DNA, 22 bp, Homo sapiens
tggaacctaaaaatgtcattgc

SEQ ID NO: 8020675 - DNA, 22 bp, Homo sapiens
tggaacactttcagtagctatt

SEQ ID NO: 8020676 - DNA, 20 bp, Homo sapiens
tggaacctaggcagagctgg

SEQ ID NO: 8020677 - DNA, 22 bp, Homo sapiens
tggaacctggcattagggacac

SEQ ID NO: 8020678 - DNA, 23 bp, Homo sapiens
tggaagaaaatggtttggctgtg

SEQ ID NO: 8020679 - DNA, 22 bp, Homo sapiens
tggaactaaggtagaaactatt

SEQ ID NO: 8020680 - DNA, 23 bp, Homo sapiens
tggaagaaaatggtttggctgtg

SEQ ID NO: 8020681 - DNA, 22 bp, Homo sapiens
tggaagaaaattcaatcgagtt

SEQ ID NO: 8020682 - DNA, 22 bp, Homo sapiens
tggaaccatcaaagagatcctg

SEQ ID NO: 8020683 - DNA, 22 bp, Homo sapiens
tggaacactgtggatgagaaga

SEQ ID NO: 8020684 - DNA, 22 bp, Homo sapiens
tggaacactggctttccactgt

SEQ ID NO: 8020685 - DNA, 22 bp, Homo sapiens
tggaacacatctaaggaagcag

SEQ ID NO: 8020686 - DNA, 22 bp, Homo sapiens
tggaacacacttcaaggagaaa

SEQ ID NO: 8020687 - DNA, 22 bp, Homo sapiens
tggaaatgtatttgggcatgcc

SEQ ID NO: 8020688 - DNA, 22 bp, Homo sapiens
tggaaatgtttcttgagctcag

SEQ ID NO: 8020689 - DNA, 22 bp, Homo sapiens
tggaaatggatctgatgagtct

SEQ ID NO: 8020690 - DNA, 22 bp, Homo sapiens
tggaaatttattcatcattcat

SEQ ID NO: 8020691 - DNA, 22 bp, Homo sapiens
tggaaattttgaacagtttcta

SEQ ID NO: 8020692 - DNA, 22 bp, Homo sapiens
tggaaatttattcatcattcat

SEQ ID NO: 8020693 - DNA, 19 bp, Homo sapiens
tggaacaaactgcaatgac

SEQ ID NO: 8020694 - DNA, 22 bp, Homo sapiens
tggaacaaacatggtgatggct

SEQ ID NO: 8020695 - DNA, 22 bp, Homo sapiens
tggaacaacatgctggaaaatt

SEQ ID NO: 8020696 - DNA, 22 bp, Homo sapiens
tggaacaaattacaattaactt

SEQ ID NO: 8020697 - DNA, 22 bp, Homo sapiens
tggaaatacaagaagtatgtca

SEQ ID NO: 8020698 - DNA, 22 bp, Homo sapiens
tggaaatacaagaagtatgtca

SEQ ID NO: 8020699 - DNA, 22 bp, Homo sapiens
tggaaatacaagaagtatgtca

SEQ ID NO: 8020700 - DNA, 22 bp, Homo sapiens
tggaaatacttgccataaaact

SEQ ID NO: 8020701 - DNA, 22 bp, Homo sapiens
tggaaatacttgccataaaact

SEQ ID NO: 8020702 - DNA, 22 bp, Homo sapiens
tggaaaggtaggatttcaagac

SEQ ID NO: 8020703 - DNA, 22 bp, Homo sapiens
tggaaagcagttcttagaatcg

SEQ ID NO: 8020704 - DNA, 22 bp, Homo sapiens
tggaaagcgaggagttggcatt

SEQ ID NO: 8020705 - DNA, 22 bp, Homo sapiens
tggaaagcagttcttagaatcg

SEQ ID NO: 8020706 - DNA, 21 bp, Homo sapiens
tggaaagattcaaagaccagg

SEQ ID NO: 8020707 - DNA, 22 bp, Homo sapiens
tggaaaggacagttgctgatag

SEQ ID NO: 8020708 - DNA, 22 bp, Homo sapiens
tggaaagggacttatgagttcc

SEQ ID NO: 8020709 - DNA, 22 bp, Homo sapiens
tggaaaggaggcttgtggaata

SEQ ID NO: 8020710 - DNA, 22 bp, Homo sapiens
tggaaaggaggcttgtggaata

SEQ ID NO: 8020711 - DNA, 22 bp, Homo sapiens
tggaaatagtaatgcataagtg

SEQ ID NO: 8020712 - DNA, 22 bp, Homo sapiens
tggaaatagttgtgagtcaggc

SEQ ID NO: 8020713 - DNA, 22 bp, Homo sapiens
tggaaatagctccagtttcatt

SEQ ID NO: 8020714 - DNA, 22 bp, Homo sapiens
tggaaatatgctccattctttt

SEQ ID NO: 8020715 - DNA, 22 bp, Homo sapiens
tggaaatatgctccattctttt

SEQ ID NO: 8020716 - DNA, 22 bp, Homo sapiens
tggaaatatacaatgtgtctct

SEQ ID NO: 8020717 - DNA, 22 bp, Homo sapiens
tggaaatatacaatgtgtctct

SEQ ID NO: 8020718 - DNA, 22 bp, Homo sapiens
tggaaatagttgtgagtcaggc

SEQ ID NO: 8020719 - DNA, 22 bp, Homo sapiens
tggaaatatacaatgtgtctct

SEQ ID NO: 8020720 - DNA, 22 bp, Homo sapiens
tggaaatagttgtgagtcaggc

SEQ ID NO: 8020721 - DNA, 22 bp, Homo sapiens
tggaaatagatagtatcattca

SEQ ID NO: 8020722 - DNA, 22 bp, Homo sapiens
tggaaatacttgccataaaact

SEQ ID NO: 8020723 - DNA, 22 bp, Homo sapiens
tggaaatagatagtatcattca

SEQ ID NO: 8020724 - DNA, 22 bp, Homo sapiens
tggaaatagatagtatcattca

SEQ ID NO: 8020725 - DNA, 22 bp, Homo sapiens
tggaaatagctccagtttcatt

SEQ ID NO: 8020726 - DNA, 22 bp, Homo sapiens
tggaaatatgctccattctttt

SEQ ID NO: 8020727 - DNA, 22 bp, Homo sapiens
tggaaatatgctccattctttt

SEQ ID NO: 8020728 - DNA, 22 bp, Homo sapiens
tggaaatattgggtaatagttg

SEQ ID NO: 8020729 - DNA, 22 bp, Homo sapiens
tggaaatatttgctcattatct

SEQ ID NO: 8020730 - DNA, 22 bp, Homo sapiens
tggaaatattgggtaatagttg

SEQ ID NO: 8020731 - DNA, 23 bp, Homo sapiens
tggaaatctgggtgaggacagaa

SEQ ID NO: 8020732 - DNA, 22 bp, Homo sapiens
tggaaatatttgctcattatct

SEQ ID NO: 8020733 - DNA, 19 bp, Homo sapiens
tggaaatggaagctcagcc

SEQ ID NO: 8020734 - DNA, 22 bp, Homo sapiens
tggaaagagatgttgtttctga

SEQ ID NO: 8020735 - DNA, 22 bp, Homo sapiens
tggaaacatctctgcctttatt

SEQ ID NO: 8020736 - DNA, 22 bp, Homo sapiens
tggaaagaggtagaggatctgg

SEQ ID NO: 8020737 - DNA, 22 bp, Homo sapiens
tggaaagaggaagtgcccagca

SEQ ID NO: 8020738 - DNA, 22 bp, Homo sapiens
tggaaagaggaagtgcccagca

SEQ ID NO: 8020739 - DNA, 22 bp, Homo sapiens
tggaaagaggtagaggatctgg

SEQ ID NO: 8020740 - DNA, 22 bp, Homo sapiens
tggaaagaggtagaggatctgg

SEQ ID NO: 8020741 - DNA, 22 bp, Homo sapiens
tggaaagatgaagatgtttaag

SEQ ID NO: 8020742 - DNA, 21 bp, Homo sapiens
tggaaagattcaaagaccagg

SEQ ID NO: 8020743 - DNA, 21 bp, Homo sapiens
tggaaagattcaaagaccagg

SEQ ID NO: 8020744 - DNA, 22 bp, Homo sapiens
tggaaagatgaagatgtttaag

SEQ ID NO: 8020745 - DNA, 22 bp, Homo sapiens
tggaaagatgaagatgtttaag

SEQ ID NO: 8020746 - DNA, 22 bp, Homo sapiens
tggaaacactgcatgttcaccc

SEQ ID NO: 8020747 - DNA, 22 bp, Homo sapiens
tggaaacactgcatgttcaccc

SEQ ID NO: 8020748 - DNA, 22 bp, Homo sapiens
tggaaacactcaagcttatatt

SEQ ID NO: 8020749 - DNA, 22 bp, Homo sapiens
tggaaacactcaagcttatatt

SEQ ID NO: 8020750 - DNA, 22 bp, Homo sapiens
tggaaacacccacgcatgcata

SEQ ID NO: 8020751 - DNA, 22 bp, Homo sapiens
tggaaacacccacgcatgcata

SEQ ID NO: 8020752 - DNA, 22 bp, Homo sapiens
tggaaacactcaagcttatatt

SEQ ID NO: 8020753 - DNA, 22 bp, Homo sapiens
tggaaacaggagaatatcttct

SEQ ID NO: 8020754 - DNA, 22 bp, Homo sapiens
tggaaacatctctgcctttatt

SEQ ID NO: 8020755 - DNA, 21 bp, Homo sapiens
tggaaacagcgccatctgccg

SEQ ID NO: 8020756 - DNA, 22 bp, Homo sapiens
tggaaacaggagaatatcttct

SEQ ID NO: 8020757 - DNA, 22 bp, Homo sapiens
tggaaacagatcataactaagc

SEQ ID NO: 8020758 - DNA, 22 bp, Homo sapiens
tggaaacactgcatgttcaccc

SEQ ID NO: 8020759 - DNA, 22 bp, Homo sapiens
tggaaacactcaagcttatatt

SEQ ID NO: 8020760 - DNA, 22 bp, Homo sapiens
tggaaacacccacgcatgcata

SEQ ID NO: 8020761 - DNA, 22 bp, Homo sapiens
tggaaacaaagtcataagctca

SEQ ID NO: 8020762 - DNA, 22 bp, Homo sapiens
tggaaaattagtagtgaaaggc

SEQ ID NO: 8020763 - DNA, 22 bp, Homo sapiens
tggaaaatgtgactattctaaa

SEQ ID NO: 8020764 - DNA, 22 bp, Homo sapiens
tggaaaatgtgactattctaaa

SEQ ID NO: 8020765 - DNA, 22 bp, Homo sapiens
tggaaaatgtgactattctaaa

SEQ ID NO: 8020766 - DNA, 22 bp, Homo sapiens
tggaaaatgtgactattctaaa

SEQ ID NO: 8020767 - DNA, 21 bp, Homo sapiens
tggaaaacatttaaatagcaa

SEQ ID NO: 8020768 - DNA, 22 bp, Homo sapiens
tggaaaatcaggggacattgat

SEQ ID NO: 8020769 - DNA, 22 bp, Homo sapiens
tggaaaaaaattggctagcttc

SEQ ID NO: 8020770 - DNA, 22 bp, Homo sapiens
tggaaaaaaattggctagcttc

SEQ ID NO: 8020771 - DNA, 22 bp, Homo sapiens
tggaaaaaaattggctagcttc

SEQ ID NO: 8020772 - DNA, 22 bp, Homo sapiens
tggaaaaaacccagactctaga

SEQ ID NO: 8020773 - DNA, 22 bp, Homo sapiens
tggaaaaaaattggctagcttc

SEQ ID NO: 8020774 - DNA, 22 bp, Homo sapiens
tggaaaaaacccagactctaga

SEQ ID NO: 8020775 - DNA, 22 bp, Homo sapiens
tggaaaaaacccagactctaga

SEQ ID NO: 8020776 - DNA, 22 bp, Homo sapiens
tggaaaaaacccagactctaga

SEQ ID NO: 8020777 - DNA, 22 bp, Homo sapiens
tggaaaaactgagacttagaca

SEQ ID NO: 8020778 - DNA, 22 bp, Homo sapiens
tggaaaaactgagacttagaca

SEQ ID NO: 8020779 - DNA, 21 bp, Homo sapiens
tggaaaaatgtggcctagtga

SEQ ID NO: 8020780 - DNA, 22 bp, Homo sapiens
tggaaaaactgagacttagaca

SEQ ID NO: 8020781 - DNA, 22 bp, Homo sapiens
tggaaaaactgagacttagaca

SEQ ID NO: 8020782 - DNA, 22 bp, Homo sapiens
tggaaaaactgagacttagaca

SEQ ID NO: 8020783 - DNA, 20 bp, Homo sapiens
tgcttttatacctataatga

SEQ ID NO: 8020784 - DNA, 22 bp, Homo sapiens
tgcttttatttaatatcttgca

SEQ ID NO: 8020785 - DNA, 22 bp, Homo sapiens
tgcttttatttaatatcttgca

SEQ ID NO: 8020786 - DNA, 20 bp, Homo sapiens
tgcttttatacctataatga

SEQ ID NO: 8020787 - DNA, 20 bp, Homo sapiens
tgcttttatacctataatga

SEQ ID NO: 8020788 - DNA, 20 bp, Homo sapiens
tgcttttatacctataatga

SEQ ID NO: 8020789 - DNA, 20 bp, Homo sapiens
tgcttttatacctataatga

SEQ ID NO: 8020790 - DNA, 22 bp, Homo sapiens
tgctttttgcaccctttgccgt

SEQ ID NO: 8020791 - DNA, 22 bp, Homo sapiens
tgctttttgcaccctttgccgt

SEQ ID NO: 8020792 - DNA, 22 bp, Homo sapiens
tgctttttagtactgtcttatt

SEQ ID NO: 8020793 - DNA, 22 bp, Homo sapiens
tgctttttagtactgtcttatt

SEQ ID NO: 8020794 - DNA, 22 bp, Homo sapiens
tgctttttagtactgtcttatt

SEQ ID NO: 8020795 - DNA, 22 bp, Homo sapiens
tgctttgtgtttgaatagataa

SEQ ID NO: 8020796 - DNA, 22 bp, Homo sapiens
tgctttgtgtttgaatagataa

SEQ ID NO: 8020797 - DNA, 22 bp, Homo sapiens
tgctttgtgtacacaagaatca

SEQ ID NO: 8020798 - DNA, 22 bp, Homo sapiens
tgctttgtgtacacaagaatca

SEQ ID NO: 8020799 - DNA, 22 bp, Homo sapiens
tgctttgggtttgactctcatg

SEQ ID NO: 8020800 - DNA, 22 bp, Homo sapiens
tgcttttaggagattaaaatta

SEQ ID NO: 8020801 - DNA, 22 bp, Homo sapiens
tgcttttaggagattaaaatta

SEQ ID NO: 8020802 - DNA, 22 bp, Homo sapiens
tgcttttaggagattaaaatta

SEQ ID NO: 8020803 - DNA, 22 bp, Homo sapiens
tgcttttaggagattaaaatta

SEQ ID NO: 8020804 - DNA, 22 bp, Homo sapiens
tgcttttaggagattaaaatta

SEQ ID NO: 8020805 - DNA, 22 bp, Homo sapiens
tgcttttagctagtaactagta

SEQ ID NO: 8020806 - DNA, 22 bp, Homo sapiens
tgcttttaagaacaatgctgct

SEQ ID NO: 8020807 - DNA, 22 bp, Homo sapiens
tgcttttagctagtaactagta

SEQ ID NO: 8020808 - DNA, 22 bp, Homo sapiens
tgctttgggtttgactctcatg

SEQ ID NO: 8020809 - DNA, 22 bp, Homo sapiens
tgctttgtgacagattagtttt

SEQ ID NO: 8020810 - DNA, 22 bp, Homo sapiens
tgctttgggtttgactctcatg

SEQ ID NO: 8020811 - DNA, 22 bp, Homo sapiens
tgctttgggtttgactctcatg

SEQ ID NO: 8020812 - DNA, 22 bp, Homo sapiens
tgctttggctgacacgctcctg

SEQ ID NO: 8020813 - DNA, 22 bp, Homo sapiens
tgctttggctgacacgctcctg

SEQ ID NO: 8020814 - DNA, 21 bp, Homo sapiens
tgctttgggaattctcagtct

SEQ ID NO: 8020815 - DNA, 21 bp, Homo sapiens
tgctttgggaattctcagtct

SEQ ID NO: 8020816 - DNA, 22 bp, Homo sapiens
tgctttgggtctctctagtttc

SEQ ID NO: 8020817 - DNA, 22 bp, Homo sapiens
tgctttggccactagaattcag

SEQ ID NO: 8020818 - DNA, 22 bp, Homo sapiens
tgctttggccactagaattcag

SEQ ID NO: 8020819 - DNA, 22 bp, Homo sapiens
tgctttggccactagaattcag

SEQ ID NO: 8020820 - DNA, 22 bp, Homo sapiens
tgctttggatctatttgctgag

SEQ ID NO: 8020821 - DNA, 22 bp, Homo sapiens
tgctttgctttggagagccagc

SEQ ID NO: 8020822 - DNA, 22 bp, Homo sapiens
tgcttgtgtgagggcctgggag

SEQ ID NO: 8020823 - DNA, 22 bp, Homo sapiens
tgcttgttcatggcctagtggc

SEQ ID NO: 8020824 - DNA, 22 bp, Homo sapiens
tgcttgtgtgagggcctgggag

SEQ ID NO: 8020825 - DNA, 22 bp, Homo sapiens
tgcttgtgagagttttttcaga

SEQ ID NO: 8020826 - DNA, 22 bp, Homo sapiens
tgctttaaaatggactgttttg

SEQ ID NO: 8020827 - DNA, 22 bp, Homo sapiens
tgctttaaaatggactgttttg

SEQ ID NO: 8020828 - DNA, 22 bp, Homo sapiens
tgctttaaaatggactgttttg

SEQ ID NO: 8020829 - DNA, 22 bp, Homo sapiens
tgctttaacataagatatcttt

SEQ ID NO: 8020830 - DNA, 22 bp, Homo sapiens
tgctttaacataagatatcttt

SEQ ID NO: 8020831 - DNA, 22 bp, Homo sapiens
tgctttaaatatgaattagcat

SEQ ID NO: 8020832 - DNA, 22 bp, Homo sapiens
tgctttaaatatgaattagcat

SEQ ID NO: 8020833 - DNA, 22 bp, Homo sapiens
tgctttaaatatgaattagcat

SEQ ID NO: 8020834 - DNA, 22 bp, Homo sapiens
tgctttaaagtatttctcgcaa

SEQ ID NO: 8020835 - DNA, 22 bp, Homo sapiens
tgctttaaaccatggatgtgag

SEQ ID NO: 8020836 - DNA, 22 bp, Homo sapiens
tgctttaacgctgagggtctca

SEQ ID NO: 8020837 - DNA, 22 bp, Homo sapiens
tgctttaagacactaagtttga

SEQ ID NO: 8020838 - DNA, 22 bp, Homo sapiens
tgctttaaccatcttgtttgga

SEQ ID NO: 8020839 - DNA, 22 bp, Homo sapiens
tgctttaaccatcttgtttgga

SEQ ID NO: 8020840 - DNA, 22 bp, Homo sapiens
tgctttaacataagatatcttt

SEQ ID NO: 8020841 - DNA, 22 bp, Homo sapiens
tgctttaaccatcttgtttgga

SEQ ID NO: 8020842 - DNA, 22 bp, Homo sapiens
tgctttataaccatttctgtgg

SEQ ID NO: 8020843 - DNA, 22 bp, Homo sapiens
tgctttactaaataacttacca

SEQ ID NO: 8020844 - DNA, 22 bp, Homo sapiens
tgctttacaagcctgcttcctc

SEQ ID NO: 8020845 - DNA, 22 bp, Homo sapiens
tgctttaagagattgttagtac

SEQ ID NO: 8020846 - DNA, 22 bp, Homo sapiens
tgcttctttatgatgtatgatt

SEQ ID NO: 8020847 - DNA, 22 bp, Homo sapiens
tgcttgaacaaggataaatttg

SEQ ID NO: 8020848 - DNA, 22 bp, Homo sapiens
tgcttctttttatcttggagta

SEQ ID NO: 8020849 - DNA, 22 bp, Homo sapiens
tgcttctttttatcttggagta

SEQ ID NO: 8020850 - DNA, 22 bp, Homo sapiens
tgcttgaaaggggtttcccagt

SEQ ID NO: 8020851 - DNA, 22 bp, Homo sapiens
tgcttgactctggaataaaatg

SEQ ID NO: 8020852 - DNA, 22 bp, Homo sapiens
tgcttgaacccaggaagtggag

SEQ ID NO: 8020853 - DNA, 22 bp, Homo sapiens
tgcttgaagatatactacttcc

SEQ ID NO: 8020854 - DNA, 22 bp, Homo sapiens
tgcttgaagatatactacttcc

SEQ ID NO: 8020855 - DNA, 22 bp, Homo sapiens
tgcttgattagggaagtcacat

SEQ ID NO: 8020856 - DNA, 22 bp, Homo sapiens
tgcttgtgagagttttttcaga

SEQ ID NO: 8020857 - DNA, 22 bp, Homo sapiens
tgcttgtgacagaactgtgtcc

SEQ ID NO: 8020858 - DNA, 22 bp, Homo sapiens
tgcttgtcttcaggattatggt

SEQ ID NO: 8020859 - DNA, 22 bp, Homo sapiens
tgcttgtcttcaggattatggt

SEQ ID NO: 8020860 - DNA, 22 bp, Homo sapiens
tgcttgtcttcaggaatgctga

SEQ ID NO: 8020861 - DNA, 21 bp, Homo sapiens
tgcttgtctgcctagaggctt

SEQ ID NO: 8020862 - DNA, 22 bp, Homo sapiens
tgcttgtcttcaggaatgctga

SEQ ID NO: 8020863 - DNA, 21 bp, Homo sapiens
tgcttgtctgcctagaggctt

SEQ ID NO: 8020864 - DNA, 22 bp, Homo sapiens
tgcttgctctgctccaccaaga

SEQ ID NO: 8020865 - DNA, 22 bp, Homo sapiens
tgcttgctctccggactctaat

SEQ ID NO: 8020866 - DNA, 22 bp, Homo sapiens
tgcttgcaaatactctgctgtt

SEQ ID NO: 8020867 - DNA, 19 bp, Homo sapiens
tgcttgcctgcctttccca

SEQ ID NO: 8020868 - DNA, 22 bp, Homo sapiens
tgcttgctatgcatcctgaact

SEQ ID NO: 8020869 - DNA, 22 bp, Homo sapiens
tgcttgctccctcacactgtcc

SEQ ID NO: 8020870 - DNA, 22 bp, Homo sapiens
tgcttgctcgccgcctgctgac

SEQ ID NO: 8020871 - DNA, 22 bp, Homo sapiens
tgcttgctcgccgcctgctgac

SEQ ID NO: 8020872 - DNA, 22 bp, Homo sapiens
tgcttgctccctcacactgtcc

SEQ ID NO: 8020873 - DNA, 22 bp, Homo sapiens
tgcttctttactataggcaatt

SEQ ID NO: 8020874 - DNA, 22 bp, Homo sapiens
tgcttctttatgatgtatgatt

SEQ ID NO: 8020875 - DNA, 16 bp, Homo sapiens
tgcttcttttgcatca

SEQ ID NO: 8020876 - DNA, 22 bp, Homo sapiens
tgcttctttaaatgatagtcaa

SEQ ID NO: 8020877 - DNA, 22 bp, Homo sapiens
tgcttctttaaatgatagtcaa

SEQ ID NO: 8020878 - DNA, 22 bp, Homo sapiens
tgcttctttactataggcaatt

SEQ ID NO: 8020879 - DNA, 22 bp, Homo sapiens
tgcttctttactataggcaatt

SEQ ID NO: 8020880 - DNA, 22 bp, Homo sapiens
tgcttctgttctttcacctacg

SEQ ID NO: 8020881 - DNA, 22 bp, Homo sapiens
tgcttcttactcatatgctgat

SEQ ID NO: 8020882 - DNA, 22 bp, Homo sapiens
tgcttcttcctccatgtgttct

SEQ ID NO: 8020883 - DNA, 22 bp, Homo sapiens
tgcttctgggtcccagcctggc

SEQ ID NO: 8020884 - DNA, 19 bp, Homo sapiens
tgcttctggggcttctcca

SEQ ID NO: 8020885 - DNA, 22 bp, Homo sapiens
tgcttctgggtcccagcctggc

SEQ ID NO: 8020886 - DNA, 22 bp, Homo sapiens
tgcttctgtctcttatgccttg

SEQ ID NO: 8020887 - DNA, 22 bp, Homo sapiens
tgcttctgttacataccagaac

SEQ ID NO: 8020888 - DNA, 22 bp, Homo sapiens
tgcttctgttctttcacctacg

SEQ ID NO: 8020889 - DNA, 22 bp, Homo sapiens
tgcttctgttctttcacctacg

SEQ ID NO: 8020890 - DNA, 22 bp, Homo sapiens
tgcttctggcacttgagggggt

SEQ ID NO: 8020891 - DNA, 22 bp, Homo sapiens
tgcttctggcacttgagggggt

SEQ ID NO: 8020892 - DNA, 22 bp, Homo sapiens
tgcttctggcagattgagtgag

SEQ ID NO: 8020893 - DNA, 22 bp, Homo sapiens
tgcttctggcttatctcgtgcc

SEQ ID NO: 8020894 - DNA, 19 bp, Homo sapiens
tgcttctggaatgcaaggc

SEQ ID NO: 8020895 - DNA, 22 bp, Homo sapiens
tgcttctggagtaacagggtga

SEQ ID NO: 8020896 - DNA, 22 bp, Homo sapiens
tgcttctggaaacagtggctgt

SEQ ID NO: 8020897 - DNA, 22 bp, Homo sapiens
tgcttctggggacaggctgcct

SEQ ID NO: 8020898 - DNA, 22 bp, Homo sapiens
tgcttctggggacaggctgcct

SEQ ID NO: 8020899 - DNA, 22 bp, Homo sapiens
tgcttctggggacaggctgcct

SEQ ID NO: 8020900 - DNA, 22 bp, Homo sapiens
tgcttctggcttatctcgtgcc

SEQ ID NO: 8020901 - DNA, 19 bp, Homo sapiens
tgcttctggggcttctcca

SEQ ID NO: 8020902 - DNA, 22 bp, Homo sapiens
tgcttctgggtaggcctcagga

SEQ ID NO: 8020903 - DNA, 22 bp, Homo sapiens
tgcttctgggtaggcctcagga

SEQ ID NO: 8020904 - DNA, 22 bp, Homo sapiens
tgcttctggggacaggctgcct

SEQ ID NO: 8020905 - DNA, 19 bp, Homo sapiens
tgcttctggggcttctcca

SEQ ID NO: 8020906 - DNA, 19 bp, Homo sapiens
tgcttctggggcttctcca

SEQ ID NO: 8020907 - DNA, 20 bp, Homo sapiens
tgctttgatggaaatacagc

SEQ ID NO: 8020908 - DNA, 22 bp, Homo sapiens
tgctttgcaaataatagaatgt

SEQ ID NO: 8020909 - DNA, 20 bp, Homo sapiens
tgctttgatggaaatacagc

SEQ ID NO: 8020910 - DNA, 20 bp, Homo sapiens
tgctttgatggaaatacagc

SEQ ID NO: 8020911 - DNA, 22 bp, Homo sapiens
tgctttgacagggatgacatga

SEQ ID NO: 8020912 - DNA, 20 bp, Homo sapiens
tgctttgatggaaatacagc

SEQ ID NO: 8020913 - DNA, 20 bp, Homo sapiens
tgctttgatggaaatacagc

SEQ ID NO: 8020914 - DNA, 22 bp, Homo sapiens
tgctttgaaagataatactgtc

SEQ ID NO: 8020915 - DNA, 22 bp, Homo sapiens
tgctttctttagctcctgagtc

SEQ ID NO: 8020916 - DNA, 22 bp, Homo sapiens
tgctttgaaagataatactgtc

SEQ ID NO: 8020917 - DNA, 22 bp, Homo sapiens
tgctttgaaagataatactgtc

SEQ ID NO: 8020918 - DNA, 22 bp, Homo sapiens
tgctttgacagggatgacatga

SEQ ID NO: 8020919 - DNA, 22 bp, Homo sapiens
tgctttctttagctcctgagtc

SEQ ID NO: 8020920 - DNA, 22 bp, Homo sapiens
tgctttctttagctcctgagtc

SEQ ID NO: 8020921 - DNA, 22 bp, Homo sapiens
tgctttctttagctcctgagtc

SEQ ID NO: 8020922 - DNA, 22 bp, Homo sapiens
tgctttctttagctcctgagtc

SEQ ID NO: 8020923 - DNA, 22 bp, Homo sapiens
tgctttctttagctcctgagtc

SEQ ID NO: 8020924 - DNA, 17 bp, Homo sapiens
tgctttcttcctgccct

SEQ ID NO: 8020925 - DNA, 22 bp, Homo sapiens
tgctttctgtttttcatataat

SEQ ID NO: 8020926 - DNA, 17 bp, Homo sapiens
tgctttcttcctgccct

SEQ ID NO: 8020927 - DNA, 22 bp, Homo sapiens
tgctttctgtttttcatataat

SEQ ID NO: 8020928 - DNA, 22 bp, Homo sapiens
tgctttctgtttttcatataat

SEQ ID NO: 8020929 - DNA, 22 bp, Homo sapiens
tgctttctgctcttgtccacac

SEQ ID NO: 8020930 - DNA, 22 bp, Homo sapiens
tgctttctgctcttgtccacac

SEQ ID NO: 8020931 - DNA, 22 bp, Homo sapiens
tgctttctgctctggaaacagg

SEQ ID NO: 8020932 - DNA, 22 bp, Homo sapiens
tgctttctgctcttgtccacac

SEQ ID NO: 8020933 - DNA, 22 bp, Homo sapiens
tgctttctgctcttgtccacac

SEQ ID NO: 8020934 - DNA, 22 bp, Homo sapiens
tgctttctgctctggaaacagg

SEQ ID NO: 8020935 - DNA, 22 bp, Homo sapiens
tgctttctctctaccccacttt

SEQ ID NO: 8020936 - DNA, 22 bp, Homo sapiens
tgctttctcctgtctgaaagat

SEQ ID NO: 8020937 - DNA, 22 bp, Homo sapiens
tgctttattcagggtttacccc

SEQ ID NO: 8020938 - DNA, 22 bp, Homo sapiens
tgctttattcagtctctgccat

SEQ ID NO: 8020939 - DNA, 22 bp, Homo sapiens
tgctttattaagagagaaattt

SEQ ID NO: 8020940 - DNA, 22 bp, Homo sapiens
tgctttattaagagagaaattt

SEQ ID NO: 8020941 - DNA, 22 bp, Homo sapiens
tgctttattaagagagaaattt

SEQ ID NO: 8020942 - DNA, 22 bp, Homo sapiens
tgctttatgttatcagaagggt

SEQ ID NO: 8020943 - DNA, 22 bp, Homo sapiens
tgctttattcccttctgatgtg

SEQ ID NO: 8020944 - DNA, 22 bp, Homo sapiens
tgctttattcccttctgatgtg

SEQ ID NO: 8020945 - DNA, 22 bp, Homo sapiens
tgctttattcgacatctggtag

SEQ ID NO: 8020946 - DNA, 22 bp, Homo sapiens
tgctttattcgacatctggtag

SEQ ID NO: 8020947 - DNA, 22 bp, Homo sapiens
tgctttctcctgtctgaaagat

SEQ ID NO: 8020948 - DNA, 22 bp, Homo sapiens
tgctttctcctgtctgaaagat

SEQ ID NO: 8020949 - DNA, 22 bp, Homo sapiens
tgctttctctctaccccacttt

SEQ ID NO: 8020950 - DNA, 18 bp, Homo sapiens
tgctttctagcttcagat

SEQ ID NO: 8020951 - DNA, 22 bp, Homo sapiens
tgctttctcctgtctgaaagat

SEQ ID NO: 8020952 - DNA, 19 bp, Homo sapiens
tgctttctaaacacatgca

SEQ ID NO: 8020953 - DNA, 19 bp, Homo sapiens
tgctttctaaacacatgca

SEQ ID NO: 8020954 - DNA, 21 bp, Homo sapiens
tgctttctaaaaatactattg

SEQ ID NO: 8020955 - DNA, 18 bp, Homo sapiens
tgctttctagcttcagat

SEQ ID NO: 8020956 - DNA, 18 bp, Homo sapiens
tgctttctagcttcagat

SEQ ID NO: 8020957 - DNA, 19 bp, Homo sapiens
tgctttctaaacacatgca

SEQ ID NO: 8020958 - DNA, 21 bp, Homo sapiens
tgctttatgggaaaaatgtca

SEQ ID NO: 8020959 - DNA, 21 bp, Homo sapiens
tgctttatgggaaaaatgtca

SEQ ID NO: 8020960 - DNA, 21 bp, Homo sapiens
tgctttatgggaaaaatgtca

SEQ ID NO: 8020961 - DNA, 21 bp, Homo sapiens
tgctttatgggaaaaatgtca

SEQ ID NO: 8020962 - DNA, 21 bp, Homo sapiens
tgctttatgggaaaaatgtca

SEQ ID NO: 8020963 - DNA, 22 bp, Homo sapiens
tgctttatgttatcagaagggt

SEQ ID NO: 8020964 - DNA, 22 bp, Homo sapiens
tgctttatgtggctgatactca

SEQ ID NO: 8020965 - DNA, 22 bp, Homo sapiens
tgctttatgtggctgatactca

SEQ ID NO: 8020966 - DNA, 18 bp, Homo sapiens
tgctttatgcttatataa

SEQ ID NO: 8020967 - DNA, 18 bp, Homo sapiens
tgctttatgcttatataa

SEQ ID NO: 8020968 - DNA, 20 bp, Homo sapiens
tgctttatgctatactttgt

SEQ ID NO: 8020969 - DNA, 20 bp, Homo sapiens
tgctttatgctatactttgt

SEQ ID NO: 8020970 - DNA, 22 bp, Homo sapiens
tgctttatggatttgtgtcctg

SEQ ID NO: 8020971 - DNA, 18 bp, Homo sapiens
tgctttatgcttatataa

SEQ ID NO: 8020972 - DNA, 22 bp, Homo sapiens
tgctttatggagcccatctcat

SEQ ID NO: 8020973 - DNA, 22 bp, Homo sapiens
tgctttatctgtgagaacctga

SEQ ID NO: 8020974 - DNA, 22 bp, Homo sapiens
tgctttatctgtgagaacctga

SEQ ID NO: 8020975 - DNA, 22 bp, Homo sapiens
tgctttatctgtgagaacctga

SEQ ID NO: 8020976 - DNA, 22 bp, Homo sapiens
tgctttatctgacttggcgctg

SEQ ID NO: 8020977 - DNA, 22 bp, Homo sapiens
tgctttatctgacttggcgctg

SEQ ID NO: 8020978 - DNA, 22 bp, Homo sapiens
tgctttatatctctcttcttag

SEQ ID NO: 8020979 - DNA, 22 bp, Homo sapiens
tgctttatatctctcttcttag

SEQ ID NO: 8020980 - DNA, 22 bp, Homo sapiens
tgctttatcaaagctatagtga

SEQ ID NO: 8020981 - DNA, 22 bp, Homo sapiens
tgctttatcaaagctatagtga

SEQ ID NO: 8020982 - DNA, 22 bp, Homo sapiens
tgctttatcaaagctatagtga

SEQ ID NO: 8020983 - DNA, 22 bp, Homo sapiens
tgctttatcaaagctatagtga

SEQ ID NO: 8020984 - DNA, 22 bp, Homo sapiens
tgctttataggggattgcaggc

SEQ ID NO: 8020985 - DNA, 22 bp, Homo sapiens
tgctttataacttagtttatgg

SEQ ID NO: 8020986 - DNA, 22 bp, Homo sapiens
tgctttataacttagtttatgg

SEQ ID NO: 8020987 - DNA, 22 bp, Homo sapiens
tgctttataacttagtttatgg

SEQ ID NO: 8020988 - DNA, 22 bp, Homo sapiens
tgctttatagacaaggaagtag

SEQ ID NO: 8020989 - DNA, 22 bp, Homo sapiens
tggacaggatctgagactgaga

SEQ ID NO: 8020990 - DNA, 22 bp, Homo sapiens
tggacaggatctgagactgaga

SEQ ID NO: 8020991 - DNA, 22 bp, Homo sapiens
tggacaggatagtgcagtacgc

SEQ ID NO: 8020992 - DNA, 22 bp, Homo sapiens
tggacaggatctgagactgaga

SEQ ID NO: 8020993 - DNA, 22 bp, Homo sapiens
tggacaggatctgagactgaga

SEQ ID NO: 8020994 - DNA, 22 bp, Homo sapiens
tggacaggatagtgcagtacgc

SEQ ID NO: 8020995 - DNA, 22 bp, Homo sapiens
tggacaggatagtgcagtacgc

SEQ ID NO: 8020996 - DNA, 22 bp, Homo sapiens
tggacaggatctgagactgaga

SEQ ID NO: 8020997 - DNA, 22 bp, Homo sapiens
tggacaggcaagcaagacatac

SEQ ID NO: 8020998 - DNA, 22 bp, Homo sapiens
tggacaggcaagcaagacatac

SEQ ID NO: 8020999 - DNA, 22 bp, Homo sapiens
tggacaggcaagcaagacatac

SEQ ID NO: 8021000 - DNA, 23 bp, Homo sapiens
tggacagcagcagcagtgtcacc

SEQ ID NO: 8021001 - DNA, 22 bp, Homo sapiens
tggacagcgaaagtgcctggga

SEQ ID NO: 8021002 - DNA, 22 bp, Homo sapiens
tggacagcttgcagagccaccc

SEQ ID NO: 8021003 - DNA, 22 bp, Homo sapiens
tggacagcttgcagagccaccc

SEQ ID NO: 8021004 - DNA, 22 bp, Homo sapiens
tggacagcttgcagagccaccc

SEQ ID NO: 8021005 - DNA, 23 bp, Homo sapiens
tggacaggacccccttcggaccc

SEQ ID NO: 8021006 - DNA, 23 bp, Homo sapiens
tggacaggacccccttcggaccc

SEQ ID NO: 8021007 - DNA, 22 bp, Homo sapiens
tggacaggatagtgcagtacgc

SEQ ID NO: 8021008 - DNA, 20 bp, Homo sapiens
tggacacagccctgttgagt

SEQ ID NO: 8021009 - DNA, 22 bp, Homo sapiens
tggacacacatgtatgtcagag

SEQ ID NO: 8021010 - DNA, 22 bp, Homo sapiens
tggacacaatgttgccttaggg

SEQ ID NO: 8021011 - DNA, 22 bp, Homo sapiens
tggacacaatgttgccttaggg

SEQ ID NO: 8021012 - DNA, 22 bp, Homo sapiens
tggacaactggtttttgacaaa

SEQ ID NO: 8021013 - DNA, 22 bp, Homo sapiens
tggacacaaagatcaaatattg

SEQ ID NO: 8021014 - DNA, 22 bp, Homo sapiens
tggacacacatgtatgtcagag

SEQ ID NO: 8021015 - DNA, 22 bp, Homo sapiens
tggacaacatagtgagacctca

SEQ ID NO: 8021016 - DNA, 22 bp, Homo sapiens
tggacacaatgttgccttaggg

SEQ ID NO: 8021017 - DNA, 22 bp, Homo sapiens
tggacaatcaatggaggtaagt

SEQ ID NO: 8021018 - DNA, 18 bp, Homo sapiens
tggacacatggcctgggt

SEQ ID NO: 8021019 - DNA, 18 bp, Homo sapiens
tggacacatggcctgggt

SEQ ID NO: 8021020 - DNA, 18 bp, Homo sapiens
tggacacatggcctgggt

SEQ ID NO: 8021021 - DNA, 18 bp, Homo sapiens
tggacacatggcctgggt

SEQ ID NO: 8021022 - DNA, 18 bp, Homo sapiens
tggacacatggcctgggt

SEQ ID NO: 8021023 - DNA, 18 bp, Homo sapiens
tggacacatggcctgggt

SEQ ID NO: 8021024 - DNA, 20 bp, Homo sapiens
tggacacagccctgttgagt

SEQ ID NO: 8021025 - DNA, 22 bp, Homo sapiens
tggacacagtaggagctgcgca

SEQ ID NO: 8021026 - DNA, 22 bp, Homo sapiens
tggacacagtggtgaaggtaca

SEQ ID NO: 8021027 - DNA, 22 bp, Homo sapiens
tggacacatcactgcagccact

SEQ ID NO: 8021028 - DNA, 22 bp, Homo sapiens
tggacagaaacccgagtgatct

SEQ ID NO: 8021029 - DNA, 22 bp, Homo sapiens
tggacacttaaaaacagataaa

SEQ ID NO: 8021030 - DNA, 22 bp, Homo sapiens
tggacactgtctccaggataaa

SEQ ID NO: 8021031 - DNA, 22 bp, Homo sapiens
tggacacagtaggagctgcgca

SEQ ID NO: 8021032 - DNA, 22 bp, Homo sapiens
tggacactggccatttgagtag

SEQ ID NO: 8021033 - DNA, 22 bp, Homo sapiens
tggacagagaggaaggccattt

SEQ ID NO: 8021034 - DNA, 22 bp, Homo sapiens
tggacagagaggaaggccattt

SEQ ID NO: 8021035 - DNA, 22 bp, Homo sapiens
tggacagagaggaaggccattt

SEQ ID NO: 8021036 - DNA, 22 bp, Homo sapiens
tggacagagctgacagtatata

SEQ ID NO: 8021037 - DNA, 22 bp, Homo sapiens
tggacagagctgacagtatata

SEQ ID NO: 8021038 - DNA, 22 bp, Homo sapiens
tggaatggaaacaaactgagga

SEQ ID NO: 8021039 - DNA, 22 bp, Homo sapiens
tggaatggaaacaaactgagga

SEQ ID NO: 8021040 - DNA, 22 bp, Homo sapiens
tggaatgttatgatgatggtaa

SEQ ID NO: 8021041 - DNA, 19 bp, Homo sapiens
tggaatgttccaaggaggc

SEQ ID NO: 8021042 - DNA, 22 bp, Homo sapiens
tggaatggaaacaaactgagga

SEQ ID NO: 8021043 - DNA, 22 bp, Homo sapiens
tggaatgttgataaacataggc

SEQ ID NO: 8021044 - DNA, 22 bp, Homo sapiens
tggaatgttgcataagatctga

SEQ ID NO: 8021045 - DNA, 22 bp, Homo sapiens
tggaatgttgcataagatctga

SEQ ID NO: 8021046 - DNA, 22 bp, Homo sapiens
tggaatgttgctctgccttgcg

SEQ ID NO: 8021047 - DNA, 22 bp, Homo sapiens
tggaatgtttgacttattcagt

SEQ ID NO: 8021048 - DNA, 22 bp, Homo sapiens
tggaatgtttgacttattcagt

SEQ ID NO: 8021049 - DNA, 22 bp, Homo sapiens
tggaatgtttgacttattcagt

SEQ ID NO: 8021050 - DNA, 23 bp, Homo sapiens
tggaatgtttcttgtactgaatg

SEQ ID NO: 8021051 - DNA, 22 bp, Homo sapiens
tggaatgtttccccagcctgca

SEQ ID NO: 8021052 - DNA, 22 bp, Homo sapiens
tggaatgttgtgtataggtcag

SEQ ID NO: 8021053 - DNA, 22 bp, Homo sapiens
tggaatgttgggatttaagtgt

SEQ ID NO: 8021054 - DNA, 22 bp, Homo sapiens
tggacaaatagcatgacacttg

SEQ ID NO: 8021055 - DNA, 22 bp, Homo sapiens
tggacaacatagtgagacctca

SEQ ID NO: 8021056 - DNA, 22 bp, Homo sapiens
tggaatttagttaattccattt

SEQ ID NO: 8021057 - DNA, 22 bp, Homo sapiens
tggacaacatagtgagacctca

SEQ ID NO: 8021058 - DNA, 22 bp, Homo sapiens
tggaattcttattctgacttca

SEQ ID NO: 8021059 - DNA, 22 bp, Homo sapiens
tggaatgttttcctaaatcaga

SEQ ID NO: 8021060 - DNA, 22 bp, Homo sapiens
tggaattatctgaagtgatttg

SEQ ID NO: 8021061 - DNA, 22 bp, Homo sapiens
tggaatggaaacaaactgagga

SEQ ID NO: 8021062 - DNA, 22 bp, Homo sapiens
tggaatgatgactaggaattgt

SEQ ID NO: 8021063 - DNA, 22 bp, Homo sapiens
tggaatgagtggctaagattca

SEQ ID NO: 8021064 - DNA, 23 bp, Homo sapiens
tggaatgagctgggaagctgagc

SEQ ID NO: 8021065 - DNA, 23 bp, Homo sapiens
tggaatgagctgggaagctgagc

SEQ ID NO: 8021066 - DNA, 21 bp, Homo sapiens
tggaatgaggctgagcagtgc

SEQ ID NO: 8021067 - DNA, 22 bp, Homo sapiens
tggaatgacaagttgttcagag

SEQ ID NO: 8021068 - DNA, 22 bp, Homo sapiens
tggaatgacaagttgttcagag

SEQ ID NO: 8021069 - DNA, 22 bp, Homo sapiens
tggaatgagctggctaataacc

SEQ ID NO: 8021070 - DNA, 22 bp, Homo sapiens
tggaatgacagagagtctgaat

SEQ ID NO: 8021071 - DNA, 22 bp, Homo sapiens
tggaatgagctggctaataacc

SEQ ID NO: 8021072 - DNA, 22 bp, Homo sapiens
tggaatgaaaatggagatcttg

SEQ ID NO: 8021073 - DNA, 22 bp, Homo sapiens
tggaatgaaaagtacttcagaa

SEQ ID NO: 8021074 - DNA, 22 bp, Homo sapiens
tggaatgaaggagatggccttt

SEQ ID NO: 8021075 - DNA, 22 bp, Homo sapiens
tggaatgaagacatgttgtttg

SEQ ID NO: 8021076 - DNA, 22 bp, Homo sapiens
tggactgaagttacagatgaca

SEQ ID NO: 8021077 - DNA, 22 bp, Homo sapiens
tggactcttggaccttctctaa

SEQ ID NO: 8021078 - DNA, 22 bp, Homo sapiens
tggactgaagttacagatgaca

SEQ ID NO: 8021079 - DNA, 22 bp, Homo sapiens
tggactgaattgaagcaggaag

SEQ ID NO: 8021080 - DNA, 22 bp, Homo sapiens
tggactgagcttgagagggttg

SEQ ID NO: 8021081 - DNA, 22 bp, Homo sapiens
tggactctaagcagaggatcta

SEQ ID NO: 8021082 - DNA, 22 bp, Homo sapiens
tggactctaagcagaggatcta

SEQ ID NO: 8021083 - DNA, 22 bp, Homo sapiens
tggactctatgatgcgccagca

SEQ ID NO: 8021084 - DNA, 22 bp, Homo sapiens
tggactctgaactggcactgac

SEQ ID NO: 8021085 - DNA, 22 bp, Homo sapiens
tggactgattttcattttaaat

SEQ ID NO: 8021086 - DNA, 22 bp, Homo sapiens
tggactggaatgctgatcctct

SEQ ID NO: 8021087 - DNA, 22 bp, Homo sapiens
tggactggaatgctgatcctct

SEQ ID NO: 8021088 - DNA, 22 bp, Homo sapiens
tggactgggctaatggcagaca

SEQ ID NO: 8021089 - DNA, 21 bp, Homo sapiens
tggactggtgagtttaggctg

SEQ ID NO: 8021090 - DNA, 22 bp, Homo sapiens
tggactgggctaatggcagaca

SEQ ID NO: 8021091 - DNA, 22 bp, Homo sapiens
tggactgggctaatggcagaca

SEQ ID NO: 8021092 - DNA, 19 bp, Homo sapiens
tggacctgtgcccatggct

SEQ ID NO: 8021093 - DNA, 22 bp, Homo sapiens
tggactaaagaggaagcaaata

SEQ ID NO: 8021094 - DNA, 20 bp, Homo sapiens
tggacctgtctctttaggga

SEQ ID NO: 8021095 - DNA, 20 bp, Homo sapiens
tggacctgtctctttaggga

SEQ ID NO: 8021096 - DNA, 22 bp, Homo sapiens
tggactcaccttgagttagcca

SEQ ID NO: 8021097 - DNA, 22 bp, Homo sapiens
tggacctcactgtctgctggta

SEQ ID NO: 8021098 - DNA, 22 bp, Homo sapiens
tggacctgaagaataggaagta

SEQ ID NO: 8021099 - DNA, 22 bp, Homo sapiens
tggacctgaagaataggaagta

SEQ ID NO: 8021100 - DNA, 22 bp, Homo sapiens
tggacctgaagaataggaagta

SEQ ID NO: 8021101 - DNA, 22 bp, Homo sapiens
tggacctgagcctggccctgcc

SEQ ID NO: 8021102 - DNA, 22 bp, Homo sapiens
tggacctgcgtaggtgctgggc

SEQ ID NO: 8021103 - DNA, 22 bp, Homo sapiens
tggacctgctggatgggcaggt

SEQ ID NO: 8021104 - DNA, 22 bp, Homo sapiens
tggacctgctggatgggcaggt

SEQ ID NO: 8021105 - DNA, 22 bp, Homo sapiens
tggacctggggtggcctcctct

SEQ ID NO: 8021106 - DNA, 22 bp, Homo sapiens
tggacccaggcaggtctgtcct

SEQ ID NO: 8021107 - DNA, 22 bp, Homo sapiens
tggaccccagacaagccagggt

SEQ ID NO: 8021108 - DNA, 22 bp, Homo sapiens
tggaccccagacaagccagggt

SEQ ID NO: 8021109 - DNA, 22 bp, Homo sapiens
tggaccccctcaaggcagagct

SEQ ID NO: 8021110 - DNA, 22 bp, Homo sapiens
tggaccccctcaaggcagagct

SEQ ID NO: 8021111 - DNA, 22 bp, Homo sapiens
tggaccccagacaagccagggt

SEQ ID NO: 8021112 - DNA, 22 bp, Homo sapiens
tggaccctacccggccctcggc

SEQ ID NO: 8021113 - DNA, 22 bp, Homo sapiens
tggaccctacccggccctcggc

SEQ ID NO: 8021114 - DNA, 23 bp, Homo sapiens
tggaccctgcacaccagctctac

SEQ ID NO: 8021115 - DNA, 23 bp, Homo sapiens
tggaccctgcacaccagctctac

SEQ ID NO: 8021116 - DNA, 23 bp, Homo sapiens
tggaccctgcacaccagctctac

SEQ ID NO: 8021117 - DNA, 22 bp, Homo sapiens
tggaccctgaagcaacagggag

SEQ ID NO: 8021118 - DNA, 17 bp, Homo sapiens
tggacccttgggcctcc

SEQ ID NO: 8021119 - DNA, 22 bp, Homo sapiens
tggaccgcagggatgcccggca

SEQ ID NO: 8021120 - DNA, 17 bp, Homo sapiens
tggacccttgggcctcc

SEQ ID NO: 8021121 - DNA, 22 bp, Homo sapiens
tggaccctggactgccctggcc

SEQ ID NO: 8021122 - DNA, 22 bp, Homo sapiens
tggaccctggactgccctggcc

SEQ ID NO: 8021123 - DNA, 22 bp, Homo sapiens
tggaccacatagtgaggccccc

SEQ ID NO: 8021124 - DNA, 22 bp, Homo sapiens
tggaccaattctcagttttctt

SEQ ID NO: 8021125 - DNA, 22 bp, Homo sapiens
tggaccaacattcactggcata

SEQ ID NO: 8021126 - DNA, 21 bp, Homo sapiens
tggaccaaagtaatttgcctt

SEQ ID NO: 8021127 - DNA, 22 bp, Homo sapiens
tggaccaacattcactggcata

SEQ ID NO: 8021128 - DNA, 21 bp, Homo sapiens
tggacattatggagagagtag

SEQ ID NO: 8021129 - DNA, 22 bp, Homo sapiens
tggacaggtgagtgactcaggg

SEQ ID NO: 8021130 - DNA, 22 bp, Homo sapiens
tggacattccacccatatcaga

SEQ ID NO: 8021131 - DNA, 22 bp, Homo sapiens
tggacatttggaatactatatt

SEQ ID NO: 8021132 - DNA, 21 bp, Homo sapiens
tggacatttacccttcaggga

SEQ ID NO: 8021133 - DNA, 22 bp, Homo sapiens
tggacatttggaatactatatt

SEQ ID NO: 8021134 - DNA, 18 bp, Homo sapiens
tggacagggtggagaaaa

SEQ ID NO: 8021135 - DNA, 22 bp, Homo sapiens
tggacaggtgagtgactcaggg

SEQ ID NO: 8021136 - DNA, 22 bp, Homo sapiens
tggacaggtgagtgactcaggg

SEQ ID NO: 8021137 - DNA, 22 bp, Homo sapiens
tggacaggtgagtgactcaggg

SEQ ID NO: 8021138 - DNA, 22 bp, Homo sapiens
tggacaggtgcacacagcagcc

SEQ ID NO: 8021139 - DNA, 22 bp, Homo sapiens
tggacaggtgagtgactcaggg

SEQ ID NO: 8021140 - DNA, 22 bp, Homo sapiens
tggacccaccccagggcctgct

SEQ ID NO: 8021141 - DNA, 22 bp, Homo sapiens
tggacccaccccagggcctgct

SEQ ID NO: 8021142 - DNA, 22 bp, Homo sapiens
tggaccagggtcccagagtatg

SEQ ID NO: 8021143 - DNA, 21 bp, Homo sapiens
tggaccaggaaggtggtggtg

SEQ ID NO: 8021144 - DNA, 22 bp, Homo sapiens
tggaccagggtcccagagtatg

SEQ ID NO: 8021145 - DNA, 22 bp, Homo sapiens
tggaccagggtcccagagtatg

SEQ ID NO: 8021146 - DNA, 22 bp, Homo sapiens
tggaccagctcctcgggagacg

SEQ ID NO: 8021147 - DNA, 21 bp, Homo sapiens
tggaccaggaaggtggtggtg

SEQ ID NO: 8021148 - DNA, 21 bp, Homo sapiens
tggaccaggaaggtggtggtg

SEQ ID NO: 8021149 - DNA, 22 bp, Homo sapiens
tggaccagcagccccagtgcct

SEQ ID NO: 8021150 - DNA, 22 bp, Homo sapiens
tggaccagcagccccagtgcct

SEQ ID NO: 8021151 - DNA, 22 bp, Homo sapiens
tggaccagcagccccagtgcct

SEQ ID NO: 8021152 - DNA, 22 bp, Homo sapiens
tggaccagcagccccagtgcct

SEQ ID NO: 8021153 - DNA, 22 bp, Homo sapiens
tggaccagcagccccagtgcct

SEQ ID NO: 8021154 - DNA, 22 bp, Homo sapiens
tggaccagcagccccagtgcct

SEQ ID NO: 8021155 - DNA, 22 bp, Homo sapiens
tggaccagcagccccagtgcct

SEQ ID NO: 8021156 - DNA, 22 bp, Homo sapiens
tggacagggcagagaccgagtc

SEQ ID NO: 8021157 - DNA, 22 bp, Homo sapiens
tggacagggcagagaccgagtc

SEQ ID NO: 8021158 - DNA, 20 bp, Homo sapiens
tggacaggggcataggttgc

SEQ ID NO: 8021159 - DNA, 22 bp, Homo sapiens
tggacagggcagagaccgagtc

SEQ ID NO: 8021160 - DNA, 20 bp, Homo sapiens
tggacaggggcataggttgc

SEQ ID NO: 8021161 - DNA, 20 bp, Homo sapiens
tggacaggggcataggttgc

SEQ ID NO: 8021162 - DNA, 22 bp, Homo sapiens
tggacagggcagagaccgagtc

SEQ ID NO: 8021163 - DNA, 20 bp, Homo sapiens
tggacaggggcataggttgc

SEQ ID NO: 8021164 - DNA, 22 bp, Homo sapiens
tggacaggctcctaggggttcc

SEQ ID NO: 8021165 - DNA, 22 bp, Homo sapiens
tggacagggcagagaccgagtc

SEQ ID NO: 8021166 - DNA, 22 bp, Homo sapiens
tggacagggcagagaccgagtc

SEQ ID NO: 8021167 - DNA, 22 bp, Homo sapiens
tggacaggctcctaggggttcc

SEQ ID NO: 8021168 - DNA, 22 bp, Homo sapiens
tggacaggctcctaggggttcc

SEQ ID NO: 8021169 - DNA, 22 bp, Homo sapiens
tggacaggctcctaggggttcc

SEQ ID NO: 8021170 - DNA, 22 bp, Homo sapiens
tggacaggctcctaggggttcc

SEQ ID NO: 8021171 - DNA, 22 bp, Homo sapiens
tggacaggctcctaggggttcc

SEQ ID NO: 8021172 - DNA, 20 bp, Homo sapiens
tggacaggggcataggttgc

SEQ ID NO: 8021173 - DNA, 22 bp, Homo sapiens
tggacaggggctgctgttgtca

SEQ ID NO: 8021174 - DNA, 23 bp, Homo sapiens
tggacagggtaactggtggtttt

SEQ ID NO: 8021175 - DNA, 23 bp, Homo sapiens
tggacagggtaactggtggtttt

SEQ ID NO: 8021176 - DNA, 23 bp, Homo sapiens
tggacagggtaactggtggtttt

SEQ ID NO: 8021177 - DNA, 23 bp, Homo sapiens
tggacagggtaactggtggtttt

SEQ ID NO: 8021178 - DNA, 18 bp, Homo sapiens
tggacagggtggagaaaa

SEQ ID NO: 8021179 - DNA, 18 bp, Homo sapiens
tggacagggtggagaaaa

SEQ ID NO: 8021180 - DNA, 18 bp, Homo sapiens
tggacagggtggagaaaa

SEQ ID NO: 8021181 - DNA, 18 bp, Homo sapiens
tggacagggtggagaaaa

SEQ ID NO: 8021182 - DNA, 18 bp, Homo sapiens
tggacagggtggagaaaa

SEQ ID NO: 8021183 - DNA, 18 bp, Homo sapiens
tggacagggtggagaaaa

SEQ ID NO: 8021184 - DNA, 22 bp, Homo sapiens
tggaagagcaggcagacaatgc

SEQ ID NO: 8021185 - DNA, 19 bp, Homo sapiens
tggaagaggaagggaaata

SEQ ID NO: 8021186 - DNA, 19 bp, Homo sapiens
tggaagaggaagggaaata

SEQ ID NO: 8021187 - DNA, 19 bp, Homo sapiens
tggaagaggaagggaaata

SEQ ID NO: 8021188 - DNA, 22 bp, Homo sapiens
tggaagagaaaggagtggatct

SEQ ID NO: 8021189 - DNA, 22 bp, Homo sapiens
tggaagagaaaatccaccctta

SEQ ID NO: 8021190 - DNA, 22 bp, Homo sapiens
tggaagagacacttacattcag

SEQ ID NO: 8021191 - DNA, 22 bp, Homo sapiens
tggaagagaaaggagtggatct

SEQ ID NO: 8021192 - DNA, 22 bp, Homo sapiens
tggaagacattgctttcctttg

SEQ ID NO: 8021193 - DNA, 22 bp, Homo sapiens
tggaagacattttggaccttgg

SEQ ID NO: 8021194 - DNA, 22 bp, Homo sapiens
tggaagacattttggaccttgg

SEQ ID NO: 8021195 - DNA, 22 bp, Homo sapiens
tggaagaccagacttcccgaac

SEQ ID NO: 8021196 - DNA, 22 bp, Homo sapiens
tggaagacattattttgtttgt

SEQ ID NO: 8021197 - DNA, 22 bp, Homo sapiens
tggaagacattgctttcctttg

SEQ ID NO: 8021198 - DNA, 22 bp, Homo sapiens
tggaagacattattttgtttgt

SEQ ID NO: 8021199 - DNA, 22 bp, Homo sapiens
tggaagacatactgttttctta

SEQ ID NO: 8021200 - DNA, 22 bp, Homo sapiens
tggaagacatactgttttctta

SEQ ID NO: 8021201 - DNA, 22 bp, Homo sapiens
tggaagactcaaggtggtgaat

SEQ ID NO: 8021202 - DNA, 22 bp, Homo sapiens
tggaagactatcccgtgatttt

SEQ ID NO: 8021203 - DNA, 23 bp, Homo sapiens
tggaagactcctctcttggctgc

SEQ ID NO: 8021204 - DNA, 22 bp, Homo sapiens
tggaagacggaaatctgtagat

SEQ ID NO: 8021205 - DNA, 22 bp, Homo sapiens
tggaagaccagacttcccgaac

SEQ ID NO: 8021206 - DNA, 22 bp, Homo sapiens
tggaagaccagacttcccgaac

SEQ ID NO: 8021207 - DNA, 22 bp, Homo sapiens
tggaagaccacaagcccttaac

SEQ ID NO: 8021208 - DNA, 22 bp, Homo sapiens
tggaagaccagacttcccgaac

SEQ ID NO: 8021209 - DNA, 22 bp, Homo sapiens
tggaagataagagattgggaag

SEQ ID NO: 8021210 - DNA, 22 bp, Homo sapiens
tggaagaggtggaagtggcttc

SEQ ID NO: 8021211 - DNA, 22 bp, Homo sapiens
tggaagataagagattgggaag

SEQ ID NO: 8021212 - DNA, 22 bp, Homo sapiens
tggaagatcaaccaggattgac

SEQ ID NO: 8021213 - DNA, 22 bp, Homo sapiens
tggaagatcaaccaggattgac

SEQ ID NO: 8021214 - DNA, 22 bp, Homo sapiens
tggaagaggtggaagtggcttc

SEQ ID NO: 8021215 - DNA, 22 bp, Homo sapiens
tggaagaggtggaagtggcttc

SEQ ID NO: 8021216 - DNA, 22 bp, Homo sapiens
tggaagaggtggaagtggcttc

SEQ ID NO: 8021217 - DNA, 22 bp, Homo sapiens
tggaagaggtggaagtggcttc

SEQ ID NO: 8021218 - DNA, 22 bp, Homo sapiens
tggaagagggagctgggtggcc

SEQ ID NO: 8021219 - DNA, 22 bp, Homo sapiens
tggaagagggagctgggtggcc

SEQ ID NO: 8021220 - DNA, 22 bp, Homo sapiens
tggaagagggagctgggtggcc

SEQ ID NO: 8021221 - DNA, 22 bp, Homo sapiens
tggaagaggcccatgactgcct

SEQ ID NO: 8021222 - DNA, 22 bp, Homo sapiens
tggaagaggcccatgactgcct

SEQ ID NO: 8021223 - DNA, 22 bp, Homo sapiens
tggaagaggccagaaagtggga

SEQ ID NO: 8021224 - DNA, 22 bp, Homo sapiens
tggaagaggccagaaagtggga

SEQ ID NO: 8021225 - DNA, 19 bp, Homo sapiens
tggaagaggaagggaaata

SEQ ID NO: 8021226 - DNA, 22 bp, Homo sapiens
tggaagaggccagaaagtggga

SEQ ID NO: 8021227 - DNA, 22 bp, Homo sapiens
tggaagcactgaagagacaacc

SEQ ID NO: 8021228 - DNA, 22 bp, Homo sapiens
tggaagcactgaagagacaacc

SEQ ID NO: 8021229 - DNA, 22 bp, Homo sapiens
tggaagcactgaagagacaacc

SEQ ID NO: 8021230 - DNA, 22 bp, Homo sapiens
tggaagcactgaagagacaacc

SEQ ID NO: 8021231 - DNA, 22 bp, Homo sapiens
tggaagcactgaagagacaacc

SEQ ID NO: 8021232 - DNA, 22 bp, Homo sapiens
tggaagcacaggatcagtggaa

SEQ ID NO: 8021233 - DNA, 22 bp, Homo sapiens
tggaagcacaggatcagtggaa

SEQ ID NO: 8021234 - DNA, 22 bp, Homo sapiens
tggaagcacaggatcagtggaa

SEQ ID NO: 8021235 - DNA, 22 bp, Homo sapiens
tggaagcaacactcagctttac

SEQ ID NO: 8021236 - DNA, 22 bp, Homo sapiens
tggaagcaacaactatggacca

SEQ ID NO: 8021237 - DNA, 22 bp, Homo sapiens
tggaagcaacaactatggacca

SEQ ID NO: 8021238 - DNA, 23 bp, Homo sapiens
tggaagcaatcactgtagtgaat

SEQ ID NO: 8021239 - DNA, 23 bp, Homo sapiens
tggaagcaatcactgtagtgaat

SEQ ID NO: 8021240 - DNA, 23 bp, Homo sapiens
tggaagcagaagtttcaatatcc

SEQ ID NO: 8021241 - DNA, 22 bp, Homo sapiens
tggaagcacttgggttttgttg

SEQ ID NO: 8021242 - DNA, 22 bp, Homo sapiens
tggaagcagagagctatcacca

SEQ ID NO: 8021243 - DNA, 22 bp, Homo sapiens
tggaagcagagagctatcacca

SEQ ID NO: 8021244 - DNA, 22 bp, Homo sapiens
tggaagcagcattaatgagtta

SEQ ID NO: 8021245 - DNA, 22 bp, Homo sapiens
tggaagcagtcacttcctagtt

SEQ ID NO: 8021246 - DNA, 22 bp, Homo sapiens
tggaagcagcattaatgagtta

SEQ ID NO: 8021247 - DNA, 22 bp, Homo sapiens
tggaagcagtgattcttgtctg

SEQ ID NO: 8021248 - DNA, 22 bp, Homo sapiens
tggaagcagtgattcttgtctg

SEQ ID NO: 8021249 - DNA, 23 bp, Homo sapiens
tggaagcagttccagcacaaata

SEQ ID NO: 8021250 - DNA, 22 bp, Homo sapiens
tggaagcatacccccttagcac

SEQ ID NO: 8021251 - DNA, 22 bp, Homo sapiens
tggaagcagtgattcttgtctg

SEQ ID NO: 8021252 - DNA, 22 bp, Homo sapiens
tggaagcatcacttcttgcctg

SEQ ID NO: 8021253 - DNA, 22 bp, Homo sapiens
tggaagcatagcagcgtgtgtg

SEQ ID NO: 8021254 - DNA, 22 bp, Homo sapiens
tggaagcatagcagcgtgtgtg

SEQ ID NO: 8021255 - DNA, 22 bp, Homo sapiens
tggaagccaaggtcagaaggag

SEQ ID NO: 8021256 - DNA, 22 bp, Homo sapiens
tggaagcatcacttcttgcctg

SEQ ID NO: 8021257 - DNA, 22 bp, Homo sapiens
tggaagccaggaagcaggggtc

SEQ ID NO: 8021258 - DNA, 22 bp, Homo sapiens
tggaagccaggcccgctcctaa

SEQ ID NO: 8021259 - DNA, 22 bp, Homo sapiens
tggaagcccagaaggaagcaga

SEQ ID NO: 8021260 - DNA, 22 bp, Homo sapiens
tggaaggaaaggtagcagagaa

SEQ ID NO: 8021261 - DNA, 22 bp, Homo sapiens
tggaaggaaaggtagcagagaa

SEQ ID NO: 8021262 - DNA, 22 bp, Homo sapiens
tggaaggaaaggtagcagagaa

SEQ ID NO: 8021263 - DNA, 22 bp, Homo sapiens
tggaaggaaaggtagcagagaa

SEQ ID NO: 8021264 - DNA, 22 bp, Homo sapiens
tggaaggaaaggtagcagagaa

SEQ ID NO: 8021265 - DNA, 22 bp, Homo sapiens
tggaaggaaaggtagcagagaa

SEQ ID NO: 8021266 - DNA, 22 bp, Homo sapiens
tggaagcttttgagattgttgc

SEQ ID NO: 8021267 - DNA, 22 bp, Homo sapiens
tggaaggaaaggtagcagagaa

SEQ ID NO: 8021268 - DNA, 22 bp, Homo sapiens
tggaagcttttgagattgttgc

SEQ ID NO: 8021269 - DNA, 22 bp, Homo sapiens
tggaagcttctgaccatttttg

SEQ ID NO: 8021270 - DNA, 22 bp, Homo sapiens
tggaaggaagccaaggaaggtt

SEQ ID NO: 8021271 - DNA, 22 bp, Homo sapiens
tggaaggaagccaaggaaggtt

SEQ ID NO: 8021272 - DNA, 22 bp, Homo sapiens
tggaaggaagccaaggaaggtt

SEQ ID NO: 8021273 - DNA, 22 bp, Homo sapiens
tggaaggaagccaaggaaggtt

SEQ ID NO: 8021274 - DNA, 22 bp, Homo sapiens
tggaaggaagccaaggaaggtt

SEQ ID NO: 8021275 - DNA, 22 bp, Homo sapiens
tggaaggaagccaaggaaggtt

SEQ ID NO: 8021276 - DNA, 22 bp, Homo sapiens
tggaaggaacagagtttgaaac

SEQ ID NO: 8021277 - DNA, 22 bp, Homo sapiens
tggaaggaacagagtttgaaac

SEQ ID NO: 8021278 - DNA, 22 bp, Homo sapiens
tggaagctagagcttagtctcg

SEQ ID NO: 8021279 - DNA, 22 bp, Homo sapiens
tggaagctcaaggcagggtgag

SEQ ID NO: 8021280 - DNA, 18 bp, Homo sapiens
tggaagctggcagatttt

SEQ ID NO: 8021281 - DNA, 18 bp, Homo sapiens
tggaagctggcagatttt

SEQ ID NO: 8021282 - DNA, 18 bp, Homo sapiens
tggaagctggcagatttt

SEQ ID NO: 8021283 - DNA, 22 bp, Homo sapiens
tggaagcccagaaggaagcaga

SEQ ID NO: 8021284 - DNA, 22 bp, Homo sapiens
tggaagccgtagggtttgggaa

SEQ ID NO: 8021285 - DNA, 17 bp, Homo sapiens
tggaagcttcatgttgg

SEQ ID NO: 8021286 - DNA, 22 bp, Homo sapiens
tggaagcttcctgttcttgagg

SEQ ID NO: 8021287 - DNA, 22 bp, Homo sapiens
tggaagcttcctgttcttgagg

SEQ ID NO: 8021288 - DNA, 17 bp, Homo sapiens
tggaagcttcatgttgg

SEQ ID NO: 8021289 - DNA, 18 bp, Homo sapiens
tggaagctggtgagcaga

SEQ ID NO: 8021290 - DNA, 18 bp, Homo sapiens
tggaagctggtgagcaga

SEQ ID NO: 8021291 - DNA, 18 bp, Homo sapiens
tggaagctggtgagcaga

SEQ ID NO: 8021292 - DNA, 18 bp, Homo sapiens
tggaagctggtgagcaga

SEQ ID NO: 8021293 - DNA, 23 bp, Homo sapiens
tggaatcagccttttttccaagg

SEQ ID NO: 8021294 - DNA, 22 bp, Homo sapiens
tggaatcagactcctgcatttt

SEQ ID NO: 8021295 - DNA, 22 bp, Homo sapiens
tggaatcaagaactttggttat

SEQ ID NO: 8021296 - DNA, 22 bp, Homo sapiens
tggaatcagactcctgcatttt

SEQ ID NO: 8021297 - DNA, 22 bp, Homo sapiens
tggaatatgcaattgcatttca

SEQ ID NO: 8021298 - DNA, 22 bp, Homo sapiens
tggaatatactcagaacaggct

SEQ ID NO: 8021299 - DNA, 23 bp, Homo sapiens
tggaataataaggtacattaaca

SEQ ID NO: 8021300 - DNA, 22 bp, Homo sapiens
tggaataatgaccacagaaaca

SEQ ID NO: 8021301 - DNA, 23 bp, Homo sapiens
tggaataataaggtacattaaca

SEQ ID NO: 8021302 - DNA, 20 bp, Homo sapiens
tggaataagttaagttgttt

SEQ ID NO: 8021303 - DNA, 22 bp, Homo sapiens
tggaatcattggagagctgtaa

SEQ ID NO: 8021304 - DNA, 22 bp, Homo sapiens
tggaatcccgcaatggaggatt

SEQ ID NO: 8021305 - DNA, 18 bp, Homo sapiens
tggaatcctgatgctggg

SEQ ID NO: 8021306 - DNA, 22 bp, Homo sapiens
tggaatctctggtatctgggga

SEQ ID NO: 8021307 - DNA, 22 bp, Homo sapiens
tggaatctttaggaagcacata

SEQ ID NO: 8021308 - DNA, 23 bp, Homo sapiens
tggaatcttcgatattgattcag

SEQ ID NO: 8021309 - DNA, 23 bp, Homo sapiens
tggaatcttcgatattgattcag

SEQ ID NO: 8021310 - DNA, 22 bp, Homo sapiens
tggaatcttgcgggcacatggc

SEQ ID NO: 8021311 - DNA, 22 bp, Homo sapiens
tggaatctgtatgtatgtataa

SEQ ID NO: 8021312 - DNA, 22 bp, Homo sapiens
tggaatctctttggggactgaa

SEQ ID NO: 8021313 - DNA, 22 bp, Homo sapiens
tggaatctgtatgtatgtataa

SEQ ID NO: 8021314 - DNA, 22 bp, Homo sapiens
tggaatctgtgctgttttagtg

SEQ ID NO: 8021315 - DNA, 22 bp, Homo sapiens
tggaatctgtgctgttttagtg

SEQ ID NO: 8021316 - DNA, 22 bp, Homo sapiens
tggaagtgctaaactggagtgt

SEQ ID NO: 8021317 - DNA, 22 bp, Homo sapiens
tggaagtgctaaactggagtgt

SEQ ID NO: 8021318 - DNA, 22 bp, Homo sapiens
tggaagtgctaaactggagtgt

SEQ ID NO: 8021319 - DNA, 22 bp, Homo sapiens
tggaagtgccttgctggctgtg

SEQ ID NO: 8021320 - DNA, 22 bp, Homo sapiens
tggaagtgctcttctgaccaac

SEQ ID NO: 8021321 - DNA, 22 bp, Homo sapiens
tggaagtgctcttctgaccaac

SEQ ID NO: 8021322 - DNA, 22 bp, Homo sapiens
tggaagtgctaaactggagtgt

SEQ ID NO: 8021323 - DNA, 22 bp, Homo sapiens
tggaagtggcagaggaagtggt

SEQ ID NO: 8021324 - DNA, 22 bp, Homo sapiens
tggaagtggcagaggaagtggt

SEQ ID NO: 8021325 - DNA, 22 bp, Homo sapiens
tggaagtggcagaggaagtggt

SEQ ID NO: 8021326 - DNA, 22 bp, Homo sapiens
tggaagtggcagaaaatgaaca

SEQ ID NO: 8021327 - DNA, 22 bp, Homo sapiens
tggaagtgattacaatgtagta

SEQ ID NO: 8021328 - DNA, 22 bp, Homo sapiens
tggaagtgattacaatgtagta

SEQ ID NO: 8021329 - DNA, 22 bp, Homo sapiens
tggaagtgccttgctggctgtg

SEQ ID NO: 8021330 - DNA, 22 bp, Homo sapiens
tggaagtgatgctgaggtgacg

SEQ ID NO: 8021331 - DNA, 22 bp, Homo sapiens
tggaagtgatgctgaggtgacg

SEQ ID NO: 8021332 - DNA, 22 bp, Homo sapiens
tggaagtgagaagtttcctcag

SEQ ID NO: 8021333 - DNA, 17 bp, Homo sapiens
tggaagtgaggacactg

SEQ ID NO: 8021334 - DNA, 22 bp, Homo sapiens
tggaagtgagaagtttcctcag

SEQ ID NO: 8021335 - DNA, 22 bp, Homo sapiens
tggaagtgtctacatgtggagt

SEQ ID NO: 8021336 - DNA, 22 bp, Homo sapiens
tggaagtgtctacatgtggagt

SEQ ID NO: 8021337 - DNA, 20 bp, Homo sapiens
tggaagttctgttgcattgg

SEQ ID NO: 8021338 - DNA, 22 bp, Homo sapiens
tggaagtgtctacatgtggagt

SEQ ID NO: 8021339 - DNA, 22 bp, Homo sapiens
tggaagtgtctacatgtggagt

SEQ ID NO: 8021340 - DNA, 22 bp, Homo sapiens
tggaagtgtctacatgtggagt

SEQ ID NO: 8021341 - DNA, 22 bp, Homo sapiens
tggaagtgtcctcttctgagtc

SEQ ID NO: 8021342 - DNA, 22 bp, Homo sapiens
tggaagtgtcctcttctgagtc

SEQ ID NO: 8021343 - DNA, 21 bp, Homo sapiens
tggaagtggttcatttgctgc

SEQ ID NO: 8021344 - DNA, 21 bp, Homo sapiens
tggaagtggttcatttgctgc

SEQ ID NO: 8021345 - DNA, 22 bp, Homo sapiens
tggaataactcaccaaggtcat

SEQ ID NO: 8021346 - DNA, 22 bp, Homo sapiens
tggaataactcaccaaggtcat

SEQ ID NO: 8021347 - DNA, 22 bp, Homo sapiens
tggaagttgaatctcagtcatg

SEQ ID NO: 8021348 - DNA, 22 bp, Homo sapiens
tggaagttgaatctcagtcatg

SEQ ID NO: 8021349 - DNA, 22 bp, Homo sapiens
tggaaggggttacgcagcagga

SEQ ID NO: 8021350 - DNA, 16 bp, Homo sapiens
tggaaggggtctccgg

SEQ ID NO: 8021351 - DNA, 22 bp, Homo sapiens
tggaaggggttacgcagcagga

SEQ ID NO: 8021352 - DNA, 22 bp, Homo sapiens
tggaagggggaagacagctctg

SEQ ID NO: 8021353 - DNA, 22 bp, Homo sapiens
tggaagggggaagacagctctg

SEQ ID NO: 8021354 - DNA, 16 bp, Homo sapiens
tggaaggggtctccgg

SEQ ID NO: 8021355 - DNA, 22 bp, Homo sapiens
tggaagggggaagacagctctg

SEQ ID NO: 8021356 - DNA, 22 bp, Homo sapiens
tggaaggggttacgcagcagga

SEQ ID NO: 8021357 - DNA, 22 bp, Homo sapiens
tggaaggggttacgcagcagga

SEQ ID NO: 8021358 - DNA, 20 bp, Homo sapiens
tggaaggtcccagaggaatt

SEQ ID NO: 8021359 - DNA, 22 bp, Homo sapiens
tggaaggtgtggcaggtctagt

SEQ ID NO: 8021360 - DNA, 22 bp, Homo sapiens
tggaaggtggatatcctagtca

SEQ ID NO: 8021361 - DNA, 22 bp, Homo sapiens
tggaaggtgtggcaggtctagt

SEQ ID NO: 8021362 - DNA, 22 bp, Homo sapiens
tggaaggggttacgcagcagga

SEQ ID NO: 8021363 - DNA, 22 bp, Homo sapiens
tggaagggggaagacagctctg

SEQ ID NO: 8021364 - DNA, 22 bp, Homo sapiens
tggaagggggaagacagctctg

SEQ ID NO: 8021365 - DNA, 22 bp, Homo sapiens
tggaagggggaagacagctctg

SEQ ID NO: 8021366 - DNA, 22 bp, Homo sapiens
tggaaggggccaggcgcggagt

SEQ ID NO: 8021367 - DNA, 22 bp, Homo sapiens
tggaaggggccaggcgcggagt

SEQ ID NO: 8021368 - DNA, 22 bp, Homo sapiens
tggaaggggccaggcgcggagt

SEQ ID NO: 8021369 - DNA, 22 bp, Homo sapiens
tggaaggggccaggcgcggagt

SEQ ID NO: 8021370 - DNA, 22 bp, Homo sapiens
tggaaggggccaggcgcggagt

SEQ ID NO: 8021371 - DNA, 22 bp, Homo sapiens
tggaaggggagttgttccacgt

SEQ ID NO: 8021372 - DNA, 22 bp, Homo sapiens
tggaaggggagttgttccacgt

SEQ ID NO: 8021373 - DNA, 22 bp, Homo sapiens
tggaaggggagttgttccacgt

SEQ ID NO: 8021374 - DNA, 22 bp, Homo sapiens
tggaaggggagctggaaagggg

SEQ ID NO: 8021375 - DNA, 22 bp, Homo sapiens
tggaaggggagctggaaagggg

SEQ ID NO: 8021376 - DNA, 22 bp, Homo sapiens
tggaaggggagctggaaagggg

SEQ ID NO: 8021377 - DNA, 22 bp, Homo sapiens
tggaagggagtgacagtcagag

SEQ ID NO: 8021378 - DNA, 22 bp, Homo sapiens
tggaagggagtgacagtcagag

SEQ ID NO: 8021379 - DNA, 22 bp, Homo sapiens
tggaagggagtgacagtcagag

SEQ ID NO: 8021380 - DNA, 22 bp, Homo sapiens
tggaagggagtgacagtcagag

SEQ ID NO: 8021381 - DNA, 22 bp, Homo sapiens
tggaaggggagctggaaagggg

SEQ ID NO: 8021382 - DNA, 22 bp, Homo sapiens
tggaaggggagctggaaagggg

SEQ ID NO: 8021383 - DNA, 22 bp, Homo sapiens
tggaaggggagctggaaagggg

SEQ ID NO: 8021384 - DNA, 22 bp, Homo sapiens
tggaaggggagctggaaagggg

SEQ ID NO: 8021385 - DNA, 22 bp, Homo sapiens
tggaaggggagctggaaagggg

SEQ ID NO: 8021386 - DNA, 22 bp, Homo sapiens
tggaaggggagctggaaagggg

SEQ ID NO: 8021387 - DNA, 22 bp, Homo sapiens
tggaaggcaacggagtgagctg

SEQ ID NO: 8021388 - DNA, 22 bp, Homo sapiens
tggaaggagctaaggacctggg

SEQ ID NO: 8021389 - DNA, 22 bp, Homo sapiens
tggaaggagctaaggacctggg

SEQ ID NO: 8021390 - DNA, 22 bp, Homo sapiens
tggaaggagctaaggacctggg

SEQ ID NO: 8021391 - DNA, 22 bp, Homo sapiens
tggaaggagactgggaagtgtg

SEQ ID NO: 8021392 - DNA, 22 bp, Homo sapiens
tggaaggagctaaggacctggg

SEQ ID NO: 8021393 - DNA, 22 bp, Homo sapiens
tggaaggagactgggaagtgtg

SEQ ID NO: 8021394 - DNA, 22 bp, Homo sapiens
tggaaggagactgggaagtgtg

SEQ ID NO: 8021395 - DNA, 22 bp, Homo sapiens
tggaaggagactgggaagtgtg

SEQ ID NO: 8021396 - DNA, 22 bp, Homo sapiens
tggaaggaagccaaggaaggtt

SEQ ID NO: 8021397 - DNA, 22 bp, Homo sapiens
tggaaggaagccaaggaaggtt

SEQ ID NO: 8021398 - DNA, 23 bp, Homo sapiens
tggagctgacagtcagagggagg

SEQ ID NO: 8021399 - DNA, 23 bp, Homo sapiens
tggagctgacagtcagagggagg

SEQ ID NO: 8021400 - DNA, 23 bp, Homo sapiens
tggagctgacagtcagagggagg

SEQ ID NO: 8021401 - DNA, 23 bp, Homo sapiens
tggagctgacagtcagagggagg

SEQ ID NO: 8021402 - DNA, 23 bp, Homo sapiens
tggagctgacagtcagagggagg

SEQ ID NO: 8021403 - DNA, 18 bp, Homo sapiens
tggagctgagtgctgtgc

SEQ ID NO: 8021404 - DNA, 18 bp, Homo sapiens
tggagctgagtgctgtgc

SEQ ID NO: 8021405 - DNA, 18 bp, Homo sapiens
tggagctgagtgctgtgc

SEQ ID NO: 8021406 - DNA, 22 bp, Homo sapiens
tggagctgaggggaatgctgag

SEQ ID NO: 8021407 - DNA, 22 bp, Homo sapiens
tggagctgaactttgaggccag

SEQ ID NO: 8021408 - DNA, 22 bp, Homo sapiens
tggagctgaactttgaggccag

SEQ ID NO: 8021409 - DNA, 22 bp, Homo sapiens
tggagctgaactttgaggccag

SEQ ID NO: 8021410 - DNA, 21 bp, Homo sapiens
tggagctgaatttttggcatc

SEQ ID NO: 8021411 - DNA, 21 bp, Homo sapiens
tggagctgaatttttggcatc

SEQ ID NO: 8021412 - DNA, 22 bp, Homo sapiens
tggagcctgtgtttctgcccag

SEQ ID NO: 8021413 - DNA, 22 bp, Homo sapiens
tggagcctgttctgagaagccg

SEQ ID NO: 8021414 - DNA, 22 bp, Homo sapiens
tggagcctgttctgagaagccg

SEQ ID NO: 8021415 - DNA, 22 bp, Homo sapiens
tggagccttttgttctgggaca

SEQ ID NO: 8021416 - DNA, 22 bp, Homo sapiens
tggagccttttacccacaggag

SEQ ID NO: 8021417 - DNA, 22 bp, Homo sapiens
tggagccttttacccacaggag

SEQ ID NO: 8021418 - DNA, 22 bp, Homo sapiens
tggagctcaaaggcctgtggga

SEQ ID NO: 8021419 - DNA, 22 bp, Homo sapiens
tggagctcaaaggcctgtggga

SEQ ID NO: 8021420 - DNA, 22 bp, Homo sapiens
tggagccttttgttctgggaca

SEQ ID NO: 8021421 - DNA, 22 bp, Homo sapiens
tggagctgaactttgaggccag

SEQ ID NO: 8021422 - DNA, 22 bp, Homo sapiens
tggagctgaactttgaggccag

SEQ ID NO: 8021423 - DNA, 23 bp, Homo sapiens
tggagctcctgcccatcctggct

SEQ ID NO: 8021424 - DNA, 18 bp, Homo sapiens
tggagccattgccaccat

SEQ ID NO: 8021425 - DNA, 22 bp, Homo sapiens
tggagcccacggatgtcgcttt

SEQ ID NO: 8021426 - DNA, 22 bp, Homo sapiens
tggagcccacggatgtcgcttt

SEQ ID NO: 8021427 - DNA, 18 bp, Homo sapiens
tggagccattgccaccat

SEQ ID NO: 8021428 - DNA, 22 bp, Homo sapiens
tggagccaggctggccctgcca

SEQ ID NO: 8021429 - DNA, 20 bp, Homo sapiens
tggagccagggacctgttct

SEQ ID NO: 8021430 - DNA, 22 bp, Homo sapiens
tggagccagggtagaagcagag

SEQ ID NO: 8021431 - DNA, 20 bp, Homo sapiens
tggagccagggacctgttct

SEQ ID NO: 8021432 - DNA, 22 bp, Homo sapiens
tggagccagtgttgcccaacac

SEQ ID NO: 8021433 - DNA, 22 bp, Homo sapiens
tggagccagtgttgcccaacac

SEQ ID NO: 8021434 - DNA, 22 bp, Homo sapiens
tggagccagtgttgcccaacac

SEQ ID NO: 8021435 - DNA, 22 bp, Homo sapiens
tggagcctccagtctttctaga

SEQ ID NO: 8021436 - DNA, 22 bp, Homo sapiens
tggagcctcctcacactgtggc

SEQ ID NO: 8021437 - DNA, 22 bp, Homo sapiens
tggagcctccagtctttctaga

SEQ ID NO: 8021438 - DNA, 22 bp, Homo sapiens
tggagcccaggtgcaagagagt

SEQ ID NO: 8021439 - DNA, 22 bp, Homo sapiens
tggagcccagacactggcattg

SEQ ID NO: 8021440 - DNA, 22 bp, Homo sapiens
tggagcccagacactggcattg

SEQ ID NO: 8021441 - DNA, 22 bp, Homo sapiens
tggagcccagggtgagaaggag

SEQ ID NO: 8021442 - DNA, 22 bp, Homo sapiens
tggagcccaggagaggataaac

SEQ ID NO: 8021443 - DNA, 22 bp, Homo sapiens
tggagctggaagacagtgatat

SEQ ID NO: 8021444 - DNA, 22 bp, Homo sapiens
tggagctggaagacagtgatat

SEQ ID NO: 8021445 - DNA, 22 bp, Homo sapiens
tggagctggaatttctgggcct

SEQ ID NO: 8021446 - DNA, 22 bp, Homo sapiens
tggagctggaatttctgggcct

SEQ ID NO: 8021447 - DNA, 22 bp, Homo sapiens
tggagctggaatttctgggcct

SEQ ID NO: 8021448 - DNA, 22 bp, Homo sapiens
tggagctggaagacagtgatat

SEQ ID NO: 8021449 - DNA, 22 bp, Homo sapiens
tggagctggaatttctgggcct

SEQ ID NO: 8021450 - DNA, 22 bp, Homo sapiens
tggagctggaatttctgggcct

SEQ ID NO: 8021451 - DNA, 22 bp, Homo sapiens
tggagctggaatttctgggcct

SEQ ID NO: 8021452 - DNA, 22 bp, Homo sapiens
tggagctggaatttgagctgga

SEQ ID NO: 8021453 - DNA, 22 bp, Homo sapiens
tggagctggaatttgagctgga

SEQ ID NO: 8021454 - DNA, 22 bp, Homo sapiens
tggagctggaatttgagctgga

SEQ ID NO: 8021455 - DNA, 22 bp, Homo sapiens
tggagctggaatttgagctgga

SEQ ID NO: 8021456 - DNA, 22 bp, Homo sapiens
tggagctggaatttgagctgga

SEQ ID NO: 8021457 - DNA, 22 bp, Homo sapiens
tggagctggaatttgagctgga

SEQ ID NO: 8021458 - DNA, 22 bp, Homo sapiens
tggagctgggagtcctgggctg

SEQ ID NO: 8021459 - DNA, 22 bp, Homo sapiens
tggagctgggagtcctgggctg

SEQ ID NO: 8021460 - DNA, 22 bp, Homo sapiens
tggagctggcttgtggaagttg

SEQ ID NO: 8021461 - DNA, 22 bp, Homo sapiens
tggagctggcttgtggaagttg

SEQ ID NO: 8021462 - DNA, 22 bp, Homo sapiens
tggagctggcttgtggaagttg

SEQ ID NO: 8021463 - DNA, 22 bp, Homo sapiens
tggagctggcttgtggaagttg

SEQ ID NO: 8021464 - DNA, 22 bp, Homo sapiens
tggagctggcttgtggaagttg

SEQ ID NO: 8021465 - DNA, 22 bp, Homo sapiens
tggagctggcttgtggaagttg

SEQ ID NO: 8021466 - DNA, 22 bp, Homo sapiens
tggagctggcttgtggaagttg

SEQ ID NO: 8021467 - DNA, 22 bp, Homo sapiens
tggagctggcttgtggaagttg

SEQ ID NO: 8021468 - DNA, 22 bp, Homo sapiens
tggagctggcagcggaaaaggg

SEQ ID NO: 8021469 - DNA, 22 bp, Homo sapiens
tggagctggaatttgagctgga

SEQ ID NO: 8021470 - DNA, 22 bp, Homo sapiens
tggagctggcagcggaaaaggg

SEQ ID NO: 8021471 - DNA, 22 bp, Homo sapiens
tggagctggcagcggaaaaggg

SEQ ID NO: 8021472 - DNA, 22 bp, Homo sapiens
tggagctggcagcggaaaaggg

SEQ ID NO: 8021473 - DNA, 22 bp, Homo sapiens
tggagctggaatttgagctgga

SEQ ID NO: 8021474 - DNA, 22 bp, Homo sapiens
tggagctgcctggcacctacag

SEQ ID NO: 8021475 - DNA, 17 bp, Homo sapiens
tggagctgcgtgtgttc

SEQ ID NO: 8021476 - DNA, 22 bp, Homo sapiens
tggagctgcctggcacctacag

SEQ ID NO: 8021477 - DNA, 22 bp, Homo sapiens
tggagctgcctggcacctacag

SEQ ID NO: 8021478 - DNA, 21 bp, Homo sapiens
tggagctgccacttgtcctcc

SEQ ID NO: 8021479 - DNA, 21 bp, Homo sapiens
tggagctgccacttgagctgc

SEQ ID NO: 8021480 - DNA, 21 bp, Homo sapiens
tggagctgccacttgagctgc

SEQ ID NO: 8021481 - DNA, 22 bp, Homo sapiens
tggagctggaagacagtgatat

SEQ ID NO: 8021482 - DNA, 22 bp, Homo sapiens
tggagctggaagaatgtagacg

SEQ ID NO: 8021483 - DNA, 22 bp, Homo sapiens
tggagctggaagaatgtagacg

SEQ ID NO: 8021484 - DNA, 22 bp, Homo sapiens
tggagctggaagaatgtagacg

SEQ ID NO: 8021485 - DNA, 18 bp, Homo sapiens
tggagctgagtgctgtgc

SEQ ID NO: 8021486 - DNA, 18 bp, Homo sapiens
tggagctgagtgctgtgc

SEQ ID NO: 8021487 - DNA, 22 bp, Homo sapiens
tggagctgatacagctggcttt

SEQ ID NO: 8021488 - DNA, 22 bp, Homo sapiens
tggagctgatacagctggcttt

SEQ ID NO: 8021489 - DNA, 22 bp, Homo sapiens
tggagctgatacagctggcttt

SEQ ID NO: 8021490 - DNA, 22 bp, Homo sapiens
tggagctgatacagctggcttt

SEQ ID NO: 8021491 - DNA, 22 bp, Homo sapiens
tggagctgatacagctggcttt

SEQ ID NO: 8021492 - DNA, 22 bp, Homo sapiens
tggagctgatacagctggcttt

SEQ ID NO: 8021493 - DNA, 22 bp, Homo sapiens
tggagctgatacagctggcttt

SEQ ID NO: 8021494 - DNA, 22 bp, Homo sapiens
tggagctgatacagctggcttt

SEQ ID NO: 8021495 - DNA, 22 bp, Homo sapiens
tggagctgatacagctggcttt

SEQ ID NO: 8021496 - DNA, 22 bp, Homo sapiens
tggagctgatacagctggcttt

SEQ ID NO: 8021497 - DNA, 21 bp, Homo sapiens
tggagctgccacttgagctgc

SEQ ID NO: 8021498 - DNA, 21 bp, Homo sapiens
tggagctgccacttgagctgc

SEQ ID NO: 8021499 - DNA, 22 bp, Homo sapiens
tggagctgatacagctggcttt

SEQ ID NO: 8021500 - DNA, 22 bp, Homo sapiens
tggagccagcaggactcagagg

SEQ ID NO: 8021501 - DNA, 22 bp, Homo sapiens
tggagccagcccaggcccctct

SEQ ID NO: 8021502 - DNA, 22 bp, Homo sapiens
tggagccagcaggactcagagg

SEQ ID NO: 8021503 - DNA, 22 bp, Homo sapiens
tggagccagcaggactcagagg

SEQ ID NO: 8021504 - DNA, 22 bp, Homo sapiens
tggagccagagcgcagcctggg

SEQ ID NO: 8021505 - DNA, 22 bp, Homo sapiens
tggagccagagcgcagcctggg

SEQ ID NO: 8021506 - DNA, 22 bp, Homo sapiens
tggagccaatgaacatttgctg

SEQ ID NO: 8021507 - DNA, 22 bp, Homo sapiens
tggagccaccttcttatttgtc

SEQ ID NO: 8021508 - DNA, 22 bp, Homo sapiens
tggagccagcccaggcccctct

SEQ ID NO: 8021509 - DNA, 22 bp, Homo sapiens
tggagccagcgagccgaggcgg

SEQ ID NO: 8021510 - DNA, 22 bp, Homo sapiens
tggagccagcggcctgctgagg

SEQ ID NO: 8021511 - DNA, 22 bp, Homo sapiens
tggagccagcggcctgctgagg

SEQ ID NO: 8021512 - DNA, 22 bp, Homo sapiens
tggagccagcggcctgctgagg

SEQ ID NO: 8021513 - DNA, 18 bp, Homo sapiens
tggagccagctctaggat

SEQ ID NO: 8021514 - DNA, 22 bp, Homo sapiens
tggagccagcggcctgctgagg

SEQ ID NO: 8021515 - DNA, 22 bp, Homo sapiens
tggagccaggctggccctgcca

SEQ ID NO: 8021516 - DNA, 22 bp, Homo sapiens
tggagccaggagcctgggagtc

SEQ ID NO: 8021517 - DNA, 22 bp, Homo sapiens
tggagccaggagcctgggagtc

SEQ ID NO: 8021518 - DNA, 22 bp, Homo sapiens
tggagccaggagcctgggagtc

SEQ ID NO: 8021519 - DNA, 18 bp, Homo sapiens
tggagccagctctaggat

SEQ ID NO: 8021520 - DNA, 18 bp, Homo sapiens
tggagccagctctaggat

SEQ ID NO: 8021521 - DNA, 22 bp, Homo sapiens
tggagcagtggtcctggagatg

SEQ ID NO: 8021522 - DNA, 22 bp, Homo sapiens
tggagcagtggtcctggagatg

SEQ ID NO: 8021523 - DNA, 22 bp, Homo sapiens
tggagcatgagagtctttagct

SEQ ID NO: 8021524 - DNA, 22 bp, Homo sapiens
tggagcatattctggagcttgg

SEQ ID NO: 8021525 - DNA, 22 bp, Homo sapiens
tggagcattcaggtttcccttt

SEQ ID NO: 8021526 - DNA, 22 bp, Homo sapiens
tggagccaaaaagggaaggaga

SEQ ID NO: 8021527 - DNA, 22 bp, Homo sapiens
tggagccaaaaagggaaggaga

SEQ ID NO: 8021528 - DNA, 22 bp, Homo sapiens
tggagccaaaaagggaaggaga

SEQ ID NO: 8021529 - DNA, 22 bp, Homo sapiens
tggagccaaggccagttctcag

SEQ ID NO: 8021530 - DNA, 20 bp, Homo sapiens
tggagccaaggtgtgtctgg

SEQ ID NO: 8021531 - DNA, 22 bp, Homo sapiens
tggagcaggtgggatgtcgtga

SEQ ID NO: 8021532 - DNA, 22 bp, Homo sapiens
tggagcaggtgggatgtcgtga

SEQ ID NO: 8021533 - DNA, 22 bp, Homo sapiens
tggagcaggtgggatgtcgtga

SEQ ID NO: 8021534 - DNA, 22 bp, Homo sapiens
tggagcaggtgggatgtcgtga

SEQ ID NO: 8021535 - DNA, 22 bp, Homo sapiens
tggagcagtggtcctggagatg

SEQ ID NO: 8021536 - DNA, 22 bp, Homo sapiens
tggagcagtggtcctggagatg

SEQ ID NO: 8021537 - DNA, 22 bp, Homo sapiens
tggagcagtggtcctggagatg

SEQ ID NO: 8021538 - DNA, 22 bp, Homo sapiens
tggagcaggtgctcagggtaat

SEQ ID NO: 8021539 - DNA, 22 bp, Homo sapiens
tggagcaggtgctcagggtaat

SEQ ID NO: 8021540 - DNA, 22 bp, Homo sapiens
tggagcaggtgctcagggtaat

SEQ ID NO: 8021541 - DNA, 22 bp, Homo sapiens
tggagcaggtgctcagggtaat

SEQ ID NO: 8021542 - DNA, 22 bp, Homo sapiens
tggagcaggtgctcagggtaat

SEQ ID NO: 8021543 - DNA, 22 bp, Homo sapiens
tggagcaggtgctcagggtaat

SEQ ID NO: 8021544 - DNA, 22 bp, Homo sapiens
tggagcaggtgctcagggtaat

SEQ ID NO: 8021545 - DNA, 22 bp, Homo sapiens
tggagcaggacggggagtggta

SEQ ID NO: 8021546 - DNA, 22 bp, Homo sapiens
tggagcaggacggggagtggta

SEQ ID NO: 8021547 - DNA, 22 bp, Homo sapiens
tggagcaggacggggagtggta

SEQ ID NO: 8021548 - DNA, 22 bp, Homo sapiens
tggagcaggaagtctatggctg

SEQ ID NO: 8021549 - DNA, 22 bp, Homo sapiens
tggagcaggaagtctatggctg

SEQ ID NO: 8021550 - DNA, 22 bp, Homo sapiens
tggagcaggaagtctatggctg

SEQ ID NO: 8021551 - DNA, 22 bp, Homo sapiens
tggagcaggacggggagtggta

SEQ ID NO: 8021552 - DNA, 22 bp, Homo sapiens
tggagcaggacggggagtggta

SEQ ID NO: 8021553 - DNA, 22 bp, Homo sapiens
tggagcaggacggggagtggta

SEQ ID NO: 8021554 - DNA, 22 bp, Homo sapiens
tggagcaggacggggagtggta

SEQ ID NO: 8021555 - DNA, 22 bp, Homo sapiens
tggagcaggtcggcaccatttg

SEQ ID NO: 8021556 - DNA, 22 bp, Homo sapiens
tggagcaggtcggcaccatttg

SEQ ID NO: 8021557 - DNA, 18 bp, Homo sapiens
tggagcaggtaggcatga

SEQ ID NO: 8021558 - DNA, 22 bp, Homo sapiens
tggagcaggtcggcaccatttg

SEQ ID NO: 8021559 - DNA, 22 bp, Homo sapiens
tggagcaggtgccaggtgtgtg

SEQ ID NO: 8021560 - DNA, 22 bp, Homo sapiens
tggagcaggtgccaggtgtgtg

SEQ ID NO: 8021561 - DNA, 22 bp, Homo sapiens
tggagcaggtgccaggtgtgtg

SEQ ID NO: 8021562 - DNA, 22 bp, Homo sapiens
tggagcaggtgccaggtgtgtg

SEQ ID NO: 8021563 - DNA, 22 bp, Homo sapiens
tggagcaggtgccaggtgtgtg

SEQ ID NO: 8021564 - DNA, 22 bp, Homo sapiens
tggagcaggtgccaggtgtgtg

SEQ ID NO: 8021565 - DNA, 22 bp, Homo sapiens
tggagcaggtgctcagggtaat

SEQ ID NO: 8021566 - DNA, 22 bp, Homo sapiens
tggagcaggtgctcagggtaat

SEQ ID NO: 8021567 - DNA, 22 bp, Homo sapiens
tggagcaggtgctcagggtaat

SEQ ID NO: 8021568 - DNA, 22 bp, Homo sapiens
tggagcaggtgctcagggtaat

SEQ ID NO: 8021569 - DNA, 22 bp, Homo sapiens
tggagcaggtgccaggtgtgtg

SEQ ID NO: 8021570 - DNA, 22 bp, Homo sapiens
tggagcaggtgccaggtgtgtg

SEQ ID NO: 8021571 - DNA, 22 bp, Homo sapiens
tggagcaggtgccaggtgtgtg

SEQ ID NO: 8021572 - DNA, 22 bp, Homo sapiens
tggagcagctgaacagagttga

SEQ ID NO: 8021573 - DNA, 22 bp, Homo sapiens
tggagcagctctagcgggcgcc

SEQ ID NO: 8021574 - DNA, 22 bp, Homo sapiens
tggagcagctgaacagagttga

SEQ ID NO: 8021575 - DNA, 22 bp, Homo sapiens
tggagcagctgaacagagttga

SEQ ID NO: 8021576 - DNA, 22 bp, Homo sapiens
tggagcagctgaacagagttga

SEQ ID NO: 8021577 - DNA, 22 bp, Homo sapiens
tggagcagctgaacagagttga

SEQ ID NO: 8021578 - DNA, 22 bp, Homo sapiens
tggagcagctaagcctctgaga

SEQ ID NO: 8021579 - DNA, 22 bp, Homo sapiens
tggagcagctaagcctctgaga

SEQ ID NO: 8021580 - DNA, 22 bp, Homo sapiens
tggagcagctaagcctctgaga

SEQ ID NO: 8021581 - DNA, 22 bp, Homo sapiens
tggagcagctctagcgggcgcc

SEQ ID NO: 8021582 - DNA, 22 bp, Homo sapiens
tggagcagctctagcgggcgcc

SEQ ID NO: 8021583 - DNA, 22 bp, Homo sapiens
tggagcagctctagcgggcgcc

SEQ ID NO: 8021584 - DNA, 22 bp, Homo sapiens
tggagcagctctagcgggcgcc

SEQ ID NO: 8021585 - DNA, 22 bp, Homo sapiens
tggagcaggaaacatctagagg

SEQ ID NO: 8021586 - DNA, 22 bp, Homo sapiens
tggagcaggaaacatctagagg

SEQ ID NO: 8021587 - DNA, 22 bp, Homo sapiens
tggagcaggaaacatctagagg

SEQ ID NO: 8021588 - DNA, 22 bp, Homo sapiens
tggagcaggaaacatctagagg

SEQ ID NO: 8021589 - DNA, 18 bp, Homo sapiens
tggagcaggaagcctggc

SEQ ID NO: 8021590 - DNA, 18 bp, Homo sapiens
tggagcaggaagcctggc

SEQ ID NO: 8021591 - DNA, 18 bp, Homo sapiens
tggagcaggaagcctggc

SEQ ID NO: 8021592 - DNA, 18 bp, Homo sapiens
tggagcaggaagcctggc

SEQ ID NO: 8021593 - DNA, 22 bp, Homo sapiens
tggagcaggaagtctatggctg

SEQ ID NO: 8021594 - DNA, 22 bp, Homo sapiens
tggagcaggaagtctatggctg

SEQ ID NO: 8021595 - DNA, 22 bp, Homo sapiens
tggagcaggaagtctatggctg

SEQ ID NO: 8021596 - DNA, 22 bp, Homo sapiens
tggagcaggaagtctatggctg

SEQ ID NO: 8021597 - DNA, 18 bp, Homo sapiens
tggagcaggaagcctggc

SEQ ID NO: 8021598 - DNA, 18 bp, Homo sapiens
tggagcaggaagcctggc

SEQ ID NO: 8021599 - DNA, 18 bp, Homo sapiens
tggagcaggaagcctggc

SEQ ID NO: 8021600 - DNA, 22 bp, Homo sapiens
tggagcagcattcatccagcag

SEQ ID NO: 8021601 - DNA, 22 bp, Homo sapiens
tggagcagcattcatccagcag

SEQ ID NO: 8021602 - DNA, 22 bp, Homo sapiens
tggagcagcattcatccagcag

SEQ ID NO: 8021603 - DNA, 22 bp, Homo sapiens
tggagcagcatcactttgagct

SEQ ID NO: 8021604 - DNA, 22 bp, Homo sapiens
tggagcagcattcatccagcag

SEQ ID NO: 8021605 - DNA, 22 bp, Homo sapiens
tggagcagcattcatccagcag

SEQ ID NO: 8021606 - DNA, 22 bp, Homo sapiens
tggagcagccatgatgacagag

SEQ ID NO: 8021607 - DNA, 22 bp, Homo sapiens
tggagcagcattcatccagcag

SEQ ID NO: 8021608 - DNA, 22 bp, Homo sapiens
tggagcagcatcactttgagct

SEQ ID NO: 8021609 - DNA, 22 bp, Homo sapiens
tggagcagcatcactttgagct

SEQ ID NO: 8021610 - DNA, 22 bp, Homo sapiens
tggagcagcatcactttgagct

SEQ ID NO: 8021611 - DNA, 22 bp, Homo sapiens
tggagcagcacaagaaagggga

SEQ ID NO: 8021612 - DNA, 22 bp, Homo sapiens
tggagcagcacaagaaagggga

SEQ ID NO: 8021613 - DNA, 22 bp, Homo sapiens
tggagcagcacaagaaagggga

SEQ ID NO: 8021614 - DNA, 22 bp, Homo sapiens
tggagcagcacaagaaagggga

SEQ ID NO: 8021615 - DNA, 22 bp, Homo sapiens
tggagcagcacaagaaagggga

SEQ ID NO: 8021616 - DNA, 22 bp, Homo sapiens
tggagcagcacaagaaagggga

SEQ ID NO: 8021617 - DNA, 22 bp, Homo sapiens
tggagcagccatgatgacagag

SEQ ID NO: 8021618 - DNA, 22 bp, Homo sapiens
tggagcagccatgatgacagag

SEQ ID NO: 8021619 - DNA, 22 bp, Homo sapiens
tggagcagccatgatgacagag

SEQ ID NO: 8021620 - DNA, 22 bp, Homo sapiens
tggagcagccatgatgacagag

SEQ ID NO: 8021621 - DNA, 22 bp, Homo sapiens
tggagcagccatgatgacagag

SEQ ID NO: 8021622 - DNA, 22 bp, Homo sapiens
tggagcagccatgatgacagag

SEQ ID NO: 8021623 - DNA, 22 bp, Homo sapiens
tggagcagccatgatgacagag

SEQ ID NO: 8021624 - DNA, 22 bp, Homo sapiens
tggagcagccttttctaagcaa

SEQ ID NO: 8021625 - DNA, 22 bp, Homo sapiens
tggagcagctaagcctctgaga

SEQ ID NO: 8021626 - DNA, 22 bp, Homo sapiens
tggagcagccttttctaagcaa

SEQ ID NO: 8021627 - DNA, 22 bp, Homo sapiens
tggagcagccttttctaagcaa

SEQ ID NO: 8021628 - DNA, 22 bp, Homo sapiens
tggagcagaggctgaggttggg

SEQ ID NO: 8021629 - DNA, 22 bp, Homo sapiens
tggagcagaggaagaaggcttt

SEQ ID NO: 8021630 - DNA, 22 bp, Homo sapiens
tggagcagaggaagaaggcttt

SEQ ID NO: 8021631 - DNA, 22 bp, Homo sapiens
tggagcagaggaagaaggcttt

SEQ ID NO: 8021632 - DNA, 22 bp, Homo sapiens
tggagcagaggaagaaggcttt

SEQ ID NO: 8021633 - DNA, 22 bp, Homo sapiens
tggagcagaggaagaaggcttt

SEQ ID NO: 8021634 - DNA, 22 bp, Homo sapiens
tggagcagagatggtggccttc

SEQ ID NO: 8021635 - DNA, 22 bp, Homo sapiens
tggagcagagatggtggccttc

SEQ ID NO: 8021636 - DNA, 22 bp, Homo sapiens
tggagcagagatggtggccttc

SEQ ID NO: 8021637 - DNA, 22 bp, Homo sapiens
tggagcagagatgggagcccaa

SEQ ID NO: 8021638 - DNA, 22 bp, Homo sapiens
tggagcagagatggtggccttc

SEQ ID NO: 8021639 - DNA, 22 bp, Homo sapiens
tggagcagaggaagaaggcttt

SEQ ID NO: 8021640 - DNA, 22 bp, Homo sapiens
tggagcagagatggtggccttc

SEQ ID NO: 8021641 - DNA, 22 bp, Homo sapiens
tggagcagcacaagaaagggga

SEQ ID NO: 8021642 - DNA, 22 bp, Homo sapiens
tggagcagcacaagaaagggga

SEQ ID NO: 8021643 - DNA, 22 bp, Homo sapiens
tggagcagcacaagaaagggga

SEQ ID NO: 8021644 - DNA, 22 bp, Homo sapiens
tggagcagagttcagcggggag

SEQ ID NO: 8021645 - DNA, 22 bp, Homo sapiens
tggagcagagttcagcggggag

SEQ ID NO: 8021646 - DNA, 22 bp, Homo sapiens
tggagcagagttcagcggggag

SEQ ID NO: 8021647 - DNA, 22 bp, Homo sapiens
tggagcagagttcagcggggag

SEQ ID NO: 8021648 - DNA, 22 bp, Homo sapiens
tggagcagagttcagcggggag

SEQ ID NO: 8021649 - DNA, 22 bp, Homo sapiens
tggagcagaggctgaggttggg

SEQ ID NO: 8021650 - DNA, 22 bp, Homo sapiens
tggagcagaggctgaggttggg

SEQ ID NO: 8021651 - DNA, 22 bp, Homo sapiens
tggagcagaggctgaggttggg

SEQ ID NO: 8021652 - DNA, 22 bp, Homo sapiens
tggagcagaggctgaggttggg

SEQ ID NO: 8021653 - DNA, 22 bp, Homo sapiens
tggagcagaggaagaaggcttt

SEQ ID NO: 8021654 - DNA, 22 bp, Homo sapiens
tggagcagaggctgaggttggg

SEQ ID NO: 8021655 - DNA, 22 bp, Homo sapiens
tggagcagaggctgaggttggg

SEQ ID NO: 8021656 - DNA, 22 bp, Homo sapiens
tggagcagaggctgaggttggg

SEQ ID NO: 8021657 - DNA, 22 bp, Homo sapiens
tggagcagagttcagcggggag

SEQ ID NO: 8021658 - DNA, 22 bp, Homo sapiens
tggagcagagttcagcggggag

SEQ ID NO: 8021659 - DNA, 22 bp, Homo sapiens
tggagaggtttaaacaaaagtt

SEQ ID NO: 8021660 - DNA, 22 bp, Homo sapiens
tggagaggtttaaacaaaagtt

SEQ ID NO: 8021661 - DNA, 22 bp, Homo sapiens
tggagaggtttaaacaaaagtt

SEQ ID NO: 8021662 - DNA, 22 bp, Homo sapiens
tggagaggtttaaacaaaagtt

SEQ ID NO: 8021663 - DNA, 22 bp, Homo sapiens
tggagagtaaatggcagaatca

SEQ ID NO: 8021664 - DNA, 22 bp, Homo sapiens
tggagagtctcaaggcaggaaa

SEQ ID NO: 8021665 - DNA, 22 bp, Homo sapiens
tggagagtaatttctgaagacc

SEQ ID NO: 8021666 - DNA, 22 bp, Homo sapiens
tggagaggagcaccatggccat

SEQ ID NO: 8021667 - DNA, 19 bp, Homo sapiens
tggagaggaaatgctgctc

SEQ ID NO: 8021668 - DNA, 22 bp, Homo sapiens
tggagaggagcaccatggccat

SEQ ID NO: 8021669 - DNA, 22 bp, Homo sapiens
tggagaggttgaataacttgtc

SEQ ID NO: 8021670 - DNA, 22 bp, Homo sapiens
tggagaggttgaataacttgtc

SEQ ID NO: 8021671 - DNA, 22 bp, Homo sapiens
tggagaggagcaccatggccat

SEQ ID NO: 8021672 - DNA, 22 bp, Homo sapiens
tggagaggagcaccatggccat

SEQ ID NO: 8021673 - DNA, 22 bp, Homo sapiens
tggagaggagcaccatggccat

SEQ ID NO: 8021674 - DNA, 22 bp, Homo sapiens
tggagaggagcaccatggccat

SEQ ID NO: 8021675 - DNA, 22 bp, Homo sapiens
tggagaggagcaccatggccat

SEQ ID NO: 8021676 - DNA, 22 bp, Homo sapiens
tggagagtctctgagccagggc

SEQ ID NO: 8021677 - DNA, 22 bp, Homo sapiens
tggagagtctctgagccagggc

SEQ ID NO: 8021678 - DNA, 21 bp, Homo sapiens
tggagagtgatttcagtgtgg

SEQ ID NO: 8021679 - DNA, 21 bp, Homo sapiens
tggagagtgatttcagtgtgg

SEQ ID NO: 8021680 - DNA, 22 bp, Homo sapiens
tggagagtctctgagccagggc

SEQ ID NO: 8021681 - DNA, 22 bp, Homo sapiens
tggagagtctctgagccagggc

SEQ ID NO: 8021682 - DNA, 22 bp, Homo sapiens
tggagagtggatatgggagcaa

SEQ ID NO: 8021683 - DNA, 22 bp, Homo sapiens
tggagagtggatatgggagcaa

SEQ ID NO: 8021684 - DNA, 22 bp, Homo sapiens
tggagagtggtttgggggacat

SEQ ID NO: 8021685 - DNA, 22 bp, Homo sapiens
tggagagtggtttgggggacat

SEQ ID NO: 8021686 - DNA, 22 bp, Homo sapiens
tggagagtgtagacttcagagt

SEQ ID NO: 8021687 - DNA, 22 bp, Homo sapiens
tggagagtgtagacttcagagt

SEQ ID NO: 8021688 - DNA, 22 bp, Homo sapiens
tggagcagaaatttgaagccat

SEQ ID NO: 8021689 - DNA, 22 bp, Homo sapiens
tggagcagaaatttgaagccat

SEQ ID NO: 8021690 - DNA, 22 bp, Homo sapiens
tggagagtgtagacttcagagt

SEQ ID NO: 8021691 - DNA, 22 bp, Homo sapiens
tggagagttctgtagatatcta

SEQ ID NO: 8021692 - DNA, 22 bp, Homo sapiens
tggagcagaaatttgaagccat

SEQ ID NO: 8021693 - DNA, 22 bp, Homo sapiens
tggagcagagatgggagcccaa

SEQ ID NO: 8021694 - DNA, 22 bp, Homo sapiens
tggagcagaaatttgaagccat

SEQ ID NO: 8021695 - DNA, 22 bp, Homo sapiens
tggagcagaaatttgaagccat

SEQ ID NO: 8021696 - DNA, 22 bp, Homo sapiens
tggagcagaaatttgaagccat

SEQ ID NO: 8021697 - DNA, 22 bp, Homo sapiens
tggagcagagatgggagcccaa

SEQ ID NO: 8021698 - DNA, 22 bp, Homo sapiens
tggagcagagatgggagcccaa

SEQ ID NO: 8021699 - DNA, 22 bp, Homo sapiens
tggagcagagatgggagcccaa

SEQ ID NO: 8021700 - DNA, 22 bp, Homo sapiens
tggagcagagatggtggccttc

SEQ ID NO: 8021701 - DNA, 22 bp, Homo sapiens
tggagcagagatgggagcccaa

SEQ ID NO: 8021702 - DNA, 22 bp, Homo sapiens
tggagcagagatgggagcccaa

SEQ ID NO: 8021703 - DNA, 22 bp, Homo sapiens
tggagagatgtctgttcaaggt

SEQ ID NO: 8021704 - DNA, 22 bp, Homo sapiens
tggagagatgtctgttcaaggt

SEQ ID NO: 8021705 - DNA, 22 bp, Homo sapiens
tggagagcaagtcgcagacatg

SEQ ID NO: 8021706 - DNA, 22 bp, Homo sapiens
tggagagcaagtcgcagacatg

SEQ ID NO: 8021707 - DNA, 22 bp, Homo sapiens
tggagagcaagtcgcagacatg

SEQ ID NO: 8021708 - DNA, 22 bp, Homo sapiens
tggagagcaagtcgcagacatg

SEQ ID NO: 8021709 - DNA, 22 bp, Homo sapiens
tggagagcacagttcctgcttc

SEQ ID NO: 8021710 - DNA, 22 bp, Homo sapiens
tggagagcacagttcctgcttc

SEQ ID NO: 8021711 - DNA, 22 bp, Homo sapiens
tggagagcaatgaggggcaggc

SEQ ID NO: 8021712 - DNA, 18 bp, Homo sapiens
tggagagcagcagtgggg

SEQ ID NO: 8021713 - DNA, 22 bp, Homo sapiens
tggagagcactgtctcattttg

SEQ ID NO: 8021714 - DNA, 22 bp, Homo sapiens
tggagagcaatgaggggcaggc

SEQ ID NO: 8021715 - DNA, 22 bp, Homo sapiens
tggagagcaatgaggggcaggc

SEQ ID NO: 8021716 - DNA, 22 bp, Homo sapiens
tggagagcaatgaggggcaggc

SEQ ID NO: 8021717 - DNA, 22 bp, Homo sapiens
tggagagcaatgaggggcaggc

SEQ ID NO: 8021718 - DNA, 22 bp, Homo sapiens
tggagagcaggggatgcgggcg

SEQ ID NO: 8021719 - DNA, 22 bp, Homo sapiens
tggagagcccgagacatcctgt

SEQ ID NO: 8021720 - DNA, 21 bp, Homo sapiens
tggagagcccttgcctgagtc

SEQ ID NO: 8021721 - DNA, 21 bp, Homo sapiens
tggagagcccttgcctgagtc

SEQ ID NO: 8021722 - DNA, 21 bp, Homo sapiens
tggagagcccttgcctgagtc

SEQ ID NO: 8021723 - DNA, 20 bp, Homo sapiens
tggagagcctctggactgtg

SEQ ID NO: 8021724 - DNA, 21 bp, Homo sapiens
tggagagcccttgcctgagtc

SEQ ID NO: 8021725 - DNA, 20 bp, Homo sapiens
tggagagcctctggactgtg

SEQ ID NO: 8021726 - DNA, 20 bp, Homo sapiens
tggagagcctctggactgtg

SEQ ID NO: 8021727 - DNA, 22 bp, Homo sapiens
tggagagcaggggatgcgggcg

SEQ ID NO: 8021728 - DNA, 22 bp, Homo sapiens
tggagagcaggggatgcgggcg

SEQ ID NO: 8021729 - DNA, 22 bp, Homo sapiens
tggagagcagggctggagttca

SEQ ID NO: 8021730 - DNA, 18 bp, Homo sapiens
tggagagcagcagtgggg

SEQ ID NO: 8021731 - DNA, 18 bp, Homo sapiens
tggagagcagcagtgggg

SEQ ID NO: 8021732 - DNA, 22 bp, Homo sapiens
tggagaggaaagtgcagttttg

SEQ ID NO: 8021733 - DNA, 22 bp, Homo sapiens
tggagaggaaagtgcagttttg

SEQ ID NO: 8021734 - DNA, 22 bp, Homo sapiens
tggagagctgttgaaatgcaga

SEQ ID NO: 8021735 - DNA, 22 bp, Homo sapiens
tggagagctggttcaaagcaga

SEQ ID NO: 8021736 - DNA, 22 bp, Homo sapiens
tggagagctgttgaaatgcaga

SEQ ID NO: 8021737 - DNA, 22 bp, Homo sapiens
tggagagctggttcaaagcaga

SEQ ID NO: 8021738 - DNA, 22 bp, Homo sapiens
tggagagctggttcaaagcaga

SEQ ID NO: 8021739 - DNA, 22 bp, Homo sapiens
tggagaggaaagtgcagttttg

SEQ ID NO: 8021740 - DNA, 22 bp, Homo sapiens
tggagaggaaagtgcagttttg

SEQ ID NO: 8021741 - DNA, 19 bp, Homo sapiens
tggagaggaaatgctgctc

SEQ ID NO: 8021742 - DNA, 19 bp, Homo sapiens
tggagaggaaatgctgctc

SEQ ID NO: 8021743 - DNA, 19 bp, Homo sapiens
tggagaggaaatgctgctc

SEQ ID NO: 8021744 - DNA, 19 bp, Homo sapiens
tggagaggaaatgctgctc

SEQ ID NO: 8021745 - DNA, 22 bp, Homo sapiens
tggagaggaaagtgcagttttg

SEQ ID NO: 8021746 - DNA, 22 bp, Homo sapiens
tggagaggaaagtgcagttttg

SEQ ID NO: 8021747 - DNA, 19 bp, Homo sapiens
tggagaggaaatgctgctc

SEQ ID NO: 8021748 - DNA, 19 bp, Homo sapiens
tggagaggaaatgctgctc

SEQ ID NO: 8021749 - DNA, 22 bp, Homo sapiens
tggagagctcctatttgctgtc

SEQ ID NO: 8021750 - DNA, 22 bp, Homo sapiens
tggagagctggttcaaagcaga

SEQ ID NO: 8021751 - DNA, 22 bp, Homo sapiens
tggagagctatttggacctcca

SEQ ID NO: 8021752 - DNA, 22 bp, Homo sapiens
tggagagctcctatttgctgtc

SEQ ID NO: 8021753 - DNA, 22 bp, Homo sapiens
tggagagctatttggacctcca

SEQ ID NO: 8021754 - DNA, 22 bp, Homo sapiens
tggagagctatttggacctcca

SEQ ID NO: 8021755 - DNA, 22 bp, Homo sapiens
tggagagcgtgcttagcactct

SEQ ID NO: 8021756 - DNA, 22 bp, Homo sapiens
tggagagcgtgcttagcactct

SEQ ID NO: 8021757 - DNA, 22 bp, Homo sapiens
tggagagcgtgcttagcactct

SEQ ID NO: 8021758 - DNA, 22 bp, Homo sapiens
tggagagcgcgacgggaggaag

SEQ ID NO: 8021759 - DNA, 22 bp, Homo sapiens
tggagagcgcgacgggaggaag

SEQ ID NO: 8021760 - DNA, 22 bp, Homo sapiens
tggagagcgcgacgggaggaag

SEQ ID NO: 8021761 - DNA, 22 bp, Homo sapiens
tggagagccttcccggcatcgc

SEQ ID NO: 8021762 - DNA, 22 bp, Homo sapiens
tggagagccttcccggcatcgc

SEQ ID NO: 8021763 - DNA, 22 bp, Homo sapiens
tggagagcctggagtccctgat

SEQ ID NO: 8021764 - DNA, 22 bp, Homo sapiens
tggagagcctggagtccctgat

SEQ ID NO: 8021765 - DNA, 22 bp, Homo sapiens
tggagagcctggagtccctgat

SEQ ID NO: 8021766 - DNA, 22 bp, Homo sapiens
tggagaagtcaaagtgaacagg

SEQ ID NO: 8021767 - DNA, 22 bp, Homo sapiens
tggagaaggggcagggtctcca

SEQ ID NO: 8021768 - DNA, 22 bp, Homo sapiens
tggagaagtcaaagtgaacagg

SEQ ID NO: 8021769 - DNA, 22 bp, Homo sapiens
tggagaagtcaaagtgaacagg

SEQ ID NO: 8021770 - DNA, 22 bp, Homo sapiens
tggagaagtcaaagtgaacagg

SEQ ID NO: 8021771 - DNA, 22 bp, Homo sapiens
tggagaatatttccaaatctaa

SEQ ID NO: 8021772 - DNA, 22 bp, Homo sapiens
tggagaagtcaaagtgaacagg

SEQ ID NO: 8021773 - DNA, 22 bp, Homo sapiens
tggagagaaagttgaatggagg

SEQ ID NO: 8021774 - DNA, 22 bp, Homo sapiens
tggagagaaagttgaatggagg

SEQ ID NO: 8021775 - DNA, 22 bp, Homo sapiens
tggagagaagaggcagtgtgct

SEQ ID NO: 8021776 - DNA, 22 bp, Homo sapiens
tggagagaagaggcagtgtgct

SEQ ID NO: 8021777 - DNA, 22 bp, Homo sapiens
tggagagaagaggcagtgtgct

SEQ ID NO: 8021778 - DNA, 22 bp, Homo sapiens
tggagagaagaggcagtgtgct

SEQ ID NO: 8021779 - DNA, 22 bp, Homo sapiens
tggagagaacagtgtctgaaag

SEQ ID NO: 8021780 - DNA, 22 bp, Homo sapiens
tggagagagtcgggatagtaca

SEQ ID NO: 8021781 - DNA, 22 bp, Homo sapiens
tggagagagtcgggatagtaca

SEQ ID NO: 8021782 - DNA, 22 bp, Homo sapiens
tggagagagtcgggatagtaca

SEQ ID NO: 8021783 - DNA, 22 bp, Homo sapiens
tggagaaaaggttgaatccatc

SEQ ID NO: 8021784 - DNA, 22 bp, Homo sapiens
tggactttcacatagcaaagga

SEQ ID NO: 8021785 - DNA, 22 bp, Homo sapiens
tggactttttaactgataggag

SEQ ID NO: 8021786 - DNA, 22 bp, Homo sapiens
tggactttctagggtagaggaa

SEQ ID NO: 8021787 - DNA, 22 bp, Homo sapiens
tggactttttaactgataggag

SEQ ID NO: 8021788 - DNA, 22 bp, Homo sapiens
tggagaagattggtcaccattc

SEQ ID NO: 8021789 - DNA, 22 bp, Homo sapiens
tggagaagattggtcaccattc

SEQ ID NO: 8021790 - DNA, 22 bp, Homo sapiens
tggagaaagctgcatatggaaa

SEQ ID NO: 8021791 - DNA, 22 bp, Homo sapiens
tggagaagattggtcaccattc

SEQ ID NO: 8021792 - DNA, 22 bp, Homo sapiens
tggagaagctgtaggtggactc

SEQ ID NO: 8021793 - DNA, 22 bp, Homo sapiens
tggagaagctgtaggtggactc

SEQ ID NO: 8021794 - DNA, 22 bp, Homo sapiens
tggagaagctgtaggtggactc

SEQ ID NO: 8021795 - DNA, 22 bp, Homo sapiens
tggagaagctgtaggtggactc

SEQ ID NO: 8021796 - DNA, 22 bp, Homo sapiens
tggagaagctgtaggtggactc

SEQ ID NO: 8021797 - DNA, 22 bp, Homo sapiens
tggagaaggccggccaggagtg

SEQ ID NO: 8021798 - DNA, 22 bp, Homo sapiens
tggagaaggccggccaggagtg

SEQ ID NO: 8021799 - DNA, 22 bp, Homo sapiens
tggagaaggccggccaggagtg

SEQ ID NO: 8021800 - DNA, 22 bp, Homo sapiens
tggagaaggggcagggtctcca

SEQ ID NO: 8021801 - DNA, 22 bp, Homo sapiens
tggagaaggggcagggtctcca

SEQ ID NO: 8021802 - DNA, 22 bp, Homo sapiens
tggagaaggggcagggtctcca

SEQ ID NO: 8021803 - DNA, 22 bp, Homo sapiens
tggagaaggacagcctgagaaa

SEQ ID NO: 8021804 - DNA, 22 bp, Homo sapiens
tggagaaggacagcctgagaaa

SEQ ID NO: 8021805 - DNA, 22 bp, Homo sapiens
tggagaaggacagcctgagaaa

SEQ ID NO: 8021806 - DNA, 22 bp, Homo sapiens
tggagaaggacagcctgagaaa

SEQ ID NO: 8021807 - DNA, 22 bp, Homo sapiens
tggagaagctgtaggtggactc

SEQ ID NO: 8021808 - DNA, 22 bp, Homo sapiens
tggagaagctgtaggtggactc

SEQ ID NO: 8021809 - DNA, 18 bp, Homo sapiens
tggaggaaaaatctcatg

SEQ ID NO: 8021810 - DNA, 22 bp, Homo sapiens
tggaggaaaaaaccaggcagag

SEQ ID NO: 8021811 - DNA, 20 bp, Homo sapiens
tggagctgtggtaaggagca

SEQ ID NO: 8021812 - DNA, 22 bp, Homo sapiens
tggagcttgggactcttggtag

SEQ ID NO: 8021813 - DNA, 22 bp, Homo sapiens
tggaggaaaaaaccaggcagag

SEQ ID NO: 8021814 - DNA, 22 bp, Homo sapiens
tggaggaaaaaaccaggcagag

SEQ ID NO: 8021815 - DNA, 22 bp, Homo sapiens
tggagctgtcactcagaaccaa

SEQ ID NO: 8021816 - DNA, 22 bp, Homo sapiens
tggagctgtcactcagaaccaa

SEQ ID NO: 8021817 - DNA, 22 bp, Homo sapiens
tggagctgtcactcagaaccaa

SEQ ID NO: 8021818 - DNA, 20 bp, Homo sapiens
tggagctgtggtaaggagca

SEQ ID NO: 8021819 - DNA, 20 bp, Homo sapiens
tggagctgtggtaaggagca

SEQ ID NO: 8021820 - DNA, 20 bp, Homo sapiens
tggagctgtggtaaggagca

SEQ ID NO: 8021821 - DNA, 22 bp, Homo sapiens
tggagctgtagccaccaccctg

SEQ ID NO: 8021822 - DNA, 22 bp, Homo sapiens
tggagctgtagccaccaccctg

SEQ ID NO: 8021823 - DNA, 20 bp, Homo sapiens
tggagctgtaatcttgtctg

SEQ ID NO: 8021824 - DNA, 20 bp, Homo sapiens
tggagctgtaatcttgtctg

SEQ ID NO: 8021825 - DNA, 20 bp, Homo sapiens
tggagctgtaatcttgtctg

SEQ ID NO: 8021826 - DNA, 20 bp, Homo sapiens
tggagctgtaatcttgtctg

SEQ ID NO: 8021827 - DNA, 22 bp, Homo sapiens
tggagctggtaaacagtgacat

SEQ ID NO: 8021828 - DNA, 22 bp, Homo sapiens
tggagctggttctggggaagct

SEQ ID NO: 8021829 - DNA, 22 bp, Homo sapiens
tggagctggttctggggaagct

SEQ ID NO: 8021830 - DNA, 22 bp, Homo sapiens
tggagctggttctggggaagct

SEQ ID NO: 8021831 - DNA, 22 bp, Homo sapiens
tggagctggttctggggaagct

SEQ ID NO: 8021832 - DNA, 22 bp, Homo sapiens
tggagctggttctggggaagct

SEQ ID NO: 8021833 - DNA, 22 bp, Homo sapiens
tggagctggttctggggaagct

SEQ ID NO: 8021834 - DNA, 22 bp, Homo sapiens
tggagctggtaaacagtgacat

SEQ ID NO: 8021835 - DNA, 22 bp, Homo sapiens
tggagctggtaaacagtgacat

SEQ ID NO: 8021836 - DNA, 22 bp, Homo sapiens
tggagctgggagtcctgggctg

SEQ ID NO: 8021837 - DNA, 22 bp, Homo sapiens
tggagctgggagtcctgggctg

SEQ ID NO: 8021838 - DNA, 22 bp, Homo sapiens
tggagctgggagtcctgggctg

SEQ ID NO: 8021839 - DNA, 22 bp, Homo sapiens
tggagctgggagtcctgggctg

SEQ ID NO: 8021840 - DNA, 22 bp, Homo sapiens
tggagctgggatttgaactgca

SEQ ID NO: 8021841 - DNA, 22 bp, Homo sapiens
tggagctgggatttgaactgca

SEQ ID NO: 8021842 - DNA, 22 bp, Homo sapiens
tggagctgggatttgaactgca

SEQ ID NO: 8021843 - DNA, 23 bp, Homo sapiens
tggagctgggctcagaccctggg

SEQ ID NO: 8021844 - DNA, 23 bp, Homo sapiens
tggagctgggcagctgggaaagt

SEQ ID NO: 8021845 - DNA, 23 bp, Homo sapiens
tggagctgggcagctgggaaagt

SEQ ID NO: 8021846 - DNA, 23 bp, Homo sapiens
tggagctgggatttgatttgatt

SEQ ID NO: 8021847 - DNA, 23 bp, Homo sapiens
tggagctgggcagctgggaaagt

SEQ ID NO: 8021848 - DNA, 23 bp, Homo sapiens
tggagctgggctcagaccctggg

SEQ ID NO: 8021849 - DNA, 23 bp, Homo sapiens
tggagctgggctcagaccctggg

SEQ ID NO: 8021850 - DNA, 23 bp, Homo sapiens
tggagctgggctcagaccctggg

SEQ ID NO: 8021851 - DNA, 23 bp, Homo sapiens
tggagctgggctcagaccctggg

SEQ ID NO: 8021852 - DNA, 23 bp, Homo sapiens
tggagctgggctcagaccctggg

SEQ ID NO: 8021853 - DNA, 22 bp, Homo sapiens
tggagctggggtttgaatctgg

SEQ ID NO: 8021854 - DNA, 22 bp, Homo sapiens
tggagctggggtttgaatctgg

SEQ ID NO: 8021855 - DNA, 22 bp, Homo sapiens
tggagctggtaaacagtgacat

SEQ ID NO: 8021856 - DNA, 22 bp, Homo sapiens
tggagctggtaaacagtgacat

SEQ ID NO: 8021857 - DNA, 22 bp, Homo sapiens
tggagctggtaaacagtgacat

SEQ ID NO: 8021858 - DNA, 22 bp, Homo sapiens
tggagctggggtttgaatctgg

SEQ ID NO: 8021859 - DNA, 22 bp, Homo sapiens
tggagctggtaaacagtgacat

SEQ ID NO: 8021860 - DNA, 22 bp, Homo sapiens
tggagctggggtttgaatctgg

SEQ ID NO: 8021861 - DNA, 22 bp, Homo sapiens
tggagctggtaaacagtgacat

SEQ ID NO: 8021862 - DNA, 22 bp, Homo sapiens
tggagctggtaaacagtgacat

SEQ ID NO: 8021863 - DNA, 22 bp, Homo sapiens
tggagctggtaaacagtgacat

SEQ ID NO: 8021864 - DNA, 22 bp, Homo sapiens
tggaggcaactgaagatgtagt

SEQ ID NO: 8021865 - DNA, 22 bp, Homo sapiens
tggaggcaactgaagatgtagt

SEQ ID NO: 8021866 - DNA, 22 bp, Homo sapiens
tggaggatgcctggggaggcct

SEQ ID NO: 8021867 - DNA, 22 bp, Homo sapiens
tggaggattaatctggaaagat

SEQ ID NO: 8021868 - DNA, 22 bp, Homo sapiens
tggaggattaatctggaaagat

SEQ ID NO: 8021869 - DNA, 22 bp, Homo sapiens
tggaggattccacttacatgag

SEQ ID NO: 8021870 - DNA, 22 bp, Homo sapiens
tggaggagtgtgattgtctgcc

SEQ ID NO: 8021871 - DNA, 22 bp, Homo sapiens
tggaggatgcctggggaggcct

SEQ ID NO: 8021872 - DNA, 22 bp, Homo sapiens
tggaggattaatctggaaagat

SEQ ID NO: 8021873 - DNA, 22 bp, Homo sapiens
tggaggatgcctggggaggcct

SEQ ID NO: 8021874 - DNA, 22 bp, Homo sapiens
tggaggatgcctggggaggcct

SEQ ID NO: 8021875 - DNA, 22 bp, Homo sapiens
tggaggagggctggtgtctgta

SEQ ID NO: 8021876 - DNA, 22 bp, Homo sapiens
tggaggagggctggtgtctgta

SEQ ID NO: 8021877 - DNA, 22 bp, Homo sapiens
tggaggagggctggtgtctgta

SEQ ID NO: 8021878 - DNA, 22 bp, Homo sapiens
tggaggagggctggtgtctgta

SEQ ID NO: 8021879 - DNA, 22 bp, Homo sapiens
tggaggagggctggtgtctgta

SEQ ID NO: 8021880 - DNA, 22 bp, Homo sapiens
tggaggagggctggtgtctgta

SEQ ID NO: 8021881 - DNA, 22 bp, Homo sapiens
tggaggagggctggtgtctgta

SEQ ID NO: 8021882 - DNA, 22 bp, Homo sapiens
tggaggagggctggtgtctgta

SEQ ID NO: 8021883 - DNA, 22 bp, Homo sapiens
tggaggagtagattttcagagg

SEQ ID NO: 8021884 - DNA, 22 bp, Homo sapiens
tggaggagtagattttcagagg

SEQ ID NO: 8021885 - DNA, 22 bp, Homo sapiens
tggaggagtagattttcagagg

SEQ ID NO: 8021886 - DNA, 22 bp, Homo sapiens
tggaggagtgtgattgtctgcc

SEQ ID NO: 8021887 - DNA, 22 bp, Homo sapiens
tggaggagtgtgattgtctgcc

SEQ ID NO: 8021888 - DNA, 22 bp, Homo sapiens
tggaggagtgtgattgtctgcc

SEQ ID NO: 8021889 - DNA, 22 bp, Homo sapiens
tggaggagtgtgattgtctgcc

SEQ ID NO: 8021890 - DNA, 22 bp, Homo sapiens
tggaggagaactccctggctac

SEQ ID NO: 8021891 - DNA, 22 bp, Homo sapiens
tggaggaaaattactggggtct

SEQ ID NO: 8021892 - DNA, 22 bp, Homo sapiens
tggaggagaatttatggtcgaa

SEQ ID NO: 8021893 - DNA, 22 bp, Homo sapiens
tggaggagaatttatggtcgaa

SEQ ID NO: 8021894 - DNA, 22 bp, Homo sapiens
tggaggagaatttatggtcgaa

SEQ ID NO: 8021895 - DNA, 22 bp, Homo sapiens
tggaggagaatttatggtcgaa

SEQ ID NO: 8021896 - DNA, 22 bp, Homo sapiens
tggaggagaccattccactcag

SEQ ID NO: 8021897 - DNA, 22 bp, Homo sapiens
tggaggagaccattccactcag

SEQ ID NO: 8021898 - DNA, 19 bp, Homo sapiens
tggaggagaggaaaagtca

SEQ ID NO: 8021899 - DNA, 22 bp, Homo sapiens
tggaggaggaacttcttatctc

SEQ ID NO: 8021900 - DNA, 22 bp, Homo sapiens
tggaggagggctggtgtctgta

SEQ ID NO: 8021901 - DNA, 22 bp, Homo sapiens
tggaggagggctggtgtctgta

SEQ ID NO: 8021902 - DNA, 22 bp, Homo sapiens
tggaggagggctggtgtctgta

SEQ ID NO: 8021903 - DNA, 19 bp, Homo sapiens
tggaggagaggaaaagtca

SEQ ID NO: 8021904 - DNA, 19 bp, Homo sapiens
tggaggagaggaaaagtca

SEQ ID NO: 8021905 - DNA, 19 bp, Homo sapiens
tggaggagaggaaaagtca

SEQ ID NO: 8021906 - DNA, 22 bp, Homo sapiens
tggaggaggaacttcttatctc

SEQ ID NO: 8021907 - DNA, 19 bp, Homo sapiens
tggaggagaggaaaagtca

SEQ ID NO: 8021908 - DNA, 23 bp, Homo sapiens
tggaggcaggatgctaaggagtc

SEQ ID NO: 8021909 - DNA, 22 bp, Homo sapiens
tggaggcaggagacagggcaaa

SEQ ID NO: 8021910 - DNA, 22 bp, Homo sapiens
tggaggcaggggatacaggtca

SEQ ID NO: 8021911 - DNA, 22 bp, Homo sapiens
tggaggcaggggatacaggtca

SEQ ID NO: 8021912 - DNA, 23 bp, Homo sapiens
tggaggcaggatgctaaggagtc

SEQ ID NO: 8021913 - DNA, 22 bp, Homo sapiens
tggaggcaggtggaggagtgaa

SEQ ID NO: 8021914 - DNA, 22 bp, Homo sapiens
tggaggcaggtggaggagtgaa

SEQ ID NO: 8021915 - DNA, 22 bp, Homo sapiens
tggaggcaggtggaggagtgaa

SEQ ID NO: 8021916 - DNA, 22 bp, Homo sapiens
tggaggcaggtggaggagtgaa

SEQ ID NO: 8021917 - DNA, 22 bp, Homo sapiens
tggaggcaggtggaggagtgaa

SEQ ID NO: 8021918 - DNA, 22 bp, Homo sapiens
tggaggcaggtggaggagtgaa

SEQ ID NO: 8021919 - DNA, 22 bp, Homo sapiens
tggaggcaggtggaggagtgaa

SEQ ID NO: 8021920 - DNA, 22 bp, Homo sapiens
tggaggcaggagacagggcaaa

SEQ ID NO: 8021921 - DNA, 22 bp, Homo sapiens
tggaggcaggagacagggcaaa

SEQ ID NO: 8021922 - DNA, 22 bp, Homo sapiens
tggaggcaggagacagggcaaa

SEQ ID NO: 8021923 - DNA, 22 bp, Homo sapiens
tggaggcaggagacagggcaaa

SEQ ID NO: 8021924 - DNA, 22 bp, Homo sapiens
tggaggcaggagacagggcaaa

SEQ ID NO: 8021925 - DNA, 18 bp, Homo sapiens
tggaggcagagttctggc

SEQ ID NO: 8021926 - DNA, 18 bp, Homo sapiens
tggaggcagagttctggc

SEQ ID NO: 8021927 - DNA, 18 bp, Homo sapiens
tggaggcagagttctggc

SEQ ID NO: 8021928 - DNA, 22 bp, Homo sapiens
tggaggcagatacactgtaaaa

SEQ ID NO: 8021929 - DNA, 22 bp, Homo sapiens
tggaggcagatacactgtaaaa

SEQ ID NO: 8021930 - DNA, 20 bp, Homo sapiens
tggaggcacctgtggagatc

SEQ ID NO: 8021931 - DNA, 22 bp, Homo sapiens
tggaggcactaaatggccacaa

SEQ ID NO: 8021932 - DNA, 22 bp, Homo sapiens
tggaggcactaaatggccacaa

SEQ ID NO: 8021933 - DNA, 22 bp, Homo sapiens
tggaggcactaaatggccacaa

SEQ ID NO: 8021934 - DNA, 20 bp, Homo sapiens
tggaggcacctgtggagatc

SEQ ID NO: 8021935 - DNA, 20 bp, Homo sapiens
tggaggcacctgtggagatc

SEQ ID NO: 8021936 - DNA, 20 bp, Homo sapiens
tggaggcacctgtggagatc

SEQ ID NO: 8021937 - DNA, 20 bp, Homo sapiens
tggaggcacctgtggagatc

SEQ ID NO: 8021938 - DNA, 20 bp, Homo sapiens
tggaggcacctgtggagatc

SEQ ID NO: 8021939 - DNA, 20 bp, Homo sapiens
tggaggcagagccagaggga

SEQ ID NO: 8021940 - DNA, 20 bp, Homo sapiens
tggaggcagagccagaggga

SEQ ID NO: 8021941 - DNA, 20 bp, Homo sapiens
tggaggcagagccagaggga

SEQ ID NO: 8021942 - DNA, 20 bp, Homo sapiens
tggaggcagagccagaggga

SEQ ID NO: 8021943 - DNA, 22 bp, Homo sapiens
tggaggcactaaatggccacaa

SEQ ID NO: 8021944 - DNA, 20 bp, Homo sapiens
tggaggcagagccagaggga

SEQ ID NO: 8021945 - DNA, 22 bp, Homo sapiens
tggaggcaccactggctgcccg

SEQ ID NO: 8021946 - DNA, 20 bp, Homo sapiens
tggaggcacctgtggagatc

SEQ ID NO: 8021947 - DNA, 20 bp, Homo sapiens
tggaggcacctgtggagatc

SEQ ID NO: 8021948 - DNA, 22 bp, Homo sapiens
tggaggcaccactggctgcccg

SEQ ID NO: 8021949 - DNA, 22 bp, Homo sapiens
tggaggcaccactggctgcccg

SEQ ID NO: 8021950 - DNA, 22 bp, Homo sapiens
tggaggcaccactggctgcccg

SEQ ID NO: 8021951 - DNA, 19 bp, Homo sapiens
tggaggcaagacatggagg

SEQ ID NO: 8021952 - DNA, 19 bp, Homo sapiens
tggaggcaagacatggagg

SEQ ID NO: 8021953 - DNA, 22 bp, Homo sapiens
tggaggcaccactggctgcccg

SEQ ID NO: 8021954 - DNA, 19 bp, Homo sapiens
tggaggcaagacatggagg

SEQ ID NO: 8021955 - DNA, 19 bp, Homo sapiens
tggaggcaagacatggagg

SEQ ID NO: 8021956 - DNA, 22 bp, Homo sapiens
tggaggcagtaactgagcaaca

SEQ ID NO: 8021957 - DNA, 22 bp, Homo sapiens
tggaggcagtaactgagcaaca

SEQ ID NO: 8021958 - DNA, 22 bp, Homo sapiens
tggaggcagtaactgagcaaca

SEQ ID NO: 8021959 - DNA, 22 bp, Homo sapiens
tggaggcaggttagccagacga

SEQ ID NO: 8021960 - DNA, 22 bp, Homo sapiens
tggaggcaggttagccagacga

SEQ ID NO: 8021961 - DNA, 22 bp, Homo sapiens
tggaggcaggttagccagacga

SEQ ID NO: 8021962 - DNA, 22 bp, Homo sapiens
tggaggcaggttagccagacga

SEQ ID NO: 8021963 - DNA, 22 bp, Homo sapiens
tggaggcagtaactgagcaaca

SEQ ID NO: 8021964 - DNA, 22 bp, Homo sapiens
tggaggcagtcaaatgactgac

SEQ ID NO: 8021965 - DNA, 22 bp, Homo sapiens
tggaggcagtcaaatgactgac

SEQ ID NO: 8021966 - DNA, 22 bp, Homo sapiens
tggaggcagtcaaatgactgac

SEQ ID NO: 8021967 - DNA, 22 bp, Homo sapiens
tggaggcagtcaaatgactgac

SEQ ID NO: 8021968 - DNA, 22 bp, Homo sapiens
tggaggcagtcaaatgactgac

SEQ ID NO: 8021969 - DNA, 22 bp, Homo sapiens
tggaggcagtcacctgaagtca

SEQ ID NO: 8021970 - DNA, 22 bp, Homo sapiens
tggaggcagtcaaatgactgac

SEQ ID NO: 8021971 - DNA, 22 bp, Homo sapiens
tggaggcagtcacctgaagtca

SEQ ID NO: 8021972 - DNA, 22 bp, Homo sapiens
tggaggcagtcaaatgactgac

SEQ ID NO: 8021973 - DNA, 22 bp, Homo sapiens
tggaggcagtcacctgaagtca

SEQ ID NO: 8021974 - DNA, 19 bp, Homo sapiens
tggaggccaggacacaggt

SEQ ID NO: 8021975 - DNA, 20 bp, Homo sapiens
tggaggccaggatactttgt

SEQ ID NO: 8021976 - DNA, 22 bp, Homo sapiens
tggaggccagtgaaagtagatt

SEQ ID NO: 8021977 - DNA, 22 bp, Homo sapiens
tggaggccagtgaaagtagatt

SEQ ID NO: 8021978 - DNA, 22 bp, Homo sapiens
tggaggccagtgaaagtagatt

SEQ ID NO: 8021979 - DNA, 22 bp, Homo sapiens
tggaggccagtgaaagtagatt

SEQ ID NO: 8021980 - DNA, 22 bp, Homo sapiens
tggaggccatacctcctgacat

SEQ ID NO: 8021981 - DNA, 22 bp, Homo sapiens
tggaggcccaagattctacagc

SEQ ID NO: 8021982 - DNA, 22 bp, Homo sapiens
tggaggccatgccagagcccta

SEQ ID NO: 8021983 - DNA, 22 bp, Homo sapiens
tggaggccatgccagagcccta

SEQ ID NO: 8021984 - DNA, 22 bp, Homo sapiens
tggaggcccacactgggtagat

SEQ ID NO: 8021985 - DNA, 22 bp, Homo sapiens
tggaggcccacactgggtagat

SEQ ID NO: 8021986 - DNA, 22 bp, Homo sapiens
tggaggcccacactgggtagat

SEQ ID NO: 8021987 - DNA, 22 bp, Homo sapiens
tggaggcccacactgggtagat

SEQ ID NO: 8021988 - DNA, 22 bp, Homo sapiens
tggaggcccaagattctacagc

SEQ ID NO: 8021989 - DNA, 20 bp, Homo sapiens
tggaggcctgcaggtttggg

SEQ ID NO: 8021990 - DNA, 20 bp, Homo sapiens
tggaggcctgcaggtttggg

SEQ ID NO: 8021991 - DNA, 22 bp, Homo sapiens
tggaggcctcctcaaattttta

SEQ ID NO: 8021992 - DNA, 22 bp, Homo sapiens
tggaggcctggattattttgag

SEQ ID NO: 8021993 - DNA, 22 bp, Homo sapiens
tggaggcctggactttaaggga

SEQ ID NO: 8021994 - DNA, 22 bp, Homo sapiens
tggaggcctggtctctcttccc

SEQ ID NO: 8021995 - DNA, 22 bp, Homo sapiens
tggaggcctggtctctcttccc

SEQ ID NO: 8021996 - DNA, 22 bp, Homo sapiens
tggaggcctgggtgtgttgagc

SEQ ID NO: 8021997 - DNA, 22 bp, Homo sapiens
tggaggcctgggtgtgttgagc

SEQ ID NO: 8021998 - DNA, 22 bp, Homo sapiens
tggaggcctgggtgtgttgagc

SEQ ID NO: 8021999 - DNA, 22 bp, Homo sapiens
tggaggctggagtgcagtggcg

SEQ ID NO: 8022000 - DNA, 22 bp, Homo sapiens
tggaggctggagtgcagtggcg

SEQ ID NO: 8022001 - DNA, 22 bp, Homo sapiens
tggaggctggagtgcagtggcg

SEQ ID NO: 8022002 - DNA, 22 bp, Homo sapiens
tggaggctggagtgcagtggcg

SEQ ID NO: 8022003 - DNA, 22 bp, Homo sapiens
tggaggcctaggttgatgtgtg

SEQ ID NO: 8022004 - DNA, 22 bp, Homo sapiens
tggaggcctaggttgatgtgtg

SEQ ID NO: 8022005 - DNA, 22 bp, Homo sapiens
tggaggcctaggttgatgtgtg

SEQ ID NO: 8022006 - DNA, 22 bp, Homo sapiens
tggaggcctaggttgatgtgtg

SEQ ID NO: 8022007 - DNA, 19 bp, Homo sapiens
tggaggcctcaggaaaaga

SEQ ID NO: 8022008 - DNA, 19 bp, Homo sapiens
tggaggcctcaggaaaaga

SEQ ID NO: 8022009 - DNA, 19 bp, Homo sapiens
tggaggcctcaggaaaaga

SEQ ID NO: 8022010 - DNA, 19 bp, Homo sapiens
tggaggcctcaggaaaaga

SEQ ID NO: 8022011 - DNA, 22 bp, Homo sapiens
tggaggccggactgagaggcat

SEQ ID NO: 8022012 - DNA, 22 bp, Homo sapiens
tggaggccggactgagaggcat

SEQ ID NO: 8022013 - DNA, 22 bp, Homo sapiens
tggaggccggactgagaggcat

SEQ ID NO: 8022014 - DNA, 22 bp, Homo sapiens
tggaggccgcgtagtctgagca

SEQ ID NO: 8022015 - DNA, 22 bp, Homo sapiens
tggaggccggactgagaggcat

SEQ ID NO: 8022016 - DNA, 22 bp, Homo sapiens
tggaggccggactgagaggcat

SEQ ID NO: 8022017 - DNA, 22 bp, Homo sapiens
tggaggccgcgtagtctgagca

SEQ ID NO: 8022018 - DNA, 22 bp, Homo sapiens
tggaggccgcgtagtctgagca

SEQ ID NO: 8022019 - DNA, 22 bp, Homo sapiens
tggaggccgcaatgcagtttcc

SEQ ID NO: 8022020 - DNA, 22 bp, Homo sapiens
tggaggccgcaatgcagtttcc

SEQ ID NO: 8022021 - DNA, 22 bp, Homo sapiens
tggaggccgcgtagtctgagca

SEQ ID NO: 8022022 - DNA, 22 bp, Homo sapiens
tggaggccgcgtagtctgagca

SEQ ID NO: 8022023 - DNA, 22 bp, Homo sapiens
tggaggccgcgtagtctgagca

SEQ ID NO: 8022024 - DNA, 22 bp, Homo sapiens
tggaggccgcgtagtctgagca

SEQ ID NO: 8022025 - DNA, 22 bp, Homo sapiens
tggaggccgaattagagcgttg

SEQ ID NO: 8022026 - DNA, 22 bp, Homo sapiens
tggaggccgaattagagcgttg

SEQ ID NO: 8022027 - DNA, 22 bp, Homo sapiens
tggaggccgaattagagcgttg

SEQ ID NO: 8022028 - DNA, 22 bp, Homo sapiens
tggaggccgaattagagcgttg

SEQ ID NO: 8022029 - DNA, 22 bp, Homo sapiens
tggaggccctcattgtagaagt

SEQ ID NO: 8022030 - DNA, 22 bp, Homo sapiens
tggaggccctcattgtagaagt

SEQ ID NO: 8022031 - DNA, 22 bp, Homo sapiens
tggaggccctcattgtagaagt

SEQ ID NO: 8022032 - DNA, 22 bp, Homo sapiens
tggaggccctcattgtagaagt

SEQ ID NO: 8022033 - DNA, 22 bp, Homo sapiens
tggaggcccccaggcaacagca

SEQ ID NO: 8022034 - DNA, 22 bp, Homo sapiens
tggaggcccccaggcaacagca

SEQ ID NO: 8022035 - DNA, 22 bp, Homo sapiens
tggaggcccccaggcaacagca

SEQ ID NO: 8022036 - DNA, 22 bp, Homo sapiens
tggaggcccccaggcaacagca

SEQ ID NO: 8022037 - DNA, 22 bp, Homo sapiens
tggagtccccgagaggcctgca

SEQ ID NO: 8022038 - DNA, 22 bp, Homo sapiens
tggagtccgctccaagttctct

SEQ ID NO: 8022039 - DNA, 22 bp, Homo sapiens
tggagtccgctccaagttctct

SEQ ID NO: 8022040 - DNA, 22 bp, Homo sapiens
tggagtcatgatggctgctgat

SEQ ID NO: 8022041 - DNA, 22 bp, Homo sapiens
tggagtcccactgggaactggg

SEQ ID NO: 8022042 - DNA, 20 bp, Homo sapiens
tggagtcatgggacactcac

SEQ ID NO: 8022043 - DNA, 20 bp, Homo sapiens
tggagtcatgggacactcac

SEQ ID NO: 8022044 - DNA, 20 bp, Homo sapiens
tggagtcatgggacactcac

SEQ ID NO: 8022045 - DNA, 20 bp, Homo sapiens
tggagtctgacagatgggta

SEQ ID NO: 8022046 - DNA, 22 bp, Homo sapiens
tggagtctgtgatgctctgggt

SEQ ID NO: 8022047 - DNA, 22 bp, Homo sapiens
tggagtctgtgatgctctgggt

SEQ ID NO: 8022048 - DNA, 22 bp, Homo sapiens
tggagtgaagtaaagaggacaa

SEQ ID NO: 8022049 - DNA, 22 bp, Homo sapiens
tggagtgaagggttggcacggt

SEQ ID NO: 8022050 - DNA, 22 bp, Homo sapiens
tggagtctgtgatgctctgggt

SEQ ID NO: 8022051 - DNA, 22 bp, Homo sapiens
tggagtgcaatagtaataaggt

SEQ ID NO: 8022052 - DNA, 21 bp, Homo sapiens
tggagtgcaacactaggtata

SEQ ID NO: 8022053 - DNA, 22 bp, Homo sapiens
tggagtgcaatagtaataaggt

SEQ ID NO: 8022054 - DNA, 21 bp, Homo sapiens
tggagtgcactcagagttggt

SEQ ID NO: 8022055 - DNA, 22 bp, Homo sapiens
tggagtgcaatagtaataaggt

SEQ ID NO: 8022056 - DNA, 22 bp, Homo sapiens
tggagtgcaatagtaataaggt

SEQ ID NO: 8022057 - DNA, 22 bp, Homo sapiens
tggagtgcaatagtaataaggt

SEQ ID NO: 8022058 - DNA, 22 bp, Homo sapiens
tggagtgaagggttggcacggt

SEQ ID NO: 8022059 - DNA, 22 bp, Homo sapiens
tggagtgaagtaaagaggacaa

SEQ ID NO: 8022060 - DNA, 22 bp, Homo sapiens
tggagtggacttcatgaggcca

SEQ ID NO: 8022061 - DNA, 22 bp, Homo sapiens
tggagtggacttcatgaggcca

SEQ ID NO: 8022062 - DNA, 22 bp, Homo sapiens
tggagtggacttcatgaggcca

SEQ ID NO: 8022063 - DNA, 22 bp, Homo sapiens
tggagtggacttcatgaggcca

SEQ ID NO: 8022064 - DNA, 22 bp, Homo sapiens
tggagtggacttcatgaggcca

SEQ ID NO: 8022065 - DNA, 20 bp, Homo sapiens
tggagtgctgtgttgagaag

SEQ ID NO: 8022066 - DNA, 22 bp, Homo sapiens
tggagtggacttcatgaggcca

SEQ ID NO: 8022067 - DNA, 20 bp, Homo sapiens
tggagtgctgtgttgagaag

SEQ ID NO: 8022068 - DNA, 22 bp, Homo sapiens
tggagtgcagttgggaggacac

SEQ ID NO: 8022069 - DNA, 22 bp, Homo sapiens
tggagtgcagttgggaggacac

SEQ ID NO: 8022070 - DNA, 22 bp, Homo sapiens
tggaggtgtccaactcgtgggt

SEQ ID NO: 8022071 - DNA, 22 bp, Homo sapiens
tggaggtgtccaactcgtgggt

SEQ ID NO: 8022072 - DNA, 22 bp, Homo sapiens
tggaggtgtataaggtagcttc

SEQ ID NO: 8022073 - DNA, 22 bp, Homo sapiens
tggaggtgtataaggtagcttc

SEQ ID NO: 8022074 - DNA, 22 bp, Homo sapiens
tggaggtgtataaggtagcttc

SEQ ID NO: 8022075 - DNA, 22 bp, Homo sapiens
tggaggtgtataaggtagcttc

SEQ ID NO: 8022076 - DNA, 22 bp, Homo sapiens
tggaggtgtataaggtagcttc

SEQ ID NO: 8022077 - DNA, 22 bp, Homo sapiens
tggaggtgtataaggtagcttc

SEQ ID NO: 8022078 - DNA, 22 bp, Homo sapiens
tggaggtgtataaggtagcttc

SEQ ID NO: 8022079 - DNA, 16 bp, Homo sapiens
tggaggtgtttctagt

SEQ ID NO: 8022080 - DNA, 22 bp, Homo sapiens
tggaggtgtggagtcaaaggga

SEQ ID NO: 8022081 - DNA, 22 bp, Homo sapiens
tggaggtgtggagtcaaaggga

SEQ ID NO: 8022082 - DNA, 22 bp, Homo sapiens
tggaggtgtggagtcaaaggga

SEQ ID NO: 8022083 - DNA, 22 bp, Homo sapiens
tggaggtgtccaactcgtgggt

SEQ ID NO: 8022084 - DNA, 22 bp, Homo sapiens
tggaggtgtccaactcgtgggt

SEQ ID NO: 8022085 - DNA, 22 bp, Homo sapiens
tggaggtgtccaactcgtgggt

SEQ ID NO: 8022086 - DNA, 23 bp, Homo sapiens
tggaggttttactgagttgagga

SEQ ID NO: 8022087 - DNA, 22 bp, Homo sapiens
tggagtcacttccatatgggaa

SEQ ID NO: 8022088 - DNA, 22 bp, Homo sapiens
tggagtacaaggctttagtggt

SEQ ID NO: 8022089 - DNA, 23 bp, Homo sapiens
tggagtcaccttagttccaaaag

SEQ ID NO: 8022090 - DNA, 22 bp, Homo sapiens
tggagtcagaatgcgacaggcc

SEQ ID NO: 8022091 - DNA, 22 bp, Homo sapiens
tggagtcagctagacctgtgtt

SEQ ID NO: 8022092 - DNA, 22 bp, Homo sapiens
tggagtcagctagacctgtgtt

SEQ ID NO: 8022093 - DNA, 22 bp, Homo sapiens
tggagtcaggatcttataaata

SEQ ID NO: 8022094 - DNA, 22 bp, Homo sapiens
tggagtcaggcaatgcttgctt

SEQ ID NO: 8022095 - DNA, 22 bp, Homo sapiens
tggagtcagagggggaagtcac

SEQ ID NO: 8022096 - DNA, 22 bp, Homo sapiens
tggagtcagagggggaagtcac

SEQ ID NO: 8022097 - DNA, 22 bp, Homo sapiens
tggagtcagtctgggttgcaat

SEQ ID NO: 8022098 - DNA, 22 bp, Homo sapiens
tggagtcaggcaatgcttgctt

SEQ ID NO: 8022099 - DNA, 22 bp, Homo sapiens
tggagtcagtctgggttgcaat

SEQ ID NO: 8022100 - DNA, 18 bp, Homo sapiens
tggagtcagtgacaccag

SEQ ID NO: 8022101 - DNA, 22 bp, Homo sapiens
tggatgctgctgtcagggatgg

SEQ ID NO: 8022102 - DNA, 22 bp, Homo sapiens
tggatgctcacttctgcagggt

SEQ ID NO: 8022103 - DNA, 22 bp, Homo sapiens
tggatgctgagaacactgcctg

SEQ ID NO: 8022104 - DNA, 22 bp, Homo sapiens
tggatgctgagaacactgcctg

SEQ ID NO: 8022105 - DNA, 22 bp, Homo sapiens
tggatgctcacttctgcagggt

SEQ ID NO: 8022106 - DNA, 22 bp, Homo sapiens
tggatatgcccagggcacccta

SEQ ID NO: 8022107 - DNA, 22 bp, Homo sapiens
tggatatccttgttaactttct

SEQ ID NO: 8022108 - DNA, 22 bp, Homo sapiens
tggatatccttgttaactttct

SEQ ID NO: 8022109 - DNA, 22 bp, Homo sapiens
tggatatccttgttaactttct

SEQ ID NO: 8022110 - DNA, 22 bp, Homo sapiens
tggatacagctgatagcaggat

SEQ ID NO: 8022111 - DNA, 22 bp, Homo sapiens
tggatacaaaaacaatctctac

SEQ ID NO: 8022112 - DNA, 22 bp, Homo sapiens
tggatgctgtaggacacgctct

SEQ ID NO: 8022113 - DNA, 22 bp, Homo sapiens
tggatggagactgatatgggta

SEQ ID NO: 8022114 - DNA, 22 bp, Homo sapiens
tggatggattgacgaaggcagc

SEQ ID NO: 8022115 - DNA, 22 bp, Homo sapiens
tggatggattgacgaaggcagc

SEQ ID NO: 8022116 - DNA, 22 bp, Homo sapiens
tggatggatctcaagggaatta

SEQ ID NO: 8022117 - DNA, 22 bp, Homo sapiens
tggatggatctcaagggaatta

SEQ ID NO: 8022118 - DNA, 19 bp, Homo sapiens
tggatggagcctgtggttg

SEQ ID NO: 8022119 - DNA, 19 bp, Homo sapiens
tggatggagcctgtggttg

SEQ ID NO: 8022120 - DNA, 22 bp, Homo sapiens
tggatggccccactggatccat

SEQ ID NO: 8022121 - DNA, 22 bp, Homo sapiens
tggatggctggggaagagcagg

SEQ ID NO: 8022122 - DNA, 22 bp, Homo sapiens
tggatggctggggaagagcagg

SEQ ID NO: 8022123 - DNA, 22 bp, Homo sapiens
tggatggctgtggtctttgccc

SEQ ID NO: 8022124 - DNA, 22 bp, Homo sapiens
tggatggctgtggtctttgccc

SEQ ID NO: 8022125 - DNA, 22 bp, Homo sapiens
tggatggggcagcttaggtgtg

SEQ ID NO: 8022126 - DNA, 22 bp, Homo sapiens
tggatggctgtggtctttgccc

SEQ ID NO: 8022127 - DNA, 22 bp, Homo sapiens
tggataaaatctgtaaggctca

SEQ ID NO: 8022128 - DNA, 22 bp, Homo sapiens
tggataaaatctgtaaggctca

SEQ ID NO: 8022129 - DNA, 22 bp, Homo sapiens
tggataaactcactgtaagttg

SEQ ID NO: 8022130 - DNA, 22 bp, Homo sapiens
tggataaactcactgtaagttg

SEQ ID NO: 8022131 - DNA, 21 bp, Homo sapiens
tggataaaggcacttttcatc

SEQ ID NO: 8022132 - DNA, 23 bp, Homo sapiens
tggataaagctgtgctgcatagg

SEQ ID NO: 8022133 - DNA, 23 bp, Homo sapiens
tggataaagctgtgctgcatagg

SEQ ID NO: 8022134 - DNA, 23 bp, Homo sapiens
tggataaaatacttacattcaac

SEQ ID NO: 8022135 - DNA, 23 bp, Homo sapiens
tggataaaatacttacattcaac

SEQ ID NO: 8022136 - DNA, 20 bp, Homo sapiens
tggagttgttctgctaggtc

SEQ ID NO: 8022137 - DNA, 20 bp, Homo sapiens
tggagttgtggcagtttgga

SEQ ID NO: 8022138 - DNA, 20 bp, Homo sapiens
tggagttgttctgctaggtc

SEQ ID NO: 8022139 - DNA, 22 bp, Homo sapiens
tggagtgggcaatgtaggcaag

SEQ ID NO: 8022140 - DNA, 22 bp, Homo sapiens
tggagtgggcaatgtaggcaag

SEQ ID NO: 8022141 - DNA, 22 bp, Homo sapiens
tggagtgggcaatgtaggcaag

SEQ ID NO: 8022142 - DNA, 22 bp, Homo sapiens
tggagttaaaaacaggatgcac

SEQ ID NO: 8022143 - DNA, 22 bp, Homo sapiens
tggagtgggcaatgtaggcaag

SEQ ID NO: 8022144 - DNA, 22 bp, Homo sapiens
tggagtggacttcatgaggcca

SEQ ID NO: 8022145 - DNA, 22 bp, Homo sapiens
tggagtgggcaatgtaggcaag

SEQ ID NO: 8022146 - DNA, 22 bp, Homo sapiens
tggagtgggcaatgtaggcaag

SEQ ID NO: 8022147 - DNA, 22 bp, Homo sapiens
tggagttctcaggtgagggctt

SEQ ID NO: 8022148 - DNA, 22 bp, Homo sapiens
tggagttcatccatgacagctt

SEQ ID NO: 8022149 - DNA, 22 bp, Homo sapiens
tggagttgcagctaccagacat

SEQ ID NO: 8022150 - DNA, 22 bp, Homo sapiens
tggaggtgggagggactgtcct

SEQ ID NO: 8022151 - DNA, 22 bp, Homo sapiens
tggaggtgggagggactgtcct

SEQ ID NO: 8022152 - DNA, 22 bp, Homo sapiens
tggaggtgggagggactgtcct

SEQ ID NO: 8022153 - DNA, 22 bp, Homo sapiens
tggaggtgggagggactgtcct

SEQ ID NO: 8022154 - DNA, 22 bp, Homo sapiens
tggaggtgggagggactgtcct

SEQ ID NO: 8022155 - DNA, 22 bp, Homo sapiens
tggaggtgggagggactgtcct

SEQ ID NO: 8022156 - DNA, 22 bp, Homo sapiens
tggaggtgggagggactgtcct

SEQ ID NO: 8022157 - DNA, 22 bp, Homo sapiens
tggaggtggcacaagggaggtc

SEQ ID NO: 8022158 - DNA, 22 bp, Homo sapiens
tggaggtggcacaagggaggtc

SEQ ID NO: 8022159 - DNA, 22 bp, Homo sapiens
tggaggtggcacaagggaggtc

SEQ ID NO: 8022160 - DNA, 22 bp, Homo sapiens
tggaggtggcacaagggaggtc

SEQ ID NO: 8022161 - DNA, 22 bp, Homo sapiens
tggaggtggcatctgacagctg

SEQ ID NO: 8022162 - DNA, 22 bp, Homo sapiens
tggaggtggcatctgacagctg

SEQ ID NO: 8022163 - DNA, 22 bp, Homo sapiens
tggaggtggcatctgacagctg

SEQ ID NO: 8022164 - DNA, 22 bp, Homo sapiens
tggaggtggcacaagggaggtc

SEQ ID NO: 8022165 - DNA, 20 bp, Homo sapiens
tggaggtggtctgctgtcct

SEQ ID NO: 8022166 - DNA, 20 bp, Homo sapiens
tggaggtggtctgctgtcct

SEQ ID NO: 8022167 - DNA, 22 bp, Homo sapiens
tggaggtggggctcaggaatct

SEQ ID NO: 8022168 - DNA, 22 bp, Homo sapiens
tggaggtggggctcaggaatct

SEQ ID NO: 8022169 - DNA, 22 bp, Homo sapiens
tggaggtggtgcccagcaattt

SEQ ID NO: 8022170 - DNA, 20 bp, Homo sapiens
tggaggtggtctgctgtcct

SEQ ID NO: 8022171 - DNA, 20 bp, Homo sapiens
tggaggtggtctgctgtcct

SEQ ID NO: 8022172 - DNA, 20 bp, Homo sapiens
tggaggtggtctgctgtcct

SEQ ID NO: 8022173 - DNA, 22 bp, Homo sapiens
tggaggtgtataaggtagcttc

SEQ ID NO: 8022174 - DNA, 22 bp, Homo sapiens
tggaggtgtataaggtagcttc

SEQ ID NO: 8022175 - DNA, 22 bp, Homo sapiens
tggaggtggtgcccagcaattt

SEQ ID NO: 8022176 - DNA, 22 bp, Homo sapiens
tggagggctaagctgagggata

SEQ ID NO: 8022177 - DNA, 22 bp, Homo sapiens
tggagggctaagctgagggata

SEQ ID NO: 8022178 - DNA, 22 bp, Homo sapiens
tggagggctaagctgagggata

SEQ ID NO: 8022179 - DNA, 22 bp, Homo sapiens
tggagggctaagctgagggata

SEQ ID NO: 8022180 - DNA, 22 bp, Homo sapiens
tggagggctaagctgagggata

SEQ ID NO: 8022181 - DNA, 22 bp, Homo sapiens
tggagggctaagctgagggata

SEQ ID NO: 8022182 - DNA, 22 bp, Homo sapiens
tggagggctaagctgagggata

SEQ ID NO: 8022183 - DNA, 22 bp, Homo sapiens
tggagggctaagctgagggata

SEQ ID NO: 8022184 - DNA, 22 bp, Homo sapiens
tggagggctctttcacctggta

SEQ ID NO: 8022185 - DNA, 22 bp, Homo sapiens
tggagggctaagctgagggata

SEQ ID NO: 8022186 - DNA, 22 bp, Homo sapiens
tggagggcgcttagatggaggg

SEQ ID NO: 8022187 - DNA, 22 bp, Homo sapiens
tggagggctaagctgagggata

SEQ ID NO: 8022188 - DNA, 22 bp, Homo sapiens
tggagggcgcttagatggaggg

SEQ ID NO: 8022189 - DNA, 22 bp, Homo sapiens
tggaggtggagttggaaactga

SEQ ID NO: 8022190 - DNA, 18 bp, Homo sapiens
tggagggcttgctgcagc

SEQ ID NO: 8022191 - DNA, 22 bp, Homo sapiens
tggaggtggcacaagggaggtc

SEQ ID NO: 8022192 - DNA, 22 bp, Homo sapiens
tggaggtggcacaagggaggtc

SEQ ID NO: 8022193 - DNA, 22 bp, Homo sapiens
tggaggtggcacaagggaggtc

SEQ ID NO: 8022194 - DNA, 22 bp, Homo sapiens
tggaggtggcacaagggaggtc

SEQ ID NO: 8022195 - DNA, 22 bp, Homo sapiens
tggaggtggagttggaaactga

SEQ ID NO: 8022196 - DNA, 22 bp, Homo sapiens
tggagggctctttcacctggta

SEQ ID NO: 8022197 - DNA, 22 bp, Homo sapiens
tggagggctctttcacctggta

SEQ ID NO: 8022198 - DNA, 22 bp, Homo sapiens
tggagggctctttcacctggta

SEQ ID NO: 8022199 - DNA, 22 bp, Homo sapiens
tggagggctctttcacctggta

SEQ ID NO: 8022200 - DNA, 22 bp, Homo sapiens
tggagggctctttcacctggta

SEQ ID NO: 8022201 - DNA, 22 bp, Homo sapiens
tggaggctgtgtgcatgagacc

SEQ ID NO: 8022202 - DNA, 22 bp, Homo sapiens
tggaggctgtgtgcatgagacc

SEQ ID NO: 8022203 - DNA, 22 bp, Homo sapiens
tggaggctgtgtgcatgagacc

SEQ ID NO: 8022204 - DNA, 22 bp, Homo sapiens
tggaggctgtgtgcatgagacc

SEQ ID NO: 8022205 - DNA, 22 bp, Homo sapiens
tggaggctgtgtgcatgagacc

SEQ ID NO: 8022206 - DNA, 22 bp, Homo sapiens
tggaggctgtgtgcatgagacc

SEQ ID NO: 8022207 - DNA, 22 bp, Homo sapiens
tggaggctgtgtgcatgagacc

SEQ ID NO: 8022208 - DNA, 22 bp, Homo sapiens
tggaggctgtgtgcatgagacc

SEQ ID NO: 8022209 - DNA, 22 bp, Homo sapiens
tggaggctgtgtgcatgagacc

SEQ ID NO: 8022210 - DNA, 22 bp, Homo sapiens
tggagggaacaaaggagtccca

SEQ ID NO: 8022211 - DNA, 22 bp, Homo sapiens
tggaggctggtttctgctgagg

SEQ ID NO: 8022212 - DNA, 22 bp, Homo sapiens
tggaggctggtttctgctgagg

SEQ ID NO: 8022213 - DNA, 22 bp, Homo sapiens
tggaggctggtttctgctgagg

SEQ ID NO: 8022214 - DNA, 22 bp, Homo sapiens
tggaggctgtgtgcatgagacc

SEQ ID NO: 8022215 - DNA, 22 bp, Homo sapiens
tggaggctggtttctgctgagg

SEQ ID NO: 8022216 - DNA, 22 bp, Homo sapiens
tggaggctggtttctgctgagg

SEQ ID NO: 8022217 - DNA, 22 bp, Homo sapiens
tggaggctggtttctgctgagg

SEQ ID NO: 8022218 - DNA, 22 bp, Homo sapiens
tggaggctggagtgcagtggcg

SEQ ID NO: 8022219 - DNA, 22 bp, Homo sapiens
tggaggctggagtgcagtggcg

SEQ ID NO: 8022220 - DNA, 22 bp, Homo sapiens
tggagggaacccaggctgctct

SEQ ID NO: 8022221 - DNA, 22 bp, Homo sapiens
tggagggaacccaggctgctct

SEQ ID NO: 8022222 - DNA, 22 bp, Homo sapiens
tggagggaacccaggctgctct

SEQ ID NO: 8022223 - DNA, 22 bp, Homo sapiens
tggagggatacaaagatgaaaa

SEQ ID NO: 8022224 - DNA, 22 bp, Homo sapiens
tggagggatacaaagatgaaaa

SEQ ID NO: 8022225 - DNA, 22 bp, Homo sapiens
tggagggatacaaagatgaaaa

SEQ ID NO: 8022226 - DNA, 22 bp, Homo sapiens
tggagggaacccaggctgctct

SEQ ID NO: 8022227 - DNA, 22 bp, Homo sapiens
tggagggaacccaggctgctct

SEQ ID NO: 8022228 - DNA, 22 bp, Homo sapiens
tggagggaacccaggctgctct

SEQ ID NO: 8022229 - DNA, 22 bp, Homo sapiens
tggagggaacccaggctgctct

SEQ ID NO: 8022230 - DNA, 22 bp, Homo sapiens
tggagggaacccaggctgctct

SEQ ID NO: 8022231 - DNA, 22 bp, Homo sapiens
tggagggaacaaaggagtccca

SEQ ID NO: 8022232 - DNA, 22 bp, Homo sapiens
tggagggcgcttagatggaggg

SEQ ID NO: 8022233 - DNA, 22 bp, Homo sapiens
tggagggcgcttagatggaggg

SEQ ID NO: 8022234 - DNA, 22 bp, Homo sapiens
tggagggcgcttagatggaggg

SEQ ID NO: 8022235 - DNA, 22 bp, Homo sapiens
tggagggcgcttagatggaggg

SEQ ID NO: 8022236 - DNA, 22 bp, Homo sapiens
tggagggcgcttagatggaggg

SEQ ID NO: 8022237 - DNA, 22 bp, Homo sapiens
tggagggcgcttagatggaggg

SEQ ID NO: 8022238 - DNA, 22 bp, Homo sapiens
tggagggcatctgtggtcaggc

SEQ ID NO: 8022239 - DNA, 22 bp, Homo sapiens
tggagggcatgctgtccatggg

SEQ ID NO: 8022240 - DNA, 22 bp, Homo sapiens
tggagggcatgctgtccatggg

SEQ ID NO: 8022241 - DNA, 22 bp, Homo sapiens
tggagggcatctgtggtcaggc

SEQ ID NO: 8022242 - DNA, 22 bp, Homo sapiens
tggagggcatctgtggtcaggc

SEQ ID NO: 8022243 - DNA, 22 bp, Homo sapiens
tggagggcatctgtggtcaggc

SEQ ID NO: 8022244 - DNA, 22 bp, Homo sapiens
tggagggcatctgtggtcaggc

SEQ ID NO: 8022245 - DNA, 22 bp, Homo sapiens
tggagggcatctgtggtcaggc

SEQ ID NO: 8022246 - DNA, 22 bp, Homo sapiens
tggagggcatctgtggtcaggc

SEQ ID NO: 8022247 - DNA, 22 bp, Homo sapiens
tggagggcatctgtggtcaggc

SEQ ID NO: 8022248 - DNA, 22 bp, Homo sapiens
tggagggcatagctgttctttc

SEQ ID NO: 8022249 - DNA, 23 bp, Homo sapiens
tggagggcagaataacagactac

SEQ ID NO: 8022250 - DNA, 22 bp, Homo sapiens
tggagggatacaaagatgaaaa

SEQ ID NO: 8022251 - DNA, 20 bp, Homo sapiens
tggagggattgttggcaaat

SEQ ID NO: 8022252 - DNA, 22 bp, Homo sapiens
tgctccagctggagatgggggc

SEQ ID NO: 8022253 - DNA, 22 bp, Homo sapiens
tgctccagctggagatgggggc

SEQ ID NO: 8022254 - DNA, 20 bp, Homo sapiens
tgctccaggaacactggccg

SEQ ID NO: 8022255 - DNA, 20 bp, Homo sapiens
tgctccaggaacactggccg

SEQ ID NO: 8022256 - DNA, 22 bp, Homo sapiens
tgctccagcgctgccaccagtt

SEQ ID NO: 8022257 - DNA, 22 bp, Homo sapiens
tgctccagcgctgccaccagtt

SEQ ID NO: 8022258 - DNA, 22 bp, Homo sapiens
tgctccagcgctgccaccagtt

SEQ ID NO: 8022259 - DNA, 20 bp, Homo sapiens
tgctccaggaacactggccg

SEQ ID NO: 8022260 - DNA, 20 bp, Homo sapiens
tgctccaggaacactggccg

SEQ ID NO: 8022261 - DNA, 20 bp, Homo sapiens
tgctccaggaacactggccg

SEQ ID NO: 8022262 - DNA, 20 bp, Homo sapiens
tgctccaggaacactggccg

SEQ ID NO: 8022263 - DNA, 22 bp, Homo sapiens
tgctccaggagcaacctttgag

SEQ ID NO: 8022264 - DNA, 20 bp, Homo sapiens
tgctccaggaacactggccg

SEQ ID NO: 8022265 - DNA, 23 bp, Homo sapiens
tgctccagcctctttgatagtgt

SEQ ID NO: 8022266 - DNA, 23 bp, Homo sapiens
tgctccagcctctttgatagtgt

SEQ ID NO: 8022267 - DNA, 22 bp, Homo sapiens
tgctccagcgctgccaccagtt

SEQ ID NO: 8022268 - DNA, 22 bp, Homo sapiens
tgctccagcgctgccaccagtt

SEQ ID NO: 8022269 - DNA, 22 bp, Homo sapiens
tgctccagcctatgctctccgg

SEQ ID NO: 8022270 - DNA, 22 bp, Homo sapiens
tgctccagcatgaccctcaatg

SEQ ID NO: 8022271 - DNA, 22 bp, Homo sapiens
tgctccagcccctggtgcacag

SEQ ID NO: 8022272 - DNA, 22 bp, Homo sapiens
tgctccagcccctggtgcacag

SEQ ID NO: 8022273 - DNA, 22 bp, Homo sapiens
tgctccagcctatgctctccgg

SEQ ID NO: 8022274 - DNA, 22 bp, Homo sapiens
tgctccagcctatgctctccgg

SEQ ID NO: 8022275 - DNA, 21 bp, Homo sapiens
tgctccagggcagcttccagc

SEQ ID NO: 8022276 - DNA, 21 bp, Homo sapiens
tgctccagggcagcttccagc

SEQ ID NO: 8022277 - DNA, 22 bp, Homo sapiens
tgctccagggcctccagtgggg

SEQ ID NO: 8022278 - DNA, 22 bp, Homo sapiens
tgctccagggcctccagtgggg

SEQ ID NO: 8022279 - DNA, 22 bp, Homo sapiens
tgctccagggcctccagtgggg

SEQ ID NO: 8022280 - DNA, 22 bp, Homo sapiens
tgctccagggcctccagtgggg

SEQ ID NO: 8022281 - DNA, 19 bp, Homo sapiens
tgctccaggccttgccgca

SEQ ID NO: 8022282 - DNA, 22 bp, Homo sapiens
tgctccaggctgctgaagatct

SEQ ID NO: 8022283 - DNA, 22 bp, Homo sapiens
tgctccaggccgcctggggctg

SEQ ID NO: 8022284 - DNA, 22 bp, Homo sapiens
tgctccaggccgcctggggctg

SEQ ID NO: 8022285 - DNA, 22 bp, Homo sapiens
tgctccaggccgcctggggctg

SEQ ID NO: 8022286 - DNA, 22 bp, Homo sapiens
tgctccaggccgcctggggctg

SEQ ID NO: 8022287 - DNA, 21 bp, Homo sapiens
tgctccaggagggggcagtcc

SEQ ID NO: 8022288 - DNA, 22 bp, Homo sapiens
tgctccaggcaagctgagagtt

SEQ ID NO: 8022289 - DNA, 22 bp, Homo sapiens
tgctccaggcaagctgagagtt

SEQ ID NO: 8022290 - DNA, 22 bp, Homo sapiens
tgctccaggagcactttccatt

SEQ ID NO: 8022291 - DNA, 21 bp, Homo sapiens
tgctccaggagggggcagtcc

SEQ ID NO: 8022292 - DNA, 21 bp, Homo sapiens
tgctccaggagggggcagtcc

SEQ ID NO: 8022293 - DNA, 18 bp, Homo sapiens
tgctccaggcccatgggc

SEQ ID NO: 8022294 - DNA, 22 bp, Homo sapiens
tgctccaggccgcctggggctg

SEQ ID NO: 8022295 - DNA, 22 bp, Homo sapiens
tgctccaggccgcctggggctg

SEQ ID NO: 8022296 - DNA, 22 bp, Homo sapiens
tgctccaggcaagctgagagtt

SEQ ID NO: 8022297 - DNA, 22 bp, Homo sapiens
tgctccaggcaagctgagagtt

SEQ ID NO: 8022298 - DNA, 18 bp, Homo sapiens
tgctccaggcccatgggc

SEQ ID NO: 8022299 - DNA, 18 bp, Homo sapiens
tgctccaggcccatgggc

SEQ ID NO: 8022300 - DNA, 22 bp, Homo sapiens
tgctccctgctcagagaggcca

SEQ ID NO: 8022301 - DNA, 22 bp, Homo sapiens
tgctcccttgccagaggggaag

SEQ ID NO: 8022302 - DNA, 22 bp, Homo sapiens
tgctcctgaacacagccctatg

SEQ ID NO: 8022303 - DNA, 22 bp, Homo sapiens
tgctcctgaacacagccctatg

SEQ ID NO: 8022304 - DNA, 22 bp, Homo sapiens
tgctcccatgtgtgggtacaga

SEQ ID NO: 8022305 - DNA, 23 bp, Homo sapiens
tgctcccaggtgacgctgctgtt

SEQ ID NO: 8022306 - DNA, 22 bp, Homo sapiens
tgctcccatgtgtgggtacaga

SEQ ID NO: 8022307 - DNA, 22 bp, Homo sapiens
tgctccctgacccaggtcttct

SEQ ID NO: 8022308 - DNA, 22 bp, Homo sapiens
tgctccctgacccaggtcttct

SEQ ID NO: 8022309 - DNA, 22 bp, Homo sapiens
tgctccctgctcagagaggcca

SEQ ID NO: 8022310 - DNA, 22 bp, Homo sapiens
tgctcccaggcattctctgttg

SEQ ID NO: 8022311 - DNA, 22 bp, Homo sapiens
tgctcccaggctctgtggtctg

SEQ ID NO: 8022312 - DNA, 22 bp, Homo sapiens
tgctcccaggcattctctgttg

SEQ ID NO: 8022313 - DNA, 22 bp, Homo sapiens
tgctcccaggactcttgagcca

SEQ ID NO: 8022314 - DNA, 22 bp, Homo sapiens
tgctccagggctgccagaccct

SEQ ID NO: 8022315 - DNA, 22 bp, Homo sapiens
tgctccagggcctccagtgggg

SEQ ID NO: 8022316 - DNA, 22 bp, Homo sapiens
tgctccagggcctccagtgggg

SEQ ID NO: 8022317 - DNA, 22 bp, Homo sapiens
tgctcctgctgcatgcatctcc

SEQ ID NO: 8022318 - DNA, 22 bp, Homo sapiens
tgctcctgctgcatgcatctcc

SEQ ID NO: 8022319 - DNA, 22 bp, Homo sapiens
tgctcctgctggccctcgtgcc

SEQ ID NO: 8022320 - DNA, 22 bp, Homo sapiens
tgctcctgctggccctcgtgcc

SEQ ID NO: 8022321 - DNA, 22 bp, Homo sapiens
tgctcctgctggccctcgtgcc

SEQ ID NO: 8022322 - DNA, 22 bp, Homo sapiens
tgctcctgctgcatgcatctcc

SEQ ID NO: 8022323 - DNA, 22 bp, Homo sapiens
tgctcctgctgcatgcatctcc

SEQ ID NO: 8022324 - DNA, 22 bp, Homo sapiens
tgctcctgatatctaatgtgta

SEQ ID NO: 8022325 - DNA, 22 bp, Homo sapiens
tgctcctgagtgtgcaggagat

SEQ ID NO: 8022326 - DNA, 22 bp, Homo sapiens
tgctcctgagcggtttccatga

SEQ ID NO: 8022327 - DNA, 22 bp, Homo sapiens
tgctcctgaggttggagatcca

SEQ ID NO: 8022328 - DNA, 22 bp, Homo sapiens
tgctcctgatatctaatgtgta

SEQ ID NO: 8022329 - DNA, 22 bp, Homo sapiens
tgctcctgatatctaatgtgta

SEQ ID NO: 8022330 - DNA, 22 bp, Homo sapiens
tgctcctgagtgtgcaggagat

SEQ ID NO: 8022331 - DNA, 22 bp, Homo sapiens
tgctcctgaattacactactac

SEQ ID NO: 8022332 - DNA, 22 bp, Homo sapiens
tgctcctgaacacagccctatg

SEQ ID NO: 8022333 - DNA, 22 bp, Homo sapiens
tgctcctgacagttttaggctc

SEQ ID NO: 8022334 - DNA, 22 bp, Homo sapiens
tgctcctgacagagtccatatg

SEQ ID NO: 8022335 - DNA, 22 bp, Homo sapiens
tgctcctggatgaggtactcca

SEQ ID NO: 8022336 - DNA, 22 bp, Homo sapiens
tgctcctggatgaggtactcca

SEQ ID NO: 8022337 - DNA, 22 bp, Homo sapiens
tgctcctggactggtgtgagat

SEQ ID NO: 8022338 - DNA, 22 bp, Homo sapiens
tgctcctggatgaggtactcca

SEQ ID NO: 8022339 - DNA, 22 bp, Homo sapiens
tgctcctggcttcaggttgggc

SEQ ID NO: 8022340 - DNA, 22 bp, Homo sapiens
tgctcctggctccttccctaac

SEQ ID NO: 8022341 - DNA, 22 bp, Homo sapiens
tgctcctggcttcaggttgggc

SEQ ID NO: 8022342 - DNA, 22 bp, Homo sapiens
tgctcctggcttcaggttgggc

SEQ ID NO: 8022343 - DNA, 22 bp, Homo sapiens
tgctcctggctccttccctaac

SEQ ID NO: 8022344 - DNA, 17 bp, Homo sapiens
tgctcctgggacaagga

SEQ ID NO: 8022345 - DNA, 22 bp, Homo sapiens
tgctcctgggctgaagcacact

SEQ ID NO: 8022346 - DNA, 17 bp, Homo sapiens
tgctcctgtggcagcct

SEQ ID NO: 8022347 - DNA, 17 bp, Homo sapiens
tgctcctgtggcagcct

SEQ ID NO: 8022348 - DNA, 17 bp, Homo sapiens
tgctcctgtggcagcct

SEQ ID NO: 8022349 - DNA, 17 bp, Homo sapiens
tgctcctgtggcagcct

SEQ ID NO: 8022350 - DNA, 17 bp, Homo sapiens
tgctcctgtggcagcct

SEQ ID NO: 8022351 - DNA, 22 bp, Homo sapiens
tgctcctgtttcatcagctata

SEQ ID NO: 8022352 - DNA, 17 bp, Homo sapiens
tgctcctgtggcagcct

SEQ ID NO: 8022353 - DNA, 17 bp, Homo sapiens
tgctcctgtggcagcct

SEQ ID NO: 8022354 - DNA, 22 bp, Homo sapiens
tgctcctgtttcatcagctata

SEQ ID NO: 8022355 - DNA, 22 bp, Homo sapiens
tgctcctgtttcatcagctata

SEQ ID NO: 8022356 - DNA, 22 bp, Homo sapiens
tgctcctgtttcatcagctata

SEQ ID NO: 8022357 - DNA, 22 bp, Homo sapiens
tgctcgccccacatgccctcat

SEQ ID NO: 8022358 - DNA, 22 bp, Homo sapiens
tgctcgccccacatgccctcat

SEQ ID NO: 8022359 - DNA, 22 bp, Homo sapiens
tgctcgccccacatgccctcat

SEQ ID NO: 8022360 - DNA, 22 bp, Homo sapiens
tgctcgccccacatgccctcat

SEQ ID NO: 8022361 - DNA, 22 bp, Homo sapiens
tgctcgccccacatgccctcat

SEQ ID NO: 8022362 - DNA, 22 bp, Homo sapiens
tgctcgaggtccccaccggctc

SEQ ID NO: 8022363 - DNA, 22 bp, Homo sapiens
tgctcctttcatccaattctca

SEQ ID NO: 8022364 - DNA, 22 bp, Homo sapiens
tgctcgaggtccccaccggctc

SEQ ID NO: 8022365 - DNA, 22 bp, Homo sapiens
tgctcgaggtccccaccggctc

SEQ ID NO: 8022366 - DNA, 22 bp, Homo sapiens
tgctccttcccttcccagtgag

SEQ ID NO: 8022367 - DNA, 22 bp, Homo sapiens
tgctccttcccttcccagtgag

SEQ ID NO: 8022368 - DNA, 21 bp, Homo sapiens
tgctcctttaccccacaagac

SEQ ID NO: 8022369 - DNA, 21 bp, Homo sapiens
tgctcctttaccccacaagac

SEQ ID NO: 8022370 - DNA, 22 bp, Homo sapiens
tgctcctttcatccaattctca

SEQ ID NO: 8022371 - DNA, 22 bp, Homo sapiens
tgctcgaggtccccaccggctc

SEQ ID NO: 8022372 - DNA, 22 bp, Homo sapiens
tgctctagctcataggactcat

SEQ ID NO: 8022373 - DNA, 22 bp, Homo sapiens
tgctctaagaactctaggaatt

SEQ ID NO: 8022374 - DNA, 22 bp, Homo sapiens
tgctctaagaactctaggaatt

SEQ ID NO: 8022375 - DNA, 22 bp, Homo sapiens
tgctctagctcataggactcat

SEQ ID NO: 8022376 - DNA, 22 bp, Homo sapiens
tgctctagtgggtagagcattg

SEQ ID NO: 8022377 - DNA, 22 bp, Homo sapiens
tgctctatttcttcacctacaa

SEQ ID NO: 8022378 - DNA, 22 bp, Homo sapiens
tgctctattaattttaacgatg

SEQ ID NO: 8022379 - DNA, 22 bp, Homo sapiens
tgctctatctaaaagtcctgga

SEQ ID NO: 8022380 - DNA, 22 bp, Homo sapiens
tgctctggggctccccaccaga

SEQ ID NO: 8022381 - DNA, 22 bp, Homo sapiens
tgctctgggggaagccagctgt

SEQ ID NO: 8022382 - DNA, 22 bp, Homo sapiens
tgctctggggctccccaccaga

SEQ ID NO: 8022383 - DNA, 22 bp, Homo sapiens
tgctctggggctccccaccaga

SEQ ID NO: 8022384 - DNA, 22 bp, Homo sapiens
tgctctgggggaagccagctgt

SEQ ID NO: 8022385 - DNA, 22 bp, Homo sapiens
tgctctgggggaagccagctgt

SEQ ID NO: 8022386 - DNA, 22 bp, Homo sapiens
tgctctgggggaagccagctgt

SEQ ID NO: 8022387 - DNA, 22 bp, Homo sapiens
tgctctgggggaagccagctgt

SEQ ID NO: 8022388 - DNA, 22 bp, Homo sapiens
tgctctggggagctcctctgcg

SEQ ID NO: 8022389 - DNA, 22 bp, Homo sapiens
tgctctggggagctcctctgcg

SEQ ID NO: 8022390 - DNA, 22 bp, Homo sapiens
tgctctgggctcaatggcagct

SEQ ID NO: 8022391 - DNA, 22 bp, Homo sapiens
tgctctgggctcaatggcagct

SEQ ID NO: 8022392 - DNA, 22 bp, Homo sapiens
tgctctggggagctcctctgcg

SEQ ID NO: 8022393 - DNA, 22 bp, Homo sapiens
tgctctggggagctcctctgcg

SEQ ID NO: 8022394 - DNA, 22 bp, Homo sapiens
tgctctggggagctcctctgcg

SEQ ID NO: 8022395 - DNA, 22 bp, Homo sapiens
tgctctggggagctcctctgcg

SEQ ID NO: 8022396 - DNA, 22 bp, Homo sapiens
tgctctgggcaacagcctccct

SEQ ID NO: 8022397 - DNA, 22 bp, Homo sapiens
tgctctgggattcagcagcctg

SEQ ID NO: 8022398 - DNA, 22 bp, Homo sapiens
tgctctgggcaacagcctccct

SEQ ID NO: 8022399 - DNA, 22 bp, Homo sapiens
tgctctgggcaacagcctccct

SEQ ID NO: 8022400 - DNA, 22 bp, Homo sapiens
tgctctgggctatctgagaaag

SEQ ID NO: 8022401 - DNA, 22 bp, Homo sapiens
tgctctgggctatctgagaaag

SEQ ID NO: 8022402 - DNA, 22 bp, Homo sapiens
tgctctgggctcaatggcagct

SEQ ID NO: 8022403 - DNA, 22 bp, Homo sapiens
tgctctgggctcaatggcagct

SEQ ID NO: 8022404 - DNA, 22 bp, Homo sapiens
tgctctgggctcaatggcagct

SEQ ID NO: 8022405 - DNA, 22 bp, Homo sapiens
tgctctgggctcaatggcagct

SEQ ID NO: 8022406 - DNA, 22 bp, Homo sapiens
tgctctgggctcaatggcagct

SEQ ID NO: 8022407 - DNA, 22 bp, Homo sapiens
tgctctgggctcaatggcagct

SEQ ID NO: 8022408 - DNA, 22 bp, Homo sapiens
tgctctgggctcaatggcagct

SEQ ID NO: 8022409 - DNA, 22 bp, Homo sapiens
tgctctgggctcaatggcagct

SEQ ID NO: 8022410 - DNA, 22 bp, Homo sapiens
tgctctgggctatctgagaaag

SEQ ID NO: 8022411 - DNA, 22 bp, Homo sapiens
tgctctgggaccgtcattaaaa

SEQ ID NO: 8022412 - DNA, 22 bp, Homo sapiens
tgctctggctgggatgagtgca

SEQ ID NO: 8022413 - DNA, 22 bp, Homo sapiens
tgctctggctgggatgagtgca

SEQ ID NO: 8022414 - DNA, 22 bp, Homo sapiens
tgctctggctgggatgagtgca

SEQ ID NO: 8022415 - DNA, 22 bp, Homo sapiens
tgctctggctgggatgagtgca

SEQ ID NO: 8022416 - DNA, 22 bp, Homo sapiens
tgctctggctgggatgagtgca

SEQ ID NO: 8022417 - DNA, 22 bp, Homo sapiens
tgctctggctgggatgagtgca

SEQ ID NO: 8022418 - DNA, 22 bp, Homo sapiens
tgctctggctggagcaatgact

SEQ ID NO: 8022419 - DNA, 22 bp, Homo sapiens
tgctctggctgggatgagtgca

SEQ ID NO: 8022420 - DNA, 22 bp, Homo sapiens
tgctctggctggagcaatgact

SEQ ID NO: 8022421 - DNA, 22 bp, Homo sapiens
tgctctggctggagcaatgact

SEQ ID NO: 8022422 - DNA, 22 bp, Homo sapiens
tgctctggctggagcaatgact

SEQ ID NO: 8022423 - DNA, 22 bp, Homo sapiens
tgctctgggattcagcagcctg

SEQ ID NO: 8022424 - DNA, 22 bp, Homo sapiens
tgctctgggattcagcagcctg

SEQ ID NO: 8022425 - DNA, 22 bp, Homo sapiens
tgctctgggattcagcagcctg

SEQ ID NO: 8022426 - DNA, 22 bp, Homo sapiens
tgctctgggattcagcagcctg

SEQ ID NO: 8022427 - DNA, 22 bp, Homo sapiens
tgctctgggattcagcagcctg

SEQ ID NO: 8022428 - DNA, 23 bp, Homo sapiens
tgctctgggaggccctggagagc

SEQ ID NO: 8022429 - DNA, 23 bp, Homo sapiens
tgctctgggaggccctggagagc

SEQ ID NO: 8022430 - DNA, 23 bp, Homo sapiens
tgctctgggaggccctggagagc

SEQ ID NO: 8022431 - DNA, 23 bp, Homo sapiens
tgctctgggaggccctggagagc

SEQ ID NO: 8022432 - DNA, 23 bp, Homo sapiens
tgctctgggaggccctggagagc

SEQ ID NO: 8022433 - DNA, 22 bp, Homo sapiens
tgctctgggaccgtcattaaaa

SEQ ID NO: 8022434 - DNA, 23 bp, Homo sapiens
tgctctgggaggccctggagagc

SEQ ID NO: 8022435 - DNA, 23 bp, Homo sapiens
tgctctgggaggccctggagagc

SEQ ID NO: 8022436 - DNA, 22 bp, Homo sapiens
tgctctcctgctcctcagccca

SEQ ID NO: 8022437 - DNA, 22 bp, Homo sapiens
tgctctcatggaggtagagaat

SEQ ID NO: 8022438 - DNA, 22 bp, Homo sapiens
tgctctggctggagcaatgact

SEQ ID NO: 8022439 - DNA, 22 bp, Homo sapiens
tgctctggctggagcaatgact

SEQ ID NO: 8022440 - DNA, 19 bp, Homo sapiens
tgctctctggtgcttcatg

SEQ ID NO: 8022441 - DNA, 22 bp, Homo sapiens
tgctctctcaggcctggcccac

SEQ ID NO: 8022442 - DNA, 22 bp, Homo sapiens
tgctctcctgctcctcagccca

SEQ ID NO: 8022443 - DNA, 22 bp, Homo sapiens
tgctgagtactctcctgtgtag

SEQ ID NO: 8022444 - DNA, 22 bp, Homo sapiens
tgctgaggtttctgactatgga

SEQ ID NO: 8022445 - DNA, 22 bp, Homo sapiens
tgctgaggtttctgactatgga

SEQ ID NO: 8022446 - DNA, 22 bp, Homo sapiens
tgctgaggtttcgtctgcttgc

SEQ ID NO: 8022447 - DNA, 20 bp, Homo sapiens
tgctgaggttgacatgccca

SEQ ID NO: 8022448 - DNA, 22 bp, Homo sapiens
tgctgaggttgtggagtgcatt

SEQ ID NO: 8022449 - DNA, 22 bp, Homo sapiens
tgctgaggttgtggagtgcatt

SEQ ID NO: 8022450 - DNA, 22 bp, Homo sapiens
tgctgaggttgtggagtgcatt

SEQ ID NO: 8022451 - DNA, 22 bp, Homo sapiens
tgctgaggttgtggagtgcatt

SEQ ID NO: 8022452 - DNA, 22 bp, Homo sapiens
tgctgaggtttcgtctgcttgc

SEQ ID NO: 8022453 - DNA, 22 bp, Homo sapiens
tgctgaggttgtggagtgcatt

SEQ ID NO: 8022454 - DNA, 22 bp, Homo sapiens
tgctgaggttgtggagtgcatt

SEQ ID NO: 8022455 - DNA, 22 bp, Homo sapiens
tgctgaggttgtggagtgcatt

SEQ ID NO: 8022456 - DNA, 22 bp, Homo sapiens
tgctgagtatttgtttgaataa

SEQ ID NO: 8022457 - DNA, 22 bp, Homo sapiens
tgctgatgagtccttctatcgc

SEQ ID NO: 8022458 - DNA, 22 bp, Homo sapiens
tgctgagtgggattcctgtgct

SEQ ID NO: 8022459 - DNA, 21 bp, Homo sapiens
tgctgatgtcagagaagcaag

SEQ ID NO: 8022460 - DNA, 21 bp, Homo sapiens
tgctgatgtcagagaagcaag

SEQ ID NO: 8022461 - DNA, 22 bp, Homo sapiens
tgctgcaaaagaggtactgaat

SEQ ID NO: 8022462 - DNA, 18 bp, Homo sapiens
tgctgatggtccattagt

SEQ ID NO: 8022463 - DNA, 22 bp, Homo sapiens
tgctgatgctgttctgttagga

SEQ ID NO: 8022464 - DNA, 22 bp, Homo sapiens
tgctgatgagtccttctatcgc

SEQ ID NO: 8022465 - DNA, 22 bp, Homo sapiens
tgctgcagtgtttgctgaagtt

SEQ ID NO: 8022466 - DNA, 22 bp, Homo sapiens
tgctgcagtgtttgctgaagtt

SEQ ID NO: 8022467 - DNA, 22 bp, Homo sapiens
tgctgcagtgtttgctgaagtt

SEQ ID NO: 8022468 - DNA, 22 bp, Homo sapiens
tgctgcagttcaccctgccgtc

SEQ ID NO: 8022469 - DNA, 22 bp, Homo sapiens
tgctgcagttcaccctgccgtc

SEQ ID NO: 8022470 - DNA, 22 bp, Homo sapiens
tgctgcagttcaccctgccgtc

SEQ ID NO: 8022471 - DNA, 19 bp, Homo sapiens
tgctgcagtcaggcgaggg

SEQ ID NO: 8022472 - DNA, 19 bp, Homo sapiens
tgctgcagtcaggcgaggg

SEQ ID NO: 8022473 - DNA, 19 bp, Homo sapiens
tgctgcagtcaggcgaggg

SEQ ID NO: 8022474 - DNA, 22 bp, Homo sapiens
tgctgcaggtgtgttcagtgag

SEQ ID NO: 8022475 - DNA, 22 bp, Homo sapiens
tgctgcaggtgtgttcagtgag

SEQ ID NO: 8022476 - DNA, 22 bp, Homo sapiens
tgctgcaacattttataactca

SEQ ID NO: 8022477 - DNA, 22 bp, Homo sapiens
tgctgcaaatgagaagagactg

SEQ ID NO: 8022478 - DNA, 22 bp, Homo sapiens
tgctgcaaatgagaagagactg

SEQ ID NO: 8022479 - DNA, 22 bp, Homo sapiens
tgctgcaggcagcccctctact

SEQ ID NO: 8022480 - DNA, 22 bp, Homo sapiens
tgctgcaggccttggctgggaa

SEQ ID NO: 8022481 - DNA, 22 bp, Homo sapiens
tgctgcagggaagtcggggggt

SEQ ID NO: 8022482 - DNA, 22 bp, Homo sapiens
tgctgcagggatttcagagaca

SEQ ID NO: 8022483 - DNA, 22 bp, Homo sapiens
tgctgcagggatttcagagaca

SEQ ID NO: 8022484 - DNA, 22 bp, Homo sapiens
tgctgcagggccttccctgcat

SEQ ID NO: 8022485 - DNA, 22 bp, Homo sapiens
tgctgcagggccttccctgcat

SEQ ID NO: 8022486 - DNA, 22 bp, Homo sapiens
tgctgcaggtgtgttcagtgag

SEQ ID NO: 8022487 - DNA, 22 bp, Homo sapiens
tgctgaggtcaccttgctgcta

SEQ ID NO: 8022488 - DNA, 22 bp, Homo sapiens
tgctgaggtaaccatatcctgc

SEQ ID NO: 8022489 - DNA, 22 bp, Homo sapiens
tgctgaggtaaccatatcctgc

SEQ ID NO: 8022490 - DNA, 22 bp, Homo sapiens
tgctgagggcagatgaattaga

SEQ ID NO: 8022491 - DNA, 22 bp, Homo sapiens
tgctgagggctgttaaggaagc

SEQ ID NO: 8022492 - DNA, 22 bp, Homo sapiens
tgctgaggctagacctggaagt

SEQ ID NO: 8022493 - DNA, 22 bp, Homo sapiens
tgctgagggaggggttttccag

SEQ ID NO: 8022494 - DNA, 22 bp, Homo sapiens
tgctgagggagcatcaaagaaa

SEQ ID NO: 8022495 - DNA, 22 bp, Homo sapiens
tgctgagggaggggttttccag

SEQ ID NO: 8022496 - DNA, 20 bp, Homo sapiens
tgctgaggttgacatgccca

SEQ ID NO: 8022497 - DNA, 20 bp, Homo sapiens
tgctgaggttgacatgccca

SEQ ID NO: 8022498 - DNA, 22 bp, Homo sapiens
tgctgaggtcatttccaagtga

SEQ ID NO: 8022499 - DNA, 22 bp, Homo sapiens
tgctgaggtcatttccaagtga

SEQ ID NO: 8022500 - DNA, 22 bp, Homo sapiens
tgctgaggtcatttccaagtga

SEQ ID NO: 8022501 - DNA, 22 bp, Homo sapiens
tgctgaggtcatttccaagtga

SEQ ID NO: 8022502 - DNA, 22 bp, Homo sapiens
tgctgaggtcacggcggccaga

SEQ ID NO: 8022503 - DNA, 22 bp, Homo sapiens
tgctgaggtcacggcggccaga

SEQ ID NO: 8022504 - DNA, 22 bp, Homo sapiens
tgctgaggtcaccttgctgcta

SEQ ID NO: 8022505 - DNA, 22 bp, Homo sapiens
tgctgaggtcacggcggccaga

SEQ ID NO: 8022506 - DNA, 20 bp, Homo sapiens
tgctgaggcctgaggcctgg

SEQ ID NO: 8022507 - DNA, 20 bp, Homo sapiens
tgctgaggcctgaggcctgg

SEQ ID NO: 8022508 - DNA, 22 bp, Homo sapiens
tgctgaggcccaggagcacttt

SEQ ID NO: 8022509 - DNA, 22 bp, Homo sapiens
tgctgaggcccaggagcacttt

SEQ ID NO: 8022510 - DNA, 22 bp, Homo sapiens
tgctgaggcccaggagcacttt

SEQ ID NO: 8022511 - DNA, 20 bp, Homo sapiens
tgctgaggcctgaggcctgg

SEQ ID NO: 8022512 - DNA, 20 bp, Homo sapiens
tgctgaggcctgaggcctgg

SEQ ID NO: 8022513 - DNA, 20 bp, Homo sapiens
tgctgaggcctgaggcctgg

SEQ ID NO: 8022514 - DNA, 22 bp, Homo sapiens
tgctgaggctagacctggaagt

SEQ ID NO: 8022515 - DNA, 22 bp, Homo sapiens
tgctgaggcatttggacagagt

SEQ ID NO: 8022516 - DNA, 22 bp, Homo sapiens
tgctgaggcatttggacagagt

SEQ ID NO: 8022517 - DNA, 22 bp, Homo sapiens
tgctgaggcagtcctaacagga

SEQ ID NO: 8022518 - DNA, 22 bp, Homo sapiens
tgctgaggcagatgtctgtgac

SEQ ID NO: 8022519 - DNA, 22 bp, Homo sapiens
tgctgaggcagatgtctgtgac

SEQ ID NO: 8022520 - DNA, 22 bp, Homo sapiens
tgctgaggcagatgtctgtgac

SEQ ID NO: 8022521 - DNA, 22 bp, Homo sapiens
tgctgaggaaaaatgtgactct

SEQ ID NO: 8022522 - DNA, 22 bp, Homo sapiens
tgctgaggaaagaggataaaag

SEQ ID NO: 8022523 - DNA, 22 bp, Homo sapiens
tgctgaggaaaaatgtgactct

SEQ ID NO: 8022524 - DNA, 22 bp, Homo sapiens
tgctgaggaatttggtttatgt

SEQ ID NO: 8022525 - DNA, 22 bp, Homo sapiens
tgctgaggaataattgttcctg

SEQ ID NO: 8022526 - DNA, 22 bp, Homo sapiens
tgctgaggaataattgttcctg

SEQ ID NO: 8022527 - DNA, 22 bp, Homo sapiens
tgctgaggacacctagccttct

SEQ ID NO: 8022528 - DNA, 22 bp, Homo sapiens
tgctgaggaatttggtttatgt

SEQ ID NO: 8022529 - DNA, 22 bp, Homo sapiens
tgctgaggacacctagccttct

SEQ ID NO: 8022530 - DNA, 22 bp, Homo sapiens
tgctgaggactaaaggagatga

SEQ ID NO: 8022531 - DNA, 22 bp, Homo sapiens
tgctgaggactaaaggagatga

SEQ ID NO: 8022532 - DNA, 22 bp, Homo sapiens
tgctgaggactaaaggagatga

SEQ ID NO: 8022533 - DNA, 22 bp, Homo sapiens
tgctgaggactaaaggagatga

SEQ ID NO: 8022534 - DNA, 19 bp, Homo sapiens
tgctgaggatgcaagatcc

SEQ ID NO: 8022535 - DNA, 19 bp, Homo sapiens
tgctgaggatgcaagatcc

SEQ ID NO: 8022536 - DNA, 19 bp, Homo sapiens
tgctgaggatgcaagatcc

SEQ ID NO: 8022537 - DNA, 22 bp, Homo sapiens
tgctgaggaggtggctgtgctt

SEQ ID NO: 8022538 - DNA, 22 bp, Homo sapiens
tgctgaggaggtggctgtgctt

SEQ ID NO: 8022539 - DNA, 22 bp, Homo sapiens
tgctgaggaggtggctgtgctt

SEQ ID NO: 8022540 - DNA, 22 bp, Homo sapiens
tgctgaggagggcacccggggg

SEQ ID NO: 8022541 - DNA, 22 bp, Homo sapiens
tgctgaggactaaaggagatga

SEQ ID NO: 8022542 - DNA, 22 bp, Homo sapiens
tgctgagcgcatccggcggccg

SEQ ID NO: 8022543 - DNA, 22 bp, Homo sapiens
tgctgagcgcatccggcggccg

SEQ ID NO: 8022544 - DNA, 22 bp, Homo sapiens
tgctgagcgcatccggcggccg

SEQ ID NO: 8022545 - DNA, 22 bp, Homo sapiens
tgctgagcgcatccggcggccg

SEQ ID NO: 8022546 - DNA, 22 bp, Homo sapiens
tgctgagcgcatccggcggccg

SEQ ID NO: 8022547 - DNA, 22 bp, Homo sapiens
tgctgaggaaaaatgtgactct

SEQ ID NO: 8022548 - DNA, 22 bp, Homo sapiens
tgctgagcttccactgcttctg

SEQ ID NO: 8022549 - DNA, 22 bp, Homo sapiens
tgctgagcgcatccggcggccg

SEQ ID NO: 8022550 - DNA, 22 bp, Homo sapiens
tgctgagatctgccagtagatg

SEQ ID NO: 8022551 - DNA, 22 bp, Homo sapiens
tgctgagatctgccagtagatg

SEQ ID NO: 8022552 - DNA, 22 bp, Homo sapiens
tgctgagatctgccagtagatg

SEQ ID NO: 8022553 - DNA, 22 bp, Homo sapiens
tgctgagatagctgactaggca

SEQ ID NO: 8022554 - DNA, 21 bp, Homo sapiens
tgctgagatttgcctgattac

SEQ ID NO: 8022555 - DNA, 22 bp, Homo sapiens
tgctgagatgaatagggctgtc

SEQ ID NO: 8022556 - DNA, 22 bp, Homo sapiens
tgctgagcgcatccggcggccg

SEQ ID NO: 8022557 - DNA, 22 bp, Homo sapiens
tgctgagcgcatccggcggccg

SEQ ID NO: 8022558 - DNA, 22 bp, Homo sapiens
tgctgaaacaataacatactgg

SEQ ID NO: 8022559 - DNA, 22 bp, Homo sapiens
tgctgaaaatgcgtatcttcca

SEQ ID NO: 8022560 - DNA, 22 bp, Homo sapiens
tgctgaaaactcaaccattgtg

SEQ ID NO: 8022561 - DNA, 22 bp, Homo sapiens
tgctgaaaactcaaccattgtg

SEQ ID NO: 8022562 - DNA, 23 bp, Homo sapiens
tgctcttctcagacctgtcagcc

SEQ ID NO: 8022563 - DNA, 22 bp, Homo sapiens
tgctgaaattagaacattgagg

SEQ ID NO: 8022564 - DNA, 22 bp, Homo sapiens
tgctgaaggcaggggaggtggc

SEQ ID NO: 8022565 - DNA, 22 bp, Homo sapiens
tgctctgggttcttgctgttac

SEQ ID NO: 8022566 - DNA, 22 bp, Homo sapiens
tgctctgggttcttgctgttac

SEQ ID NO: 8022567 - DNA, 22 bp, Homo sapiens
tgctctgggtcctgggcctcct

SEQ ID NO: 8022568 - DNA, 22 bp, Homo sapiens
tgctctgggttcttgctgttac

SEQ ID NO: 8022569 - DNA, 20 bp, Homo sapiens
tgctctgggggtggagagac

SEQ ID NO: 8022570 - DNA, 22 bp, Homo sapiens
tgctctgggtcctgggcctcct

SEQ ID NO: 8022571 - DNA, 22 bp, Homo sapiens
tgctctgggtcctgggcctcct

SEQ ID NO: 8022572 - DNA, 20 bp, Homo sapiens
tgctctgggggtggagagac

SEQ ID NO: 8022573 - DNA, 20 bp, Homo sapiens
tgctctgggggtggagagac

SEQ ID NO: 8022574 - DNA, 20 bp, Homo sapiens
tgctctgggggtggagagac

SEQ ID NO: 8022575 - DNA, 20 bp, Homo sapiens
tgctctgggggtggagagac

SEQ ID NO: 8022576 - DNA, 22 bp, Homo sapiens
tgctctgggggaagccagctgt

SEQ ID NO: 8022577 - DNA, 22 bp, Homo sapiens
tgctctgggggaagccagctgt

SEQ ID NO: 8022578 - DNA, 20 bp, Homo sapiens
tgctctgggggtggagagac

SEQ ID NO: 8022579 - DNA, 20 bp, Homo sapiens
tgctctgggggtggagagac

SEQ ID NO: 8022580 - DNA, 20 bp, Homo sapiens
tgctctgggggtggagagac

SEQ ID NO: 8022581 - DNA, 20 bp, Homo sapiens
tgctctgggggtggagagac

SEQ ID NO: 8022582 - DNA, 20 bp, Homo sapiens
tgctctgggggtggagagac

SEQ ID NO: 8022583 - DNA, 20 bp, Homo sapiens
tgctctgggggtggagagac

SEQ ID NO: 8022584 - DNA, 22 bp, Homo sapiens
tgctctggtaactcacttccat

SEQ ID NO: 8022585 - DNA, 22 bp, Homo sapiens
tgctctggtaactcacttccat

SEQ ID NO: 8022586 - DNA, 22 bp, Homo sapiens
tgctctggtaactcacttccat

SEQ ID NO: 8022587 - DNA, 21 bp, Homo sapiens
tgctctggtagaaactctttc

SEQ ID NO: 8022588 - DNA, 22 bp, Homo sapiens
tgctctggtcctccctcggcgc

SEQ ID NO: 8022589 - DNA, 22 bp, Homo sapiens
tgctctggtaactcacttccat

SEQ ID NO: 8022590 - DNA, 21 bp, Homo sapiens
tgctctggtagaaactctttc

SEQ ID NO: 8022591 - DNA, 22 bp, Homo sapiens
tgctctggtcctccctcggcgc

SEQ ID NO: 8022592 - DNA, 18 bp, Homo sapiens
tgctctggtctcacttgg

SEQ ID NO: 8022593 - DNA, 18 bp, Homo sapiens
tgctctggtctcacttgg

SEQ ID NO: 8022594 - DNA, 18 bp, Homo sapiens
tgctctggtctcacttgg

SEQ ID NO: 8022595 - DNA, 21 bp, Homo sapiens
tgctctggtgttttatttaac

SEQ ID NO: 8022596 - DNA, 18 bp, Homo sapiens
tgctctggtctcacttgg

SEQ ID NO: 8022597 - DNA, 22 bp, Homo sapiens
tgctcttcaccattacatcatg

SEQ ID NO: 8022598 - DNA, 22 bp, Homo sapiens
tgctcttcggggccactgcttg

SEQ ID NO: 8022599 - DNA, 23 bp, Homo sapiens
tgctcttctcagacctgtcagcc

SEQ ID NO: 8022600 - DNA, 23 bp, Homo sapiens
tgctcttctcagacctgtcagcc

SEQ ID NO: 8022601 - DNA, 22 bp, Homo sapiens
tgctcttcggggccactgcttg

SEQ ID NO: 8022602 - DNA, 22 bp, Homo sapiens
tgctcttcggggccactgcttg

SEQ ID NO: 8022603 - DNA, 22 bp, Homo sapiens
tgctctgttcagtgtatcttgt

SEQ ID NO: 8022604 - DNA, 22 bp, Homo sapiens
tgctctgtgtgtggttatttcc

SEQ ID NO: 8022605 - DNA, 22 bp, Homo sapiens
tgctcttacattaattcagcat

SEQ ID NO: 8022606 - DNA, 22 bp, Homo sapiens
tgctcttcacagtttcagcatc

SEQ ID NO: 8022607 - DNA, 18 bp, Homo sapiens
tgctctgtttaatgattt

SEQ ID NO: 8022608 - DNA, 18 bp, Homo sapiens
tgctctgtttaatgattt

SEQ ID NO: 8022609 - DNA, 22 bp, Homo sapiens
tgctctgtattctatggcagtt

SEQ ID NO: 8022610 - DNA, 22 bp, Homo sapiens
tgctctgtcaagaaaagatgcc

SEQ ID NO: 8022611 - DNA, 22 bp, Homo sapiens
tgctctgtaggggaaagagagc

SEQ ID NO: 8022612 - DNA, 21 bp, Homo sapiens
tgctctggtgttttatttaac

SEQ ID NO: 8022613 - DNA, 22 bp, Homo sapiens
tgctctgtaacaaattgacatg

SEQ ID NO: 8022614 - DNA, 22 bp, Homo sapiens
tgctctgtaggggaaagagagc

SEQ ID NO: 8022615 - DNA, 22 bp, Homo sapiens
tgctctgtcaagaaaagatgcc

SEQ ID NO: 8022616 - DNA, 22 bp, Homo sapiens
tgctcagtatagaaaatgatat

SEQ ID NO: 8022617 - DNA, 22 bp, Homo sapiens
tgctcagtagcagtgtgctgct

SEQ ID NO: 8022618 - DNA, 22 bp, Homo sapiens
tgctcagtcctcctgcagtgcc

SEQ ID NO: 8022619 - DNA, 22 bp, Homo sapiens
tgctcagtcctcctgcagtgcc

SEQ ID NO: 8022620 - DNA, 22 bp, Homo sapiens
tgctcagtcctaccttggctcc

SEQ ID NO: 8022621 - DNA, 21 bp, Homo sapiens
tgctcagtctgtctccagctt

SEQ ID NO: 8022622 - DNA, 22 bp, Homo sapiens
tgctcagtcctcctgcagtgcc

SEQ ID NO: 8022623 - DNA, 22 bp, Homo sapiens
tgctcagtcctcctgcagtgcc

SEQ ID NO: 8022624 - DNA, 22 bp, Homo sapiens
tgctcattaggactgcaaattc

SEQ ID NO: 8022625 - DNA, 21 bp, Homo sapiens
tgctcatgcaatgcatgtcca

SEQ ID NO: 8022626 - DNA, 21 bp, Homo sapiens
tgctcatgcaatgcatgtcca

SEQ ID NO: 8022627 - DNA, 22 bp, Homo sapiens
tgctcatgctggggacagatgt

SEQ ID NO: 8022628 - DNA, 22 bp, Homo sapiens
tgctcagttcaaggaaggtgga

SEQ ID NO: 8022629 - DNA, 22 bp, Homo sapiens
tgctcagttcaaggaaggtgga

SEQ ID NO: 8022630 - DNA, 22 bp, Homo sapiens
tgctcagttaagcagaggaaat

SEQ ID NO: 8022631 - DNA, 19 bp, Homo sapiens
tgctcagtggctaaaagca

SEQ ID NO: 8022632 - DNA, 19 bp, Homo sapiens
tgctcagtggctaaaagca

SEQ ID NO: 8022633 - DNA, 22 bp, Homo sapiens
tgctcagtgagtctgtgacagg

SEQ ID NO: 8022634 - DNA, 22 bp, Homo sapiens
tgctcattggcgatctgaggga

SEQ ID NO: 8022635 - DNA, 22 bp, Homo sapiens
tgctcattggcgatctgaggga

SEQ ID NO: 8022636 - DNA, 22 bp, Homo sapiens
tgctcattggcgatctgaggga

SEQ ID NO: 8022637 - DNA, 22 bp, Homo sapiens
tgctcattggcgatctgaggga

SEQ ID NO: 8022638 - DNA, 22 bp, Homo sapiens
tgctcattggcgatctgaggga

SEQ ID NO: 8022639 - DNA, 22 bp, Homo sapiens
tgctccaccctcacactcttcc

SEQ ID NO: 8022640 - DNA, 22 bp, Homo sapiens
tgctccaccctcacactcttcc

SEQ ID NO: 8022641 - DNA, 22 bp, Homo sapiens
tgctcatttgcccattagcatc

SEQ ID NO: 8022642 - DNA, 22 bp, Homo sapiens
tgctccactcccaattgcatgt

SEQ ID NO: 8022643 - DNA, 22 bp, Homo sapiens
tgctccactgtgcgtggccata

SEQ ID NO: 8022644 - DNA, 22 bp, Homo sapiens
tgctccacctcccagctaacat

SEQ ID NO: 8022645 - DNA, 22 bp, Homo sapiens
tgctccactaagccatcccatt

SEQ ID NO: 8022646 - DNA, 22 bp, Homo sapiens
tgctccactaagccatcccatt

SEQ ID NO: 8022647 - DNA, 22 bp, Homo sapiens
tgctccagaaaaacttgagact

SEQ ID NO: 8022648 - DNA, 22 bp, Homo sapiens
tgctccacttgggcacccccca

SEQ ID NO: 8022649 - DNA, 22 bp, Homo sapiens
tgctccagaacctgaccatgct

SEQ ID NO: 8022650 - DNA, 22 bp, Homo sapiens
tgctccagaacctgaccatgct

SEQ ID NO: 8022651 - DNA, 22 bp, Homo sapiens
tgctccagaacctgaccatgct

SEQ ID NO: 8022652 - DNA, 22 bp, Homo sapiens
tgctccagaacctgaccatgct

SEQ ID NO: 8022653 - DNA, 22 bp, Homo sapiens
tgctccagcaacaggcttagct

SEQ ID NO: 8022654 - DNA, 22 bp, Homo sapiens
tgctccagcaacaggcttagct

SEQ ID NO: 8022655 - DNA, 22 bp, Homo sapiens
tgctccagcaccaagagctcca

SEQ ID NO: 8022656 - DNA, 22 bp, Homo sapiens
tgctccagcaccaagagctcca

SEQ ID NO: 8022657 - DNA, 22 bp, Homo sapiens
tgctcagcgccaaagctgatgg

SEQ ID NO: 8022658 - DNA, 22 bp, Homo sapiens
tgctcagccgtgagcagagccg

SEQ ID NO: 8022659 - DNA, 19 bp, Homo sapiens
tgctcagctcctgtgagtc

SEQ ID NO: 8022660 - DNA, 21 bp, Homo sapiens
tgctcagattctccatctgga

SEQ ID NO: 8022661 - DNA, 21 bp, Homo sapiens
tgctcagattctccatctgga

SEQ ID NO: 8022662 - DNA, 21 bp, Homo sapiens
tgctcagattctccatctgga

SEQ ID NO: 8022663 - DNA, 22 bp, Homo sapiens
tgctcagagctccagctctcct

SEQ ID NO: 8022664 - DNA, 18 bp, Homo sapiens
tgctcagagaaatcaagg

SEQ ID NO: 8022665 - DNA, 18 bp, Homo sapiens
tgctcagagaaatcaagg

SEQ ID NO: 8022666 - DNA, 18 bp, Homo sapiens
tgctcagagaaatcaagg

SEQ ID NO: 8022667 - DNA, 22 bp, Homo sapiens
tgctcagaagacttactggtta

SEQ ID NO: 8022668 - DNA, 22 bp, Homo sapiens
tgctcagacaagctgaacagta

SEQ ID NO: 8022669 - DNA, 22 bp, Homo sapiens
tgctcagacaagctgaacagta

SEQ ID NO: 8022670 - DNA, 22 bp, Homo sapiens
tgctcagactagctccagggaa

SEQ ID NO: 8022671 - DNA, 22 bp, Homo sapiens
tgctcagacaagctgaacagta

SEQ ID NO: 8022672 - DNA, 22 bp, Homo sapiens
tgctcagacttaagaagatcag

SEQ ID NO: 8022673 - DNA, 22 bp, Homo sapiens
tgctcagacttaagaagatcag

SEQ ID NO: 8022674 - DNA, 17 bp, Homo sapiens
tgctcaaatacttttga

SEQ ID NO: 8022675 - DNA, 21 bp, Homo sapiens
tgctcacagatgtgctcagtg

SEQ ID NO: 8022676 - DNA, 21 bp, Homo sapiens
tgctcacagatgtgctcagtg

SEQ ID NO: 8022677 - DNA, 21 bp, Homo sapiens
tgctcacagatgtgctcagtg

SEQ ID NO: 8022678 - DNA, 22 bp, Homo sapiens
tgctcacaattatcagaagtat

SEQ ID NO: 8022679 - DNA, 22 bp, Homo sapiens
tgctcacaattatcagaagtat

SEQ ID NO: 8022680 - DNA, 18 bp, Homo sapiens
tgctcacactgacctctg

SEQ ID NO: 8022681 - DNA, 22 bp, Homo sapiens
tgctcactctattcacagtgcc

SEQ ID NO: 8022682 - DNA, 22 bp, Homo sapiens
tgctcactctattcacagtgcc

SEQ ID NO: 8022683 - DNA, 22 bp, Homo sapiens
tgctcactctattcacagtgcc

SEQ ID NO: 8022684 - DNA, 22 bp, Homo sapiens
tgctcactctattcacagtgcc

SEQ ID NO: 8022685 - DNA, 22 bp, Homo sapiens
tgctcacattaggcatccatgg

SEQ ID NO: 8022686 - DNA, 22 bp, Homo sapiens
tgctcactctattcacagtgcc

SEQ ID NO: 8022687 - DNA, 22 bp, Homo sapiens
tgctcacatatcacctacctaa

SEQ ID NO: 8022688 - DNA, 22 bp, Homo sapiens
tgctcacatatcacctacctaa

SEQ ID NO: 8022689 - DNA, 22 bp, Homo sapiens
tgctcacagcccagaacataat

SEQ ID NO: 8022690 - DNA, 22 bp, Homo sapiens
tgctcagaactgtgaatacatg

SEQ ID NO: 8022691 - DNA, 22 bp, Homo sapiens
tgctcagaactgtgaatacatg

SEQ ID NO: 8022692 - DNA, 22 bp, Homo sapiens
tgctcagaacatgattcaggcg

SEQ ID NO: 8022693 - DNA, 22 bp, Homo sapiens
tgctcagaaagccaccagagcg

SEQ ID NO: 8022694 - DNA, 22 bp, Homo sapiens
tgctcactgaactcttgctgtc

SEQ ID NO: 8022695 - DNA, 20 bp, Homo sapiens
tgcgtgtgtatttattttct

SEQ ID NO: 8022696 - DNA, 23 bp, Homo sapiens
tgcgtgtgtgctgaggggcgtcc

SEQ ID NO: 8022697 - DNA, 20 bp, Homo sapiens
tgcgtgtgtatttattttct

SEQ ID NO: 8022698 - DNA, 22 bp, Homo sapiens
tgcgttgcgctcctgcagcagg

SEQ ID NO: 8022699 - DNA, 22 bp, Homo sapiens
tgcgtttagtttcaagacacgt

SEQ ID NO: 8022700 - DNA, 22 bp, Homo sapiens
tgcgtgtgtgtatatacacagg

SEQ ID NO: 8022701 - DNA, 22 bp, Homo sapiens
tgctaaattcattattgattta

SEQ ID NO: 8022702 - DNA, 22 bp, Homo sapiens
tgctaaataacttacatagtgg

SEQ ID NO: 8022703 - DNA, 23 bp, Homo sapiens
tgcgtacggctgccagtgtgact

SEQ ID NO: 8022704 - DNA, 22 bp, Homo sapiens
tgcgggtcccagggtcacaggc

SEQ ID NO: 8022705 - DNA, 22 bp, Homo sapiens
tgcgggtcccagggtcacaggc

SEQ ID NO: 8022706 - DNA, 22 bp, Homo sapiens
tgcgggggaagctgtgggagaa

SEQ ID NO: 8022707 - DNA, 22 bp, Homo sapiens
tgcgggggaagctgtgggagaa

SEQ ID NO: 8022708 - DNA, 22 bp, Homo sapiens
tgcggggccctcccgtgcactg

SEQ ID NO: 8022709 - DNA, 22 bp, Homo sapiens
tgcgtggctgcgaggacccagc

SEQ ID NO: 8022710 - DNA, 22 bp, Homo sapiens
tgcgtggctgcgaggacccagc

SEQ ID NO: 8022711 - DNA, 22 bp, Homo sapiens
tgcgtggcgcagcgtgtgggat

SEQ ID NO: 8022712 - DNA, 21 bp, Homo sapiens
tgcgtgtgcatggccttcggg

SEQ ID NO: 8022713 - DNA, 22 bp, Homo sapiens
tgcgtggctggtccctgtgacc

SEQ ID NO: 8022714 - DNA, 22 bp, Homo sapiens
tgcgtctggagtggagtttgaa

SEQ ID NO: 8022715 - DNA, 22 bp, Homo sapiens
tgcgtagtacgaatttgtgcct

SEQ ID NO: 8022716 - DNA, 22 bp, Homo sapiens
tgcgtggcgcagcgtgtgggat

SEQ ID NO: 8022717 - DNA, 22 bp, Homo sapiens
tgcgcggctcagtcatctccag

SEQ ID NO: 8022718 - DNA, 22 bp, Homo sapiens
tgcgcggctcagtcatctccag

SEQ ID NO: 8022719 - DNA, 22 bp, Homo sapiens
tgcgctggtggcggataagggt

SEQ ID NO: 8022720 - DNA, 22 bp, Homo sapiens
tgcgcctgtaagtccagagtcc

SEQ ID NO: 8022721 - DNA, 22 bp, Homo sapiens
tgcgcctctaatctcgggcgtc

SEQ ID NO: 8022722 - DNA, 22 bp, Homo sapiens
tgcgcctctaatctcgggcgtc

SEQ ID NO: 8022723 - DNA, 22 bp, Homo sapiens
tgcgcccagccaagtctggcac

SEQ ID NO: 8022724 - DNA, 22 bp, Homo sapiens
tgcgcccagccaagtctggcac

SEQ ID NO: 8022725 - DNA, 22 bp, Homo sapiens
tgcgcccagccaagtctggcac

SEQ ID NO: 8022726 - DNA, 22 bp, Homo sapiens
tgcgcaggagctctgccaggag

SEQ ID NO: 8022727 - DNA, 22 bp, Homo sapiens
tgcgcaggacacttgcagtgac

SEQ ID NO: 8022728 - DNA, 22 bp, Homo sapiens
tgcggagggagcagtcggctgt

SEQ ID NO: 8022729 - DNA, 22 bp, Homo sapiens
tgcggaaggcagcgcagggtgg

SEQ ID NO: 8022730 - DNA, 22 bp, Homo sapiens
tgcggagggagcagtcggctgt

SEQ ID NO: 8022731 - DNA, 22 bp, Homo sapiens
tgcggaggtcggtgctgcgggc

SEQ ID NO: 8022732 - DNA, 22 bp, Homo sapiens
tgcgcatgcgtggctctccggc

SEQ ID NO: 8022733 - DNA, 22 bp, Homo sapiens
tgcggatggattaggagagccc

SEQ ID NO: 8022734 - DNA, 22 bp, Homo sapiens
tgcggcagccaccgcgtggccc

SEQ ID NO: 8022735 - DNA, 16 bp, Homo sapiens
tgcggcaacttgcggc

SEQ ID NO: 8022736 - DNA, 22 bp, Homo sapiens
tgcggcagccaccgcgtggccc

SEQ ID NO: 8022737 - DNA, 22 bp, Homo sapiens
tgcggggagagaggtccaggat

SEQ ID NO: 8022738 - DNA, 22 bp, Homo sapiens
tgcggcggcgggcagaggacta

SEQ ID NO: 8022739 - DNA, 22 bp, Homo sapiens
tgcggcaggagaaggtgttatg

SEQ ID NO: 8022740 - DNA, 22 bp, Homo sapiens
tgcggctggtgctgaagctgag

SEQ ID NO: 8022741 - DNA, 22 bp, Homo sapiens
tgcggcaggagaaggtgttatg

SEQ ID NO: 8022742 - DNA, 22 bp, Homo sapiens
tgctatttggaaaagcatttgg

SEQ ID NO: 8022743 - DNA, 22 bp, Homo sapiens
tgctatttgggggctacatgat

SEQ ID NO: 8022744 - DNA, 22 bp, Homo sapiens
tgctatttgggggctacatgat

SEQ ID NO: 8022745 - DNA, 22 bp, Homo sapiens
tgctatttctatctcatttaaa

SEQ ID NO: 8022746 - DNA, 22 bp, Homo sapiens
tgctatttctatctcatttaaa

SEQ ID NO: 8022747 - DNA, 22 bp, Homo sapiens
tgctatttttatcttgatcaaa

SEQ ID NO: 8022748 - DNA, 22 bp, Homo sapiens
tgctatttttatcttgatcaaa

SEQ ID NO: 8022749 - DNA, 22 bp, Homo sapiens
tgctatttttatcttgatcaaa

SEQ ID NO: 8022750 - DNA, 22 bp, Homo sapiens
tgctattttggtctacagcact

SEQ ID NO: 8022751 - DNA, 22 bp, Homo sapiens
tgctattttagacatactttgt

SEQ ID NO: 8022752 - DNA, 22 bp, Homo sapiens
tgctatttgtgtaatggtaaat

SEQ ID NO: 8022753 - DNA, 22 bp, Homo sapiens
tgctatttgtgagtgtcttcgt

SEQ ID NO: 8022754 - DNA, 22 bp, Homo sapiens
tgctatgtaaagctctgggttt

SEQ ID NO: 8022755 - DNA, 22 bp, Homo sapiens
tgctattaatgaggctgcattt

SEQ ID NO: 8022756 - DNA, 22 bp, Homo sapiens
tgctattacctgctggacagtc

SEQ ID NO: 8022757 - DNA, 22 bp, Homo sapiens
tgctattaaattaaattgatat

SEQ ID NO: 8022758 - DNA, 19 bp, Homo sapiens
tgctatttagaacgcctgg

SEQ ID NO: 8022759 - DNA, 19 bp, Homo sapiens
tgctatttagaacgcctgg

SEQ ID NO: 8022760 - DNA, 22 bp, Homo sapiens
tgctattattgtcaccactgta

SEQ ID NO: 8022761 - DNA, 22 bp, Homo sapiens
tgctattagaagccatgctgtt

SEQ ID NO: 8022762 - DNA, 22 bp, Homo sapiens
tgctatctctatatccatttat

SEQ ID NO: 8022763 - DNA, 22 bp, Homo sapiens
tgctatcctggtctaattagaa

SEQ ID NO: 8022764 - DNA, 22 bp, Homo sapiens
tgctatataatggaatttctaa

SEQ ID NO: 8022765 - DNA, 22 bp, Homo sapiens
tgctataataatacagaggtga

SEQ ID NO: 8022766 - DNA, 22 bp, Homo sapiens
tgctataagtagacattcaaca

SEQ ID NO: 8022767 - DNA, 22 bp, Homo sapiens
tgctatacatgtacatattagt

SEQ ID NO: 8022768 - DNA, 22 bp, Homo sapiens
tgctataagaattatattactc

SEQ ID NO: 8022769 - DNA, 22 bp, Homo sapiens
tgctagtgtgtgagatgttcaa

SEQ ID NO: 8022770 - DNA, 22 bp, Homo sapiens
tgctagtgtgtgagatgttcaa

SEQ ID NO: 8022771 - DNA, 22 bp, Homo sapiens
tgctataagtagacattcaaca

SEQ ID NO: 8022772 - DNA, 19 bp, Homo sapiens
tgcctgtggcgagcatctt

SEQ ID NO: 8022773 - DNA, 22 bp, Homo sapiens
tgcctgtggaaaggctggtgct

SEQ ID NO: 8022774 - DNA, 22 bp, Homo sapiens
tgcctgtgcccttcttggcatt

SEQ ID NO: 8022775 - DNA, 22 bp, Homo sapiens
tgcctgtgcccttcttggcatt

SEQ ID NO: 8022776 - DNA, 22 bp, Homo sapiens
tgcctgtgccctttgctgggag

SEQ ID NO: 8022777 - DNA, 22 bp, Homo sapiens
tgcctgtgccctttgctgggag

SEQ ID NO: 8022778 - DNA, 22 bp, Homo sapiens
tgcctgtgccctttgctgggag

SEQ ID NO: 8022779 - DNA, 22 bp, Homo sapiens
tgcctgtgggtgatgatttgat

SEQ ID NO: 8022780 - DNA, 19 bp, Homo sapiens
tgcctgtggcgagcatctt

SEQ ID NO: 8022781 - DNA, 22 bp, Homo sapiens
tgcctgtgtatgtgcatgcaca

SEQ ID NO: 8022782 - DNA, 22 bp, Homo sapiens
tgcctgtgtatgtgcatgcaca

SEQ ID NO: 8022783 - DNA, 22 bp, Homo sapiens
tgcctgtggttccagttttttc

SEQ ID NO: 8022784 - DNA, 22 bp, Homo sapiens
tgccttgcacataatatacatt

SEQ ID NO: 8022785 - DNA, 22 bp, Homo sapiens
tgccttgcaggttttaaataca

SEQ ID NO: 8022786 - DNA, 22 bp, Homo sapiens
tgccttgcaggttttaaataca

SEQ ID NO: 8022787 - DNA, 22 bp, Homo sapiens
tgccttcttgaatatggttctt

SEQ ID NO: 8022788 - DNA, 22 bp, Homo sapiens
tgccttcttgaatatggttctt

SEQ ID NO: 8022789 - DNA, 22 bp, Homo sapiens
tgccttcttctccctggctcag

SEQ ID NO: 8022790 - DNA, 22 bp, Homo sapiens
tgccttgctggatgtcagtttt

SEQ ID NO: 8022791 - DNA, 16 bp, Homo sapiens
tgccttgctgtcagtc

SEQ ID NO: 8022792 - DNA, 22 bp, Homo sapiens
tgccttgctttggcggaggctg

SEQ ID NO: 8022793 - DNA, 22 bp, Homo sapiens
tgccttgcttcaatcaaaccgt

SEQ ID NO: 8022794 - DNA, 22 bp, Homo sapiens
tgccttgcttaacaagatggca

SEQ ID NO: 8022795 - DNA, 20 bp, Homo sapiens
tgccttggagcagccaaggt

SEQ ID NO: 8022796 - DNA, 22 bp, Homo sapiens
tgccttgccactgctcttaatg

SEQ ID NO: 8022797 - DNA, 20 bp, Homo sapiens
tgccttgccaagcctcctaa

SEQ ID NO: 8022798 - DNA, 22 bp, Homo sapiens
tgccttgcgggcgtttctgttg

SEQ ID NO: 8022799 - DNA, 22 bp, Homo sapiens
tgccttgcggtgtatttctggg

SEQ ID NO: 8022800 - DNA, 22 bp, Homo sapiens
tgccttgcgggcgtttctgttg

SEQ ID NO: 8022801 - DNA, 22 bp, Homo sapiens
tgccttgctgctttggagtcct

SEQ ID NO: 8022802 - DNA, 22 bp, Homo sapiens
tgccttgctctgtaaaatctct

SEQ ID NO: 8022803 - DNA, 22 bp, Homo sapiens
tgcctgtgtatttccggcctgc

SEQ ID NO: 8022804 - DNA, 22 bp, Homo sapiens
tgcctgtgtcacagtgatgttt

SEQ ID NO: 8022805 - DNA, 22 bp, Homo sapiens
tgcctgtgtcacagtgatgttt

SEQ ID NO: 8022806 - DNA, 22 bp, Homo sapiens
tgcctgtgtccccttcttggca

SEQ ID NO: 8022807 - DNA, 22 bp, Homo sapiens
tgcctgtgtccccttcttggca

SEQ ID NO: 8022808 - DNA, 22 bp, Homo sapiens
tgcctgtgtccccttcttggca

SEQ ID NO: 8022809 - DNA, 22 bp, Homo sapiens
tgcctgtgtgaccacgggcaag

SEQ ID NO: 8022810 - DNA, 22 bp, Homo sapiens
tgcgaccctagccccctcactt

SEQ ID NO: 8022811 - DNA, 22 bp, Homo sapiens
tgccttttgttagggctgccag

SEQ ID NO: 8022812 - DNA, 22 bp, Homo sapiens
tgccttttgttagggctgccag

SEQ ID NO: 8022813 - DNA, 22 bp, Homo sapiens
tgccttttgaagcctcacaggt

SEQ ID NO: 8022814 - DNA, 22 bp, Homo sapiens
tgccttttgaagcctcacaggt

SEQ ID NO: 8022815 - DNA, 22 bp, Homo sapiens
tgccttttgtatgcaggccatg

SEQ ID NO: 8022816 - DNA, 22 bp, Homo sapiens
tgccttttctgtagctctggaa

SEQ ID NO: 8022817 - DNA, 22 bp, Homo sapiens
tgcgatggcgtagacaaatccc

SEQ ID NO: 8022818 - DNA, 17 bp, Homo sapiens
tgcgatgtctgtgtttg

SEQ ID NO: 8022819 - DNA, 22 bp, Homo sapiens
tgcgatgtatgcagtatttgtt

SEQ ID NO: 8022820 - DNA, 21 bp, Homo sapiens
tgcgatcctcaatcctctgtt

SEQ ID NO: 8022821 - DNA, 22 bp, Homo sapiens
tgcgatcctgcattaaatttcc

SEQ ID NO: 8022822 - DNA, 22 bp, Homo sapiens
tgcgagagtggaaaggaagcct

SEQ ID NO: 8022823 - DNA, 22 bp, Homo sapiens
tgcctttgcaattgaggaggat

SEQ ID NO: 8022824 - DNA, 20 bp, Homo sapiens
tgcctttcctgtttcatctt

SEQ ID NO: 8022825 - DNA, 22 bp, Homo sapiens
tgcctttgcaattgaggaggat

SEQ ID NO: 8022826 - DNA, 20 bp, Homo sapiens
tgcctttcctgtttcatctt

SEQ ID NO: 8022827 - DNA, 22 bp, Homo sapiens
tgcctttataagccagcagcaa

SEQ ID NO: 8022828 - DNA, 22 bp, Homo sapiens
tgcctttataagccagcagcaa

SEQ ID NO: 8022829 - DNA, 22 bp, Homo sapiens
tgccttttagtgctcaataaag

SEQ ID NO: 8022830 - DNA, 22 bp, Homo sapiens
tgccttttaccttgtaattctg

SEQ ID NO: 8022831 - DNA, 22 bp, Homo sapiens
tgccttttaccttgtaattctg

SEQ ID NO: 8022832 - DNA, 22 bp, Homo sapiens
tgcctttggtttgctacatgcc

SEQ ID NO: 8022833 - DNA, 22 bp, Homo sapiens
tgccttttccagcttccaggag

SEQ ID NO: 8022834 - DNA, 22 bp, Homo sapiens
tgccttttccagtttctagggg

SEQ ID NO: 8022835 - DNA, 22 bp, Homo sapiens
tgccttttccagtttctagggg

SEQ ID NO: 8022836 - DNA, 22 bp, Homo sapiens
tgccttttatggctagcctcag

SEQ ID NO: 8022837 - DNA, 20 bp, Homo sapiens
tgccttttatacctttaaac

SEQ ID NO: 8022838 - DNA, 22 bp, Homo sapiens
tgccttttccagcttccagagg

SEQ ID NO: 8022839 - DNA, 22 bp, Homo sapiens
tgccttgggatatatggacact

SEQ ID NO: 8022840 - DNA, 22 bp, Homo sapiens
tgccttggtgcttcttcatgtg

SEQ ID NO: 8022841 - DNA, 22 bp, Homo sapiens
tgccttggtggcagtctgcggt

SEQ ID NO: 8022842 - DNA, 22 bp, Homo sapiens
tgccttggtggcagtctgcggt

SEQ ID NO: 8022843 - DNA, 22 bp, Homo sapiens
tgccttggttctctacttggag

SEQ ID NO: 8022844 - DNA, 19 bp, Homo sapiens
tgccttggctgccaggaaa

SEQ ID NO: 8022845 - DNA, 20 bp, Homo sapiens
tgccttgggacagtgcctgt

SEQ ID NO: 8022846 - DNA, 22 bp, Homo sapiens
tgccttgggagccagcatgcca

SEQ ID NO: 8022847 - DNA, 22 bp, Homo sapiens
tgccttggattgcagggaacct

SEQ ID NO: 8022848 - DNA, 22 bp, Homo sapiens
tgccttggaggaatgatgagag

SEQ ID NO: 8022849 - DNA, 22 bp, Homo sapiens
tgccttggtttccccatctgta

SEQ ID NO: 8022850 - DNA, 22 bp, Homo sapiens
tgccttggtttccccatctgta

SEQ ID NO: 8022851 - DNA, 22 bp, Homo sapiens
tgccttgtccttcgtcagggct

SEQ ID NO: 8022852 - DNA, 22 bp, Homo sapiens
tgccttgtccttcgtcagggct

SEQ ID NO: 8022853 - DNA, 22 bp, Homo sapiens
tgcctttaaaaaggaagtcatt

SEQ ID NO: 8022854 - DNA, 22 bp, Homo sapiens
tgcctttaaactgatcatcagg

SEQ ID NO: 8022855 - DNA, 22 bp, Homo sapiens
tgcctttaaactgatcatcagg

SEQ ID NO: 8022856 - DNA, 22 bp, Homo sapiens
tgcctttaaactgatcatcagg

SEQ ID NO: 8022857 - DNA, 22 bp, Homo sapiens
tgcctttaacaagatctccaga

SEQ ID NO: 8022858 - DNA, 22 bp, Homo sapiens
tgcctttaaaaaggaagtcatt

SEQ ID NO: 8022859 - DNA, 22 bp, Homo sapiens
tgcctttaacaagatctccaga

SEQ ID NO: 8022860 - DNA, 22 bp, Homo sapiens
tgcctttaacaagatctccaga

SEQ ID NO: 8022861 - DNA, 22 bp, Homo sapiens
tgcctttaaccagtctagacag

SEQ ID NO: 8022862 - DNA, 22 bp, Homo sapiens
tgcctttaacttaaagcatgac

SEQ ID NO: 8022863 - DNA, 22 bp, Homo sapiens
tgcctttaacttaaagcatgac

SEQ ID NO: 8022864 - DNA, 22 bp, Homo sapiens
tgcctttaaccagtctagacag

SEQ ID NO: 8022865 - DNA, 22 bp, Homo sapiens
tgcctttaacttaaagcatgac

SEQ ID NO: 8022866 - DNA, 22 bp, Homo sapiens
tgcctttaaggaatcattcttg

SEQ ID NO: 8022867 - DNA, 22 bp, Homo sapiens
tgcctttactataaaggatctg

SEQ ID NO: 8022868 - DNA, 22 bp, Homo sapiens
tgcctttactgattagctgtgt

SEQ ID NO: 8022869 - DNA, 22 bp, Homo sapiens
tgcctttagggaaaagcaagct

SEQ ID NO: 8022870 - DNA, 22 bp, Homo sapiens
tgcctttaaggaatcattcttg

SEQ ID NO: 8022871 - DNA, 22 bp, Homo sapiens
tgcctttactataaaggatctg

SEQ ID NO: 8022872 - DNA, 22 bp, Homo sapiens
tgcctttaggggcctctccctc

SEQ ID NO: 8022873 - DNA, 22 bp, Homo sapiens
tgcctttagggaaaagcaagct

SEQ ID NO: 8022874 - DNA, 20 bp, Homo sapiens
tgcctggcctttctctgccc

SEQ ID NO: 8022875 - DNA, 20 bp, Homo sapiens
tgcctggcctttctctgccc

SEQ ID NO: 8022876 - DNA, 20 bp, Homo sapiens
tgcctggcctttctctgccc

SEQ ID NO: 8022877 - DNA, 21 bp, Homo sapiens
tgcctggcctttgcttttcct

SEQ ID NO: 8022878 - DNA, 20 bp, Homo sapiens
tgcctggcctttctctgccc

SEQ ID NO: 8022879 - DNA, 22 bp, Homo sapiens
tgcctggccctgacagccctgg

SEQ ID NO: 8022880 - DNA, 22 bp, Homo sapiens
tgcctggccctgacagccctgg

SEQ ID NO: 8022881 - DNA, 22 bp, Homo sapiens
tgcctggccctgacagccctgg

SEQ ID NO: 8022882 - DNA, 22 bp, Homo sapiens
tgcctggccctgacagccctgg

SEQ ID NO: 8022883 - DNA, 22 bp, Homo sapiens
tgcctggccagaccctatagag

SEQ ID NO: 8022884 - DNA, 22 bp, Homo sapiens
tgcctggcatgttatagacaca

SEQ ID NO: 8022885 - DNA, 22 bp, Homo sapiens
tgcctggcatgttatagacaca

SEQ ID NO: 8022886 - DNA, 22 bp, Homo sapiens
tgcctggccagaccctatagag

SEQ ID NO: 8022887 - DNA, 22 bp, Homo sapiens
tgcctggctaatttttgtatcc

SEQ ID NO: 8022888 - DNA, 22 bp, Homo sapiens
tgcctggctctatcagtggtgg

SEQ ID NO: 8022889 - DNA, 21 bp, Homo sapiens
tgcctggcctttgcttttcct

SEQ ID NO: 8022890 - DNA, 22 bp, Homo sapiens
tgcctggctctatcagtggtgg

SEQ ID NO: 8022891 - DNA, 22 bp, Homo sapiens
tgcctggctctatcagtggtgg

SEQ ID NO: 8022892 - DNA, 22 bp, Homo sapiens
tgcctggctaatttttgtatcc

SEQ ID NO: 8022893 - DNA, 22 bp, Homo sapiens
tgcctggctctatcagtggtgg

SEQ ID NO: 8022894 - DNA, 22 bp, Homo sapiens
tgcctggctgggctgctcatgg

SEQ ID NO: 8022895 - DNA, 22 bp, Homo sapiens
tgcctggctgggctgctcatgg

SEQ ID NO: 8022896 - DNA, 22 bp, Homo sapiens
tgcctggctgaggtgacaggtt

SEQ ID NO: 8022897 - DNA, 22 bp, Homo sapiens
tgcctggctgaggtgacaggtt

SEQ ID NO: 8022898 - DNA, 22 bp, Homo sapiens
tgcctggctgaggtgacaggtt

SEQ ID NO: 8022899 - DNA, 22 bp, Homo sapiens
tgcctggctgaggtgacaggtt

SEQ ID NO: 8022900 - DNA, 22 bp, Homo sapiens
tgcctggctgaggtgacaggtt

SEQ ID NO: 8022901 - DNA, 22 bp, Homo sapiens
tgcctgggtccaggccaagcct

SEQ ID NO: 8022902 - DNA, 22 bp, Homo sapiens
tgcctgggtccaggccaagcct

SEQ ID NO: 8022903 - DNA, 22 bp, Homo sapiens
tgcctgggtccaggccaagcct

SEQ ID NO: 8022904 - DNA, 22 bp, Homo sapiens
tgcctggggttggcaaactgct

SEQ ID NO: 8022905 - DNA, 22 bp, Homo sapiens
tgcctgggtccaggccaagcct

SEQ ID NO: 8022906 - DNA, 22 bp, Homo sapiens
tgcctggggattgctctgggcc

SEQ ID NO: 8022907 - DNA, 22 bp, Homo sapiens
tgcctggggattgctctgggcc

SEQ ID NO: 8022908 - DNA, 22 bp, Homo sapiens
tgcctggggattgctctgggcc

SEQ ID NO: 8022909 - DNA, 22 bp, Homo sapiens
tgcctgggggactaaggccaaa

SEQ ID NO: 8022910 - DNA, 22 bp, Homo sapiens
tgcctgggggactaaggccaaa

SEQ ID NO: 8022911 - DNA, 22 bp, Homo sapiens
tgcctgggggactaaggccaaa

SEQ ID NO: 8022912 - DNA, 22 bp, Homo sapiens
tgcctgggggactaaggccaaa

SEQ ID NO: 8022913 - DNA, 22 bp, Homo sapiens
tgcctgggaaccaatcctggct

SEQ ID NO: 8022914 - DNA, 22 bp, Homo sapiens
tgcctggctgggctgctcatgg

SEQ ID NO: 8022915 - DNA, 22 bp, Homo sapiens
tgcctgggaaccaatcctggct

SEQ ID NO: 8022916 - DNA, 22 bp, Homo sapiens
tgcctgggaaccaatcctggct

SEQ ID NO: 8022917 - DNA, 22 bp, Homo sapiens
tgcctgggaaccaatcctggct

SEQ ID NO: 8022918 - DNA, 22 bp, Homo sapiens
tgcctgggaaccaatcctggct

SEQ ID NO: 8022919 - DNA, 22 bp, Homo sapiens
tgcctggggattgctctgggcc

SEQ ID NO: 8022920 - DNA, 22 bp, Homo sapiens
tgcctggggattgctctgggcc

SEQ ID NO: 8022921 - DNA, 22 bp, Homo sapiens
tgcctggggattgctctgggcc

SEQ ID NO: 8022922 - DNA, 22 bp, Homo sapiens
tgcctgggctcggtagccatcg

SEQ ID NO: 8022923 - DNA, 22 bp, Homo sapiens
tgcctgggctcggtagccatcg

SEQ ID NO: 8022924 - DNA, 22 bp, Homo sapiens
tgcctgtcttcaggagtgtcac

SEQ ID NO: 8022925 - DNA, 22 bp, Homo sapiens
tgcctgtcttcaggagtgtcac

SEQ ID NO: 8022926 - DNA, 22 bp, Homo sapiens
tgcctgtcttcaggagtgtcac

SEQ ID NO: 8022927 - DNA, 22 bp, Homo sapiens
tgcctgtctctgactgccatta

SEQ ID NO: 8022928 - DNA, 22 bp, Homo sapiens
tgcctgtcttaatatctggaaa

SEQ ID NO: 8022929 - DNA, 22 bp, Homo sapiens
tgcctgtcttaatatctggaaa

SEQ ID NO: 8022930 - DNA, 19 bp, Homo sapiens
tgcctgtcagtagatctca

SEQ ID NO: 8022931 - DNA, 22 bp, Homo sapiens
tgcctgtcagggggagtgggaa

SEQ ID NO: 8022932 - DNA, 22 bp, Homo sapiens
tgcctgtcctgaggatgagggt

SEQ ID NO: 8022933 - DNA, 22 bp, Homo sapiens
tgcctgtctcctctgcagggtg

SEQ ID NO: 8022934 - DNA, 22 bp, Homo sapiens
tgcctgtctcctctgcagggtg

SEQ ID NO: 8022935 - DNA, 22 bp, Homo sapiens
tgcctgtcttggagtcctggcc

SEQ ID NO: 8022936 - DNA, 22 bp, Homo sapiens
tgcctgtcttggagtcctggcc

SEQ ID NO: 8022937 - DNA, 22 bp, Homo sapiens
tgcctgtgaaaaccctggggtt

SEQ ID NO: 8022938 - DNA, 22 bp, Homo sapiens
tgcctgtcttggagtcctggcc

SEQ ID NO: 8022939 - DNA, 22 bp, Homo sapiens
tgcctgtgacccaaggatgcga

SEQ ID NO: 8022940 - DNA, 22 bp, Homo sapiens
tgcctgggtgtaaagggccaac

SEQ ID NO: 8022941 - DNA, 22 bp, Homo sapiens
tgcctgggtgtaaagggccaac

SEQ ID NO: 8022942 - DNA, 22 bp, Homo sapiens
tgcctgggtgtaaagggccaac

SEQ ID NO: 8022943 - DNA, 22 bp, Homo sapiens
tgcctgggtgtaaagggccaac

SEQ ID NO: 8022944 - DNA, 22 bp, Homo sapiens
tgcctgggtgtaaagggccaac

SEQ ID NO: 8022945 - DNA, 22 bp, Homo sapiens
tgcctgggtgccctctgctcct

SEQ ID NO: 8022946 - DNA, 22 bp, Homo sapiens
tgcctgggtgccctctgctcct

SEQ ID NO: 8022947 - DNA, 22 bp, Homo sapiens
tgcctgggtgccctctgctcct

SEQ ID NO: 8022948 - DNA, 22 bp, Homo sapiens
tgcctgggtgctggctggtcac

SEQ ID NO: 8022949 - DNA, 22 bp, Homo sapiens
tgcctgggtgctggctggtcac

SEQ ID NO: 8022950 - DNA, 22 bp, Homo sapiens
tgcctgggtgctggctggtcac

SEQ ID NO: 8022951 - DNA, 22 bp, Homo sapiens
tgcctgggtgccctctgctcct

SEQ ID NO: 8022952 - DNA, 22 bp, Homo sapiens
tgcctggtatttgaataaagag

SEQ ID NO: 8022953 - DNA, 22 bp, Homo sapiens
tgcctgtcagggggagtgggaa

SEQ ID NO: 8022954 - DNA, 22 bp, Homo sapiens
tgcctgggttcccaccccaaag

SEQ ID NO: 8022955 - DNA, 22 bp, Homo sapiens
tgcctgggttgactcttagctg

SEQ ID NO: 8022956 - DNA, 22 bp, Homo sapiens
tgcctgggtgtaaagggccaac

SEQ ID NO: 8022957 - DNA, 22 bp, Homo sapiens
tgcctgggttcccaccccaaag

SEQ ID NO: 8022958 - DNA, 22 bp, Homo sapiens
tgcctgggtgtaaagggccaac

SEQ ID NO: 8022959 - DNA, 22 bp, Homo sapiens
tgcctgggtgtaaagggccaac

SEQ ID NO: 8022960 - DNA, 22 bp, Homo sapiens
tgctggagtaacaagacactca

SEQ ID NO: 8022961 - DNA, 22 bp, Homo sapiens
tgctggagtaacaagacactca

SEQ ID NO: 8022962 - DNA, 22 bp, Homo sapiens
tgctggagtctcttgaccctgg

SEQ ID NO: 8022963 - DNA, 22 bp, Homo sapiens
tgctggagtaacaagacactca

SEQ ID NO: 8022964 - DNA, 19 bp, Homo sapiens
tgctggagtgacattctga

SEQ ID NO: 8022965 - DNA, 22 bp, Homo sapiens
tgctggagtgagattatgagtt

SEQ ID NO: 8022966 - DNA, 19 bp, Homo sapiens
tgctggagtgacattctga

SEQ ID NO: 8022967 - DNA, 22 bp, Homo sapiens
tgctggagtctcttgaccctgg

SEQ ID NO: 8022968 - DNA, 19 bp, Homo sapiens
tgctggaggttgacagggt

SEQ ID NO: 8022969 - DNA, 19 bp, Homo sapiens
tgctggaggttgacagggt

SEQ ID NO: 8022970 - DNA, 19 bp, Homo sapiens
tgctggaggttgacagggt

SEQ ID NO: 8022971 - DNA, 22 bp, Homo sapiens
tgctggagtaacaagacactca

SEQ ID NO: 8022972 - DNA, 22 bp, Homo sapiens
tgctggagtaacaagacactca

SEQ ID NO: 8022973 - DNA, 19 bp, Homo sapiens
tgctggaggttgacagggt

SEQ ID NO: 8022974 - DNA, 19 bp, Homo sapiens
tgctggaggttgacagggt

SEQ ID NO: 8022975 - DNA, 19 bp, Homo sapiens
tgctggaggttgacagggt

SEQ ID NO: 8022976 - DNA, 19 bp, Homo sapiens
tgctggaggttgacagggt

SEQ ID NO: 8022977 - DNA, 19 bp, Homo sapiens
tgctggaggttgacagggt

SEQ ID NO: 8022978 - DNA, 22 bp, Homo sapiens
tgctggaggggatgccttcact

SEQ ID NO: 8022979 - DNA, 22 bp, Homo sapiens
tgctggaggggcctgaccagga

SEQ ID NO: 8022980 - DNA, 22 bp, Homo sapiens
tgctggaggggatgccttcact

SEQ ID NO: 8022981 - DNA, 17 bp, Homo sapiens
tgctggaggcggggtat

SEQ ID NO: 8022982 - DNA, 17 bp, Homo sapiens
tgctggaggcggggtat

SEQ ID NO: 8022983 - DNA, 22 bp, Homo sapiens
tgctggaggggatgccttcact

SEQ ID NO: 8022984 - DNA, 17 bp, Homo sapiens
tgctggaggcggggtat

SEQ ID NO: 8022985 - DNA, 17 bp, Homo sapiens
tgctggaggcggggtat

SEQ ID NO: 8022986 - DNA, 17 bp, Homo sapiens
tgctggaggcggggtat

SEQ ID NO: 8022987 - DNA, 19 bp, Homo sapiens
tgctggagggtagtgagtc

SEQ ID NO: 8022988 - DNA, 22 bp, Homo sapiens
tgctggaggggcctgaccagga

SEQ ID NO: 8022989 - DNA, 22 bp, Homo sapiens
tgctggagggggtaccactcaa

SEQ ID NO: 8022990 - DNA, 19 bp, Homo sapiens
tgctggagggtagtgagtc

SEQ ID NO: 8022991 - DNA, 19 bp, Homo sapiens
tgctggagggtagtgagtc

SEQ ID NO: 8022992 - DNA, 22 bp, Homo sapiens
tgctggagggggtaccactcaa

SEQ ID NO: 8022993 - DNA, 22 bp, Homo sapiens
tgctggagggggtaccactcaa

SEQ ID NO: 8022994 - DNA, 22 bp, Homo sapiens
tgctggagggggtaccactcaa

SEQ ID NO: 8022995 - DNA, 22 bp, Homo sapiens
tgctggaggggcctgaccagga

SEQ ID NO: 8022996 - DNA, 22 bp, Homo sapiens
tgctggaggggcctgaccagga

SEQ ID NO: 8022997 - DNA, 22 bp, Homo sapiens
tgctggaggggcctgaccagga

SEQ ID NO: 8022998 - DNA, 22 bp, Homo sapiens
tgctggaggggcctgaccagga

SEQ ID NO: 8022999 - DNA, 22 bp, Homo sapiens
tgctggaggggcctgaccagga

SEQ ID NO: 8023000 - DNA, 22 bp, Homo sapiens
tgctggaggccgagaagcagca

SEQ ID NO: 8023001 - DNA, 22 bp, Homo sapiens
tgctggaggccgagaagcagca

SEQ ID NO: 8023002 - DNA, 22 bp, Homo sapiens
tgctggaggccgagaagcagca

SEQ ID NO: 8023003 - DNA, 22 bp, Homo sapiens
tgctggaggccgagaagcagca

SEQ ID NO: 8023004 - DNA, 20 bp, Homo sapiens
tgctggaggcgccggcgctc

SEQ ID NO: 8023005 - DNA, 17 bp, Homo sapiens
tgctggaggcggggtat

SEQ ID NO: 8023006 - DNA, 20 bp, Homo sapiens
tgctggaggcgccggcgctc

SEQ ID NO: 8023007 - DNA, 20 bp, Homo sapiens
tgctggaggcgccggcgctc

SEQ ID NO: 8023008 - DNA, 20 bp, Homo sapiens
tgctggaggcgccggcgctc

SEQ ID NO: 8023009 - DNA, 20 bp, Homo sapiens
tgctggaggcgccggcgctc

SEQ ID NO: 8023010 - DNA, 20 bp, Homo sapiens
tgctggaggcgccggcgctc

SEQ ID NO: 8023011 - DNA, 22 bp, Homo sapiens
tgctggaggcctgactgtgttt

SEQ ID NO: 8023012 - DNA, 22 bp, Homo sapiens
tgctggaggcctgactgtgttt

SEQ ID NO: 8023013 - DNA, 22 bp, Homo sapiens
tgctggaggcctgactgtgttt

SEQ ID NO: 8023014 - DNA, 22 bp, Homo sapiens
tgctggaggcctgactgtgttt

SEQ ID NO: 8023015 - DNA, 22 bp, Homo sapiens
tgctggaggcctgactgtgttt

SEQ ID NO: 8023016 - DNA, 22 bp, Homo sapiens
tgctggaggcctgactgtgttt

SEQ ID NO: 8023017 - DNA, 22 bp, Homo sapiens
tgctggaggccagaagtctgag

SEQ ID NO: 8023018 - DNA, 22 bp, Homo sapiens
tgctggaggccagaagtctgag

SEQ ID NO: 8023019 - DNA, 22 bp, Homo sapiens
tgctggaggcagtggaggtgcc

SEQ ID NO: 8023020 - DNA, 22 bp, Homo sapiens
tgctggaggcagtggaggtgcc

SEQ ID NO: 8023021 - DNA, 22 bp, Homo sapiens
tgctggaggcagtggaggtgcc

SEQ ID NO: 8023022 - DNA, 22 bp, Homo sapiens
tgctggaggcagtggaggtgcc

SEQ ID NO: 8023023 - DNA, 22 bp, Homo sapiens
tgctggaggattaaacaagtca

SEQ ID NO: 8023024 - DNA, 22 bp, Homo sapiens
tgctggaggcagtggaggtgcc

SEQ ID NO: 8023025 - DNA, 22 bp, Homo sapiens
tgctggaggagtttactgtggc

SEQ ID NO: 8023026 - DNA, 22 bp, Homo sapiens
tgctggaggagtttactgtggc

SEQ ID NO: 8023027 - DNA, 22 bp, Homo sapiens
tgctggaggagaaggttgctca

SEQ ID NO: 8023028 - DNA, 22 bp, Homo sapiens
tgctggaggagaaggttgctca

SEQ ID NO: 8023029 - DNA, 22 bp, Homo sapiens
tgctggaggagtttactgtggc

SEQ ID NO: 8023030 - DNA, 22 bp, Homo sapiens
tgctggaggattaaacaagtca

SEQ ID NO: 8023031 - DNA, 22 bp, Homo sapiens
tgctggaggagtttactgtggc

SEQ ID NO: 8023032 - DNA, 23 bp, Homo sapiens
tgctggagtttactcaggccagc

SEQ ID NO: 8023033 - DNA, 23 bp, Homo sapiens
tgctggagtttactcaggccagc

SEQ ID NO: 8023034 - DNA, 23 bp, Homo sapiens
tgctggagtttactcaggccagc

SEQ ID NO: 8023035 - DNA, 23 bp, Homo sapiens
tgctggagtttactcaggccagc

SEQ ID NO: 8023036 - DNA, 23 bp, Homo sapiens
tgctggagtttactcaggccagc

SEQ ID NO: 8023037 - DNA, 23 bp, Homo sapiens
tgctggagtttactcaggccagc

SEQ ID NO: 8023038 - DNA, 23 bp, Homo sapiens
tgctggagtttactcaggccagc

SEQ ID NO: 8023039 - DNA, 23 bp, Homo sapiens
tgctggagtttactcaggccagc

SEQ ID NO: 8023040 - DNA, 21 bp, Homo sapiens
tgctggcaagactcaggaata

SEQ ID NO: 8023041 - DNA, 17 bp, Homo sapiens
tgctggcaacatacaaa

SEQ ID NO: 8023042 - DNA, 22 bp, Homo sapiens
tgctggcaatgctcttgacgtc

SEQ ID NO: 8023043 - DNA, 21 bp, Homo sapiens
tgctggcaagactcaggaata

SEQ ID NO: 8023044 - DNA, 22 bp, Homo sapiens
tgctggcacatagagactggct

SEQ ID NO: 8023045 - DNA, 22 bp, Homo sapiens
tgctggcacatagagactggct

SEQ ID NO: 8023046 - DNA, 22 bp, Homo sapiens
tgctggagttcgacattgcaaa

SEQ ID NO: 8023047 - DNA, 22 bp, Homo sapiens
tgctggagttcgacattgcaaa

SEQ ID NO: 8023048 - DNA, 22 bp, Homo sapiens
tgctggagttcgacattgcaaa

SEQ ID NO: 8023049 - DNA, 22 bp, Homo sapiens
tgctggagttcgacattgcaaa

SEQ ID NO: 8023050 - DNA, 22 bp, Homo sapiens
tgctggagtggcactgtgtggc

SEQ ID NO: 8023051 - DNA, 22 bp, Homo sapiens
tgctggagtggcactgtgtggc

SEQ ID NO: 8023052 - DNA, 22 bp, Homo sapiens
tgctggagttcgacattgcaaa

SEQ ID NO: 8023053 - DNA, 22 bp, Homo sapiens
tgctggagtggcactgtgtggc

SEQ ID NO: 8023054 - DNA, 22 bp, Homo sapiens
tgctggagtgagtggtttctta

SEQ ID NO: 8023055 - DNA, 22 bp, Homo sapiens
tgctggagtgagattatgagtt

SEQ ID NO: 8023056 - DNA, 22 bp, Homo sapiens
tgctggagtgagattatgagtt

SEQ ID NO: 8023057 - DNA, 22 bp, Homo sapiens
tgctggagtgcagtggcttaac

SEQ ID NO: 8023058 - DNA, 22 bp, Homo sapiens
tgctggagtgagtggtttctta

SEQ ID NO: 8023059 - DNA, 22 bp, Homo sapiens
tgctggagtgagtggtttctta

SEQ ID NO: 8023060 - DNA, 22 bp, Homo sapiens
tgctggagtgcagtggcttaac

SEQ ID NO: 8023061 - DNA, 22 bp, Homo sapiens
tgctggagtggcactgtgtggc

SEQ ID NO: 8023062 - DNA, 22 bp, Homo sapiens
tgctggagtggcactgtgtggc

SEQ ID NO: 8023063 - DNA, 22 bp, Homo sapiens
tgctggcacgtggaccaggaga

SEQ ID NO: 8023064 - DNA, 22 bp, Homo sapiens
tgctggcagaaggctcgtggaa

SEQ ID NO: 8023065 - DNA, 22 bp, Homo sapiens
tgctggcagaaggctcgtggaa

SEQ ID NO: 8023066 - DNA, 22 bp, Homo sapiens
tgctggcagccatgccttggaa

SEQ ID NO: 8023067 - DNA, 22 bp, Homo sapiens
tgctggcacgtgactgggaagt

SEQ ID NO: 8023068 - DNA, 22 bp, Homo sapiens
tgctggcacgtgactgggaagt

SEQ ID NO: 8023069 - DNA, 22 bp, Homo sapiens
tgctggcacgtgactgggaagt

SEQ ID NO: 8023070 - DNA, 20 bp, Homo sapiens
tgctggcacgggtggactcc

SEQ ID NO: 8023071 - DNA, 22 bp, Homo sapiens
tgctggcacgtgactgggaagt

SEQ ID NO: 8023072 - DNA, 20 bp, Homo sapiens
tgctggcacgggtggactcc

SEQ ID NO: 8023073 - DNA, 20 bp, Homo sapiens
tgctggcacgggtggactcc

SEQ ID NO: 8023074 - DNA, 22 bp, Homo sapiens
tgctggcacgaaagggtgtcca

SEQ ID NO: 8023075 - DNA, 22 bp, Homo sapiens
tgctggcaccattttcggacat

SEQ ID NO: 8023076 - DNA, 22 bp, Homo sapiens
tgctggcacatagagactggct

SEQ ID NO: 8023077 - DNA, 22 bp, Homo sapiens
tgctggcacatagagactggct

SEQ ID NO: 8023078 - DNA, 22 bp, Homo sapiens
tgctggcacatagagactggct

SEQ ID NO: 8023079 - DNA, 22 bp, Homo sapiens
tgctggcaccagaatgactgca

SEQ ID NO: 8023080 - DNA, 20 bp, Homo sapiens
tgctggcatgcaagagggaa

SEQ ID NO: 8023081 - DNA, 22 bp, Homo sapiens
tgctggcatgcatgctgtagga

SEQ ID NO: 8023082 - DNA, 22 bp, Homo sapiens
tgctggcatcttaatgttctgt

SEQ ID NO: 8023083 - DNA, 22 bp, Homo sapiens
tgctggcatggtcttggtgaca

SEQ ID NO: 8023084 - DNA, 22 bp, Homo sapiens
tgctggcatggtcttggtgaca

SEQ ID NO: 8023085 - DNA, 22 bp, Homo sapiens
tgctggcagccatgccttggaa

SEQ ID NO: 8023086 - DNA, 22 bp, Homo sapiens
tgctggcaggcacctcctgggg

SEQ ID NO: 8023087 - DNA, 22 bp, Homo sapiens
tgctggcagtggcagtgatggt

SEQ ID NO: 8023088 - DNA, 22 bp, Homo sapiens
tgctggcagtggcagtgatggt

SEQ ID NO: 8023089 - DNA, 23 bp, Homo sapiens
tgctggctgtgttattgccaaca

SEQ ID NO: 8023090 - DNA, 23 bp, Homo sapiens
tgctggctgtgttattgccaaca

SEQ ID NO: 8023091 - DNA, 22 bp, Homo sapiens
tgctggctgtgtaccatctcaa

SEQ ID NO: 8023092 - DNA, 22 bp, Homo sapiens
tgctggctgttctagggaggcc

SEQ ID NO: 8023093 - DNA, 22 bp, Homo sapiens
tgctggctgttctagggaggcc

SEQ ID NO: 8023094 - DNA, 22 bp, Homo sapiens
tgctggctgttctagggaggcc

SEQ ID NO: 8023095 - DNA, 23 bp, Homo sapiens
tgctggctgtgttattgccaaca

SEQ ID NO: 8023096 - DNA, 23 bp, Homo sapiens
tgctggctgtgttattgccaaca

SEQ ID NO: 8023097 - DNA, 22 bp, Homo sapiens
tgctggctgtccctacctggct

SEQ ID NO: 8023098 - DNA, 22 bp, Homo sapiens
tgctggctgtccctacctggct

SEQ ID NO: 8023099 - DNA, 22 bp, Homo sapiens
tgctggctgtccctacctggct

SEQ ID NO: 8023100 - DNA, 22 bp, Homo sapiens
tgctggctgtgtaccatctcaa

SEQ ID NO: 8023101 - DNA, 22 bp, Homo sapiens
tgctggctgtgtaccatctcaa

SEQ ID NO: 8023102 - DNA, 22 bp, Homo sapiens
tgctggctgtgtaccatctcaa

SEQ ID NO: 8023103 - DNA, 22 bp, Homo sapiens
tgctggctgttctagggaggcc

SEQ ID NO: 8023104 - DNA, 22 bp, Homo sapiens
tgctggctgttctagggaggcc

SEQ ID NO: 8023105 - DNA, 22 bp, Homo sapiens
tgctggctgttctagggaggcc

SEQ ID NO: 8023106 - DNA, 22 bp, Homo sapiens
tgctggcttagatatcactgcc

SEQ ID NO: 8023107 - DNA, 22 bp, Homo sapiens
tgctggcttagatatcactgcc

SEQ ID NO: 8023108 - DNA, 22 bp, Homo sapiens
tgctggcttagatatcactgcc

SEQ ID NO: 8023109 - DNA, 22 bp, Homo sapiens
tgctggcttatttagtaaatgt

SEQ ID NO: 8023110 - DNA, 22 bp, Homo sapiens
tgctggcttatttagtaaatgt

SEQ ID NO: 8023111 - DNA, 23 bp, Homo sapiens
tgctggcttccagctgctccctc

SEQ ID NO: 8023112 - DNA, 22 bp, Homo sapiens
tgctggcttcctgtgcacagca

SEQ ID NO: 8023113 - DNA, 22 bp, Homo sapiens
tgctggcttatttagtaaatgt

SEQ ID NO: 8023114 - DNA, 23 bp, Homo sapiens
tgctggcttccagctgctccctc

SEQ ID NO: 8023115 - DNA, 22 bp, Homo sapiens
tgctggcttatttagtaaatgt

SEQ ID NO: 8023116 - DNA, 22 bp, Homo sapiens
tgctggctggatcagagattgg

SEQ ID NO: 8023117 - DNA, 22 bp, Homo sapiens
tgctggctggatcagagattgg

SEQ ID NO: 8023118 - DNA, 22 bp, Homo sapiens
tgctggctggatcagagattgg

SEQ ID NO: 8023119 - DNA, 22 bp, Homo sapiens
tgctggctggatcagagattgg

SEQ ID NO: 8023120 - DNA, 22 bp, Homo sapiens
tgctggctggagtgcctctgga

SEQ ID NO: 8023121 - DNA, 22 bp, Homo sapiens
tgctggctggagtgcctctgga

SEQ ID NO: 8023122 - DNA, 22 bp, Homo sapiens
tgctggctgccaggttccctgt

SEQ ID NO: 8023123 - DNA, 22 bp, Homo sapiens
tgctggctgccaggttccctgt

SEQ ID NO: 8023124 - DNA, 22 bp, Homo sapiens
tgctggctgcagtgctgtcaaa

SEQ ID NO: 8023125 - DNA, 22 bp, Homo sapiens
tgctggctgcagtgctgtcaaa

SEQ ID NO: 8023126 - DNA, 22 bp, Homo sapiens
tgctggctgcagtgctgtcaaa

SEQ ID NO: 8023127 - DNA, 22 bp, Homo sapiens
tgctggctgcagtgctgtcaaa

SEQ ID NO: 8023128 - DNA, 22 bp, Homo sapiens
tgctggctgcagtgctgtcaaa

SEQ ID NO: 8023129 - DNA, 22 bp, Homo sapiens
tgctggctgcagtgctgtcaaa

SEQ ID NO: 8023130 - DNA, 22 bp, Homo sapiens
tgctggctgggctgctggagac

SEQ ID NO: 8023131 - DNA, 22 bp, Homo sapiens
tgctggctggcctggcctggac

SEQ ID NO: 8023132 - DNA, 22 bp, Homo sapiens
tgctggctgggctgctggagac

SEQ ID NO: 8023133 - DNA, 22 bp, Homo sapiens
tgctggctggcctggcctggac

SEQ ID NO: 8023134 - DNA, 22 bp, Homo sapiens
tgctggctggcctggcctggac

SEQ ID NO: 8023135 - DNA, 22 bp, Homo sapiens
tgctggctggcctggcctggac

SEQ ID NO: 8023136 - DNA, 22 bp, Homo sapiens
tgctggctgggctgctggagac

SEQ ID NO: 8023137 - DNA, 22 bp, Homo sapiens
tgctggctgggctgctggagac

SEQ ID NO: 8023138 - DNA, 22 bp, Homo sapiens
tgctggctgtatatgtgagagt

SEQ ID NO: 8023139 - DNA, 22 bp, Homo sapiens
tgctggctgtatatgtgagagt

SEQ ID NO: 8023140 - DNA, 22 bp, Homo sapiens
tgctggctgtatatgtgagagt

SEQ ID NO: 8023141 - DNA, 22 bp, Homo sapiens
tgctggctgtatatgtgagagt

SEQ ID NO: 8023142 - DNA, 22 bp, Homo sapiens
tgctggctgtatatgtgagagt

SEQ ID NO: 8023143 - DNA, 22 bp, Homo sapiens
tgctggctatttaaagaagaaa

SEQ ID NO: 8023144 - DNA, 22 bp, Homo sapiens
tgctggctactgatggcaggcc

SEQ ID NO: 8023145 - DNA, 22 bp, Homo sapiens
tgctggctactgatggcaggcc

SEQ ID NO: 8023146 - DNA, 22 bp, Homo sapiens
tgctggctcagtttgcagactc

SEQ ID NO: 8023147 - DNA, 22 bp, Homo sapiens
tgctggctcagtttgcagactc

SEQ ID NO: 8023148 - DNA, 22 bp, Homo sapiens
tgctggctcagtttgcagactc

SEQ ID NO: 8023149 - DNA, 22 bp, Homo sapiens
tgctggctcagtttgcagactc

SEQ ID NO: 8023150 - DNA, 22 bp, Homo sapiens
tgctggctatttaaagaagaaa

SEQ ID NO: 8023151 - DNA, 22 bp, Homo sapiens
tgctggctccaacctggcatct

SEQ ID NO: 8023152 - DNA, 22 bp, Homo sapiens
tgctggctccaacctggcatct

SEQ ID NO: 8023153 - DNA, 22 bp, Homo sapiens
tgctggctcagtttgcagactc

SEQ ID NO: 8023154 - DNA, 22 bp, Homo sapiens
tgctggctccaacctggcatct

SEQ ID NO: 8023155 - DNA, 22 bp, Homo sapiens
tgctggctccaacctggcatct

SEQ ID NO: 8023156 - DNA, 22 bp, Homo sapiens
tgctggctcccaggagccgctg

SEQ ID NO: 8023157 - DNA, 22 bp, Homo sapiens
tgctggctccaacctggcatct

SEQ ID NO: 8023158 - DNA, 22 bp, Homo sapiens
tgctggctactgatggcaggcc

SEQ ID NO: 8023159 - DNA, 22 bp, Homo sapiens
tgctggctactgatggcaggcc

SEQ ID NO: 8023160 - DNA, 22 bp, Homo sapiens
tgctggctactgatggcaggcc

SEQ ID NO: 8023161 - DNA, 22 bp, Homo sapiens
tgctggccaagcagaggtcaat

SEQ ID NO: 8023162 - DNA, 22 bp, Homo sapiens
tgctggctactgatggcaggcc

SEQ ID NO: 8023163 - DNA, 22 bp, Homo sapiens
tgctggccaagcagaggtcaat

SEQ ID NO: 8023164 - DNA, 22 bp, Homo sapiens
tgctggccaagcagaggtcaat

SEQ ID NO: 8023165 - DNA, 22 bp, Homo sapiens
tgctggccaagcagaggtcaat

SEQ ID NO: 8023166 - DNA, 22 bp, Homo sapiens
tgctggcatttcaggactcacc

SEQ ID NO: 8023167 - DNA, 22 bp, Homo sapiens
tgctggcatttcaggactcacc

SEQ ID NO: 8023168 - DNA, 22 bp, Homo sapiens
tgctggccaacaaggctccaag

SEQ ID NO: 8023169 - DNA, 22 bp, Homo sapiens
tgctggccaacaaggctccaag

SEQ ID NO: 8023170 - DNA, 22 bp, Homo sapiens
tgctggccaacaaggctccaag

SEQ ID NO: 8023171 - DNA, 22 bp, Homo sapiens
tgctggccaacaaggctccaag

SEQ ID NO: 8023172 - DNA, 22 bp, Homo sapiens
tgctggcatttcaggactcacc

SEQ ID NO: 8023173 - DNA, 22 bp, Homo sapiens
tgctggcattgcataggcagtt

SEQ ID NO: 8023174 - DNA, 22 bp, Homo sapiens
tgctggcattgcataggcagtt

SEQ ID NO: 8023175 - DNA, 22 bp, Homo sapiens
tgctggcattgcataggcagtt

SEQ ID NO: 8023176 - DNA, 22 bp, Homo sapiens
tgctggctcctcgaggcttcgt

SEQ ID NO: 8023177 - DNA, 22 bp, Homo sapiens
tgctggctctaggctgagacag

SEQ ID NO: 8023178 - DNA, 22 bp, Homo sapiens
tgctggctcctcgaggcttcgt

SEQ ID NO: 8023179 - DNA, 22 bp, Homo sapiens
tgctggctcccaggagccgctg

SEQ ID NO: 8023180 - DNA, 22 bp, Homo sapiens
tgctggctcccaggagccgctg

SEQ ID NO: 8023181 - DNA, 22 bp, Homo sapiens
tgctggctcctcgaggcttcgt

SEQ ID NO: 8023182 - DNA, 22 bp, Homo sapiens
tgctggctcctcgaggcttcgt

SEQ ID NO: 8023183 - DNA, 22 bp, Homo sapiens
tgctggctctgggccaagcagg

SEQ ID NO: 8023184 - DNA, 22 bp, Homo sapiens
tgctggctctgggccaagcagg

SEQ ID NO: 8023185 - DNA, 22 bp, Homo sapiens
tgctggctctgggccaagcagg

SEQ ID NO: 8023186 - DNA, 22 bp, Homo sapiens
tgctggctctgggccaagcagg

SEQ ID NO: 8023187 - DNA, 22 bp, Homo sapiens
tgctggctctgggccaagcagg

SEQ ID NO: 8023188 - DNA, 22 bp, Homo sapiens
tgctggctctaggctgagacag

SEQ ID NO: 8023189 - DNA, 22 bp, Homo sapiens
tgctggctctaggctgagacag

SEQ ID NO: 8023190 - DNA, 22 bp, Homo sapiens
tgctggctctaggctgagacag

SEQ ID NO: 8023191 - DNA, 23 bp, Homo sapiens
tgctggctgaaacagccaaagga

SEQ ID NO: 8023192 - DNA, 23 bp, Homo sapiens
tgctggctgaaacagccaaagga

SEQ ID NO: 8023193 - DNA, 23 bp, Homo sapiens
tgctggctgaaacagccaaagga

SEQ ID NO: 8023194 - DNA, 23 bp, Homo sapiens
tgctggctgaaacagccaaagga

SEQ ID NO: 8023195 - DNA, 23 bp, Homo sapiens
tgctggctgaaacagccaaagga

SEQ ID NO: 8023196 - DNA, 21 bp, Homo sapiens
tgctggctgaaaggcacagag

SEQ ID NO: 8023197 - DNA, 21 bp, Homo sapiens
tgctggctgaaaggcacagag

SEQ ID NO: 8023198 - DNA, 21 bp, Homo sapiens
tgctggctgaaaggcacagag

SEQ ID NO: 8023199 - DNA, 21 bp, Homo sapiens
tgctggctgaaaggcacagag

SEQ ID NO: 8023200 - DNA, 21 bp, Homo sapiens
tgctggctgaaaggcacagag

SEQ ID NO: 8023201 - DNA, 21 bp, Homo sapiens
tgctggctgaaaggcacagag

SEQ ID NO: 8023202 - DNA, 22 bp, Homo sapiens
tgctggctgaggcctgagcggg

SEQ ID NO: 8023203 - DNA, 22 bp, Homo sapiens
tgctggctgaggcctgagcggg

SEQ ID NO: 8023204 - DNA, 22 bp, Homo sapiens
tgctggctgaggcctgagcggg

SEQ ID NO: 8023205 - DNA, 22 bp, Homo sapiens
tgctggctgaggcctgagcggg

SEQ ID NO: 8023206 - DNA, 21 bp, Homo sapiens
tgctggctgaaaggcacagag

SEQ ID NO: 8023207 - DNA, 21 bp, Homo sapiens
tgctggctgaaaggcacagag

SEQ ID NO: 8023208 - DNA, 21 bp, Homo sapiens
tgctggctgaaaggcacagag

SEQ ID NO: 8023209 - DNA, 22 bp, Homo sapiens
tgctgccacatttaaagagggg

SEQ ID NO: 8023210 - DNA, 22 bp, Homo sapiens
tgctgccacaaattcagctgcc

SEQ ID NO: 8023211 - DNA, 22 bp, Homo sapiens
tgctgccacccctcaccagagc

SEQ ID NO: 8023212 - DNA, 22 bp, Homo sapiens
tgctgccacctggtggctgaag

SEQ ID NO: 8023213 - DNA, 22 bp, Homo sapiens
tgctgccacctggtggctgaag

SEQ ID NO: 8023214 - DNA, 22 bp, Homo sapiens
tgctgccacaaattcagctgcc

SEQ ID NO: 8023215 - DNA, 22 bp, Homo sapiens
tgctgccacaaattcagctgcc

SEQ ID NO: 8023216 - DNA, 22 bp, Homo sapiens
tgctgccacaaattcagctgcc

SEQ ID NO: 8023217 - DNA, 22 bp, Homo sapiens
tgctgccaatttctggtcttga

SEQ ID NO: 8023218 - DNA, 22 bp, Homo sapiens
tgctgccaatttctggtcttga

SEQ ID NO: 8023219 - DNA, 23 bp, Homo sapiens
tgctgccaagcacgagttgagtt

SEQ ID NO: 8023220 - DNA, 23 bp, Homo sapiens
tgctgccaagcacgagttgagtt

SEQ ID NO: 8023221 - DNA, 22 bp, Homo sapiens
tgctgccaaatgcgagctctgt

SEQ ID NO: 8023222 - DNA, 17 bp, Homo sapiens
tgctgccaagtcccaac

SEQ ID NO: 8023223 - DNA, 17 bp, Homo sapiens
tgctgccaagtcccaac

SEQ ID NO: 8023224 - DNA, 22 bp, Homo sapiens
tgctgccaagcccgtgctcctg

SEQ ID NO: 8023225 - DNA, 22 bp, Homo sapiens
tgctgccaagcccgtgctcctg

SEQ ID NO: 8023226 - DNA, 20 bp, Homo sapiens
tgctgcagtttcatgggact

SEQ ID NO: 8023227 - DNA, 20 bp, Homo sapiens
tgctgcagtttcatgggact

SEQ ID NO: 8023228 - DNA, 22 bp, Homo sapiens
tgctgcatagcagctcctgaaa

SEQ ID NO: 8023229 - DNA, 22 bp, Homo sapiens
tgctgcattcaggagcacagtt

SEQ ID NO: 8023230 - DNA, 22 bp, Homo sapiens
tgctgccaaatgcgagctctgt

SEQ ID NO: 8023231 - DNA, 22 bp, Homo sapiens
tgctgccacctgtggtagtctg

SEQ ID NO: 8023232 - DNA, 22 bp, Homo sapiens
tgctgccactggtagtctcatt

SEQ ID NO: 8023233 - DNA, 22 bp, Homo sapiens
tgctgccacctgtggtagtctg

SEQ ID NO: 8023234 - DNA, 22 bp, Homo sapiens
tgctgccacctgtggtagtctg

SEQ ID NO: 8023235 - DNA, 22 bp, Homo sapiens
tgctgccagccaggccatggag

SEQ ID NO: 8023236 - DNA, 22 bp, Homo sapiens
tgctgccagccaggccatggag

SEQ ID NO: 8023237 - DNA, 22 bp, Homo sapiens
tgctgccagccaggccatggag

SEQ ID NO: 8023238 - DNA, 22 bp, Homo sapiens
tgctgccagccaggccatggag

SEQ ID NO: 8023239 - DNA, 22 bp, Homo sapiens
tgctgccaggtcttgctgtcca

SEQ ID NO: 8023240 - DNA, 22 bp, Homo sapiens
tgctgccaggtcttgctgtcca

SEQ ID NO: 8023241 - DNA, 22 bp, Homo sapiens
tgctgccaggtcttgctgtcca

SEQ ID NO: 8023242 - DNA, 22 bp, Homo sapiens
tgctgccagggctctgcccaca

SEQ ID NO: 8023243 - DNA, 22 bp, Homo sapiens
tgctgccagggctctgcccaca

SEQ ID NO: 8023244 - DNA, 22 bp, Homo sapiens
tgctgccagggctctgcccaca

SEQ ID NO: 8023245 - DNA, 21 bp, Homo sapiens
tgctgccatagacctgaggga

SEQ ID NO: 8023246 - DNA, 22 bp, Homo sapiens
tgctgccatctcaactgccctt

SEQ ID NO: 8023247 - DNA, 21 bp, Homo sapiens
tgctgccatagacctgaggga

SEQ ID NO: 8023248 - DNA, 21 bp, Homo sapiens
tgctgccatagacctgaggga

SEQ ID NO: 8023249 - DNA, 21 bp, Homo sapiens
tgctgccatcatgcagagatg

SEQ ID NO: 8023250 - DNA, 22 bp, Homo sapiens
tgctgcctcagcttcctgggct

SEQ ID NO: 8023251 - DNA, 22 bp, Homo sapiens
tgctgcctccaactcctgggct

SEQ ID NO: 8023252 - DNA, 22 bp, Homo sapiens
tgctgcctcaactgtcaggaac

SEQ ID NO: 8023253 - DNA, 22 bp, Homo sapiens
tgctgcctcagcttcctgggct

SEQ ID NO: 8023254 - DNA, 22 bp, Homo sapiens
tgctgcctcagcttcctgggct

SEQ ID NO: 8023255 - DNA, 22 bp, Homo sapiens
tgctgcctccttcctgccagga

SEQ ID NO: 8023256 - DNA, 22 bp, Homo sapiens
tgctgcctccttcctgccagga

SEQ ID NO: 8023257 - DNA, 22 bp, Homo sapiens
tgctgcctccaactcctgggct

SEQ ID NO: 8023258 - DNA, 22 bp, Homo sapiens
tgctgcctccaactcctgggct

SEQ ID NO: 8023259 - DNA, 22 bp, Homo sapiens
tgctgcctccttcctgccagga

SEQ ID NO: 8023260 - DNA, 22 bp, Homo sapiens
tgctgcctccttcctgccagga

SEQ ID NO: 8023261 - DNA, 22 bp, Homo sapiens
tgctgcctccttcctgccagga

SEQ ID NO: 8023262 - DNA, 22 bp, Homo sapiens
tgctgcctaataagtcgagggt

SEQ ID NO: 8023263 - DNA, 22 bp, Homo sapiens
tgctgcctaataagtcgagggt

SEQ ID NO: 8023264 - DNA, 22 bp, Homo sapiens
tgctgcctaacagaactctttc

SEQ ID NO: 8023265 - DNA, 23 bp, Homo sapiens
tgctgccctgccttcagctctcc

SEQ ID NO: 8023266 - DNA, 22 bp, Homo sapiens
tgctgcctaataagtcgagggt

SEQ ID NO: 8023267 - DNA, 22 bp, Homo sapiens
tgctgcctaacagaactctttc

SEQ ID NO: 8023268 - DNA, 22 bp, Homo sapiens
tgctgcctcaactgtcaggaac

SEQ ID NO: 8023269 - DNA, 22 bp, Homo sapiens
tgctgcctcaactgtcaggaac

SEQ ID NO: 8023270 - DNA, 20 bp, Homo sapiens
tgctgcctactaagccctca

SEQ ID NO: 8023271 - DNA, 22 bp, Homo sapiens
tgctgcctaggaatctgtattt

SEQ ID NO: 8023272 - DNA, 22 bp, Homo sapiens
tgctgcctaggaatctgtattt

SEQ ID NO: 8023273 - DNA, 22 bp, Homo sapiens
tgctgcccactgtatttctcca

SEQ ID NO: 8023274 - DNA, 23 bp, Homo sapiens
tgctgcccactcttccagccctc

SEQ ID NO: 8023275 - DNA, 23 bp, Homo sapiens
tgctgcccactcttccagccctc

SEQ ID NO: 8023276 - DNA, 23 bp, Homo sapiens
tgctgcccgcttggcacgctccc

SEQ ID NO: 8023277 - DNA, 22 bp, Homo sapiens
tgctgcccactgtatttctcca

SEQ ID NO: 8023278 - DNA, 22 bp, Homo sapiens
tgctgcccgtacctgtgcactt

SEQ ID NO: 8023279 - DNA, 22 bp, Homo sapiens
tgctgcccgtacctgtgcactt

SEQ ID NO: 8023280 - DNA, 22 bp, Homo sapiens
tgctgcccgtacctgtgcactt

SEQ ID NO: 8023281 - DNA, 23 bp, Homo sapiens
tgctgccctgccttcagctctcc

SEQ ID NO: 8023282 - DNA, 23 bp, Homo sapiens
tgctgccctgccttcagctctcc

SEQ ID NO: 8023283 - DNA, 18 bp, Homo sapiens
tgctgcccaactctcccc

SEQ ID NO: 8023284 - DNA, 22 bp, Homo sapiens
tgctgccatgcagagcaacaga

SEQ ID NO: 8023285 - DNA, 23 bp, Homo sapiens
tgctgcccactcttccagccctc

SEQ ID NO: 8023286 - DNA, 22 bp, Homo sapiens
tgctgccatggtcgctggtgtc

SEQ ID NO: 8023287 - DNA, 22 bp, Homo sapiens
tgctgccatctcaactgccctt

SEQ ID NO: 8023288 - DNA, 22 bp, Homo sapiens
tgctgctgacatttggggcttg

SEQ ID NO: 8023289 - DNA, 22 bp, Homo sapiens
tgctgctgacatttggggcttg

SEQ ID NO: 8023290 - DNA, 22 bp, Homo sapiens
tgctgctgacatttggggcttg

SEQ ID NO: 8023291 - DNA, 22 bp, Homo sapiens
tgctgctgaaaaggtgtgctta

SEQ ID NO: 8023292 - DNA, 22 bp, Homo sapiens
tgctgctgaggctaaagtatag

SEQ ID NO: 8023293 - DNA, 22 bp, Homo sapiens
tgctgctgatcatttatagtct

SEQ ID NO: 8023294 - DNA, 22 bp, Homo sapiens
tgctgctgacatttggggcttg

SEQ ID NO: 8023295 - DNA, 21 bp, Homo sapiens
tgctgctgatcggggttggct

SEQ ID NO: 8023296 - DNA, 22 bp, Homo sapiens
tgctgctgatcatttatagtct

SEQ ID NO: 8023297 - DNA, 21 bp, Homo sapiens
tgctgctgatcggggttggct

SEQ ID NO: 8023298 - DNA, 21 bp, Homo sapiens
tgctgctgatcggggttggct

SEQ ID NO: 8023299 - DNA, 21 bp, Homo sapiens
tgctgctgatcggggttggct

SEQ ID NO: 8023300 - DNA, 22 bp, Homo sapiens
tgctgctgatgcatagtctgct

SEQ ID NO: 8023301 - DNA, 22 bp, Homo sapiens
tgctgctgatgcatagtctgct

SEQ ID NO: 8023302 - DNA, 22 bp, Homo sapiens
tgctgctcgccacggcccaggg

SEQ ID NO: 8023303 - DNA, 22 bp, Homo sapiens
tgctgctcgccacggcccaggg

SEQ ID NO: 8023304 - DNA, 22 bp, Homo sapiens
tgctgctctgtaaagtgatgag

SEQ ID NO: 8023305 - DNA, 22 bp, Homo sapiens
tgctgctcttcaccatggcctc

SEQ ID NO: 8023306 - DNA, 22 bp, Homo sapiens
tgctgctgaaaaggtgtgctta

SEQ ID NO: 8023307 - DNA, 22 bp, Homo sapiens
tgctgctgaaaaggtgtgctta

SEQ ID NO: 8023308 - DNA, 22 bp, Homo sapiens
tgctgctccccagcacacagca

SEQ ID NO: 8023309 - DNA, 22 bp, Homo sapiens
tgctgctcctgcctggctccca

SEQ ID NO: 8023310 - DNA, 22 bp, Homo sapiens
tgctgctcgccacggcccaggg

SEQ ID NO: 8023311 - DNA, 22 bp, Homo sapiens
tgctgctcctgcctggctccca

SEQ ID NO: 8023312 - DNA, 22 bp, Homo sapiens
tgctgctcctgcctggctccca

SEQ ID NO: 8023313 - DNA, 22 bp, Homo sapiens
tgctgcctccttcctgccagga

SEQ ID NO: 8023314 - DNA, 22 bp, Homo sapiens
tgctgcctctgctgatatggcc

SEQ ID NO: 8023315 - DNA, 22 bp, Homo sapiens
tgctgcctctgctgatatggcc

SEQ ID NO: 8023316 - DNA, 20 bp, Homo sapiens
tgctggaaattgttctagga

SEQ ID NO: 8023317 - DNA, 22 bp, Homo sapiens
tgctggaactcagtgaatcatt

SEQ ID NO: 8023318 - DNA, 22 bp, Homo sapiens
tgctggaactcagtgaatcatt

SEQ ID NO: 8023319 - DNA, 22 bp, Homo sapiens
tgctggaagaattccatgctgg

SEQ ID NO: 8023320 - DNA, 22 bp, Homo sapiens
tgctggaacttagcatgctctc

SEQ ID NO: 8023321 - DNA, 22 bp, Homo sapiens
tgctggaaagttaaattttgga

SEQ ID NO: 8023322 - DNA, 22 bp, Homo sapiens
tgctggaaaaatcatttgcttt

SEQ ID NO: 8023323 - DNA, 22 bp, Homo sapiens
tgctggaatttttctaggattt

SEQ ID NO: 8023324 - DNA, 22 bp, Homo sapiens
tgctggaatttttctaggattt

SEQ ID NO: 8023325 - DNA, 22 bp, Homo sapiens
tgctggaatttttctaggattt

SEQ ID NO: 8023326 - DNA, 22 bp, Homo sapiens
tgctggacagggcacggcccat

SEQ ID NO: 8023327 - DNA, 22 bp, Homo sapiens
tgctggagaaagtttttctgaa

SEQ ID NO: 8023328 - DNA, 22 bp, Homo sapiens
tgctggaattgacctagaagga

SEQ ID NO: 8023329 - DNA, 22 bp, Homo sapiens
tgctggaattgacctagaagga

SEQ ID NO: 8023330 - DNA, 22 bp, Homo sapiens
tgctggaattgacctagaagga

SEQ ID NO: 8023331 - DNA, 22 bp, Homo sapiens
tgctggaataatttcatgttaa

SEQ ID NO: 8023332 - DNA, 23 bp, Homo sapiens
tgctggaaggtccaatttgctca

SEQ ID NO: 8023333 - DNA, 22 bp, Homo sapiens
tgctggaagagattggagcctc

SEQ ID NO: 8023334 - DNA, 22 bp, Homo sapiens
tgctggaagctcctgcatgtct

SEQ ID NO: 8023335 - DNA, 22 bp, Homo sapiens
tgctggaggagaaggttgctca

SEQ ID NO: 8023336 - DNA, 22 bp, Homo sapiens
tgctggaggagaaggttgctca

SEQ ID NO: 8023337 - DNA, 22 bp, Homo sapiens
tgctggaggagaaggttgctca

SEQ ID NO: 8023338 - DNA, 22 bp, Homo sapiens
tgctggaggagaaggttgctca

SEQ ID NO: 8023339 - DNA, 21 bp, Homo sapiens
tgctggaggacagggtttcat

SEQ ID NO: 8023340 - DNA, 21 bp, Homo sapiens
tgctggaggacagggtttcat

SEQ ID NO: 8023341 - DNA, 21 bp, Homo sapiens
tgctggaggacagggtttcat

SEQ ID NO: 8023342 - DNA, 22 bp, Homo sapiens
tgctggagctccgggctgtagg

SEQ ID NO: 8023343 - DNA, 21 bp, Homo sapiens
tgctggaggacagggtttcat

SEQ ID NO: 8023344 - DNA, 22 bp, Homo sapiens
tgctggagctccgggctgtagg

SEQ ID NO: 8023345 - DNA, 22 bp, Homo sapiens
tgctggagctccgggctgtagg

SEQ ID NO: 8023346 - DNA, 22 bp, Homo sapiens
tgctggagcggaggtgagccag

SEQ ID NO: 8023347 - DNA, 22 bp, Homo sapiens
tgctggagcggaggtgagccag

SEQ ID NO: 8023348 - DNA, 22 bp, Homo sapiens
tgctggagcggaggtgagccag

SEQ ID NO: 8023349 - DNA, 22 bp, Homo sapiens
tgctggagctccgggctgtagg

SEQ ID NO: 8023350 - DNA, 22 bp, Homo sapiens
tgctggagcggaggtgagccag

SEQ ID NO: 8023351 - DNA, 23 bp, Homo sapiens
tgctggagacaagtgtgagaagg

SEQ ID NO: 8023352 - DNA, 23 bp, Homo sapiens
tgctggagacaagtgtgagaagg

SEQ ID NO: 8023353 - DNA, 22 bp, Homo sapiens
tgctggagcggaggtgagccag

SEQ ID NO: 8023354 - DNA, 23 bp, Homo sapiens
tgctggagacaagtgtgagaagg

SEQ ID NO: 8023355 - DNA, 23 bp, Homo sapiens
tgctggagaagcaaagttctgag

SEQ ID NO: 8023356 - DNA, 22 bp, Homo sapiens
tgctggagaactgctctgtgtt

SEQ ID NO: 8023357 - DNA, 22 bp, Homo sapiens
tgctggagaactgctctgtgtt

SEQ ID NO: 8023358 - DNA, 22 bp, Homo sapiens
tgctggagaactgctctgtgtt

SEQ ID NO: 8023359 - DNA, 22 bp, Homo sapiens
tgctggagaactgctctgtgtt

SEQ ID NO: 8023360 - DNA, 22 bp, Homo sapiens
tgctggagaactgctctgtgtt

SEQ ID NO: 8023361 - DNA, 22 bp, Homo sapiens
tgctggagaactgctctgtgtt

SEQ ID NO: 8023362 - DNA, 22 bp, Homo sapiens
tgctggagaactgctctgtgtt

SEQ ID NO: 8023363 - DNA, 22 bp, Homo sapiens
tgctggagaaagtttttctgaa

SEQ ID NO: 8023364 - DNA, 23 bp, Homo sapiens
tgctggagaagcaaagttctgag

SEQ ID NO: 8023365 - DNA, 23 bp, Homo sapiens
tgctggagaagcaaagttctgag

SEQ ID NO: 8023366 - DNA, 22 bp, Homo sapiens
tgctggagaagctcctgggact

SEQ ID NO: 8023367 - DNA, 22 bp, Homo sapiens
tgctggagaagctcctgggact

SEQ ID NO: 8023368 - DNA, 22 bp, Homo sapiens
tgctggagaagctcctgggact

SEQ ID NO: 8023369 - DNA, 22 bp, Homo sapiens
tgctggagaagctcctgggact

SEQ ID NO: 8023370 - DNA, 22 bp, Homo sapiens
tgctggagaagctcctgggact

SEQ ID NO: 8023371 - DNA, 22 bp, Homo sapiens
tgctgcttttagttggatagaa

SEQ ID NO: 8023372 - DNA, 22 bp, Homo sapiens
tgctgcttttgtatatcagaga

SEQ ID NO: 8023373 - DNA, 22 bp, Homo sapiens
tgctgcttttgtatatcagaga

SEQ ID NO: 8023374 - DNA, 20 bp, Homo sapiens
tgctgctttgccactagttg

SEQ ID NO: 8023375 - DNA, 22 bp, Homo sapiens
tgctgctttggaactccacagg

SEQ ID NO: 8023376 - DNA, 22 bp, Homo sapiens
tgctgcttggaaatggggctga

SEQ ID NO: 8023377 - DNA, 22 bp, Homo sapiens
tgctgcttggcaccctcagagt

SEQ ID NO: 8023378 - DNA, 22 bp, Homo sapiens
tgctgcttgttttgtaaataaa

SEQ ID NO: 8023379 - DNA, 22 bp, Homo sapiens
tgctgctttaaaaagtgctgat

SEQ ID NO: 8023380 - DNA, 22 bp, Homo sapiens
tgctgctttaaaaagtgctgat

SEQ ID NO: 8023381 - DNA, 22 bp, Homo sapiens
tgctgctttgatgtgtaaatca

SEQ ID NO: 8023382 - DNA, 20 bp, Homo sapiens
tgctgctgtgagcgtccctg

SEQ ID NO: 8023383 - DNA, 20 bp, Homo sapiens
tgctgctgtgagcgtccctg

SEQ ID NO: 8023384 - DNA, 22 bp, Homo sapiens
tgctgctgttgacggctgtcca

SEQ ID NO: 8023385 - DNA, 22 bp, Homo sapiens
tgctgctgttgacggctgtcca

SEQ ID NO: 8023386 - DNA, 22 bp, Homo sapiens
tgctgctgttgacggctgtcca

SEQ ID NO: 8023387 - DNA, 22 bp, Homo sapiens
tgctgcttgcatccaccctggg

SEQ ID NO: 8023388 - DNA, 22 bp, Homo sapiens
tgctgcttcacctgttgtacag

SEQ ID NO: 8023389 - DNA, 19 bp, Homo sapiens
tgctgcttccagctcactc

SEQ ID NO: 8023390 - DNA, 19 bp, Homo sapiens
tgctgcttccagctcactc

SEQ ID NO: 8023391 - DNA, 22 bp, Homo sapiens
tgctgctgtttcctacatctca

SEQ ID NO: 8023392 - DNA, 19 bp, Homo sapiens
tgctgctgtccttgcaggg

SEQ ID NO: 8023393 - DNA, 19 bp, Homo sapiens
tgctgctgtccttgcaggg

SEQ ID NO: 8023394 - DNA, 19 bp, Homo sapiens
tgctgctgtccttgcaggg

SEQ ID NO: 8023395 - DNA, 22 bp, Homo sapiens
tgctgctgtatccttagtgtca

SEQ ID NO: 8023396 - DNA, 22 bp, Homo sapiens
tgctgctgtatccttagtgtca

SEQ ID NO: 8023397 - DNA, 19 bp, Homo sapiens
tgctgctgtccttgcaggg

SEQ ID NO: 8023398 - DNA, 19 bp, Homo sapiens
tgctgctgtccttgcaggg

SEQ ID NO: 8023399 - DNA, 19 bp, Homo sapiens
tgctgctgtccttgcaggg

SEQ ID NO: 8023400 - DNA, 22 bp, Homo sapiens
tgctgctgtatccttagtgtca

SEQ ID NO: 8023401 - DNA, 22 bp, Homo sapiens
tgctgctgtatcatgccttcat

SEQ ID NO: 8023402 - DNA, 22 bp, Homo sapiens
tgctgctgtatcatgccttcat

SEQ ID NO: 8023403 - DNA, 22 bp, Homo sapiens
tgctgctgtatcatgccttcat

SEQ ID NO: 8023404 - DNA, 22 bp, Homo sapiens
tgctgctgggtttgacagtcac

SEQ ID NO: 8023405 - DNA, 22 bp, Homo sapiens
tgctgctgggtttgacagtcac

SEQ ID NO: 8023406 - DNA, 22 bp, Homo sapiens
tgctgctgggtttgacagtcac

SEQ ID NO: 8023407 - DNA, 22 bp, Homo sapiens
tgctgctgggtttgacagtcac

SEQ ID NO: 8023408 - DNA, 22 bp, Homo sapiens
tgctgctggatcttactcatct

SEQ ID NO: 8023409 - DNA, 22 bp, Homo sapiens
tgctgctggatcttactcatct

SEQ ID NO: 8023410 - DNA, 22 bp, Homo sapiens
tgctgctgcttctgtacagcct

SEQ ID NO: 8023411 - DNA, 22 bp, Homo sapiens
tgctgctgcttctgtacagcct

SEQ ID NO: 8023412 - DNA, 20 bp, Homo sapiens
tgctgctgcttcacccccat

SEQ ID NO: 8023413 - DNA, 22 bp, Homo sapiens
tgctgctgatggcacctaggca

SEQ ID NO: 8023414 - DNA, 20 bp, Homo sapiens
tgctgctgcctccgcctctg

SEQ ID NO: 8023415 - DNA, 20 bp, Homo sapiens
tgctgctgcctccgcctctg

SEQ ID NO: 8023416 - DNA, 22 bp, Homo sapiens
tgctgctgatggatgcctggac

SEQ ID NO: 8023417 - DNA, 22 bp, Homo sapiens
tgctgctgatggatgcctggac

SEQ ID NO: 8023418 - DNA, 22 bp, Homo sapiens
tgctgctgatggatgcctggac

SEQ ID NO: 8023419 - DNA, 22 bp, Homo sapiens
tgctgctgatggcacctaggca

SEQ ID NO: 8023420 - DNA, 22 bp, Homo sapiens
tgctgggtcagtgagagcaggg

SEQ ID NO: 8023421 - DNA, 22 bp, Homo sapiens
tgctgggtcccttgagagctca

SEQ ID NO: 8023422 - DNA, 18 bp, Homo sapiens
tgctgggtaactgtatgg

SEQ ID NO: 8023423 - DNA, 22 bp, Homo sapiens
tgctgggtagaagtattagtct

SEQ ID NO: 8023424 - DNA, 22 bp, Homo sapiens
tgctggggtctctccggtgccc

SEQ ID NO: 8023425 - DNA, 22 bp, Homo sapiens
tgctggggtctctccggtgccc

SEQ ID NO: 8023426 - DNA, 22 bp, Homo sapiens
tgctggggtctctccggtgccc

SEQ ID NO: 8023427 - DNA, 22 bp, Homo sapiens
tgctggggtctctccggtgccc

SEQ ID NO: 8023428 - DNA, 22 bp, Homo sapiens
tgctggggtctctccggtgccc

SEQ ID NO: 8023429 - DNA, 23 bp, Homo sapiens
tgctggggtagtttgtggcacag

SEQ ID NO: 8023430 - DNA, 23 bp, Homo sapiens
tgctggggtagtttgtggcacag

SEQ ID NO: 8023431 - DNA, 23 bp, Homo sapiens
tgctggggtagtttgtggcacag

SEQ ID NO: 8023432 - DNA, 23 bp, Homo sapiens
tgctggggtagtttgtggcacag

SEQ ID NO: 8023433 - DNA, 22 bp, Homo sapiens
tgctggggtcatggggcgcccg

SEQ ID NO: 8023434 - DNA, 22 bp, Homo sapiens
tgctggggtcatggggcgcccg

SEQ ID NO: 8023435 - DNA, 22 bp, Homo sapiens
tgctggggtcatggggcgcccg

SEQ ID NO: 8023436 - DNA, 22 bp, Homo sapiens
tgctggggtcatggggcgcccg

SEQ ID NO: 8023437 - DNA, 22 bp, Homo sapiens
tgctggggtcatggggcgcccg

SEQ ID NO: 8023438 - DNA, 20 bp, Homo sapiens
tgctggggacatacagggtg

SEQ ID NO: 8023439 - DNA, 20 bp, Homo sapiens
tgctggggacatacagggtg

SEQ ID NO: 8023440 - DNA, 20 bp, Homo sapiens
tgctggggacatacagggtg

SEQ ID NO: 8023441 - DNA, 22 bp, Homo sapiens
tgctgggcttgaaagctgctaa

SEQ ID NO: 8023442 - DNA, 20 bp, Homo sapiens
tgctggggacatacagggtg

SEQ ID NO: 8023443 - DNA, 22 bp, Homo sapiens
tgctggggagtgattgaccatc

SEQ ID NO: 8023444 - DNA, 22 bp, Homo sapiens
tgctggggatccgtaccaaccc

SEQ ID NO: 8023445 - DNA, 22 bp, Homo sapiens
tgctggggagtgattgaccatc

SEQ ID NO: 8023446 - DNA, 20 bp, Homo sapiens
tgctggggacatacagggtg

SEQ ID NO: 8023447 - DNA, 20 bp, Homo sapiens
tgctggggacatacagggtg

SEQ ID NO: 8023448 - DNA, 22 bp, Homo sapiens
tgctggggagtgattgaccatc

SEQ ID NO: 8023449 - DNA, 22 bp, Homo sapiens
tgctggggatccgtaccaaccc

SEQ ID NO: 8023450 - DNA, 22 bp, Homo sapiens
tgctggggatccgtaccaaccc

SEQ ID NO: 8023451 - DNA, 22 bp, Homo sapiens
tgctggggcagaagagccaaga

SEQ ID NO: 8023452 - DNA, 22 bp, Homo sapiens
tgctggggcagaagagccaaga

SEQ ID NO: 8023453 - DNA, 16 bp, Homo sapiens
tgctggggcgccgtcc

SEQ ID NO: 8023454 - DNA, 16 bp, Homo sapiens
tgctggggcgccgtcc

SEQ ID NO: 8023455 - DNA, 22 bp, Homo sapiens
tgctggggcagaagagccaaga

SEQ ID NO: 8023456 - DNA, 22 bp, Homo sapiens
tgctggggcagaagagccaaga

SEQ ID NO: 8023457 - DNA, 22 bp, Homo sapiens
tgctggggcagaagagccaaga

SEQ ID NO: 8023458 - DNA, 22 bp, Homo sapiens
tgctggggcagaagagccaaga

SEQ ID NO: 8023459 - DNA, 22 bp, Homo sapiens
tgctggggcagaagagccaaga

SEQ ID NO: 8023460 - DNA, 22 bp, Homo sapiens
tgctgtattacttttacaaact

SEQ ID NO: 8023461 - DNA, 22 bp, Homo sapiens
tgctgtattacttttacaaact

SEQ ID NO: 8023462 - DNA, 22 bp, Homo sapiens
tgctgtatatattttgaagtga

SEQ ID NO: 8023463 - DNA, 22 bp, Homo sapiens
tgctgtatatattttgaagtga

SEQ ID NO: 8023464 - DNA, 22 bp, Homo sapiens
tgctgtcaagaaaacaagcaat

SEQ ID NO: 8023465 - DNA, 22 bp, Homo sapiens
tgctgtcaagaaaacaagcaat

SEQ ID NO: 8023466 - DNA, 22 bp, Homo sapiens
tgctgtcaaggttacatgcttt

SEQ ID NO: 8023467 - DNA, 22 bp, Homo sapiens
tgctgtcaagaaaacaagcaat

SEQ ID NO: 8023468 - DNA, 22 bp, Homo sapiens
tgctgtcagttggcaggatgag

SEQ ID NO: 8023469 - DNA, 23 bp, Homo sapiens
tgctgtccaacagactggccatg

SEQ ID NO: 8023470 - DNA, 23 bp, Homo sapiens
tgctgtccaacagactggccatg

SEQ ID NO: 8023471 - DNA, 22 bp, Homo sapiens
tgctgtcagacagcagtggtaa

SEQ ID NO: 8023472 - DNA, 23 bp, Homo sapiens
tgctgtccaacagactggccatg

SEQ ID NO: 8023473 - DNA, 23 bp, Homo sapiens
tgctggtgtttttgggaccaggg

SEQ ID NO: 8023474 - DNA, 23 bp, Homo sapiens
tgctggtgtttttgggaccaggg

SEQ ID NO: 8023475 - DNA, 22 bp, Homo sapiens
tgctggtggagaaagtggaggt

SEQ ID NO: 8023476 - DNA, 23 bp, Homo sapiens
tgctggtgtttttgggaccaggg

SEQ ID NO: 8023477 - DNA, 23 bp, Homo sapiens
tgctggtgtttttgggaccaggg

SEQ ID NO: 8023478 - DNA, 20 bp, Homo sapiens
tgctggttacaccaccaagg

SEQ ID NO: 8023479 - DNA, 22 bp, Homo sapiens
tgctggttcttaagatgcctcc

SEQ ID NO: 8023480 - DNA, 22 bp, Homo sapiens
tgctgtagccctgcacagtgca

SEQ ID NO: 8023481 - DNA, 17 bp, Homo sapiens
tgctgtagctctaaagc

SEQ ID NO: 8023482 - DNA, 22 bp, Homo sapiens
tgctgtagtcaaagcaaagctg

SEQ ID NO: 8023483 - DNA, 17 bp, Homo sapiens
tgctgtagctctaaagc

SEQ ID NO: 8023484 - DNA, 21 bp, Homo sapiens
tgctgggtttgcccatcaggc

SEQ ID NO: 8023485 - DNA, 22 bp, Homo sapiens
tgctgggttacctaagcctaaa

SEQ ID NO: 8023486 - DNA, 22 bp, Homo sapiens
tgctggtaccgcgcctccgcca

SEQ ID NO: 8023487 - DNA, 22 bp, Homo sapiens
tgctggtccatgaggccagatc

SEQ ID NO: 8023488 - DNA, 22 bp, Homo sapiens
tgctggtccatgaggccagatc

SEQ ID NO: 8023489 - DNA, 21 bp, Homo sapiens
tgctggtcacaggtggcccca

SEQ ID NO: 8023490 - DNA, 22 bp, Homo sapiens
tgctggtcccctgcagcctgtg

SEQ ID NO: 8023491 - DNA, 22 bp, Homo sapiens
tgctggtcccctgcagcctgtg

SEQ ID NO: 8023492 - DNA, 22 bp, Homo sapiens
tgctggtccatgaggccagatc

SEQ ID NO: 8023493 - DNA, 22 bp, Homo sapiens
tgctggtcccctgcagcctgtg

SEQ ID NO: 8023494 - DNA, 22 bp, Homo sapiens
tgctgggtggttgctcctcccg

SEQ ID NO: 8023495 - DNA, 22 bp, Homo sapiens
tgctgggtggttgctcctcccg

SEQ ID NO: 8023496 - DNA, 22 bp, Homo sapiens
tgctgggtggttgctcctcccg

SEQ ID NO: 8023497 - DNA, 22 bp, Homo sapiens
tgctgggtcccttgagagctca

SEQ ID NO: 8023498 - DNA, 21 bp, Homo sapiens
tgctggtgagctcatgtggct

SEQ ID NO: 8023499 - DNA, 21 bp, Homo sapiens
tgctggtgagctcatgtggct

SEQ ID NO: 8023500 - DNA, 21 bp, Homo sapiens
tgctggtgagctcatgtggct

SEQ ID NO: 8023501 - DNA, 22 bp, Homo sapiens
tgctggtgaggtccttgctgga

SEQ ID NO: 8023502 - DNA, 22 bp, Homo sapiens
tgctggtgaggtccttgctgga

SEQ ID NO: 8023503 - DNA, 22 bp, Homo sapiens
tgctggtcctggagctgggttc

SEQ ID NO: 8023504 - DNA, 22 bp, Homo sapiens
tgctggtcccctgcagcctgtg

SEQ ID NO: 8023505 - DNA, 22 bp, Homo sapiens
tgctggtcctggagctgggttc

SEQ ID NO: 8023506 - DNA, 22 bp, Homo sapiens
tgctggtcccctgcagcctgtg

SEQ ID NO: 8023507 - DNA, 22 bp, Homo sapiens
tgctggtcctggagctgggttc

SEQ ID NO: 8023508 - DNA, 21 bp, Homo sapiens
tgctggtgagctcatgtggct

SEQ ID NO: 8023509 - DNA, 21 bp, Homo sapiens
tgctggtgagctcatgtggct

SEQ ID NO: 8023510 - DNA, 22 bp, Homo sapiens
tgctggtggagaaagtggaggt

SEQ ID NO: 8023511 - DNA, 22 bp, Homo sapiens
tgctggtggagaaagtggaggt

SEQ ID NO: 8023512 - DNA, 22 bp, Homo sapiens
tgctggtggagaaagtggaggt

SEQ ID NO: 8023513 - DNA, 22 bp, Homo sapiens
tgctggtgaggtccttgctgga

SEQ ID NO: 8023514 - DNA, 22 bp, Homo sapiens
tgctggtgattaaatcctgaag

SEQ ID NO: 8023515 - DNA, 22 bp, Homo sapiens
tgctggcttcctgtgcacagca

SEQ ID NO: 8023516 - DNA, 22 bp, Homo sapiens
tgctggcttcctgtgcacagca

SEQ ID NO: 8023517 - DNA, 22 bp, Homo sapiens
tgctggcttcctgtgcacagca

SEQ ID NO: 8023518 - DNA, 22 bp, Homo sapiens
tgctggcttcctgtgcacagca

SEQ ID NO: 8023519 - DNA, 22 bp, Homo sapiens
tgctggcttcctgtgcacagca

SEQ ID NO: 8023520 - DNA, 22 bp, Homo sapiens
tgctggcttcctgtgcacagca

SEQ ID NO: 8023521 - DNA, 22 bp, Homo sapiens
tgctggcttcctgtgcacagca

SEQ ID NO: 8023522 - DNA, 22 bp, Homo sapiens
tgctggcttcctgtgcacagca

SEQ ID NO: 8023523 - DNA, 22 bp, Homo sapiens
tgctggcttggaaggaaagcgc

SEQ ID NO: 8023524 - DNA, 22 bp, Homo sapiens
tgctggcttggaaggaaagcgc

SEQ ID NO: 8023525 - DNA, 22 bp, Homo sapiens
tgctgggcactgtctctgggga

SEQ ID NO: 8023526 - DNA, 22 bp, Homo sapiens
tgctgggcactgtctctgggga

SEQ ID NO: 8023527 - DNA, 22 bp, Homo sapiens
tgctgggcactgtctctgggga

SEQ ID NO: 8023528 - DNA, 22 bp, Homo sapiens
tgctgggcactgtctctgggga

SEQ ID NO: 8023529 - DNA, 23 bp, Homo sapiens
tgctgggcagagctggtgctgag

SEQ ID NO: 8023530 - DNA, 23 bp, Homo sapiens
tgctgggcagagctggtgctgag

SEQ ID NO: 8023531 - DNA, 23 bp, Homo sapiens
tgctgggcagagctggtgctgag

SEQ ID NO: 8023532 - DNA, 23 bp, Homo sapiens
tgctgggcagagctggtgctgag

SEQ ID NO: 8023533 - DNA, 23 bp, Homo sapiens
tgctgggcagagctggtgctgag

SEQ ID NO: 8023534 - DNA, 20 bp, Homo sapiens
tgctgggcatgcagtggaaa

SEQ ID NO: 8023535 - DNA, 20 bp, Homo sapiens
tgctgggcatgcagtggaaa

SEQ ID NO: 8023536 - DNA, 20 bp, Homo sapiens
tgctgggcatgcagtggaaa

SEQ ID NO: 8023537 - DNA, 20 bp, Homo sapiens
tgctgggcatgcagtggaaa

SEQ ID NO: 8023538 - DNA, 20 bp, Homo sapiens
tgctgggcatgcagtggaaa

SEQ ID NO: 8023539 - DNA, 20 bp, Homo sapiens
tgctgggcatgcagtggaaa

SEQ ID NO: 8023540 - DNA, 22 bp, Homo sapiens
tgctgggcatcgtaggaggtac

SEQ ID NO: 8023541 - DNA, 22 bp, Homo sapiens
tgctgggcatcgtaggaggtac

SEQ ID NO: 8023542 - DNA, 22 bp, Homo sapiens
tgctgggcatcgtaggaggtac

SEQ ID NO: 8023543 - DNA, 22 bp, Homo sapiens
tgctgggcatcgtaggaggtac

SEQ ID NO: 8023544 - DNA, 22 bp, Homo sapiens
tgctgggcatcgtaggaggtac

SEQ ID NO: 8023545 - DNA, 23 bp, Homo sapiens
tgctgggcagagctggtgctgag

SEQ ID NO: 8023546 - DNA, 22 bp, Homo sapiens
tgctgggcagtgtgccctcgag

SEQ ID NO: 8023547 - DNA, 23 bp, Homo sapiens
tgctgggcagagctggtgctgag

SEQ ID NO: 8023548 - DNA, 22 bp, Homo sapiens
tgctgggcagtgtgccctcgag

SEQ ID NO: 8023549 - DNA, 22 bp, Homo sapiens
tgctgggcagtgtgccctcgag

SEQ ID NO: 8023550 - DNA, 22 bp, Homo sapiens
tgctgggcagtgtgccctcgag

SEQ ID NO: 8023551 - DNA, 22 bp, Homo sapiens
tgctgggcatcgtaggaggtac

SEQ ID NO: 8023552 - DNA, 22 bp, Homo sapiens
tgctgggcagtgtgccctcgag

SEQ ID NO: 8023553 - DNA, 22 bp, Homo sapiens
tgctgggcatcgtaggaggtac

SEQ ID NO: 8023554 - DNA, 22 bp, Homo sapiens
tgctgggccaaagcagggtttt

SEQ ID NO: 8023555 - DNA, 22 bp, Homo sapiens
tgctgggccaaagcagggtttt

SEQ ID NO: 8023556 - DNA, 22 bp, Homo sapiens
tgctgggccaaagcagggtttt

SEQ ID NO: 8023557 - DNA, 22 bp, Homo sapiens
tgctgggccaaagcagggtttt

SEQ ID NO: 8023558 - DNA, 22 bp, Homo sapiens
tgctgggccaaagcagggtttt

SEQ ID NO: 8023559 - DNA, 22 bp, Homo sapiens
tgctgggccaaagcagggtttt

SEQ ID NO: 8023560 - DNA, 22 bp, Homo sapiens
tgctgggccaaagcagggtttt

SEQ ID NO: 8023561 - DNA, 22 bp, Homo sapiens
tgctgggcatttttatggctcc

SEQ ID NO: 8023562 - DNA, 22 bp, Homo sapiens
tgctgggcatttttatggctcc

SEQ ID NO: 8023563 - DNA, 22 bp, Homo sapiens
tgctgggcatttttatggctcc

SEQ ID NO: 8023564 - DNA, 22 bp, Homo sapiens
tgctgggcatttttatggctcc

SEQ ID NO: 8023565 - DNA, 22 bp, Homo sapiens
tgctgggcatttttatggctcc

SEQ ID NO: 8023566 - DNA, 22 bp, Homo sapiens
tgctgggcatttatgcagatgg

SEQ ID NO: 8023567 - DNA, 22 bp, Homo sapiens
tgctgggcatttatgcagatgg

SEQ ID NO: 8023568 - DNA, 22 bp, Homo sapiens
tgctgggcatttatgcagatgg

SEQ ID NO: 8023569 - DNA, 22 bp, Homo sapiens
tgctgggcatttatgcagatgg

SEQ ID NO: 8023570 - DNA, 22 bp, Homo sapiens
tgctgggcatttatgcagatgg

SEQ ID NO: 8023571 - DNA, 18 bp, Homo sapiens
tgctgggcattaggctta

SEQ ID NO: 8023572 - DNA, 18 bp, Homo sapiens
tgctgggcattaggctta

SEQ ID NO: 8023573 - DNA, 18 bp, Homo sapiens
tgctgggcattaggctta

SEQ ID NO: 8023574 - DNA, 22 bp, Homo sapiens
tgctgggcatttatgcagatgg

SEQ ID NO: 8023575 - DNA, 20 bp, Homo sapiens
tgctgggcatgcagtggaaa

SEQ ID NO: 8023576 - DNA, 18 bp, Homo sapiens
tgctgggcattaggctta

SEQ ID NO: 8023577 - DNA, 18 bp, Homo sapiens
tgctgggcattaggctta

SEQ ID NO: 8023578 - DNA, 22 bp, Homo sapiens
tgctgggcctgcccctgtcagc

SEQ ID NO: 8023579 - DNA, 22 bp, Homo sapiens
tgctgggcctgcccctgtcagc

SEQ ID NO: 8023580 - DNA, 22 bp, Homo sapiens
tgctgggcctgcccctgtcagc

SEQ ID NO: 8023581 - DNA, 22 bp, Homo sapiens
tgctgggcctcttccctggata

SEQ ID NO: 8023582 - DNA, 22 bp, Homo sapiens
tgctgggcctcttccctggata

SEQ ID NO: 8023583 - DNA, 22 bp, Homo sapiens
tgctgggcccccagtgaccttc

SEQ ID NO: 8023584 - DNA, 22 bp, Homo sapiens
tgctgggcccagggagcctctg

SEQ ID NO: 8023585 - DNA, 22 bp, Homo sapiens
tgctgggcccagggagcctctg

SEQ ID NO: 8023586 - DNA, 22 bp, Homo sapiens
tgctgggcccccagtgaccttc

SEQ ID NO: 8023587 - DNA, 22 bp, Homo sapiens
tgctgggcccccagtgaccttc

SEQ ID NO: 8023588 - DNA, 20 bp, Homo sapiens
tgctgggccatcttgcatgc

SEQ ID NO: 8023589 - DNA, 22 bp, Homo sapiens
tgctgggcccagggagcctctg

SEQ ID NO: 8023590 - DNA, 22 bp, Homo sapiens
tgctgggcccagggagcctctg

SEQ ID NO: 8023591 - DNA, 20 bp, Homo sapiens
tgctgggccatcttgcatgc

SEQ ID NO: 8023592 - DNA, 20 bp, Homo sapiens
tgctgggccatcttgcatgc

SEQ ID NO: 8023593 - DNA, 20 bp, Homo sapiens
tgctgggccatcttgcatgc

SEQ ID NO: 8023594 - DNA, 22 bp, Homo sapiens
tgctgggctagaagctgaggcc

SEQ ID NO: 8023595 - DNA, 22 bp, Homo sapiens
tgctgggctagaagctgaggcc

SEQ ID NO: 8023596 - DNA, 22 bp, Homo sapiens
tgctgggctagaagctgaggcc

SEQ ID NO: 8023597 - DNA, 22 bp, Homo sapiens
tgctgggctagaagctgaggcc

SEQ ID NO: 8023598 - DNA, 22 bp, Homo sapiens
tgctgggctagaagctgaggcc

SEQ ID NO: 8023599 - DNA, 22 bp, Homo sapiens
tgctgggctagaagctgaggcc

SEQ ID NO: 8023600 - DNA, 22 bp, Homo sapiens
tgctgggctagaagctgaggcc

SEQ ID NO: 8023601 - DNA, 22 bp, Homo sapiens
tgctgggctagaagctgaggcc

SEQ ID NO: 8023602 - DNA, 22 bp, Homo sapiens
tgctgggctagaagctgaggcc

SEQ ID NO: 8023603 - DNA, 22 bp, Homo sapiens
tgctgggcggtgggctcatccc

SEQ ID NO: 8023604 - DNA, 22 bp, Homo sapiens
tgctgggcggtgggctcatccc

SEQ ID NO: 8023605 - DNA, 22 bp, Homo sapiens
tgctgggcggtgggctcatccc

SEQ ID NO: 8023606 - DNA, 22 bp, Homo sapiens
tgctgggcggtgggctcatccc

SEQ ID NO: 8023607 - DNA, 22 bp, Homo sapiens
tgctgggcggtgggctcatccc

SEQ ID NO: 8023608 - DNA, 22 bp, Homo sapiens
tgctgggcctttacctccaggg

SEQ ID NO: 8023609 - DNA, 22 bp, Homo sapiens
tgctgggcctttacctccaggg

SEQ ID NO: 8023610 - DNA, 22 bp, Homo sapiens
tgctgggcctttacctccaggg

SEQ ID NO: 8023611 - DNA, 22 bp, Homo sapiens
tgctgggcctttacctccaggg

SEQ ID NO: 8023612 - DNA, 22 bp, Homo sapiens
tgctgggctagggtggagctct

SEQ ID NO: 8023613 - DNA, 22 bp, Homo sapiens
tgctgggctagggtggagctct

SEQ ID NO: 8023614 - DNA, 22 bp, Homo sapiens
tgctgggctagggtggagctct

SEQ ID NO: 8023615 - DNA, 22 bp, Homo sapiens
tgctgggctgcacccccagagt

SEQ ID NO: 8023616 - DNA, 22 bp, Homo sapiens
tgctgggctgcacccccagagt

SEQ ID NO: 8023617 - DNA, 22 bp, Homo sapiens
tgctgggctgcacccccagagt

SEQ ID NO: 8023618 - DNA, 22 bp, Homo sapiens
tgctgggctcaacctccagagc

SEQ ID NO: 8023619 - DNA, 22 bp, Homo sapiens
tgctgggctcaacctccagagc

SEQ ID NO: 8023620 - DNA, 22 bp, Homo sapiens
tgctgggctcaacctccagagc

SEQ ID NO: 8023621 - DNA, 22 bp, Homo sapiens
tgctgggctagaagctgaggcc

SEQ ID NO: 8023622 - DNA, 22 bp, Homo sapiens
tgctgggctagaagctgaggcc

SEQ ID NO: 8023623 - DNA, 22 bp, Homo sapiens
tgctgggctagaagctgaggcc

SEQ ID NO: 8023624 - DNA, 22 bp, Homo sapiens
tgctgggctagaagctgaggcc

SEQ ID NO: 8023625 - DNA, 22 bp, Homo sapiens
tgctgggctagaagctgaggcc

SEQ ID NO: 8023626 - DNA, 22 bp, Homo sapiens
tgctgggctagggtggagctct

SEQ ID NO: 8023627 - DNA, 22 bp, Homo sapiens
tgctgggctagggtggagctct

SEQ ID NO: 8023628 - DNA, 22 bp, Homo sapiens
tgctgggctagggtggagctct

SEQ ID NO: 8023629 - DNA, 22 bp, Homo sapiens
tgctgggctagggtggagctct

SEQ ID NO: 8023630 - DNA, 22 bp, Homo sapiens
tgctgggctagggtggagctct

SEQ ID NO: 8023631 - DNA, 22 bp, Homo sapiens
tgctgggcttcaactgcctgag

SEQ ID NO: 8023632 - DNA, 22 bp, Homo sapiens
tgctgggcttcaactgcctgag

SEQ ID NO: 8023633 - DNA, 22 bp, Homo sapiens
tgctgggcttcaactgcctgag

SEQ ID NO: 8023634 - DNA, 22 bp, Homo sapiens
tgctgggcttcaactgcctgag

SEQ ID NO: 8023635 - DNA, 22 bp, Homo sapiens
tgctgggcttcaactgcctgag

SEQ ID NO: 8023636 - DNA, 22 bp, Homo sapiens
tgctgggcttcaactgcctgag

SEQ ID NO: 8023637 - DNA, 22 bp, Homo sapiens
tgctgggctgttcctgtccatg

SEQ ID NO: 8023638 - DNA, 22 bp, Homo sapiens
tgctgggcttcacccccacagt

SEQ ID NO: 8023639 - DNA, 22 bp, Homo sapiens
tgctgggcttcacccccacagt

SEQ ID NO: 8023640 - DNA, 22 bp, Homo sapiens
tgctgggcttgaaagctgctaa

SEQ ID NO: 8023641 - DNA, 22 bp, Homo sapiens
tgctgggcttgaaagctgctaa

SEQ ID NO: 8023642 - DNA, 22 bp, Homo sapiens
tgctgggcttgaaagctgctaa

SEQ ID NO: 8023643 - DNA, 22 bp, Homo sapiens
tgctgggcttgaaagctgctaa

SEQ ID NO: 8023644 - DNA, 22 bp, Homo sapiens
tgctgggcttgaaagctgctaa

SEQ ID NO: 8023645 - DNA, 22 bp, Homo sapiens
tgctgggcttgaaagctgctaa

SEQ ID NO: 8023646 - DNA, 22 bp, Homo sapiens
tgctgggctggagctgccaggg

SEQ ID NO: 8023647 - DNA, 22 bp, Homo sapiens
tgctgggctggagctgccaggg

SEQ ID NO: 8023648 - DNA, 22 bp, Homo sapiens
tgctgggctggagctgccaggg

SEQ ID NO: 8023649 - DNA, 22 bp, Homo sapiens
tgctgggctggagctgccaggg

SEQ ID NO: 8023650 - DNA, 21 bp, Homo sapiens
tgctgggctgcaggggatgca

SEQ ID NO: 8023651 - DNA, 21 bp, Homo sapiens
tgctgggctgcaggggatgca

SEQ ID NO: 8023652 - DNA, 21 bp, Homo sapiens
tgctgggctgcaggggatgca

SEQ ID NO: 8023653 - DNA, 21 bp, Homo sapiens
tgctgggctgcaggggatgca

SEQ ID NO: 8023654 - DNA, 21 bp, Homo sapiens
tgctgggctgcaggggatgca

SEQ ID NO: 8023655 - DNA, 22 bp, Homo sapiens
tgctgggctgttcctgtccatg

SEQ ID NO: 8023656 - DNA, 22 bp, Homo sapiens
tgctgggctgttcctgtccatg

SEQ ID NO: 8023657 - DNA, 22 bp, Homo sapiens
tgctgggctgttcctgtccatg

SEQ ID NO: 8023658 - DNA, 22 bp, Homo sapiens
tgctgggctgttcctgtccatg

SEQ ID NO: 8023659 - DNA, 22 bp, Homo sapiens
tgctgggctggggcctcagacc

SEQ ID NO: 8023660 - DNA, 22 bp, Homo sapiens
tgctgggctggagctgccaggg

SEQ ID NO: 8023661 - DNA, 22 bp, Homo sapiens
tgctgggctggggcctcagacc

SEQ ID NO: 8023662 - DNA, 22 bp, Homo sapiens
tgctgggctggggcctcagacc

SEQ ID NO: 8023663 - DNA, 22 bp, Homo sapiens
tgcttcatttccttatattgta

SEQ ID NO: 8023664 - DNA, 22 bp, Homo sapiens
tgcttcattaaaacaatatttt

SEQ ID NO: 8023665 - DNA, 22 bp, Homo sapiens
tgcttcattaaaacaatatttt

SEQ ID NO: 8023666 - DNA, 22 bp, Homo sapiens
tgcttcattaaaacaatatttt

SEQ ID NO: 8023667 - DNA, 22 bp, Homo sapiens
tgcttccagctctctgtaaggt

SEQ ID NO: 8023668 - DNA, 22 bp, Homo sapiens
tgcttccagcatccctggcctg

SEQ ID NO: 8023669 - DNA, 22 bp, Homo sapiens
tgcttccactaatgagctgtgt

SEQ ID NO: 8023670 - DNA, 22 bp, Homo sapiens
tgcttccactaatgagctgtgt

SEQ ID NO: 8023671 - DNA, 22 bp, Homo sapiens
tgcttccactaatgagctgtgt

SEQ ID NO: 8023672 - DNA, 22 bp, Homo sapiens
tgcttccagcatccctggcctg

SEQ ID NO: 8023673 - DNA, 22 bp, Homo sapiens
tgcttcatgcttctgacaatag

SEQ ID NO: 8023674 - DNA, 22 bp, Homo sapiens
tgcttcagtgtgtcattattta

SEQ ID NO: 8023675 - DNA, 22 bp, Homo sapiens
tgcttcaggagatgtcaccatg

SEQ ID NO: 8023676 - DNA, 22 bp, Homo sapiens
tgcttcagtgctctgagcctgt

SEQ ID NO: 8023677 - DNA, 17 bp, Homo sapiens
tgcttcatcccgatcct

SEQ ID NO: 8023678 - DNA, 22 bp, Homo sapiens
tgcttcaggagatgtcaccatg

SEQ ID NO: 8023679 - DNA, 22 bp, Homo sapiens
tgcttcagtcctatgggcaggt

SEQ ID NO: 8023680 - DNA, 22 bp, Homo sapiens
tgcttcagtgctctgagcctgt

SEQ ID NO: 8023681 - DNA, 22 bp, Homo sapiens
tgcttcagtcctatgggcaggt

SEQ ID NO: 8023682 - DNA, 22 bp, Homo sapiens
tgcttcagtgctctgagcctgt

SEQ ID NO: 8023683 - DNA, 22 bp, Homo sapiens
tgcttcagcactttgagagcct

SEQ ID NO: 8023684 - DNA, 22 bp, Homo sapiens
tgcttcagcactttgagagcct

SEQ ID NO: 8023685 - DNA, 22 bp, Homo sapiens
tgcttcagcagggatcgggggg

SEQ ID NO: 8023686 - DNA, 22 bp, Homo sapiens
tgcttcaggaagaaacgccagg

SEQ ID NO: 8023687 - DNA, 22 bp, Homo sapiens
tgcttattctttccacaattca

SEQ ID NO: 8023688 - DNA, 22 bp, Homo sapiens
tgcttattctttccacaattca

SEQ ID NO: 8023689 - DNA, 22 bp, Homo sapiens
tgcttattgctttcaagactgt

SEQ ID NO: 8023690 - DNA, 22 bp, Homo sapiens
tgcttattgctttcaagactgt

SEQ ID NO: 8023691 - DNA, 22 bp, Homo sapiens
tgcttattaaacatgcatattc

SEQ ID NO: 8023692 - DNA, 22 bp, Homo sapiens
tgcttatttaggtagatattaa

SEQ ID NO: 8023693 - DNA, 22 bp, Homo sapiens
tgcttattgctttcaagactgt

SEQ ID NO: 8023694 - DNA, 22 bp, Homo sapiens
tgcttatttaggtagatattaa

SEQ ID NO: 8023695 - DNA, 22 bp, Homo sapiens
tgcttatttatagtcaatagag

SEQ ID NO: 8023696 - DNA, 22 bp, Homo sapiens
tgcttatttatagtcaatagag

SEQ ID NO: 8023697 - DNA, 22 bp, Homo sapiens
tgcttatttgaatttattctca

SEQ ID NO: 8023698 - DNA, 22 bp, Homo sapiens
tgcttcaaggacactgactttt

SEQ ID NO: 8023699 - DNA, 22 bp, Homo sapiens
tgcttcaaaaggcagcttaatg

SEQ ID NO: 8023700 - DNA, 22 bp, Homo sapiens
tgcttcacaagaattcaggacc

SEQ ID NO: 8023701 - DNA, 22 bp, Homo sapiens
tgcttcaaggccatgtcaagct

SEQ ID NO: 8023702 - DNA, 19 bp, Homo sapiens
tgcttcagaaatagaaagc

SEQ ID NO: 8023703 - DNA, 19 bp, Homo sapiens
tgcttcagaaatagaaagc

SEQ ID NO: 8023704 - DNA, 22 bp, Homo sapiens
tgcttcacaagaattcaggacc

SEQ ID NO: 8023705 - DNA, 22 bp, Homo sapiens
tgcttcaaggccatgtcaagct

SEQ ID NO: 8023706 - DNA, 22 bp, Homo sapiens
tgcttcaaggccatgtcaagct

SEQ ID NO: 8023707 - DNA, 22 bp, Homo sapiens
tgcttcaagttgaaatattctt

SEQ ID NO: 8023708 - DNA, 22 bp, Homo sapiens
tgcttcagaggaaaggcaaaag

SEQ ID NO: 8023709 - DNA, 22 bp, Homo sapiens
tgcttcagcactttgagagcct

SEQ ID NO: 8023710 - DNA, 22 bp, Homo sapiens
tgcttcagcactttgagagcct

SEQ ID NO: 8023711 - DNA, 22 bp, Homo sapiens
tgcttcagcactttgagagcct

SEQ ID NO: 8023712 - DNA, 22 bp, Homo sapiens
tgcttcagagaagaatggaaag

SEQ ID NO: 8023713 - DNA, 22 bp, Homo sapiens
tgcttcagaggaaaggcaaaag

SEQ ID NO: 8023714 - DNA, 22 bp, Homo sapiens
tgcttcagagacatcctactca

SEQ ID NO: 8023715 - DNA, 22 bp, Homo sapiens
tgcttcagagacatcctactca

SEQ ID NO: 8023716 - DNA, 22 bp, Homo sapiens
tgcttcagagacatcctactca

SEQ ID NO: 8023717 - DNA, 22 bp, Homo sapiens
tgcttctgcaggagctcctgat

SEQ ID NO: 8023718 - DNA, 22 bp, Homo sapiens
tgcttctgatgtgagcagcccc

SEQ ID NO: 8023719 - DNA, 22 bp, Homo sapiens
tgcttctgatgtgagcagcccc

SEQ ID NO: 8023720 - DNA, 22 bp, Homo sapiens
tgcttctgcaggagctcctgat

SEQ ID NO: 8023721 - DNA, 22 bp, Homo sapiens
tgcttctgcaggagctcctgat

SEQ ID NO: 8023722 - DNA, 22 bp, Homo sapiens
tgcttctgcaggagctcctgat

SEQ ID NO: 8023723 - DNA, 22 bp, Homo sapiens
tgcttctgctcagcttcctact

SEQ ID NO: 8023724 - DNA, 22 bp, Homo sapiens
tgcttctgctcagcttcctact

SEQ ID NO: 8023725 - DNA, 22 bp, Homo sapiens
tgcttctgctcagcttcctact

SEQ ID NO: 8023726 - DNA, 22 bp, Homo sapiens
tgcttctgcaggagctcctgat

SEQ ID NO: 8023727 - DNA, 22 bp, Homo sapiens
tgcttctgactaagctgcatga

SEQ ID NO: 8023728 - DNA, 22 bp, Homo sapiens
tgcttctgactaagctgcatga

SEQ ID NO: 8023729 - DNA, 22 bp, Homo sapiens
tgcttctgactaagctgcatga

SEQ ID NO: 8023730 - DNA, 22 bp, Homo sapiens
tgcttctgagttgcaggacttg

SEQ ID NO: 8023731 - DNA, 22 bp, Homo sapiens
tgcttctgagttgcaggacttg

SEQ ID NO: 8023732 - DNA, 22 bp, Homo sapiens
tgcttctgactgggtcagttga

SEQ ID NO: 8023733 - DNA, 22 bp, Homo sapiens
tgcttctgaactcagcatgtgg

SEQ ID NO: 8023734 - DNA, 22 bp, Homo sapiens
tgcttctgaactcagcatgtgg

SEQ ID NO: 8023735 - DNA, 22 bp, Homo sapiens
tgcttctgaactcagcatgtgg

SEQ ID NO: 8023736 - DNA, 22 bp, Homo sapiens
tgcttctgaagtggatgggtgc

SEQ ID NO: 8023737 - DNA, 22 bp, Homo sapiens
tgcttctgacatgttcttggtt

SEQ ID NO: 8023738 - DNA, 22 bp, Homo sapiens
tgcttctaacacttcatgagca

SEQ ID NO: 8023739 - DNA, 22 bp, Homo sapiens
tgcttctaatctactgcattag

SEQ ID NO: 8023740 - DNA, 22 bp, Homo sapiens
tgcttccctgctctgcacacct

SEQ ID NO: 8023741 - DNA, 22 bp, Homo sapiens
tgcttccctcacttcacctggc

SEQ ID NO: 8023742 - DNA, 22 bp, Homo sapiens
tgcttccctgaaggcacaggag

SEQ ID NO: 8023743 - DNA, 22 bp, Homo sapiens
tgcttctcaaagaagcataatg

SEQ ID NO: 8023744 - DNA, 22 bp, Homo sapiens
tgcttctcaaagaagcataatg

SEQ ID NO: 8023745 - DNA, 22 bp, Homo sapiens
tgcttctagacactgcaattga

SEQ ID NO: 8023746 - DNA, 22 bp, Homo sapiens
tgcttctcaaaaggaggtaggt

SEQ ID NO: 8023747 - DNA, 22 bp, Homo sapiens
tgcttctcaaaaggaggtaggt

SEQ ID NO: 8023748 - DNA, 22 bp, Homo sapiens
tgcttctcaaagaagcataatg

SEQ ID NO: 8023749 - DNA, 22 bp, Homo sapiens
tgcttctcagcctgtctggaaa

SEQ ID NO: 8023750 - DNA, 22 bp, Homo sapiens
tgcttctctctaggaagacgct

SEQ ID NO: 8023751 - DNA, 21 bp, Homo sapiens
tgcttctctagatcaactact

SEQ ID NO: 8023752 - DNA, 21 bp, Homo sapiens
tgcttctctagatcaactact

SEQ ID NO: 8023753 - DNA, 22 bp, Homo sapiens
tgcttctccattgatgctaagt

SEQ ID NO: 8023754 - DNA, 22 bp, Homo sapiens
tgcttctcccaaccagggcctg

SEQ ID NO: 8023755 - DNA, 23 bp, Homo sapiens
tgcttctctgcttgacagttctg

SEQ ID NO: 8023756 - DNA, 23 bp, Homo sapiens
tgcttctctgcttgacagttctg

SEQ ID NO: 8023757 - DNA, 23 bp, Homo sapiens
tgcttctctgcttgacagttctg

SEQ ID NO: 8023758 - DNA, 22 bp, Homo sapiens
tgcttctctgttctaacccttg

SEQ ID NO: 8023759 - DNA, 22 bp, Homo sapiens
tgcttaaaaacagtatggtagt

SEQ ID NO: 8023760 - DNA, 22 bp, Homo sapiens
tgcttaaaaagctccatcaata

SEQ ID NO: 8023761 - DNA, 22 bp, Homo sapiens
tgcttaaaaagctccatcaata

SEQ ID NO: 8023762 - DNA, 23 bp, Homo sapiens
tgctgtgcctttgtctgcctcca

SEQ ID NO: 8023763 - DNA, 22 bp, Homo sapiens
tgcttaaaaacagtatggtagt

SEQ ID NO: 8023764 - DNA, 23 bp, Homo sapiens
tgctgtgcctttgtctgcctcca

SEQ ID NO: 8023765 - DNA, 22 bp, Homo sapiens
tgcttaaaatagttcatttttg

SEQ ID NO: 8023766 - DNA, 22 bp, Homo sapiens
tgcttaaaatgatgattatttt

SEQ ID NO: 8023767 - DNA, 22 bp, Homo sapiens
tgcttaaaatagttcatttttg

SEQ ID NO: 8023768 - DNA, 22 bp, Homo sapiens
tgctgtgaggttgagaaggaag

SEQ ID NO: 8023769 - DNA, 22 bp, Homo sapiens
tgctgtgaggttgagaaggaag

SEQ ID NO: 8023770 - DNA, 22 bp, Homo sapiens
tgctgtgaggttgagaaggaag

SEQ ID NO: 8023771 - DNA, 22 bp, Homo sapiens
tgctgtgaggttgagaaggaag

SEQ ID NO: 8023772 - DNA, 22 bp, Homo sapiens
tgctgtgaggttgagaaggaag

SEQ ID NO: 8023773 - DNA, 22 bp, Homo sapiens
tgctgtgcaaaggtgatgtgag

SEQ ID NO: 8023774 - DNA, 18 bp, Homo sapiens
tgctgtgcacagccctat

SEQ ID NO: 8023775 - DNA, 22 bp, Homo sapiens
tgctgtgcatcatagtgtttgg

SEQ ID NO: 8023776 - DNA, 22 bp, Homo sapiens
tgctgtgcaaaggtgatgtgag

SEQ ID NO: 8023777 - DNA, 22 bp, Homo sapiens
tgctgtctgcaacagtactaca

SEQ ID NO: 8023778 - DNA, 22 bp, Homo sapiens
tgctgtctgattcagggtgatt

SEQ ID NO: 8023779 - DNA, 20 bp, Homo sapiens
tgctgtcgtgttttctgctt

SEQ ID NO: 8023780 - DNA, 22 bp, Homo sapiens
tgctgtcctgttttggagtaat

SEQ ID NO: 8023781 - DNA, 22 bp, Homo sapiens
tgctgtcctgctgagggatgtg

SEQ ID NO: 8023782 - DNA, 21 bp, Homo sapiens
tgctgtcctagaaccagggcc

SEQ ID NO: 8023783 - DNA, 22 bp, Homo sapiens
tgctgtcctgctgagggatgtg

SEQ ID NO: 8023784 - DNA, 21 bp, Homo sapiens
tgctgtcctagaaccagggcc

SEQ ID NO: 8023785 - DNA, 22 bp, Homo sapiens
tgctgtccctaagtctcttcaa

SEQ ID NO: 8023786 - DNA, 22 bp, Homo sapiens
tgctgtctgtttactggctata

SEQ ID NO: 8023787 - DNA, 22 bp, Homo sapiens
tgctgtcttccaggatggtgaa

SEQ ID NO: 8023788 - DNA, 22 bp, Homo sapiens
tgctgtcttctctgaggtccct

SEQ ID NO: 8023789 - DNA, 22 bp, Homo sapiens
tgctgtcttttcccaatcctgg

SEQ ID NO: 8023790 - DNA, 22 bp, Homo sapiens
tgctgtcttttcccaatcctgg

SEQ ID NO: 8023791 - DNA, 22 bp, Homo sapiens
tgctgtctttttcccttcctaa

SEQ ID NO: 8023792 - DNA, 22 bp, Homo sapiens
tgctgtgacccaaaaaagacct

SEQ ID NO: 8023793 - DNA, 22 bp, Homo sapiens
tgctgtgacagagtctcatgga

SEQ ID NO: 8023794 - DNA, 22 bp, Homo sapiens
tgcttataatgttactgacaac

SEQ ID NO: 8023795 - DNA, 22 bp, Homo sapiens
tgcttataatgttactgacaac

SEQ ID NO: 8023796 - DNA, 22 bp, Homo sapiens
tgcttattaaacatgcatattc

SEQ ID NO: 8023797 - DNA, 22 bp, Homo sapiens
tgcttattaaacatgcatattc

SEQ ID NO: 8023798 - DNA, 22 bp, Homo sapiens
tgcttaggttggtctagaccat

SEQ ID NO: 8023799 - DNA, 22 bp, Homo sapiens
tgcttaggtgttatgtaatatc

SEQ ID NO: 8023800 - DNA, 22 bp, Homo sapiens
tgcttagggctcctccaataga

SEQ ID NO: 8023801 - DNA, 22 bp, Homo sapiens
tgcttaggctaacaaaaatagc

SEQ ID NO: 8023802 - DNA, 22 bp, Homo sapiens
tgcttagaatctggacttgttg

SEQ ID NO: 8023803 - DNA, 22 bp, Homo sapiens
tgcttagacgtcaagtacagcc

SEQ ID NO: 8023804 - DNA, 22 bp, Homo sapiens
tgcttagatgaggcagcaggag

SEQ ID NO: 8023805 - DNA, 22 bp, Homo sapiens
tgcttaatcaagaagcctattt

SEQ ID NO: 8023806 - DNA, 22 bp, Homo sapiens
tgcttaatccaacctggctgac

SEQ ID NO: 8023807 - DNA, 22 bp, Homo sapiens
tgcttaatcaagaagcctattt

SEQ ID NO: 8023808 - DNA, 22 bp, Homo sapiens
tgcttacaactttattgaggaa

SEQ ID NO: 8023809 - DNA, 19 bp, Homo sapiens
tgcttaattcctagtaggt

SEQ ID NO: 8023810 - DNA, 22 bp, Homo sapiens
tgcttaataggagttgaacatt

SEQ ID NO: 8023811 - DNA, 22 bp, Homo sapiens
tgcttaaacatactatttatat

SEQ ID NO: 8023812 - DNA, 22 bp, Homo sapiens
tgcttaaacatactatttatat

SEQ ID NO: 8023813 - DNA, 22 bp, Homo sapiens
tgcttaaacatccagacagtat

SEQ ID NO: 8023814 - DNA, 22 bp, Homo sapiens
tgcttaaacacatacatacata

SEQ ID NO: 8023815 - DNA, 22 bp, Homo sapiens
tgcttaaacacatacatacata

SEQ ID NO: 8023816 - DNA, 22 bp, Homo sapiens
tgcttaaacacatacatacata

SEQ ID NO: 8023817 - DNA, 22 bp, Homo sapiens
tgcttaaacacatacatacata

SEQ ID NO: 8023818 - DNA, 22 bp, Homo sapiens
tgcttaaaccctgatcatgtgt

SEQ ID NO: 8023819 - DNA, 22 bp, Homo sapiens
tgcttaaaccctgatcatgtgt

SEQ ID NO: 8023820 - DNA, 22 bp, Homo sapiens
tgcttaaacatccagacagtat

SEQ ID NO: 8023821 - DNA, 22 bp, Homo sapiens
tgcttaaacatccagacagtat

SEQ ID NO: 8023822 - DNA, 22 bp, Homo sapiens
tgcttaaaccctgatcatgtgt

SEQ ID NO: 8023823 - DNA, 22 bp, Homo sapiens
tgcttaaagtagtggattgtta

SEQ ID NO: 8023824 - DNA, 22 bp, Homo sapiens
tgcttaaagctgctcagttgta

SEQ ID NO: 8023825 - DNA, 22 bp, Homo sapiens
tgcttaaaggatagtttaaact

SEQ ID NO: 8023826 - DNA, 22 bp, Homo sapiens
tggccacagcctctgccagttc

SEQ ID NO: 8023827 - DNA, 22 bp, Homo sapiens
tggccacagcctctgccagttc

SEQ ID NO: 8023828 - DNA, 22 bp, Homo sapiens
tggccacagcctctgccagttc

SEQ ID NO: 8023829 - DNA, 23 bp, Homo sapiens
tggccacagggtgctccattgta

SEQ ID NO: 8023830 - DNA, 23 bp, Homo sapiens
tggccacagtccatgcatgccca

SEQ ID NO: 8023831 - DNA, 22 bp, Homo sapiens
tggcatttctgttagactctca

SEQ ID NO: 8023832 - DNA, 22 bp, Homo sapiens
tggccacactgcccccactggg

SEQ ID NO: 8023833 - DNA, 22 bp, Homo sapiens
tggccacactgcccccactggg

SEQ ID NO: 8023834 - DNA, 22 bp, Homo sapiens
tggccacacccacctagaggag

SEQ ID NO: 8023835 - DNA, 22 bp, Homo sapiens
tggcatttagagaaatgaagga

SEQ ID NO: 8023836 - DNA, 22 bp, Homo sapiens
tggcatttagaaaacaacatgt

SEQ ID NO: 8023837 - DNA, 22 bp, Homo sapiens
tggcatttagagaaatgaagga

SEQ ID NO: 8023838 - DNA, 22 bp, Homo sapiens
tggcatttatatcccagtttat

SEQ ID NO: 8023839 - DNA, 22 bp, Homo sapiens
tggcatttcacctttcatttcc

SEQ ID NO: 8023840 - DNA, 23 bp, Homo sapiens
tggcatttctatactggcaagtg

SEQ ID NO: 8023841 - DNA, 22 bp, Homo sapiens
tggcatttcagtattttcataa

SEQ ID NO: 8023842 - DNA, 22 bp, Homo sapiens
tggcatgtggcagctggttcag

SEQ ID NO: 8023843 - DNA, 22 bp, Homo sapiens
tggcatgtggctttgagtcatc

SEQ ID NO: 8023844 - DNA, 22 bp, Homo sapiens
tggcatgtgtgtgtaggataca

SEQ ID NO: 8023845 - DNA, 22 bp, Homo sapiens
tggcatgttctcttagcagctc

SEQ ID NO: 8023846 - DNA, 22 bp, Homo sapiens
tggcatgtatttgtggtgaatt

SEQ ID NO: 8023847 - DNA, 22 bp, Homo sapiens
tggcatgtccacttcaacagtt

SEQ ID NO: 8023848 - DNA, 22 bp, Homo sapiens
tggcatgtggcagctggttcag

SEQ ID NO: 8023849 - DNA, 22 bp, Homo sapiens
tggcatgtatttgtggtgaatt

SEQ ID NO: 8023850 - DNA, 22 bp, Homo sapiens
tggcatgtacccaggaatggac

SEQ ID NO: 8023851 - DNA, 22 bp, Homo sapiens
tggcatgtaacatctccagatt

SEQ ID NO: 8023852 - DNA, 22 bp, Homo sapiens
tggcatggtcaaggctatgtta

SEQ ID NO: 8023853 - DNA, 22 bp, Homo sapiens
tggcatggtggagtgacgggca

SEQ ID NO: 8023854 - DNA, 22 bp, Homo sapiens
tggcatgtttcatggctgcaaa

SEQ ID NO: 8023855 - DNA, 22 bp, Homo sapiens
tggcatgtttcatggctgcaaa

SEQ ID NO: 8023856 - DNA, 19 bp, Homo sapiens
tggcatgtttggctaagga

SEQ ID NO: 8023857 - DNA, 22 bp, Homo sapiens
tggcatgtttgcttgtgcatat

SEQ ID NO: 8023858 - DNA, 19 bp, Homo sapiens
tggcatgtttggctaagga

SEQ ID NO: 8023859 - DNA, 22 bp, Homo sapiens
tggcatgttctcttagcagctc

SEQ ID NO: 8023860 - DNA, 22 bp, Homo sapiens
tggcatgttctcttagcagctc

SEQ ID NO: 8023861 - DNA, 22 bp, Homo sapiens
tggcatgttgagaggcaagatt

SEQ ID NO: 8023862 - DNA, 22 bp, Homo sapiens
tggcatgttgataatggagaag

SEQ ID NO: 8023863 - DNA, 22 bp, Homo sapiens
tggcatgtttaaatggcaataa

SEQ ID NO: 8023864 - DNA, 22 bp, Homo sapiens
tggcatgtttaatgtactgtat

SEQ ID NO: 8023865 - DNA, 22 bp, Homo sapiens
tggcattgacaactttcagttc

SEQ ID NO: 8023866 - DNA, 22 bp, Homo sapiens
tggcattgacgctgacctgcac

SEQ ID NO: 8023867 - DNA, 22 bp, Homo sapiens
tggcatgttttgctcttgaaaa

SEQ ID NO: 8023868 - DNA, 22 bp, Homo sapiens
tggcattgctgtagtgtcagaa

SEQ ID NO: 8023869 - DNA, 22 bp, Homo sapiens
tggcattgaggagcaaaattta

SEQ ID NO: 8023870 - DNA, 22 bp, Homo sapiens
tggcattgggttgatgtctcag

SEQ ID NO: 8023871 - DNA, 22 bp, Homo sapiens
tggcattgcttctgaagtggag

SEQ ID NO: 8023872 - DNA, 22 bp, Homo sapiens
tggcattggaatttgtgttgca

SEQ ID NO: 8023873 - DNA, 22 bp, Homo sapiens
tggcattggttgccaggctgtg

SEQ ID NO: 8023874 - DNA, 22 bp, Homo sapiens
tggcattgtagggtgtttagcg

SEQ ID NO: 8023875 - DNA, 22 bp, Homo sapiens
tggccagagtccagtgagcctt

SEQ ID NO: 8023876 - DNA, 22 bp, Homo sapiens
tggccagagtccagtgagcctt

SEQ ID NO: 8023877 - DNA, 22 bp, Homo sapiens
tggccagagtccagtgagcctt

SEQ ID NO: 8023878 - DNA, 22 bp, Homo sapiens
tggccagagtccagtgagcctt

SEQ ID NO: 8023879 - DNA, 17 bp, Homo sapiens
tggccagagcaggcccc

SEQ ID NO: 8023880 - DNA, 17 bp, Homo sapiens
tggccagagcaggcccc

SEQ ID NO: 8023881 - DNA, 17 bp, Homo sapiens
tggccagagcaggcccc

SEQ ID NO: 8023882 - DNA, 22 bp, Homo sapiens
tggccagacctgactgtcaggg

SEQ ID NO: 8023883 - DNA, 22 bp, Homo sapiens
tggccagacagagaggctttgt

SEQ ID NO: 8023884 - DNA, 22 bp, Homo sapiens
tggccagacagagaggctttgt

SEQ ID NO: 8023885 - DNA, 22 bp, Homo sapiens
tggccagaactcagacatgtgg

SEQ ID NO: 8023886 - DNA, 22 bp, Homo sapiens
tggccagaactcagacatgtgg

SEQ ID NO: 8023887 - DNA, 22 bp, Homo sapiens
tggccagacagagaggctttgt

SEQ ID NO: 8023888 - DNA, 22 bp, Homo sapiens
tggccagaacctgcagtaggcc

SEQ ID NO: 8023889 - DNA, 22 bp, Homo sapiens
tggccagaactcagacatgtgg

SEQ ID NO: 8023890 - DNA, 22 bp, Homo sapiens
tggccactcagggatgcaggaa

SEQ ID NO: 8023891 - DNA, 22 bp, Homo sapiens
tggccactcctccctgcaggct

SEQ ID NO: 8023892 - DNA, 22 bp, Homo sapiens
tggccactcctccctgcaggct

SEQ ID NO: 8023893 - DNA, 22 bp, Homo sapiens
tggccactcctccctgcaggct

SEQ ID NO: 8023894 - DNA, 22 bp, Homo sapiens
tggccactcctccctgcaggct

SEQ ID NO: 8023895 - DNA, 22 bp, Homo sapiens
tggccactggcttccactgagt

SEQ ID NO: 8023896 - DNA, 22 bp, Homo sapiens
tggccactggcttccactgagt

SEQ ID NO: 8023897 - DNA, 20 bp, Homo sapiens
tggccactggccactggagc

SEQ ID NO: 8023898 - DNA, 22 bp, Homo sapiens
tggccactcagggatgcaggaa

SEQ ID NO: 8023899 - DNA, 19 bp, Homo sapiens
tggccacctctgctgttct

SEQ ID NO: 8023900 - DNA, 22 bp, Homo sapiens
tggccacagtgtccagcagcag

SEQ ID NO: 8023901 - DNA, 23 bp, Homo sapiens
tggccacagtccatgcatgccca

SEQ ID NO: 8023902 - DNA, 22 bp, Homo sapiens
tggccacagtgtccagcagcag

SEQ ID NO: 8023903 - DNA, 22 bp, Homo sapiens
tggccacatcctttccttgtca

SEQ ID NO: 8023904 - DNA, 22 bp, Homo sapiens
tggccacatctgaaatgagtgt

SEQ ID NO: 8023905 - DNA, 22 bp, Homo sapiens
tggccacatcctttccttgtca

SEQ ID NO: 8023906 - DNA, 22 bp, Homo sapiens
tggccacatctgaaatgagtgt

SEQ ID NO: 8023907 - DNA, 22 bp, Homo sapiens
tggccacatctgaaatgagtgt

SEQ ID NO: 8023908 - DNA, 22 bp, Homo sapiens
tggccacatgcgtctgtgaggc

SEQ ID NO: 8023909 - DNA, 22 bp, Homo sapiens
tggccacatatgtgggacagct

SEQ ID NO: 8023910 - DNA, 22 bp, Homo sapiens
tggccacatatgtgggacagct

SEQ ID NO: 8023911 - DNA, 22 bp, Homo sapiens
tggccacatatgtgggacagct

SEQ ID NO: 8023912 - DNA, 22 bp, Homo sapiens
tggccacatatgtgggacagct

SEQ ID NO: 8023913 - DNA, 22 bp, Homo sapiens
tggccacatgcgtctgtgaggc

SEQ ID NO: 8023914 - DNA, 22 bp, Homo sapiens
tggccacatgcgtctgtgaggc

SEQ ID NO: 8023915 - DNA, 22 bp, Homo sapiens
tggccaccaccaatacttgcct

SEQ ID NO: 8023916 - DNA, 22 bp, Homo sapiens
tggccacccagctgacgccttc

SEQ ID NO: 8023917 - DNA, 22 bp, Homo sapiens
tggccacccagctgacgccttc

SEQ ID NO: 8023918 - DNA, 22 bp, Homo sapiens
tggccacccctttctctgcact

SEQ ID NO: 8023919 - DNA, 22 bp, Homo sapiens
tggccacccctttctctgcact

SEQ ID NO: 8023920 - DNA, 22 bp, Homo sapiens
tggccaggtgtgggttctcaga

SEQ ID NO: 8023921 - DNA, 23 bp, Homo sapiens
tggccaggtagaggaggtagtga

SEQ ID NO: 8023922 - DNA, 23 bp, Homo sapiens
tggccaggtagaggaggtagtga

SEQ ID NO: 8023923 - DNA, 23 bp, Homo sapiens
tggccaggtagaggaggtagtga

SEQ ID NO: 8023924 - DNA, 23 bp, Homo sapiens
tggccaggtagaggaggtagtga

SEQ ID NO: 8023925 - DNA, 23 bp, Homo sapiens
tggccaggtagaggaggtagtga

SEQ ID NO: 8023926 - DNA, 19 bp, Homo sapiens
tggccaggtactgtctgct

SEQ ID NO: 8023927 - DNA, 23 bp, Homo sapiens
tggccaggtagaggaggtagtga

SEQ ID NO: 8023928 - DNA, 23 bp, Homo sapiens
tggccaggtagaggaggtagtga

SEQ ID NO: 8023929 - DNA, 19 bp, Homo sapiens
tggccaggtactgtctgct

SEQ ID NO: 8023930 - DNA, 22 bp, Homo sapiens
tggccaggttgggctttgcagc

SEQ ID NO: 8023931 - DNA, 22 bp, Homo sapiens
tggccaggtgtgggttctcaga

SEQ ID NO: 8023932 - DNA, 22 bp, Homo sapiens
tggccaggtgtgggttctcaga

SEQ ID NO: 8023933 - DNA, 22 bp, Homo sapiens
tggccaggtgtgggttctcaga

SEQ ID NO: 8023934 - DNA, 22 bp, Homo sapiens
tggccagtagataggcaggcaa

SEQ ID NO: 8023935 - DNA, 22 bp, Homo sapiens
tggccagtagataggcaggcaa

SEQ ID NO: 8023936 - DNA, 22 bp, Homo sapiens
tggccagtagagctcagatagt

SEQ ID NO: 8023937 - DNA, 22 bp, Homo sapiens
tggccagtaatagcttctggtg

SEQ ID NO: 8023938 - DNA, 22 bp, Homo sapiens
tggccaggctggtctggaacgc

SEQ ID NO: 8023939 - DNA, 22 bp, Homo sapiens
tggccaggctggtctggaacgc

SEQ ID NO: 8023940 - DNA, 22 bp, Homo sapiens
tggccaggctggtctggaacgc

SEQ ID NO: 8023941 - DNA, 22 bp, Homo sapiens
tggccaggggagttcccctcca

SEQ ID NO: 8023942 - DNA, 22 bp, Homo sapiens
tggccaggggagttcccctcca

SEQ ID NO: 8023943 - DNA, 22 bp, Homo sapiens
tggccaggggagttcccctcca

SEQ ID NO: 8023944 - DNA, 22 bp, Homo sapiens
tggccaggggagttcccctcca

SEQ ID NO: 8023945 - DNA, 22 bp, Homo sapiens
tggccaggctggtctggaacgc

SEQ ID NO: 8023946 - DNA, 22 bp, Homo sapiens
tggccaggcctcttggtgccca

SEQ ID NO: 8023947 - DNA, 22 bp, Homo sapiens
tggccaggcctcttggtgccca

SEQ ID NO: 8023948 - DNA, 22 bp, Homo sapiens
tggccaggcctcttggtgccca

SEQ ID NO: 8023949 - DNA, 22 bp, Homo sapiens
tggccaggctggtctggaacgc

SEQ ID NO: 8023950 - DNA, 22 bp, Homo sapiens
tggccaggctggtctggaacgc

SEQ ID NO: 8023951 - DNA, 22 bp, Homo sapiens
tggccaggctggtctggaacgc

SEQ ID NO: 8023952 - DNA, 23 bp, Homo sapiens
tggccagggtactacacccaccc

SEQ ID NO: 8023953 - DNA, 23 bp, Homo sapiens
tggccagggtactacacccaccc

SEQ ID NO: 8023954 - DNA, 23 bp, Homo sapiens
tggccagggtactacacccaccc

SEQ ID NO: 8023955 - DNA, 23 bp, Homo sapiens
tggccagggtactacacccaccc

SEQ ID NO: 8023956 - DNA, 23 bp, Homo sapiens
tggccagggtactacacccaccc

SEQ ID NO: 8023957 - DNA, 23 bp, Homo sapiens
tggccagggtactacacccaccc

SEQ ID NO: 8023958 - DNA, 19 bp, Homo sapiens
tggccaggtactgtctgct

SEQ ID NO: 8023959 - DNA, 19 bp, Homo sapiens
tggccaggtactgtctgct

SEQ ID NO: 8023960 - DNA, 19 bp, Homo sapiens
tggccaggtactgtctgct

SEQ ID NO: 8023961 - DNA, 19 bp, Homo sapiens
tggccaggtactgtctgct

SEQ ID NO: 8023962 - DNA, 19 bp, Homo sapiens
tggccaggtactgtctgct

SEQ ID NO: 8023963 - DNA, 19 bp, Homo sapiens
tggccaggtactgtctgct

SEQ ID NO: 8023964 - DNA, 19 bp, Homo sapiens
tggccaggtactgtctgct

SEQ ID NO: 8023965 - DNA, 17 bp, Homo sapiens
tggccaggccccgccag

SEQ ID NO: 8023966 - DNA, 17 bp, Homo sapiens
tggccaggccccgccag

SEQ ID NO: 8023967 - DNA, 22 bp, Homo sapiens
tggccaggcattcagataagac

SEQ ID NO: 8023968 - DNA, 22 bp, Homo sapiens
tggccaggccggggacagaact

SEQ ID NO: 8023969 - DNA, 22 bp, Homo sapiens
tggccaggccggggacagaact

SEQ ID NO: 8023970 - DNA, 22 bp, Homo sapiens
tggccaggccggggacagaact

SEQ ID NO: 8023971 - DNA, 22 bp, Homo sapiens
tggccaggccggggacagaact

SEQ ID NO: 8023972 - DNA, 22 bp, Homo sapiens
tggccaggccggggacagaact

SEQ ID NO: 8023973 - DNA, 22 bp, Homo sapiens
tggccaggccggggacagaact

SEQ ID NO: 8023974 - DNA, 22 bp, Homo sapiens
tggccaggccggggacagaact

SEQ ID NO: 8023975 - DNA, 22 bp, Homo sapiens
tggccaggccggggacagaact

SEQ ID NO: 8023976 - DNA, 22 bp, Homo sapiens
tggccaggcctcttggtgccca

SEQ ID NO: 8023977 - DNA, 22 bp, Homo sapiens
tggccaggcctcttggtgccca

SEQ ID NO: 8023978 - DNA, 22 bp, Homo sapiens
tggccaggcctcttggtgccca

SEQ ID NO: 8023979 - DNA, 22 bp, Homo sapiens
tggccaggccggggacagaact

SEQ ID NO: 8023980 - DNA, 22 bp, Homo sapiens
tggccaggccggggacagaact

SEQ ID NO: 8023981 - DNA, 21 bp, Homo sapiens
tggccagctggagtctccaca

SEQ ID NO: 8023982 - DNA, 22 bp, Homo sapiens
tggccaggcattcagataagac

SEQ ID NO: 8023983 - DNA, 21 bp, Homo sapiens
tggccagctgctcgtctcctc

SEQ ID NO: 8023984 - DNA, 21 bp, Homo sapiens
tggccagctggagtctccaca

SEQ ID NO: 8023985 - DNA, 21 bp, Homo sapiens
tggccagctggagtctccaca

SEQ ID NO: 8023986 - DNA, 21 bp, Homo sapiens
tggccagctggagtctccaca

SEQ ID NO: 8023987 - DNA, 21 bp, Homo sapiens
tggccagctgctcgtctcctc

SEQ ID NO: 8023988 - DNA, 21 bp, Homo sapiens
tggccagctgctcgtctcctc

SEQ ID NO: 8023989 - DNA, 21 bp, Homo sapiens
tggccagctgctcgtctcctc

SEQ ID NO: 8023990 - DNA, 22 bp, Homo sapiens
tggccagcctggtgcttgctcc

SEQ ID NO: 8023991 - DNA, 22 bp, Homo sapiens
tggccagcccttcagccatgcc

SEQ ID NO: 8023992 - DNA, 22 bp, Homo sapiens
tggccagcctggtgcttgctcc

SEQ ID NO: 8023993 - DNA, 22 bp, Homo sapiens
tggccagctgagatttagcaca

SEQ ID NO: 8023994 - DNA, 22 bp, Homo sapiens
tggccagccttgtcatcgcttt

SEQ ID NO: 8023995 - DNA, 22 bp, Homo sapiens
tggccagctgagatttagcaca

SEQ ID NO: 8023996 - DNA, 22 bp, Homo sapiens
tggccagccctcttcccacact

SEQ ID NO: 8023997 - DNA, 22 bp, Homo sapiens
tggccagccataaaagaaccca

SEQ ID NO: 8023998 - DNA, 22 bp, Homo sapiens
tggccagccctcttcccacact

SEQ ID NO: 8023999 - DNA, 22 bp, Homo sapiens
tggccagcccttcagccatgcc

SEQ ID NO: 8024000 - DNA, 22 bp, Homo sapiens
tggccagcccttcagccatgcc

SEQ ID NO: 8024001 - DNA, 22 bp, Homo sapiens
tggccagcccttcagccatgcc

SEQ ID NO: 8024002 - DNA, 22 bp, Homo sapiens
tggccagcccttcagccatgcc

SEQ ID NO: 8024003 - DNA, 22 bp, Homo sapiens
tggccagcccttcagccatgcc

SEQ ID NO: 8024004 - DNA, 22 bp, Homo sapiens
tggccagcccttcagccatgcc

SEQ ID NO: 8024005 - DNA, 22 bp, Homo sapiens
tggccagcccttcagccatgcc

SEQ ID NO: 8024006 - DNA, 22 bp, Homo sapiens
tggccagcacttagcccttacc

SEQ ID NO: 8024007 - DNA, 22 bp, Homo sapiens
tggccagcacttagcccttacc

SEQ ID NO: 8024008 - DNA, 23 bp, Homo sapiens
tggccagcagaagcaaggggagc

SEQ ID NO: 8024009 - DNA, 23 bp, Homo sapiens
tggccagcagaagcaaggggagc

SEQ ID NO: 8024010 - DNA, 23 bp, Homo sapiens
tggccagcagaagcaaggggagc

SEQ ID NO: 8024011 - DNA, 22 bp, Homo sapiens
tggccagattcatgcatgtatc

SEQ ID NO: 8024012 - DNA, 22 bp, Homo sapiens
tggccagagttgagggggtttc

SEQ ID NO: 8024013 - DNA, 22 bp, Homo sapiens
tggccagcagagttcactctct

SEQ ID NO: 8024014 - DNA, 22 bp, Homo sapiens
tggccagcagagttcactctct

SEQ ID NO: 8024015 - DNA, 22 bp, Homo sapiens
tggccagcagagttcactctct

SEQ ID NO: 8024016 - DNA, 22 bp, Homo sapiens
tggccagccagaaagaagcctt

SEQ ID NO: 8024017 - DNA, 22 bp, Homo sapiens
tggccagccacaatataaagta

SEQ ID NO: 8024018 - DNA, 22 bp, Homo sapiens
tggccagccagaaagaagcctt

SEQ ID NO: 8024019 - DNA, 22 bp, Homo sapiens
tggcagggtcttgctgtgttgc

SEQ ID NO: 8024020 - DNA, 22 bp, Homo sapiens
tggcagggtcttgctgtgttgc

SEQ ID NO: 8024021 - DNA, 22 bp, Homo sapiens
tggcagggtcttgctgtgttgc

SEQ ID NO: 8024022 - DNA, 22 bp, Homo sapiens
tggcagggtcttgctgtgttgc

SEQ ID NO: 8024023 - DNA, 22 bp, Homo sapiens
tggcagggtcttgctgtgttgc

SEQ ID NO: 8024024 - DNA, 22 bp, Homo sapiens
tggcagggtcttgctgtgttgc

SEQ ID NO: 8024025 - DNA, 22 bp, Homo sapiens
tggcagggtacaccttaacacc

SEQ ID NO: 8024026 - DNA, 22 bp, Homo sapiens
tggcagggtcttgctgtgttgc

SEQ ID NO: 8024027 - DNA, 22 bp, Homo sapiens
tggcagggtacaccttaacacc

SEQ ID NO: 8024028 - DNA, 22 bp, Homo sapiens
tggcaggtcatgagtggccacc

SEQ ID NO: 8024029 - DNA, 22 bp, Homo sapiens
tggcagggtggcaacttttggt

SEQ ID NO: 8024030 - DNA, 22 bp, Homo sapiens
tggcagggtgccagttgcgagt

SEQ ID NO: 8024031 - DNA, 22 bp, Homo sapiens
tggcagggtgccagttgcgagt

SEQ ID NO: 8024032 - DNA, 22 bp, Homo sapiens
tggcagggtgccagttgcgagt

SEQ ID NO: 8024033 - DNA, 22 bp, Homo sapiens
tggcagggtgccagttgcgagt

SEQ ID NO: 8024034 - DNA, 22 bp, Homo sapiens
tggcagggtgccagttgcgagt

SEQ ID NO: 8024035 - DNA, 18 bp, Homo sapiens
tggcaggtccagctgtgg

SEQ ID NO: 8024036 - DNA, 22 bp, Homo sapiens
tggcaggtgaagttgttaggga

SEQ ID NO: 8024037 - DNA, 22 bp, Homo sapiens
tggcaggtccactcacagatct

SEQ ID NO: 8024038 - DNA, 22 bp, Homo sapiens
tggcaggtccactcacagatct

SEQ ID NO: 8024039 - DNA, 22 bp, Homo sapiens
tggcaggtgccatgggctcaga

SEQ ID NO: 8024040 - DNA, 22 bp, Homo sapiens
tggcaggtgaagttgttaggga

SEQ ID NO: 8024041 - DNA, 22 bp, Homo sapiens
tggcaggtggcacagcctggga

SEQ ID NO: 8024042 - DNA, 22 bp, Homo sapiens
tggcaggtggcacagcctggga

SEQ ID NO: 8024043 - DNA, 20 bp, Homo sapiens
tggcaggtggcctcagttcc

SEQ ID NO: 8024044 - DNA, 22 bp, Homo sapiens
tggcaggtggagacagcagagc

SEQ ID NO: 8024045 - DNA, 18 bp, Homo sapiens
tggcagtgaggtaggcat

SEQ ID NO: 8024046 - DNA, 18 bp, Homo sapiens
tggcagtgaggtaggcat

SEQ ID NO: 8024047 - DNA, 22 bp, Homo sapiens
tggcagtgaagctgtctttagg

SEQ ID NO: 8024048 - DNA, 22 bp, Homo sapiens
tggcagtgaagctgtctttagg

SEQ ID NO: 8024049 - DNA, 22 bp, Homo sapiens
tggcagtgaaccaaggctccaa

SEQ ID NO: 8024050 - DNA, 22 bp, Homo sapiens
tggcagtgaaagacaattgggc

SEQ ID NO: 8024051 - DNA, 22 bp, Homo sapiens
tggcagtgaaagacaattgggc

SEQ ID NO: 8024052 - DNA, 22 bp, Homo sapiens
tggcagtgaaagacaattgggc

SEQ ID NO: 8024053 - DNA, 22 bp, Homo sapiens
tggcagtcttgtaggcatctcc

SEQ ID NO: 8024054 - DNA, 22 bp, Homo sapiens
tggcagtcttgtaggcatctcc

SEQ ID NO: 8024055 - DNA, 22 bp, Homo sapiens
tggcagtcttcatcagttctgg

SEQ ID NO: 8024056 - DNA, 22 bp, Homo sapiens
tggcagtcttcatcagttctgg

SEQ ID NO: 8024057 - DNA, 22 bp, Homo sapiens
tggcagtcttgctctctaagag

SEQ ID NO: 8024058 - DNA, 22 bp, Homo sapiens
tggcagtcttgctctctaagag

SEQ ID NO: 8024059 - DNA, 22 bp, Homo sapiens
tggcagtgccccttgaccagtg

SEQ ID NO: 8024060 - DNA, 22 bp, Homo sapiens
tggcagtgccccttgaccagtg

SEQ ID NO: 8024061 - DNA, 23 bp, Homo sapiens
tggcagtgcccagggagatgatc

SEQ ID NO: 8024062 - DNA, 22 bp, Homo sapiens
tggcagtgatgcggcaggacat

SEQ ID NO: 8024063 - DNA, 23 bp, Homo sapiens
tggcagtgcccagggagatgatc

SEQ ID NO: 8024064 - DNA, 22 bp, Homo sapiens
tggcagtgatgcttatggtttg

SEQ ID NO: 8024065 - DNA, 18 bp, Homo sapiens
tggcagtgccaccttctc

SEQ ID NO: 8024066 - DNA, 22 bp, Homo sapiens
tggcagtgatgcggcaggacat

SEQ ID NO: 8024067 - DNA, 22 bp, Homo sapiens
tggcagtgatgcggcaggacat

SEQ ID NO: 8024068 - DNA, 22 bp, Homo sapiens
tggcagtgatgcggcaggacat

SEQ ID NO: 8024069 - DNA, 22 bp, Homo sapiens
tggcagtgatgcggcaggacat

SEQ ID NO: 8024070 - DNA, 22 bp, Homo sapiens
tggcagtgatgcggcaggacat

SEQ ID NO: 8024071 - DNA, 22 bp, Homo sapiens
tggcagtgatgcggcaggacat

SEQ ID NO: 8024072 - DNA, 22 bp, Homo sapiens
tggcagtctgcctcttcaccat

SEQ ID NO: 8024073 - DNA, 22 bp, Homo sapiens
tggcagtctgcctcttcaccat

SEQ ID NO: 8024074 - DNA, 22 bp, Homo sapiens
tggcagtctgggttggcagtta

SEQ ID NO: 8024075 - DNA, 22 bp, Homo sapiens
tggcagtctgggttggcagtta

SEQ ID NO: 8024076 - DNA, 22 bp, Homo sapiens
tggcagtctgggttggcagtta

SEQ ID NO: 8024077 - DNA, 22 bp, Homo sapiens
tggcagtcggacttctatctca

SEQ ID NO: 8024078 - DNA, 22 bp, Homo sapiens
tggcagtcgatcatattcagca

SEQ ID NO: 8024079 - DNA, 22 bp, Homo sapiens
tggcagtcgatcatattcagca

SEQ ID NO: 8024080 - DNA, 22 bp, Homo sapiens
tggcagtcctcttcctcgggcg

SEQ ID NO: 8024081 - DNA, 22 bp, Homo sapiens
tggcagtagatccagtctctct

SEQ ID NO: 8024082 - DNA, 22 bp, Homo sapiens
tggcagtccctctggtagcacc

SEQ ID NO: 8024083 - DNA, 22 bp, Homo sapiens
tggcagtccctctggtagcacc

SEQ ID NO: 8024084 - DNA, 22 bp, Homo sapiens
tggcagtccctctggtagcacc

SEQ ID NO: 8024085 - DNA, 22 bp, Homo sapiens
tggcagtcccctgtgcctggaa

SEQ ID NO: 8024086 - DNA, 22 bp, Homo sapiens
tggcagtcccctgtgcctggaa

SEQ ID NO: 8024087 - DNA, 22 bp, Homo sapiens
tggcagtcccctgtgcctggaa

SEQ ID NO: 8024088 - DNA, 22 bp, Homo sapiens
tggcagtccagaccctggactc

SEQ ID NO: 8024089 - DNA, 22 bp, Homo sapiens
tggcagtccagaccctggactc

SEQ ID NO: 8024090 - DNA, 22 bp, Homo sapiens
tggcagtcagcatttgtagtat

SEQ ID NO: 8024091 - DNA, 22 bp, Homo sapiens
tggcagtcagcatttgtagtat

SEQ ID NO: 8024092 - DNA, 22 bp, Homo sapiens
tggcagtcattatcgctgagtc

SEQ ID NO: 8024093 - DNA, 22 bp, Homo sapiens
tggcagtccagaccctggactc

SEQ ID NO: 8024094 - DNA, 22 bp, Homo sapiens
tggcaggtttcgttaaaaatgg

SEQ ID NO: 8024095 - DNA, 22 bp, Homo sapiens
tggcagtgttgtgccacattcc

SEQ ID NO: 8024096 - DNA, 19 bp, Homo sapiens
tggcagtgtggggtatgaa

SEQ ID NO: 8024097 - DNA, 22 bp, Homo sapiens
tggcagtgtttctaaggggctc

SEQ ID NO: 8024098 - DNA, 22 bp, Homo sapiens
tggcagtgtttctaaggggctc

SEQ ID NO: 8024099 - DNA, 22 bp, Homo sapiens
tggcagtgtttctaaggggctc

SEQ ID NO: 8024100 - DNA, 22 bp, Homo sapiens
tggcagtgttgtgccacattcc

SEQ ID NO: 8024101 - DNA, 19 bp, Homo sapiens
tggcagtgtggggtatgaa

SEQ ID NO: 8024102 - DNA, 22 bp, Homo sapiens
tggcagtggctcagagtgcaga

SEQ ID NO: 8024103 - DNA, 22 bp, Homo sapiens
tggcagtggcgggactcagggc

SEQ ID NO: 8024104 - DNA, 22 bp, Homo sapiens
tggcagtggctcagagtgcaga

SEQ ID NO: 8024105 - DNA, 22 bp, Homo sapiens
tggcagtggctcagagtgcaga

SEQ ID NO: 8024106 - DNA, 22 bp, Homo sapiens
tggcagtggataggggagcggt

SEQ ID NO: 8024107 - DNA, 22 bp, Homo sapiens
tggcagtggcactgcccccata

SEQ ID NO: 8024108 - DNA, 22 bp, Homo sapiens
tggcagtggcatcaccccaata

SEQ ID NO: 8024109 - DNA, 22 bp, Homo sapiens
tggcagtggcatcaccccaata

SEQ ID NO: 8024110 - DNA, 22 bp, Homo sapiens
tggcagtggcgggactcagggc

SEQ ID NO: 8024111 - DNA, 22 bp, Homo sapiens
tggcagtggcatcaccccaata

SEQ ID NO: 8024112 - DNA, 22 bp, Homo sapiens
tggcagtggcgggactcagggc

SEQ ID NO: 8024113 - DNA, 22 bp, Homo sapiens
tggcagtggcgggactcagggc

SEQ ID NO: 8024114 - DNA, 22 bp, Homo sapiens
tggcagtggctcagagtgcaga

SEQ ID NO: 8024115 - DNA, 22 bp, Homo sapiens
tggcagtggataggggagcggt

SEQ ID NO: 8024116 - DNA, 22 bp, Homo sapiens
tggcagtggataggggagcggt

SEQ ID NO: 8024117 - DNA, 22 bp, Homo sapiens
tggcagtggataggggagcggt

SEQ ID NO: 8024118 - DNA, 22 bp, Homo sapiens
tggcagtgccccttgaccagtg

SEQ ID NO: 8024119 - DNA, 22 bp, Homo sapiens
tggcagtgctgcagtgccctta

SEQ ID NO: 8024120 - DNA, 23 bp, Homo sapiens
tggcatagtgaggggcacagaga

SEQ ID NO: 8024121 - DNA, 23 bp, Homo sapiens
tggcatagtgaggggcacagaga

SEQ ID NO: 8024122 - DNA, 22 bp, Homo sapiens
tggcatataaagatgtgttcaa

SEQ ID NO: 8024123 - DNA, 22 bp, Homo sapiens
tggcatcatagccaaggtgctt

SEQ ID NO: 8024124 - DNA, 22 bp, Homo sapiens
tggcatcattttcagctggcca

SEQ ID NO: 8024125 - DNA, 22 bp, Homo sapiens
tggcatccaacggctcgctttc

SEQ ID NO: 8024126 - DNA, 22 bp, Homo sapiens
tggcatccacaaatgcttagat

SEQ ID NO: 8024127 - DNA, 22 bp, Homo sapiens
tggcatccagataccctgaggg

SEQ ID NO: 8024128 - DNA, 19 bp, Homo sapiens
tggcatcccagtaaagctt

SEQ ID NO: 8024129 - DNA, 22 bp, Homo sapiens
tggcatcccttcccacccttta

SEQ ID NO: 8024130 - DNA, 18 bp, Homo sapiens
tggcatcccttctcttac

SEQ ID NO: 8024131 - DNA, 22 bp, Homo sapiens
tggcatccaggtcctcacatgg

SEQ ID NO: 8024132 - DNA, 23 bp, Homo sapiens
tggcatccatttttgtacaacct

SEQ ID NO: 8024133 - DNA, 19 bp, Homo sapiens
tggcatcccagtaaagctt

SEQ ID NO: 8024134 - DNA, 22 bp, Homo sapiens
tggcatcctccctcaagctgaa

SEQ ID NO: 8024135 - DNA, 22 bp, Homo sapiens
tggcatcctccctcaagctgaa

SEQ ID NO: 8024136 - DNA, 22 bp, Homo sapiens
tggcatcctttatctgcaggct

SEQ ID NO: 8024137 - DNA, 21 bp, Homo sapiens
tggcatcctcttctcctttcc

SEQ ID NO: 8024138 - DNA, 22 bp, Homo sapiens
tggcatcctttatctgcaggct

SEQ ID NO: 8024139 - DNA, 22 bp, Homo sapiens
tggcagttgagttactgggtga

SEQ ID NO: 8024140 - DNA, 22 bp, Homo sapiens
tggcagttcaggctgcaatcat

SEQ ID NO: 8024141 - DNA, 22 bp, Homo sapiens
tggcagttgtgaggttcatatt

SEQ ID NO: 8024142 - DNA, 22 bp, Homo sapiens
tggcagttttgtatttgagcat

SEQ ID NO: 8024143 - DNA, 23 bp, Homo sapiens
tggcatagtgaggggcacagaga

SEQ ID NO: 8024144 - DNA, 18 bp, Homo sapiens
tggcataaaatcagagtc

SEQ ID NO: 8024145 - DNA, 22 bp, Homo sapiens
tggcatctccgacagtcttgat

SEQ ID NO: 8024146 - DNA, 22 bp, Homo sapiens
tggcatctccgacagtcttgat

SEQ ID NO: 8024147 - DNA, 22 bp, Homo sapiens
tggcatctccgacagtcttgat

SEQ ID NO: 8024148 - DNA, 22 bp, Homo sapiens
tggcatcgggccaccccatccc

SEQ ID NO: 8024149 - DNA, 22 bp, Homo sapiens
tggcatctcaaacaggcagatt

SEQ ID NO: 8024150 - DNA, 23 bp, Homo sapiens
tggcatcttggcatcttgctgct

SEQ ID NO: 8024151 - DNA, 23 bp, Homo sapiens
tggcatcttggcatcttgctgct

SEQ ID NO: 8024152 - DNA, 22 bp, Homo sapiens
tggcatgaagtcagcagctggg

SEQ ID NO: 8024153 - DNA, 22 bp, Homo sapiens
tggcatgaagtcagcagctggg

SEQ ID NO: 8024154 - DNA, 22 bp, Homo sapiens
tggcatctttgtcccagaagct

SEQ ID NO: 8024155 - DNA, 22 bp, Homo sapiens
tggcatctttgtcccagaagct

SEQ ID NO: 8024156 - DNA, 22 bp, Homo sapiens
tggcatgaagtcagcagctggg

SEQ ID NO: 8024157 - DNA, 17 bp, Homo sapiens
tggcatgagggtgtggg

SEQ ID NO: 8024158 - DNA, 22 bp, Homo sapiens
tggcatgataggaggtgcagaa

SEQ ID NO: 8024159 - DNA, 22 bp, Homo sapiens
tggcatgagtataggcttctca

SEQ ID NO: 8024160 - DNA, 17 bp, Homo sapiens
tggcatgagggtgtggg

SEQ ID NO: 8024161 - DNA, 22 bp, Homo sapiens
tggcatgcaagaggaggctccc

SEQ ID NO: 8024162 - DNA, 22 bp, Homo sapiens
tggcatgcaagaggaggctccc

SEQ ID NO: 8024163 - DNA, 22 bp, Homo sapiens
tggcatgataggaggtgcagaa

SEQ ID NO: 8024164 - DNA, 22 bp, Homo sapiens
tggcatgccttgtcagacagtg

SEQ ID NO: 8024165 - DNA, 22 bp, Homo sapiens
tggcatgcatctgttgtcctag

SEQ ID NO: 8024166 - DNA, 22 bp, Homo sapiens
tggcatggaccttggaagaatt

SEQ ID NO: 8024167 - DNA, 22 bp, Homo sapiens
tggcatggaccttggaagaatt

SEQ ID NO: 8024168 - DNA, 22 bp, Homo sapiens
tggcatggactagtgctgaggt

SEQ ID NO: 8024169 - DNA, 22 bp, Homo sapiens
tggcatggactagtgctgaggt

SEQ ID NO: 8024170 - DNA, 22 bp, Homo sapiens
tggcatggactagtgctgaggt

SEQ ID NO: 8024171 - DNA, 22 bp, Homo sapiens
tggcatggactagtgctgaggt

SEQ ID NO: 8024172 - DNA, 22 bp, Homo sapiens
tggcatggactagtgctgaggt

SEQ ID NO: 8024173 - DNA, 22 bp, Homo sapiens
tggcatggactagtgctgaggt

SEQ ID NO: 8024174 - DNA, 21 bp, Homo sapiens
tggcatggaggtagcagtgtg

SEQ ID NO: 8024175 - DNA, 21 bp, Homo sapiens
tggcatggaggtagcagtgtg

SEQ ID NO: 8024176 - DNA, 21 bp, Homo sapiens
tggcatggaggtagcagtgtg

SEQ ID NO: 8024177 - DNA, 21 bp, Homo sapiens
tggcatggaggtagcagtgtg

SEQ ID NO: 8024178 - DNA, 21 bp, Homo sapiens
tggcatggaggtagcagtgtg

SEQ ID NO: 8024179 - DNA, 22 bp, Homo sapiens
tggcatggcatttagagaatta

SEQ ID NO: 8024180 - DNA, 22 bp, Homo sapiens
tggcatggcaaccctgcaggga

SEQ ID NO: 8024181 - DNA, 22 bp, Homo sapiens
tggcatggcaaccctgcaggga

SEQ ID NO: 8024182 - DNA, 22 bp, Homo sapiens
tggcatggccagtgctgggagt

SEQ ID NO: 8024183 - DNA, 22 bp, Homo sapiens
tggcatggcatttagagaatta

SEQ ID NO: 8024184 - DNA, 22 bp, Homo sapiens
tggcatggcatttagagaatta

SEQ ID NO: 8024185 - DNA, 22 bp, Homo sapiens
tggcatggcaaccctgcaggga

SEQ ID NO: 8024186 - DNA, 22 bp, Homo sapiens
tggcatggcaaccctgcaggga

SEQ ID NO: 8024187 - DNA, 22 bp, Homo sapiens
tggcatggcaaccctgcaggga

SEQ ID NO: 8024188 - DNA, 22 bp, Homo sapiens
tggcatggcaaccctgcaggga

SEQ ID NO: 8024189 - DNA, 22 bp, Homo sapiens
tggcatgggtggagagagcaca

SEQ ID NO: 8024190 - DNA, 22 bp, Homo sapiens
tggcatgggtggagagagcaca

SEQ ID NO: 8024191 - DNA, 22 bp, Homo sapiens
tggcatgggtggagagagcaca

SEQ ID NO: 8024192 - DNA, 22 bp, Homo sapiens
tggcatgggcaaaccagggaaa

SEQ ID NO: 8024193 - DNA, 22 bp, Homo sapiens
tggcatgggcaaaccagggaaa

SEQ ID NO: 8024194 - DNA, 22 bp, Homo sapiens
tggcatgggcaaaccagggaaa

SEQ ID NO: 8024195 - DNA, 22 bp, Homo sapiens
tggcatgggccagggagagctg

SEQ ID NO: 8024196 - DNA, 22 bp, Homo sapiens
tggcatgggccagggagagctg

SEQ ID NO: 8024197 - DNA, 22 bp, Homo sapiens
tggcatggccagtgctgggagt

SEQ ID NO: 8024198 - DNA, 22 bp, Homo sapiens
tggcatggcgtggcatcgtgtg

SEQ ID NO: 8024199 - DNA, 22 bp, Homo sapiens
tggcatggcgtggcatcgtgtg

SEQ ID NO: 8024200 - DNA, 22 bp, Homo sapiens
tggcatgggcaaaccagggaaa

SEQ ID NO: 8024201 - DNA, 22 bp, Homo sapiens
tggcatgggcaaaccagggaaa

SEQ ID NO: 8024202 - DNA, 22 bp, Homo sapiens
tggcatggctactggaatggcg

SEQ ID NO: 8024203 - DNA, 22 bp, Homo sapiens
tggcatggctactggaatggcg

SEQ ID NO: 8024204 - DNA, 22 bp, Homo sapiens
tggccctgcacccagagcagtt

SEQ ID NO: 8024205 - DNA, 22 bp, Homo sapiens
tggccctgcacccagagcagtt

SEQ ID NO: 8024206 - DNA, 22 bp, Homo sapiens
tggccctgcacccagagcagtt

SEQ ID NO: 8024207 - DNA, 22 bp, Homo sapiens
tggccctgcacccagagcagtt

SEQ ID NO: 8024208 - DNA, 22 bp, Homo sapiens
tggccctgcacccagagcagtt

SEQ ID NO: 8024209 - DNA, 22 bp, Homo sapiens
tggccctgcagaactagcctgg

SEQ ID NO: 8024210 - DNA, 22 bp, Homo sapiens
tggccctgcagaactagcctgg

SEQ ID NO: 8024211 - DNA, 22 bp, Homo sapiens
tggccctgcagaactagcctgg

SEQ ID NO: 8024212 - DNA, 22 bp, Homo sapiens
tggccctgcagaactagcctgg

SEQ ID NO: 8024213 - DNA, 22 bp, Homo sapiens
tggccctgcagaactagcctgg

SEQ ID NO: 8024214 - DNA, 22 bp, Homo sapiens
tggccctgccactcactgctga

SEQ ID NO: 8024215 - DNA, 22 bp, Homo sapiens
tggccctgaggggctgtgcccc

SEQ ID NO: 8024216 - DNA, 22 bp, Homo sapiens
tggccctgaggggctgtgcccc

SEQ ID NO: 8024217 - DNA, 22 bp, Homo sapiens
tggccctgaggggctgtgcccc

SEQ ID NO: 8024218 - DNA, 22 bp, Homo sapiens
tggccctgaggggctgtgcccc

SEQ ID NO: 8024219 - DNA, 22 bp, Homo sapiens
tggccctgaggggctgtgcccc

SEQ ID NO: 8024220 - DNA, 22 bp, Homo sapiens
tggccctgcacccagagcagtt

SEQ ID NO: 8024221 - DNA, 22 bp, Homo sapiens
tggccctgcacccagagcagtt

SEQ ID NO: 8024222 - DNA, 22 bp, Homo sapiens
tggccctgaggacccagtgtgg

SEQ ID NO: 8024223 - DNA, 22 bp, Homo sapiens
tggccctgagggctcggagcca

SEQ ID NO: 8024224 - DNA, 22 bp, Homo sapiens
tggccctgaggacccagtgtgg

SEQ ID NO: 8024225 - DNA, 22 bp, Homo sapiens
tggccctgagggctcggagcca

SEQ ID NO: 8024226 - DNA, 22 bp, Homo sapiens
tggccctgaggggctgtgcccc

SEQ ID NO: 8024227 - DNA, 22 bp, Homo sapiens
tggccctgagggctcggagcca

SEQ ID NO: 8024228 - DNA, 22 bp, Homo sapiens
tggccctgagggctcggagcca

SEQ ID NO: 8024229 - DNA, 22 bp, Homo sapiens
tggccctgactgatgtggaggg

SEQ ID NO: 8024230 - DNA, 22 bp, Homo sapiens
tggccctgactgatgtggaggg

SEQ ID NO: 8024231 - DNA, 22 bp, Homo sapiens
tggccctgacaggtcctgggca

SEQ ID NO: 8024232 - DNA, 22 bp, Homo sapiens
tggccctgacaggtcctgggca

SEQ ID NO: 8024233 - DNA, 22 bp, Homo sapiens
tggccctgacaggtcctgggca

SEQ ID NO: 8024234 - DNA, 22 bp, Homo sapiens
tggccctgacacgtggtactgg

SEQ ID NO: 8024235 - DNA, 22 bp, Homo sapiens
tggccctgacaggtcctgggca

SEQ ID NO: 8024236 - DNA, 22 bp, Homo sapiens
tggccctgacaggtcctgggca

SEQ ID NO: 8024237 - DNA, 22 bp, Homo sapiens
tggccctgacaggtcctgggca

SEQ ID NO: 8024238 - DNA, 22 bp, Homo sapiens
tggccctgacaggtcctgggca

SEQ ID NO: 8024239 - DNA, 22 bp, Homo sapiens
tggccctgacacgtggtactgg

SEQ ID NO: 8024240 - DNA, 22 bp, Homo sapiens
tggccctgaggacccagtgtgg

SEQ ID NO: 8024241 - DNA, 22 bp, Homo sapiens
tggccctgacttggaggcctga

SEQ ID NO: 8024242 - DNA, 22 bp, Homo sapiens
tggccctgaggacccagtgtgg

SEQ ID NO: 8024243 - DNA, 22 bp, Homo sapiens
tggccctgactgatgtggaggg

SEQ ID NO: 8024244 - DNA, 22 bp, Homo sapiens
tggccctgacttggaggcctga

SEQ ID NO: 8024245 - DNA, 22 bp, Homo sapiens
tggccctgacttggaggcctga

SEQ ID NO: 8024246 - DNA, 22 bp, Homo sapiens
tggccctgacttggaggcctga

SEQ ID NO: 8024247 - DNA, 22 bp, Homo sapiens
tggccctgacttggaggcctga

SEQ ID NO: 8024248 - DNA, 22 bp, Homo sapiens
tggccctgacttggaggcctga

SEQ ID NO: 8024249 - DNA, 22 bp, Homo sapiens
tggccctctgcaagattctgga

SEQ ID NO: 8024250 - DNA, 22 bp, Homo sapiens
tggccctgaaggccttgagcat

SEQ ID NO: 8024251 - DNA, 22 bp, Homo sapiens
tggccctgaaggccttgagcat

SEQ ID NO: 8024252 - DNA, 22 bp, Homo sapiens
tggccctgaaggccttgagcat

SEQ ID NO: 8024253 - DNA, 22 bp, Homo sapiens
tggccctcgtccgacaggtggg

SEQ ID NO: 8024254 - DNA, 22 bp, Homo sapiens
tggccctcgtccgacaggtggg

SEQ ID NO: 8024255 - DNA, 22 bp, Homo sapiens
tggccctcagtcttgctcctgc

SEQ ID NO: 8024256 - DNA, 22 bp, Homo sapiens
tggccctcgtccgacaggtggg

SEQ ID NO: 8024257 - DNA, 22 bp, Homo sapiens
tggccctcgtccgacaggtggg

SEQ ID NO: 8024258 - DNA, 22 bp, Homo sapiens
tggccctatttggaaatagagc

SEQ ID NO: 8024259 - DNA, 22 bp, Homo sapiens
tggccctcagcactgagacctt

SEQ ID NO: 8024260 - DNA, 17 bp, Homo sapiens
tggccctagactccagc

SEQ ID NO: 8024261 - DNA, 23 bp, Homo sapiens
tggcccgggctcagaggcagtgc

SEQ ID NO: 8024262 - DNA, 22 bp, Homo sapiens
tggccctcagtcttgctcctgc

SEQ ID NO: 8024263 - DNA, 22 bp, Homo sapiens
tggccctcagtcttgctcctgc

SEQ ID NO: 8024264 - DNA, 22 bp, Homo sapiens
tggccctcagcactgagacctt

SEQ ID NO: 8024265 - DNA, 23 bp, Homo sapiens
tggccctgaatctgtcctggagg

SEQ ID NO: 8024266 - DNA, 22 bp, Homo sapiens
tggccctgaatcaaggccagca

SEQ ID NO: 8024267 - DNA, 23 bp, Homo sapiens
tggccctgaatctgtcctggagg

SEQ ID NO: 8024268 - DNA, 23 bp, Homo sapiens
tggccctgaatctgtcctggagg

SEQ ID NO: 8024269 - DNA, 23 bp, Homo sapiens
tggccctgaatctgtcctggagg

SEQ ID NO: 8024270 - DNA, 22 bp, Homo sapiens
tggccctgacacgtggtactgg

SEQ ID NO: 8024271 - DNA, 23 bp, Homo sapiens
tggccctgaatctgtcctggagg

SEQ ID NO: 8024272 - DNA, 22 bp, Homo sapiens
tggccctgaatcaaggccagca

SEQ ID NO: 8024273 - DNA, 22 bp, Homo sapiens
tggccctgaatcaaggccagca

SEQ ID NO: 8024274 - DNA, 22 bp, Homo sapiens
tggccctgaaggccttgagcat

SEQ ID NO: 8024275 - DNA, 22 bp, Homo sapiens
tggccctgaatcaaggccagca

SEQ ID NO: 8024276 - DNA, 22 bp, Homo sapiens
tggccctgaatcaaggccagca

SEQ ID NO: 8024277 - DNA, 22 bp, Homo sapiens
tggccctgaatcaaggccagca

SEQ ID NO: 8024278 - DNA, 22 bp, Homo sapiens
tggccctgaatcaaggccagca

SEQ ID NO: 8024279 - DNA, 22 bp, Homo sapiens
tggcccaggtgcacccagaggc

SEQ ID NO: 8024280 - DNA, 22 bp, Homo sapiens
tggcccaggtgcacccagaggc

SEQ ID NO: 8024281 - DNA, 22 bp, Homo sapiens
tggcccaggtgcacccagaggc

SEQ ID NO: 8024282 - DNA, 22 bp, Homo sapiens
tggcccagtagaaaagggatcg

SEQ ID NO: 8024283 - DNA, 22 bp, Homo sapiens
tggcccagtagaaaagggatcg

SEQ ID NO: 8024284 - DNA, 22 bp, Homo sapiens
tggcccaggtgcacccagaggc

SEQ ID NO: 8024285 - DNA, 22 bp, Homo sapiens
tggcccaggtgcacccagaggc

SEQ ID NO: 8024286 - DNA, 22 bp, Homo sapiens
tggcccaggtgcaagagacaga

SEQ ID NO: 8024287 - DNA, 22 bp, Homo sapiens
tggcccaggtgcaagagacaga

SEQ ID NO: 8024288 - DNA, 22 bp, Homo sapiens
tggcccaggtgcaagagacaga

SEQ ID NO: 8024289 - DNA, 22 bp, Homo sapiens
tggcccaggtgcaagagacaga

SEQ ID NO: 8024290 - DNA, 22 bp, Homo sapiens
tggcccaggtgcaagagacaga

SEQ ID NO: 8024291 - DNA, 22 bp, Homo sapiens
tggcccaggtgcacccagaggc

SEQ ID NO: 8024292 - DNA, 22 bp, Homo sapiens
tggcccaggtgcaagagacaga

SEQ ID NO: 8024293 - DNA, 22 bp, Homo sapiens
tggcccagtatgtataatctta

SEQ ID NO: 8024294 - DNA, 22 bp, Homo sapiens
tggcccagtatgtataatctta

SEQ ID NO: 8024295 - DNA, 22 bp, Homo sapiens
tggcccagtatgtataatctta

SEQ ID NO: 8024296 - DNA, 22 bp, Homo sapiens
tggcccagtagaaaagggatcg

SEQ ID NO: 8024297 - DNA, 22 bp, Homo sapiens
tggcccagtatgtataatctta

SEQ ID NO: 8024298 - DNA, 22 bp, Homo sapiens
tggcccagtcagcaggagaggg

SEQ ID NO: 8024299 - DNA, 22 bp, Homo sapiens
tggcccagtcagcaggagaggg

SEQ ID NO: 8024300 - DNA, 22 bp, Homo sapiens
tggcccagtcagcaggagaggg

SEQ ID NO: 8024301 - DNA, 22 bp, Homo sapiens
tggcccagtcagcaggagaggg

SEQ ID NO: 8024302 - DNA, 22 bp, Homo sapiens
tggcccgccggaagaagatgtc

SEQ ID NO: 8024303 - DNA, 22 bp, Homo sapiens
tggcccagtcagcaggagaggg

SEQ ID NO: 8024304 - DNA, 22 bp, Homo sapiens
tggcccagtgcttatgctctga

SEQ ID NO: 8024305 - DNA, 22 bp, Homo sapiens
tggcccggctctgagctgtgct

SEQ ID NO: 8024306 - DNA, 22 bp, Homo sapiens
tggcccagtcagcaggagaggg

SEQ ID NO: 8024307 - DNA, 22 bp, Homo sapiens
tggcccagtcagcaggagaggg

SEQ ID NO: 8024308 - DNA, 22 bp, Homo sapiens
tggcccagtcagcaggagaggg

SEQ ID NO: 8024309 - DNA, 22 bp, Homo sapiens
tggccatgaaggaggcagcaga

SEQ ID NO: 8024310 - DNA, 22 bp, Homo sapiens
tggccagtttgctcaggcagtc

SEQ ID NO: 8024311 - DNA, 22 bp, Homo sapiens
tggccatgaaggaggcagcaga

SEQ ID NO: 8024312 - DNA, 22 bp, Homo sapiens
tggccatgaaggaggcagcaga

SEQ ID NO: 8024313 - DNA, 22 bp, Homo sapiens
tggccatgaaggaggcagcaga

SEQ ID NO: 8024314 - DNA, 22 bp, Homo sapiens
tggccagtgttggctagggaca

SEQ ID NO: 8024315 - DNA, 22 bp, Homo sapiens
tggccagtttgctcaggcagtc

SEQ ID NO: 8024316 - DNA, 22 bp, Homo sapiens
tggccagtttgctcaggcagtc

SEQ ID NO: 8024317 - DNA, 22 bp, Homo sapiens
tggccagtttgctcaggcagtc

SEQ ID NO: 8024318 - DNA, 22 bp, Homo sapiens
tggccagtttgctcaggcagtc

SEQ ID NO: 8024319 - DNA, 22 bp, Homo sapiens
tggcccaaagcagcccagcagg

SEQ ID NO: 8024320 - DNA, 22 bp, Homo sapiens
tggccatttactctgtaagagt

SEQ ID NO: 8024321 - DNA, 22 bp, Homo sapiens
tggccatgggatagtgcagggg

SEQ ID NO: 8024322 - DNA, 22 bp, Homo sapiens
tggccatgggatagtgcagggg

SEQ ID NO: 8024323 - DNA, 22 bp, Homo sapiens
tggccatgaaggaggcagcaga

SEQ ID NO: 8024324 - DNA, 22 bp, Homo sapiens
tggccatgacatggaggctttg

SEQ ID NO: 8024325 - DNA, 22 bp, Homo sapiens
tggccatgacatggaggctttg

SEQ ID NO: 8024326 - DNA, 22 bp, Homo sapiens
tggccatgggatagtgcagggg

SEQ ID NO: 8024327 - DNA, 22 bp, Homo sapiens
tggccatgggatagtgcagggg

SEQ ID NO: 8024328 - DNA, 22 bp, Homo sapiens
tggccagtggactaagttctga

SEQ ID NO: 8024329 - DNA, 22 bp, Homo sapiens
tggccagtggggttgagcagga

SEQ ID NO: 8024330 - DNA, 22 bp, Homo sapiens
tggccagtggggttgagcagga

SEQ ID NO: 8024331 - DNA, 22 bp, Homo sapiens
tggccagtgcctgccagtgcag

SEQ ID NO: 8024332 - DNA, 22 bp, Homo sapiens
tggccagtgtgtgctgccggct

SEQ ID NO: 8024333 - DNA, 22 bp, Homo sapiens
tggccagtgttggctagggaca

SEQ ID NO: 8024334 - DNA, 22 bp, Homo sapiens
tggccagtggggttgagcagga

SEQ ID NO: 8024335 - DNA, 22 bp, Homo sapiens
tggccagtgtcggaggccagga

SEQ ID NO: 8024336 - DNA, 22 bp, Homo sapiens
tggccagtgtcggaggccagga

SEQ ID NO: 8024337 - DNA, 22 bp, Homo sapiens
tggcccagactctgctcttatc

SEQ ID NO: 8024338 - DNA, 22 bp, Homo sapiens
tggcccagactctgctcttatc

SEQ ID NO: 8024339 - DNA, 22 bp, Homo sapiens
tggcccagactctgctcttatc

SEQ ID NO: 8024340 - DNA, 22 bp, Homo sapiens
tggcccagagcactgctgggca

SEQ ID NO: 8024341 - DNA, 22 bp, Homo sapiens
tggcccagccctgctctagggc

SEQ ID NO: 8024342 - DNA, 22 bp, Homo sapiens
tggcccagccctgctctagggc

SEQ ID NO: 8024343 - DNA, 22 bp, Homo sapiens
tggcccagagcactgctgggca

SEQ ID NO: 8024344 - DNA, 15 bp, Homo sapiens
tggcccacccgttga

SEQ ID NO: 8024345 - DNA, 22 bp, Homo sapiens
tggcccagactctgctcttatc

SEQ ID NO: 8024346 - DNA, 15 bp, Homo sapiens
tggcccacccgttga

SEQ ID NO: 8024347 - DNA, 22 bp, Homo sapiens
tggcccaatatgttaacatgat

SEQ ID NO: 8024348 - DNA, 22 bp, Homo sapiens
tggcccaagtctgctagaagag

SEQ ID NO: 8024349 - DNA, 22 bp, Homo sapiens
tggcccaaggttacatggctag

SEQ ID NO: 8024350 - DNA, 22 bp, Homo sapiens
tggcccaagtctgctagaagag

SEQ ID NO: 8024351 - DNA, 22 bp, Homo sapiens
tggcccaagacgttacctcctt

SEQ ID NO: 8024352 - DNA, 22 bp, Homo sapiens
tggcccaagcccgggacggcca

SEQ ID NO: 8024353 - DNA, 22 bp, Homo sapiens
tggcccagccctgctctagggc

SEQ ID NO: 8024354 - DNA, 22 bp, Homo sapiens
tggcccagccctgctctagggc

SEQ ID NO: 8024355 - DNA, 22 bp, Homo sapiens
tggcccagctcagggtgggcgg

SEQ ID NO: 8024356 - DNA, 22 bp, Homo sapiens
tggcccagctcagggtgggcgg

SEQ ID NO: 8024357 - DNA, 22 bp, Homo sapiens
tggcccagctcagggtgggcgg

SEQ ID NO: 8024358 - DNA, 22 bp, Homo sapiens
tggcccagccctgctctagggc

SEQ ID NO: 8024359 - DNA, 22 bp, Homo sapiens
tggcccagccctgctctagggc

SEQ ID NO: 8024360 - DNA, 22 bp, Homo sapiens
tggcccagctgcagatggtgga

SEQ ID NO: 8024361 - DNA, 22 bp, Homo sapiens
tggcccagctgcagatggtgga

SEQ ID NO: 8024362 - DNA, 22 bp, Homo sapiens
tggcccagctgcagatggtgga

SEQ ID NO: 8024363 - DNA, 22 bp, Homo sapiens
tggcccagctgcagatggtgga

SEQ ID NO: 8024364 - DNA, 22 bp, Homo sapiens
tggcccagctcagggtgggcgg

SEQ ID NO: 8024365 - DNA, 22 bp, Homo sapiens
tggcccagctcagggtgggcgg

SEQ ID NO: 8024366 - DNA, 22 bp, Homo sapiens
tggcccagctcagggtgggcgg

SEQ ID NO: 8024367 - DNA, 22 bp, Homo sapiens
tggcccagctcagggtgggcgg

SEQ ID NO: 8024368 - DNA, 22 bp, Homo sapiens
tggcccagctcagggtgggcgg

SEQ ID NO: 8024369 - DNA, 22 bp, Homo sapiens
tggcccagggagttcatggtgt

SEQ ID NO: 8024370 - DNA, 22 bp, Homo sapiens
tggcccagggagttcatggtgt

SEQ ID NO: 8024371 - DNA, 22 bp, Homo sapiens
tggcccagggagttcatggtgt

SEQ ID NO: 8024372 - DNA, 22 bp, Homo sapiens
tggcccaggcgaggtgggcaga

SEQ ID NO: 8024373 - DNA, 22 bp, Homo sapiens
tggcccagggagttcatggtgt

SEQ ID NO: 8024374 - DNA, 22 bp, Homo sapiens
tggcccaggcgaggtgggcaga

SEQ ID NO: 8024375 - DNA, 22 bp, Homo sapiens
tggcccaggcgaggtgggcaga

SEQ ID NO: 8024376 - DNA, 22 bp, Homo sapiens
tggcccaggcgaggtgggcaga

SEQ ID NO: 8024377 - DNA, 22 bp, Homo sapiens
tggcccaggcgaggtgggcaga

SEQ ID NO: 8024378 - DNA, 22 bp, Homo sapiens
tggcccaggcgaggtgggcaga

SEQ ID NO: 8024379 - DNA, 22 bp, Homo sapiens
tggcccaggcgaggtgggcaga

SEQ ID NO: 8024380 - DNA, 22 bp, Homo sapiens
tggcccaggcgaggtgggcaga

SEQ ID NO: 8024381 - DNA, 22 bp, Homo sapiens
tggcccaggcgaggtgggcaga

SEQ ID NO: 8024382 - DNA, 22 bp, Homo sapiens
tggcccaggccaaagccctgga

SEQ ID NO: 8024383 - DNA, 22 bp, Homo sapiens
tggcccaggccaaagccctgga

SEQ ID NO: 8024384 - DNA, 22 bp, Homo sapiens
tggcccaggcgaggtgggcaga

SEQ ID NO: 8024385 - DNA, 22 bp, Homo sapiens
tggcccaggccaaagccctgga

SEQ ID NO: 8024386 - DNA, 22 bp, Homo sapiens
tggcccaggaggccagagggca

SEQ ID NO: 8024387 - DNA, 22 bp, Homo sapiens
tggcccaggaggccagagggca

SEQ ID NO: 8024388 - DNA, 22 bp, Homo sapiens
tggcccaggaggccagagggca

SEQ ID NO: 8024389 - DNA, 22 bp, Homo sapiens
tggcccaggaggccagagggca

SEQ ID NO: 8024390 - DNA, 22 bp, Homo sapiens
tggcccagctgcagatggtgga

SEQ ID NO: 8024391 - DNA, 22 bp, Homo sapiens
tggcccagctgcagatggtgga

SEQ ID NO: 8024392 - DNA, 22 bp, Homo sapiens
tggcccaggaggccagagggca

SEQ ID NO: 8024393 - DNA, 22 bp, Homo sapiens
tggcccaggaggccagagggca

SEQ ID NO: 8024394 - DNA, 22 bp, Homo sapiens
tggcccaggaggccagagggca

SEQ ID NO: 8024395 - DNA, 22 bp, Homo sapiens
tggcccaggaggccagagggca

SEQ ID NO: 8024396 - DNA, 22 bp, Homo sapiens
tggcccaggccaaagccctgga

SEQ ID NO: 8024397 - DNA, 22 bp, Homo sapiens
tggcccaggccaaagccctgga

SEQ ID NO: 8024398 - DNA, 22 bp, Homo sapiens
tggcccaggccaaagccctgga

SEQ ID NO: 8024399 - DNA, 22 bp, Homo sapiens
tggcccaggggctcttggtgtt

SEQ ID NO: 8024400 - DNA, 22 bp, Homo sapiens
tggcccaggggctcttggtgtt

SEQ ID NO: 8024401 - DNA, 22 bp, Homo sapiens
tggcccaggggctcttggtgtt

SEQ ID NO: 8024402 - DNA, 22 bp, Homo sapiens
tggcccaggggctcttggtgtt

SEQ ID NO: 8024403 - DNA, 22 bp, Homo sapiens
tggcccagggcacagcagggag

SEQ ID NO: 8024404 - DNA, 22 bp, Homo sapiens
tggcccaggggctcttggtgtt

SEQ ID NO: 8024405 - DNA, 22 bp, Homo sapiens
tggcccagggcacagcagggag

SEQ ID NO: 8024406 - DNA, 22 bp, Homo sapiens
tggcccagggcacagcagggag

SEQ ID NO: 8024407 - DNA, 22 bp, Homo sapiens
tggcccagggcacagcagggag

SEQ ID NO: 8024408 - DNA, 22 bp, Homo sapiens
tggcccagggcacagcagggag

SEQ ID NO: 8024409 - DNA, 22 bp, Homo sapiens
tggcccagggcacagcagggag

SEQ ID NO: 8024410 - DNA, 22 bp, Homo sapiens
tggcccagggtctacagcctca

SEQ ID NO: 8024411 - DNA, 22 bp, Homo sapiens
tggcccagggtctacagcctca

SEQ ID NO: 8024412 - DNA, 22 bp, Homo sapiens
tggcccagggtctacagcctca

SEQ ID NO: 8024413 - DNA, 22 bp, Homo sapiens
tggcccagggtctacagcctca

SEQ ID NO: 8024414 - DNA, 22 bp, Homo sapiens
tggcccagggtctacagcctca

SEQ ID NO: 8024415 - DNA, 22 bp, Homo sapiens
tggcccaggtctctctgagccc

SEQ ID NO: 8024416 - DNA, 22 bp, Homo sapiens
tggcccagggtctacagcctca

SEQ ID NO: 8024417 - DNA, 22 bp, Homo sapiens
tggcccagggtctacagcctca

SEQ ID NO: 8024418 - DNA, 22 bp, Homo sapiens
tggcccagggtctacagcctca

SEQ ID NO: 8024419 - DNA, 22 bp, Homo sapiens
tggcccagggtctacagcctca

SEQ ID NO: 8024420 - DNA, 22 bp, Homo sapiens
tggcccaggtctctctgagccc

SEQ ID NO: 8024421 - DNA, 22 bp, Homo sapiens
tggcccaggtctctctgagccc

SEQ ID NO: 8024422 - DNA, 22 bp, Homo sapiens
tggcccaggtctctctgagccc

SEQ ID NO: 8024423 - DNA, 22 bp, Homo sapiens
tggcccaggtctctctgagccc

SEQ ID NO: 8024424 - DNA, 22 bp, Homo sapiens
tggcccaggtctctctgagccc

SEQ ID NO: 8024425 - DNA, 22 bp, Homo sapiens
tggcccaggtctctctgagccc

SEQ ID NO: 8024426 - DNA, 22 bp, Homo sapiens
tggccctggtggcacagcctgc

SEQ ID NO: 8024427 - DNA, 22 bp, Homo sapiens
tggccctggtggcacagcctgc

SEQ ID NO: 8024428 - DNA, 22 bp, Homo sapiens
tggccctggtggcacagcctgc

SEQ ID NO: 8024429 - DNA, 22 bp, Homo sapiens
tggccctgggcatctttcgtga

SEQ ID NO: 8024430 - DNA, 22 bp, Homo sapiens
tggccctgggtggaatgtccca

SEQ ID NO: 8024431 - DNA, 22 bp, Homo sapiens
tggccctggtggcacagcctgc

SEQ ID NO: 8024432 - DNA, 22 bp, Homo sapiens
tggccctgtccctggagcctgg

SEQ ID NO: 8024433 - DNA, 22 bp, Homo sapiens
tggccctgtccctggagcctgg

SEQ ID NO: 8024434 - DNA, 22 bp, Homo sapiens
tggccctgtccctggagcctgg

SEQ ID NO: 8024435 - DNA, 22 bp, Homo sapiens
tggccctgtcctcatttcatct

SEQ ID NO: 8024436 - DNA, 22 bp, Homo sapiens
tggccctgtctgcacacaggat

SEQ ID NO: 8024437 - DNA, 22 bp, Homo sapiens
tggccctgtctgcacacaggat

SEQ ID NO: 8024438 - DNA, 22 bp, Homo sapiens
tggccctgtccctggagcctgg

SEQ ID NO: 8024439 - DNA, 22 bp, Homo sapiens
tggccctgtcctcatttcatct

SEQ ID NO: 8024440 - DNA, 22 bp, Homo sapiens
tggccctgtctgcacacaggat

SEQ ID NO: 8024441 - DNA, 22 bp, Homo sapiens
tggccctgtctgcacacaggat

SEQ ID NO: 8024442 - DNA, 22 bp, Homo sapiens
tggccctgtctgcacacaggat

SEQ ID NO: 8024443 - DNA, 22 bp, Homo sapiens
tggccctgtgactgagttctag

SEQ ID NO: 8024444 - DNA, 22 bp, Homo sapiens
tggccctgtgactgagttctag

SEQ ID NO: 8024445 - DNA, 23 bp, Homo sapiens
tggccctgtgcatgctgcttccc

SEQ ID NO: 8024446 - DNA, 22 bp, Homo sapiens
tggccctgtgactgagttctag

SEQ ID NO: 8024447 - DNA, 22 bp, Homo sapiens
tggccctgccgcactatcctca

SEQ ID NO: 8024448 - DNA, 22 bp, Homo sapiens
tggccctgccgccacgacgtct

SEQ ID NO: 8024449 - DNA, 22 bp, Homo sapiens
tggccctgccctcttcatcttt

SEQ ID NO: 8024450 - DNA, 22 bp, Homo sapiens
tggccctgccgcactatcctca

SEQ ID NO: 8024451 - DNA, 22 bp, Homo sapiens
tggccctgccactcactgctga

SEQ ID NO: 8024452 - DNA, 22 bp, Homo sapiens
tggccctgccactcactgctga

SEQ ID NO: 8024453 - DNA, 22 bp, Homo sapiens
tggccctgccactcactgctga

SEQ ID NO: 8024454 - DNA, 22 bp, Homo sapiens
tggccctgccactcactgctga

SEQ ID NO: 8024455 - DNA, 22 bp, Homo sapiens
tggccctgccactcactgctga

SEQ ID NO: 8024456 - DNA, 22 bp, Homo sapiens
tggccctgccctcttcatcttt

SEQ ID NO: 8024457 - DNA, 21 bp, Homo sapiens
tggccctggccacggctgcca

SEQ ID NO: 8024458 - DNA, 21 bp, Homo sapiens
tggccctggccacggctgcca

SEQ ID NO: 8024459 - DNA, 22 bp, Homo sapiens
tggccctggctgagttagattt

SEQ ID NO: 8024460 - DNA, 22 bp, Homo sapiens
tggccctgggcagaggcaacat

SEQ ID NO: 8024461 - DNA, 22 bp, Homo sapiens
tggccctggctgagttagattt

SEQ ID NO: 8024462 - DNA, 22 bp, Homo sapiens
tggccctgggcagaggcaacat

SEQ ID NO: 8024463 - DNA, 22 bp, Homo sapiens
tggccctgggcagaggcaacat

SEQ ID NO: 8024464 - DNA, 22 bp, Homo sapiens
tggccctgggcagaggcaacat

SEQ ID NO: 8024465 - DNA, 22 bp, Homo sapiens
tggccctgggcagaggcaacat

SEQ ID NO: 8024466 - DNA, 22 bp, Homo sapiens
tggccgctatgagtcacctgca

SEQ ID NO: 8024467 - DNA, 16 bp, Homo sapiens
tggccgcagaggcctc

SEQ ID NO: 8024468 - DNA, 22 bp, Homo sapiens
tggcctcaaccgtcctaagcac

SEQ ID NO: 8024469 - DNA, 22 bp, Homo sapiens
tggcctagagaagccaaaagat

SEQ ID NO: 8024470 - DNA, 22 bp, Homo sapiens
tggccgggaagggacagtgtgg

SEQ ID NO: 8024471 - DNA, 22 bp, Homo sapiens
tggccctttggtttatgactga

SEQ ID NO: 8024472 - DNA, 22 bp, Homo sapiens
tggccctttggtttatgactga

SEQ ID NO: 8024473 - DNA, 22 bp, Homo sapiens
tggccctttggtttatgactga

SEQ ID NO: 8024474 - DNA, 22 bp, Homo sapiens
tggcccttttgtgaagtggcca

SEQ ID NO: 8024475 - DNA, 22 bp, Homo sapiens
tggcccttgttcaaatatgtca

SEQ ID NO: 8024476 - DNA, 22 bp, Homo sapiens
tggccctttgggtgcaggggca

SEQ ID NO: 8024477 - DNA, 22 bp, Homo sapiens
tggcccttgtcctgggagagtt

SEQ ID NO: 8024478 - DNA, 20 bp, Homo sapiens
tggccctgttttctccaggc

SEQ ID NO: 8024479 - DNA, 20 bp, Homo sapiens
tggccctgttttctccaggc

SEQ ID NO: 8024480 - DNA, 22 bp, Homo sapiens
tggccctgttctgtacctcata

SEQ ID NO: 8024481 - DNA, 20 bp, Homo sapiens
tggccctgttttctccaggc

SEQ ID NO: 8024482 - DNA, 22 bp, Homo sapiens
tggccctgttctgtacctcata

SEQ ID NO: 8024483 - DNA, 20 bp, Homo sapiens
tggccctgttttctccaggc

SEQ ID NO: 8024484 - DNA, 20 bp, Homo sapiens
tggccctgttttctccaggc

SEQ ID NO: 8024485 - DNA, 20 bp, Homo sapiens
tggccctgttttctccaggc

SEQ ID NO: 8024486 - DNA, 22 bp, Homo sapiens
tggcccttcaaattccctagtc

SEQ ID NO: 8024487 - DNA, 22 bp, Homo sapiens
tggcccttcaaattccctagtc

SEQ ID NO: 8024488 - DNA, 22 bp, Homo sapiens
tggcccttcaaattccctagtc

SEQ ID NO: 8024489 - DNA, 22 bp, Homo sapiens
tggcccttcaaattccctagtc

SEQ ID NO: 8024490 - DNA, 22 bp, Homo sapiens
tggcccttctgagcacagggcc

SEQ ID NO: 8024491 - DNA, 22 bp, Homo sapiens
tggcccttctgagcacagggcc

SEQ ID NO: 8024492 - DNA, 22 bp, Homo sapiens
tggccctgtggaggtcagtgag

SEQ ID NO: 8024493 - DNA, 22 bp, Homo sapiens
tggccctgtggaggtcagtgag

SEQ ID NO: 8024494 - DNA, 22 bp, Homo sapiens
tggccctgtggaggtcagtgag

SEQ ID NO: 8024495 - DNA, 22 bp, Homo sapiens
tggccctgtggcttcagaacag

SEQ ID NO: 8024496 - DNA, 22 bp, Homo sapiens
tggccctgtgtcctgctgccag

SEQ ID NO: 8024497 - DNA, 23 bp, Homo sapiens
tggccctgtgcatgctgcttccc

SEQ ID NO: 8024498 - DNA, 23 bp, Homo sapiens
tggccctgtgcatgctgcttccc

SEQ ID NO: 8024499 - DNA, 22 bp, Homo sapiens
tggccctgtggaggtcagtgag

SEQ ID NO: 8024500 - DNA, 22 bp, Homo sapiens
tggccctgtggaggtcagtgag

SEQ ID NO: 8024501 - DNA, 22 bp, Homo sapiens
tggccctgtgtgcaggctgcac

SEQ ID NO: 8024502 - DNA, 22 bp, Homo sapiens
tggccctgtgtgcaggctgcac

SEQ ID NO: 8024503 - DNA, 22 bp, Homo sapiens
tggccctgtgtgcaggctgcac

SEQ ID NO: 8024504 - DNA, 22 bp, Homo sapiens
tggccctgtgtgcaggctgcac

SEQ ID NO: 8024505 - DNA, 22 bp, Homo sapiens
tggccctgtgtgcaggctgcac

SEQ ID NO: 8024506 - DNA, 22 bp, Homo sapiens
tggccctgtgtgcaggctgcac

SEQ ID NO: 8024507 - DNA, 22 bp, Homo sapiens
tggccctgtgtcctgctgccag

SEQ ID NO: 8024508 - DNA, 22 bp, Homo sapiens
tggccctgtgtcctgctgccag

SEQ ID NO: 8024509 - DNA, 22 bp, Homo sapiens
tggccctgtggcttcagaacag

SEQ ID NO: 8024510 - DNA, 22 bp, Homo sapiens
tggccctgtgtcctgctgccag

SEQ ID NO: 8024511 - DNA, 22 bp, Homo sapiens
tggccctgtgtcctgctgccag

SEQ ID NO: 8024512 - DNA, 22 bp, Homo sapiens
tggcctgccactgccacgccac

SEQ ID NO: 8024513 - DNA, 22 bp, Homo sapiens
tggcctgccactgccacgccac

SEQ ID NO: 8024514 - DNA, 22 bp, Homo sapiens
tggcctgccactgccacgccac

SEQ ID NO: 8024515 - DNA, 22 bp, Homo sapiens
tggcctgcattggctttggtgt

SEQ ID NO: 8024516 - DNA, 22 bp, Homo sapiens
tggcctgcccaagtcaatcgga

SEQ ID NO: 8024517 - DNA, 22 bp, Homo sapiens
tggcctgcccagagcagctctg

SEQ ID NO: 8024518 - DNA, 22 bp, Homo sapiens
tggcctgcccagagcagctctg

SEQ ID NO: 8024519 - DNA, 22 bp, Homo sapiens
tggcctgccccgagatcctggc

SEQ ID NO: 8024520 - DNA, 22 bp, Homo sapiens
tggcctgccccgagatcctggc

SEQ ID NO: 8024521 - DNA, 22 bp, Homo sapiens
tggcctgcctcacttgcttatt

SEQ ID NO: 8024522 - DNA, 22 bp, Homo sapiens
tggcctgccccgagatcctggc

SEQ ID NO: 8024523 - DNA, 22 bp, Homo sapiens
tggcctgcctcccggcttcttt

SEQ ID NO: 8024524 - DNA, 22 bp, Homo sapiens
tggcctgcctcccggcttcttt

SEQ ID NO: 8024525 - DNA, 22 bp, Homo sapiens
tggcctgcctgggagcagcagg

SEQ ID NO: 8024526 - DNA, 23 bp, Homo sapiens
tggcctgcagagtttctgctggg

SEQ ID NO: 8024527 - DNA, 23 bp, Homo sapiens
tggcctgcagagtttctgctggg

SEQ ID NO: 8024528 - DNA, 23 bp, Homo sapiens
tggcctgcagagtttctgctggg

SEQ ID NO: 8024529 - DNA, 23 bp, Homo sapiens
tggcctgcagagtttctgctggg

SEQ ID NO: 8024530 - DNA, 22 bp, Homo sapiens
tggcctgcagctctcagggaag

SEQ ID NO: 8024531 - DNA, 22 bp, Homo sapiens
tggcctgcagaggctgtggggc

SEQ ID NO: 8024532 - DNA, 22 bp, Homo sapiens
tggcctgcagaggctgtggggc

SEQ ID NO: 8024533 - DNA, 22 bp, Homo sapiens
tggcctgcaagctaaaaatcta

SEQ ID NO: 8024534 - DNA, 22 bp, Homo sapiens
tggcctgcaaagtcttcttgct

SEQ ID NO: 8024535 - DNA, 22 bp, Homo sapiens
tggcctgcaagctaaaaatcta

SEQ ID NO: 8024536 - DNA, 22 bp, Homo sapiens
tggcctgcaaagtcttcttgct

SEQ ID NO: 8024537 - DNA, 22 bp, Homo sapiens
tggcctgcaaagtcttcttgct

SEQ ID NO: 8024538 - DNA, 22 bp, Homo sapiens
tggcctgcaaagtcttcttgct

SEQ ID NO: 8024539 - DNA, 22 bp, Homo sapiens
tggcctgaggctcggcatgggt

SEQ ID NO: 8024540 - DNA, 22 bp, Homo sapiens
tggcctgaggctcggcatgggt

SEQ ID NO: 8024541 - DNA, 22 bp, Homo sapiens
tggcctgactgtccagccaggg

SEQ ID NO: 8024542 - DNA, 22 bp, Homo sapiens
tggcctgaggctcggcatgggt

SEQ ID NO: 8024543 - DNA, 22 bp, Homo sapiens
tggcctgagttgtctgcaggcc

SEQ ID NO: 8024544 - DNA, 22 bp, Homo sapiens
tggcctgagttgtctgcaggcc

SEQ ID NO: 8024545 - DNA, 22 bp, Homo sapiens
tggcctctttcttccctttgac

SEQ ID NO: 8024546 - DNA, 22 bp, Homo sapiens
tggcctctttcttccctttgac

SEQ ID NO: 8024547 - DNA, 22 bp, Homo sapiens
tggcctcttaggacatcctcta

SEQ ID NO: 8024548 - DNA, 22 bp, Homo sapiens
tggcctcttaggacatcctcta

SEQ ID NO: 8024549 - DNA, 22 bp, Homo sapiens
tggcctctgtgggagctgagca

SEQ ID NO: 8024550 - DNA, 22 bp, Homo sapiens
tggcctcttaaggatgacacaa

SEQ ID NO: 8024551 - DNA, 22 bp, Homo sapiens
tggcctctgtgggagctgagca

SEQ ID NO: 8024552 - DNA, 22 bp, Homo sapiens
tggcctctgtgggagctgagca

SEQ ID NO: 8024553 - DNA, 22 bp, Homo sapiens
tggcctctgtgggagctgagca

SEQ ID NO: 8024554 - DNA, 22 bp, Homo sapiens
tggcctcttaggacatcctcta

SEQ ID NO: 8024555 - DNA, 22 bp, Homo sapiens
tggcctcttacgacatagcctt

SEQ ID NO: 8024556 - DNA, 22 bp, Homo sapiens
tggcctcttaaggatgacacaa

SEQ ID NO: 8024557 - DNA, 22 bp, Homo sapiens
tggcctcttaaggatgacacaa

SEQ ID NO: 8024558 - DNA, 22 bp, Homo sapiens
tggcctcttacgacatagcctt

SEQ ID NO: 8024559 - DNA, 22 bp, Homo sapiens
tggcctctgaggcacctttgcc

SEQ ID NO: 8024560 - DNA, 20 bp, Homo sapiens
tggcctctgagatgccacgg

SEQ ID NO: 8024561 - DNA, 20 bp, Homo sapiens
tggcctctgagatgccacgg

SEQ ID NO: 8024562 - DNA, 20 bp, Homo sapiens
tggcctctgagatgccacgg

SEQ ID NO: 8024563 - DNA, 22 bp, Homo sapiens
tggcctctgcaatggattcacc

SEQ ID NO: 8024564 - DNA, 22 bp, Homo sapiens
tggcctctgaggcacctttgcc

SEQ ID NO: 8024565 - DNA, 22 bp, Homo sapiens
tggcctctgcactgggctcccc

SEQ ID NO: 8024566 - DNA, 22 bp, Homo sapiens
tggcctctgcactgggctcccc

SEQ ID NO: 8024567 - DNA, 22 bp, Homo sapiens
tggcctctgcactgggctcccc

SEQ ID NO: 8024568 - DNA, 22 bp, Homo sapiens
tggcctctgcactgggctcccc

SEQ ID NO: 8024569 - DNA, 20 bp, Homo sapiens
tggcctctgtagaggccaag

SEQ ID NO: 8024570 - DNA, 20 bp, Homo sapiens
tggcctctgtagaggccaag

SEQ ID NO: 8024571 - DNA, 20 bp, Homo sapiens
tggcctctgtagaggccaag

SEQ ID NO: 8024572 - DNA, 22 bp, Homo sapiens
tggcctctggctgaggactaac

SEQ ID NO: 8024573 - DNA, 22 bp, Homo sapiens
tggcctctggctgaggactaac

SEQ ID NO: 8024574 - DNA, 22 bp, Homo sapiens
tggcctctggctgaggactaac

SEQ ID NO: 8024575 - DNA, 22 bp, Homo sapiens
tggcctctgggaaagcagattc

SEQ ID NO: 8024576 - DNA, 22 bp, Homo sapiens
tggcctctggctgaggactaac

SEQ ID NO: 8024577 - DNA, 22 bp, Homo sapiens
tggcctgccttcgctgagctga

SEQ ID NO: 8024578 - DNA, 22 bp, Homo sapiens
tggcctgccttcgctgagctga

SEQ ID NO: 8024579 - DNA, 22 bp, Homo sapiens
tggcctgccttcgctgagctga

SEQ ID NO: 8024580 - DNA, 22 bp, Homo sapiens
tggcctgccttcgctgagctga

SEQ ID NO: 8024581 - DNA, 22 bp, Homo sapiens
tggcctgccttcgctgagctga

SEQ ID NO: 8024582 - DNA, 22 bp, Homo sapiens
tggcctgctcacagtcagatgg

SEQ ID NO: 8024583 - DNA, 22 bp, Homo sapiens
tggcctgctctgactttggggg

SEQ ID NO: 8024584 - DNA, 22 bp, Homo sapiens
tggcctgctctgactttggggg

SEQ ID NO: 8024585 - DNA, 22 bp, Homo sapiens
tggcctggaaaaatgcagatgg

SEQ ID NO: 8024586 - DNA, 22 bp, Homo sapiens
tggcctggaaaaatgcagatgg

SEQ ID NO: 8024587 - DNA, 22 bp, Homo sapiens
tggcctggaaaaatgcagatgg

SEQ ID NO: 8024588 - DNA, 22 bp, Homo sapiens
tggcctggaaaaatgcagatgg

SEQ ID NO: 8024589 - DNA, 22 bp, Homo sapiens
tggcctggaaaaatgcagatgg

SEQ ID NO: 8024590 - DNA, 22 bp, Homo sapiens
tggcctggaaaaatgcagatgg

SEQ ID NO: 8024591 - DNA, 22 bp, Homo sapiens
tggcctgctttcttaggtgttc

SEQ ID NO: 8024592 - DNA, 22 bp, Homo sapiens
tggcctgctttcatttgatgct

SEQ ID NO: 8024593 - DNA, 22 bp, Homo sapiens
tggcctggaacctggcagggac

SEQ ID NO: 8024594 - DNA, 22 bp, Homo sapiens
tggcctggaacctggcagggac

SEQ ID NO: 8024595 - DNA, 22 bp, Homo sapiens
tggcctggaacctggcagggac

SEQ ID NO: 8024596 - DNA, 22 bp, Homo sapiens
tggcctggaagagaggtcgagg

SEQ ID NO: 8024597 - DNA, 22 bp, Homo sapiens
tggcctggaacctggcagggac

SEQ ID NO: 8024598 - DNA, 22 bp, Homo sapiens
tggcctggaagagaggtcgagg

SEQ ID NO: 8024599 - DNA, 22 bp, Homo sapiens
tggcctggaagagaggtcgagg

SEQ ID NO: 8024600 - DNA, 22 bp, Homo sapiens
tggcctggaaaaatgcagatgg

SEQ ID NO: 8024601 - DNA, 22 bp, Homo sapiens
tggcctggaaaaatgcagatgg

SEQ ID NO: 8024602 - DNA, 22 bp, Homo sapiens
tggcctggaaaaatgcagatgg

SEQ ID NO: 8024603 - DNA, 22 bp, Homo sapiens
tggcctggaacctggcagggac

SEQ ID NO: 8024604 - DNA, 22 bp, Homo sapiens
tggcctggaacctggcagggac

SEQ ID NO: 8024605 - DNA, 23 bp, Homo sapiens
tggcctggagagaaaagatgagt

SEQ ID NO: 8024606 - DNA, 23 bp, Homo sapiens
tggcctggagagaaaagatgagt

SEQ ID NO: 8024607 - DNA, 23 bp, Homo sapiens
tggcctggagagaaaagatgagt

SEQ ID NO: 8024608 - DNA, 23 bp, Homo sapiens
tggcctggagagaaaagatgagt

SEQ ID NO: 8024609 - DNA, 18 bp, Homo sapiens
tggcctggagacaactct

SEQ ID NO: 8024610 - DNA, 22 bp, Homo sapiens
tggcctggaagagaggtcgagg

SEQ ID NO: 8024611 - DNA, 22 bp, Homo sapiens
tggcctggaagagaggtcgagg

SEQ ID NO: 8024612 - DNA, 18 bp, Homo sapiens
tggcctggagacaactct

SEQ ID NO: 8024613 - DNA, 22 bp, Homo sapiens
tggcctggaagagaggtcgagg

SEQ ID NO: 8024614 - DNA, 18 bp, Homo sapiens
tggcctggagacaactct

SEQ ID NO: 8024615 - DNA, 22 bp, Homo sapiens
tggcctggccacatccagcagg

SEQ ID NO: 8024616 - DNA, 22 bp, Homo sapiens
tggcctggccacatccagcagg

SEQ ID NO: 8024617 - DNA, 22 bp, Homo sapiens
tggcctggccacatccagcagg

SEQ ID NO: 8024618 - DNA, 22 bp, Homo sapiens
tggcctggccctgaggccctgt

SEQ ID NO: 8024619 - DNA, 22 bp, Homo sapiens
tggcctggccacatccagcagg

SEQ ID NO: 8024620 - DNA, 22 bp, Homo sapiens
tggcctggccacatccagcagg

SEQ ID NO: 8024621 - DNA, 22 bp, Homo sapiens
tggcctggccacatccagcagg

SEQ ID NO: 8024622 - DNA, 22 bp, Homo sapiens
tggcctggccacatccagcagg

SEQ ID NO: 8024623 - DNA, 22 bp, Homo sapiens
tggcctggccacatccagcagg

SEQ ID NO: 8024624 - DNA, 22 bp, Homo sapiens
tggcctggcagagcaaggcctg

SEQ ID NO: 8024625 - DNA, 22 bp, Homo sapiens
tggcctggcagagcaaggcctg

SEQ ID NO: 8024626 - DNA, 22 bp, Homo sapiens
tggcctggccacatccagcagg

SEQ ID NO: 8024627 - DNA, 22 bp, Homo sapiens
tggcctggccacatccagcagg

SEQ ID NO: 8024628 - DNA, 22 bp, Homo sapiens
tggcctggcagagcaaggcctg

SEQ ID NO: 8024629 - DNA, 22 bp, Homo sapiens
tggcctggcagagcaaggcctg

SEQ ID NO: 8024630 - DNA, 22 bp, Homo sapiens
tggcctggcagagcaaggcctg

SEQ ID NO: 8024631 - DNA, 22 bp, Homo sapiens
tggcaggaaccaggaggctctc

SEQ ID NO: 8024632 - DNA, 22 bp, Homo sapiens
tggcaggaaccaggaggctctc

SEQ ID NO: 8024633 - DNA, 22 bp, Homo sapiens
tggcaggaaccaggaggctctc

SEQ ID NO: 8024634 - DNA, 22 bp, Homo sapiens
tggcaggaaccaggaggctctc

SEQ ID NO: 8024635 - DNA, 22 bp, Homo sapiens
tggcaggaaccaggaggctctc

SEQ ID NO: 8024636 - DNA, 18 bp, Homo sapiens
tggcaggaaatgcacttt

SEQ ID NO: 8024637 - DNA, 18 bp, Homo sapiens
tggcaggaaatgcacttt

SEQ ID NO: 8024638 - DNA, 18 bp, Homo sapiens
tggcaggaaatgcacttt

SEQ ID NO: 8024639 - DNA, 22 bp, Homo sapiens
tggcaggaaccaggaggctctc

SEQ ID NO: 8024640 - DNA, 22 bp, Homo sapiens
tggcaggaaccaggaggctctc

SEQ ID NO: 8024641 - DNA, 22 bp, Homo sapiens
tggcaggaaccttaaccacaaa

SEQ ID NO: 8024642 - DNA, 22 bp, Homo sapiens
tggcaggaaccttaaccacaaa

SEQ ID NO: 8024643 - DNA, 22 bp, Homo sapiens
tggcaggaaccttaaccacaaa

SEQ ID NO: 8024644 - DNA, 22 bp, Homo sapiens
tggcaggaagacgtggggcacc

SEQ ID NO: 8024645 - DNA, 22 bp, Homo sapiens
tggcaggaagacgtggggcacc

SEQ ID NO: 8024646 - DNA, 22 bp, Homo sapiens
tggcaggaagacgtggggcacc

SEQ ID NO: 8024647 - DNA, 22 bp, Homo sapiens
tggcaggaagacgtggggcacc

SEQ ID NO: 8024648 - DNA, 22 bp, Homo sapiens
tggcaggaaccttaaccacaaa

SEQ ID NO: 8024649 - DNA, 22 bp, Homo sapiens
tggcaggaaagtaacagagcac

SEQ ID NO: 8024650 - DNA, 22 bp, Homo sapiens
tggcaggaaataccctgcctag

SEQ ID NO: 8024651 - DNA, 22 bp, Homo sapiens
tggcaggaaagtaacagagcac

SEQ ID NO: 8024652 - DNA, 22 bp, Homo sapiens
tggcaggaaagtaacagagcac

SEQ ID NO: 8024653 - DNA, 22 bp, Homo sapiens
tggcaggaaagtaacagagcac

SEQ ID NO: 8024654 - DNA, 22 bp, Homo sapiens
tggcaggaaagtaacagagcac

SEQ ID NO: 8024655 - DNA, 22 bp, Homo sapiens
tggcaggaaagtaacagagcac

SEQ ID NO: 8024656 - DNA, 22 bp, Homo sapiens
tggcaggaaaaagggccagagg

SEQ ID NO: 8024657 - DNA, 22 bp, Homo sapiens
tggcaggaaagtaacagagcac

SEQ ID NO: 8024658 - DNA, 22 bp, Homo sapiens
tggcaggaaataccctgcctag

SEQ ID NO: 8024659 - DNA, 22 bp, Homo sapiens
tggcaggaaataccctgcctag

SEQ ID NO: 8024660 - DNA, 22 bp, Homo sapiens
tggcaggaaataccctgcctag

SEQ ID NO: 8024661 - DNA, 22 bp, Homo sapiens
tggcaggaaataccctgcctag

SEQ ID NO: 8024662 - DNA, 23 bp, Homo sapiens
tggcaggaaatgagaatgttcct

SEQ ID NO: 8024663 - DNA, 23 bp, Homo sapiens
tggcaggaaatgagaatgttcct

SEQ ID NO: 8024664 - DNA, 18 bp, Homo sapiens
tggcaggaaatgcacttt

SEQ ID NO: 8024665 - DNA, 22 bp, Homo sapiens
tggcaggaaataccctgcctag

SEQ ID NO: 8024666 - DNA, 23 bp, Homo sapiens
tggcaggaaatgagaatgttcct

SEQ ID NO: 8024667 - DNA, 23 bp, Homo sapiens
tggcaggaaatgagaatgttcct

SEQ ID NO: 8024668 - DNA, 22 bp, Homo sapiens
tggcagctgaggggaggctttg

SEQ ID NO: 8024669 - DNA, 22 bp, Homo sapiens
tggcagctgaatggctggatgg

SEQ ID NO: 8024670 - DNA, 22 bp, Homo sapiens
tggcagctgaatggctggatgg

SEQ ID NO: 8024671 - DNA, 22 bp, Homo sapiens
tggcagctgaatggctggatgg

SEQ ID NO: 8024672 - DNA, 17 bp, Homo sapiens
tggcagctgaaagctct

SEQ ID NO: 8024673 - DNA, 22 bp, Homo sapiens
tggcagctctgttcaacatgag

SEQ ID NO: 8024674 - DNA, 22 bp, Homo sapiens
tggcagctctgttcaacatgag

SEQ ID NO: 8024675 - DNA, 22 bp, Homo sapiens
tggcagctctgttcaacatgag

SEQ ID NO: 8024676 - DNA, 22 bp, Homo sapiens
tggcagctgaggggaggctttg

SEQ ID NO: 8024677 - DNA, 22 bp, Homo sapiens
tggcagctgaggggaggctttg

SEQ ID NO: 8024678 - DNA, 22 bp, Homo sapiens
tggcagctgattagatggtgcc

SEQ ID NO: 8024679 - DNA, 22 bp, Homo sapiens
tggcagctgattagatggtgcc

SEQ ID NO: 8024680 - DNA, 22 bp, Homo sapiens
tggcagctgattagatggtgcc

SEQ ID NO: 8024681 - DNA, 22 bp, Homo sapiens
tggcagctgagtgcaccccctc

SEQ ID NO: 8024682 - DNA, 22 bp, Homo sapiens
tggcagctgcaggcctcctgag

SEQ ID NO: 8024683 - DNA, 22 bp, Homo sapiens
tggcagctgcaggcctcctgag

SEQ ID NO: 8024684 - DNA, 22 bp, Homo sapiens
tggcagctgcaggcctcctgag

SEQ ID NO: 8024685 - DNA, 22 bp, Homo sapiens
tggcagctgcaggcctcctgag

SEQ ID NO: 8024686 - DNA, 22 bp, Homo sapiens
tggcagctgcaggcctcctgag

SEQ ID NO: 8024687 - DNA, 22 bp, Homo sapiens
tggcagctgccatgtccacgtg

SEQ ID NO: 8024688 - DNA, 22 bp, Homo sapiens
tggcagctgccatgtccacgtg

SEQ ID NO: 8024689 - DNA, 22 bp, Homo sapiens
tggcaggaaaaagggccagagg

SEQ ID NO: 8024690 - DNA, 22 bp, Homo sapiens
tggcaggaaaaagggccagagg

SEQ ID NO: 8024691 - DNA, 22 bp, Homo sapiens
tggcaggaaagtaacagagcac

SEQ ID NO: 8024692 - DNA, 22 bp, Homo sapiens
tggcaggaaaaagggccagagg

SEQ ID NO: 8024693 - DNA, 22 bp, Homo sapiens
tggcaggaaaaagggccagagg

SEQ ID NO: 8024694 - DNA, 22 bp, Homo sapiens
tggcaggaaaaagggccagagg

SEQ ID NO: 8024695 - DNA, 22 bp, Homo sapiens
tggcaggaaaaagggccagagg

SEQ ID NO: 8024696 - DNA, 22 bp, Homo sapiens
tggcaggaaaaagggccagagg

SEQ ID NO: 8024697 - DNA, 22 bp, Homo sapiens
tggcagctggagggcaatggcc

SEQ ID NO: 8024698 - DNA, 22 bp, Homo sapiens
tggcagctgcgttgtgtttctg

SEQ ID NO: 8024699 - DNA, 22 bp, Homo sapiens
tggcaggaggttttctccagga

SEQ ID NO: 8024700 - DNA, 20 bp, Homo sapiens
tggcaggaggcagcagtgga

SEQ ID NO: 8024701 - DNA, 22 bp, Homo sapiens
tggcaggaggttttctccagga

SEQ ID NO: 8024702 - DNA, 22 bp, Homo sapiens
tggcaggaggttttctccagga

SEQ ID NO: 8024703 - DNA, 22 bp, Homo sapiens
tggcaggaggttttctccagga

SEQ ID NO: 8024704 - DNA, 20 bp, Homo sapiens
tggcaggaggcagcagtgga

SEQ ID NO: 8024705 - DNA, 22 bp, Homo sapiens
tggcaggatctttgagagtgaa

SEQ ID NO: 8024706 - DNA, 22 bp, Homo sapiens
tggcaggatctttgagagtgaa

SEQ ID NO: 8024707 - DNA, 22 bp, Homo sapiens
tggcaggaggttttctccagga

SEQ ID NO: 8024708 - DNA, 22 bp, Homo sapiens
tggcaggaggttttctccagga

SEQ ID NO: 8024709 - DNA, 20 bp, Homo sapiens
tggcaggaggcagcagtgga

SEQ ID NO: 8024710 - DNA, 20 bp, Homo sapiens
tggcaggaggcagcagtgga

SEQ ID NO: 8024711 - DNA, 20 bp, Homo sapiens
tggcaggaggcagcagtgga

SEQ ID NO: 8024712 - DNA, 20 bp, Homo sapiens
tggcaggaggcagcagtgga

SEQ ID NO: 8024713 - DNA, 20 bp, Homo sapiens
tggcaggaggcagcagtgga

SEQ ID NO: 8024714 - DNA, 20 bp, Homo sapiens
tggcaggaggcagcagtgga

SEQ ID NO: 8024715 - DNA, 22 bp, Homo sapiens
tggcaggaggatgaggcggcta

SEQ ID NO: 8024716 - DNA, 20 bp, Homo sapiens
tggcaggaggcagcagtgga

SEQ ID NO: 8024717 - DNA, 20 bp, Homo sapiens
tggcaggaggcagcagtgga

SEQ ID NO: 8024718 - DNA, 22 bp, Homo sapiens
tggcaggaggatgaggcggcta

SEQ ID NO: 8024719 - DNA, 22 bp, Homo sapiens
tggcaggaggatgaggcggcta

SEQ ID NO: 8024720 - DNA, 22 bp, Homo sapiens
tggcaggaggatgaggcggcta

SEQ ID NO: 8024721 - DNA, 22 bp, Homo sapiens
tggcaggaggatgaggcggcta

SEQ ID NO: 8024722 - DNA, 22 bp, Homo sapiens
tggcaggagcctgcggggaggt

SEQ ID NO: 8024723 - DNA, 22 bp, Homo sapiens
tggcaggaggatgaggcggcta

SEQ ID NO: 8024724 - DNA, 22 bp, Homo sapiens
tggcaggagcctgcggggaggt

SEQ ID NO: 8024725 - DNA, 22 bp, Homo sapiens
tggcaggagcctgcggggaggt

SEQ ID NO: 8024726 - DNA, 22 bp, Homo sapiens
tggcaggagcctgcggggaggt

SEQ ID NO: 8024727 - DNA, 22 bp, Homo sapiens
tggcaggagcctgcggggaggt

SEQ ID NO: 8024728 - DNA, 20 bp, Homo sapiens
tggcaggagccactggaagc

SEQ ID NO: 8024729 - DNA, 20 bp, Homo sapiens
tggcaggagccactggaagc

SEQ ID NO: 8024730 - DNA, 20 bp, Homo sapiens
tggcaggagccactggaagc

SEQ ID NO: 8024731 - DNA, 20 bp, Homo sapiens
tggcaggagccactggaagc

SEQ ID NO: 8024732 - DNA, 20 bp, Homo sapiens
tggcaggagccactggaagc

SEQ ID NO: 8024733 - DNA, 22 bp, Homo sapiens
tggcaggagagcgtcagatcag

SEQ ID NO: 8024734 - DNA, 22 bp, Homo sapiens
tggcaggagacacatggcatag

SEQ ID NO: 8024735 - DNA, 22 bp, Homo sapiens
tggcaggagagcgtcagatcag

SEQ ID NO: 8024736 - DNA, 22 bp, Homo sapiens
tggcaggagagcgtcagatcag

SEQ ID NO: 8024737 - DNA, 22 bp, Homo sapiens
tggcaggagagcgtcagatcag

SEQ ID NO: 8024738 - DNA, 22 bp, Homo sapiens
tggcaggagacacatggcatag

SEQ ID NO: 8024739 - DNA, 22 bp, Homo sapiens
tggcaggagacacatggcatag

SEQ ID NO: 8024740 - DNA, 22 bp, Homo sapiens
tggcaggagacacatggcatag

SEQ ID NO: 8024741 - DNA, 22 bp, Homo sapiens
tggcaggagacacatggcatag

SEQ ID NO: 8024742 - DNA, 20 bp, Homo sapiens
tggcaggactggctccaccc

SEQ ID NO: 8024743 - DNA, 20 bp, Homo sapiens
tggcaggactggctccaccc

SEQ ID NO: 8024744 - DNA, 20 bp, Homo sapiens
tggcaggactggctccaccc

SEQ ID NO: 8024745 - DNA, 20 bp, Homo sapiens
tggcaggactggctccaccc

SEQ ID NO: 8024746 - DNA, 20 bp, Homo sapiens
tggcaggactggctccaccc

SEQ ID NO: 8024747 - DNA, 20 bp, Homo sapiens
tggcaggaatagggccagag

SEQ ID NO: 8024748 - DNA, 20 bp, Homo sapiens
tggcaggaatagggccagag

SEQ ID NO: 8024749 - DNA, 20 bp, Homo sapiens
tggcaggaatagggccagag

SEQ ID NO: 8024750 - DNA, 20 bp, Homo sapiens
tggcaggactggctccaccc

SEQ ID NO: 8024751 - DNA, 20 bp, Homo sapiens
tggcaggactggctccaccc

SEQ ID NO: 8024752 - DNA, 22 bp, Homo sapiens
tggcaggaaggagactcagccc

SEQ ID NO: 8024753 - DNA, 22 bp, Homo sapiens
tggcaggaaggagactcagccc

SEQ ID NO: 8024754 - DNA, 22 bp, Homo sapiens
tggcaggaaggagactcagccc

SEQ ID NO: 8024755 - DNA, 20 bp, Homo sapiens
tggcaggaatagggccagag

SEQ ID NO: 8024756 - DNA, 20 bp, Homo sapiens
tggcaggaatagggccagag

SEQ ID NO: 8024757 - DNA, 20 bp, Homo sapiens
tggcaggaatagggccagag

SEQ ID NO: 8024758 - DNA, 20 bp, Homo sapiens
tggcaggaatagggccagag

SEQ ID NO: 8024759 - DNA, 20 bp, Homo sapiens
tggcaggaatagggccagag

SEQ ID NO: 8024760 - DNA, 22 bp, Homo sapiens
tggcaggaagcatctataggtc

SEQ ID NO: 8024761 - DNA, 22 bp, Homo sapiens
tggcaggaagcatctataggtc

SEQ ID NO: 8024762 - DNA, 22 bp, Homo sapiens
tggcaggaagcatctataggtc

SEQ ID NO: 8024763 - DNA, 22 bp, Homo sapiens
tggcaggaagcatctataggtc

SEQ ID NO: 8024764 - DNA, 22 bp, Homo sapiens
tggcaggaagacgtggggcacc

SEQ ID NO: 8024765 - DNA, 22 bp, Homo sapiens
tggcaggaagacgtggggcacc

SEQ ID NO: 8024766 - DNA, 22 bp, Homo sapiens
tggcaggggaggtgcttgctta

SEQ ID NO: 8024767 - DNA, 22 bp, Homo sapiens
tggcaggggaggtgcttgctta

SEQ ID NO: 8024768 - DNA, 22 bp, Homo sapiens
tggcaggggaggtgcttgctta

SEQ ID NO: 8024769 - DNA, 22 bp, Homo sapiens
tggcaggggaggtgcttgctta

SEQ ID NO: 8024770 - DNA, 22 bp, Homo sapiens
tggcaggggaggtgcttgctta

SEQ ID NO: 8024771 - DNA, 22 bp, Homo sapiens
tggcaggggaggtgcttgctta

SEQ ID NO: 8024772 - DNA, 22 bp, Homo sapiens
tggcaggggaggtgcttgctta

SEQ ID NO: 8024773 - DNA, 22 bp, Homo sapiens
tggcaggggaggtgcttgctta

SEQ ID NO: 8024774 - DNA, 18 bp, Homo sapiens
tggcaggggcagtacgcc

SEQ ID NO: 8024775 - DNA, 18 bp, Homo sapiens
tggcaggggcagtacgcc

SEQ ID NO: 8024776 - DNA, 18 bp, Homo sapiens
tggcaggggcagtacgcc

SEQ ID NO: 8024777 - DNA, 18 bp, Homo sapiens
tggcaggggcagtacgcc

SEQ ID NO: 8024778 - DNA, 18 bp, Homo sapiens
tggcaggggcagtacgcc

SEQ ID NO: 8024779 - DNA, 18 bp, Homo sapiens
tggcaggggcagtacgcc

SEQ ID NO: 8024780 - DNA, 22 bp, Homo sapiens
tggcagggtacaccttaacacc

SEQ ID NO: 8024781 - DNA, 22 bp, Homo sapiens
tggcagggtacaccttaacacc

SEQ ID NO: 8024782 - DNA, 21 bp, Homo sapiens
tggcaggggtagtagtacagc

SEQ ID NO: 8024783 - DNA, 21 bp, Homo sapiens
tggcaggggtagtagtacagc

SEQ ID NO: 8024784 - DNA, 21 bp, Homo sapiens
tggcaggggtagtagtacagc

SEQ ID NO: 8024785 - DNA, 21 bp, Homo sapiens
tggcaggggtagtagtacagc

SEQ ID NO: 8024786 - DNA, 21 bp, Homo sapiens
tggcaggggtagtagtacagc

SEQ ID NO: 8024787 - DNA, 21 bp, Homo sapiens
tggcaggggtagtagtacagc

SEQ ID NO: 8024788 - DNA, 18 bp, Homo sapiens
tggcaggggcagtacgcc

SEQ ID NO: 8024789 - DNA, 18 bp, Homo sapiens
tggcaggggcagtacgcc

SEQ ID NO: 8024790 - DNA, 18 bp, Homo sapiens
tggcaggggcagtacgcc

SEQ ID NO: 8024791 - DNA, 18 bp, Homo sapiens
tggcaggggcagtacgcc

SEQ ID NO: 8024792 - DNA, 22 bp, Homo sapiens
tggcagggcctgaatcttatac

SEQ ID NO: 8024793 - DNA, 22 bp, Homo sapiens
tggcagggcctgaatcttatac

SEQ ID NO: 8024794 - DNA, 22 bp, Homo sapiens
tggcagggcctgaatcttatac

SEQ ID NO: 8024795 - DNA, 22 bp, Homo sapiens
tggcagggcctgaatcttatac

SEQ ID NO: 8024796 - DNA, 22 bp, Homo sapiens
tggcagggcctaccccaatatc

SEQ ID NO: 8024797 - DNA, 22 bp, Homo sapiens
tggcagggcctgctcatcatcc

SEQ ID NO: 8024798 - DNA, 22 bp, Homo sapiens
tggcaggggaggtgcttgctta

SEQ ID NO: 8024799 - DNA, 22 bp, Homo sapiens
tggcagggcctgctcatcatcc

SEQ ID NO: 8024800 - DNA, 22 bp, Homo sapiens
tggcagggcctgctcatcatcc

SEQ ID NO: 8024801 - DNA, 22 bp, Homo sapiens
tggcagggagttgcaggatttc

SEQ ID NO: 8024802 - DNA, 22 bp, Homo sapiens
tggcagggagttgcaggatttc

SEQ ID NO: 8024803 - DNA, 22 bp, Homo sapiens
tggcagggagttgcaggatttc

SEQ ID NO: 8024804 - DNA, 22 bp, Homo sapiens
tggcagggagttgcaggatttc

SEQ ID NO: 8024805 - DNA, 22 bp, Homo sapiens
tggcagggagttcgttcacaac

SEQ ID NO: 8024806 - DNA, 22 bp, Homo sapiens
tggcagggagttgcaggatttc

SEQ ID NO: 8024807 - DNA, 22 bp, Homo sapiens
tggcagggagttgcaggatttc

SEQ ID NO: 8024808 - DNA, 22 bp, Homo sapiens
tggcagggcctaccccaatatc

SEQ ID NO: 8024809 - DNA, 22 bp, Homo sapiens
tggcagggagttgcaggatttc

SEQ ID NO: 8024810 - DNA, 22 bp, Homo sapiens
tggcaggatttgcccggaagga

SEQ ID NO: 8024811 - DNA, 22 bp, Homo sapiens
tggcaggcaagttcagctccac

SEQ ID NO: 8024812 - DNA, 22 bp, Homo sapiens
tggcaggcaagttcagctccac

SEQ ID NO: 8024813 - DNA, 22 bp, Homo sapiens
tggcaggcagagagcggccttt

SEQ ID NO: 8024814 - DNA, 21 bp, Homo sapiens
tggcaggcagctggaagcttg

SEQ ID NO: 8024815 - DNA, 22 bp, Homo sapiens
tggcaggatttgcccggaagga

SEQ ID NO: 8024816 - DNA, 22 bp, Homo sapiens
tggcaggatttgcccggaagga

SEQ ID NO: 8024817 - DNA, 22 bp, Homo sapiens
tggcaggatctttgagagtgaa

SEQ ID NO: 8024818 - DNA, 22 bp, Homo sapiens
tggcaggatctttgagagtgaa

SEQ ID NO: 8024819 - DNA, 22 bp, Homo sapiens
tggcaggaggttttctccagga

SEQ ID NO: 8024820 - DNA, 22 bp, Homo sapiens
tggcaggatctttgagagtgaa

SEQ ID NO: 8024821 - DNA, 22 bp, Homo sapiens
tggcaggaggttttctccagga

SEQ ID NO: 8024822 - DNA, 22 bp, Homo sapiens
tggcaggatctttgagagtgaa

SEQ ID NO: 8024823 - DNA, 22 bp, Homo sapiens
tggcaggatctttgagagtgaa

SEQ ID NO: 8024824 - DNA, 22 bp, Homo sapiens
tggcaggatctttgagagtgaa

SEQ ID NO: 8024825 - DNA, 21 bp, Homo sapiens
tggcaggcagctggaagcttg

SEQ ID NO: 8024826 - DNA, 21 bp, Homo sapiens
tggcaggcagctggaagcttg

SEQ ID NO: 8024827 - DNA, 21 bp, Homo sapiens
tggcaggcagctggaagcttg

SEQ ID NO: 8024828 - DNA, 21 bp, Homo sapiens
tggcaggcagctggaagcttg

SEQ ID NO: 8024829 - DNA, 22 bp, Homo sapiens
tggcaggcagctggcatcctaa

SEQ ID NO: 8024830 - DNA, 21 bp, Homo sapiens
tggcaggcagctggaagcttg

SEQ ID NO: 8024831 - DNA, 22 bp, Homo sapiens
tggcaggcagtgtgggagctgg

SEQ ID NO: 8024832 - DNA, 22 bp, Homo sapiens
tggcaggcagtgtgggagctgg

SEQ ID NO: 8024833 - DNA, 22 bp, Homo sapiens
tggcaggcaggcagccttctga

SEQ ID NO: 8024834 - DNA, 22 bp, Homo sapiens
tggcaggcaggcagccttctga

SEQ ID NO: 8024835 - DNA, 18 bp, Homo sapiens
tggcagggaggaaatata

SEQ ID NO: 8024836 - DNA, 18 bp, Homo sapiens
tggcagggaggaaatata

SEQ ID NO: 8024837 - DNA, 18 bp, Homo sapiens
tggcagggaggaaatata

SEQ ID NO: 8024838 - DNA, 22 bp, Homo sapiens
tggcaggcattgatgcgagttc

SEQ ID NO: 8024839 - DNA, 18 bp, Homo sapiens
tggcagggaggaaatata

SEQ ID NO: 8024840 - DNA, 18 bp, Homo sapiens
tggcagggaggaaatata

SEQ ID NO: 8024841 - DNA, 18 bp, Homo sapiens
tggcagggaggaaatata

SEQ ID NO: 8024842 - DNA, 22 bp, Homo sapiens
tggcaggcattgatgcgagttc

SEQ ID NO: 8024843 - DNA, 22 bp, Homo sapiens
tggcagggagccaccggtcatg

SEQ ID NO: 8024844 - DNA, 22 bp, Homo sapiens
tggcagggagccaccggtcatg

SEQ ID NO: 8024845 - DNA, 22 bp, Homo sapiens
tggcagggagccaccggtcatg

SEQ ID NO: 8024846 - DNA, 22 bp, Homo sapiens
tggcagggagccaccggtcatg

SEQ ID NO: 8024847 - DNA, 19 bp, Homo sapiens
tggcagggagtgatattag

SEQ ID NO: 8024848 - DNA, 19 bp, Homo sapiens
tggcagggagtgatattag

SEQ ID NO: 8024849 - DNA, 18 bp, Homo sapiens
tggcagggaggaaatata

SEQ ID NO: 8024850 - DNA, 19 bp, Homo sapiens
tggcagggagtgatattag

SEQ ID NO: 8024851 - DNA, 19 bp, Homo sapiens
tggcagggagtgatattag

SEQ ID NO: 8024852 - DNA, 19 bp, Homo sapiens
tggcagggagtgatattag

SEQ ID NO: 8024853 - DNA, 22 bp, Homo sapiens
tggcagggagttcgttcacaac

SEQ ID NO: 8024854 - DNA, 22 bp, Homo sapiens
tggcagggagttcgttcacaac

SEQ ID NO: 8024855 - DNA, 22 bp, Homo sapiens
tggcagggagttcgttcacaac

SEQ ID NO: 8024856 - DNA, 22 bp, Homo sapiens
tggcagggagttcgttcacaac

SEQ ID NO: 8024857 - DNA, 19 bp, Homo sapiens
tggcagggagtgatattag

SEQ ID NO: 8024858 - DNA, 22 bp, Homo sapiens
tggcagcagtggaggtagaaag

SEQ ID NO: 8024859 - DNA, 22 bp, Homo sapiens
tggcagcataaagcatttagct

SEQ ID NO: 8024860 - DNA, 22 bp, Homo sapiens
tggcagcagtggaggtagaaag

SEQ ID NO: 8024861 - DNA, 22 bp, Homo sapiens
tggcagcagtggaggtagaaag

SEQ ID NO: 8024862 - DNA, 22 bp, Homo sapiens
tggcagcagtggaggtagaaag

SEQ ID NO: 8024863 - DNA, 22 bp, Homo sapiens
tggcagcagtagccaccccagc

SEQ ID NO: 8024864 - DNA, 22 bp, Homo sapiens
tggcagcagtggaggtagaaag

SEQ ID NO: 8024865 - DNA, 22 bp, Homo sapiens
tggcagcatgtcccggcctcag

SEQ ID NO: 8024866 - DNA, 22 bp, Homo sapiens
tggcagcataaagcatttagct

SEQ ID NO: 8024867 - DNA, 22 bp, Homo sapiens
tggcagcatgtcccggcctcag

SEQ ID NO: 8024868 - DNA, 22 bp, Homo sapiens
tggcagcatgtcccggcctcag

SEQ ID NO: 8024869 - DNA, 22 bp, Homo sapiens
tggcagcatgtcccggcctcag

SEQ ID NO: 8024870 - DNA, 22 bp, Homo sapiens
tggcagcattaattattcaggt

SEQ ID NO: 8024871 - DNA, 22 bp, Homo sapiens
tggcagcatgttatgtaaggaa

SEQ ID NO: 8024872 - DNA, 22 bp, Homo sapiens
tggcagcatgttatgtaaggaa

SEQ ID NO: 8024873 - DNA, 18 bp, Homo sapiens
tggcagcaggaagccatt

SEQ ID NO: 8024874 - DNA, 18 bp, Homo sapiens
tggcagcaggaagccatt

SEQ ID NO: 8024875 - DNA, 22 bp, Homo sapiens
tggcagcagggaggccagtgtt

SEQ ID NO: 8024876 - DNA, 22 bp, Homo sapiens
tggcagcagggaggccagtgtt

SEQ ID NO: 8024877 - DNA, 22 bp, Homo sapiens
tggcagcagggaggccagtgtt

SEQ ID NO: 8024878 - DNA, 22 bp, Homo sapiens
tggcagcagggcccctggagga

SEQ ID NO: 8024879 - DNA, 22 bp, Homo sapiens
tggcagcagggcccctggagga

SEQ ID NO: 8024880 - DNA, 22 bp, Homo sapiens
tggcagcagggaggccagtgtt

SEQ ID NO: 8024881 - DNA, 22 bp, Homo sapiens
tggcagcagggaggccagtgtt

SEQ ID NO: 8024882 - DNA, 22 bp, Homo sapiens
tggcagcagggcccctggagga

SEQ ID NO: 8024883 - DNA, 22 bp, Homo sapiens
tggcagcagggcccctggagga

SEQ ID NO: 8024884 - DNA, 22 bp, Homo sapiens
tggcagcagggcccctggagga

SEQ ID NO: 8024885 - DNA, 22 bp, Homo sapiens
tggcagcagtagccaccccagc

SEQ ID NO: 8024886 - DNA, 22 bp, Homo sapiens
tggcagcagtagccaccccagc

SEQ ID NO: 8024887 - DNA, 22 bp, Homo sapiens
tggcagcagccatggaaggccc

SEQ ID NO: 8024888 - DNA, 22 bp, Homo sapiens
tggcagcagccatggaaggccc

SEQ ID NO: 8024889 - DNA, 22 bp, Homo sapiens
tggcagcagccatggaaggccc

SEQ ID NO: 8024890 - DNA, 22 bp, Homo sapiens
tggcagcagccatggaaggccc

SEQ ID NO: 8024891 - DNA, 22 bp, Homo sapiens
tggcagcagccatggaaggccc

SEQ ID NO: 8024892 - DNA, 22 bp, Homo sapiens
tggcagcagccatggaaggccc

SEQ ID NO: 8024893 - DNA, 22 bp, Homo sapiens
tggcagcagctaacttaggcag

SEQ ID NO: 8024894 - DNA, 22 bp, Homo sapiens
tggcagcagctaacttaggcag

SEQ ID NO: 8024895 - DNA, 22 bp, Homo sapiens
tggcagcagctaacttaggcag

SEQ ID NO: 8024896 - DNA, 22 bp, Homo sapiens
tggcagcagctaacttaggcag

SEQ ID NO: 8024897 - DNA, 18 bp, Homo sapiens
tggcagcaggaagccatt

SEQ ID NO: 8024898 - DNA, 18 bp, Homo sapiens
tggcagcaggaagccatt

SEQ ID NO: 8024899 - DNA, 22 bp, Homo sapiens
tggcagcagcaaatggcatatc

SEQ ID NO: 8024900 - DNA, 22 bp, Homo sapiens
tggcagcagcaaatggcatatc

SEQ ID NO: 8024901 - DNA, 22 bp, Homo sapiens
tggcagcagcaaatggcatatc

SEQ ID NO: 8024902 - DNA, 23 bp, Homo sapiens
tggcagcagatcttaaagtgacc

SEQ ID NO: 8024903 - DNA, 22 bp, Homo sapiens
tggcagcagcaaatggcatatc

SEQ ID NO: 8024904 - DNA, 22 bp, Homo sapiens
tggcagcagacatctgaggtct

SEQ ID NO: 8024905 - DNA, 22 bp, Homo sapiens
tggcagcagacatctgaggtct

SEQ ID NO: 8024906 - DNA, 22 bp, Homo sapiens
tggcagcagacaaaaggccatt

SEQ ID NO: 8024907 - DNA, 22 bp, Homo sapiens
tggcagcagacaaaaggccatt

SEQ ID NO: 8024908 - DNA, 22 bp, Homo sapiens
tggcagcagacatctgaggtct

SEQ ID NO: 8024909 - DNA, 22 bp, Homo sapiens
tggcagcagacatctgaggtct

SEQ ID NO: 8024910 - DNA, 22 bp, Homo sapiens
tggcagcagacatctgaggtct

SEQ ID NO: 8024911 - DNA, 22 bp, Homo sapiens
tggcagcagacatctgaggtct

SEQ ID NO: 8024912 - DNA, 22 bp, Homo sapiens
tggcagccatctgagggtgggg

SEQ ID NO: 8024913 - DNA, 22 bp, Homo sapiens
tggcagccatctgagggtgggg

SEQ ID NO: 8024914 - DNA, 22 bp, Homo sapiens
tggcagccatctgagggtgggg

SEQ ID NO: 8024915 - DNA, 22 bp, Homo sapiens
tggcagcctcagacaaggacct

SEQ ID NO: 8024916 - DNA, 19 bp, Homo sapiens
tggcagcctccacttttgc

SEQ ID NO: 8024917 - DNA, 22 bp, Homo sapiens
tggcagcctcccagctgcattc

SEQ ID NO: 8024918 - DNA, 22 bp, Homo sapiens
tggcagcctcagacaaggacct

SEQ ID NO: 8024919 - DNA, 22 bp, Homo sapiens
tggcagcctcagacaaggacct

SEQ ID NO: 8024920 - DNA, 22 bp, Homo sapiens
tggcagcctcagacaaggacct

SEQ ID NO: 8024921 - DNA, 22 bp, Homo sapiens
tggcagccttctctgagaaggt

SEQ ID NO: 8024922 - DNA, 22 bp, Homo sapiens
tggcagcctggaatctctcagc

SEQ ID NO: 8024923 - DNA, 22 bp, Homo sapiens
tggcagcctggaatctctcagc

SEQ ID NO: 8024924 - DNA, 22 bp, Homo sapiens
tggcagcctcccagctgcattc

SEQ ID NO: 8024925 - DNA, 22 bp, Homo sapiens
tggcagcctcccagctgcattc

SEQ ID NO: 8024926 - DNA, 22 bp, Homo sapiens
tggcagcctcccagctgcattc

SEQ ID NO: 8024927 - DNA, 22 bp, Homo sapiens
tggcagcctgcgtgaaggagct

SEQ ID NO: 8024928 - DNA, 22 bp, Homo sapiens
tggcagcctgcgtgaaggagct

SEQ ID NO: 8024929 - DNA, 22 bp, Homo sapiens
tggcagccatcagagcaggggt

SEQ ID NO: 8024930 - DNA, 22 bp, Homo sapiens
tggcagccatcagagcaggggt

SEQ ID NO: 8024931 - DNA, 22 bp, Homo sapiens
tggcagccatcagagcaggggt

SEQ ID NO: 8024932 - DNA, 22 bp, Homo sapiens
tggcagccatcagagcaggggt

SEQ ID NO: 8024933 - DNA, 22 bp, Homo sapiens
tggcagccacatctcgtggatt

SEQ ID NO: 8024934 - DNA, 22 bp, Homo sapiens
tggcagcattttttccagaaca

SEQ ID NO: 8024935 - DNA, 22 bp, Homo sapiens
tggcagcattttttccagaaca

SEQ ID NO: 8024936 - DNA, 19 bp, Homo sapiens
tggcagcattggtaccttg

SEQ ID NO: 8024937 - DNA, 22 bp, Homo sapiens
tggcagcattaattattcaggt

SEQ ID NO: 8024938 - DNA, 22 bp, Homo sapiens
tggcagcattaattattcaggt

SEQ ID NO: 8024939 - DNA, 22 bp, Homo sapiens
tggcagcattttttccagaaca

SEQ ID NO: 8024940 - DNA, 22 bp, Homo sapiens
tggcagcattttttccagaaca

SEQ ID NO: 8024941 - DNA, 22 bp, Homo sapiens
tggcagcattttttccagaaca

SEQ ID NO: 8024942 - DNA, 19 bp, Homo sapiens
tggcagcattggtaccttg

SEQ ID NO: 8024943 - DNA, 22 bp, Homo sapiens
tggcagctccgggtaggggctg

SEQ ID NO: 8024944 - DNA, 22 bp, Homo sapiens
tggcagctcctggggccagcac

SEQ ID NO: 8024945 - DNA, 22 bp, Homo sapiens
tggcagctccgggtaggggctg

SEQ ID NO: 8024946 - DNA, 22 bp, Homo sapiens
tggcagctcctggggccagcac

SEQ ID NO: 8024947 - DNA, 22 bp, Homo sapiens
tggcagctcctggggccagcac

SEQ ID NO: 8024948 - DNA, 22 bp, Homo sapiens
tggcagctcctggggccagcac

SEQ ID NO: 8024949 - DNA, 22 bp, Homo sapiens
tggcagctcctggggccagcac

SEQ ID NO: 8024950 - DNA, 22 bp, Homo sapiens
tggcagctcctggggccagcac

SEQ ID NO: 8024951 - DNA, 22 bp, Homo sapiens
tggcagctcccagagcttccaa

SEQ ID NO: 8024952 - DNA, 22 bp, Homo sapiens
tggcagctccgggtaggggctg

SEQ ID NO: 8024953 - DNA, 22 bp, Homo sapiens
tggcagctcccagagcttccaa

SEQ ID NO: 8024954 - DNA, 22 bp, Homo sapiens
tggcagctattacaaggaagtc

SEQ ID NO: 8024955 - DNA, 22 bp, Homo sapiens
tggcagctattacaaggaagtc

SEQ ID NO: 8024956 - DNA, 22 bp, Homo sapiens
tggcagctcatttggaaatgga

SEQ ID NO: 8024957 - DNA, 22 bp, Homo sapiens
tggcagctacagacagaggtga

SEQ ID NO: 8024958 - DNA, 22 bp, Homo sapiens
tggcagctacagacagaggtga

SEQ ID NO: 8024959 - DNA, 22 bp, Homo sapiens
tggcagctacagacagaggtga

SEQ ID NO: 8024960 - DNA, 22 bp, Homo sapiens
tggcagccttctctgagaaggt

SEQ ID NO: 8024961 - DNA, 22 bp, Homo sapiens
tggcagccttctctgagaaggt

SEQ ID NO: 8024962 - DNA, 22 bp, Homo sapiens
tggcagccttctctgagaaggt

SEQ ID NO: 8024963 - DNA, 22 bp, Homo sapiens
tggcagctacagacagaggtga

SEQ ID NO: 8024964 - DNA, 22 bp, Homo sapiens
tggcagctagatagtgtgttta

SEQ ID NO: 8024965 - DNA, 18 bp, Homo sapiens
tggcagctaggtaaagaa

SEQ ID NO: 8024966 - DNA, 22 bp, Homo sapiens
tggcagctagctgttttcatgc

SEQ ID NO: 8024967 - DNA, 18 bp, Homo sapiens
tggcagctaggtaaagaa

SEQ ID NO: 8024968 - DNA, 22 bp, Homo sapiens
tggcagctatctttaatgagat

SEQ ID NO: 8024969 - DNA, 22 bp, Homo sapiens
tggcagctatggtctaagggcc

SEQ ID NO: 8024970 - DNA, 22 bp, Homo sapiens
tggcagctatggtctaagggcc

SEQ ID NO: 8024971 - DNA, 22 bp, Homo sapiens
tggcagagtgcagaagaggcat

SEQ ID NO: 8024972 - DNA, 22 bp, Homo sapiens
tggcagagtgcagaagaggcat

SEQ ID NO: 8024973 - DNA, 22 bp, Homo sapiens
tggcagagtgcagaagaggcat

SEQ ID NO: 8024974 - DNA, 21 bp, Homo sapiens
tggcagagtgcagtctataca

SEQ ID NO: 8024975 - DNA, 21 bp, Homo sapiens
tggcagagtgcagtctataca

SEQ ID NO: 8024976 - DNA, 22 bp, Homo sapiens
tggcagagtgcagaagaggcat

SEQ ID NO: 8024977 - DNA, 22 bp, Homo sapiens
tggcagagtgcagaagaggcat

SEQ ID NO: 8024978 - DNA, 22 bp, Homo sapiens
tggcagagtgcagaagaggcat

SEQ ID NO: 8024979 - DNA, 22 bp, Homo sapiens
tggcagagtgcagaagaggcat

SEQ ID NO: 8024980 - DNA, 22 bp, Homo sapiens
tggcagagtgcagaagaggcat

SEQ ID NO: 8024981 - DNA, 22 bp, Homo sapiens
tggcagagtctgggcttgggca

SEQ ID NO: 8024982 - DNA, 22 bp, Homo sapiens
tggcagagtggaccatactcaa

SEQ ID NO: 8024983 - DNA, 22 bp, Homo sapiens
tggcagagtggaccatactcaa

SEQ ID NO: 8024984 - DNA, 22 bp, Homo sapiens
tggcagagtggaccatactcaa

SEQ ID NO: 8024985 - DNA, 22 bp, Homo sapiens
tggcagagtggaccatactcaa

SEQ ID NO: 8024986 - DNA, 21 bp, Homo sapiens
tggcagagtgcagtctataca

SEQ ID NO: 8024987 - DNA, 22 bp, Homo sapiens
tggcagagtggaccatactcaa

SEQ ID NO: 8024988 - DNA, 22 bp, Homo sapiens
tggcagagtggaccatactcaa

SEQ ID NO: 8024989 - DNA, 22 bp, Homo sapiens
tggcagagtggaccatactcaa

SEQ ID NO: 8024990 - DNA, 22 bp, Homo sapiens
tggcagagtggaccatactcaa

SEQ ID NO: 8024991 - DNA, 22 bp, Homo sapiens
tggcagagtggaccatactcaa

SEQ ID NO: 8024992 - DNA, 21 bp, Homo sapiens
tggcagagtgcagtctataca

SEQ ID NO: 8024993 - DNA, 21 bp, Homo sapiens
tggcagagtgcagtctataca

SEQ ID NO: 8024994 - DNA, 22 bp, Homo sapiens
tggcagagtgcggcatcccctg

SEQ ID NO: 8024995 - DNA, 22 bp, Homo sapiens
tggcagagtgcggcatcccctg

SEQ ID NO: 8024996 - DNA, 22 bp, Homo sapiens
tggcagagtgcggcatcccctg

SEQ ID NO: 8024997 - DNA, 22 bp, Homo sapiens
tggcagagtgcggcatcccctg

SEQ ID NO: 8024998 - DNA, 22 bp, Homo sapiens
tggcagagtaggatggccctgt

SEQ ID NO: 8024999 - DNA, 22 bp, Homo sapiens
tggcagagtaggatggccctgt

SEQ ID NO: 8025000 - DNA, 22 bp, Homo sapiens
tggcagagtaggatggccctgt

SEQ ID NO: 8025001 - DNA, 22 bp, Homo sapiens
tggcagagtaggatggccctgt

SEQ ID NO: 8025002 - DNA, 22 bp, Homo sapiens
tggcagagtaggatggccctgt

SEQ ID NO: 8025003 - DNA, 22 bp, Homo sapiens
tggcagagtaggatggccctgt

SEQ ID NO: 8025004 - DNA, 22 bp, Homo sapiens
tggcagagtcatcacatctgga

SEQ ID NO: 8025005 - DNA, 22 bp, Homo sapiens
tggcagagtcatcacatctgga

SEQ ID NO: 8025006 - DNA, 22 bp, Homo sapiens
tggcagagtcatcacatctgga

SEQ ID NO: 8025007 - DNA, 22 bp, Homo sapiens
tggcagagtcatcacatctgga

SEQ ID NO: 8025008 - DNA, 22 bp, Homo sapiens
tggcagagtcatcacatctgga

SEQ ID NO: 8025009 - DNA, 22 bp, Homo sapiens
tggcagagtcatcacatctgga

SEQ ID NO: 8025010 - DNA, 22 bp, Homo sapiens
tggcagagtctctcctttccag

SEQ ID NO: 8025011 - DNA, 22 bp, Homo sapiens
tggcagagtctctcctttccag

SEQ ID NO: 8025012 - DNA, 22 bp, Homo sapiens
tggcagagtcatcacatctgga

SEQ ID NO: 8025013 - DNA, 22 bp, Homo sapiens
tggcagagtctctcctttccag

SEQ ID NO: 8025014 - DNA, 22 bp, Homo sapiens
tggcagagtctctcctttccag

SEQ ID NO: 8025015 - DNA, 22 bp, Homo sapiens
tggcagagtctctcctttccag

SEQ ID NO: 8025016 - DNA, 22 bp, Homo sapiens
tggcagagtctgggcttgggca

SEQ ID NO: 8025017 - DNA, 22 bp, Homo sapiens
tggcagagtctgggcttgggca

SEQ ID NO: 8025018 - DNA, 22 bp, Homo sapiens
tggcagagtctgggcttgggca

SEQ ID NO: 8025019 - DNA, 22 bp, Homo sapiens
tggcagagtctgggcttgggca

SEQ ID NO: 8025020 - DNA, 22 bp, Homo sapiens
tggcagagtctgggcttgggca

SEQ ID NO: 8025021 - DNA, 22 bp, Homo sapiens
tggcagatacccaggcaaatgg

SEQ ID NO: 8025022 - DNA, 22 bp, Homo sapiens
tggcagcagaacatgaaaccca

SEQ ID NO: 8025023 - DNA, 22 bp, Homo sapiens
tggcagcacttgaacttgagcc

SEQ ID NO: 8025024 - DNA, 22 bp, Homo sapiens
tggcagcacttgaacttgagcc

SEQ ID NO: 8025025 - DNA, 22 bp, Homo sapiens
tggcagcagacaaaaggccatt

SEQ ID NO: 8025026 - DNA, 22 bp, Homo sapiens
tggcagcagacaaaaggccatt

SEQ ID NO: 8025027 - DNA, 22 bp, Homo sapiens
tggcagataaaataatagggaa

SEQ ID NO: 8025028 - DNA, 20 bp, Homo sapiens
tggcagagttgtcccaccca

SEQ ID NO: 8025029 - DNA, 20 bp, Homo sapiens
tggcagagttgtcccaccca

SEQ ID NO: 8025030 - DNA, 22 bp, Homo sapiens
tggcagataacctgctgtgccc

SEQ ID NO: 8025031 - DNA, 20 bp, Homo sapiens
tggcagagttgtcccaccca

SEQ ID NO: 8025032 - DNA, 20 bp, Homo sapiens
tggcagagttgtcccaccca

SEQ ID NO: 8025033 - DNA, 20 bp, Homo sapiens
tggcagagttgtcccaccca

SEQ ID NO: 8025034 - DNA, 20 bp, Homo sapiens
tggcagagttgtcccaccca

SEQ ID NO: 8025035 - DNA, 22 bp, Homo sapiens
tggcagagttggaggtggaaga

SEQ ID NO: 8025036 - DNA, 21 bp, Homo sapiens
tggcagagttgagtagttatg

SEQ ID NO: 8025037 - DNA, 22 bp, Homo sapiens
tggcagagttggaggtggaaga

SEQ ID NO: 8025038 - DNA, 22 bp, Homo sapiens
tggcagagttggaggtggaaga

SEQ ID NO: 8025039 - DNA, 22 bp, Homo sapiens
tggcagagttggaggtggaaga

SEQ ID NO: 8025040 - DNA, 22 bp, Homo sapiens
tggcagagttggaggtggaaga

SEQ ID NO: 8025041 - DNA, 22 bp, Homo sapiens
tggcagagttggaggtggaaga

SEQ ID NO: 8025042 - DNA, 22 bp, Homo sapiens
tggcagagttcgctgtgccttt

SEQ ID NO: 8025043 - DNA, 22 bp, Homo sapiens
tggcagagttcgctgtgccttt

SEQ ID NO: 8025044 - DNA, 22 bp, Homo sapiens
tggcagagttcgctgtgccttt

SEQ ID NO: 8025045 - DNA, 22 bp, Homo sapiens
tggcagagttcgctgtgccttt

SEQ ID NO: 8025046 - DNA, 22 bp, Homo sapiens
tggcagagttcgctcctattca

SEQ ID NO: 8025047 - DNA, 21 bp, Homo sapiens
tggcagagttgagtagttatg

SEQ ID NO: 8025048 - DNA, 21 bp, Homo sapiens
tggcagagttgagtagttatg

SEQ ID NO: 8025049 - DNA, 21 bp, Homo sapiens
tggcagagttgagtagttatg

SEQ ID NO: 8025050 - DNA, 22 bp, Homo sapiens
tggcagagttcgctgtgccttt

SEQ ID NO: 8025051 - DNA, 22 bp, Homo sapiens
tggcagagttcgctgtgccttt

SEQ ID NO: 8025052 - DNA, 18 bp, Homo sapiens
tggcagagtgtctgttct

SEQ ID NO: 8025053 - DNA, 18 bp, Homo sapiens
tggcagagtgtctgttct

SEQ ID NO: 8025054 - DNA, 18 bp, Homo sapiens
tggcagagtgtctgttct

SEQ ID NO: 8025055 - DNA, 18 bp, Homo sapiens
tggcagagtgtctgttct

SEQ ID NO: 8025056 - DNA, 22 bp, Homo sapiens
tggcagagttatgggtatttat

SEQ ID NO: 8025057 - DNA, 22 bp, Homo sapiens
tggcagagttcgctcctattca

SEQ ID NO: 8025058 - DNA, 18 bp, Homo sapiens
tggcagagtgtctgttct

SEQ ID NO: 8025059 - DNA, 22 bp, Homo sapiens
tggcagagttatgggtatttat

SEQ ID NO: 8025060 - DNA, 22 bp, Homo sapiens
tggcaaagatgaagcatttcgt

SEQ ID NO: 8025061 - DNA, 22 bp, Homo sapiens
tggcaaagatggttctcaccat

SEQ ID NO: 8025062 - DNA, 22 bp, Homo sapiens
tggcaaagattaccacatctac

SEQ ID NO: 8025063 - DNA, 22 bp, Homo sapiens
tggcaaagacgctagctaagat

SEQ ID NO: 8025064 - DNA, 22 bp, Homo sapiens
tggcaaagacgctagctaagat

SEQ ID NO: 8025065 - DNA, 22 bp, Homo sapiens
tggcaaagacgctagctaagat

SEQ ID NO: 8025066 - DNA, 22 bp, Homo sapiens
tggcaaagactgcaaggacttt

SEQ ID NO: 8025067 - DNA, 22 bp, Homo sapiens
tggcaaaagttttaggttattt

SEQ ID NO: 8025068 - DNA, 22 bp, Homo sapiens
tggcaaaacccacaattatatc

SEQ ID NO: 8025069 - DNA, 22 bp, Homo sapiens
tggcaaaacccacaattatatc

SEQ ID NO: 8025070 - DNA, 22 bp, Homo sapiens
tggattttagcatgtaactgtg

SEQ ID NO: 8025071 - DNA, 22 bp, Homo sapiens
tggatttgggagcctttccttc

SEQ ID NO: 8025072 - DNA, 22 bp, Homo sapiens
tggatttgggagcctttccttc

SEQ ID NO: 8025073 - DNA, 22 bp, Homo sapiens
tggcaaagaccgcaattacttt

SEQ ID NO: 8025074 - DNA, 22 bp, Homo sapiens
tggcaaactgaagtacatgtca

SEQ ID NO: 8025075 - DNA, 22 bp, Homo sapiens
tggcaaaatgagcaattacttt

SEQ ID NO: 8025076 - DNA, 22 bp, Homo sapiens
tggcaaaagttttaggttattt

SEQ ID NO: 8025077 - DNA, 22 bp, Homo sapiens
tggcaaactggaggaagccctg

SEQ ID NO: 8025078 - DNA, 22 bp, Homo sapiens
tggcaaaatgagcaattacttt

SEQ ID NO: 8025079 - DNA, 22 bp, Homo sapiens
tggcaaaggcgctcacatgcct

SEQ ID NO: 8025080 - DNA, 22 bp, Homo sapiens
tggcaaaggaacctattttaaa

SEQ ID NO: 8025081 - DNA, 22 bp, Homo sapiens
tggcaaaggcgctcacatgcct

SEQ ID NO: 8025082 - DNA, 22 bp, Homo sapiens
tggcaaaggggaccatgttgaa

SEQ ID NO: 8025083 - DNA, 22 bp, Homo sapiens
tggcaaagtatctgtcccagct

SEQ ID NO: 8025084 - DNA, 22 bp, Homo sapiens
tggcaaagtaattgggtttctc

SEQ ID NO: 8025085 - DNA, 22 bp, Homo sapiens
tggcaaagctagacattccctc

SEQ ID NO: 8025086 - DNA, 22 bp, Homo sapiens
tggcaaaggaaatgatttaaga

SEQ ID NO: 8025087 - DNA, 22 bp, Homo sapiens
tggcaaaggaaatgatttaaga

SEQ ID NO: 8025088 - DNA, 22 bp, Homo sapiens
tggcaaagattaccacatctac

SEQ ID NO: 8025089 - DNA, 22 bp, Homo sapiens
tggcaaagattaccacatctac

SEQ ID NO: 8025090 - DNA, 23 bp, Homo sapiens
tggcaaagcattcttataacagt

SEQ ID NO: 8025091 - DNA, 23 bp, Homo sapiens
tggcaaagcattcttataacagt

SEQ ID NO: 8025092 - DNA, 22 bp, Homo sapiens
tggcaataattgtaattcaatt

SEQ ID NO: 8025093 - DNA, 22 bp, Homo sapiens
tggcaaccacaactacttttgc

SEQ ID NO: 8025094 - DNA, 22 bp, Homo sapiens
tggcaacatgtcgaagtgctgt

SEQ ID NO: 8025095 - DNA, 22 bp, Homo sapiens
tggcaaccaggtggtctagggt

SEQ ID NO: 8025096 - DNA, 22 bp, Homo sapiens
tggcaaccgcatggcctgcttc

SEQ ID NO: 8025097 - DNA, 23 bp, Homo sapiens
tggcaactagtggtgaagagcct

SEQ ID NO: 8025098 - DNA, 23 bp, Homo sapiens
tggcaactagtggtgaagagcct

SEQ ID NO: 8025099 - DNA, 22 bp, Homo sapiens
tggcaacctctgtgctatggag

SEQ ID NO: 8025100 - DNA, 22 bp, Homo sapiens
tggcaactcctgactctactca

SEQ ID NO: 8025101 - DNA, 22 bp, Homo sapiens
tggcaaagtttatcaggaatat

SEQ ID NO: 8025102 - DNA, 22 bp, Homo sapiens
tggcaaagtttatcaggaatat

SEQ ID NO: 8025103 - DNA, 22 bp, Homo sapiens
tggcaaagtgactccttggggc

SEQ ID NO: 8025104 - DNA, 22 bp, Homo sapiens
tggcaaatattttgttttgtaa

SEQ ID NO: 8025105 - DNA, 22 bp, Homo sapiens
tggcaacaagaaaggcagaggg

SEQ ID NO: 8025106 - DNA, 22 bp, Homo sapiens
tggcaacaagaaaggcagaggg

SEQ ID NO: 8025107 - DNA, 22 bp, Homo sapiens
tggcaacacctggaagacatgg

SEQ ID NO: 8025108 - DNA, 22 bp, Homo sapiens
tggcaacacctggaagacatgg

SEQ ID NO: 8025109 - DNA, 22 bp, Homo sapiens
tggcaacatggacaggtctgcc

SEQ ID NO: 8025110 - DNA, 22 bp, Homo sapiens
tggcaacatggacaggtctgcc

SEQ ID NO: 8025111 - DNA, 22 bp, Homo sapiens
tggcaacatgtcgaagtgctgt

SEQ ID NO: 8025112 - DNA, 22 bp, Homo sapiens
tggcaacatgtcgaagtgctgt

SEQ ID NO: 8025113 - DNA, 22 bp, Homo sapiens
tggcaacatgtcgaagtgctgt

SEQ ID NO: 8025114 - DNA, 22 bp, Homo sapiens
tggattattgtaagacaaagta

SEQ ID NO: 8025115 - DNA, 22 bp, Homo sapiens
tggattcaaatttcagctctgt

SEQ ID NO: 8025116 - DNA, 22 bp, Homo sapiens
tggattattgtaagacaaagta

SEQ ID NO: 8025117 - DNA, 22 bp, Homo sapiens
tggattcacaccattctcctgc

SEQ ID NO: 8025118 - DNA, 22 bp, Homo sapiens
tggattcaaatttcagctctgt

SEQ ID NO: 8025119 - DNA, 22 bp, Homo sapiens
tggattagttaagaaatgttag

SEQ ID NO: 8025120 - DNA, 22 bp, Homo sapiens
tggattagtttaacaatgtggc

SEQ ID NO: 8025121 - DNA, 22 bp, Homo sapiens
tggattagtttcaaggcagcaa

SEQ ID NO: 8025122 - DNA, 22 bp, Homo sapiens
tggattagtttcaaggcagcaa

SEQ ID NO: 8025123 - DNA, 17 bp, Homo sapiens
tggatgtgggatctgga

SEQ ID NO: 8025124 - DNA, 22 bp, Homo sapiens
tggatgtgagaaggatcaggct

SEQ ID NO: 8025125 - DNA, 22 bp, Homo sapiens
tggatgtgtcgccctggctctc

SEQ ID NO: 8025126 - DNA, 18 bp, Homo sapiens
tggattagaggagaaggt

SEQ ID NO: 8025127 - DNA, 22 bp, Homo sapiens
tggatgggttgaaatgtgagcc

SEQ ID NO: 8025128 - DNA, 22 bp, Homo sapiens
tggatgggttgaaatgtgagcc

SEQ ID NO: 8025129 - DNA, 22 bp, Homo sapiens
tggatgggttgaaatgtgagcc

SEQ ID NO: 8025130 - DNA, 22 bp, Homo sapiens
tggatggttctgggcggcagca

SEQ ID NO: 8025131 - DNA, 22 bp, Homo sapiens
tggatggttgaaaacgggcagt

SEQ ID NO: 8025132 - DNA, 22 bp, Homo sapiens
tggatgtagatgctcttgctga

SEQ ID NO: 8025133 - DNA, 22 bp, Homo sapiens
tggatgggttgaaatgtgagcc

SEQ ID NO: 8025134 - DNA, 22 bp, Homo sapiens
tggatggttctgggcggcagca

SEQ ID NO: 8025135 - DNA, 22 bp, Homo sapiens
tggatgtctcagcttgagctgc

SEQ ID NO: 8025136 - DNA, 22 bp, Homo sapiens
tggatgtcatagttggatatac

SEQ ID NO: 8025137 - DNA, 22 bp, Homo sapiens
tggatgtcaaaggagtttccag

SEQ ID NO: 8025138 - DNA, 22 bp, Homo sapiens
tggatgtaggacacatagaatt

SEQ ID NO: 8025139 - DNA, 20 bp, Homo sapiens
tggatgtcaaattaggctgg

SEQ ID NO: 8025140 - DNA, 22 bp, Homo sapiens
tggatgtcatagttggatatac

SEQ ID NO: 8025141 - DNA, 22 bp, Homo sapiens
tggattctgggagagttctata

SEQ ID NO: 8025142 - DNA, 20 bp, Homo sapiens
tggattccctcctgggactc

SEQ ID NO: 8025143 - DNA, 18 bp, Homo sapiens
tggattgaattgagaggt

SEQ ID NO: 8025144 - DNA, 22 bp, Homo sapiens
tggattctgggctgtttgcatt

SEQ ID NO: 8025145 - DNA, 22 bp, Homo sapiens
tggattgataaaatgggatgtt

SEQ ID NO: 8025146 - DNA, 18 bp, Homo sapiens
tggattgaattgagaggt

SEQ ID NO: 8025147 - DNA, 18 bp, Homo sapiens
tggattgaattgagaggt

SEQ ID NO: 8025148 - DNA, 22 bp, Homo sapiens
tggattgaattaacacctccca

SEQ ID NO: 8025149 - DNA, 22 bp, Homo sapiens
tggattctaatgcacttcaaat

SEQ ID NO: 8025150 - DNA, 22 bp, Homo sapiens
tggattctcatgggaccagtag

SEQ ID NO: 8025151 - DNA, 22 bp, Homo sapiens
tggattctcatgggaccagtag

SEQ ID NO: 8025152 - DNA, 22 bp, Homo sapiens
tggattcacaccattctcctgc

SEQ ID NO: 8025153 - DNA, 22 bp, Homo sapiens
tggattcatgctgggatttttc

SEQ ID NO: 8025154 - DNA, 22 bp, Homo sapiens
tggattcatgctgggatttttc

SEQ ID NO: 8025155 - DNA, 22 bp, Homo sapiens
tggattccacgcctgctcctgt

SEQ ID NO: 8025156 - DNA, 22 bp, Homo sapiens
tggattcacaccattctcctgc

SEQ ID NO: 8025157 - DNA, 22 bp, Homo sapiens
tggattcacaccattctcctgc

SEQ ID NO: 8025158 - DNA, 22 bp, Homo sapiens
tggatttattaggttggtgaaa

SEQ ID NO: 8025159 - DNA, 22 bp, Homo sapiens
tggatttctccagctctccatt

SEQ ID NO: 8025160 - DNA, 21 bp, Homo sapiens
tggatttgagcagtgcctcgg

SEQ ID NO: 8025161 - DNA, 22 bp, Homo sapiens
tggatttgctaccttctgatat

SEQ ID NO: 8025162 - DNA, 22 bp, Homo sapiens
tggatttgagatgtgttcagat

SEQ ID NO: 8025163 - DNA, 21 bp, Homo sapiens
tggattgaggtgacagtgtgc

SEQ ID NO: 8025164 - DNA, 22 bp, Homo sapiens
tggattgattataagagattca

SEQ ID NO: 8025165 - DNA, 22 bp, Homo sapiens
tggattgtaacatagagtaaat

SEQ ID NO: 8025166 - DNA, 22 bp, Homo sapiens
tggatttaacagaataccaggt

SEQ ID NO: 8025167 - DNA, 22 bp, Homo sapiens
tggatttaacagaataccaggt

SEQ ID NO: 8025168 - DNA, 22 bp, Homo sapiens
tggatttaatggatgaggggca

SEQ ID NO: 8025169 - DNA, 22 bp, Homo sapiens
tggatttaaggcagagagggcc

SEQ ID NO: 8025170 - DNA, 22 bp, Homo sapiens
tggatttaaggcagagagggcc

SEQ ID NO: 8025171 - DNA, 22 bp, Homo sapiens
tggatttaacagaataccaggt

SEQ ID NO: 8025172 - DNA, 22 bp, Homo sapiens
tggatttagttcttcacaggcc

SEQ ID NO: 8025173 - DNA, 22 bp, Homo sapiens
tggatttagttcttcacaggcc

SEQ ID NO: 8025174 - DNA, 22 bp, Homo sapiens
tggatttaatggatgaggggca

SEQ ID NO: 8025175 - DNA, 22 bp, Homo sapiens
tggatttaccacagggccacag

SEQ ID NO: 8025176 - DNA, 22 bp, Homo sapiens
tggcacagaaaaatgctccatt

SEQ ID NO: 8025177 - DNA, 22 bp, Homo sapiens
tggcacagaaaaatgctccatt

SEQ ID NO: 8025178 - DNA, 20 bp, Homo sapiens
tggcacagaacccttgccta

SEQ ID NO: 8025179 - DNA, 21 bp, Homo sapiens
tggcacagaaaggaaagttca

SEQ ID NO: 8025180 - DNA, 21 bp, Homo sapiens
tggcacagaaaggaaagttca

SEQ ID NO: 8025181 - DNA, 22 bp, Homo sapiens
tggcacagaaaaatgctccatt

SEQ ID NO: 8025182 - DNA, 22 bp, Homo sapiens
tggcacagacagatcaggagtc

SEQ ID NO: 8025183 - DNA, 20 bp, Homo sapiens
tggcacagaacccttgccta

SEQ ID NO: 8025184 - DNA, 22 bp, Homo sapiens
tggcacagacagatcaggagtc

SEQ ID NO: 8025185 - DNA, 22 bp, Homo sapiens
tggcacagacagatcaggagtc

SEQ ID NO: 8025186 - DNA, 22 bp, Homo sapiens
tggcacagacagatcaggagtc

SEQ ID NO: 8025187 - DNA, 22 bp, Homo sapiens
tggcacagacagatcaggagtc

SEQ ID NO: 8025188 - DNA, 20 bp, Homo sapiens
tggcacagaacccttgccta

SEQ ID NO: 8025189 - DNA, 20 bp, Homo sapiens
tggcacagaacccttgccta

SEQ ID NO: 8025190 - DNA, 20 bp, Homo sapiens
tggcacagaacccttgccta

SEQ ID NO: 8025191 - DNA, 22 bp, Homo sapiens
tggcacagacagatcaggagtc

SEQ ID NO: 8025192 - DNA, 22 bp, Homo sapiens
tggcacagacagcacagcaatg

SEQ ID NO: 8025193 - DNA, 22 bp, Homo sapiens
tggcacagacagcacagcaatg

SEQ ID NO: 8025194 - DNA, 22 bp, Homo sapiens
tggcacagacagcacagcaatg

SEQ ID NO: 8025195 - DNA, 22 bp, Homo sapiens
tggcacagacagcacagcaatg

SEQ ID NO: 8025196 - DNA, 22 bp, Homo sapiens
tggcacagacagatcaggagtc

SEQ ID NO: 8025197 - DNA, 22 bp, Homo sapiens
tggcacagacagatcaggagtc

SEQ ID NO: 8025198 - DNA, 22 bp, Homo sapiens
tggcacagacagcacagcaatg

SEQ ID NO: 8025199 - DNA, 22 bp, Homo sapiens
tggcacagacagcacagcaatg

SEQ ID NO: 8025200 - DNA, 22 bp, Homo sapiens
tggcacagaccttatcttctct

SEQ ID NO: 8025201 - DNA, 22 bp, Homo sapiens
tggcacagaccttatcttctct

SEQ ID NO: 8025202 - DNA, 22 bp, Homo sapiens
tggcacagaccttatcttctct

SEQ ID NO: 8025203 - DNA, 22 bp, Homo sapiens
tggcacagaccttatcttctct

SEQ ID NO: 8025204 - DNA, 22 bp, Homo sapiens
tggcaatgaggtcagatgtctt

SEQ ID NO: 8025205 - DNA, 21 bp, Homo sapiens
tggcaatggccaacagtcatc

SEQ ID NO: 8025206 - DNA, 22 bp, Homo sapiens
tggcaatgagcaggtgctctgg

SEQ ID NO: 8025207 - DNA, 22 bp, Homo sapiens
tggcaatgtaggcaagaacatt

SEQ ID NO: 8025208 - DNA, 22 bp, Homo sapiens
tggcaattgtccactgtctgcc

SEQ ID NO: 8025209 - DNA, 22 bp, Homo sapiens
tggcaatgttagcaaagcattt

SEQ ID NO: 8025210 - DNA, 22 bp, Homo sapiens
tggcaatgtggcatcaacgaag

SEQ ID NO: 8025211 - DNA, 22 bp, Homo sapiens
tggcacagaaaaatgctccatt

SEQ ID NO: 8025212 - DNA, 22 bp, Homo sapiens
tggcacagaaaaatgctccatt

SEQ ID NO: 8025213 - DNA, 22 bp, Homo sapiens
tggcacagaaaaatgctccatt

SEQ ID NO: 8025214 - DNA, 22 bp, Homo sapiens
tggcacagaaaaatgctccatt

SEQ ID NO: 8025215 - DNA, 22 bp, Homo sapiens
tggcacacagagaagacacttg

SEQ ID NO: 8025216 - DNA, 22 bp, Homo sapiens
tggcacacagagaagacacttg

SEQ ID NO: 8025217 - DNA, 22 bp, Homo sapiens
tggcacacagagaagacacttg

SEQ ID NO: 8025218 - DNA, 22 bp, Homo sapiens
tggcacaagggctattccttag

SEQ ID NO: 8025219 - DNA, 22 bp, Homo sapiens
tggcacaaaagtaattgcagtt

SEQ ID NO: 8025220 - DNA, 22 bp, Homo sapiens
tggcacaaaagtaattgcagtt

SEQ ID NO: 8025221 - DNA, 22 bp, Homo sapiens
tggcacagcccagagctcttga

SEQ ID NO: 8025222 - DNA, 22 bp, Homo sapiens
tggcacagcccattcagagaag

SEQ ID NO: 8025223 - DNA, 22 bp, Homo sapiens
tggcacagcccattcagagaag

SEQ ID NO: 8025224 - DNA, 22 bp, Homo sapiens
tggcacagcccattcagagaag

SEQ ID NO: 8025225 - DNA, 22 bp, Homo sapiens
tggcacagcccattcagagaag

SEQ ID NO: 8025226 - DNA, 22 bp, Homo sapiens
tggcacagcctccatgtcgtcc

SEQ ID NO: 8025227 - DNA, 22 bp, Homo sapiens
tggcacagtgctggatggtgct

SEQ ID NO: 8025228 - DNA, 22 bp, Homo sapiens
tggcacagcccggattctatga

SEQ ID NO: 8025229 - DNA, 22 bp, Homo sapiens
tggcacagcctttaaagtacca

SEQ ID NO: 8025230 - DNA, 22 bp, Homo sapiens
tggcacagtgctggatggtgct

SEQ ID NO: 8025231 - DNA, 22 bp, Homo sapiens
tggcacagtgctggatggtgct

SEQ ID NO: 8025232 - DNA, 22 bp, Homo sapiens
tggcacagccatcttctcctgc

SEQ ID NO: 8025233 - DNA, 22 bp, Homo sapiens
tggcacagcccagagctcttga

SEQ ID NO: 8025234 - DNA, 22 bp, Homo sapiens
tggcacagccatcttctcctgc

SEQ ID NO: 8025235 - DNA, 23 bp, Homo sapiens
tggcacagcaggtgtgctttgtt

SEQ ID NO: 8025236 - DNA, 23 bp, Homo sapiens
tggcacagcaggtgtgctttgtt

SEQ ID NO: 8025237 - DNA, 22 bp, Homo sapiens
tggcacagccactgaatcggga

SEQ ID NO: 8025238 - DNA, 22 bp, Homo sapiens
tggcacagccactgaatcggga

SEQ ID NO: 8025239 - DNA, 22 bp, Homo sapiens
tggcacagccactgaatcggga

SEQ ID NO: 8025240 - DNA, 21 bp, Homo sapiens
tggcacagcaagtgggctcat

SEQ ID NO: 8025241 - DNA, 21 bp, Homo sapiens
tggcacagcaagtgggctcat

SEQ ID NO: 8025242 - DNA, 21 bp, Homo sapiens
tggcacagcaagtgggctcat

SEQ ID NO: 8025243 - DNA, 21 bp, Homo sapiens
tggcacagcaagtgggctcat

SEQ ID NO: 8025244 - DNA, 21 bp, Homo sapiens
tggcacagcaagtgggctcat

SEQ ID NO: 8025245 - DNA, 23 bp, Homo sapiens
tggcacagcaggtgtgctttgtt

SEQ ID NO: 8025246 - DNA, 23 bp, Homo sapiens
tggcacagcaggtgtgctttgtt

SEQ ID NO: 8025247 - DNA, 22 bp, Homo sapiens
tggcacagagggacccagcagc

SEQ ID NO: 8025248 - DNA, 17 bp, Homo sapiens
tggcacagaggtgctat

SEQ ID NO: 8025249 - DNA, 22 bp, Homo sapiens
tggcacagagggacccagcagc

SEQ ID NO: 8025250 - DNA, 17 bp, Homo sapiens
tggcacagaggtgctat

SEQ ID NO: 8025251 - DNA, 17 bp, Homo sapiens
tggcacagaggtgctat

SEQ ID NO: 8025252 - DNA, 17 bp, Homo sapiens
tggcacagaggtgctat

SEQ ID NO: 8025253 - DNA, 17 bp, Homo sapiens
tggcacagaggtgctat

SEQ ID NO: 8025254 - DNA, 21 bp, Homo sapiens
tggcacagcaagtgggctcat

SEQ ID NO: 8025255 - DNA, 22 bp, Homo sapiens
tggcacagcaagagtttgggaa

SEQ ID NO: 8025256 - DNA, 21 bp, Homo sapiens
tggcacagcaagtgggctcat

SEQ ID NO: 8025257 - DNA, 19 bp, Homo sapiens
tggcacagatttcctccct

SEQ ID NO: 8025258 - DNA, 22 bp, Homo sapiens
tggcacagcaagagtttgggaa

SEQ ID NO: 8025259 - DNA, 17 bp, Homo sapiens
tggcacagaggtgctat

SEQ ID NO: 8025260 - DNA, 17 bp, Homo sapiens
tggcacagaggtgctat

SEQ ID NO: 8025261 - DNA, 17 bp, Homo sapiens
tggcacagaggtgctat

SEQ ID NO: 8025262 - DNA, 22 bp, Homo sapiens
tggcacagagggacccagcagc

SEQ ID NO: 8025263 - DNA, 22 bp, Homo sapiens
tggcacagagggacccagcagc

SEQ ID NO: 8025264 - DNA, 23 bp, Homo sapiens
tggcacagaggaccatgctttgc

SEQ ID NO: 8025265 - DNA, 22 bp, Homo sapiens
tggcacagagggacccagcagc

SEQ ID NO: 8025266 - DNA, 23 bp, Homo sapiens
tggcacagaggaccatgctttgc

SEQ ID NO: 8025267 - DNA, 16 bp, Homo sapiens
tggcacagagcagata

SEQ ID NO: 8025268 - DNA, 22 bp, Homo sapiens
tggcacagactgggccaaggaa

SEQ ID NO: 8025269 - DNA, 22 bp, Homo sapiens
tggcacagactgggccaaggaa

SEQ ID NO: 8025270 - DNA, 22 bp, Homo sapiens
tggcacagactgggccaaggaa

SEQ ID NO: 8025271 - DNA, 22 bp, Homo sapiens
tggcacagactgggccaaggaa

SEQ ID NO: 8025272 - DNA, 22 bp, Homo sapiens
tggcacagactgggccaaggaa

SEQ ID NO: 8025273 - DNA, 22 bp, Homo sapiens
tggcacagactgggccaaggaa

SEQ ID NO: 8025274 - DNA, 22 bp, Homo sapiens
tggcagagaacacggctgatct

SEQ ID NO: 8025275 - DNA, 22 bp, Homo sapiens
tggcagagaacacggctgatct

SEQ ID NO: 8025276 - DNA, 22 bp, Homo sapiens
tggcagagaacacggctgatct

SEQ ID NO: 8025277 - DNA, 22 bp, Homo sapiens
tggcagagaacacggctgatct

SEQ ID NO: 8025278 - DNA, 22 bp, Homo sapiens
tggcagagaacacggctgatct

SEQ ID NO: 8025279 - DNA, 22 bp, Homo sapiens
tggcagagaacacggctgatct

SEQ ID NO: 8025280 - DNA, 22 bp, Homo sapiens
tggcagagaataaatcttgact

SEQ ID NO: 8025281 - DNA, 22 bp, Homo sapiens
tggcagagaataaatcttgact

SEQ ID NO: 8025282 - DNA, 22 bp, Homo sapiens
tggcagagaacctgggctttgt

SEQ ID NO: 8025283 - DNA, 22 bp, Homo sapiens
tggcagagaacctgggctttgt

SEQ ID NO: 8025284 - DNA, 22 bp, Homo sapiens
tggcagagaacctgggctttgt

SEQ ID NO: 8025285 - DNA, 22 bp, Homo sapiens
tggcagagaacctgggctttgt

SEQ ID NO: 8025286 - DNA, 22 bp, Homo sapiens
tggcagagacaaggccgggcct

SEQ ID NO: 8025287 - DNA, 22 bp, Homo sapiens
tggcagagacaaggccgggcct

SEQ ID NO: 8025288 - DNA, 22 bp, Homo sapiens
tggcagagacaaggccgggcct

SEQ ID NO: 8025289 - DNA, 22 bp, Homo sapiens
tggcagagacaaggccgggcct

SEQ ID NO: 8025290 - DNA, 22 bp, Homo sapiens
tggcagagacaaggccgggcct

SEQ ID NO: 8025291 - DNA, 22 bp, Homo sapiens
tggcagagaataaatcttgact

SEQ ID NO: 8025292 - DNA, 22 bp, Homo sapiens
tggcagagacaaggccgggcct

SEQ ID NO: 8025293 - DNA, 23 bp, Homo sapiens
tggcagagacccagaatctacat

SEQ ID NO: 8025294 - DNA, 23 bp, Homo sapiens
tggcagagacccagaatctacat

SEQ ID NO: 8025295 - DNA, 23 bp, Homo sapiens
tggcagagacccagaatctacat

SEQ ID NO: 8025296 - DNA, 23 bp, Homo sapiens
tggcagagacccagaatctacat

SEQ ID NO: 8025297 - DNA, 22 bp, Homo sapiens
tggcagagacaaggccgggcct

SEQ ID NO: 8025298 - DNA, 22 bp, Homo sapiens
tggcagagagactctccttgat

SEQ ID NO: 8025299 - DNA, 22 bp, Homo sapiens
tggcagagagactctccttgat

SEQ ID NO: 8025300 - DNA, 22 bp, Homo sapiens
tggcagagagactctccttgat

SEQ ID NO: 8025301 - DNA, 22 bp, Homo sapiens
tggcagagagactctccttgat

SEQ ID NO: 8025302 - DNA, 22 bp, Homo sapiens
tggcagagagactctccttgat

SEQ ID NO: 8025303 - DNA, 22 bp, Homo sapiens
tggcagagactcctcctgggag

SEQ ID NO: 8025304 - DNA, 22 bp, Homo sapiens
tggcagagactcctcctgggag

SEQ ID NO: 8025305 - DNA, 22 bp, Homo sapiens
tggcagagactcctcctgggag

SEQ ID NO: 8025306 - DNA, 22 bp, Homo sapiens
tggcagagactcctcctgggag

SEQ ID NO: 8025307 - DNA, 22 bp, Homo sapiens
tggcagagactcctcctgggag

SEQ ID NO: 8025308 - DNA, 22 bp, Homo sapiens
tggcagagactcctcctgggag

SEQ ID NO: 8025309 - DNA, 22 bp, Homo sapiens
tggcagagactcctcctgggag

SEQ ID NO: 8025310 - DNA, 22 bp, Homo sapiens
tggcagagactcctcctgggag

SEQ ID NO: 8025311 - DNA, 22 bp, Homo sapiens
tggcagagactcctcctgggag

SEQ ID NO: 8025312 - DNA, 22 bp, Homo sapiens
tggcagagactcctcctgggag

SEQ ID NO: 8025313 - DNA, 22 bp, Homo sapiens
tggcagagagagtgcagtcgac

SEQ ID NO: 8025314 - DNA, 22 bp, Homo sapiens
tggcagagagagtgcagtcgac

SEQ ID NO: 8025315 - DNA, 22 bp, Homo sapiens
tggcagagagagtgcagtcgac

SEQ ID NO: 8025316 - DNA, 22 bp, Homo sapiens
tggcagagagagtgcagtcgac

SEQ ID NO: 8025317 - DNA, 22 bp, Homo sapiens
tggcagagagagtgcagtcgac

SEQ ID NO: 8025318 - DNA, 22 bp, Homo sapiens
tggcagagagagtgcagtcgac

SEQ ID NO: 8025319 - DNA, 22 bp, Homo sapiens
tggcagagagactctccttgat

SEQ ID NO: 8025320 - DNA, 22 bp, Homo sapiens
tggcagagagagtgcagtcgac

SEQ ID NO: 8025321 - DNA, 22 bp, Homo sapiens
tggcagagagactctccttgat

SEQ ID NO: 8025322 - DNA, 22 bp, Homo sapiens
tggcagagagactctccttgat

SEQ ID NO: 8025323 - DNA, 22 bp, Homo sapiens
tggcagagagactctccttgat

SEQ ID NO: 8025324 - DNA, 22 bp, Homo sapiens
tggcagagctggctgcggatga

SEQ ID NO: 8025325 - DNA, 22 bp, Homo sapiens
tggcagagctggctgcggatga

SEQ ID NO: 8025326 - DNA, 22 bp, Homo sapiens
tggcagagctggctgcggatga

SEQ ID NO: 8025327 - DNA, 22 bp, Homo sapiens
tggcagagctggctgcggatga

SEQ ID NO: 8025328 - DNA, 22 bp, Homo sapiens
tggcagagctggctgcggatga

SEQ ID NO: 8025329 - DNA, 22 bp, Homo sapiens
tggcagagcccagactccagtc

SEQ ID NO: 8025330 - DNA, 22 bp, Homo sapiens
tggcagagccttgccaaactcc

SEQ ID NO: 8025331 - DNA, 22 bp, Homo sapiens
tggcagagcccagactccagtc

SEQ ID NO: 8025332 - DNA, 22 bp, Homo sapiens
tggcagagccttgccaaactcc

SEQ ID NO: 8025333 - DNA, 22 bp, Homo sapiens
tggcagagccttgccaaactcc

SEQ ID NO: 8025334 - DNA, 22 bp, Homo sapiens
tggcagagctggctgcggatga

SEQ ID NO: 8025335 - DNA, 22 bp, Homo sapiens
tggcagaggaaaaagtcactgg

SEQ ID NO: 8025336 - DNA, 22 bp, Homo sapiens
tggcagaggaaaaagtcactgg

SEQ ID NO: 8025337 - DNA, 22 bp, Homo sapiens
tggcagagctggctgcggatga

SEQ ID NO: 8025338 - DNA, 22 bp, Homo sapiens
tggcagagctggctgcggatga

SEQ ID NO: 8025339 - DNA, 22 bp, Homo sapiens
tggcagaggaaaaagtcactgg

SEQ ID NO: 8025340 - DNA, 22 bp, Homo sapiens
tggcagaggaaaaagtcactgg

SEQ ID NO: 8025341 - DNA, 22 bp, Homo sapiens
tggcagaggaaaaagtcactgg

SEQ ID NO: 8025342 - DNA, 22 bp, Homo sapiens
tggcagaggaaaaagtcactgg

SEQ ID NO: 8025343 - DNA, 22 bp, Homo sapiens
tggcagaggaaaaagtcactgg

SEQ ID NO: 8025344 - DNA, 22 bp, Homo sapiens
tggcagaggaaaaagtcactgg

SEQ ID NO: 8025345 - DNA, 22 bp, Homo sapiens
tggcagaggtatattgggagga

SEQ ID NO: 8025346 - DNA, 16 bp, Homo sapiens
tggcagaggttcagcc

SEQ ID NO: 8025347 - DNA, 22 bp, Homo sapiens
tggcagagcccagactccagtc

SEQ ID NO: 8025348 - DNA, 22 bp, Homo sapiens
tggcagagcccagactccagtc

SEQ ID NO: 8025349 - DNA, 22 bp, Homo sapiens
tggcagagcccagactccagtc

SEQ ID NO: 8025350 - DNA, 22 bp, Homo sapiens
tggcagagcccagactccagtc

SEQ ID NO: 8025351 - DNA, 22 bp, Homo sapiens
tggcagagcccagactccagtc

SEQ ID NO: 8025352 - DNA, 22 bp, Homo sapiens
tggcagagcccagactccagtc

SEQ ID NO: 8025353 - DNA, 22 bp, Homo sapiens
tggcagagcccagactccagtc

SEQ ID NO: 8025354 - DNA, 22 bp, Homo sapiens
tggcagagcccagaactgagca

SEQ ID NO: 8025355 - DNA, 22 bp, Homo sapiens
tggcagagcccagaactgagca

SEQ ID NO: 8025356 - DNA, 22 bp, Homo sapiens
tggcagagcccagaactgagca

SEQ ID NO: 8025357 - DNA, 22 bp, Homo sapiens
tggcagagcccagaactgagca

SEQ ID NO: 8025358 - DNA, 22 bp, Homo sapiens
tggcagagcccagaactgagca

SEQ ID NO: 8025359 - DNA, 22 bp, Homo sapiens
tggcagagcccagaactgagca

SEQ ID NO: 8025360 - DNA, 22 bp, Homo sapiens
tggcagagagagtgcagtcgac

SEQ ID NO: 8025361 - DNA, 22 bp, Homo sapiens
tggcagagatgaagagttgttt

SEQ ID NO: 8025362 - DNA, 22 bp, Homo sapiens
tggcagagatgaagagttgttt

SEQ ID NO: 8025363 - DNA, 22 bp, Homo sapiens
tggcagagatgaagagttgttt

SEQ ID NO: 8025364 - DNA, 22 bp, Homo sapiens
tggcagagatgaagagttgttt

SEQ ID NO: 8025365 - DNA, 22 bp, Homo sapiens
tggcagagatgaagagttgttt

SEQ ID NO: 8025366 - DNA, 22 bp, Homo sapiens
tggcagagcaaaaagatagaat

SEQ ID NO: 8025367 - DNA, 22 bp, Homo sapiens
tggcagagcccagaactgagca

SEQ ID NO: 8025368 - DNA, 22 bp, Homo sapiens
tggcagagcaaaaagatagaat

SEQ ID NO: 8025369 - DNA, 22 bp, Homo sapiens
tggcagagatgaagagttgttt

SEQ ID NO: 8025370 - DNA, 22 bp, Homo sapiens
tggcagagcaaaaagatagaat

SEQ ID NO: 8025371 - DNA, 22 bp, Homo sapiens
tggcagagcaaaaagatagaat

SEQ ID NO: 8025372 - DNA, 22 bp, Homo sapiens
tggcactatggatgagactgat

SEQ ID NO: 8025373 - DNA, 22 bp, Homo sapiens
tggcactgaaaaaggagaggtt

SEQ ID NO: 8025374 - DNA, 22 bp, Homo sapiens
tggcactgaaaaaggagaggtt

SEQ ID NO: 8025375 - DNA, 22 bp, Homo sapiens
tggcactgaagctggaaagcct

SEQ ID NO: 8025376 - DNA, 22 bp, Homo sapiens
tggcactgaaaaaggagaggtt

SEQ ID NO: 8025377 - DNA, 22 bp, Homo sapiens
tggcactgaaaaaggagaggtt

SEQ ID NO: 8025378 - DNA, 22 bp, Homo sapiens
tggcactgaaaaaggagaggtt

SEQ ID NO: 8025379 - DNA, 22 bp, Homo sapiens
tggcactgaagctggaaagcct

SEQ ID NO: 8025380 - DNA, 22 bp, Homo sapiens
tggcactgaagctggaaagcct

SEQ ID NO: 8025381 - DNA, 22 bp, Homo sapiens
tggcactgaagctggaaagcct

SEQ ID NO: 8025382 - DNA, 22 bp, Homo sapiens
tggcactgaagctggaaagcct

SEQ ID NO: 8025383 - DNA, 22 bp, Homo sapiens
tggcactgaagctggaaagcct

SEQ ID NO: 8025384 - DNA, 22 bp, Homo sapiens
tggcactgaagctggaaagcct

SEQ ID NO: 8025385 - DNA, 22 bp, Homo sapiens
tggcactgaagctggaaagcct

SEQ ID NO: 8025386 - DNA, 22 bp, Homo sapiens
tggcactgacagggtgctcaag

SEQ ID NO: 8025387 - DNA, 22 bp, Homo sapiens
tggcactgacagggtgctcaag

SEQ ID NO: 8025388 - DNA, 22 bp, Homo sapiens
tggcactgacagggtgctcaag

SEQ ID NO: 8025389 - DNA, 22 bp, Homo sapiens
tggcaccctgaagttggtcact

SEQ ID NO: 8025390 - DNA, 22 bp, Homo sapiens
tggcacccagtggagctgtgct

SEQ ID NO: 8025391 - DNA, 22 bp, Homo sapiens
tggcacccagtggagctgtgct

SEQ ID NO: 8025392 - DNA, 22 bp, Homo sapiens
tggcaccatgttggcaaatgtt

SEQ ID NO: 8025393 - DNA, 22 bp, Homo sapiens
tggcaccatgttggcaaatgtt

SEQ ID NO: 8025394 - DNA, 22 bp, Homo sapiens
tggcacctggtgcagggtggcc

SEQ ID NO: 8025395 - DNA, 22 bp, Homo sapiens
tggcacctgaacttagaggtgt

SEQ ID NO: 8025396 - DNA, 22 bp, Homo sapiens
tggcacgacaattggcaccaat

SEQ ID NO: 8025397 - DNA, 22 bp, Homo sapiens
tggcacgacaattggcaccaat

SEQ ID NO: 8025398 - DNA, 22 bp, Homo sapiens
tggcacgacaattggcaccaat

SEQ ID NO: 8025399 - DNA, 22 bp, Homo sapiens
tggcacgacaattggcaccaat

SEQ ID NO: 8025400 - DNA, 22 bp, Homo sapiens
tggcacgacaattggcaccaat

SEQ ID NO: 8025401 - DNA, 22 bp, Homo sapiens
tggcactaagacggtgcttccc

SEQ ID NO: 8025402 - DNA, 22 bp, Homo sapiens
tggcacatggtaagactcagta

SEQ ID NO: 8025403 - DNA, 22 bp, Homo sapiens
tggcacatggttaatcataatt

SEQ ID NO: 8025404 - DNA, 22 bp, Homo sapiens
tggcacatggttaatcataatt

SEQ ID NO: 8025405 - DNA, 22 bp, Homo sapiens
tggcacatgatgttgtggcatc

SEQ ID NO: 8025406 - DNA, 22 bp, Homo sapiens
tggcacatgatgttgtggcatc

SEQ ID NO: 8025407 - DNA, 22 bp, Homo sapiens
tggcacatggtaagactcagta

SEQ ID NO: 8025408 - DNA, 22 bp, Homo sapiens
tggcacatatttttagtgctca

SEQ ID NO: 8025409 - DNA, 22 bp, Homo sapiens
tggcacatagaaaaggatcaat

SEQ ID NO: 8025410 - DNA, 22 bp, Homo sapiens
tggcacagttaaagttgtagaa

SEQ ID NO: 8025411 - DNA, 22 bp, Homo sapiens
tggcacagttaaagttgtagaa

SEQ ID NO: 8025412 - DNA, 22 bp, Homo sapiens
tggcacagttaaagttgtagaa

SEQ ID NO: 8025413 - DNA, 22 bp, Homo sapiens
tggcacagttaaagttgtagaa

SEQ ID NO: 8025414 - DNA, 22 bp, Homo sapiens
tggcacatagtaggtgctcaat

SEQ ID NO: 8025415 - DNA, 22 bp, Homo sapiens
tggcacatagcaggtactcagt

SEQ ID NO: 8025416 - DNA, 22 bp, Homo sapiens
tggcacatagcaggtactcagt

SEQ ID NO: 8025417 - DNA, 22 bp, Homo sapiens
tggcaccaccagacaccaggag

SEQ ID NO: 8025418 - DNA, 22 bp, Homo sapiens
tggcaccaccagacaccaggag

SEQ ID NO: 8025419 - DNA, 22 bp, Homo sapiens
tggcacatggttaatcataatt

SEQ ID NO: 8025420 - DNA, 22 bp, Homo sapiens
tggcaccaccagacaccaggag

SEQ ID NO: 8025421 - DNA, 22 bp, Homo sapiens
tggcaccaccagacaccaggag

SEQ ID NO: 8025422 - DNA, 22 bp, Homo sapiens
tggcaccagcacctagatgggg

SEQ ID NO: 8025423 - DNA, 22 bp, Homo sapiens
tggcaccatcaaggctgagaac

SEQ ID NO: 8025424 - DNA, 22 bp, Homo sapiens
tggcaccatcaaggctgagaac

SEQ ID NO: 8025425 - DNA, 20 bp, Homo sapiens
tggcaccaggtggtggcccc

SEQ ID NO: 8025426 - DNA, 22 bp, Homo sapiens
tggcaccagggaacaagcattt

SEQ ID NO: 8025427 - DNA, 22 bp, Homo sapiens
tggcaccagggaacaagcattt

SEQ ID NO: 8025428 - DNA, 22 bp, Homo sapiens
tggcaccagggaacaagcattt

SEQ ID NO: 8025429 - DNA, 22 bp, Homo sapiens
tggcactgccaacctgctaggt

SEQ ID NO: 8025430 - DNA, 22 bp, Homo sapiens
tggcactgccaacctgctaggt

SEQ ID NO: 8025431 - DNA, 22 bp, Homo sapiens
tggcactgccaacctgctaggt

SEQ ID NO: 8025432 - DNA, 22 bp, Homo sapiens
tggcactgccaacctgctaggt

SEQ ID NO: 8025433 - DNA, 22 bp, Homo sapiens
tggcactgccaacctgctaggt

SEQ ID NO: 8025434 - DNA, 22 bp, Homo sapiens
tggcactgccaacctgctaggt

SEQ ID NO: 8025435 - DNA, 22 bp, Homo sapiens
tggcactgaccccaggcctgtg

SEQ ID NO: 8025436 - DNA, 22 bp, Homo sapiens
tggcactgaccccaggcctgtg

SEQ ID NO: 8025437 - DNA, 22 bp, Homo sapiens
tggcactgaccccaggcctgtg

SEQ ID NO: 8025438 - DNA, 22 bp, Homo sapiens
tggcactgaccccaggcctgtg

SEQ ID NO: 8025439 - DNA, 22 bp, Homo sapiens
tggcactgcctggcagggcccc

SEQ ID NO: 8025440 - DNA, 21 bp, Homo sapiens
tggcactgcttagcaggttcc

SEQ ID NO: 8025441 - DNA, 21 bp, Homo sapiens
tggcactgcttagcaggttcc

SEQ ID NO: 8025442 - DNA, 22 bp, Homo sapiens
tggcactgccaacctgctaggt

SEQ ID NO: 8025443 - DNA, 22 bp, Homo sapiens
tggcactggaatcgtagccttg

SEQ ID NO: 8025444 - DNA, 22 bp, Homo sapiens
tggcactggaatcgtagccttg

SEQ ID NO: 8025445 - DNA, 21 bp, Homo sapiens
tggcactgcttagcaggttcc

SEQ ID NO: 8025446 - DNA, 22 bp, Homo sapiens
tggcactggaatcgtagccttg

SEQ ID NO: 8025447 - DNA, 22 bp, Homo sapiens
tggcactgtagccactactgcc

SEQ ID NO: 8025448 - DNA, 22 bp, Homo sapiens
tggcactgggatgctactgtta

SEQ ID NO: 8025449 - DNA, 22 bp, Homo sapiens
tggcactgtcaccaatgctgtc

SEQ ID NO: 8025450 - DNA, 22 bp, Homo sapiens
tggcactgtcaccaatgctgtc

SEQ ID NO: 8025451 - DNA, 22 bp, Homo sapiens
tggcactgtcaccaatgctgtc

SEQ ID NO: 8025452 - DNA, 22 bp, Homo sapiens
tggcactggcgcaggatggcgg

SEQ ID NO: 8025453 - DNA, 22 bp, Homo sapiens
tggcactgggacagatgctctc

SEQ ID NO: 8025454 - DNA, 22 bp, Homo sapiens
tggcactgggacagatgctctc

SEQ ID NO: 8025455 - DNA, 22 bp, Homo sapiens
tggcactgggatgctactgtta

SEQ ID NO: 8025456 - DNA, 22 bp, Homo sapiens
tggcactgggacagatgctctc

SEQ ID NO: 8025457 - DNA, 22 bp, Homo sapiens
tggcactggcgcaggatggcgg

SEQ ID NO: 8025458 - DNA, 22 bp, Homo sapiens
tggcactggcgcaggatggcgg

SEQ ID NO: 8025459 - DNA, 22 bp, Homo sapiens
tggcactggaatcgtagccttg

SEQ ID NO: 8025460 - DNA, 22 bp, Homo sapiens
tggcactggcgcaggatggcgg

SEQ ID NO: 8025461 - DNA, 22 bp, Homo sapiens
tggcactgggacagatgctctc

SEQ ID NO: 8025462 - DNA, 22 bp, Homo sapiens
tggcacttccgtctgccttgtg

SEQ ID NO: 8025463 - DNA, 22 bp, Homo sapiens
tggcagagaacacggctgatct

SEQ ID NO: 8025464 - DNA, 22 bp, Homo sapiens
tggcacttattcatatcatgga

SEQ ID NO: 8025465 - DNA, 22 bp, Homo sapiens
tggcacttccactgtggctgct

SEQ ID NO: 8025466 - DNA, 22 bp, Homo sapiens
tggcacttaggtacaagggaat

SEQ ID NO: 8025467 - DNA, 22 bp, Homo sapiens
tggcacttaatgcatgtgctat

SEQ ID NO: 8025468 - DNA, 22 bp, Homo sapiens
tggcactgtggatttcacaagt

SEQ ID NO: 8025469 - DNA, 22 bp, Homo sapiens
tggcacttagatcaggttgggt

SEQ ID NO: 8025470 - DNA, 22 bp, Homo sapiens
tggcacttagcagggaaggtgt

SEQ ID NO: 8025471 - DNA, 22 bp, Homo sapiens
tggcactgtcaccaatgctgtc

SEQ ID NO: 8025472 - DNA, 22 bp, Homo sapiens
tggcactgtggatttcacaagt

SEQ ID NO: 8025473 - DNA, 22 bp, Homo sapiens
tggcactgtggatttcacaagt

SEQ ID NO: 8025474 - DNA, 22 bp, Homo sapiens
tggcacttaaaaattattcttc

SEQ ID NO: 8025475 - DNA, 22 bp, Homo sapiens
tggcacttaaaaattattcttc

SEQ ID NO: 8025476 - DNA, 22 bp, Homo sapiens
tgggactcactcttttggccag

SEQ ID NO: 8025477 - DNA, 22 bp, Homo sapiens
tgggactcactcttttggccag

SEQ ID NO: 8025478 - DNA, 22 bp, Homo sapiens
tgggactcactcttttggccag

SEQ ID NO: 8025479 - DNA, 22 bp, Homo sapiens
tgggactcactcttttggccag

SEQ ID NO: 8025480 - DNA, 22 bp, Homo sapiens
tgggactcactcttttggccag

SEQ ID NO: 8025481 - DNA, 22 bp, Homo sapiens
tgggactcactcttttggccag

SEQ ID NO: 8025482 - DNA, 22 bp, Homo sapiens
tgggactcactcttttggccag

SEQ ID NO: 8025483 - DNA, 22 bp, Homo sapiens
tgggactcactcttttggccag

SEQ ID NO: 8025484 - DNA, 22 bp, Homo sapiens
tgggactcactcttttggccag

SEQ ID NO: 8025485 - DNA, 22 bp, Homo sapiens
tgggactcactcttttggccag

SEQ ID NO: 8025486 - DNA, 20 bp, Homo sapiens
tgggactgacccatctgagc

SEQ ID NO: 8025487 - DNA, 22 bp, Homo sapiens
tgggactgtgacctccagggta

SEQ ID NO: 8025488 - DNA, 22 bp, Homo sapiens
tgggactgtgacctccagggta

SEQ ID NO: 8025489 - DNA, 22 bp, Homo sapiens
tgggactgtgacctccagggta

SEQ ID NO: 8025490 - DNA, 22 bp, Homo sapiens
tgggactgtggtcaaggacaaa

SEQ ID NO: 8025491 - DNA, 22 bp, Homo sapiens
tgggactgctcttgctggggtc

SEQ ID NO: 8025492 - DNA, 22 bp, Homo sapiens
tgggactgagaatatgatgggg

SEQ ID NO: 8025493 - DNA, 22 bp, Homo sapiens
tgggaccagataaagggaggtc

SEQ ID NO: 8025494 - DNA, 21 bp, Homo sapiens
tgggacagtgatggctcctcc

SEQ ID NO: 8025495 - DNA, 21 bp, Homo sapiens
tgggacagtgatggctcctcc

SEQ ID NO: 8025496 - DNA, 21 bp, Homo sapiens
tgggacagtgatggctcctcc

SEQ ID NO: 8025497 - DNA, 21 bp, Homo sapiens
tgggacagtgatggctcctcc

SEQ ID NO: 8025498 - DNA, 21 bp, Homo sapiens
tgggacagtgatggctcctcc

SEQ ID NO: 8025499 - DNA, 22 bp, Homo sapiens
tgggacagtgaccccagaggtc

SEQ ID NO: 8025500 - DNA, 22 bp, Homo sapiens
tgggacagtgaccccagaggtc

SEQ ID NO: 8025501 - DNA, 21 bp, Homo sapiens
tgggacagtgatggctcctcc

SEQ ID NO: 8025502 - DNA, 21 bp, Homo sapiens
tgggacagtgatggctcctcc

SEQ ID NO: 8025503 - DNA, 22 bp, Homo sapiens
tgggacagtgtgccttgctcct

SEQ ID NO: 8025504 - DNA, 22 bp, Homo sapiens
tgggacagtgtgccttgctcct

SEQ ID NO: 8025505 - DNA, 22 bp, Homo sapiens
tgggacagtgtgccttgctcct

SEQ ID NO: 8025506 - DNA, 21 bp, Homo sapiens
tgggacagtgatggctcctcc

SEQ ID NO: 8025507 - DNA, 22 bp, Homo sapiens
tgggacagtgtgccttgctcct

SEQ ID NO: 8025508 - DNA, 22 bp, Homo sapiens
tgggacagtgtgccttgctcct

SEQ ID NO: 8025509 - DNA, 22 bp, Homo sapiens
tgggacagtgtgccttgctcct

SEQ ID NO: 8025510 - DNA, 22 bp, Homo sapiens
tgggaccaagtcatttctttag

SEQ ID NO: 8025511 - DNA, 22 bp, Homo sapiens
tgggaccacactttgaacaaca

SEQ ID NO: 8025512 - DNA, 22 bp, Homo sapiens
tgggacagttgtcctccactct

SEQ ID NO: 8025513 - DNA, 22 bp, Homo sapiens
tgggacagttgtcctccactct

SEQ ID NO: 8025514 - DNA, 22 bp, Homo sapiens
tgggacagttgtcctccactct

SEQ ID NO: 8025515 - DNA, 22 bp, Homo sapiens
tgggacagttgtcctccactct

SEQ ID NO: 8025516 - DNA, 23 bp, Homo sapiens
tgggaatgacatctagagcagag

SEQ ID NO: 8025517 - DNA, 22 bp, Homo sapiens
tgggaagttaggatgccaggga

SEQ ID NO: 8025518 - DNA, 22 bp, Homo sapiens
tgggaatacaagttattcacct

SEQ ID NO: 8025519 - DNA, 22 bp, Homo sapiens
tgggaatacaagttattcacct

SEQ ID NO: 8025520 - DNA, 22 bp, Homo sapiens
tgggaatagaacaagatagaga

SEQ ID NO: 8025521 - DNA, 22 bp, Homo sapiens
tgggaagttgtaccttctgtta

SEQ ID NO: 8025522 - DNA, 22 bp, Homo sapiens
tgggaagttgtaccttctgtta

SEQ ID NO: 8025523 - DNA, 22 bp, Homo sapiens
tgggaagtatcatttggcctgg

SEQ ID NO: 8025524 - DNA, 22 bp, Homo sapiens
tgggaaggttagcagtttgtca

SEQ ID NO: 8025525 - DNA, 22 bp, Homo sapiens
tgggaagtaggacagtgcagtt

SEQ ID NO: 8025526 - DNA, 22 bp, Homo sapiens
tgggaagtcgtagagttcatgt

SEQ ID NO: 8025527 - DNA, 22 bp, Homo sapiens
tgggaagtatcatttggcctgg

SEQ ID NO: 8025528 - DNA, 22 bp, Homo sapiens
tgggaagttaggatgccaggga

SEQ ID NO: 8025529 - DNA, 22 bp, Homo sapiens
tgggaaggttagcagtttgtca

SEQ ID NO: 8025530 - DNA, 22 bp, Homo sapiens
tgggaaggttagcagtttgtca

SEQ ID NO: 8025531 - DNA, 22 bp, Homo sapiens
tgggaaggttagcagtttgtca

SEQ ID NO: 8025532 - DNA, 22 bp, Homo sapiens
tgggaatgcaaggaaagctgtt

SEQ ID NO: 8025533 - DNA, 22 bp, Homo sapiens
tgggaatgggcctagaaggctg

SEQ ID NO: 8025534 - DNA, 22 bp, Homo sapiens
tgggaattgaggtgattgtgag

SEQ ID NO: 8025535 - DNA, 22 bp, Homo sapiens
tgggacaaggactagctccaat

SEQ ID NO: 8025536 - DNA, 22 bp, Homo sapiens
tgggacacagtgtgtgaagtgc

SEQ ID NO: 8025537 - DNA, 22 bp, Homo sapiens
tgggacacccaggagggagtgg

SEQ ID NO: 8025538 - DNA, 22 bp, Homo sapiens
tgggacagggaatctgatcccc

SEQ ID NO: 8025539 - DNA, 23 bp, Homo sapiens
tgggacacagggtcatggttatt

SEQ ID NO: 8025540 - DNA, 22 bp, Homo sapiens
tgggacacacaaggtcagctct

SEQ ID NO: 8025541 - DNA, 22 bp, Homo sapiens
tgggacacaaaccagaccagga

SEQ ID NO: 8025542 - DNA, 22 bp, Homo sapiens
tgggacacaaaccagaccagga

SEQ ID NO: 8025543 - DNA, 22 bp, Homo sapiens
tgggacagtgaccccagaggtc

SEQ ID NO: 8025544 - DNA, 22 bp, Homo sapiens
tgggacagtgaccccagaggtc

SEQ ID NO: 8025545 - DNA, 22 bp, Homo sapiens
tgggacagtgaccccagaggtc

SEQ ID NO: 8025546 - DNA, 22 bp, Homo sapiens
tgggacagtgaccccagaggtc

SEQ ID NO: 8025547 - DNA, 22 bp, Homo sapiens
tgggacagtgaccccagaggtc

SEQ ID NO: 8025548 - DNA, 22 bp, Homo sapiens
tgggacagtgaccccagaggtc

SEQ ID NO: 8025549 - DNA, 22 bp, Homo sapiens
tgggacaggttggagagaagca

SEQ ID NO: 8025550 - DNA, 22 bp, Homo sapiens
tgggacaggttggagagaagca

SEQ ID NO: 8025551 - DNA, 22 bp, Homo sapiens
tgggacaggttggagagaagca

SEQ ID NO: 8025552 - DNA, 22 bp, Homo sapiens
tgggacaggttggagagaagca

SEQ ID NO: 8025553 - DNA, 22 bp, Homo sapiens
tgggacaggttggagagaagca

SEQ ID NO: 8025554 - DNA, 22 bp, Homo sapiens
tgggacaggttggagagaagca

SEQ ID NO: 8025555 - DNA, 22 bp, Homo sapiens
tgggacaggttggagagaagca

SEQ ID NO: 8025556 - DNA, 22 bp, Homo sapiens
tgggaagaggcgggaggctgtt

SEQ ID NO: 8025557 - DNA, 22 bp, Homo sapiens
tgggaagaggggtataaagaag

SEQ ID NO: 8025558 - DNA, 22 bp, Homo sapiens
tgggaagaggggtataaagaag

SEQ ID NO: 8025559 - DNA, 22 bp, Homo sapiens
tgggaagaggggtataaagaag

SEQ ID NO: 8025560 - DNA, 22 bp, Homo sapiens
tgggaagaggggtataaagaag

SEQ ID NO: 8025561 - DNA, 22 bp, Homo sapiens
tgggaagagttagagacagctg

SEQ ID NO: 8025562 - DNA, 22 bp, Homo sapiens
tgggaagagttagagacagctg

SEQ ID NO: 8025563 - DNA, 23 bp, Homo sapiens
tgggaagatatgtatgttcaagg

SEQ ID NO: 8025564 - DNA, 22 bp, Homo sapiens
tgggaagatatgagtgaccaac

SEQ ID NO: 8025565 - DNA, 22 bp, Homo sapiens
tgggaagatatgagtgaccaac

SEQ ID NO: 8025566 - DNA, 22 bp, Homo sapiens
tgggaagcattaatgatagggg

SEQ ID NO: 8025567 - DNA, 22 bp, Homo sapiens
tgggaagcacgctcagcagaaa

SEQ ID NO: 8025568 - DNA, 22 bp, Homo sapiens
tgggaagcattaatgatagggg

SEQ ID NO: 8025569 - DNA, 22 bp, Homo sapiens
tgggaagatggagtgacaggca

SEQ ID NO: 8025570 - DNA, 22 bp, Homo sapiens
tgggaagatggagtgacaggca

SEQ ID NO: 8025571 - DNA, 22 bp, Homo sapiens
tgggaagatgataattcacagt

SEQ ID NO: 8025572 - DNA, 22 bp, Homo sapiens
tgggaagatgaggtgccatggg

SEQ ID NO: 8025573 - DNA, 22 bp, Homo sapiens
tgggaagatgaggtgccatggg

SEQ ID NO: 8025574 - DNA, 23 bp, Homo sapiens
tgggaagatatgtatgttcaagg

SEQ ID NO: 8025575 - DNA, 22 bp, Homo sapiens
tgggaagatgataattcacagt

SEQ ID NO: 8025576 - DNA, 22 bp, Homo sapiens
tgggaagatgataattcacagt

SEQ ID NO: 8025577 - DNA, 22 bp, Homo sapiens
tgggaagatgataattcacagt

SEQ ID NO: 8025578 - DNA, 22 bp, Homo sapiens
tgggaagatggagtgacaggca

SEQ ID NO: 8025579 - DNA, 22 bp, Homo sapiens
tgggaagatggagtgacaggca

SEQ ID NO: 8025580 - DNA, 22 bp, Homo sapiens
tgggaagatggagtgacaggca

SEQ ID NO: 8025581 - DNA, 22 bp, Homo sapiens
tgggaagctactcatgcaggca

SEQ ID NO: 8025582 - DNA, 22 bp, Homo sapiens
tgggaagctactcatgcaggca

SEQ ID NO: 8025583 - DNA, 22 bp, Homo sapiens
tgggaagcctagcagacagctg

SEQ ID NO: 8025584 - DNA, 22 bp, Homo sapiens
tgggaaggcgtggaagtagaag

SEQ ID NO: 8025585 - DNA, 22 bp, Homo sapiens
tgggaaggcgtggaagtagaag

SEQ ID NO: 8025586 - DNA, 22 bp, Homo sapiens
tgggaaggcgtggaagtagaag

SEQ ID NO: 8025587 - DNA, 22 bp, Homo sapiens
tgggaagggagagtgtcctgga

SEQ ID NO: 8025588 - DNA, 22 bp, Homo sapiens
tgggaaggcgtggaagtagaag

SEQ ID NO: 8025589 - DNA, 22 bp, Homo sapiens
tgggaagggagagtgtcctgga

SEQ ID NO: 8025590 - DNA, 22 bp, Homo sapiens
tgggaagggagtttcttggagt

SEQ ID NO: 8025591 - DNA, 22 bp, Homo sapiens
tgggaagggagtttcttggagt

SEQ ID NO: 8025592 - DNA, 22 bp, Homo sapiens
tgggaagggagagtgtcctgga

SEQ ID NO: 8025593 - DNA, 22 bp, Homo sapiens
tgggaagggagagtgtcctgga

SEQ ID NO: 8025594 - DNA, 22 bp, Homo sapiens
tgggaagggagtttcttggagt

SEQ ID NO: 8025595 - DNA, 22 bp, Homo sapiens
tgggaagggagtttcttggagt

SEQ ID NO: 8025596 - DNA, 22 bp, Homo sapiens
tgggaagggccgatggagcctc

SEQ ID NO: 8025597 - DNA, 22 bp, Homo sapiens
tgggaagggagtttcttggagt

SEQ ID NO: 8025598 - DNA, 22 bp, Homo sapiens
tgggaagggccgatggagcctc

SEQ ID NO: 8025599 - DNA, 22 bp, Homo sapiens
tgggaagggccgatggagcctc

SEQ ID NO: 8025600 - DNA, 22 bp, Homo sapiens
tgggaagggccgatggagcctc

SEQ ID NO: 8025601 - DNA, 22 bp, Homo sapiens
tgggaagggccgatggagcctc

SEQ ID NO: 8025602 - DNA, 22 bp, Homo sapiens
tgggaagggccgatggagcctc

SEQ ID NO: 8025603 - DNA, 22 bp, Homo sapiens
tgggaagggccgatggagcctc

SEQ ID NO: 8025604 - DNA, 22 bp, Homo sapiens
tgggaagggtcaacagctggaa

SEQ ID NO: 8025605 - DNA, 22 bp, Homo sapiens
tgggaagggtcaacagctggaa

SEQ ID NO: 8025606 - DNA, 22 bp, Homo sapiens
tgggaagggtcaacagctggaa

SEQ ID NO: 8025607 - DNA, 22 bp, Homo sapiens
tgggaagggtcaacagctggaa

SEQ ID NO: 8025608 - DNA, 22 bp, Homo sapiens
tgggaagggtcaacagctggaa

SEQ ID NO: 8025609 - DNA, 22 bp, Homo sapiens
tgggaagggtcaacagctggaa

SEQ ID NO: 8025610 - DNA, 22 bp, Homo sapiens
tgggaagggtcaacagctggaa

SEQ ID NO: 8025611 - DNA, 22 bp, Homo sapiens
tgggaagggtcaacagctggaa

SEQ ID NO: 8025612 - DNA, 22 bp, Homo sapiens
tgggaagggtcaacagctggaa

SEQ ID NO: 8025613 - DNA, 22 bp, Homo sapiens
tgggaaggggagctggaaagga

SEQ ID NO: 8025614 - DNA, 22 bp, Homo sapiens
tgggaaggggagctggaaagga

SEQ ID NO: 8025615 - DNA, 22 bp, Homo sapiens
tgggaaggggagctggaaagga

SEQ ID NO: 8025616 - DNA, 22 bp, Homo sapiens
tgggaaggggagctggaaagga

SEQ ID NO: 8025617 - DNA, 22 bp, Homo sapiens
tgggaaggggagctggaaagga

SEQ ID NO: 8025618 - DNA, 22 bp, Homo sapiens
tgggaaggggagctggaaagga

SEQ ID NO: 8025619 - DNA, 22 bp, Homo sapiens
tgggaaggggagctggaaagga

SEQ ID NO: 8025620 - DNA, 22 bp, Homo sapiens
tgggaaggggagctggaaagga

SEQ ID NO: 8025621 - DNA, 22 bp, Homo sapiens
tgggaaggggagctggaaagga

SEQ ID NO: 8025622 - DNA, 22 bp, Homo sapiens
tgggaaggggagctggaaagga

SEQ ID NO: 8025623 - DNA, 22 bp, Homo sapiens
tgggaaggggagctggaaagga

SEQ ID NO: 8025624 - DNA, 22 bp, Homo sapiens
tgggaaggggagctggaaagga

SEQ ID NO: 8025625 - DNA, 22 bp, Homo sapiens
tgggaagggcctgcccttcctc

SEQ ID NO: 8025626 - DNA, 22 bp, Homo sapiens
tgggaaggggagctggaaagga

SEQ ID NO: 8025627 - DNA, 22 bp, Homo sapiens
tgggaagggcctgcccttcctc

SEQ ID NO: 8025628 - DNA, 22 bp, Homo sapiens
tgggaaggggagctggaaagga

SEQ ID NO: 8025629 - DNA, 22 bp, Homo sapiens
tgggaagggcctgcccttcctc

SEQ ID NO: 8025630 - DNA, 22 bp, Homo sapiens
tgggaagggcctgcccttcctc

SEQ ID NO: 8025631 - DNA, 22 bp, Homo sapiens
tgggaagggccgatggagcctc

SEQ ID NO: 8025632 - DNA, 22 bp, Homo sapiens
tgggaaggtacacgggaaagag

SEQ ID NO: 8025633 - DNA, 22 bp, Homo sapiens
tgggaaggtacacgggaaagag

SEQ ID NO: 8025634 - DNA, 22 bp, Homo sapiens
tgggaagggtctgaatctgaga

SEQ ID NO: 8025635 - DNA, 22 bp, Homo sapiens
tgggaagggtctgaatctgaga

SEQ ID NO: 8025636 - DNA, 22 bp, Homo sapiens
tgggaagggtcagtttcttcat

SEQ ID NO: 8025637 - DNA, 22 bp, Homo sapiens
tgggaagggtcaacagctggaa

SEQ ID NO: 8025638 - DNA, 22 bp, Homo sapiens
tgggaagggtcaacagctggaa

SEQ ID NO: 8025639 - DNA, 22 bp, Homo sapiens
tgggaaggtgtagaaagaacaa

SEQ ID NO: 8025640 - DNA, 22 bp, Homo sapiens
tgggaaggtgattttccaaaag

SEQ ID NO: 8025641 - DNA, 22 bp, Homo sapiens
tgggaaggtgtagaaagaacaa

SEQ ID NO: 8025642 - DNA, 22 bp, Homo sapiens
tgggaaggtgtagaaagaacaa

SEQ ID NO: 8025643 - DNA, 22 bp, Homo sapiens
tgggaaggtgtagaaagaacaa

SEQ ID NO: 8025644 - DNA, 22 bp, Homo sapiens
tgggaaggtacacgggaaagag

SEQ ID NO: 8025645 - DNA, 22 bp, Homo sapiens
tgggaaggtacacgggaaagag

SEQ ID NO: 8025646 - DNA, 22 bp, Homo sapiens
tgggaaggtacacgggaaagag

SEQ ID NO: 8025647 - DNA, 22 bp, Homo sapiens
tgggaaggtacacgggaaagag

SEQ ID NO: 8025648 - DNA, 22 bp, Homo sapiens
tgggaaggtacacgggaaagag

SEQ ID NO: 8025649 - DNA, 22 bp, Homo sapiens
tgggaggatctcttgaggccag

SEQ ID NO: 8025650 - DNA, 22 bp, Homo sapiens
tgggaggatctcttgaggccag

SEQ ID NO: 8025651 - DNA, 22 bp, Homo sapiens
tgggaggatctcttgaggccag

SEQ ID NO: 8025652 - DNA, 22 bp, Homo sapiens
tgggaggatctcttgaggccag

SEQ ID NO: 8025653 - DNA, 22 bp, Homo sapiens
tgggaggatctcttgaggccag

SEQ ID NO: 8025654 - DNA, 22 bp, Homo sapiens
tgggaggcagaagttgactgga

SEQ ID NO: 8025655 - DNA, 22 bp, Homo sapiens
tgggaggcagaagttgactgga

SEQ ID NO: 8025656 - DNA, 22 bp, Homo sapiens
tgggaggcaggtaggtgatgat

SEQ ID NO: 8025657 - DNA, 22 bp, Homo sapiens
tgggaggcagaagttgactgga

SEQ ID NO: 8025658 - DNA, 22 bp, Homo sapiens
tgggaggcagaagttgactgga

SEQ ID NO: 8025659 - DNA, 22 bp, Homo sapiens
tgggaggcagaagttgactgga

SEQ ID NO: 8025660 - DNA, 22 bp, Homo sapiens
tgggaggcagaagttgactgga

SEQ ID NO: 8025661 - DNA, 22 bp, Homo sapiens
tgggaggagccctctgggaagg

SEQ ID NO: 8025662 - DNA, 22 bp, Homo sapiens
tgggaggagccctctgggaagg

SEQ ID NO: 8025663 - DNA, 22 bp, Homo sapiens
tgggaggagccctctgggaagg

SEQ ID NO: 8025664 - DNA, 22 bp, Homo sapiens
tgggaggagccctctgggaagg

SEQ ID NO: 8025665 - DNA, 22 bp, Homo sapiens
tgggaggatcgcttgagcccag

SEQ ID NO: 8025666 - DNA, 22 bp, Homo sapiens
tgggaggagccctctgggaagg

SEQ ID NO: 8025667 - DNA, 22 bp, Homo sapiens
tgggaggatcgcttgagcccag

SEQ ID NO: 8025668 - DNA, 22 bp, Homo sapiens
tgggaggatctcttgaggccag

SEQ ID NO: 8025669 - DNA, 22 bp, Homo sapiens
tgggaggatctcttgaggccag

SEQ ID NO: 8025670 - DNA, 22 bp, Homo sapiens
tgggaggatctcttgaggccag

SEQ ID NO: 8025671 - DNA, 22 bp, Homo sapiens
tgggaggatcgcttgagcccag

SEQ ID NO: 8025672 - DNA, 22 bp, Homo sapiens
tgggaggatcgcttgagcccag

SEQ ID NO: 8025673 - DNA, 22 bp, Homo sapiens
tgggaggacttgtgggcttcat

SEQ ID NO: 8025674 - DNA, 22 bp, Homo sapiens
tgggaggacttgtgggcttcat

SEQ ID NO: 8025675 - DNA, 22 bp, Homo sapiens
tgggaggacttgtgggcttcat

SEQ ID NO: 8025676 - DNA, 22 bp, Homo sapiens
tgggaggacttgtgggcttcat

SEQ ID NO: 8025677 - DNA, 22 bp, Homo sapiens
tgggaggacttgtgggcttcat

SEQ ID NO: 8025678 - DNA, 22 bp, Homo sapiens
tgggaggaatgtcactgagcca

SEQ ID NO: 8025679 - DNA, 22 bp, Homo sapiens
tgggaggaagtgctaatgggag

SEQ ID NO: 8025680 - DNA, 22 bp, Homo sapiens
tgggaggaatgtcactgagcca

SEQ ID NO: 8025681 - DNA, 22 bp, Homo sapiens
tgggaggaatgtcactgagcca

SEQ ID NO: 8025682 - DNA, 22 bp, Homo sapiens
tgggaggaagtgctaatgggag

SEQ ID NO: 8025683 - DNA, 22 bp, Homo sapiens
tgggaggaagtgctaatgggag

SEQ ID NO: 8025684 - DNA, 22 bp, Homo sapiens
tgggaggaagtgctaatgggag

SEQ ID NO: 8025685 - DNA, 20 bp, Homo sapiens
tgggagctggtgaggtctca

SEQ ID NO: 8025686 - DNA, 20 bp, Homo sapiens
tgggagctggtgaggtctca

SEQ ID NO: 8025687 - DNA, 22 bp, Homo sapiens
tgggagctcctggagggcagga

SEQ ID NO: 8025688 - DNA, 22 bp, Homo sapiens
tgggagcaggaagcaggaagta

SEQ ID NO: 8025689 - DNA, 22 bp, Homo sapiens
tgggagctctgagcctgctatg

SEQ ID NO: 8025690 - DNA, 22 bp, Homo sapiens
tgggagctctgagcctgctatg

SEQ ID NO: 8025691 - DNA, 22 bp, Homo sapiens
tgggagctcctggagggcagga

SEQ ID NO: 8025692 - DNA, 22 bp, Homo sapiens
tgggagctggggttggacgtct

SEQ ID NO: 8025693 - DNA, 22 bp, Homo sapiens
tgggagcaccttgagggcagaa

SEQ ID NO: 8025694 - DNA, 22 bp, Homo sapiens
tgggagcactctttgggaagca

SEQ ID NO: 8025695 - DNA, 22 bp, Homo sapiens
tgggagcaccttgagggcagaa

SEQ ID NO: 8025696 - DNA, 22 bp, Homo sapiens
tgggagcaccttgagggcagaa

SEQ ID NO: 8025697 - DNA, 22 bp, Homo sapiens
tgggagcactctttgggaagca

SEQ ID NO: 8025698 - DNA, 22 bp, Homo sapiens
tgggagcactctttgggaagca

SEQ ID NO: 8025699 - DNA, 22 bp, Homo sapiens
tgggagcactctttgggaagca

SEQ ID NO: 8025700 - DNA, 22 bp, Homo sapiens
tgggagcactctttgggaagca

SEQ ID NO: 8025701 - DNA, 22 bp, Homo sapiens
tgggagcaccctgaggagcttc

SEQ ID NO: 8025702 - DNA, 22 bp, Homo sapiens
tgggagcaccctgaggagcttc

SEQ ID NO: 8025703 - DNA, 22 bp, Homo sapiens
tgggagcaccttgagggcagaa

SEQ ID NO: 8025704 - DNA, 22 bp, Homo sapiens
tgggagcaccttgagggcagaa

SEQ ID NO: 8025705 - DNA, 22 bp, Homo sapiens
tgggagcaccttgagggcagaa

SEQ ID NO: 8025706 - DNA, 22 bp, Homo sapiens
tgggagcaccttgagggcagaa

SEQ ID NO: 8025707 - DNA, 22 bp, Homo sapiens
tgggagcaccttgagggcagaa

SEQ ID NO: 8025708 - DNA, 22 bp, Homo sapiens
tgggagcaccttgagggcagaa

SEQ ID NO: 8025709 - DNA, 22 bp, Homo sapiens
tgggagcaccttgagggcagaa

SEQ ID NO: 8025710 - DNA, 22 bp, Homo sapiens
tgggagcaccctgaggagcttc

SEQ ID NO: 8025711 - DNA, 22 bp, Homo sapiens
tgggagcaccctgaggagcttc

SEQ ID NO: 8025712 - DNA, 22 bp, Homo sapiens
tgggagcaagctggtgctggag

SEQ ID NO: 8025713 - DNA, 22 bp, Homo sapiens
tgggagcaccctgaggagcttc

SEQ ID NO: 8025714 - DNA, 22 bp, Homo sapiens
tgggagcaccctgaggagcttc

SEQ ID NO: 8025715 - DNA, 22 bp, Homo sapiens
tgggagcaccctgaggagcttc

SEQ ID NO: 8025716 - DNA, 22 bp, Homo sapiens
tgggagcaccctgaggagcttc

SEQ ID NO: 8025717 - DNA, 22 bp, Homo sapiens
tgggagcaccctgaggagcttc

SEQ ID NO: 8025718 - DNA, 22 bp, Homo sapiens
tgggagcaccctgaggagcttc

SEQ ID NO: 8025719 - DNA, 22 bp, Homo sapiens
tgggagcaccctgaggagcttc

SEQ ID NO: 8025720 - DNA, 22 bp, Homo sapiens
tgggagcaagctggtgctggag

SEQ ID NO: 8025721 - DNA, 22 bp, Homo sapiens
tgggagcaagctggtgctggag

SEQ ID NO: 8025722 - DNA, 22 bp, Homo sapiens
tgggagcaagctggtgctggag

SEQ ID NO: 8025723 - DNA, 22 bp, Homo sapiens
tgggagcaagctggtgctggag

SEQ ID NO: 8025724 - DNA, 22 bp, Homo sapiens
tgggagcaagctggtgctggag

SEQ ID NO: 8025725 - DNA, 22 bp, Homo sapiens
tgggagcaagctggtgctggag

SEQ ID NO: 8025726 - DNA, 22 bp, Homo sapiens
tgggagcagcctcagcttcggg

SEQ ID NO: 8025727 - DNA, 22 bp, Homo sapiens
tgggagcagccaacatggcctt

SEQ ID NO: 8025728 - DNA, 22 bp, Homo sapiens
tgggagcagccaacatggcctt

SEQ ID NO: 8025729 - DNA, 22 bp, Homo sapiens
tgggagcagccaacatggcctt

SEQ ID NO: 8025730 - DNA, 22 bp, Homo sapiens
tgggagcagccaacatggcctt

SEQ ID NO: 8025731 - DNA, 22 bp, Homo sapiens
tgggagcagccaacatggcctt

SEQ ID NO: 8025732 - DNA, 22 bp, Homo sapiens
tgggagcagccaacatggcctt

SEQ ID NO: 8025733 - DNA, 22 bp, Homo sapiens
tgggagcagcattgccatgtgc

SEQ ID NO: 8025734 - DNA, 22 bp, Homo sapiens
tgggagcagcattgccatgtgc

SEQ ID NO: 8025735 - DNA, 22 bp, Homo sapiens
tgggagcagcattgccatgtgc

SEQ ID NO: 8025736 - DNA, 22 bp, Homo sapiens
tgggagcagcagggagatgcgg

SEQ ID NO: 8025737 - DNA, 22 bp, Homo sapiens
tgggagcagcagggagatgcgg

SEQ ID NO: 8025738 - DNA, 22 bp, Homo sapiens
tgggagcactctttgggaagca

SEQ ID NO: 8025739 - DNA, 22 bp, Homo sapiens
tgggagcactctttgggaagca

SEQ ID NO: 8025740 - DNA, 22 bp, Homo sapiens
tgggagcagcagggagatgcgg

SEQ ID NO: 8025741 - DNA, 22 bp, Homo sapiens
tgggagcaccttgagggcagaa

SEQ ID NO: 8025742 - DNA, 22 bp, Homo sapiens
tgggagcagcagggagatgcgg

SEQ ID NO: 8025743 - DNA, 22 bp, Homo sapiens
tgggagcagcagggagatgcgg

SEQ ID NO: 8025744 - DNA, 22 bp, Homo sapiens
tgggagcagcattgccatgtgc

SEQ ID NO: 8025745 - DNA, 22 bp, Homo sapiens
tgggagcagcagggagatgcgg

SEQ ID NO: 8025746 - DNA, 22 bp, Homo sapiens
tgggagcagcagggagatgcgg

SEQ ID NO: 8025747 - DNA, 22 bp, Homo sapiens
tgggagcagcagggagatgcgg

SEQ ID NO: 8025748 - DNA, 22 bp, Homo sapiens
tgggagcagctttgcgagggag

SEQ ID NO: 8025749 - DNA, 22 bp, Homo sapiens
tgggagcagctttgcgagggag

SEQ ID NO: 8025750 - DNA, 22 bp, Homo sapiens
tgggagcagctttgcgagggag

SEQ ID NO: 8025751 - DNA, 22 bp, Homo sapiens
tgggagcagctttgcgagggag

SEQ ID NO: 8025752 - DNA, 22 bp, Homo sapiens
tgggagcagctttgcgagggag

SEQ ID NO: 8025753 - DNA, 22 bp, Homo sapiens
tgggagcagctttgcgagggag

SEQ ID NO: 8025754 - DNA, 22 bp, Homo sapiens
tgggagcagcctcagcttcggg

SEQ ID NO: 8025755 - DNA, 22 bp, Homo sapiens
tgggagcagctgggaacacagc

SEQ ID NO: 8025756 - DNA, 22 bp, Homo sapiens
tgggagcagcctcagcttcggg

SEQ ID NO: 8025757 - DNA, 22 bp, Homo sapiens
tgggagcagcctcagcttcggg

SEQ ID NO: 8025758 - DNA, 22 bp, Homo sapiens
tgggagcagctgggaacacagc

SEQ ID NO: 8025759 - DNA, 22 bp, Homo sapiens
tgggagcagctgggaacacagc

SEQ ID NO: 8025760 - DNA, 22 bp, Homo sapiens
tgggagcagctgggaacacagc

SEQ ID NO: 8025761 - DNA, 22 bp, Homo sapiens
tgggagcaggaagcaggaagta

SEQ ID NO: 8025762 - DNA, 22 bp, Homo sapiens
tgggagcaggaagcaggaagta

SEQ ID NO: 8025763 - DNA, 22 bp, Homo sapiens
tgggagcaggaagcaggaagta

SEQ ID NO: 8025764 - DNA, 22 bp, Homo sapiens
tgggagcagctttgcgagggag

SEQ ID NO: 8025765 - DNA, 22 bp, Homo sapiens
tgggagcagctttgcgagggag

SEQ ID NO: 8025766 - DNA, 22 bp, Homo sapiens
tgggagcaggaagcaggaagta

SEQ ID NO: 8025767 - DNA, 22 bp, Homo sapiens
tgggagcagctttgcgagggag

SEQ ID NO: 8025768 - DNA, 22 bp, Homo sapiens
tgggagctcctggagggcagga

SEQ ID NO: 8025769 - DNA, 22 bp, Homo sapiens
tgggagcaggaagcaggaagta

SEQ ID NO: 8025770 - DNA, 22 bp, Homo sapiens
tgggagctcctggagggcagga

SEQ ID NO: 8025771 - DNA, 22 bp, Homo sapiens
tgggagctcctggagggcagga

SEQ ID NO: 8025772 - DNA, 22 bp, Homo sapiens
tgggagaaactgtctctcccac

SEQ ID NO: 8025773 - DNA, 22 bp, Homo sapiens
tgggagaaactgtctctcccac

SEQ ID NO: 8025774 - DNA, 22 bp, Homo sapiens
tgggacttgcctcgagggctgc

SEQ ID NO: 8025775 - DNA, 22 bp, Homo sapiens
tgggacttcaatgcaatgaggt

SEQ ID NO: 8025776 - DNA, 22 bp, Homo sapiens
tgggacttcaatgcaatgaggt

SEQ ID NO: 8025777 - DNA, 22 bp, Homo sapiens
tgggacttaatatgcccttgat

SEQ ID NO: 8025778 - DNA, 22 bp, Homo sapiens
tgggacttcaatgcaatgaggt

SEQ ID NO: 8025779 - DNA, 22 bp, Homo sapiens
tgggagaacccagggtcaggct

SEQ ID NO: 8025780 - DNA, 22 bp, Homo sapiens
tgggagaacccagggtcaggct

SEQ ID NO: 8025781 - DNA, 22 bp, Homo sapiens
tgggagaacccagggtcaggct

SEQ ID NO: 8025782 - DNA, 22 bp, Homo sapiens
tgggagaacactgctctggatg

SEQ ID NO: 8025783 - DNA, 22 bp, Homo sapiens
tgggagaacccagggtcaggct

SEQ ID NO: 8025784 - DNA, 22 bp, Homo sapiens
tgggagaaagaaccctgagtga

SEQ ID NO: 8025785 - DNA, 22 bp, Homo sapiens
tgggagaaagaaccctgagtga

SEQ ID NO: 8025786 - DNA, 22 bp, Homo sapiens
tgggagaacactgctctggatg

SEQ ID NO: 8025787 - DNA, 22 bp, Homo sapiens
tgggagaagcagcagccaagtg

SEQ ID NO: 8025788 - DNA, 22 bp, Homo sapiens
tgggagaagcagcagccaagtg

SEQ ID NO: 8025789 - DNA, 22 bp, Homo sapiens
tgggagaagcagcagccaagtg

SEQ ID NO: 8025790 - DNA, 22 bp, Homo sapiens
tgggagaagcagcagccaagtg

SEQ ID NO: 8025791 - DNA, 22 bp, Homo sapiens
tgggagaagcagcagccaagtg

SEQ ID NO: 8025792 - DNA, 22 bp, Homo sapiens
tgggagaagcagtgggacagta

SEQ ID NO: 8025793 - DNA, 22 bp, Homo sapiens
tgggagaagcagtgggacagta

SEQ ID NO: 8025794 - DNA, 22 bp, Homo sapiens
tgggagaagcagcagccaagtg

SEQ ID NO: 8025795 - DNA, 22 bp, Homo sapiens
tgggagaacccagggtcaggct

SEQ ID NO: 8025796 - DNA, 22 bp, Homo sapiens
tgggagaacccagggtcaggct

SEQ ID NO: 8025797 - DNA, 20 bp, Homo sapiens
tgggagaagaacactggaac

SEQ ID NO: 8025798 - DNA, 22 bp, Homo sapiens
tgggagaagacgtactttagac

SEQ ID NO: 8025799 - DNA, 21 bp, Homo sapiens
tgggagaccgccttcctggga

SEQ ID NO: 8025800 - DNA, 22 bp, Homo sapiens
tgggagacactggtgggagctt

SEQ ID NO: 8025801 - DNA, 22 bp, Homo sapiens
tgggagacactggtgggagctt

SEQ ID NO: 8025802 - DNA, 21 bp, Homo sapiens
tgggagacacagccttgagct

SEQ ID NO: 8025803 - DNA, 21 bp, Homo sapiens
tgggagacacagccttgagct

SEQ ID NO: 8025804 - DNA, 21 bp, Homo sapiens
tgggagacacagccttgagct

SEQ ID NO: 8025805 - DNA, 22 bp, Homo sapiens
tgggagacactggtgggagctt

SEQ ID NO: 8025806 - DNA, 22 bp, Homo sapiens
tgggagacactggtgggagctt

SEQ ID NO: 8025807 - DNA, 22 bp, Homo sapiens
tgggagagaataatcaataggt

SEQ ID NO: 8025808 - DNA, 21 bp, Homo sapiens
tgggagaccgccttcctggga

SEQ ID NO: 8025809 - DNA, 22 bp, Homo sapiens
tgggagagcttcatgccttcag

SEQ ID NO: 8025810 - DNA, 22 bp, Homo sapiens
tgggagagcttcatgccttcag

SEQ ID NO: 8025811 - DNA, 22 bp, Homo sapiens
tgggagagcttcatgccttcag

SEQ ID NO: 8025812 - DNA, 22 bp, Homo sapiens
tgggagaatcttgctctgctac

SEQ ID NO: 8025813 - DNA, 22 bp, Homo sapiens
tgggagaatcttgctctgctac

SEQ ID NO: 8025814 - DNA, 22 bp, Homo sapiens
tgggagaagcatggggtgcaga

SEQ ID NO: 8025815 - DNA, 22 bp, Homo sapiens
tgggagaagcatggggtgcaga

SEQ ID NO: 8025816 - DNA, 22 bp, Homo sapiens
tgggagaagcatggggtgcaga

SEQ ID NO: 8025817 - DNA, 22 bp, Homo sapiens
tgggagaagcagtgggacagta

SEQ ID NO: 8025818 - DNA, 22 bp, Homo sapiens
tgggagaagcagtgggacagta

SEQ ID NO: 8025819 - DNA, 22 bp, Homo sapiens
tgggagaagcagtgggacagta

SEQ ID NO: 8025820 - DNA, 22 bp, Homo sapiens
tgggagaagcatggggtgcaga

SEQ ID NO: 8025821 - DNA, 22 bp, Homo sapiens
tgggagaagcatggggtgcaga

SEQ ID NO: 8025822 - DNA, 22 bp, Homo sapiens
tgggagaagcagtgggacagta

SEQ ID NO: 8025823 - DNA, 22 bp, Homo sapiens
tgggagaagcagtgggacagta

SEQ ID NO: 8025824 - DNA, 21 bp, Homo sapiens
tgggagagggctcagctaccc

SEQ ID NO: 8025825 - DNA, 22 bp, Homo sapiens
tgggagaggctgccatcttgca

SEQ ID NO: 8025826 - DNA, 21 bp, Homo sapiens
tgggagagggctcagctaccc

SEQ ID NO: 8025827 - DNA, 21 bp, Homo sapiens
tgggagagggctcagctaccc

SEQ ID NO: 8025828 - DNA, 21 bp, Homo sapiens
tgggagagggctcagctaccc

SEQ ID NO: 8025829 - DNA, 22 bp, Homo sapiens
tgggagagtctaaaaccgaggt

SEQ ID NO: 8025830 - DNA, 22 bp, Homo sapiens
tgggagagtaaccaattccttc

SEQ ID NO: 8025831 - DNA, 22 bp, Homo sapiens
tgggagagtaaccaattccttc

SEQ ID NO: 8025832 - DNA, 21 bp, Homo sapiens
tgggagagggctcagctaccc

SEQ ID NO: 8025833 - DNA, 21 bp, Homo sapiens
tgggagagggctcagctaccc

SEQ ID NO: 8025834 - DNA, 19 bp, Homo sapiens
tgggagaggcaacagagta

SEQ ID NO: 8025835 - DNA, 19 bp, Homo sapiens
tgggagaggcaacagagta

SEQ ID NO: 8025836 - DNA, 22 bp, Homo sapiens
tgggagagcttcatgccttcag

SEQ ID NO: 8025837 - DNA, 19 bp, Homo sapiens
tgggagaggcaacagagta

SEQ ID NO: 8025838 - DNA, 19 bp, Homo sapiens
tgggagaggcaacagagta

SEQ ID NO: 8025839 - DNA, 19 bp, Homo sapiens
tgggagaggcaacagagta

SEQ ID NO: 8025840 - DNA, 19 bp, Homo sapiens
tgggagaggcaacagagta

SEQ ID NO: 8025841 - DNA, 19 bp, Homo sapiens
tgggagaggcaacagagta

SEQ ID NO: 8025842 - DNA, 22 bp, Homo sapiens
tgggagagcttcatgccttcag

SEQ ID NO: 8025843 - DNA, 22 bp, Homo sapiens
tgggagaggctgccatcttgca

SEQ ID NO: 8025844 - DNA, 22 bp, Homo sapiens
tgggagaggctgccatcttgca

SEQ ID NO: 8025845 - DNA, 19 bp, Homo sapiens
tgggagaggcaacagagta

SEQ ID NO: 8025846 - DNA, 22 bp, Homo sapiens
tgggagcaaatgactgggagat

SEQ ID NO: 8025847 - DNA, 22 bp, Homo sapiens
tgggagcaaatgactgggagat

SEQ ID NO: 8025848 - DNA, 22 bp, Homo sapiens
tgggagcaaatgactgggagat

SEQ ID NO: 8025849 - DNA, 22 bp, Homo sapiens
tgggagcaaatgactgggagat

SEQ ID NO: 8025850 - DNA, 22 bp, Homo sapiens
tgggagcaaatgactgggagat

SEQ ID NO: 8025851 - DNA, 22 bp, Homo sapiens
tgggagcaagctacttagggaa

SEQ ID NO: 8025852 - DNA, 22 bp, Homo sapiens
tgggagcaagctacttagggaa

SEQ ID NO: 8025853 - DNA, 22 bp, Homo sapiens
tgggagcaagctacttagggaa

SEQ ID NO: 8025854 - DNA, 22 bp, Homo sapiens
tgggagcaagctacttagggaa

SEQ ID NO: 8025855 - DNA, 22 bp, Homo sapiens
tgggagcaagctacttagggaa

SEQ ID NO: 8025856 - DNA, 22 bp, Homo sapiens
tgggagcaagctacttagggaa

SEQ ID NO: 8025857 - DNA, 22 bp, Homo sapiens
tgggagcaaatgactgggagat

SEQ ID NO: 8025858 - DNA, 22 bp, Homo sapiens
tgggagcaaatgactgggagat

SEQ ID NO: 8025859 - DNA, 22 bp, Homo sapiens
tgggagatggttctgagacttt

SEQ ID NO: 8025860 - DNA, 22 bp, Homo sapiens
tgggagatattgctgtggctgt

SEQ ID NO: 8025861 - DNA, 22 bp, Homo sapiens
tgggagatcttgaggcttattt

SEQ ID NO: 8025862 - DNA, 20 bp, Homo sapiens
tgggagatgatctccttgct

SEQ ID NO: 8025863 - DNA, 22 bp, Homo sapiens
tgggagatattgctgtggctgt

SEQ ID NO: 8025864 - DNA, 22 bp, Homo sapiens
tgggagatatccggcctccgtg

SEQ ID NO: 8025865 - DNA, 22 bp, Homo sapiens
tgggagagtttgtttagagtga

SEQ ID NO: 8025866 - DNA, 22 bp, Homo sapiens
tgggagagtgctcaatgtgcaa

SEQ ID NO: 8025867 - DNA, 22 bp, Homo sapiens
tgggagagtgctcaatgtgcaa

SEQ ID NO: 8025868 - DNA, 22 bp, Homo sapiens
tgggagagtttgtttagagtga

SEQ ID NO: 8025869 - DNA, 22 bp, Homo sapiens
tgggagagtttgtttagagtga

SEQ ID NO: 8025870 - DNA, 22 bp, Homo sapiens
tgggagagtgctcaatgtgcaa

SEQ ID NO: 8025871 - DNA, 22 bp, Homo sapiens
tgggagagtgctcaatgtgcaa

SEQ ID NO: 8025872 - DNA, 22 bp, Homo sapiens
tgggagagtctaaaaccgaggt

SEQ ID NO: 8025873 - DNA, 22 bp, Homo sapiens
tgggagagtgctcaatgtgcaa

SEQ ID NO: 8025874 - DNA, 22 bp, Homo sapiens
tggctggggccacagttttcct

SEQ ID NO: 8025875 - DNA, 22 bp, Homo sapiens
tggctggggcctgaatcctgca

SEQ ID NO: 8025876 - DNA, 22 bp, Homo sapiens
tggctggggcctgaatcctgca

SEQ ID NO: 8025877 - DNA, 22 bp, Homo sapiens
tggctggggcctgaatcctgca

SEQ ID NO: 8025878 - DNA, 22 bp, Homo sapiens
tggctggggcctgaatcctgca

SEQ ID NO: 8025879 - DNA, 22 bp, Homo sapiens
tggctggggcctgaatcctgca

SEQ ID NO: 8025880 - DNA, 22 bp, Homo sapiens
tggctggggcctgaatcctgca

SEQ ID NO: 8025881 - DNA, 22 bp, Homo sapiens
tggctggggccacagttttcct

SEQ ID NO: 8025882 - DNA, 22 bp, Homo sapiens
tggctggggagccccgactccc

SEQ ID NO: 8025883 - DNA, 22 bp, Homo sapiens
tggctggggccacagttttcct

SEQ ID NO: 8025884 - DNA, 22 bp, Homo sapiens
tggctggggagccccgactccc

SEQ ID NO: 8025885 - DNA, 19 bp, Homo sapiens
tggctgggcgtgcctccgt

SEQ ID NO: 8025886 - DNA, 19 bp, Homo sapiens
tggctgggcgtgcctccgt

SEQ ID NO: 8025887 - DNA, 22 bp, Homo sapiens
tggctgggccgggccttgtgcc

SEQ ID NO: 8025888 - DNA, 22 bp, Homo sapiens
tggctgggccgggccttgtgcc

SEQ ID NO: 8025889 - DNA, 19 bp, Homo sapiens
tggctgggcgtgcctccgt

SEQ ID NO: 8025890 - DNA, 22 bp, Homo sapiens
tggctgggccgggccttgtgcc

SEQ ID NO: 8025891 - DNA, 22 bp, Homo sapiens
tggctgggccgggccttgtgcc

SEQ ID NO: 8025892 - DNA, 22 bp, Homo sapiens
tggctgggccgggccttgtgcc

SEQ ID NO: 8025893 - DNA, 22 bp, Homo sapiens
tggctggggagccccgactccc

SEQ ID NO: 8025894 - DNA, 22 bp, Homo sapiens
tggctggggagccccgactccc

SEQ ID NO: 8025895 - DNA, 19 bp, Homo sapiens
tggctgggcgtgcctccgt

SEQ ID NO: 8025896 - DNA, 22 bp, Homo sapiens
tggctggggagccccgactccc

SEQ ID NO: 8025897 - DNA, 19 bp, Homo sapiens
tggctgggcgtgcctccgt

SEQ ID NO: 8025898 - DNA, 19 bp, Homo sapiens
tggctgggcgtgcctccgt

SEQ ID NO: 8025899 - DNA, 19 bp, Homo sapiens
tggctgggcgtgcctccgt

SEQ ID NO: 8025900 - DNA, 22 bp, Homo sapiens
tggctgggtgctatccagtact

SEQ ID NO: 8025901 - DNA, 22 bp, Homo sapiens
tggctggtcacatggtaggtct

SEQ ID NO: 8025902 - DNA, 19 bp, Homo sapiens
tggctgggtgccaatggcc

SEQ ID NO: 8025903 - DNA, 22 bp, Homo sapiens
tggctgggtgctatccagtact

SEQ ID NO: 8025904 - DNA, 22 bp, Homo sapiens
tggctgggtgctatccagtact

SEQ ID NO: 8025905 - DNA, 22 bp, Homo sapiens
tggctgggtgctatccagtact

SEQ ID NO: 8025906 - DNA, 22 bp, Homo sapiens
tggctgggtgctatccagtact

SEQ ID NO: 8025907 - DNA, 22 bp, Homo sapiens
tggctgggtgctatccagtact

SEQ ID NO: 8025908 - DNA, 21 bp, Homo sapiens
tggctggtggcagggcttctc

SEQ ID NO: 8025909 - DNA, 22 bp, Homo sapiens
tggctggtcacatggtaggtct

SEQ ID NO: 8025910 - DNA, 22 bp, Homo sapiens
tggctggtgggcctcagcctgc

SEQ ID NO: 8025911 - DNA, 22 bp, Homo sapiens
tggctggttttggtgagctccg

SEQ ID NO: 8025912 - DNA, 22 bp, Homo sapiens
tggctggttttggtgagctccg

SEQ ID NO: 8025913 - DNA, 22 bp, Homo sapiens
tggctgggggtgctatagctgc

SEQ ID NO: 8025914 - DNA, 22 bp, Homo sapiens
tggctgggggtgctatagctgc

SEQ ID NO: 8025915 - DNA, 19 bp, Homo sapiens
tggctgggtgccaatggcc

SEQ ID NO: 8025916 - DNA, 22 bp, Homo sapiens
tggctgggggtgctatagctgc

SEQ ID NO: 8025917 - DNA, 22 bp, Homo sapiens
tggctgggggtgctatagctgc

SEQ ID NO: 8025918 - DNA, 22 bp, Homo sapiens
tggctgggggtgctatagctgc

SEQ ID NO: 8025919 - DNA, 22 bp, Homo sapiens
tggctgggggtgctatagctgc

SEQ ID NO: 8025920 - DNA, 22 bp, Homo sapiens
tggctgggggtgctatagctgc

SEQ ID NO: 8025921 - DNA, 19 bp, Homo sapiens
tggctgggtgccaatggcc

SEQ ID NO: 8025922 - DNA, 19 bp, Homo sapiens
tggctgggtgccaatggcc

SEQ ID NO: 8025923 - DNA, 19 bp, Homo sapiens
tggctgggtgccaatggcc

SEQ ID NO: 8025924 - DNA, 22 bp, Homo sapiens
tggctgggggtgctatagctgc

SEQ ID NO: 8025925 - DNA, 19 bp, Homo sapiens
tggctgggtgccaatggcc

SEQ ID NO: 8025926 - DNA, 19 bp, Homo sapiens
tggctgggtgccaatggcc

SEQ ID NO: 8025927 - DNA, 19 bp, Homo sapiens
tggctgggtgccaatggcc

SEQ ID NO: 8025928 - DNA, 22 bp, Homo sapiens
tggcttcaagtctaggttctac

SEQ ID NO: 8025929 - DNA, 23 bp, Homo sapiens
tggcttcaactctgtcggcagcc

SEQ ID NO: 8025930 - DNA, 22 bp, Homo sapiens
tggcttcacaatttcataacta

SEQ ID NO: 8025931 - DNA, 22 bp, Homo sapiens
tggcttcaaaatctagtggtct

SEQ ID NO: 8025932 - DNA, 22 bp, Homo sapiens
tggcttaatatttcatatttaa

SEQ ID NO: 8025933 - DNA, 22 bp, Homo sapiens
tggcttaatttctctgtgcctc

SEQ ID NO: 8025934 - DNA, 22 bp, Homo sapiens
tggcttcaaaggtagcatacaa

SEQ ID NO: 8025935 - DNA, 23 bp, Homo sapiens
tggcttcaactctgtcggcagcc

SEQ ID NO: 8025936 - DNA, 22 bp, Homo sapiens
tggctgtgtccctgtccagagt

SEQ ID NO: 8025937 - DNA, 22 bp, Homo sapiens
tggctgtgtgccaggctgtctg

SEQ ID NO: 8025938 - DNA, 22 bp, Homo sapiens
tggctgtgtgccaggctgtctg

SEQ ID NO: 8025939 - DNA, 22 bp, Homo sapiens
tggctgtgtccctgtccagagt

SEQ ID NO: 8025940 - DNA, 22 bp, Homo sapiens
tggctgtgtccctgtccagagt

SEQ ID NO: 8025941 - DNA, 22 bp, Homo sapiens
tggctgtgttaccacttcatgt

SEQ ID NO: 8025942 - DNA, 22 bp, Homo sapiens
tggctgtgttaccacttcatgt

SEQ ID NO: 8025943 - DNA, 23 bp, Homo sapiens
tggcttaacctcttcctatgtct

SEQ ID NO: 8025944 - DNA, 22 bp, Homo sapiens
tggcttaagatttatgctttta

SEQ ID NO: 8025945 - DNA, 22 bp, Homo sapiens
tggctgtcagtcgcctgcattc

SEQ ID NO: 8025946 - DNA, 22 bp, Homo sapiens
tggctgtgatttgcacgagatg

SEQ ID NO: 8025947 - DNA, 22 bp, Homo sapiens
tggctgtgatttgcacgagatg

SEQ ID NO: 8025948 - DNA, 22 bp, Homo sapiens
tggctgtgaatggcaaataatc

SEQ ID NO: 8025949 - DNA, 22 bp, Homo sapiens
tggctgtggactcagatggctc

SEQ ID NO: 8025950 - DNA, 22 bp, Homo sapiens
tggctgtgtcatcatagctgtg

SEQ ID NO: 8025951 - DNA, 22 bp, Homo sapiens
tggctgtggtttatcccagttc

SEQ ID NO: 8025952 - DNA, 20 bp, Homo sapiens
tggctgtgggcatctgtttc

SEQ ID NO: 8025953 - DNA, 19 bp, Homo sapiens
tggctgtggggaaatgctt

SEQ ID NO: 8025954 - DNA, 22 bp, Homo sapiens
tggctgtgggtggaaggaaacc

SEQ ID NO: 8025955 - DNA, 22 bp, Homo sapiens
tggctgtgggatgagagcctca

SEQ ID NO: 8025956 - DNA, 22 bp, Homo sapiens
tggctgtgggatgagagcctca

SEQ ID NO: 8025957 - DNA, 22 bp, Homo sapiens
tggctgtgggatatgtgactga

SEQ ID NO: 8025958 - DNA, 22 bp, Homo sapiens
tggctgggccgggccttgtgcc

SEQ ID NO: 8025959 - DNA, 22 bp, Homo sapiens
tggctgggcccccacctgcctc

SEQ ID NO: 8025960 - DNA, 22 bp, Homo sapiens
tggctgggcccccacctgcctc

SEQ ID NO: 8025961 - DNA, 22 bp, Homo sapiens
tggctgggcccccacctgcctc

SEQ ID NO: 8025962 - DNA, 22 bp, Homo sapiens
tggctgggcccccacctgcctc

SEQ ID NO: 8025963 - DNA, 22 bp, Homo sapiens
tggctgggcccccacctgcctc

SEQ ID NO: 8025964 - DNA, 22 bp, Homo sapiens
tggctgggagctggaactgggc

SEQ ID NO: 8025965 - DNA, 22 bp, Homo sapiens
tggctgggagctggaactgggc

SEQ ID NO: 8025966 - DNA, 22 bp, Homo sapiens
tggctgggagctggaactgggc

SEQ ID NO: 8025967 - DNA, 22 bp, Homo sapiens
tggctgggagctggaactgggc

SEQ ID NO: 8025968 - DNA, 22 bp, Homo sapiens
tggctgggagctggaactgggc

SEQ ID NO: 8025969 - DNA, 22 bp, Homo sapiens
tggctgggcccccacctgcctc

SEQ ID NO: 8025970 - DNA, 22 bp, Homo sapiens
tggctggcgttggggccagtga

SEQ ID NO: 8025971 - DNA, 22 bp, Homo sapiens
tggctggcgttggggccagtga

SEQ ID NO: 8025972 - DNA, 22 bp, Homo sapiens
tggctggcgttggggccagtga

SEQ ID NO: 8025973 - DNA, 23 bp, Homo sapiens
tggctggcgcctgcctcaccctg

SEQ ID NO: 8025974 - DNA, 22 bp, Homo sapiens
tggctggctagaatggaaatgt

SEQ ID NO: 8025975 - DNA, 22 bp, Homo sapiens
tggctgggagctggaactgggc

SEQ ID NO: 8025976 - DNA, 22 bp, Homo sapiens
tggctgggagctggaactgggc

SEQ ID NO: 8025977 - DNA, 22 bp, Homo sapiens
tggctggctagtgggcaggatt

SEQ ID NO: 8025978 - DNA, 22 bp, Homo sapiens
tggctgggagctggaactgggc

SEQ ID NO: 8025979 - DNA, 22 bp, Homo sapiens
tggctggctagaatggaaatgt

SEQ ID NO: 8025980 - DNA, 22 bp, Homo sapiens
tggctgggagctggaactgggc

SEQ ID NO: 8025981 - DNA, 22 bp, Homo sapiens
tggctgggagctggaactgggc

SEQ ID NO: 8025982 - DNA, 22 bp, Homo sapiens
tggctgggagctggaactgggc

SEQ ID NO: 8025983 - DNA, 22 bp, Homo sapiens
tggctggccctgggagtgcaga

SEQ ID NO: 8025984 - DNA, 22 bp, Homo sapiens
tggctggcatagccattgctcc

SEQ ID NO: 8025985 - DNA, 22 bp, Homo sapiens
tggctggcatagccattgctcc

SEQ ID NO: 8025986 - DNA, 22 bp, Homo sapiens
tggctggcatagccattgctcc

SEQ ID NO: 8025987 - DNA, 22 bp, Homo sapiens
tggctggcagttatctttggat

SEQ ID NO: 8025988 - DNA, 22 bp, Homo sapiens
tggctggcagttatctttggat

SEQ ID NO: 8025989 - DNA, 22 bp, Homo sapiens
tggctggcgccgggctagccac

SEQ ID NO: 8025990 - DNA, 22 bp, Homo sapiens
tggctggcgccgggctagccac

SEQ ID NO: 8025991 - DNA, 22 bp, Homo sapiens
tggctggcgccgggctagccac

SEQ ID NO: 8025992 - DNA, 22 bp, Homo sapiens
tggctggcgccgggctagccac

SEQ ID NO: 8025993 - DNA, 22 bp, Homo sapiens
tggctggccctgggagtgcaga

SEQ ID NO: 8025994 - DNA, 22 bp, Homo sapiens
tggctggccctgggagtgcaga

SEQ ID NO: 8025995 - DNA, 22 bp, Homo sapiens
tggctggccctgggagtgcaga

SEQ ID NO: 8025996 - DNA, 22 bp, Homo sapiens
tggctggcgccgggctagccac

SEQ ID NO: 8025997 - DNA, 23 bp, Homo sapiens
tggctggcagaaactgaagcatg

SEQ ID NO: 8025998 - DNA, 23 bp, Homo sapiens
tggctggcagaaactgaagcatg

SEQ ID NO: 8025999 - DNA, 23 bp, Homo sapiens
tggctggcagaaactgaagcatg

SEQ ID NO: 8026000 - DNA, 22 bp, Homo sapiens
tggctggcagtaggctagtggc

SEQ ID NO: 8026001 - DNA, 22 bp, Homo sapiens
tggctggcagtaggctagtggc

SEQ ID NO: 8026002 - DNA, 22 bp, Homo sapiens
tggctggcagtaggctagtggc

SEQ ID NO: 8026003 - DNA, 22 bp, Homo sapiens
tggctggcagtaggctagtggc

SEQ ID NO: 8026004 - DNA, 22 bp, Homo sapiens
tggctggcagtaggctagtggc

SEQ ID NO: 8026005 - DNA, 18 bp, Homo sapiens
tggctggcagtgggcagc

SEQ ID NO: 8026006 - DNA, 18 bp, Homo sapiens
tggctggcagtgggcagc

SEQ ID NO: 8026007 - DNA, 18 bp, Homo sapiens
tggctggcagtgggcagc

SEQ ID NO: 8026008 - DNA, 22 bp, Homo sapiens
tggctggcagtaggctagtggc

SEQ ID NO: 8026009 - DNA, 22 bp, Homo sapiens
tggctggcagtaggctagtggc

SEQ ID NO: 8026010 - DNA, 22 bp, Homo sapiens
tggctggcaaggctggagtcag

SEQ ID NO: 8026011 - DNA, 22 bp, Homo sapiens
tggctggcaaggctggagtcag

SEQ ID NO: 8026012 - DNA, 22 bp, Homo sapiens
tggctggattattggctagtac

SEQ ID NO: 8026013 - DNA, 22 bp, Homo sapiens
tggctggcaaggctggagtcag

SEQ ID NO: 8026014 - DNA, 23 bp, Homo sapiens
tggctggcagaaactgaagcatg

SEQ ID NO: 8026015 - DNA, 23 bp, Homo sapiens
tggctggcagaaactgaagcatg

SEQ ID NO: 8026016 - DNA, 22 bp, Homo sapiens
tggctggcaaggctggagtcag

SEQ ID NO: 8026017 - DNA, 22 bp, Homo sapiens
tggctggcaaggctggagtcag

SEQ ID NO: 8026018 - DNA, 22 bp, Homo sapiens
tggctggatgtgagatcaagag

SEQ ID NO: 8026019 - DNA, 22 bp, Homo sapiens
tggctggattattggctagtac

SEQ ID NO: 8026020 - DNA, 22 bp, Homo sapiens
tggctggattattggctagtac

SEQ ID NO: 8026021 - DNA, 22 bp, Homo sapiens
tggctggatatcaggcaagggg

SEQ ID NO: 8026022 - DNA, 22 bp, Homo sapiens
tggctggatatcaggcaagggg

SEQ ID NO: 8026023 - DNA, 22 bp, Homo sapiens
tggctggatgtgagatcaagag

SEQ ID NO: 8026024 - DNA, 22 bp, Homo sapiens
tggctggagtataggagtagga

SEQ ID NO: 8026025 - DNA, 22 bp, Homo sapiens
tggctggagtataggagtagga

SEQ ID NO: 8026026 - DNA, 22 bp, Homo sapiens
tggctggagtataggagtagga

SEQ ID NO: 8026027 - DNA, 22 bp, Homo sapiens
tggctggagtataggagtagga

SEQ ID NO: 8026028 - DNA, 22 bp, Homo sapiens
tggctggagtctggtgctagcc

SEQ ID NO: 8026029 - DNA, 22 bp, Homo sapiens
tggctggagtctggtgctagcc

SEQ ID NO: 8026030 - DNA, 22 bp, Homo sapiens
tggctggagtgggagaagttta

SEQ ID NO: 8026031 - DNA, 22 bp, Homo sapiens
tggctggataatattctgttgt

SEQ ID NO: 8026032 - DNA, 21 bp, Homo sapiens
tggctggatagatgggaactg

SEQ ID NO: 8026033 - DNA, 22 bp, Homo sapiens
tggctggataatattctgttgt

SEQ ID NO: 8026034 - DNA, 22 bp, Homo sapiens
tggctggagtgggagaagttta

SEQ ID NO: 8026035 - DNA, 21 bp, Homo sapiens
tggctggatagatgggaactg

SEQ ID NO: 8026036 - DNA, 22 bp, Homo sapiens
tggctggatatcagaggaagtg

SEQ ID NO: 8026037 - DNA, 22 bp, Homo sapiens
tggctggatatcagaggaagtg

SEQ ID NO: 8026038 - DNA, 22 bp, Homo sapiens
tggctggatatcaggcaagggg

SEQ ID NO: 8026039 - DNA, 22 bp, Homo sapiens
tggctggatatcaggcaagggg

SEQ ID NO: 8026040 - DNA, 22 bp, Homo sapiens
tggctggagcccctcaagagca

SEQ ID NO: 8026041 - DNA, 22 bp, Homo sapiens
tggctggagcccctcaagagca

SEQ ID NO: 8026042 - DNA, 22 bp, Homo sapiens
tggctggagcccctcaagagca

SEQ ID NO: 8026043 - DNA, 22 bp, Homo sapiens
tggctggagcccctcaagagca

SEQ ID NO: 8026044 - DNA, 22 bp, Homo sapiens
tggctggagcattccttgtctt

SEQ ID NO: 8026045 - DNA, 22 bp, Homo sapiens
tggctggagcattccttgtctt

SEQ ID NO: 8026046 - DNA, 22 bp, Homo sapiens
tggctggagcgccctcctctgc

SEQ ID NO: 8026047 - DNA, 22 bp, Homo sapiens
tggctggagcgccctcctctgc

SEQ ID NO: 8026048 - DNA, 22 bp, Homo sapiens
tggctggaggaaggaactgagg

SEQ ID NO: 8026049 - DNA, 22 bp, Homo sapiens
tggctggaggaaggaactgagg

SEQ ID NO: 8026050 - DNA, 22 bp, Homo sapiens
tggctggaggaaggaactgagg

SEQ ID NO: 8026051 - DNA, 22 bp, Homo sapiens
tggctggagggttagtgagata

SEQ ID NO: 8026052 - DNA, 22 bp, Homo sapiens
tggctggagggttagtgagata

SEQ ID NO: 8026053 - DNA, 22 bp, Homo sapiens
tggctggagggttagtgagata

SEQ ID NO: 8026054 - DNA, 22 bp, Homo sapiens
tggctggagggttagtgagata

SEQ ID NO: 8026055 - DNA, 22 bp, Homo sapiens
tggctggaggcatgcaagctcc

SEQ ID NO: 8026056 - DNA, 22 bp, Homo sapiens
tggctggagggacccactcaga

SEQ ID NO: 8026057 - DNA, 22 bp, Homo sapiens
tggctggagggacccactcaga

SEQ ID NO: 8026058 - DNA, 22 bp, Homo sapiens
tggctggacagtgggcagtgga

SEQ ID NO: 8026059 - DNA, 22 bp, Homo sapiens
tggctggacagtgggcagtgga

SEQ ID NO: 8026060 - DNA, 22 bp, Homo sapiens
tggctggacagtgggcagtgga

SEQ ID NO: 8026061 - DNA, 22 bp, Homo sapiens
tggctggacagtgggcagtgga

SEQ ID NO: 8026062 - DNA, 22 bp, Homo sapiens
tggctggacagtgggcagtgga

SEQ ID NO: 8026063 - DNA, 22 bp, Homo sapiens
tggctggaatggagctgagcct

SEQ ID NO: 8026064 - DNA, 22 bp, Homo sapiens
tggctggaatggagctgagcct

SEQ ID NO: 8026065 - DNA, 22 bp, Homo sapiens
tggctggacctgggctggaatt

SEQ ID NO: 8026066 - DNA, 22 bp, Homo sapiens
tggctggacctgggctggaatt

SEQ ID NO: 8026067 - DNA, 22 bp, Homo sapiens
tggctggagaacttggggatct

SEQ ID NO: 8026068 - DNA, 22 bp, Homo sapiens
tggctggagagggtcccatgag

SEQ ID NO: 8026069 - DNA, 22 bp, Homo sapiens
tggctggagagggtcccatgag

SEQ ID NO: 8026070 - DNA, 19 bp, Homo sapiens
tggctggagatctgctact

SEQ ID NO: 8026071 - DNA, 19 bp, Homo sapiens
tggcttcttcggtgttccc

SEQ ID NO: 8026072 - DNA, 22 bp, Homo sapiens
tggcttcttcatatgtgatctt

SEQ ID NO: 8026073 - DNA, 19 bp, Homo sapiens
tggcttcttcggtgttccc

SEQ ID NO: 8026074 - DNA, 22 bp, Homo sapiens
tggcttcttagaccagtggcct

SEQ ID NO: 8026075 - DNA, 18 bp, Homo sapiens
tggcttcttgagctaaca

SEQ ID NO: 8026076 - DNA, 18 bp, Homo sapiens
tggcttcttgagctaaca

SEQ ID NO: 8026077 - DNA, 22 bp, Homo sapiens
tggcttcttgacttcttggctg

SEQ ID NO: 8026078 - DNA, 22 bp, Homo sapiens
tggcttcttgatcttggacttg

SEQ ID NO: 8026079 - DNA, 22 bp, Homo sapiens
tggcttcttgatcttggacttg

SEQ ID NO: 8026080 - DNA, 22 bp, Homo sapiens
tggcttcttgggatgggtcatt

SEQ ID NO: 8026081 - DNA, 22 bp, Homo sapiens
tggcttcttgggatgggtcatt

SEQ ID NO: 8026082 - DNA, 22 bp, Homo sapiens
tggcttcttgtctaatttgtta

SEQ ID NO: 8026083 - DNA, 22 bp, Homo sapiens
tggctttataaatccactggtt

SEQ ID NO: 8026084 - DNA, 22 bp, Homo sapiens
tggctttataaatccactggtt

SEQ ID NO: 8026085 - DNA, 22 bp, Homo sapiens
tggctttatacttaagcacaat

SEQ ID NO: 8026086 - DNA, 22 bp, Homo sapiens
tggctttatacttaagcacaat

SEQ ID NO: 8026087 - DNA, 22 bp, Homo sapiens
tggctttatacttaagcacaat

SEQ ID NO: 8026088 - DNA, 22 bp, Homo sapiens
tggctttataaatccactggtt

SEQ ID NO: 8026089 - DNA, 22 bp, Homo sapiens
tggctttctcccccagcttctc

SEQ ID NO: 8026090 - DNA, 22 bp, Homo sapiens
tggctttcgctatagagcacgg

SEQ ID NO: 8026091 - DNA, 17 bp, Homo sapiens
tggctttcctgacacag

SEQ ID NO: 8026092 - DNA, 23 bp, Homo sapiens
tggctttattcacatatctgacc

SEQ ID NO: 8026093 - DNA, 22 bp, Homo sapiens
tggctttatccatcatcgccaa

SEQ ID NO: 8026094 - DNA, 22 bp, Homo sapiens
tggctttatgtgttacgaaaat

SEQ ID NO: 8026095 - DNA, 22 bp, Homo sapiens
tgggaaagactcaggacaggag

SEQ ID NO: 8026096 - DNA, 22 bp, Homo sapiens
tgggaaagactcaggacaggag

SEQ ID NO: 8026097 - DNA, 22 bp, Homo sapiens
tgggaaagactcaggacaggag

SEQ ID NO: 8026098 - DNA, 22 bp, Homo sapiens
tggcttttgttggtaccacctt

SEQ ID NO: 8026099 - DNA, 22 bp, Homo sapiens
tggctttctcccccagcttctc

SEQ ID NO: 8026100 - DNA, 22 bp, Homo sapiens
tggctttgaaatccagtcatta

SEQ ID NO: 8026101 - DNA, 22 bp, Homo sapiens
tggctttgatggacagaggtca

SEQ ID NO: 8026102 - DNA, 22 bp, Homo sapiens
tggctttgatggacagaggtca

SEQ ID NO: 8026103 - DNA, 22 bp, Homo sapiens
tggctttgacttaccagaagtg

SEQ ID NO: 8026104 - DNA, 21 bp, Homo sapiens
tggcttttatggagctctggg

SEQ ID NO: 8026105 - DNA, 22 bp, Homo sapiens
tggcttttgcctttcaaattgg

SEQ ID NO: 8026106 - DNA, 21 bp, Homo sapiens
tggcttttatggagctctggg

SEQ ID NO: 8026107 - DNA, 22 bp, Homo sapiens
tgggaaagtaattgtcatcctt

SEQ ID NO: 8026108 - DNA, 19 bp, Homo sapiens
tgggaaagtaacatacaaa

SEQ ID NO: 8026109 - DNA, 22 bp, Homo sapiens
tgggaaagtaattgtcatcctt

SEQ ID NO: 8026110 - DNA, 22 bp, Homo sapiens
tgggaaagtaattgtcatcctt

SEQ ID NO: 8026111 - DNA, 20 bp, Homo sapiens
tgggaaagtctaagtgcctc

SEQ ID NO: 8026112 - DNA, 22 bp, Homo sapiens
tgggaaagccagcagtgtcacc

SEQ ID NO: 8026113 - DNA, 22 bp, Homo sapiens
tgggaaagactcaggacaggag

SEQ ID NO: 8026114 - DNA, 22 bp, Homo sapiens
tgggaaagccagcagtgtcacc

SEQ ID NO: 8026115 - DNA, 22 bp, Homo sapiens
tgggaactctctgggaggcatc

SEQ ID NO: 8026116 - DNA, 22 bp, Homo sapiens
tgggaaccacaggactcggcac

SEQ ID NO: 8026117 - DNA, 22 bp, Homo sapiens
tgggaacattttgagctgagag

SEQ ID NO: 8026118 - DNA, 22 bp, Homo sapiens
tgggaacattttgagctgagag

SEQ ID NO: 8026119 - DNA, 22 bp, Homo sapiens
tgggaacagtagctgctgagct

SEQ ID NO: 8026120 - DNA, 22 bp, Homo sapiens
tgggaacagtagctgctgagct

SEQ ID NO: 8026121 - DNA, 22 bp, Homo sapiens
tgggaagaagcagagaactgga

SEQ ID NO: 8026122 - DNA, 22 bp, Homo sapiens
tgggaagaagcagagaactgga

SEQ ID NO: 8026123 - DNA, 22 bp, Homo sapiens
tgggaagaagcagagaactgga

SEQ ID NO: 8026124 - DNA, 18 bp, Homo sapiens
tgggaagaaattcttctc

SEQ ID NO: 8026125 - DNA, 19 bp, Homo sapiens
tgggaacttgttagacatg

SEQ ID NO: 8026126 - DNA, 22 bp, Homo sapiens
tgggaactgcaggtgttacata

SEQ ID NO: 8026127 - DNA, 22 bp, Homo sapiens
tgggaagaggcgggaggctgtt

SEQ ID NO: 8026128 - DNA, 22 bp, Homo sapiens
tgggaagaggcgggaggctgtt

SEQ ID NO: 8026129 - DNA, 22 bp, Homo sapiens
tgggaagaggcgggaggctgtt

SEQ ID NO: 8026130 - DNA, 22 bp, Homo sapiens
tgggaagaggcgggaggctgtt

SEQ ID NO: 8026131 - DNA, 22 bp, Homo sapiens
tgggaagaggatgaggcatatg

SEQ ID NO: 8026132 - DNA, 22 bp, Homo sapiens
tgggaagaggatgaggcatatg

SEQ ID NO: 8026133 - DNA, 22 bp, Homo sapiens
tgggaagaggatgaggcatatg

SEQ ID NO: 8026134 - DNA, 22 bp, Homo sapiens
tgggaagaggcgggaggctgtt

SEQ ID NO: 8026135 - DNA, 22 bp, Homo sapiens
tgggaagactcctcaggaggcg

SEQ ID NO: 8026136 - DNA, 22 bp, Homo sapiens
tgggaagactcctcaggaggcg

SEQ ID NO: 8026137 - DNA, 22 bp, Homo sapiens
tgggaagactcctcaggaggcg

SEQ ID NO: 8026138 - DNA, 22 bp, Homo sapiens
tgggaagactcctcaggaggcg

SEQ ID NO: 8026139 - DNA, 22 bp, Homo sapiens
tgggaagactcctcaggaggcg

SEQ ID NO: 8026140 - DNA, 22 bp, Homo sapiens
tgggaagactcctcaggaggcg

SEQ ID NO: 8026141 - DNA, 22 bp, Homo sapiens
tgggaaagtgtagcctgcaggc

SEQ ID NO: 8026142 - DNA, 22 bp, Homo sapiens
tgggaaagtgtagcctgcaggc

SEQ ID NO: 8026143 - DNA, 22 bp, Homo sapiens
tgggaaagtgtagcctgcaggc

SEQ ID NO: 8026144 - DNA, 22 bp, Homo sapiens
tgggaaagtgttgaggtgtctt

SEQ ID NO: 8026145 - DNA, 22 bp, Homo sapiens
tgggaaagtgttgaggtgtctt

SEQ ID NO: 8026146 - DNA, 22 bp, Homo sapiens
tgggaaatataatttagctgtg

SEQ ID NO: 8026147 - DNA, 22 bp, Homo sapiens
tgggaaagtgttgaggtgtctt

SEQ ID NO: 8026148 - DNA, 22 bp, Homo sapiens
tgggaacagaggacttgactgt

SEQ ID NO: 8026149 - DNA, 22 bp, Homo sapiens
tgggaacagtagctgctgagct

SEQ ID NO: 8026150 - DNA, 22 bp, Homo sapiens
tgggaacacctgctgcccagtg

SEQ ID NO: 8026151 - DNA, 22 bp, Homo sapiens
tgggaacaacatgcactgccac

SEQ ID NO: 8026152 - DNA, 22 bp, Homo sapiens
tgggaaattgtatttctatttc

SEQ ID NO: 8026153 - DNA, 22 bp, Homo sapiens
tgggaaatgtgtttctggacca

SEQ ID NO: 8026154 - DNA, 22 bp, Homo sapiens
tgggaaattgtatttctatttc

SEQ ID NO: 8026155 - DNA, 22 bp, Homo sapiens
tgggaaatgctgcattgggcaa

SEQ ID NO: 8026156 - DNA, 22 bp, Homo sapiens
tgggaaatcagtatagtatcag

SEQ ID NO: 8026157 - DNA, 22 bp, Homo sapiens
tgggaaatattggttattggat

SEQ ID NO: 8026158 - DNA, 22 bp, Homo sapiens
tgggaaatattctaaaagtctt

SEQ ID NO: 8026159 - DNA, 22 bp, Homo sapiens
tgggaaatattctaaaagtctt

SEQ ID NO: 8026160 - DNA, 22 bp, Homo sapiens
tgggaaatatggcattgggcct

SEQ ID NO: 8026161 - DNA, 22 bp, Homo sapiens
tgggaaatataatttagctgtg

SEQ ID NO: 8026162 - DNA, 22 bp, Homo sapiens
tggcttctccctacaacatgcc

SEQ ID NO: 8026163 - DNA, 22 bp, Homo sapiens
tggcttctccctacaacatgcc

SEQ ID NO: 8026164 - DNA, 22 bp, Homo sapiens
tggcttctccctccccatctag

SEQ ID NO: 8026165 - DNA, 22 bp, Homo sapiens
tggcttctcccgacaccctggc

SEQ ID NO: 8026166 - DNA, 22 bp, Homo sapiens
tggcttctcgcctgtcatcccg

SEQ ID NO: 8026167 - DNA, 22 bp, Homo sapiens
tggcttctctggcatccccatc

SEQ ID NO: 8026168 - DNA, 22 bp, Homo sapiens
tggcttctccctctgcctgatt

SEQ ID NO: 8026169 - DNA, 20 bp, Homo sapiens
tggcttctcttcactcctgt

SEQ ID NO: 8026170 - DNA, 22 bp, Homo sapiens
tggcttctctgttttagtattt

SEQ ID NO: 8026171 - DNA, 22 bp, Homo sapiens
tggcttctctgttttagtattt

SEQ ID NO: 8026172 - DNA, 22 bp, Homo sapiens
tggcttctctgtgtgagggaga

SEQ ID NO: 8026173 - DNA, 22 bp, Homo sapiens
tggcttctgagtctcctgacat

SEQ ID NO: 8026174 - DNA, 22 bp, Homo sapiens
tggcttctgagcattgaaacgt

SEQ ID NO: 8026175 - DNA, 22 bp, Homo sapiens
tggcttctgcatatttttagag

SEQ ID NO: 8026176 - DNA, 22 bp, Homo sapiens
tggcttctgctcccagaatgat

SEQ ID NO: 8026177 - DNA, 23 bp, Homo sapiens
tggcttctgccccattctctcca

SEQ ID NO: 8026178 - DNA, 21 bp, Homo sapiens
tggcttctgccaatgttaaga

SEQ ID NO: 8026179 - DNA, 22 bp, Homo sapiens
tggcttctgcatatttttagag

SEQ ID NO: 8026180 - DNA, 23 bp, Homo sapiens
tggcttctgccccattctctcca

SEQ ID NO: 8026181 - DNA, 22 bp, Homo sapiens
tggcttctgctcccagaatgat

SEQ ID NO: 8026182 - DNA, 22 bp, Homo sapiens
tggcttctgctcccagaatgat

SEQ ID NO: 8026183 - DNA, 22 bp, Homo sapiens
tggcttctgctttcagtggagg

SEQ ID NO: 8026184 - DNA, 22 bp, Homo sapiens
tggcttctgctttcagtggagg

SEQ ID NO: 8026185 - DNA, 22 bp, Homo sapiens
tggcttctggccaggcacagga

SEQ ID NO: 8026186 - DNA, 19 bp, Homo sapiens
tggcttctggcaacagatg

SEQ ID NO: 8026187 - DNA, 22 bp, Homo sapiens
tggcttctggggtggcctgcat

SEQ ID NO: 8026188 - DNA, 22 bp, Homo sapiens
tggcttctgggacttgtgagca

SEQ ID NO: 8026189 - DNA, 22 bp, Homo sapiens
tggcttctgggacttgtgagca

SEQ ID NO: 8026190 - DNA, 22 bp, Homo sapiens
tggcttctggctggtgagaaat

SEQ ID NO: 8026191 - DNA, 22 bp, Homo sapiens
tggcttctggctggtgagaaat

SEQ ID NO: 8026192 - DNA, 19 bp, Homo sapiens
tggcttctgttttcatgtt

SEQ ID NO: 8026193 - DNA, 22 bp, Homo sapiens
tggcttctggtttatccttata

SEQ ID NO: 8026194 - DNA, 22 bp, Homo sapiens
tggcttctgtccctgctacatt

SEQ ID NO: 8026195 - DNA, 22 bp, Homo sapiens
tggcttctagtttgaggaaaaa

SEQ ID NO: 8026196 - DNA, 22 bp, Homo sapiens
tggcttctagtttgaggaaaaa

SEQ ID NO: 8026197 - DNA, 22 bp, Homo sapiens
tggcttctagtttgaggaaaaa

SEQ ID NO: 8026198 - DNA, 22 bp, Homo sapiens
tggcttctagcagtgttgattt

SEQ ID NO: 8026199 - DNA, 22 bp, Homo sapiens
tggcttctagcagtgttgattt

SEQ ID NO: 8026200 - DNA, 22 bp, Homo sapiens
tggcttctagcagtgttgattt

SEQ ID NO: 8026201 - DNA, 22 bp, Homo sapiens
tggcttcctgtttcccagaaag

SEQ ID NO: 8026202 - DNA, 22 bp, Homo sapiens
tggcttctagagcccatccttc

SEQ ID NO: 8026203 - DNA, 22 bp, Homo sapiens
tggcttctaaagtttcttttag

SEQ ID NO: 8026204 - DNA, 22 bp, Homo sapiens
tggcttctcagtttcataatga

SEQ ID NO: 8026205 - DNA, 22 bp, Homo sapiens
tggcttctcagtttcataatga

SEQ ID NO: 8026206 - DNA, 22 bp, Homo sapiens
tggcttctccagaaatcttggt

SEQ ID NO: 8026207 - DNA, 22 bp, Homo sapiens
tggcttctcatttgcattaaac

SEQ ID NO: 8026208 - DNA, 18 bp, Homo sapiens
tggcttctattttactca

SEQ ID NO: 8026209 - DNA, 22 bp, Homo sapiens
tggcttctattgctgtggcatt

SEQ ID NO: 8026210 - DNA, 18 bp, Homo sapiens
tggcttctattttactca

SEQ ID NO: 8026211 - DNA, 22 bp, Homo sapiens
tggcttctcaaaataactggtt

SEQ ID NO: 8026212 - DNA, 18 bp, Homo sapiens
tggcttctcaaagcccag

SEQ ID NO: 8026213 - DNA, 22 bp, Homo sapiens
tggcttctcagaatactctgga

SEQ ID NO: 8026214 - DNA, 22 bp, Homo sapiens
tggcttcctgcatggatcctct

SEQ ID NO: 8026215 - DNA, 22 bp, Homo sapiens
tggcttcctgcacagtgtctgc

SEQ ID NO: 8026216 - DNA, 19 bp, Homo sapiens
tggcttcctgactctcatc

SEQ ID NO: 8026217 - DNA, 22 bp, Homo sapiens
tggcttcctccagagcaggagg

SEQ ID NO: 8026218 - DNA, 22 bp, Homo sapiens
tggcttcctccagagcaggagg

SEQ ID NO: 8026219 - DNA, 22 bp, Homo sapiens
tggcttcctgcacagtgtctgc

SEQ ID NO: 8026220 - DNA, 22 bp, Homo sapiens
tggcttccgccgcgggcctcgg

SEQ ID NO: 8026221 - DNA, 17 bp, Homo sapiens
tggcttccctgggccac

SEQ ID NO: 8026222 - DNA, 17 bp, Homo sapiens
tggcttccctgggccac

SEQ ID NO: 8026223 - DNA, 22 bp, Homo sapiens
tggcttcctaggagcccgtgct

SEQ ID NO: 8026224 - DNA, 22 bp, Homo sapiens
tggcttcagacttctgctacgt

SEQ ID NO: 8026225 - DNA, 22 bp, Homo sapiens
tggcttcagagacagaatctat

SEQ ID NO: 8026226 - DNA, 22 bp, Homo sapiens
tggcttcagagacagaatctat

SEQ ID NO: 8026227 - DNA, 22 bp, Homo sapiens
tggcttcagagacagaatctat

SEQ ID NO: 8026228 - DNA, 22 bp, Homo sapiens
tggcttcacctcagcatgaagg

SEQ ID NO: 8026229 - DNA, 22 bp, Homo sapiens
tggcttcactgctcaagtgatt

SEQ ID NO: 8026230 - DNA, 22 bp, Homo sapiens
tggcttcaggagcacctggctt

SEQ ID NO: 8026231 - DNA, 22 bp, Homo sapiens
tggcttcaggagcacctggctt

SEQ ID NO: 8026232 - DNA, 22 bp, Homo sapiens
tggcttcagagtctgagttctt

SEQ ID NO: 8026233 - DNA, 22 bp, Homo sapiens
tggcttcagagtctgagttctt

SEQ ID NO: 8026234 - DNA, 23 bp, Homo sapiens
tggctctgtggatccctcaggag

SEQ ID NO: 8026235 - DNA, 23 bp, Homo sapiens
tggctctgtggatccctcaggag

SEQ ID NO: 8026236 - DNA, 22 bp, Homo sapiens
tggctctgtgcttctagtatct

SEQ ID NO: 8026237 - DNA, 23 bp, Homo sapiens
tggctctgtggatccctcaggag

SEQ ID NO: 8026238 - DNA, 23 bp, Homo sapiens
tggctctgtggatccctcaggag

SEQ ID NO: 8026239 - DNA, 23 bp, Homo sapiens
tggctctgtggatccctcaggag

SEQ ID NO: 8026240 - DNA, 23 bp, Homo sapiens
tggctctgtggatccctcaggag

SEQ ID NO: 8026241 - DNA, 23 bp, Homo sapiens
tggctctgtggatccctcaggag

SEQ ID NO: 8026242 - DNA, 22 bp, Homo sapiens
tggctctgtggatgttctgacc

SEQ ID NO: 8026243 - DNA, 22 bp, Homo sapiens
tggctctgtggatgttctgacc

SEQ ID NO: 8026244 - DNA, 22 bp, Homo sapiens
tggctctgtggatgttctgacc

SEQ ID NO: 8026245 - DNA, 22 bp, Homo sapiens
tggctctgtggtcttagcatgc

SEQ ID NO: 8026246 - DNA, 22 bp, Homo sapiens
tggctctgtggtcttagcatgc

SEQ ID NO: 8026247 - DNA, 22 bp, Homo sapiens
tggctctgtggtcttagcatgc

SEQ ID NO: 8026248 - DNA, 23 bp, Homo sapiens
tggctctgtgtcacatacaggat

SEQ ID NO: 8026249 - DNA, 22 bp, Homo sapiens
tggctctgtggtcttagcatgc

SEQ ID NO: 8026250 - DNA, 22 bp, Homo sapiens
tggctctgtgcttctagtatct

SEQ ID NO: 8026251 - DNA, 22 bp, Homo sapiens
tggctctgtgaacagacgactg

SEQ ID NO: 8026252 - DNA, 22 bp, Homo sapiens
tggctctgtgaacagacgactg

SEQ ID NO: 8026253 - DNA, 22 bp, Homo sapiens
tggctctgtgaacagacgactg

SEQ ID NO: 8026254 - DNA, 22 bp, Homo sapiens
tggctctgtgcttctagtatct

SEQ ID NO: 8026255 - DNA, 22 bp, Homo sapiens
tggctctgtgcttctagtatct

SEQ ID NO: 8026256 - DNA, 22 bp, Homo sapiens
tggctctggggacagtaagtcc

SEQ ID NO: 8026257 - DNA, 22 bp, Homo sapiens
tggctctggggacagtaagtcc

SEQ ID NO: 8026258 - DNA, 22 bp, Homo sapiens
tggctctggggacagtaagtcc

SEQ ID NO: 8026259 - DNA, 22 bp, Homo sapiens
tggctctgtcgccgtttggaat

SEQ ID NO: 8026260 - DNA, 22 bp, Homo sapiens
tggctctgtcgccgtttggaat

SEQ ID NO: 8026261 - DNA, 22 bp, Homo sapiens
tggctctgtcgccgtttggaat

SEQ ID NO: 8026262 - DNA, 22 bp, Homo sapiens
tggctctgtcgccgtttggaat

SEQ ID NO: 8026263 - DNA, 22 bp, Homo sapiens
tggctctgggaatgggaagatg

SEQ ID NO: 8026264 - DNA, 22 bp, Homo sapiens
tggctctgggaatgggaagatg

SEQ ID NO: 8026265 - DNA, 22 bp, Homo sapiens
tggctctgggaatctgttgctt

SEQ ID NO: 8026266 - DNA, 22 bp, Homo sapiens
tggctctgggaatgggaagatg

SEQ ID NO: 8026267 - DNA, 22 bp, Homo sapiens
tggctctgggaatgggaagatg

SEQ ID NO: 8026268 - DNA, 22 bp, Homo sapiens
tggctctgggaatctgttgctt

SEQ ID NO: 8026269 - DNA, 22 bp, Homo sapiens
tggctctgggaatctgttgctt

SEQ ID NO: 8026270 - DNA, 22 bp, Homo sapiens
tggctctggcgtgaagcccaga

SEQ ID NO: 8026271 - DNA, 22 bp, Homo sapiens
tggctctgggaatctgttgctt

SEQ ID NO: 8026272 - DNA, 22 bp, Homo sapiens
tggctctgggcaccgtgtccac

SEQ ID NO: 8026273 - DNA, 22 bp, Homo sapiens
tggctctgggaatgggaagatg

SEQ ID NO: 8026274 - DNA, 22 bp, Homo sapiens
tggctctggggacagtaagtcc

SEQ ID NO: 8026275 - DNA, 22 bp, Homo sapiens
tggctctgggcaccgtgtccac

SEQ ID NO: 8026276 - DNA, 22 bp, Homo sapiens
tggctctgggcaccgtgtccac

SEQ ID NO: 8026277 - DNA, 22 bp, Homo sapiens
tggctctggagctggcggctga

SEQ ID NO: 8026278 - DNA, 22 bp, Homo sapiens
tggctctggagctggcggctga

SEQ ID NO: 8026279 - DNA, 22 bp, Homo sapiens
tggctctggattaatctaggaa

SEQ ID NO: 8026280 - DNA, 22 bp, Homo sapiens
tggctctggattaatctaggaa

SEQ ID NO: 8026281 - DNA, 22 bp, Homo sapiens
tggctctggattaatctaggaa

SEQ ID NO: 8026282 - DNA, 22 bp, Homo sapiens
tggctctggattaatctaggaa

SEQ ID NO: 8026283 - DNA, 22 bp, Homo sapiens
tggctctggattaatctaggaa

SEQ ID NO: 8026284 - DNA, 22 bp, Homo sapiens
tggctctggattaatctaggaa

SEQ ID NO: 8026285 - DNA, 22 bp, Homo sapiens
tggctctggccaccgggagggc

SEQ ID NO: 8026286 - DNA, 22 bp, Homo sapiens
tggctctggccaccgggagggc

SEQ ID NO: 8026287 - DNA, 22 bp, Homo sapiens
tggctctggcgtgaagcccaga

SEQ ID NO: 8026288 - DNA, 22 bp, Homo sapiens
tggctctgttgtgctgagccag

SEQ ID NO: 8026289 - DNA, 22 bp, Homo sapiens
tggctctgttgtgctgagccag

SEQ ID NO: 8026290 - DNA, 22 bp, Homo sapiens
tggctctgttgctcgcagtttt

SEQ ID NO: 8026291 - DNA, 22 bp, Homo sapiens
tggctctgttgtaaagaaattt

SEQ ID NO: 8026292 - DNA, 22 bp, Homo sapiens
tggctctgttgaggtatggatt

SEQ ID NO: 8026293 - DNA, 22 bp, Homo sapiens
tggctctgttcgccatcaggag

SEQ ID NO: 8026294 - DNA, 22 bp, Homo sapiens
tggctctgttcgccatcaggag

SEQ ID NO: 8026295 - DNA, 22 bp, Homo sapiens
tggctctgttgaggtatggatt

SEQ ID NO: 8026296 - DNA, 22 bp, Homo sapiens
tggctctgttgaggtatggatt

SEQ ID NO: 8026297 - DNA, 22 bp, Homo sapiens
tggctctgttcgccatcaggag

SEQ ID NO: 8026298 - DNA, 22 bp, Homo sapiens
tggctctgttcgccatcaggag

SEQ ID NO: 8026299 - DNA, 22 bp, Homo sapiens
tggctctgttcgccatcaggag

SEQ ID NO: 8026300 - DNA, 22 bp, Homo sapiens
tggctctgttcgccatcaggag

SEQ ID NO: 8026301 - DNA, 21 bp, Homo sapiens
tggctctgttcaatatatgga

SEQ ID NO: 8026302 - DNA, 22 bp, Homo sapiens
tggctctgttcgccatcaggag

SEQ ID NO: 8026303 - DNA, 21 bp, Homo sapiens
tggctctgttcaatatatgga

SEQ ID NO: 8026304 - DNA, 21 bp, Homo sapiens
tggctctgttcaatatatgga

SEQ ID NO: 8026305 - DNA, 22 bp, Homo sapiens
tggctctgtgtctcccagcagc

SEQ ID NO: 8026306 - DNA, 22 bp, Homo sapiens
tggctctgtgtctcccagcagc

SEQ ID NO: 8026307 - DNA, 22 bp, Homo sapiens
tggctctgtgtctcccagcagc

SEQ ID NO: 8026308 - DNA, 23 bp, Homo sapiens
tggctctgtgtcacatacaggat

SEQ ID NO: 8026309 - DNA, 23 bp, Homo sapiens
tggctctgtgtcacatacaggat

SEQ ID NO: 8026310 - DNA, 22 bp, Homo sapiens
tggctctgtgtctcccagcagc

SEQ ID NO: 8026311 - DNA, 22 bp, Homo sapiens
tggctctgtgtctcccagcagc

SEQ ID NO: 8026312 - DNA, 22 bp, Homo sapiens
tggctctgtgtctcccagcagc

SEQ ID NO: 8026313 - DNA, 23 bp, Homo sapiens
tggctctgtgtcacatacaggat

SEQ ID NO: 8026314 - DNA, 23 bp, Homo sapiens
tggctctgtgtcacatacaggat

SEQ ID NO: 8026315 - DNA, 19 bp, Homo sapiens
tggctctgtttctctggag

SEQ ID NO: 8026316 - DNA, 19 bp, Homo sapiens
tggctctgtttctctggag

SEQ ID NO: 8026317 - DNA, 19 bp, Homo sapiens
tggctctgtttctctggag

SEQ ID NO: 8026318 - DNA, 19 bp, Homo sapiens
tggctctgtttctctggag

SEQ ID NO: 8026319 - DNA, 19 bp, Homo sapiens
tggctctgtttctctggag

SEQ ID NO: 8026320 - DNA, 19 bp, Homo sapiens
tggctctgtttctctggag

SEQ ID NO: 8026321 - DNA, 19 bp, Homo sapiens
tggctctgtttctctggag

SEQ ID NO: 8026322 - DNA, 22 bp, Homo sapiens
tggctctgttgtgctgagccag

SEQ ID NO: 8026323 - DNA, 22 bp, Homo sapiens
tggctctgttgtgctgagccag

SEQ ID NO: 8026324 - DNA, 22 bp, Homo sapiens
tggctctgttgtgctgagccag

SEQ ID NO: 8026325 - DNA, 22 bp, Homo sapiens
tggctctgttgtgctgagccag

SEQ ID NO: 8026326 - DNA, 22 bp, Homo sapiens
tggctctgttgtgctgagccag

SEQ ID NO: 8026327 - DNA, 22 bp, Homo sapiens
tggctctgttgtgctgagccag

SEQ ID NO: 8026328 - DNA, 22 bp, Homo sapiens
tggctctgttgtgctgagccag

SEQ ID NO: 8026329 - DNA, 22 bp, Homo sapiens
tggctcttggtgctagtttctg

SEQ ID NO: 8026330 - DNA, 22 bp, Homo sapiens
tggctctttcaaatttactaaa

SEQ ID NO: 8026331 - DNA, 19 bp, Homo sapiens
tggctcttgtgggactgca

SEQ ID NO: 8026332 - DNA, 22 bp, Homo sapiens
tggctcttgcttacgaaggtta

SEQ ID NO: 8026333 - DNA, 22 bp, Homo sapiens
tggctcttggtgctagtttctg

SEQ ID NO: 8026334 - DNA, 22 bp, Homo sapiens
tggctcttctcaagcattggct

SEQ ID NO: 8026335 - DNA, 22 bp, Homo sapiens
tggctctttctgtctgggatcc

SEQ ID NO: 8026336 - DNA, 22 bp, Homo sapiens
tggctctttctagacttaatta

SEQ ID NO: 8026337 - DNA, 22 bp, Homo sapiens
tggctctttcaaatttactaaa

SEQ ID NO: 8026338 - DNA, 22 bp, Homo sapiens
tggctctttcaaatttactaaa

SEQ ID NO: 8026339 - DNA, 22 bp, Homo sapiens
tggctctgttttatgagtacca

SEQ ID NO: 8026340 - DNA, 22 bp, Homo sapiens
tggctctgttttatgagtacca

SEQ ID NO: 8026341 - DNA, 22 bp, Homo sapiens
tggctcttaaggtccctgtgct

SEQ ID NO: 8026342 - DNA, 22 bp, Homo sapiens
tggctctgtttgttaactagac

SEQ ID NO: 8026343 - DNA, 22 bp, Homo sapiens
tggctctgtttgttaactagac

SEQ ID NO: 8026344 - DNA, 22 bp, Homo sapiens
tggctctgttttatgagtacca

SEQ ID NO: 8026345 - DNA, 22 bp, Homo sapiens
tggctctgtttgttaactagac

SEQ ID NO: 8026346 - DNA, 18 bp, Homo sapiens
tggctctgcagccagatg

SEQ ID NO: 8026347 - DNA, 18 bp, Homo sapiens
tggctctgcagccagatg

SEQ ID NO: 8026348 - DNA, 18 bp, Homo sapiens
tggctctgcagccagatg

SEQ ID NO: 8026349 - DNA, 18 bp, Homo sapiens
tggctctgcagccagatg

SEQ ID NO: 8026350 - DNA, 22 bp, Homo sapiens
tggctctgcacctcagtgtacc

SEQ ID NO: 8026351 - DNA, 22 bp, Homo sapiens
tggctctgcagcagtgtgcgtg

SEQ ID NO: 8026352 - DNA, 22 bp, Homo sapiens
tggctctgcagcagtgtgcgtg

SEQ ID NO: 8026353 - DNA, 22 bp, Homo sapiens
tggctctgcacctcagtgtacc

SEQ ID NO: 8026354 - DNA, 22 bp, Homo sapiens
tggctctgcacctcagtgtacc

SEQ ID NO: 8026355 - DNA, 22 bp, Homo sapiens
tggctctgatgggaggtattgg

SEQ ID NO: 8026356 - DNA, 22 bp, Homo sapiens
tggctctgatgggaggtattgg

SEQ ID NO: 8026357 - DNA, 22 bp, Homo sapiens
tggctctgatgggaggtattgg

SEQ ID NO: 8026358 - DNA, 22 bp, Homo sapiens
tggctctgatcagatgtccagt

SEQ ID NO: 8026359 - DNA, 22 bp, Homo sapiens
tggctctgatgggaggtattgg

SEQ ID NO: 8026360 - DNA, 22 bp, Homo sapiens
tggctctgatcagatgtccagt

SEQ ID NO: 8026361 - DNA, 22 bp, Homo sapiens
tggctctgagtctgcccttggc

SEQ ID NO: 8026362 - DNA, 22 bp, Homo sapiens
tggctctgatcagatgtccagt

SEQ ID NO: 8026363 - DNA, 18 bp, Homo sapiens
tggctctgccactcaccg

SEQ ID NO: 8026364 - DNA, 18 bp, Homo sapiens
tggctctgccactcaccg

SEQ ID NO: 8026365 - DNA, 18 bp, Homo sapiens
tggctctgccactcaccg

SEQ ID NO: 8026366 - DNA, 18 bp, Homo sapiens
tggctctgccactcaccg

SEQ ID NO: 8026367 - DNA, 18 bp, Homo sapiens
tggctctgccactcaccg

SEQ ID NO: 8026368 - DNA, 22 bp, Homo sapiens
tggctctgccccatacccctgc

SEQ ID NO: 8026369 - DNA, 22 bp, Homo sapiens
tggctctgccccatacccctgc

SEQ ID NO: 8026370 - DNA, 18 bp, Homo sapiens
tggctctgccactcaccg

SEQ ID NO: 8026371 - DNA, 22 bp, Homo sapiens
tggctctgccacctttccctaa

SEQ ID NO: 8026372 - DNA, 22 bp, Homo sapiens
tggctctgccacctttccctaa

SEQ ID NO: 8026373 - DNA, 22 bp, Homo sapiens
tggctctgccacctttccctaa

SEQ ID NO: 8026374 - DNA, 22 bp, Homo sapiens
tggctctgccactaacttggta

SEQ ID NO: 8026375 - DNA, 22 bp, Homo sapiens
tggctctgccactaacttggta

SEQ ID NO: 8026376 - DNA, 22 bp, Homo sapiens
tggctctgccactaacttggta

SEQ ID NO: 8026377 - DNA, 18 bp, Homo sapiens
tggctctgcagccagatg

SEQ ID NO: 8026378 - DNA, 18 bp, Homo sapiens
tggctctgcagccagatg

SEQ ID NO: 8026379 - DNA, 18 bp, Homo sapiens
tggctctgcagccagatg

SEQ ID NO: 8026380 - DNA, 22 bp, Homo sapiens
tggctctggagctcctgggccc

SEQ ID NO: 8026381 - DNA, 22 bp, Homo sapiens
tggctctggagctcctgggccc

SEQ ID NO: 8026382 - DNA, 18 bp, Homo sapiens
tggctctggacttgctcc

SEQ ID NO: 8026383 - DNA, 22 bp, Homo sapiens
tggctctggagctcctgggccc

SEQ ID NO: 8026384 - DNA, 22 bp, Homo sapiens
tggctctggagctcctgggccc

SEQ ID NO: 8026385 - DNA, 22 bp, Homo sapiens
tggctctggagctcctgggccc

SEQ ID NO: 8026386 - DNA, 22 bp, Homo sapiens
tggctctggagctcctgggccc

SEQ ID NO: 8026387 - DNA, 22 bp, Homo sapiens
tggctctggagctggcggctga

SEQ ID NO: 8026388 - DNA, 22 bp, Homo sapiens
tggctctggagctcctgggccc

SEQ ID NO: 8026389 - DNA, 18 bp, Homo sapiens
tggctctggacttgctcc

SEQ ID NO: 8026390 - DNA, 18 bp, Homo sapiens
tggctctggacttgctcc

SEQ ID NO: 8026391 - DNA, 22 bp, Homo sapiens
tggctctgctgaacctagtgca

SEQ ID NO: 8026392 - DNA, 22 bp, Homo sapiens
tggctctgctgaacctagtgca

SEQ ID NO: 8026393 - DNA, 22 bp, Homo sapiens
tggctctgctgaacctagtgca

SEQ ID NO: 8026394 - DNA, 22 bp, Homo sapiens
tggctctgctgaacctagtgca

SEQ ID NO: 8026395 - DNA, 22 bp, Homo sapiens
tggctctgctgaacctagtgca

SEQ ID NO: 8026396 - DNA, 21 bp, Homo sapiens
tggctctgctcagagcagtcc

SEQ ID NO: 8026397 - DNA, 21 bp, Homo sapiens
tggctctgctcagagcagtcc

SEQ ID NO: 8026398 - DNA, 21 bp, Homo sapiens
tggctctgctcagagcagtcc

SEQ ID NO: 8026399 - DNA, 22 bp, Homo sapiens
tggctctgcgtctgttcgtggg

SEQ ID NO: 8026400 - DNA, 21 bp, Homo sapiens
tggctctgctcagagcagtcc

SEQ ID NO: 8026401 - DNA, 22 bp, Homo sapiens
tggctctgcgtctgttcgtggg

SEQ ID NO: 8026402 - DNA, 22 bp, Homo sapiens
tggctctgcgtctgttcgtggg

SEQ ID NO: 8026403 - DNA, 17 bp, Homo sapiens
tggctctgaggctgaat

SEQ ID NO: 8026404 - DNA, 17 bp, Homo sapiens
tggctctgaggctgaat

SEQ ID NO: 8026405 - DNA, 17 bp, Homo sapiens
tggctctgaggctgaat

SEQ ID NO: 8026406 - DNA, 17 bp, Homo sapiens
tggctctgaggctgaat

SEQ ID NO: 8026407 - DNA, 17 bp, Homo sapiens
tggctctgaggctgaat

SEQ ID NO: 8026408 - DNA, 17 bp, Homo sapiens
tggctctgaggctgaat

SEQ ID NO: 8026409 - DNA, 17 bp, Homo sapiens
tggctctgaggctgaat

SEQ ID NO: 8026410 - DNA, 22 bp, Homo sapiens
tggctctgagtctgcccttggc

SEQ ID NO: 8026411 - DNA, 22 bp, Homo sapiens
tggctctgagtctgcccttggc

SEQ ID NO: 8026412 - DNA, 23 bp, Homo sapiens
tggctctgagcttcctggtggcc

SEQ ID NO: 8026413 - DNA, 17 bp, Homo sapiens
tggctctgaggctgaat

SEQ ID NO: 8026414 - DNA, 23 bp, Homo sapiens
tggctctgagcttcctggtggcc

SEQ ID NO: 8026415 - DNA, 22 bp, Homo sapiens
tggctctgagctgcaaagctgc

SEQ ID NO: 8026416 - DNA, 23 bp, Homo sapiens
tggctctgagcttcctggtggcc

SEQ ID NO: 8026417 - DNA, 23 bp, Homo sapiens
tggctctgagcttcctggtggcc

SEQ ID NO: 8026418 - DNA, 21 bp, Homo sapiens
tggctctgagcctcatggctg

SEQ ID NO: 8026419 - DNA, 21 bp, Homo sapiens
tggctctgagcctcatggctg

SEQ ID NO: 8026420 - DNA, 21 bp, Homo sapiens
tggctctgagcctcatggctg

SEQ ID NO: 8026421 - DNA, 21 bp, Homo sapiens
tggctctgagcctcatggctg

SEQ ID NO: 8026422 - DNA, 21 bp, Homo sapiens
tggctctgagcctcatggctg

SEQ ID NO: 8026423 - DNA, 21 bp, Homo sapiens
tggctctgagcctcatggctg

SEQ ID NO: 8026424 - DNA, 22 bp, Homo sapiens
tggctctgagctgcaaagctgc

SEQ ID NO: 8026425 - DNA, 22 bp, Homo sapiens
tggctctgagctgcaaagctgc

SEQ ID NO: 8026426 - DNA, 22 bp, Homo sapiens
tggctctgagctgcaaagctgc

SEQ ID NO: 8026427 - DNA, 21 bp, Homo sapiens
tggctctgagcctcatggctg

SEQ ID NO: 8026428 - DNA, 23 bp, Homo sapiens
tggctctgagaggttcagatgct

SEQ ID NO: 8026429 - DNA, 23 bp, Homo sapiens
tggctctgagaggttcagatgct

SEQ ID NO: 8026430 - DNA, 22 bp, Homo sapiens
tggctctgagacacaggctctc

SEQ ID NO: 8026431 - DNA, 23 bp, Homo sapiens
tggctctgagaggttcagatgct

SEQ ID NO: 8026432 - DNA, 23 bp, Homo sapiens
tggctctgagaggttcagatgct

SEQ ID NO: 8026433 - DNA, 21 bp, Homo sapiens
tggctctgagcctcatggctg

SEQ ID NO: 8026434 - DNA, 22 bp, Homo sapiens
tggctccttccgcagcatgcct

SEQ ID NO: 8026435 - DNA, 22 bp, Homo sapiens
tggctccttccgcagcatgcct

SEQ ID NO: 8026436 - DNA, 22 bp, Homo sapiens
tggctccttcattctcctgcca

SEQ ID NO: 8026437 - DNA, 22 bp, Homo sapiens
tggctccttcattctcctgcca

SEQ ID NO: 8026438 - DNA, 22 bp, Homo sapiens
tggctccttcattctcctgcca

SEQ ID NO: 8026439 - DNA, 20 bp, Homo sapiens
tggctcctggctcctccctc

SEQ ID NO: 8026440 - DNA, 20 bp, Homo sapiens
tggctcctggctcctccctc

SEQ ID NO: 8026441 - DNA, 20 bp, Homo sapiens
tggctcctggctcctccctc

SEQ ID NO: 8026442 - DNA, 20 bp, Homo sapiens
tggctcctggctcctccctc

SEQ ID NO: 8026443 - DNA, 22 bp, Homo sapiens
tggctcctgtggctatttcagt

SEQ ID NO: 8026444 - DNA, 22 bp, Homo sapiens
tggctccttcattctcctgcca

SEQ ID NO: 8026445 - DNA, 22 bp, Homo sapiens
tggctccttcattctcctgcca

SEQ ID NO: 8026446 - DNA, 22 bp, Homo sapiens
tggctctcaatggctgtactat

SEQ ID NO: 8026447 - DNA, 23 bp, Homo sapiens
tggctctagaaggccattttcct

SEQ ID NO: 8026448 - DNA, 22 bp, Homo sapiens
tggctcggccacctgccagcca

SEQ ID NO: 8026449 - DNA, 22 bp, Homo sapiens
tggctctactcaaatatctggc

SEQ ID NO: 8026450 - DNA, 22 bp, Homo sapiens
tggctcgtattgatcttgaggc

SEQ ID NO: 8026451 - DNA, 22 bp, Homo sapiens
tggctcggccacctgccagcca

SEQ ID NO: 8026452 - DNA, 22 bp, Homo sapiens
tggctcggccacctgccagcca

SEQ ID NO: 8026453 - DNA, 22 bp, Homo sapiens
tggctcctttccgggtctccag

SEQ ID NO: 8026454 - DNA, 22 bp, Homo sapiens
tggctcctttccagcctggttt

SEQ ID NO: 8026455 - DNA, 21 bp, Homo sapiens
tggctcgatttatagcatttc

SEQ ID NO: 8026456 - DNA, 20 bp, Homo sapiens
tggctctcaccctgtgcgat

SEQ ID NO: 8026457 - DNA, 20 bp, Homo sapiens
tggctctcaccctgtgcgat

SEQ ID NO: 8026458 - DNA, 20 bp, Homo sapiens
tggctctcaccctgtgcgat

SEQ ID NO: 8026459 - DNA, 20 bp, Homo sapiens
tggctctcaccctgtgcgat

SEQ ID NO: 8026460 - DNA, 22 bp, Homo sapiens
tggctctgagacacaggctctc

SEQ ID NO: 8026461 - DNA, 19 bp, Homo sapiens
tggctctttttatgacatt

SEQ ID NO: 8026462 - DNA, 19 bp, Homo sapiens
tggctctttttatgacatt

SEQ ID NO: 8026463 - DNA, 19 bp, Homo sapiens
tggctctttttatgacatt

SEQ ID NO: 8026464 - DNA, 22 bp, Homo sapiens
tggctcttttcacgtcccctct

SEQ ID NO: 8026465 - DNA, 22 bp, Homo sapiens
tggctgacaatgtagcagtaac

SEQ ID NO: 8026466 - DNA, 22 bp, Homo sapiens
tggctgacaatgtagcagtaac

SEQ ID NO: 8026467 - DNA, 22 bp, Homo sapiens
tggctgaataatattctgttgt

SEQ ID NO: 8026468 - DNA, 22 bp, Homo sapiens
tggctgaatctgcagcaggaag

SEQ ID NO: 8026469 - DNA, 22 bp, Homo sapiens
tggctgagaaaaaagagctata

SEQ ID NO: 8026470 - DNA, 22 bp, Homo sapiens
tggctgagaaaaaagagctata

SEQ ID NO: 8026471 - DNA, 22 bp, Homo sapiens
tggctgagaaaaaagagctata

SEQ ID NO: 8026472 - DNA, 21 bp, Homo sapiens
tggctgactcttcctatcatt

SEQ ID NO: 8026473 - DNA, 21 bp, Homo sapiens
tggctgactcttcctatcatt

SEQ ID NO: 8026474 - DNA, 22 bp, Homo sapiens
tggctgagaaaaaagagctata

SEQ ID NO: 8026475 - DNA, 22 bp, Homo sapiens
tggctgagaaaatggttttagg

SEQ ID NO: 8026476 - DNA, 22 bp, Homo sapiens
tggctgagaaaaaagagctata

SEQ ID NO: 8026477 - DNA, 22 bp, Homo sapiens
tggctgagaaaaaagagctata

SEQ ID NO: 8026478 - DNA, 22 bp, Homo sapiens
tggctgagaagttctggtggga

SEQ ID NO: 8026479 - DNA, 22 bp, Homo sapiens
tggctgagaagttctggtggga

SEQ ID NO: 8026480 - DNA, 22 bp, Homo sapiens
tggctgagaagttctggtggga

SEQ ID NO: 8026481 - DNA, 22 bp, Homo sapiens
tggctgagaagttctggtggga

SEQ ID NO: 8026482 - DNA, 22 bp, Homo sapiens
tggctgagaaaatggttttagg

SEQ ID NO: 8026483 - DNA, 22 bp, Homo sapiens
tggctgagaaaatggttttagg

SEQ ID NO: 8026484 - DNA, 22 bp, Homo sapiens
tggctgagaagttctggtggga

SEQ ID NO: 8026485 - DNA, 22 bp, Homo sapiens
tggctgagaaaatggttttagg

SEQ ID NO: 8026486 - DNA, 21 bp, Homo sapiens
tggctgagccaggtgtgtgga

SEQ ID NO: 8026487 - DNA, 22 bp, Homo sapiens
tggctgagccacttgttcagat

SEQ ID NO: 8026488 - DNA, 21 bp, Homo sapiens
tggctgagccaggtgtgtgga

SEQ ID NO: 8026489 - DNA, 21 bp, Homo sapiens
tggctgagccaggtgtgtgga

SEQ ID NO: 8026490 - DNA, 21 bp, Homo sapiens
tggctgagccaggtgtgtgga

SEQ ID NO: 8026491 - DNA, 21 bp, Homo sapiens
tggctgagccaggtgtgtgga

SEQ ID NO: 8026492 - DNA, 22 bp, Homo sapiens
tggctgagcctttggggctttc

SEQ ID NO: 8026493 - DNA, 22 bp, Homo sapiens
tggctgagcctttggggctttc

SEQ ID NO: 8026494 - DNA, 22 bp, Homo sapiens
tggctgagcctttggggctttc

SEQ ID NO: 8026495 - DNA, 22 bp, Homo sapiens
tggctgagcctttggggctttc

SEQ ID NO: 8026496 - DNA, 23 bp, Homo sapiens
tggctgagcccactatcttggcc

SEQ ID NO: 8026497 - DNA, 23 bp, Homo sapiens
tggctgagcccactatcttggcc

SEQ ID NO: 8026498 - DNA, 23 bp, Homo sapiens
tggctgagcccactatcttggcc

SEQ ID NO: 8026499 - DNA, 23 bp, Homo sapiens
tggctgagcccactatcttggcc

SEQ ID NO: 8026500 - DNA, 22 bp, Homo sapiens
tggctgagccacttgttcagat

SEQ ID NO: 8026501 - DNA, 22 bp, Homo sapiens
tggctgagccacttgttcagat

SEQ ID NO: 8026502 - DNA, 22 bp, Homo sapiens
tggctgagccacttgttcagat

SEQ ID NO: 8026503 - DNA, 22 bp, Homo sapiens
tggctgagagtcatcctgtgtg

SEQ ID NO: 8026504 - DNA, 23 bp, Homo sapiens
tggctgagatcctactgtttgct

SEQ ID NO: 8026505 - DNA, 23 bp, Homo sapiens
tggctgagatcctactgtttgct

SEQ ID NO: 8026506 - DNA, 23 bp, Homo sapiens
tggctgagatcctactgtttgct

SEQ ID NO: 8026507 - DNA, 22 bp, Homo sapiens
tggctgagagtcatcctgtgtg

SEQ ID NO: 8026508 - DNA, 22 bp, Homo sapiens
tggctgagagtcatcctgtgtg

SEQ ID NO: 8026509 - DNA, 22 bp, Homo sapiens
tggctgagagtcatcctgtgtg

SEQ ID NO: 8026510 - DNA, 22 bp, Homo sapiens
tggctgagagcaattgactctg

SEQ ID NO: 8026511 - DNA, 22 bp, Homo sapiens
tggctgagaagttctggtggga

SEQ ID NO: 8026512 - DNA, 22 bp, Homo sapiens
tggctgagagcaattgactctg

SEQ ID NO: 8026513 - DNA, 22 bp, Homo sapiens
tggctgaggagggtcttctggt

SEQ ID NO: 8026514 - DNA, 22 bp, Homo sapiens
tggctgaggagggtcttctggt

SEQ ID NO: 8026515 - DNA, 22 bp, Homo sapiens
tggctgaggagggtcttctggt

SEQ ID NO: 8026516 - DNA, 22 bp, Homo sapiens
tggctgaggagggtcttctggt

SEQ ID NO: 8026517 - DNA, 22 bp, Homo sapiens
tggctgaggagggtcttctggt

SEQ ID NO: 8026518 - DNA, 22 bp, Homo sapiens
tggctgaggcacagctgccgcc

SEQ ID NO: 8026519 - DNA, 22 bp, Homo sapiens
tggctgaggcacagctgccgcc

SEQ ID NO: 8026520 - DNA, 22 bp, Homo sapiens
tggctgaggcacagctgccgcc

SEQ ID NO: 8026521 - DNA, 22 bp, Homo sapiens
tggctgaggagagggcggaagt

SEQ ID NO: 8026522 - DNA, 22 bp, Homo sapiens
tggctgaggagagggcggaagt

SEQ ID NO: 8026523 - DNA, 22 bp, Homo sapiens
tggctgaggagagggcggaagt

SEQ ID NO: 8026524 - DNA, 22 bp, Homo sapiens
tggctgaggagagggcggaagt

SEQ ID NO: 8026525 - DNA, 22 bp, Homo sapiens
tggctgaggagagggcggaagt

SEQ ID NO: 8026526 - DNA, 19 bp, Homo sapiens
tggctgagctggactgagg

SEQ ID NO: 8026527 - DNA, 19 bp, Homo sapiens
tggctgagctggactgagg

SEQ ID NO: 8026528 - DNA, 19 bp, Homo sapiens
tggctgagctggactgagg

SEQ ID NO: 8026529 - DNA, 19 bp, Homo sapiens
tggctgagctggactgagg

SEQ ID NO: 8026530 - DNA, 19 bp, Homo sapiens
tggctgagctggactgagg

SEQ ID NO: 8026531 - DNA, 19 bp, Homo sapiens
tggctgagctggactgagg

SEQ ID NO: 8026532 - DNA, 19 bp, Homo sapiens
tggctgagctggactgagg

SEQ ID NO: 8026533 - DNA, 22 bp, Homo sapiens
tggctgagctgcagcgtggctt

SEQ ID NO: 8026534 - DNA, 22 bp, Homo sapiens
tggctgagctgcagcgtggctt

SEQ ID NO: 8026535 - DNA, 22 bp, Homo sapiens
tggctgagctgcagcgtggctt

SEQ ID NO: 8026536 - DNA, 22 bp, Homo sapiens
tggctgagctgcagcgtggctt

SEQ ID NO: 8026537 - DNA, 22 bp, Homo sapiens
tggctgagctgcagcgtggctt

SEQ ID NO: 8026538 - DNA, 22 bp, Homo sapiens
tggctgagcctttggggctttc

SEQ ID NO: 8026539 - DNA, 22 bp, Homo sapiens
tggctgagcctttggggctttc

SEQ ID NO: 8026540 - DNA, 22 bp, Homo sapiens
tggctgagctccctgtgtgttg

SEQ ID NO: 8026541 - DNA, 22 bp, Homo sapiens
tggctgagctgcagcgtggctt

SEQ ID NO: 8026542 - DNA, 22 bp, Homo sapiens
tggctgagctgcagcgtggctt

SEQ ID NO: 8026543 - DNA, 22 bp, Homo sapiens
tggctgagctccctgtgtgttg

SEQ ID NO: 8026544 - DNA, 22 bp, Homo sapiens
tggctgagctccctgtgtgttg

SEQ ID NO: 8026545 - DNA, 22 bp, Homo sapiens
tggctgaggtctggggcttctg

SEQ ID NO: 8026546 - DNA, 22 bp, Homo sapiens
tggctgagggcactatgaagcc

SEQ ID NO: 8026547 - DNA, 22 bp, Homo sapiens
tggctgagggcactatgaagcc

SEQ ID NO: 8026548 - DNA, 22 bp, Homo sapiens
tggctgagggcactatgaagcc

SEQ ID NO: 8026549 - DNA, 22 bp, Homo sapiens
tggctgaggttatgctggttgt

SEQ ID NO: 8026550 - DNA, 22 bp, Homo sapiens
tggctgaggttatgctggttgt

SEQ ID NO: 8026551 - DNA, 22 bp, Homo sapiens
tggctgaggttatgctggttgt

SEQ ID NO: 8026552 - DNA, 22 bp, Homo sapiens
tggctgaggttatgctggttgt

SEQ ID NO: 8026553 - DNA, 22 bp, Homo sapiens
tggctgaggtctggggcttctg

SEQ ID NO: 8026554 - DNA, 22 bp, Homo sapiens
tggctgaggttatgctggttgt

SEQ ID NO: 8026555 - DNA, 22 bp, Homo sapiens
tggctgagtaagttgtgatatg

SEQ ID NO: 8026556 - DNA, 22 bp, Homo sapiens
tggctgaggttatgctggttgt

SEQ ID NO: 8026557 - DNA, 22 bp, Homo sapiens
tggctgaggttatgctggttgt

SEQ ID NO: 8026558 - DNA, 22 bp, Homo sapiens
tggctgagtgaacatgtccatt

SEQ ID NO: 8026559 - DNA, 22 bp, Homo sapiens
tggctgagtaagttgtgatatg

SEQ ID NO: 8026560 - DNA, 22 bp, Homo sapiens
tggctgagtaagttgtgatatg

SEQ ID NO: 8026561 - DNA, 22 bp, Homo sapiens
tggctgagtaagttgtgatatg

SEQ ID NO: 8026562 - DNA, 22 bp, Homo sapiens
tggctgaggctggagtgcagtg

SEQ ID NO: 8026563 - DNA, 22 bp, Homo sapiens
tggctgaggctggagtgcagtg

SEQ ID NO: 8026564 - DNA, 22 bp, Homo sapiens
tggctgaggctggagtgcagtg

SEQ ID NO: 8026565 - DNA, 22 bp, Homo sapiens
tggctgaggctggagtgcagtg

SEQ ID NO: 8026566 - DNA, 22 bp, Homo sapiens
tggctgaggctggagtgcagtg

SEQ ID NO: 8026567 - DNA, 22 bp, Homo sapiens
tggctgaggctggagtgcagtg

SEQ ID NO: 8026568 - DNA, 22 bp, Homo sapiens
tggctgaggcacagctgccgcc

SEQ ID NO: 8026569 - DNA, 22 bp, Homo sapiens
tggctgaggctggagtgcagtg

SEQ ID NO: 8026570 - DNA, 22 bp, Homo sapiens
tggctgaggctggagtgcagtg

SEQ ID NO: 8026571 - DNA, 22 bp, Homo sapiens
tggctgaggctggagtgcagtg

SEQ ID NO: 8026572 - DNA, 22 bp, Homo sapiens
tggctgaggcttttcttaaaga

SEQ ID NO: 8026573 - DNA, 22 bp, Homo sapiens
tggctgagggcactatgaagcc

SEQ ID NO: 8026574 - DNA, 22 bp, Homo sapiens
tggctgagggcactatgaagcc

SEQ ID NO: 8026575 - DNA, 22 bp, Homo sapiens
tggctgaggcttttcttaaaga

SEQ ID NO: 8026576 - DNA, 22 bp, Homo sapiens
tggctgaggcttttcttaaaga

SEQ ID NO: 8026577 - DNA, 22 bp, Homo sapiens
tggctgaggcttttcttaaaga

SEQ ID NO: 8026578 - DNA, 22 bp, Homo sapiens
tggctgagtttcatgcatcatg

SEQ ID NO: 8026579 - DNA, 22 bp, Homo sapiens
tggctgagtttcatgcatcatg

SEQ ID NO: 8026580 - DNA, 22 bp, Homo sapiens
tggctgagtttcatgcatcatg

SEQ ID NO: 8026581 - DNA, 22 bp, Homo sapiens
tggctgagtttcatgcatcatg

SEQ ID NO: 8026582 - DNA, 22 bp, Homo sapiens
tggctgagttctccaggagtag

SEQ ID NO: 8026583 - DNA, 22 bp, Homo sapiens
tggctgagttctccaggagtag

SEQ ID NO: 8026584 - DNA, 22 bp, Homo sapiens
tggctgagttctccaggagtag

SEQ ID NO: 8026585 - DNA, 22 bp, Homo sapiens
tggctgagttctccaggagtag

SEQ ID NO: 8026586 - DNA, 20 bp, Homo sapiens
tggctgcacaccaggacagg

SEQ ID NO: 8026587 - DNA, 22 bp, Homo sapiens
tggctgattgatttcctatgta

SEQ ID NO: 8026588 - DNA, 21 bp, Homo sapiens
tggctgcaagcagctgcctcc

SEQ ID NO: 8026589 - DNA, 21 bp, Homo sapiens
tggctgcaagcagctgcctcc

SEQ ID NO: 8026590 - DNA, 22 bp, Homo sapiens
tggctgattggtaccatcttca

SEQ ID NO: 8026591 - DNA, 22 bp, Homo sapiens
tggctgcagatcaagggcaggc

SEQ ID NO: 8026592 - DNA, 22 bp, Homo sapiens
tggctgcagatcaagggcaggc

SEQ ID NO: 8026593 - DNA, 22 bp, Homo sapiens
tggctgcagatcaagggcaggc

SEQ ID NO: 8026594 - DNA, 22 bp, Homo sapiens
tggctgcagatcaagggcaggc

SEQ ID NO: 8026595 - DNA, 22 bp, Homo sapiens
tggctgcagatcaagggcaggc

SEQ ID NO: 8026596 - DNA, 22 bp, Homo sapiens
tggctgcacttcaacacatcct

SEQ ID NO: 8026597 - DNA, 22 bp, Homo sapiens
tggctgcagaacctcctcagga

SEQ ID NO: 8026598 - DNA, 22 bp, Homo sapiens
tggctgcagacacctatggcag

SEQ ID NO: 8026599 - DNA, 20 bp, Homo sapiens
tggctgcacaccaggacagg

SEQ ID NO: 8026600 - DNA, 20 bp, Homo sapiens
tggctgcacaccaggacagg

SEQ ID NO: 8026601 - DNA, 21 bp, Homo sapiens
tggctgcactgtggctttcat

SEQ ID NO: 8026602 - DNA, 21 bp, Homo sapiens
tggctgagtggatgcatgaat

SEQ ID NO: 8026603 - DNA, 22 bp, Homo sapiens
tggctgagtgaacatgtccatt

SEQ ID NO: 8026604 - DNA, 22 bp, Homo sapiens
tggctgagtgatatttgcaaag

SEQ ID NO: 8026605 - DNA, 22 bp, Homo sapiens
tggctgagtgatatttgcaaag

SEQ ID NO: 8026606 - DNA, 22 bp, Homo sapiens
tggctgagtgatatttgcaaag

SEQ ID NO: 8026607 - DNA, 22 bp, Homo sapiens
tggctgagtgaacatgtccatt

SEQ ID NO: 8026608 - DNA, 22 bp, Homo sapiens
tggctgagtgatatttgcaaag

SEQ ID NO: 8026609 - DNA, 22 bp, Homo sapiens
tggctgagtgaacatgtccatt

SEQ ID NO: 8026610 - DNA, 22 bp, Homo sapiens
tggctgagtgttccaaggagca

SEQ ID NO: 8026611 - DNA, 21 bp, Homo sapiens
tggctgagtggatgcatgaat

SEQ ID NO: 8026612 - DNA, 21 bp, Homo sapiens
tggctgagtggatgcatgaat

SEQ ID NO: 8026613 - DNA, 21 bp, Homo sapiens
tggctgagtggatgcatgaat

SEQ ID NO: 8026614 - DNA, 22 bp, Homo sapiens
tggctgagtgttccaaggagca

SEQ ID NO: 8026615 - DNA, 22 bp, Homo sapiens
tggctgagtgttccaaggagca

SEQ ID NO: 8026616 - DNA, 22 bp, Homo sapiens
tggctgagtgttccaaggagca

SEQ ID NO: 8026617 - DNA, 22 bp, Homo sapiens
tggctgagtgttccaaggagca

SEQ ID NO: 8026618 - DNA, 22 bp, Homo sapiens
tggctgagtgttccaaggagca

SEQ ID NO: 8026619 - DNA, 22 bp, Homo sapiens
tggctgagtgttccaaggagca

SEQ ID NO: 8026620 - DNA, 22 bp, Homo sapiens
tggctgagttctccaggagtag

SEQ ID NO: 8026621 - DNA, 22 bp, Homo sapiens
tggctgagttctccaggagtag

SEQ ID NO: 8026622 - DNA, 22 bp, Homo sapiens
tggctgagttctccaggagtag

SEQ ID NO: 8026623 - DNA, 22 bp, Homo sapiens
tggctgagttctccaggagtag

SEQ ID NO: 8026624 - DNA, 22 bp, Homo sapiens
tggctgagttctccaggagtag

SEQ ID NO: 8026625 - DNA, 22 bp, Homo sapiens
tggctgagttcctggcacacgg

SEQ ID NO: 8026626 - DNA, 22 bp, Homo sapiens
tggctgagttcctggcacacgg

SEQ ID NO: 8026627 - DNA, 22 bp, Homo sapiens
tggctgagttcctggcacacgg

SEQ ID NO: 8026628 - DNA, 22 bp, Homo sapiens
tggctgagttacgaacagagca

SEQ ID NO: 8026629 - DNA, 22 bp, Homo sapiens
tggctgagttacgaacagagca

SEQ ID NO: 8026630 - DNA, 22 bp, Homo sapiens
tggctgagttcctggcacacgg

SEQ ID NO: 8026631 - DNA, 22 bp, Homo sapiens
tggctgagttacgaacagagca

SEQ ID NO: 8026632 - DNA, 22 bp, Homo sapiens
tggctgagttacgaacagagca

SEQ ID NO: 8026633 - DNA, 22 bp, Homo sapiens
tggctgagttacgaacagagca

SEQ ID NO: 8026634 - DNA, 22 bp, Homo sapiens
tggctgcagatctgtgggacac

SEQ ID NO: 8026635 - DNA, 22 bp, Homo sapiens
tggctgcagtgcttgagatgtc

SEQ ID NO: 8026636 - DNA, 22 bp, Homo sapiens
tggctgcagtgcttgagatgtc

SEQ ID NO: 8026637 - DNA, 22 bp, Homo sapiens
tggctgcagttcacaggagcaa

SEQ ID NO: 8026638 - DNA, 22 bp, Homo sapiens
tggctgcagttcacaggagcaa

SEQ ID NO: 8026639 - DNA, 22 bp, Homo sapiens
tggctgcagtgcttgagatgtc

SEQ ID NO: 8026640 - DNA, 22 bp, Homo sapiens
tggctgccagctcctcgccttg

SEQ ID NO: 8026641 - DNA, 22 bp, Homo sapiens
tggctgccaatggcttggaaag

SEQ ID NO: 8026642 - DNA, 22 bp, Homo sapiens
tggctgccaagcaggtcagaga

SEQ ID NO: 8026643 - DNA, 22 bp, Homo sapiens
tggctgcagttcacaggagcaa

SEQ ID NO: 8026644 - DNA, 22 bp, Homo sapiens
tggctgcagttcacaggagcaa

SEQ ID NO: 8026645 - DNA, 22 bp, Homo sapiens
tggctgccccctcccgtggaca

SEQ ID NO: 8026646 - DNA, 22 bp, Homo sapiens
tggctgccatgacgcctgggga

SEQ ID NO: 8026647 - DNA, 22 bp, Homo sapiens
tggctgccccctcccgtggaca

SEQ ID NO: 8026648 - DNA, 22 bp, Homo sapiens
tggctgccccctcccgtggaca

SEQ ID NO: 8026649 - DNA, 20 bp, Homo sapiens
tggctgcccgaggcacacac

SEQ ID NO: 8026650 - DNA, 22 bp, Homo sapiens
tggctgccagctcctcgccttg

SEQ ID NO: 8026651 - DNA, 22 bp, Homo sapiens
tggctgccatgacgcctgggga

SEQ ID NO: 8026652 - DNA, 22 bp, Homo sapiens
tggctgccatgacgcctgggga

SEQ ID NO: 8026653 - DNA, 22 bp, Homo sapiens
tggctgccatgacgcctgggga

SEQ ID NO: 8026654 - DNA, 22 bp, Homo sapiens
tggctgccatgacgcctgggga

SEQ ID NO: 8026655 - DNA, 22 bp, Homo sapiens
tggctgctctcttccccagggt

SEQ ID NO: 8026656 - DNA, 22 bp, Homo sapiens
tggctgctgagaaggcagctgt

SEQ ID NO: 8026657 - DNA, 22 bp, Homo sapiens
tggctgctcaagggaggaggct

SEQ ID NO: 8026658 - DNA, 20 bp, Homo sapiens
tggctgcccgaggcacacac

SEQ ID NO: 8026659 - DNA, 22 bp, Homo sapiens
tggctgctgagaaggcagctgt

SEQ ID NO: 8026660 - DNA, 22 bp, Homo sapiens
tggctgctgagaaggcagctgt

SEQ ID NO: 8026661 - DNA, 22 bp, Homo sapiens
tggctgctgagaaggcagctgt

SEQ ID NO: 8026662 - DNA, 22 bp, Homo sapiens
tggctgctgagaaggcagctgt

SEQ ID NO: 8026663 - DNA, 22 bp, Homo sapiens
tggctgctgagaaggcagctgt

SEQ ID NO: 8026664 - DNA, 22 bp, Homo sapiens
tggctgctctcttccccagggt

SEQ ID NO: 8026665 - DNA, 22 bp, Homo sapiens
tggctggaagtcagaaatggga

SEQ ID NO: 8026666 - DNA, 22 bp, Homo sapiens
tggctggaagtcagaaatggga

SEQ ID NO: 8026667 - DNA, 22 bp, Homo sapiens
tggctggaagtcagaaatggga

SEQ ID NO: 8026668 - DNA, 22 bp, Homo sapiens
tggctggaagtcagaaatggga

SEQ ID NO: 8026669 - DNA, 22 bp, Homo sapiens
tggctggaaacaggagattcag

SEQ ID NO: 8026670 - DNA, 22 bp, Homo sapiens
tggctggaatatgtggagacca

SEQ ID NO: 8026671 - DNA, 22 bp, Homo sapiens
tggctggaatatgtggagacca

SEQ ID NO: 8026672 - DNA, 22 bp, Homo sapiens
tggctggaatatgtggagacca

SEQ ID NO: 8026673 - DNA, 22 bp, Homo sapiens
tggctggaatatgtggagacca

SEQ ID NO: 8026674 - DNA, 22 bp, Homo sapiens
tggctggaatggagctgagcct

SEQ ID NO: 8026675 - DNA, 22 bp, Homo sapiens
tggctggaaacaggagattcag

SEQ ID NO: 8026676 - DNA, 22 bp, Homo sapiens
tggctggaaacaggagattcag

SEQ ID NO: 8026677 - DNA, 22 bp, Homo sapiens
tggctgcttgttttagtgaggc

SEQ ID NO: 8026678 - DNA, 18 bp, Homo sapiens
tggctgcttccaggtaca

SEQ ID NO: 8026679 - DNA, 18 bp, Homo sapiens
tggctgcttccaggtaca

SEQ ID NO: 8026680 - DNA, 18 bp, Homo sapiens
tggctgcttccaggtaca

SEQ ID NO: 8026681 - DNA, 22 bp, Homo sapiens
tggctgctgtgggtagagggat

SEQ ID NO: 8026682 - DNA, 22 bp, Homo sapiens
tggctgcttaaaattgctgcaa

SEQ ID NO: 8026683 - DNA, 22 bp, Homo sapiens
tggctgctgcagacagacagga

SEQ ID NO: 8026684 - DNA, 22 bp, Homo sapiens
tggctgctgcagacagacagga

SEQ ID NO: 8026685 - DNA, 22 bp, Homo sapiens
tggctgctgctcactcagcctc

SEQ ID NO: 8026686 - DNA, 22 bp, Homo sapiens
tggctgctgcttggtcttcttc

SEQ ID NO: 8026687 - DNA, 22 bp, Homo sapiens
tggctgctgctcactcagcctc

SEQ ID NO: 8026688 - DNA, 22 bp, Homo sapiens
tggctgctgctcactcagcctc

SEQ ID NO: 8026689 - DNA, 21 bp, Homo sapiens
tggctgctggccctctctcca

SEQ ID NO: 8026690 - DNA, 21 bp, Homo sapiens
tggctgctggccctctctcca

SEQ ID NO: 8026691 - DNA, 21 bp, Homo sapiens
tggctgctggccctctctcca

SEQ ID NO: 8026692 - DNA, 21 bp, Homo sapiens
tggctgctggccctctctcca

SEQ ID NO: 8026693 - DNA, 22 bp, Homo sapiens
tggctgctgtgggtagagggat

SEQ ID NO: 8026694 - DNA, 21 bp, Homo sapiens
tggctgctggccctctctcca

SEQ ID NO: 8026695 - DNA, 22 bp, Homo sapiens
tggctgctgcttggtcttcttc

SEQ ID NO: 8026696 - DNA, 22 bp, Homo sapiens
tggctgctgctcactcagcctc

SEQ ID NO: 8026697 - DNA, 22 bp, Homo sapiens
tggctgctgcttggtcttcttc

SEQ ID NO: 8026698 - DNA, 18 bp, Homo sapiens
tggctgctggagtagggt

SEQ ID NO: 8026699 - DNA, 22 bp, Homo sapiens
tggctattgagtgatctctaga

SEQ ID NO: 8026700 - DNA, 22 bp, Homo sapiens
tggctattgtgccaaatgaaca

SEQ ID NO: 8026701 - DNA, 22 bp, Homo sapiens
tggctaacaaacaagacattag

SEQ ID NO: 8026702 - DNA, 22 bp, Homo sapiens
tggctatgacttcgtactgtct

SEQ ID NO: 8026703 - DNA, 22 bp, Homo sapiens
tggctatgaagtcttcacatga

SEQ ID NO: 8026704 - DNA, 22 bp, Homo sapiens
tggctatactctcagttaatac

SEQ ID NO: 8026705 - DNA, 22 bp, Homo sapiens
tggctatgcaaacctgaggctg

SEQ ID NO: 8026706 - DNA, 22 bp, Homo sapiens
tggctcaccttcagaatatacc

SEQ ID NO: 8026707 - DNA, 22 bp, Homo sapiens
tggctcactgtagccttgacct

SEQ ID NO: 8026708 - DNA, 22 bp, Homo sapiens
tggctcaagtaacaaaaatata

SEQ ID NO: 8026709 - DNA, 22 bp, Homo sapiens
tggctatttacaaggtaggtga

SEQ ID NO: 8026710 - DNA, 22 bp, Homo sapiens
tggctcacaatctcccatgaag

SEQ ID NO: 8026711 - DNA, 22 bp, Homo sapiens
tggctcacttccgtggagaggt

SEQ ID NO: 8026712 - DNA, 22 bp, Homo sapiens
tggctcacttccgtggagaggt

SEQ ID NO: 8026713 - DNA, 22 bp, Homo sapiens
tggctcacttccgtggagaggt

SEQ ID NO: 8026714 - DNA, 22 bp, Homo sapiens
tggctcacttccgtggagaggt

SEQ ID NO: 8026715 - DNA, 22 bp, Homo sapiens
tggctcagaactacttctagtt

SEQ ID NO: 8026716 - DNA, 22 bp, Homo sapiens
tggctcacttccgtggagaggt

SEQ ID NO: 8026717 - DNA, 22 bp, Homo sapiens
tggctcagaactacttctagtt

SEQ ID NO: 8026718 - DNA, 22 bp, Homo sapiens
tggctcagaactacttctagtt

SEQ ID NO: 8026719 - DNA, 22 bp, Homo sapiens
tggctcagaactacttctagtt

SEQ ID NO: 8026720 - DNA, 22 bp, Homo sapiens
tggctcagaactacttctagtt

SEQ ID NO: 8026721 - DNA, 22 bp, Homo sapiens
tggctcagaactacttctagtt

SEQ ID NO: 8026722 - DNA, 22 bp, Homo sapiens
tggctcagaactacttctagtt

SEQ ID NO: 8026723 - DNA, 22 bp, Homo sapiens
tggctcagaactacttctagtt

SEQ ID NO: 8026724 - DNA, 22 bp, Homo sapiens
tggctcagaagaaaaggtaaac

SEQ ID NO: 8026725 - DNA, 22 bp, Homo sapiens
tggctcagaagaaaaggtaaac

SEQ ID NO: 8026726 - DNA, 22 bp, Homo sapiens
tggctcagaagaaaaggtaaac

SEQ ID NO: 8026727 - DNA, 21 bp, Homo sapiens
tggcggggacttgtggctgcc

SEQ ID NO: 8026728 - DNA, 20 bp, Homo sapiens
tggcggggatgagggagtta

SEQ ID NO: 8026729 - DNA, 21 bp, Homo sapiens
tggcggggacttgtggctgcc

SEQ ID NO: 8026730 - DNA, 21 bp, Homo sapiens
tggcggggacttgtggctgcc

SEQ ID NO: 8026731 - DNA, 22 bp, Homo sapiens
tggcggagttccagctgggatc

SEQ ID NO: 8026732 - DNA, 22 bp, Homo sapiens
tggcgcgacgtgccccctgctt

SEQ ID NO: 8026733 - DNA, 22 bp, Homo sapiens
tggcgcgacgtgccccctgctt

SEQ ID NO: 8026734 - DNA, 21 bp, Homo sapiens
tggcgccgtcttgggactggc

SEQ ID NO: 8026735 - DNA, 22 bp, Homo sapiens
tggcgcgacgtgccccctgctt

SEQ ID NO: 8026736 - DNA, 22 bp, Homo sapiens
tggcgcagtttctctgctgcct

SEQ ID NO: 8026737 - DNA, 22 bp, Homo sapiens
tggcggagttccagctgggatc

SEQ ID NO: 8026738 - DNA, 22 bp, Homo sapiens
tggcggagttccagctgggatc

SEQ ID NO: 8026739 - DNA, 22 bp, Homo sapiens
tggcggagttccagctgggatc

SEQ ID NO: 8026740 - DNA, 20 bp, Homo sapiens
tggcggggatgagggagtta

SEQ ID NO: 8026741 - DNA, 20 bp, Homo sapiens
tggcggggatgagggagtta

SEQ ID NO: 8026742 - DNA, 20 bp, Homo sapiens
tggcggggatgagggagtta

SEQ ID NO: 8026743 - DNA, 22 bp, Homo sapiens
tggcggggcagctctggcttct

SEQ ID NO: 8026744 - DNA, 22 bp, Homo sapiens
tggcgtctctcataagtatgtg

SEQ ID NO: 8026745 - DNA, 22 bp, Homo sapiens
tggcgtctctcataagtatgtg

SEQ ID NO: 8026746 - DNA, 23 bp, Homo sapiens
tggctaaaggctctagtcctgct

SEQ ID NO: 8026747 - DNA, 22 bp, Homo sapiens
tggctaacaaggtgaaaccccg

SEQ ID NO: 8026748 - DNA, 22 bp, Homo sapiens
tggctaacaaggtgaaaccccg

SEQ ID NO: 8026749 - DNA, 22 bp, Homo sapiens
tggctagtccgttagaggcgtg

SEQ ID NO: 8026750 - DNA, 22 bp, Homo sapiens
tggctagtccgttagaggcgtg

SEQ ID NO: 8026751 - DNA, 23 bp, Homo sapiens
tggctaaacagtggagaaagctt

SEQ ID NO: 8026752 - DNA, 23 bp, Homo sapiens
tggctaaacagtggagaaagctt

SEQ ID NO: 8026753 - DNA, 22 bp, Homo sapiens
tggctcagagcagggactctgg

SEQ ID NO: 8026754 - DNA, 22 bp, Homo sapiens
tggctcagagccttgagagctg

SEQ ID NO: 8026755 - DNA, 22 bp, Homo sapiens
tggctcagagcagggactctgg

SEQ ID NO: 8026756 - DNA, 22 bp, Homo sapiens
tggctcagagcagggactctgg

SEQ ID NO: 8026757 - DNA, 22 bp, Homo sapiens
tggctcagagcagggactctgg

SEQ ID NO: 8026758 - DNA, 22 bp, Homo sapiens
tggctcagagccttgagagctg

SEQ ID NO: 8026759 - DNA, 22 bp, Homo sapiens
tggctcagagccttgagagctg

SEQ ID NO: 8026760 - DNA, 22 bp, Homo sapiens
tggctcagagccttgagagctg

SEQ ID NO: 8026761 - DNA, 22 bp, Homo sapiens
tggctcagagccttgagagctg

SEQ ID NO: 8026762 - DNA, 22 bp, Homo sapiens
tggctcagaggggaagtggttt

SEQ ID NO: 8026763 - DNA, 22 bp, Homo sapiens
tggctcagagccttgagagctg

SEQ ID NO: 8026764 - DNA, 22 bp, Homo sapiens
tggctcagagccttgagagctg

SEQ ID NO: 8026765 - DNA, 22 bp, Homo sapiens
tggctcagagccttgagagctg

SEQ ID NO: 8026766 - DNA, 22 bp, Homo sapiens
tggctcagaaggctgccttcac

SEQ ID NO: 8026767 - DNA, 22 bp, Homo sapiens
tggctcagaaggctgccttcac

SEQ ID NO: 8026768 - DNA, 22 bp, Homo sapiens
tggctcagaaggctgccttcac

SEQ ID NO: 8026769 - DNA, 22 bp, Homo sapiens
tggctcagaaggctgccttcac

SEQ ID NO: 8026770 - DNA, 22 bp, Homo sapiens
tggctcagaagaaaaggtaaac

SEQ ID NO: 8026771 - DNA, 22 bp, Homo sapiens
tggctcagaaggctgccttcac

SEQ ID NO: 8026772 - DNA, 22 bp, Homo sapiens
tggctcagaagaaaaggtaaac

SEQ ID NO: 8026773 - DNA, 22 bp, Homo sapiens
tggctcagaaggctgccttcac

SEQ ID NO: 8026774 - DNA, 22 bp, Homo sapiens
tggctcagaaggctgccttcac

SEQ ID NO: 8026775 - DNA, 22 bp, Homo sapiens
tggctcagaaggctgccttcac

SEQ ID NO: 8026776 - DNA, 22 bp, Homo sapiens
tggctcagaaggctgccttcac

SEQ ID NO: 8026777 - DNA, 22 bp, Homo sapiens
tggctcagaaggctgccttcac

SEQ ID NO: 8026778 - DNA, 22 bp, Homo sapiens
tggctcagagagggagtgtgga

SEQ ID NO: 8026779 - DNA, 22 bp, Homo sapiens
tggctcagaaggctgccttcac

SEQ ID NO: 8026780 - DNA, 22 bp, Homo sapiens
tggctcagagagggagtgtgga

SEQ ID NO: 8026781 - DNA, 22 bp, Homo sapiens
tggctcagagagggagtgtgga

SEQ ID NO: 8026782 - DNA, 22 bp, Homo sapiens
tggctcagagagggagtgtgga

SEQ ID NO: 8026783 - DNA, 22 bp, Homo sapiens
tggctcagagagggagtgtgga

SEQ ID NO: 8026784 - DNA, 22 bp, Homo sapiens
tggctcagatttttgtaggctt

SEQ ID NO: 8026785 - DNA, 22 bp, Homo sapiens
tggctcagatttttgtaggctt

SEQ ID NO: 8026786 - DNA, 18 bp, Homo sapiens
tggctcagatggctttaa

SEQ ID NO: 8026787 - DNA, 22 bp, Homo sapiens
tggctcagatttttgtaggctt

SEQ ID NO: 8026788 - DNA, 18 bp, Homo sapiens
tggctcagatggctttaa

SEQ ID NO: 8026789 - DNA, 22 bp, Homo sapiens
tggctcagatttttgtaggctt

SEQ ID NO: 8026790 - DNA, 18 bp, Homo sapiens
tggctcagatggctttaa

SEQ ID NO: 8026791 - DNA, 22 bp, Homo sapiens
tggctcagatgctcttccagtg

SEQ ID NO: 8026792 - DNA, 22 bp, Homo sapiens
tggctcagatgctcttccagtg

SEQ ID NO: 8026793 - DNA, 22 bp, Homo sapiens
tggctcagatgctcttccagtg

SEQ ID NO: 8026794 - DNA, 22 bp, Homo sapiens
tggctcagatgctcttccagtg

SEQ ID NO: 8026795 - DNA, 22 bp, Homo sapiens
tggctcagatgctcttccagtg

SEQ ID NO: 8026796 - DNA, 22 bp, Homo sapiens
tggctcagatgctcttccagtg

SEQ ID NO: 8026797 - DNA, 18 bp, Homo sapiens
tggctcagatggctttaa

SEQ ID NO: 8026798 - DNA, 22 bp, Homo sapiens
tggctcagatgctcttccagtg

SEQ ID NO: 8026799 - DNA, 22 bp, Homo sapiens
tggctcagatgctcttccagtg

SEQ ID NO: 8026800 - DNA, 22 bp, Homo sapiens
tggctcagataattcaaggggc

SEQ ID NO: 8026801 - DNA, 22 bp, Homo sapiens
tggctcagataattcaaggggc

SEQ ID NO: 8026802 - DNA, 22 bp, Homo sapiens
tggctcagagttcatcttttag

SEQ ID NO: 8026803 - DNA, 22 bp, Homo sapiens
tggctcagataattcaaggggc

SEQ ID NO: 8026804 - DNA, 22 bp, Homo sapiens
tggctcagataattcaaggggc

SEQ ID NO: 8026805 - DNA, 22 bp, Homo sapiens
tggctcagataattcaaggggc

SEQ ID NO: 8026806 - DNA, 22 bp, Homo sapiens
tggctcagataattcaaggggc

SEQ ID NO: 8026807 - DNA, 22 bp, Homo sapiens
tggctcagatgctcttccagtg

SEQ ID NO: 8026808 - DNA, 22 bp, Homo sapiens
tggctcagagttcatcttttag

SEQ ID NO: 8026809 - DNA, 22 bp, Homo sapiens
tggctcagagttcatcttttag

SEQ ID NO: 8026810 - DNA, 22 bp, Homo sapiens
tggctcagataattcaaggggc

SEQ ID NO: 8026811 - DNA, 22 bp, Homo sapiens
tggctcagagttcatcttttag

SEQ ID NO: 8026812 - DNA, 22 bp, Homo sapiens
tggctcagaggggaagtggttt

SEQ ID NO: 8026813 - DNA, 22 bp, Homo sapiens
tggctcagaggggaagtggttt

SEQ ID NO: 8026814 - DNA, 22 bp, Homo sapiens
tggctcagaggggaagtggttt

SEQ ID NO: 8026815 - DNA, 22 bp, Homo sapiens
tggcctggttgttgctgccgtt

SEQ ID NO: 8026816 - DNA, 22 bp, Homo sapiens
tggcctgtcactgcccagggct

SEQ ID NO: 8026817 - DNA, 22 bp, Homo sapiens
tggcctggttgttgctgccgtt

SEQ ID NO: 8026818 - DNA, 22 bp, Homo sapiens
tggcctggttgttgctgccgtt

SEQ ID NO: 8026819 - DNA, 22 bp, Homo sapiens
tggcctggttgttgctgccgtt

SEQ ID NO: 8026820 - DNA, 22 bp, Homo sapiens
tggcctggttgttgctgccgtt

SEQ ID NO: 8026821 - DNA, 22 bp, Homo sapiens
tggcctggttgttgctgccgtt

SEQ ID NO: 8026822 - DNA, 22 bp, Homo sapiens
tggcctggtgtctgcgaggcct

SEQ ID NO: 8026823 - DNA, 22 bp, Homo sapiens
tggcctggtgtctgcgaggcct

SEQ ID NO: 8026824 - DNA, 22 bp, Homo sapiens
tggcctggttatattgctatca

SEQ ID NO: 8026825 - DNA, 22 bp, Homo sapiens
tggcctggtgtctgcgaggcct

SEQ ID NO: 8026826 - DNA, 22 bp, Homo sapiens
tggcctggtgtctgcgaggcct

SEQ ID NO: 8026827 - DNA, 22 bp, Homo sapiens
tggcctggtgtctgcgaggcct

SEQ ID NO: 8026828 - DNA, 22 bp, Homo sapiens
tggcctggtgctcaggcagtag

SEQ ID NO: 8026829 - DNA, 22 bp, Homo sapiens
tggcctggtgtctgcgaggcct

SEQ ID NO: 8026830 - DNA, 22 bp, Homo sapiens
tggcctggtgtctgcgaggcct

SEQ ID NO: 8026831 - DNA, 22 bp, Homo sapiens
tggcctggtgtctgcgaggcct

SEQ ID NO: 8026832 - DNA, 22 bp, Homo sapiens
tggcctggtgtctgcgaggcct

SEQ ID NO: 8026833 - DNA, 22 bp, Homo sapiens
tggcctggtgtctgcgaggcct

SEQ ID NO: 8026834 - DNA, 22 bp, Homo sapiens
tggcctggtccttgtcaaggca

SEQ ID NO: 8026835 - DNA, 22 bp, Homo sapiens
tggcctggtccttgtcaaggca

SEQ ID NO: 8026836 - DNA, 22 bp, Homo sapiens
tggcctggtccttgtcaaggca

SEQ ID NO: 8026837 - DNA, 22 bp, Homo sapiens
tggcctggtgctcaggcagtag

SEQ ID NO: 8026838 - DNA, 22 bp, Homo sapiens
tggcctggtgctcaggcagtag

SEQ ID NO: 8026839 - DNA, 22 bp, Homo sapiens
tggcctggccctgaggccctgt

SEQ ID NO: 8026840 - DNA, 22 bp, Homo sapiens
tggcctggccctgaggccctgt

SEQ ID NO: 8026841 - DNA, 22 bp, Homo sapiens
tggcctggccctgaggccctgt

SEQ ID NO: 8026842 - DNA, 22 bp, Homo sapiens
tggcctggctcacagtgagatt

SEQ ID NO: 8026843 - DNA, 22 bp, Homo sapiens
tggcctggctcacagtgagatt

SEQ ID NO: 8026844 - DNA, 22 bp, Homo sapiens
tggcctggctcacagtgagatt

SEQ ID NO: 8026845 - DNA, 22 bp, Homo sapiens
tggcctggctcacagtgagatt

SEQ ID NO: 8026846 - DNA, 22 bp, Homo sapiens
tggcctggctcacagtgagatt

SEQ ID NO: 8026847 - DNA, 22 bp, Homo sapiens
tggcctggctcacagtgagatt

SEQ ID NO: 8026848 - DNA, 22 bp, Homo sapiens
tggcctgggtcacaccagggtc

SEQ ID NO: 8026849 - DNA, 22 bp, Homo sapiens
tggcctgggtcacaccagggtc

SEQ ID NO: 8026850 - DNA, 22 bp, Homo sapiens
tggcctgggtcacaccagggtc

SEQ ID NO: 8026851 - DNA, 22 bp, Homo sapiens
tggcctgggtgctgctgacatc

SEQ ID NO: 8026852 - DNA, 22 bp, Homo sapiens
tggcctggtaccacatagattt

SEQ ID NO: 8026853 - DNA, 22 bp, Homo sapiens
tggcctggtaccacatagattt

SEQ ID NO: 8026854 - DNA, 22 bp, Homo sapiens
tggcctgggtgctgctgacatc

SEQ ID NO: 8026855 - DNA, 22 bp, Homo sapiens
tggcctggtccttgtcaaggca

SEQ ID NO: 8026856 - DNA, 22 bp, Homo sapiens
tggcctggtccttgtcaaggca

SEQ ID NO: 8026857 - DNA, 22 bp, Homo sapiens
tggcctggtccttgtcaaggca

SEQ ID NO: 8026858 - DNA, 22 bp, Homo sapiens
tggcctggtccttgtcaaggca

SEQ ID NO: 8026859 - DNA, 22 bp, Homo sapiens
tggcctgggtgctgctgacatc

SEQ ID NO: 8026860 - DNA, 22 bp, Homo sapiens
tggcctggtaccacatagattt

SEQ ID NO: 8026861 - DNA, 22 bp, Homo sapiens
tggcctgggtgctgctgacatc

SEQ ID NO: 8026862 - DNA, 22 bp, Homo sapiens
tggcctgggtgctgctgacatc

SEQ ID NO: 8026863 - DNA, 22 bp, Homo sapiens
tggcctgggtgctgctgacatc

SEQ ID NO: 8026864 - DNA, 22 bp, Homo sapiens
tggcgagccccgactgagtgtt

SEQ ID NO: 8026865 - DNA, 22 bp, Homo sapiens
tggcgaagctgaacataggcta

SEQ ID NO: 8026866 - DNA, 22 bp, Homo sapiens
tggcgagctttgttctccagga

SEQ ID NO: 8026867 - DNA, 22 bp, Homo sapiens
tggcgaggccaggccagggcct

SEQ ID NO: 8026868 - DNA, 20 bp, Homo sapiens
tggcctttaaatagtattcc

SEQ ID NO: 8026869 - DNA, 20 bp, Homo sapiens
tggccttttggcttggagct

SEQ ID NO: 8026870 - DNA, 22 bp, Homo sapiens
tggcgcagtttctctgctgcct

SEQ ID NO: 8026871 - DNA, 22 bp, Homo sapiens
tggcgcagtttctctgctgcct

SEQ ID NO: 8026872 - DNA, 18 bp, Homo sapiens
tggcgatggtcatttttc

SEQ ID NO: 8026873 - DNA, 22 bp, Homo sapiens
tggcgaggccaggccagggcct

SEQ ID NO: 8026874 - DNA, 22 bp, Homo sapiens
tggcgaggtttcagagagcggc

SEQ ID NO: 8026875 - DNA, 22 bp, Homo sapiens
tggcgaggtttcagagagcggc

SEQ ID NO: 8026876 - DNA, 22 bp, Homo sapiens
tggcgaggtttcagagagcggc

SEQ ID NO: 8026877 - DNA, 22 bp, Homo sapiens
tggccttggcagtgagaagagt

SEQ ID NO: 8026878 - DNA, 22 bp, Homo sapiens
tggccttggccgtgctggggtc

SEQ ID NO: 8026879 - DNA, 20 bp, Homo sapiens
tggccttggggagctcacac

SEQ ID NO: 8026880 - DNA, 20 bp, Homo sapiens
tggccttggggagctcacac

SEQ ID NO: 8026881 - DNA, 22 bp, Homo sapiens
tggccttgtgtttaagcaagaa

SEQ ID NO: 8026882 - DNA, 22 bp, Homo sapiens
tggccttggtcctctttgcaat

SEQ ID NO: 8026883 - DNA, 22 bp, Homo sapiens
tggccttggagaggcacggccc

SEQ ID NO: 8026884 - DNA, 22 bp, Homo sapiens
tggccttgagatgcagcagcca

SEQ ID NO: 8026885 - DNA, 22 bp, Homo sapiens
tggcctgtggatcccagctctg

SEQ ID NO: 8026886 - DNA, 22 bp, Homo sapiens
tggcctgtggcatgacctctag

SEQ ID NO: 8026887 - DNA, 22 bp, Homo sapiens
tggcctgtgactgcctctgggc

SEQ ID NO: 8026888 - DNA, 22 bp, Homo sapiens
tggcctgtgactgcctctgggc

SEQ ID NO: 8026889 - DNA, 22 bp, Homo sapiens
tggccttcctggtgactcatga

SEQ ID NO: 8026890 - DNA, 22 bp, Homo sapiens
tggcctgttgctcctaggggtc

SEQ ID NO: 8026891 - DNA, 22 bp, Homo sapiens
tggctcctaggatggtgcctgg

SEQ ID NO: 8026892 - DNA, 22 bp, Homo sapiens
tggctcctaggatggtgcctgg

SEQ ID NO: 8026893 - DNA, 22 bp, Homo sapiens
tggctcctatcaaggagtgggt

SEQ ID NO: 8026894 - DNA, 22 bp, Homo sapiens
tggctcctaggatggtgcctgg

SEQ ID NO: 8026895 - DNA, 22 bp, Homo sapiens
tggctcctatcaaggagtgggt

SEQ ID NO: 8026896 - DNA, 22 bp, Homo sapiens
tggctcccgcagaccctgtgct

SEQ ID NO: 8026897 - DNA, 22 bp, Homo sapiens
tggctcccgcttgcacctaaga

SEQ ID NO: 8026898 - DNA, 22 bp, Homo sapiens
tggctcccgcttgcacctaaga

SEQ ID NO: 8026899 - DNA, 22 bp, Homo sapiens
tggctccgttgtacaggctgga

SEQ ID NO: 8026900 - DNA, 22 bp, Homo sapiens
tggctccgttgtacaggctgga

SEQ ID NO: 8026901 - DNA, 22 bp, Homo sapiens
tggctccggcgctctgagacag

SEQ ID NO: 8026902 - DNA, 22 bp, Homo sapiens
tggctcctaatgctgcccagac

SEQ ID NO: 8026903 - DNA, 22 bp, Homo sapiens
tggctcctaatcggcttctttc

SEQ ID NO: 8026904 - DNA, 22 bp, Homo sapiens
tggctcctaatcggcttctttc

SEQ ID NO: 8026905 - DNA, 22 bp, Homo sapiens
tggctccatcatccatgcaaga

SEQ ID NO: 8026906 - DNA, 22 bp, Homo sapiens
tggctccatcatccatgcaaga

SEQ ID NO: 8026907 - DNA, 22 bp, Homo sapiens
tggctccatcatccatgcaaga

SEQ ID NO: 8026908 - DNA, 22 bp, Homo sapiens
tggctccatcatccatgcaaga

SEQ ID NO: 8026909 - DNA, 22 bp, Homo sapiens
tggctccaggggacacgcagta

SEQ ID NO: 8026910 - DNA, 22 bp, Homo sapiens
tggctccaggggacacgcagta

SEQ ID NO: 8026911 - DNA, 22 bp, Homo sapiens
tggctccaggggacacgcagta

SEQ ID NO: 8026912 - DNA, 23 bp, Homo sapiens
tggctccaggagaagccagaagc

SEQ ID NO: 8026913 - DNA, 22 bp, Homo sapiens
tggctcccaaggagctcctgcc

SEQ ID NO: 8026914 - DNA, 22 bp, Homo sapiens
tggctcccaaggagctcctgcc

SEQ ID NO: 8026915 - DNA, 22 bp, Homo sapiens
tggctcccaaggagctcctgcc

SEQ ID NO: 8026916 - DNA, 22 bp, Homo sapiens
tggctcccacaaactcactact

SEQ ID NO: 8026917 - DNA, 22 bp, Homo sapiens
tggctcccacaaactcactact

SEQ ID NO: 8026918 - DNA, 22 bp, Homo sapiens
tggctccatgatagttcttaca

SEQ ID NO: 8026919 - DNA, 22 bp, Homo sapiens
tggctccaggggacacgcagta

SEQ ID NO: 8026920 - DNA, 20 bp, Homo sapiens
tggctcctgcggtggaacca

SEQ ID NO: 8026921 - DNA, 19 bp, Homo sapiens
tggctcctgcctgccttct

SEQ ID NO: 8026922 - DNA, 19 bp, Homo sapiens
tggctcctgcctgccttct

SEQ ID NO: 8026923 - DNA, 19 bp, Homo sapiens
tggctcctgcctgccttct

SEQ ID NO: 8026924 - DNA, 19 bp, Homo sapiens
tggctcctgcctgccttct

SEQ ID NO: 8026925 - DNA, 18 bp, Homo sapiens
tggctcctgcctcctgca

SEQ ID NO: 8026926 - DNA, 22 bp, Homo sapiens
tggctcctgcatttgtgctaac

SEQ ID NO: 8026927 - DNA, 18 bp, Homo sapiens
tggctcctgcctcctgca

SEQ ID NO: 8026928 - DNA, 20 bp, Homo sapiens
tggctcctcttggctgtggc

SEQ ID NO: 8026929 - DNA, 22 bp, Homo sapiens
tggctcctcttctgggtgtccc

SEQ ID NO: 8026930 - DNA, 20 bp, Homo sapiens
tggctcctcttggctgtggc

SEQ ID NO: 8026931 - DNA, 22 bp, Homo sapiens
tggctcctgcagaccatctgga

SEQ ID NO: 8026932 - DNA, 22 bp, Homo sapiens
tggctcctcatcacagttggtg

SEQ ID NO: 8026933 - DNA, 22 bp, Homo sapiens
tggctcctcttctgggtgtccc

SEQ ID NO: 8026934 - DNA, 22 bp, Homo sapiens
tggctcctccctgtgtgtgcgt

SEQ ID NO: 8026935 - DNA, 22 bp, Homo sapiens
tggctcctcacgtcctcagagc

SEQ ID NO: 8026936 - DNA, 22 bp, Homo sapiens
tggctcctcacgtcctcagagc

SEQ ID NO: 8026937 - DNA, 22 bp, Homo sapiens
tggctcctcacgtcctcagagc

SEQ ID NO: 8026938 - DNA, 22 bp, Homo sapiens
tggctcctcatcacagttggtg

SEQ ID NO: 8026939 - DNA, 22 bp, Homo sapiens
tggctcctatcaaggagtgggt

SEQ ID NO: 8026940 - DNA, 22 bp, Homo sapiens
tggctccagatttcctgctgca

SEQ ID NO: 8026941 - DNA, 22 bp, Homo sapiens
tggctccagatttcctgctgca

SEQ ID NO: 8026942 - DNA, 22 bp, Homo sapiens
tggctccagatttcctgctgca

SEQ ID NO: 8026943 - DNA, 22 bp, Homo sapiens
tggctccagatttcctgctgca

SEQ ID NO: 8026944 - DNA, 22 bp, Homo sapiens
tggctccagatttcctgctgca

SEQ ID NO: 8026945 - DNA, 22 bp, Homo sapiens
tggctccagatttcctgctgca

SEQ ID NO: 8026946 - DNA, 22 bp, Homo sapiens
tggctccagatttcctgctgca

SEQ ID NO: 8026947 - DNA, 22 bp, Homo sapiens
tggctccagatctgtctcctgt

SEQ ID NO: 8026948 - DNA, 22 bp, Homo sapiens
tggctccagatctgtctcctgt

SEQ ID NO: 8026949 - DNA, 22 bp, Homo sapiens
tggctccagatctgtctcctgt

SEQ ID NO: 8026950 - DNA, 22 bp, Homo sapiens
tggctccagaagggagggcgcc

SEQ ID NO: 8026951 - DNA, 22 bp, Homo sapiens
tggctccactctccaggagttt

SEQ ID NO: 8026952 - DNA, 22 bp, Homo sapiens
tggctccactactgggtgtgtt

SEQ ID NO: 8026953 - DNA, 22 bp, Homo sapiens
tggctccaccgccgcggagctc

SEQ ID NO: 8026954 - DNA, 22 bp, Homo sapiens
tggctccaccgccgcggagctc

SEQ ID NO: 8026955 - DNA, 23 bp, Homo sapiens
tggctccaggagaagccagaagc

SEQ ID NO: 8026956 - DNA, 23 bp, Homo sapiens
tggctccaggagaagccagaagc

SEQ ID NO: 8026957 - DNA, 23 bp, Homo sapiens
tggctccaggagaagccagaagc

SEQ ID NO: 8026958 - DNA, 23 bp, Homo sapiens
tggctccaggagaagccagaagc

SEQ ID NO: 8026959 - DNA, 22 bp, Homo sapiens
tggctccagcgtccacgtcctg

SEQ ID NO: 8026960 - DNA, 22 bp, Homo sapiens
tggctccagcgtccacgtcctg

SEQ ID NO: 8026961 - DNA, 22 bp, Homo sapiens
tggctccagctcaagtatggca

SEQ ID NO: 8026962 - DNA, 22 bp, Homo sapiens
tggctccagctcaagtatggca

SEQ ID NO: 8026963 - DNA, 20 bp, Homo sapiens
tggctccagcctcccctacc

SEQ ID NO: 8026964 - DNA, 22 bp, Homo sapiens
tggctccagccctgagcaagct

SEQ ID NO: 8026965 - DNA, 20 bp, Homo sapiens
tggctccagcctcccctacc

SEQ ID NO: 8026966 - DNA, 22 bp, Homo sapiens
tggctccagatttcctgctgca

SEQ ID NO: 8026967 - DNA, 22 bp, Homo sapiens
tggctccagccctgagcaagct

SEQ ID NO: 8026968 - DNA, 22 bp, Homo sapiens
tggctccagccctgagcaagct

SEQ ID NO: 8026969 - DNA, 22 bp, Homo sapiens
tggctccagccctgagcaagct

SEQ ID NO: 8026970 - DNA, 22 bp, Homo sapiens
tggctcagttaggtcagaaaca

SEQ ID NO: 8026971 - DNA, 22 bp, Homo sapiens
tggctcagttaggtcagaaaca

SEQ ID NO: 8026972 - DNA, 22 bp, Homo sapiens
tggctcagttaggtcagaaaca

SEQ ID NO: 8026973 - DNA, 22 bp, Homo sapiens
tggctcagttccatcatctgga

SEQ ID NO: 8026974 - DNA, 22 bp, Homo sapiens
tggctcagtggcagccgcagct

SEQ ID NO: 8026975 - DNA, 22 bp, Homo sapiens
tggctcagttaggtcagaaaca

SEQ ID NO: 8026976 - DNA, 22 bp, Homo sapiens
tggctcagttaggtcagaaaca

SEQ ID NO: 8026977 - DNA, 22 bp, Homo sapiens
tggctcagttccatcatctgga

SEQ ID NO: 8026978 - DNA, 22 bp, Homo sapiens
tggctcagttccatcatctgga

SEQ ID NO: 8026979 - DNA, 22 bp, Homo sapiens
tggctcagttccatcatctgga

SEQ ID NO: 8026980 - DNA, 22 bp, Homo sapiens
tggctcagttccatcatctgga

SEQ ID NO: 8026981 - DNA, 22 bp, Homo sapiens
tggctcagttccatcatctgga

SEQ ID NO: 8026982 - DNA, 22 bp, Homo sapiens
tggctcagttccatcatctgga

SEQ ID NO: 8026983 - DNA, 22 bp, Homo sapiens
tggctcagttccatcatctgga

SEQ ID NO: 8026984 - DNA, 21 bp, Homo sapiens
tggctcagttgctgggcacag

SEQ ID NO: 8026985 - DNA, 22 bp, Homo sapiens
tggctccacaggccagggtgtg

SEQ ID NO: 8026986 - DNA, 22 bp, Homo sapiens
tggctccaaatcaactgctgtt

SEQ ID NO: 8026987 - DNA, 22 bp, Homo sapiens
tggctccaccgccgcggagctc

SEQ ID NO: 8026988 - DNA, 22 bp, Homo sapiens
tggctccacaggccagggtgtg

SEQ ID NO: 8026989 - DNA, 22 bp, Homo sapiens
tggctccaaatcaactgctgtt

SEQ ID NO: 8026990 - DNA, 22 bp, Homo sapiens
tggctccaaatcaactgctgtt

SEQ ID NO: 8026991 - DNA, 22 bp, Homo sapiens
tggctccaaatcaactgctgtt

SEQ ID NO: 8026992 - DNA, 22 bp, Homo sapiens
tggctccaaaaacaaatgacat

SEQ ID NO: 8026993 - DNA, 22 bp, Homo sapiens
tggctcattctactctccctgg

SEQ ID NO: 8026994 - DNA, 22 bp, Homo sapiens
tggctcatggaattagctatta

SEQ ID NO: 8026995 - DNA, 22 bp, Homo sapiens
tggctcattctggggaagtcag

SEQ ID NO: 8026996 - DNA, 22 bp, Homo sapiens
tggctcattctttagaatatac

SEQ ID NO: 8026997 - DNA, 22 bp, Homo sapiens
tggctcattctttagaatatac

SEQ ID NO: 8026998 - DNA, 21 bp, Homo sapiens
tggctcagttgctgggcacag

SEQ ID NO: 8026999 - DNA, 21 bp, Homo sapiens
tggctcagttgctgggcacag

SEQ ID NO: 8027000 - DNA, 22 bp, Homo sapiens
tggctcatggaattagctatta

SEQ ID NO: 8027001 - DNA, 22 bp, Homo sapiens
tggctcattctactctccctgg

SEQ ID NO: 8027002 - DNA, 22 bp, Homo sapiens
tggctcaggatctaagcagaat

SEQ ID NO: 8027003 - DNA, 22 bp, Homo sapiens
tggctcaggatctaagcagaat

SEQ ID NO: 8027004 - DNA, 22 bp, Homo sapiens
tggctcaggatctaagcagaat

SEQ ID NO: 8027005 - DNA, 22 bp, Homo sapiens
tggctcaggatctaagcagaat

SEQ ID NO: 8027006 - DNA, 22 bp, Homo sapiens
tggctcaggccacttcttttat

SEQ ID NO: 8027007 - DNA, 22 bp, Homo sapiens
tggctcaggccacttcttttat

SEQ ID NO: 8027008 - DNA, 22 bp, Homo sapiens
tggctcaggccacttcttttat

SEQ ID NO: 8027009 - DNA, 22 bp, Homo sapiens
tggctcaggccacttcttttat

SEQ ID NO: 8027010 - DNA, 22 bp, Homo sapiens
tggctcaggcttgaaaatagat

SEQ ID NO: 8027011 - DNA, 22 bp, Homo sapiens
tggctcaggcttgaaaatagat

SEQ ID NO: 8027012 - DNA, 22 bp, Homo sapiens
tggctcaggcttgaaaatagat

SEQ ID NO: 8027013 - DNA, 22 bp, Homo sapiens
tggctcaggcttgaaaatagat

SEQ ID NO: 8027014 - DNA, 22 bp, Homo sapiens
tggctcaggcctacgacgcctt

SEQ ID NO: 8027015 - DNA, 22 bp, Homo sapiens
tggctcaggcctacgacgcctt

SEQ ID NO: 8027016 - DNA, 22 bp, Homo sapiens
tggctcaggcctacgacgcctt

SEQ ID NO: 8027017 - DNA, 22 bp, Homo sapiens
tggctcaggataattttcccaa

SEQ ID NO: 8027018 - DNA, 22 bp, Homo sapiens
tggctcaggataattttcccaa

SEQ ID NO: 8027019 - DNA, 22 bp, Homo sapiens
tggctcaggatctaagcagaat

SEQ ID NO: 8027020 - DNA, 22 bp, Homo sapiens
tggctcaggataattttcccaa

SEQ ID NO: 8027021 - DNA, 22 bp, Homo sapiens
tggctcaggatctaagcagaat

SEQ ID NO: 8027022 - DNA, 22 bp, Homo sapiens
tggctcaggagggatctttgct

SEQ ID NO: 8027023 - DNA, 22 bp, Homo sapiens
tggctcaggagggatctttgct

SEQ ID NO: 8027024 - DNA, 22 bp, Homo sapiens
tggctcaggagggatctttgct

SEQ ID NO: 8027025 - DNA, 22 bp, Homo sapiens
tggctcaggagggatctttgct

SEQ ID NO: 8027026 - DNA, 22 bp, Homo sapiens
tggctcaggataattttcccaa

SEQ ID NO: 8027027 - DNA, 22 bp, Homo sapiens
tggctcagctttccccatctgg

SEQ ID NO: 8027028 - DNA, 22 bp, Homo sapiens
tggctcagctttccccatctgg

SEQ ID NO: 8027029 - DNA, 22 bp, Homo sapiens
tggctcagctttccccatctgg

SEQ ID NO: 8027030 - DNA, 22 bp, Homo sapiens
tggctcagctttccccatctgg

SEQ ID NO: 8027031 - DNA, 22 bp, Homo sapiens
tggctcagctttccccatctgg

SEQ ID NO: 8027032 - DNA, 22 bp, Homo sapiens
tggctcagctttccccatctgg

SEQ ID NO: 8027033 - DNA, 22 bp, Homo sapiens
tggctcaggagggatctttgct

SEQ ID NO: 8027034 - DNA, 22 bp, Homo sapiens
tggctcagctttccccatctgg

SEQ ID NO: 8027035 - DNA, 22 bp, Homo sapiens
tggctcaggagggatctttgct

SEQ ID NO: 8027036 - DNA, 22 bp, Homo sapiens
tggctcagcaggttagaaacta

SEQ ID NO: 8027037 - DNA, 22 bp, Homo sapiens
tggctcagcattcactggtctt

SEQ ID NO: 8027038 - DNA, 22 bp, Homo sapiens
tggctcagcaggttagaaacta

SEQ ID NO: 8027039 - DNA, 22 bp, Homo sapiens
tggctcagcattcactggtctt

SEQ ID NO: 8027040 - DNA, 22 bp, Homo sapiens
tggctcagcattcactggtctt

SEQ ID NO: 8027041 - DNA, 22 bp, Homo sapiens
tggctcagccagccctaggaac

SEQ ID NO: 8027042 - DNA, 22 bp, Homo sapiens
tggctcagatttttgtaggctt

SEQ ID NO: 8027043 - DNA, 22 bp, Homo sapiens
tggctcagatttttgtaggctt

SEQ ID NO: 8027044 - DNA, 22 bp, Homo sapiens
tggctcagatttttgtaggctt

SEQ ID NO: 8027045 - DNA, 22 bp, Homo sapiens
tggctcagatttttgtaggctt

SEQ ID NO: 8027046 - DNA, 22 bp, Homo sapiens
tggctcagcaagacattgacct

SEQ ID NO: 8027047 - DNA, 22 bp, Homo sapiens
tggctcagcaagacattgacct

SEQ ID NO: 8027048 - DNA, 22 bp, Homo sapiens
tggctcagcaagacattgacct

SEQ ID NO: 8027049 - DNA, 22 bp, Homo sapiens
tggctcagcaggttagaaacta

SEQ ID NO: 8027050 - DNA, 22 bp, Homo sapiens
tggctcagcaagacattgacct

SEQ ID NO: 8027051 - DNA, 22 bp, Homo sapiens
tggctcagcaagacattgacct

SEQ ID NO: 8027052 - DNA, 22 bp, Homo sapiens
tggctcagccagccctaggaac

SEQ ID NO: 8027053 - DNA, 22 bp, Homo sapiens
tggctcagccagccctaggaac

SEQ ID NO: 8027054 - DNA, 22 bp, Homo sapiens
tggctcagccagccctaggaac

SEQ ID NO: 8027055 - DNA, 22 bp, Homo sapiens
tggctcagccagccctaggaac

SEQ ID NO: 8027056 - DNA, 22 bp, Homo sapiens
tggctcagctgtcacagcctgg

SEQ ID NO: 8027057 - DNA, 22 bp, Homo sapiens
tggctcagctgtcacagcctgg

SEQ ID NO: 8027058 - DNA, 22 bp, Homo sapiens
tggctcagccagccctaggaac

SEQ ID NO: 8027059 - DNA, 22 bp, Homo sapiens
tggctcagccagccctaggaac

SEQ ID NO: 8027060 - DNA, 22 bp, Homo sapiens
tggctcagccagccctaggaac

SEQ ID NO: 8027061 - DNA, 22 bp, Homo sapiens
tggctcagctgtcacagcctgg

SEQ ID NO: 8027062 - DNA, 22 bp, Homo sapiens
tggctcagctgtcacagcctgg

SEQ ID NO: 8027063 - DNA, 22 bp, Homo sapiens
tggctcagctgtcacagcctgg

SEQ ID NO: 8027064 - DNA, 22 bp, Homo sapiens
tggctcagcttacttttgaggg

SEQ ID NO: 8027065 - DNA, 22 bp, Homo sapiens
tggctcagcttacttttgaggg

SEQ ID NO: 8027066 - DNA, 22 bp, Homo sapiens
tggctcagctttccccatctgg

SEQ ID NO: 8027067 - DNA, 22 bp, Homo sapiens
tggctcagcttacttttgaggg

SEQ ID NO: 8027068 - DNA, 22 bp, Homo sapiens
tggctcagcttacttttgaggg

SEQ ID NO: 8027069 - DNA, 22 bp, Homo sapiens
tggctcagcttacttttgaggg

SEQ ID NO: 8027070 - DNA, 22 bp, Homo sapiens
tggctcagggtccccaaatggt

SEQ ID NO: 8027071 - DNA, 23 bp, Homo sapiens
tggctcagggtctcttatgaagt

SEQ ID NO: 8027072 - DNA, 23 bp, Homo sapiens
tggctcagggtctcttatgaagt

SEQ ID NO: 8027073 - DNA, 23 bp, Homo sapiens
tggctcagggtctcttatgaagt

SEQ ID NO: 8027074 - DNA, 22 bp, Homo sapiens
tggctcagggtccccaaatggt

SEQ ID NO: 8027075 - DNA, 22 bp, Homo sapiens
tggctcagggtccccaaatggt

SEQ ID NO: 8027076 - DNA, 22 bp, Homo sapiens
tggctcagggtccccaaatggt

SEQ ID NO: 8027077 - DNA, 22 bp, Homo sapiens
tggctcagggtccccaaatggt

SEQ ID NO: 8027078 - DNA, 22 bp, Homo sapiens
tggctcagggtccccaaatggt

SEQ ID NO: 8027079 - DNA, 22 bp, Homo sapiens
tggctcaggggtctggctctgt

SEQ ID NO: 8027080 - DNA, 22 bp, Homo sapiens
tggctcaggggtctggctctgt

SEQ ID NO: 8027081 - DNA, 22 bp, Homo sapiens
tggctcaggcttgaaaatagat

SEQ ID NO: 8027082 - DNA, 22 bp, Homo sapiens
tggctcaggggtctggctctgt

SEQ ID NO: 8027083 - DNA, 22 bp, Homo sapiens
tggctcaggggtctggctctgt

SEQ ID NO: 8027084 - DNA, 22 bp, Homo sapiens
tggctcaggggtctggctctgt

SEQ ID NO: 8027085 - DNA, 22 bp, Homo sapiens
tggctcaggtgtgagctgaaga

SEQ ID NO: 8027086 - DNA, 22 bp, Homo sapiens
tggctcaggtgtgagctgaaga

SEQ ID NO: 8027087 - DNA, 22 bp, Homo sapiens
tggctcagtaatcgagtctcct

SEQ ID NO: 8027088 - DNA, 22 bp, Homo sapiens
tggctcagtaatcgagtctcct

SEQ ID NO: 8027089 - DNA, 22 bp, Homo sapiens
tggctcagtaatcgagtctcct

SEQ ID NO: 8027090 - DNA, 22 bp, Homo sapiens
tggctcaggtgtgagctgaaga

SEQ ID NO: 8027091 - DNA, 22 bp, Homo sapiens
tggctcaggtgtgagctgaaga

SEQ ID NO: 8027092 - DNA, 23 bp, Homo sapiens
tggctcagggtctcttatgaagt

SEQ ID NO: 8027093 - DNA, 23 bp, Homo sapiens
tggctcagggtctcttatgaagt

SEQ ID NO: 8027094 - DNA, 22 bp, Homo sapiens
tggctcaggtgtgagctgaaga

SEQ ID NO: 8027095 - DNA, 22 bp, Homo sapiens
tggctcagtagcagtgtggtca

SEQ ID NO: 8027096 - DNA, 22 bp, Homo sapiens
tggctcagtagcagtgtggtca

SEQ ID NO: 8027097 - DNA, 22 bp, Homo sapiens
tggctcagtagcagtgtggtca

SEQ ID NO: 8027098 - DNA, 22 bp, Homo sapiens
tggctcagtagcagtgtggtca

SEQ ID NO: 8027099 - DNA, 22 bp, Homo sapiens
tggctcagtagcagtgtggtca

SEQ ID NO: 8027100 - DNA, 22 bp, Homo sapiens
tggctcagtaatcgagtctcct

SEQ ID NO: 8027101 - DNA, 22 bp, Homo sapiens
tggctcagtaatcgagtctcct

SEQ ID NO: 8027102 - DNA, 22 bp, Homo sapiens
tggctcagtcatggatgagtaa

SEQ ID NO: 8027103 - DNA, 22 bp, Homo sapiens
tggctcagtcatggatgagtaa

SEQ ID NO: 8027104 - DNA, 22 bp, Homo sapiens
tggctcagtcatggatgagtaa

SEQ ID NO: 8027105 - DNA, 22 bp, Homo sapiens
tggctcagtctgggttgactga

SEQ ID NO: 8027106 - DNA, 22 bp, Homo sapiens
tggctcagtcatggatgagtaa

SEQ ID NO: 8027107 - DNA, 22 bp, Homo sapiens
tggctcagtcatggatgagtaa

SEQ ID NO: 8027108 - DNA, 22 bp, Homo sapiens
tggctcagtcatggatgagtaa

SEQ ID NO: 8027109 - DNA, 22 bp, Homo sapiens
tggctcagtcatggatgagtaa

SEQ ID NO: 8027110 - DNA, 22 bp, Homo sapiens
tggctcagtcatggatgagtaa

SEQ ID NO: 8027111 - DNA, 22 bp, Homo sapiens
tggctcagtctgggttgactga

SEQ ID NO: 8027112 - DNA, 22 bp, Homo sapiens
tggctcagtgaagagataactt

SEQ ID NO: 8027113 - DNA, 22 bp, Homo sapiens
tggctcagtctgggttgactga

SEQ ID NO: 8027114 - DNA, 22 bp, Homo sapiens
tggctcagtgaagagataactt

SEQ ID NO: 8027115 - DNA, 22 bp, Homo sapiens
tggctcagtgaagagataactt

SEQ ID NO: 8027116 - DNA, 22 bp, Homo sapiens
tggctcagtgaagagataactt

SEQ ID NO: 8027117 - DNA, 22 bp, Homo sapiens
tggctcagtgaagagataactt

SEQ ID NO: 8027118 - DNA, 22 bp, Homo sapiens
tggctcagtggcagccgcagct

SEQ ID NO: 8027119 - DNA, 22 bp, Homo sapiens
tggctcagtggcagccgcagct

SEQ ID NO: 8027120 - DNA, 22 bp, Homo sapiens
tggctcagtggcagccgcagct

SEQ ID NO: 8027121 - DNA, 22 bp, Homo sapiens
tggctcagtggcagccgcagct

SEQ ID NO: 8027122 - DNA, 22 bp, Homo sapiens
tggctcagtggcagccgcagct

SEQ ID NO: 8027123 - DNA, 22 bp, Homo sapiens
tggctcagtgcattcacagtaa

SEQ ID NO: 8027124 - DNA, 22 bp, Homo sapiens
tggctcagtgcattcacagtaa

SEQ ID NO: 8027125 - DNA, 22 bp, Homo sapiens
tggctcagtgcattcacagtaa

SEQ ID NO: 8027126 - DNA, 22 bp, Homo sapiens
tggctcagtgcattcacagtaa

SEQ ID NO: 8027127 - DNA, 22 bp, Homo sapiens
tggctcagtggcagccgcagct

SEQ ID NO: 8027128 - DNA, 22 bp, Homo sapiens
tggctcagtgacattcctccca

SEQ ID NO: 8027129 - DNA, 22 bp, Homo sapiens
tggctcagtgacattcctccca

SEQ ID NO: 8027130 - DNA, 22 bp, Homo sapiens
tggctcagtgacattcctccca

SEQ ID NO: 8027131 - DNA, 22 bp, Homo sapiens
tggctcagtgacattcctccca

SEQ ID NO: 8027132 - DNA, 22 bp, Homo sapiens
tggctcagtgcattcacagtaa

SEQ ID NO: 8027133 - DNA, 22 bp, Homo sapiens
tggctcagtgcattcacagtaa

SEQ ID NO: 8027134 - DNA, 22 bp, Homo sapiens
tggctcagtgacattcctccca

SEQ ID NO: 8027135 - DNA, 22 bp, Homo sapiens
tggctcagtgcattcacagtaa

SEQ ID NO: 8027136 - DNA, 23 bp, Homo sapiens
tgacctcatgatccgcccacctc

SEQ ID NO: 8027137 - DNA, 22 bp, Homo sapiens
tgacctccaatacctttcttcc

SEQ ID NO: 8027138 - DNA, 22 bp, Homo sapiens
tgacctctgtcctgcagtctgg

SEQ ID NO: 8027139 - DNA, 22 bp, Homo sapiens
tgacctgggcattacaggtgca

SEQ ID NO: 8027140 - DNA, 22 bp, Homo sapiens
tgacctgcgtaggtggtttctg

SEQ ID NO: 8027141 - DNA, 22 bp, Homo sapiens
tgaccttatttgaaaatagaga

SEQ ID NO: 8027142 - DNA, 22 bp, Homo sapiens
tgacctttcaacccttcttggc

SEQ ID NO: 8027143 - DNA, 22 bp, Homo sapiens
tgacgtcaactgcaaaggcctt

SEQ ID NO: 8027144 - DNA, 22 bp, Homo sapiens
tgactaaaataggacattaact

SEQ ID NO: 8027145 - DNA, 22 bp, Homo sapiens
tgactaaaataggacattaact

SEQ ID NO: 8027146 - DNA, 22 bp, Homo sapiens
tgactaattgataactctgtaa

SEQ ID NO: 8027147 - DNA, 22 bp, Homo sapiens
tgactaattatgttactaatca

SEQ ID NO: 8027148 - DNA, 22 bp, Homo sapiens
tgactacaacctccacctcccg

SEQ ID NO: 8027149 - DNA, 22 bp, Homo sapiens
tgactacaacctccacctcccg

SEQ ID NO: 8027150 - DNA, 22 bp, Homo sapiens
tgactacaacctccacctcccg

SEQ ID NO: 8027151 - DNA, 22 bp, Homo sapiens
tgactacaacctccacctcccg

SEQ ID NO: 8027152 - DNA, 22 bp, Homo sapiens
tgactacaacctccacctcccg

SEQ ID NO: 8027153 - DNA, 22 bp, Homo sapiens
tgactagaattgtatttagtgt

SEQ ID NO: 8027154 - DNA, 22 bp, Homo sapiens
tgactagacctatatctttttg

SEQ ID NO: 8027155 - DNA, 22 bp, Homo sapiens
tgactagaattgtatttagtgt

SEQ ID NO: 8027156 - DNA, 19 bp, Homo sapiens
tgactctgtggaacagaag

SEQ ID NO: 8027157 - DNA, 22 bp, Homo sapiens
tgactctgaatttatgaaatgg

SEQ ID NO: 8027158 - DNA, 22 bp, Homo sapiens
tgactctgattgccttagcttg

SEQ ID NO: 8027159 - DNA, 22 bp, Homo sapiens
tgactcctggtatggatgacag

SEQ ID NO: 8027160 - DNA, 22 bp, Homo sapiens
tgactcctggtatggatgacag

SEQ ID NO: 8027161 - DNA, 22 bp, Homo sapiens
tgactccacaatttgacttata

SEQ ID NO: 8027162 - DNA, 22 bp, Homo sapiens
tgactagacctatatctttttg

SEQ ID NO: 8027163 - DNA, 21 bp, Homo sapiens
tgactccattctccatctgct

SEQ ID NO: 8027164 - DNA, 22 bp, Homo sapiens
tgactcatatttcatggatacg

SEQ ID NO: 8027165 - DNA, 22 bp, Homo sapiens
tgactcagtacatctggagttg

SEQ ID NO: 8027166 - DNA, 22 bp, Homo sapiens
tgactcaccatcggagtttgaa

SEQ ID NO: 8027167 - DNA, 18 bp, Homo sapiens
tgactcaccctgtcagtg

SEQ ID NO: 8027168 - DNA, 22 bp, Homo sapiens
tgactcaggaggaaagactcca

SEQ ID NO: 8027169 - DNA, 20 bp, Homo sapiens
tgactattcccacatgagag

SEQ ID NO: 8027170 - DNA, 22 bp, Homo sapiens
tgactaggagaaatattaaaat

SEQ ID NO: 8027171 - DNA, 22 bp, Homo sapiens
tgacttgtctctttgggagaca

SEQ ID NO: 8027172 - DNA, 22 bp, Homo sapiens
tgacttgtctctttgggagaca

SEQ ID NO: 8027173 - DNA, 22 bp, Homo sapiens
tgactttaaaataacaagttta

SEQ ID NO: 8027174 - DNA, 22 bp, Homo sapiens
tgactttaaaataacaagttta

SEQ ID NO: 8027175 - DNA, 20 bp, Homo sapiens
tgacttcttcatgctgtact

SEQ ID NO: 8027176 - DNA, 22 bp, Homo sapiens
tgacttgaagcaaaatagaatt

SEQ ID NO: 8027177 - DNA, 22 bp, Homo sapiens
tgacttctctggcctggtgcag

SEQ ID NO: 8027178 - DNA, 22 bp, Homo sapiens
tgacttctgggtgagccagcat

SEQ ID NO: 8027179 - DNA, 22 bp, Homo sapiens
tgacttctgggtgagccagcat

SEQ ID NO: 8027180 - DNA, 20 bp, Homo sapiens
tgacttctgggatttgtggt

SEQ ID NO: 8027181 - DNA, 22 bp, Homo sapiens
tgacttccagcaacttcctcca

SEQ ID NO: 8027182 - DNA, 22 bp, Homo sapiens
tgacttcaaggttcagcacctt

SEQ ID NO: 8027183 - DNA, 22 bp, Homo sapiens
tgactgtgtgattaaggcttca

SEQ ID NO: 8027184 - DNA, 17 bp, Homo sapiens
tgacttaacagcaaggc

SEQ ID NO: 8027185 - DNA, 22 bp, Homo sapiens
tgacttcaaaggctctactcct

SEQ ID NO: 8027186 - DNA, 22 bp, Homo sapiens
tgacttactctagagaatgctg

SEQ ID NO: 8027187 - DNA, 19 bp, Homo sapiens
tgactgtgttattccaatg

SEQ ID NO: 8027188 - DNA, 22 bp, Homo sapiens
tgacttcctgcactcaggtgat

SEQ ID NO: 8027189 - DNA, 22 bp, Homo sapiens
tgacttcctgcactcaggtgat

SEQ ID NO: 8027190 - DNA, 22 bp, Homo sapiens
tgacttctagcatttagcaacc

SEQ ID NO: 8027191 - DNA, 21 bp, Homo sapiens
tgactgaggcttcttcacaca

SEQ ID NO: 8027192 - DNA, 21 bp, Homo sapiens
tgactgaggcttcttcacaca

SEQ ID NO: 8027193 - DNA, 21 bp, Homo sapiens
tgactgaggcttcttcacaca

SEQ ID NO: 8027194 - DNA, 21 bp, Homo sapiens
tgactgaggcttcttcacaca

SEQ ID NO: 8027195 - DNA, 22 bp, Homo sapiens
tgactgagggaggaagcaggtg

SEQ ID NO: 8027196 - DNA, 22 bp, Homo sapiens
tgactgagggaggaagcaggtg

SEQ ID NO: 8027197 - DNA, 22 bp, Homo sapiens
tgactgaggtttgatatatacc

SEQ ID NO: 8027198 - DNA, 22 bp, Homo sapiens
tgactgaggtttgatatatacc

SEQ ID NO: 8027199 - DNA, 22 bp, Homo sapiens
tgactgaggcagcctgagttat

SEQ ID NO: 8027200 - DNA, 22 bp, Homo sapiens
tgactgaggcctgataacagtt

SEQ ID NO: 8027201 - DNA, 22 bp, Homo sapiens
tgactgaggcctgataacagtt

SEQ ID NO: 8027202 - DNA, 22 bp, Homo sapiens
tgactgaggcctgataacagtt

SEQ ID NO: 8027203 - DNA, 22 bp, Homo sapiens
tgactgaggcagcctgagttat

SEQ ID NO: 8027204 - DNA, 22 bp, Homo sapiens
tgactgaggcagcctgagttat

SEQ ID NO: 8027205 - DNA, 22 bp, Homo sapiens
tgactgaggaagaccaggtagc

SEQ ID NO: 8027206 - DNA, 22 bp, Homo sapiens
tgactgaggaagaccaggtagc

SEQ ID NO: 8027207 - DNA, 22 bp, Homo sapiens
tgactgagagagaactcagctt

SEQ ID NO: 8027208 - DNA, 22 bp, Homo sapiens
tgactgaaatggcgacagtgaa

SEQ ID NO: 8027209 - DNA, 22 bp, Homo sapiens
tgactgaaggactagattgatt

SEQ ID NO: 8027210 - DNA, 22 bp, Homo sapiens
tgactgagagagaactcagctt

SEQ ID NO: 8027211 - DNA, 22 bp, Homo sapiens
tgactgaaggactagattgatt

SEQ ID NO: 8027212 - DNA, 22 bp, Homo sapiens
tgactggagacctcagtagggt

SEQ ID NO: 8027213 - DNA, 22 bp, Homo sapiens
tgactggagacctcagtagggt

SEQ ID NO: 8027214 - DNA, 22 bp, Homo sapiens
tgactgccgattgtccttctct

SEQ ID NO: 8027215 - DNA, 22 bp, Homo sapiens
tgactgtgcctgttgaatgaat

SEQ ID NO: 8027216 - DNA, 22 bp, Homo sapiens
tgactgtgccgtgcccctagga

SEQ ID NO: 8027217 - DNA, 22 bp, Homo sapiens
tgactggattgtcattacgacg

SEQ ID NO: 8027218 - DNA, 22 bp, Homo sapiens
tgactggattgtcattacgacg

SEQ ID NO: 8027219 - DNA, 22 bp, Homo sapiens
tgactgtgcaagcagagagcat

SEQ ID NO: 8027220 - DNA, 22 bp, Homo sapiens
tgacatttaatccctaaatatt

SEQ ID NO: 8027221 - DNA, 22 bp, Homo sapiens
tgacatttaatccctaaatatt

SEQ ID NO: 8027222 - DNA, 22 bp, Homo sapiens
tgacatttaattaacgaatgct

SEQ ID NO: 8027223 - DNA, 22 bp, Homo sapiens
tgacatttaagcctctgatttc

SEQ ID NO: 8027224 - DNA, 22 bp, Homo sapiens
tgacatttaagcctctgatttc

SEQ ID NO: 8027225 - DNA, 22 bp, Homo sapiens
tgacatttaagcctctgatttc

SEQ ID NO: 8027226 - DNA, 22 bp, Homo sapiens
tgacatttaagcctctgatttc

SEQ ID NO: 8027227 - DNA, 22 bp, Homo sapiens
tgacattccgcagtaaggttaa

SEQ ID NO: 8027228 - DNA, 22 bp, Homo sapiens
tgacattccgcagtaaggttaa

SEQ ID NO: 8027229 - DNA, 22 bp, Homo sapiens
tgacattccgcagtaaggttaa

SEQ ID NO: 8027230 - DNA, 22 bp, Homo sapiens
tgacattgtgtgcatttaaagt

SEQ ID NO: 8027231 - DNA, 22 bp, Homo sapiens
tgacatgtatgttgttggcatg

SEQ ID NO: 8027232 - DNA, 22 bp, Homo sapiens
tgacatgtccaggtggtcctgt

SEQ ID NO: 8027233 - DNA, 22 bp, Homo sapiens
tgacatgtcctgagaagatggc

SEQ ID NO: 8027234 - DNA, 22 bp, Homo sapiens
tgacattattatcatgtcacca

SEQ ID NO: 8027235 - DNA, 22 bp, Homo sapiens
tgacatgttagggaaatgtgat

SEQ ID NO: 8027236 - DNA, 22 bp, Homo sapiens
tgacatgtgtaatcagctccgt

SEQ ID NO: 8027237 - DNA, 22 bp, Homo sapiens
tgacatgtgtctccttccgtct

SEQ ID NO: 8027238 - DNA, 22 bp, Homo sapiens
tgacatgtgctcatcttggcta

SEQ ID NO: 8027239 - DNA, 22 bp, Homo sapiens
tgacatgtggctttgacccagg

SEQ ID NO: 8027240 - DNA, 22 bp, Homo sapiens
tgacatttatcttctacaatga

SEQ ID NO: 8027241 - DNA, 22 bp, Homo sapiens
tgacatttatcttctacaatga

SEQ ID NO: 8027242 - DNA, 22 bp, Homo sapiens
tgacatttatcaaagaaatggt

SEQ ID NO: 8027243 - DNA, 22 bp, Homo sapiens
tgacatttatcttctacaatga

SEQ ID NO: 8027244 - DNA, 22 bp, Homo sapiens
tgacatttatcaaagaaatggt

SEQ ID NO: 8027245 - DNA, 22 bp, Homo sapiens
tgacatttatcaaagaaatggt

SEQ ID NO: 8027246 - DNA, 22 bp, Homo sapiens
tgacatttatcaaagaaatggt

SEQ ID NO: 8027247 - DNA, 21 bp, Homo sapiens
tgacatttagtagcattgtca

SEQ ID NO: 8027248 - DNA, 22 bp, Homo sapiens
tgacatttactattcctggtta

SEQ ID NO: 8027249 - DNA, 21 bp, Homo sapiens
tgacatttagtagcattgtca

SEQ ID NO: 8027250 - DNA, 21 bp, Homo sapiens
tgacatttagtagcattgtca

SEQ ID NO: 8027251 - DNA, 18 bp, Homo sapiens
tgacatttccagagtgta

SEQ ID NO: 8027252 - DNA, 21 bp, Homo sapiens
tgacatttccaatataaagcc

SEQ ID NO: 8027253 - DNA, 22 bp, Homo sapiens
tgacatttatcttctacaatga

SEQ ID NO: 8027254 - DNA, 22 bp, Homo sapiens
tgacatttatcttctacaatga

SEQ ID NO: 8027255 - DNA, 22 bp, Homo sapiens
tgacatttcagatatggtattt

SEQ ID NO: 8027256 - DNA, 22 bp, Homo sapiens
tgacatttgagcatacatgtaa

SEQ ID NO: 8027257 - DNA, 22 bp, Homo sapiens
tgacatttgagcatacatgtaa

SEQ ID NO: 8027258 - DNA, 22 bp, Homo sapiens
tgacatttgagcatacatgtaa

SEQ ID NO: 8027259 - DNA, 22 bp, Homo sapiens
tgacatttgagcatacatgtaa

SEQ ID NO: 8027260 - DNA, 22 bp, Homo sapiens
tgacatttgagagagatataca

SEQ ID NO: 8027261 - DNA, 22 bp, Homo sapiens
tgacatttgagagagatataca

SEQ ID NO: 8027262 - DNA, 22 bp, Homo sapiens
tgacatttcttgttgatataaa

SEQ ID NO: 8027263 - DNA, 22 bp, Homo sapiens
tgacatttcttgttgatataaa

SEQ ID NO: 8027264 - DNA, 22 bp, Homo sapiens
tgacatttcttgttgatataaa

SEQ ID NO: 8027265 - DNA, 22 bp, Homo sapiens
tgacatttcttgttgatataaa

SEQ ID NO: 8027266 - DNA, 22 bp, Homo sapiens
tgacatttcttgttgatataaa

SEQ ID NO: 8027267 - DNA, 22 bp, Homo sapiens
tgacatttcggtgtatgtgatg

SEQ ID NO: 8027268 - DNA, 22 bp, Homo sapiens
tgacatttcctagtgctttgtg

SEQ ID NO: 8027269 - DNA, 22 bp, Homo sapiens
tgacatttcctagtgctttgtg

SEQ ID NO: 8027270 - DNA, 18 bp, Homo sapiens
tgacatttccagagtgta

SEQ ID NO: 8027271 - DNA, 18 bp, Homo sapiens
tgacatttccagagtgta

SEQ ID NO: 8027272 - DNA, 22 bp, Homo sapiens
tgacatttcctagtgctttgtg

SEQ ID NO: 8027273 - DNA, 22 bp, Homo sapiens
tgacatttcggtgtatgtgatg

SEQ ID NO: 8027274 - DNA, 22 bp, Homo sapiens
tgacatttcctagtgctttgtg

SEQ ID NO: 8027275 - DNA, 22 bp, Homo sapiens
tgacatttttaaaaccactagt

SEQ ID NO: 8027276 - DNA, 22 bp, Homo sapiens
tgacatttttaaaaccactagt

SEQ ID NO: 8027277 - DNA, 22 bp, Homo sapiens
tgaccctggcagcccactggcc

SEQ ID NO: 8027278 - DNA, 22 bp, Homo sapiens
tgacatttttataagagtcaaa

SEQ ID NO: 8027279 - DNA, 22 bp, Homo sapiens
tgacatttttataagagtcaaa

SEQ ID NO: 8027280 - DNA, 22 bp, Homo sapiens
tgacattttatcaatatcacag

SEQ ID NO: 8027281 - DNA, 22 bp, Homo sapiens
tgacattttatcaatatcacag

SEQ ID NO: 8027282 - DNA, 22 bp, Homo sapiens
tgacattttatcaatatcacag

SEQ ID NO: 8027283 - DNA, 21 bp, Homo sapiens
tgacatttggattcatagtaa

SEQ ID NO: 8027284 - DNA, 21 bp, Homo sapiens
tgacatttggattcatagtaa

SEQ ID NO: 8027285 - DNA, 22 bp, Homo sapiens
tgaccctttcattattctcatt

SEQ ID NO: 8027286 - DNA, 22 bp, Homo sapiens
tgacctattagatttccttgcc

SEQ ID NO: 8027287 - DNA, 18 bp, Homo sapiens
tgaccctttctccctgtg

SEQ ID NO: 8027288 - DNA, 22 bp, Homo sapiens
tgaccgtcttcccactttctgt

SEQ ID NO: 8027289 - DNA, 22 bp, Homo sapiens
tgaccgaacacgtcataaatgc

SEQ ID NO: 8027290 - DNA, 21 bp, Homo sapiens
tgacccttgccgagctacatt

SEQ ID NO: 8027291 - DNA, 22 bp, Homo sapiens
tgacaggaggcttgaggccagg

SEQ ID NO: 8027292 - DNA, 22 bp, Homo sapiens
tgacaggagggttgtggcaggg

SEQ ID NO: 8027293 - DNA, 22 bp, Homo sapiens
tgacaggagggttgtggcaggg

SEQ ID NO: 8027294 - DNA, 22 bp, Homo sapiens
tgacaggagggttgtggcaggg

SEQ ID NO: 8027295 - DNA, 22 bp, Homo sapiens
tgacaggatagtaggaagatct

SEQ ID NO: 8027296 - DNA, 22 bp, Homo sapiens
tgacaggatgatgagcaggggg

SEQ ID NO: 8027297 - DNA, 22 bp, Homo sapiens
tgacaggagtggctagtgggag

SEQ ID NO: 8027298 - DNA, 22 bp, Homo sapiens
tgacaggatagtaggaagatct

SEQ ID NO: 8027299 - DNA, 22 bp, Homo sapiens
tgacaggatgatgagcaggggg

SEQ ID NO: 8027300 - DNA, 22 bp, Homo sapiens
tgacaggatgatgagcaggggg

SEQ ID NO: 8027301 - DNA, 22 bp, Homo sapiens
tgacaggattggttgcttctga

SEQ ID NO: 8027302 - DNA, 22 bp, Homo sapiens
tgacaggattggttgcttctga

SEQ ID NO: 8027303 - DNA, 22 bp, Homo sapiens
tgacaggattggttgcttctga

SEQ ID NO: 8027304 - DNA, 21 bp, Homo sapiens
tgacaggcaccctggctgtga

SEQ ID NO: 8027305 - DNA, 21 bp, Homo sapiens
tgacaggcaccctggctgtga

SEQ ID NO: 8027306 - DNA, 22 bp, Homo sapiens
tgacaggcaggacagaggtgtg

SEQ ID NO: 8027307 - DNA, 22 bp, Homo sapiens
tgacaggcaggacagaggtgtg

SEQ ID NO: 8027308 - DNA, 22 bp, Homo sapiens
tgacagggacagtggagatgga

SEQ ID NO: 8027309 - DNA, 22 bp, Homo sapiens
tgacagggacagtggagatgga

SEQ ID NO: 8027310 - DNA, 22 bp, Homo sapiens
tgacagggacagtggagatgga

SEQ ID NO: 8027311 - DNA, 22 bp, Homo sapiens
tgacagggaaaggtcctctttt

SEQ ID NO: 8027312 - DNA, 23 bp, Homo sapiens
tgacaggctttgctccttctgcc

SEQ ID NO: 8027313 - DNA, 23 bp, Homo sapiens
tgacaggctttgctccttctgcc

SEQ ID NO: 8027314 - DNA, 22 bp, Homo sapiens
tgacaggcttgctaagacatag

SEQ ID NO: 8027315 - DNA, 22 bp, Homo sapiens
tgacaggcttgctaagacatag

SEQ ID NO: 8027316 - DNA, 22 bp, Homo sapiens
tgacaggcagtgctgggcatgt

SEQ ID NO: 8027317 - DNA, 22 bp, Homo sapiens
tgacaggcagtgctgggcatgt

SEQ ID NO: 8027318 - DNA, 22 bp, Homo sapiens
tgacaggctaggaggctgaagg

SEQ ID NO: 8027319 - DNA, 23 bp, Homo sapiens
tgacaggctgcttctggctgagg

SEQ ID NO: 8027320 - DNA, 23 bp, Homo sapiens
tgacaggccagaagagcagctgg

SEQ ID NO: 8027321 - DNA, 23 bp, Homo sapiens
tgacaggccagaagagcagctgg

SEQ ID NO: 8027322 - DNA, 23 bp, Homo sapiens
tgacaggccagaagagcagctgg

SEQ ID NO: 8027323 - DNA, 21 bp, Homo sapiens
tgacagcatagagcagggagg

SEQ ID NO: 8027324 - DNA, 22 bp, Homo sapiens
tgacagcataacactggtcttg

SEQ ID NO: 8027325 - DNA, 22 bp, Homo sapiens
tgacagcataacactggtcttg

SEQ ID NO: 8027326 - DNA, 22 bp, Homo sapiens
tgacagcagcatagtgagcaat

SEQ ID NO: 8027327 - DNA, 23 bp, Homo sapiens
tgacagcaggaactgattatgta

SEQ ID NO: 8027328 - DNA, 22 bp, Homo sapiens
tgacagcagccacctctcaccc

SEQ ID NO: 8027329 - DNA, 22 bp, Homo sapiens
tgacagcataacactggtcttg

SEQ ID NO: 8027330 - DNA, 22 bp, Homo sapiens
tgacagccatgatccttactgt

SEQ ID NO: 8027331 - DNA, 22 bp, Homo sapiens
tgacagcccacctcacaggatt

SEQ ID NO: 8027332 - DNA, 22 bp, Homo sapiens
tgacagcccacctcacaggatt

SEQ ID NO: 8027333 - DNA, 22 bp, Homo sapiens
tgacagctgagccccaggcaag

SEQ ID NO: 8027334 - DNA, 22 bp, Homo sapiens
tgacagctgagccccaggcaag

SEQ ID NO: 8027335 - DNA, 22 bp, Homo sapiens
tgacagcattactaatacatgt

SEQ ID NO: 8027336 - DNA, 22 bp, Homo sapiens
tgacagcatgaccacagggtct

SEQ ID NO: 8027337 - DNA, 22 bp, Homo sapiens
tgacagcatgaccacagggtct

SEQ ID NO: 8027338 - DNA, 22 bp, Homo sapiens
tgacagcattactaatacatgt

SEQ ID NO: 8027339 - DNA, 22 bp, Homo sapiens
tgacaggacagagaaatgacct

SEQ ID NO: 8027340 - DNA, 22 bp, Homo sapiens
tgacaggaaacatgcagtgatt

SEQ ID NO: 8027341 - DNA, 22 bp, Homo sapiens
tgacaggacagagaaatgacct

SEQ ID NO: 8027342 - DNA, 22 bp, Homo sapiens
tgacaggacagagaaatgacct

SEQ ID NO: 8027343 - DNA, 22 bp, Homo sapiens
tgacagctgaggcccagagtac

SEQ ID NO: 8027344 - DNA, 22 bp, Homo sapiens
tgacaggaaacatgcagtgatt

SEQ ID NO: 8027345 - DNA, 22 bp, Homo sapiens
tgacagtgaacaggttaccact

SEQ ID NO: 8027346 - DNA, 22 bp, Homo sapiens
tgacagtgaataagtctcttaa

SEQ ID NO: 8027347 - DNA, 22 bp, Homo sapiens
tgacagtgacagccaaaggctt

SEQ ID NO: 8027348 - DNA, 22 bp, Homo sapiens
tgacagtattgatggcaggatt

SEQ ID NO: 8027349 - DNA, 22 bp, Homo sapiens
tgacagtagtgttagaactgat

SEQ ID NO: 8027350 - DNA, 22 bp, Homo sapiens
tgacagtaccactgaaagtctg

SEQ ID NO: 8027351 - DNA, 22 bp, Homo sapiens
tgacagtgagcttggggtactt

SEQ ID NO: 8027352 - DNA, 22 bp, Homo sapiens
tgacagtgagcttggggtactt

SEQ ID NO: 8027353 - DNA, 22 bp, Homo sapiens
tgacatgtaagatggaaaagcg

SEQ ID NO: 8027354 - DNA, 22 bp, Homo sapiens
tgacatgtatatcttacgctat

SEQ ID NO: 8027355 - DNA, 22 bp, Homo sapiens
tgacatgtatgtatttgtttat

SEQ ID NO: 8027356 - DNA, 22 bp, Homo sapiens
tgacaggttgtgtaggtggcca

SEQ ID NO: 8027357 - DNA, 22 bp, Homo sapiens
tgacagtaccactgaaagtctg

SEQ ID NO: 8027358 - DNA, 22 bp, Homo sapiens
tgacagtaccaccaaatctgat

SEQ ID NO: 8027359 - DNA, 22 bp, Homo sapiens
tgacagtaccaccaaatctgat

SEQ ID NO: 8027360 - DNA, 22 bp, Homo sapiens
tgacagtaattcactgggaccc

SEQ ID NO: 8027361 - DNA, 22 bp, Homo sapiens
tgacagtaccaccaaatctgat

SEQ ID NO: 8027362 - DNA, 21 bp, Homo sapiens
tgacaggtttaggattaaaat

SEQ ID NO: 8027363 - DNA, 19 bp, Homo sapiens
tgacaggttttatgtgttt

SEQ ID NO: 8027364 - DNA, 22 bp, Homo sapiens
tgacaggtgctgggggcagtgt

SEQ ID NO: 8027365 - DNA, 22 bp, Homo sapiens
tgacaggttcgttagtcatgtt

SEQ ID NO: 8027366 - DNA, 22 bp, Homo sapiens
tgacaggttcgttagtcatgtt

SEQ ID NO: 8027367 - DNA, 22 bp, Homo sapiens
tgacaggttcgttagtcatgtt

SEQ ID NO: 8027368 - DNA, 22 bp, Homo sapiens
tgacaggtgctgggggcagtgt

SEQ ID NO: 8027369 - DNA, 22 bp, Homo sapiens
tgacaggtgattgtgaactaag

SEQ ID NO: 8027370 - DNA, 22 bp, Homo sapiens
tgacaggtcatataagcttgca

SEQ ID NO: 8027371 - DNA, 22 bp, Homo sapiens
tgacaggtgaaatgtccttatt

SEQ ID NO: 8027372 - DNA, 22 bp, Homo sapiens
tgacagggtgtttgtgagacta

SEQ ID NO: 8027373 - DNA, 21 bp, Homo sapiens
tgacaggtatttatctggaaa

SEQ ID NO: 8027374 - DNA, 22 bp, Homo sapiens
tgacagggtgtttgtgagacta

SEQ ID NO: 8027375 - DNA, 22 bp, Homo sapiens
tgacagggtgattatgagagct

SEQ ID NO: 8027376 - DNA, 22 bp, Homo sapiens
tgacagggtgattatgagagct

SEQ ID NO: 8027377 - DNA, 22 bp, Homo sapiens
tgacagggtcagagctgagctg

SEQ ID NO: 8027378 - DNA, 22 bp, Homo sapiens
tgacagggtcagagctgagctg

SEQ ID NO: 8027379 - DNA, 22 bp, Homo sapiens
tgacagggtcagagctgagctg

SEQ ID NO: 8027380 - DNA, 22 bp, Homo sapiens
tgacagggtcagagctgagctg

SEQ ID NO: 8027381 - DNA, 22 bp, Homo sapiens
tgacagggggcagaggtggctg

SEQ ID NO: 8027382 - DNA, 22 bp, Homo sapiens
tgacagggggcagaggtggctg

SEQ ID NO: 8027383 - DNA, 22 bp, Homo sapiens
tgacagggggcagaggtggctg

SEQ ID NO: 8027384 - DNA, 22 bp, Homo sapiens
tgacagggggcagaggtggctg

SEQ ID NO: 8027385 - DNA, 22 bp, Homo sapiens
tgacagggctgttctgttttag

SEQ ID NO: 8027386 - DNA, 22 bp, Homo sapiens
tgacagggcttccctttaatca

SEQ ID NO: 8027387 - DNA, 22 bp, Homo sapiens
tgacagggctagaggcaatgca

SEQ ID NO: 8027388 - DNA, 22 bp, Homo sapiens
tgacagggccatgctgcactgc

SEQ ID NO: 8027389 - DNA, 22 bp, Homo sapiens
tgacagggccatgctgcactgc

SEQ ID NO: 8027390 - DNA, 22 bp, Homo sapiens
tgacagggaggtggaataagta

SEQ ID NO: 8027391 - DNA, 22 bp, Homo sapiens
tgacagggcaggcttactggtt

SEQ ID NO: 8027392 - DNA, 22 bp, Homo sapiens
tgacagggacagtggagatgga

SEQ ID NO: 8027393 - DNA, 22 bp, Homo sapiens
tgacagggaggtggaataagta

SEQ ID NO: 8027394 - DNA, 22 bp, Homo sapiens
tgacagaaatagttcttaattt

SEQ ID NO: 8027395 - DNA, 22 bp, Homo sapiens
tgacagaaatagttcttaattt

SEQ ID NO: 8027396 - DNA, 22 bp, Homo sapiens
tgacagaaatagttcttaattt

SEQ ID NO: 8027397 - DNA, 16 bp, Homo sapiens
tgacagaaagatctat

SEQ ID NO: 8027398 - DNA, 22 bp, Homo sapiens
tgacagaaatagttcttaattt

SEQ ID NO: 8027399 - DNA, 22 bp, Homo sapiens
tgacagaaaaatgtagctccat

SEQ ID NO: 8027400 - DNA, 22 bp, Homo sapiens
tgacagaaaaatgtagctccat

SEQ ID NO: 8027401 - DNA, 22 bp, Homo sapiens
tgacagaaagaatatgtcaatc

SEQ ID NO: 8027402 - DNA, 22 bp, Homo sapiens
tgacagaaagaatatgtcaatc

SEQ ID NO: 8027403 - DNA, 22 bp, Homo sapiens
tgacagaaagaatatgtcaatc

SEQ ID NO: 8027404 - DNA, 22 bp, Homo sapiens
tgacacttgggctttgagaggt

SEQ ID NO: 8027405 - DNA, 22 bp, Homo sapiens
tgacactgcaaatataaatatt

SEQ ID NO: 8027406 - DNA, 22 bp, Homo sapiens
tgacacttggaagcttggcaac

SEQ ID NO: 8027407 - DNA, 22 bp, Homo sapiens
tgacacttccagttaaaaatat

SEQ ID NO: 8027408 - DNA, 22 bp, Homo sapiens
tgacactgacctaaagacctgg

SEQ ID NO: 8027409 - DNA, 22 bp, Homo sapiens
tgacactgcaaatataaatatt

SEQ ID NO: 8027410 - DNA, 22 bp, Homo sapiens
tgacactgcatatattgaagtt

SEQ ID NO: 8027411 - DNA, 22 bp, Homo sapiens
tgacactgcatatattgaagtt

SEQ ID NO: 8027412 - DNA, 22 bp, Homo sapiens
tgacactgccgaaactgtagag

SEQ ID NO: 8027413 - DNA, 22 bp, Homo sapiens
tgacactgccgaaactgtagag

SEQ ID NO: 8027414 - DNA, 18 bp, Homo sapiens
tgacagaacctggagcct

SEQ ID NO: 8027415 - DNA, 22 bp, Homo sapiens
tgacagaactttttcacatctc

SEQ ID NO: 8027416 - DNA, 22 bp, Homo sapiens
tgacagaatgtgactctcagat

SEQ ID NO: 8027417 - DNA, 22 bp, Homo sapiens
tgacagaactcattctcaccaa

SEQ ID NO: 8027418 - DNA, 22 bp, Homo sapiens
tgacagaactttttcacatctc

SEQ ID NO: 8027419 - DNA, 17 bp, Homo sapiens
tgacagacatcatgagc

SEQ ID NO: 8027420 - DNA, 17 bp, Homo sapiens
tgacagacatcatgagc

SEQ ID NO: 8027421 - DNA, 22 bp, Homo sapiens
tgacagacagcttctcatttta

SEQ ID NO: 8027422 - DNA, 22 bp, Homo sapiens
tgacagaccactgcaactctgt

SEQ ID NO: 8027423 - DNA, 22 bp, Homo sapiens
tgacagagttcggattgagttt

SEQ ID NO: 8027424 - DNA, 21 bp, Homo sapiens
tgacagcacatgcaatcggag

SEQ ID NO: 8027425 - DNA, 22 bp, Homo sapiens
tgacagcagcatagtgagcaat

SEQ ID NO: 8027426 - DNA, 22 bp, Homo sapiens
tgacagcagcatagtgagcaat

SEQ ID NO: 8027427 - DNA, 22 bp, Homo sapiens
tgacagattttgatggctaata

SEQ ID NO: 8027428 - DNA, 19 bp, Homo sapiens
tgacacagctaggtttgct

SEQ ID NO: 8027429 - DNA, 22 bp, Homo sapiens
tgacacagattagagacatacc

SEQ ID NO: 8027430 - DNA, 22 bp, Homo sapiens
tgacacagattagagacatacc

SEQ ID NO: 8027431 - DNA, 22 bp, Homo sapiens
tgacacagattagagacatacc

SEQ ID NO: 8027432 - DNA, 22 bp, Homo sapiens
tgacacagaatttggctatcac

SEQ ID NO: 8027433 - DNA, 22 bp, Homo sapiens
tgacacagaaattaagctgtca

SEQ ID NO: 8027434 - DNA, 22 bp, Homo sapiens
tgacacactgccaggcgctcgg

SEQ ID NO: 8027435 - DNA, 22 bp, Homo sapiens
tgacacactaggaaaagcattt

SEQ ID NO: 8027436 - DNA, 22 bp, Homo sapiens
tgacacacagggggatggagtt

SEQ ID NO: 8027437 - DNA, 22 bp, Homo sapiens
tgacacactaggaaaagcattt

SEQ ID NO: 8027438 - DNA, 22 bp, Homo sapiens
tgacacagaaattaagctgtca

SEQ ID NO: 8027439 - DNA, 22 bp, Homo sapiens
tgacacaggcagctcccagcac

SEQ ID NO: 8027440 - DNA, 22 bp, Homo sapiens
tgacacaggcagctcccagcac

SEQ ID NO: 8027441 - DNA, 22 bp, Homo sapiens
tgacacagggaaagcggatcca

SEQ ID NO: 8027442 - DNA, 22 bp, Homo sapiens
tgacacagggcatgcagcagaa

SEQ ID NO: 8027443 - DNA, 22 bp, Homo sapiens
tgacacagggcatgcagcagaa

SEQ ID NO: 8027444 - DNA, 22 bp, Homo sapiens
tgacacagggaaagcggatcca

SEQ ID NO: 8027445 - DNA, 22 bp, Homo sapiens
tgacacaggggaaggagtctgg

SEQ ID NO: 8027446 - DNA, 22 bp, Homo sapiens
tgacacaggggaaggagtctgg

SEQ ID NO: 8027447 - DNA, 23 bp, Homo sapiens
tgacacaggtcaaaaataagatg

SEQ ID NO: 8027448 - DNA, 23 bp, Homo sapiens
tgacacaggtcaaaaataagatg

SEQ ID NO: 8027449 - DNA, 23 bp, Homo sapiens
tgacacaggtcaaaaataagatg

SEQ ID NO: 8027450 - DNA, 22 bp, Homo sapiens
tgacacaggtcaaatctacttt

SEQ ID NO: 8027451 - DNA, 22 bp, Homo sapiens
tgacacagttgtcgactctaca

SEQ ID NO: 8027452 - DNA, 22 bp, Homo sapiens
tgacacagttgtcgactctaca

SEQ ID NO: 8027453 - DNA, 22 bp, Homo sapiens
tgacacatgcaccagtctttaa

SEQ ID NO: 8027454 - DNA, 22 bp, Homo sapiens
tgacacatgcaccagtctttaa

SEQ ID NO: 8027455 - DNA, 22 bp, Homo sapiens
tgacacatgcaccagtctttaa

SEQ ID NO: 8027456 - DNA, 22 bp, Homo sapiens
tgacacataccgaaaatatttg

SEQ ID NO: 8027457 - DNA, 22 bp, Homo sapiens
tgacacataccgaaaatatttg

SEQ ID NO: 8027458 - DNA, 22 bp, Homo sapiens
tgacacagtatcaaacatgatt

SEQ ID NO: 8027459 - DNA, 22 bp, Homo sapiens
tgacacagtagaaagatgatga

SEQ ID NO: 8027460 - DNA, 22 bp, Homo sapiens
tgacacagggcatgcagcagaa

SEQ ID NO: 8027461 - DNA, 22 bp, Homo sapiens
tgacacagtagaaagatgatga

SEQ ID NO: 8027462 - DNA, 22 bp, Homo sapiens
tgacacagtagaaagatgatga

SEQ ID NO: 8027463 - DNA, 22 bp, Homo sapiens
tgacactaaatagctgtgtgcc

SEQ ID NO: 8027464 - DNA, 22 bp, Homo sapiens
tgacacattaaatgctcacaaa

SEQ ID NO: 8027465 - DNA, 23 bp, Homo sapiens
tgacacatttcctttccactgca

SEQ ID NO: 8027466 - DNA, 22 bp, Homo sapiens
tgacaccaaggaagtatcattt

SEQ ID NO: 8027467 - DNA, 22 bp, Homo sapiens
tgaatctttttggaaataaaga

SEQ ID NO: 8027468 - DNA, 22 bp, Homo sapiens
tgaatctggatctatgatcaat

SEQ ID NO: 8027469 - DNA, 22 bp, Homo sapiens
tgaatgaatcctaacaaagaca

SEQ ID NO: 8027470 - DNA, 22 bp, Homo sapiens
tgaatctcgaggctatagaagt

SEQ ID NO: 8027471 - DNA, 22 bp, Homo sapiens
tgaatctcagttctgtgtaacc

SEQ ID NO: 8027472 - DNA, 22 bp, Homo sapiens
tgaatctgatttccctggaggc

SEQ ID NO: 8027473 - DNA, 22 bp, Homo sapiens
tgaatgaatgaattaatagagt

SEQ ID NO: 8027474 - DNA, 22 bp, Homo sapiens
tgaatgaatcctaacaaagaca

SEQ ID NO: 8027475 - DNA, 22 bp, Homo sapiens
tgaatggatataacaacagtgt

SEQ ID NO: 8027476 - DNA, 22 bp, Homo sapiens
tgaatggattcagaaaatgtgt

SEQ ID NO: 8027477 - DNA, 22 bp, Homo sapiens
tgaatggatataacaacagtgt

SEQ ID NO: 8027478 - DNA, 22 bp, Homo sapiens
tgaatgctttggagccttctaa

SEQ ID NO: 8027479 - DNA, 22 bp, Homo sapiens
tgaatgagtgagttcagacctc

SEQ ID NO: 8027480 - DNA, 22 bp, Homo sapiens
tgaatgagtcaatcatttagct

SEQ ID NO: 8027481 - DNA, 22 bp, Homo sapiens
tgaatgagtcaatcatttagct

SEQ ID NO: 8027482 - DNA, 22 bp, Homo sapiens
tgaatgagtcaatcatttagct

SEQ ID NO: 8027483 - DNA, 22 bp, Homo sapiens
tgaatgaggatccttgacctta

SEQ ID NO: 8027484 - DNA, 21 bp, Homo sapiens
tgaatgaggaggatggcattt

SEQ ID NO: 8027485 - DNA, 22 bp, Homo sapiens
tgaatgaggatccttgacctta

SEQ ID NO: 8027486 - DNA, 21 bp, Homo sapiens
tgaatgagcatctggactttt

SEQ ID NO: 8027487 - DNA, 22 bp, Homo sapiens
tgaatgagaacactgaaagagg

SEQ ID NO: 8027488 - DNA, 21 bp, Homo sapiens
tgaatgagcatctggactttt

SEQ ID NO: 8027489 - DNA, 21 bp, Homo sapiens
tgaatgaggaggatggcattt

SEQ ID NO: 8027490 - DNA, 21 bp, Homo sapiens
tgaatgagcatctggactttt

SEQ ID NO: 8027491 - DNA, 22 bp, Homo sapiens
tgaatgtgatgctaaacatatg

SEQ ID NO: 8027492 - DNA, 22 bp, Homo sapiens
tgaatgtgatgctaaacatatg

SEQ ID NO: 8027493 - DNA, 22 bp, Homo sapiens
tgaatgtgatgctaaacatatg

SEQ ID NO: 8027494 - DNA, 22 bp, Homo sapiens
tgaatgtatggtcctgtgaatt

SEQ ID NO: 8027495 - DNA, 22 bp, Homo sapiens
tgaatgtaggtctaatatccca

SEQ ID NO: 8027496 - DNA, 22 bp, Homo sapiens
tgaatgtaggcacatgcaaatg

SEQ ID NO: 8027497 - DNA, 22 bp, Homo sapiens
tgaatggtgattggtgcttctc

SEQ ID NO: 8027498 - DNA, 22 bp, Homo sapiens
tgaatgtaggcacatgcaaatg

SEQ ID NO: 8027499 - DNA, 22 bp, Homo sapiens
tgaatgtaccttgaaggtgtaa

SEQ ID NO: 8027500 - DNA, 22 bp, Homo sapiens
tgaatggtgattggtgcttctc

SEQ ID NO: 8027501 - DNA, 22 bp, Homo sapiens
tgaatggtcactgagcatctgt

SEQ ID NO: 8027502 - DNA, 22 bp, Homo sapiens
tgaatgttctctaaatactcct

SEQ ID NO: 8027503 - DNA, 22 bp, Homo sapiens
tgaatgttgatatgagtacaga

SEQ ID NO: 8027504 - DNA, 22 bp, Homo sapiens
tgaatgttctctaaatactcct

SEQ ID NO: 8027505 - DNA, 22 bp, Homo sapiens
tgaatgtgatgctaaacatatg

SEQ ID NO: 8027506 - DNA, 22 bp, Homo sapiens
tgaatgtgatgctaaacatatg

SEQ ID NO: 8027507 - DNA, 22 bp, Homo sapiens
tgaatgtgatgctaaacatatg

SEQ ID NO: 8027508 - DNA, 22 bp, Homo sapiens
tgaatgtgatgctaaacatatg

SEQ ID NO: 8027509 - DNA, 18 bp, Homo sapiens
tgaatgttttctggaccc

SEQ ID NO: 8027510 - DNA, 22 bp, Homo sapiens
tgaatgtttgatgagaaataga

SEQ ID NO: 8027511 - DNA, 23 bp, Homo sapiens
tgaatgtttattctcggtgcaga

SEQ ID NO: 8027512 - DNA, 23 bp, Homo sapiens
tgaatgtttattctcggtgcaga

SEQ ID NO: 8027513 - DNA, 22 bp, Homo sapiens
tgaattatcttgtaattttgaa

SEQ ID NO: 8027514 - DNA, 22 bp, Homo sapiens
tgaattcaaattgtgcctatta

SEQ ID NO: 8027515 - DNA, 22 bp, Homo sapiens
tgaattcaagttgttgagccat

SEQ ID NO: 8027516 - DNA, 22 bp, Homo sapiens
tgaattagcagtagacagactg

SEQ ID NO: 8027517 - DNA, 19 bp, Homo sapiens
tgaattagaattatcctct

SEQ ID NO: 8027518 - DNA, 22 bp, Homo sapiens
tgaattacatccatggacacac

SEQ ID NO: 8027519 - DNA, 22 bp, Homo sapiens
tgaattacatccatggacacac

SEQ ID NO: 8027520 - DNA, 22 bp, Homo sapiens
tgaatcagtataaattctcaaa

SEQ ID NO: 8027521 - DNA, 22 bp, Homo sapiens
tgaatcagtataaattctcaaa

SEQ ID NO: 8027522 - DNA, 22 bp, Homo sapiens
tgaatcctaattctatcactta

SEQ ID NO: 8027523 - DNA, 22 bp, Homo sapiens
tgaatcattttgctgtttgaac

SEQ ID NO: 8027524 - DNA, 22 bp, Homo sapiens
tgaatccagagctatttcgtcc

SEQ ID NO: 8027525 - DNA, 23 bp, Homo sapiens
tgaatcaattatgggattcaatg

SEQ ID NO: 8027526 - DNA, 22 bp, Homo sapiens
tgaatcaatgaattgcacttca

SEQ ID NO: 8027527 - DNA, 22 bp, Homo sapiens
tgaatcaatgaattgcacttca

SEQ ID NO: 8027528 - DNA, 22 bp, Homo sapiens
tgaatcagtataaattctcaaa

SEQ ID NO: 8027529 - DNA, 23 bp, Homo sapiens
tgaatcaattatgggattcaatg

SEQ ID NO: 8027530 - DNA, 22 bp, Homo sapiens
tgaatcaatagttgcaagtatt

SEQ ID NO: 8027531 - DNA, 22 bp, Homo sapiens
tgaatatgttcctcacaagttc

SEQ ID NO: 8027532 - DNA, 22 bp, Homo sapiens
tgaatatgtgactttgatttca

SEQ ID NO: 8027533 - DNA, 22 bp, Homo sapiens
tgaatatgggcagcaggactag

SEQ ID NO: 8027534 - DNA, 22 bp, Homo sapiens
tgaatatggcaactcttgtaac

SEQ ID NO: 8027535 - DNA, 22 bp, Homo sapiens
tgaatatgattgcaaatttggc

SEQ ID NO: 8027536 - DNA, 20 bp, Homo sapiens
tgaatatgaccttatttgga

SEQ ID NO: 8027537 - DNA, 22 bp, Homo sapiens
tgaatagtgttctataatatgg

SEQ ID NO: 8027538 - DNA, 22 bp, Homo sapiens
tgaatagtccttggaataactg

SEQ ID NO: 8027539 - DNA, 22 bp, Homo sapiens
tgaatagtaagagaatatttgc

SEQ ID NO: 8027540 - DNA, 22 bp, Homo sapiens
tgaatagttctactacttgaca

SEQ ID NO: 8027541 - DNA, 22 bp, Homo sapiens
tgaatagttctactacttgaca

SEQ ID NO: 8027542 - DNA, 22 bp, Homo sapiens
tgaatacactaaaaatcacttt

SEQ ID NO: 8027543 - DNA, 22 bp, Homo sapiens
tgaatacactaaaaatcacttt

SEQ ID NO: 8027544 - DNA, 22 bp, Homo sapiens
tgaataattcctttttgtcaag

SEQ ID NO: 8027545 - DNA, 22 bp, Homo sapiens
tgaatacactaaaaatcacttt

SEQ ID NO: 8027546 - DNA, 22 bp, Homo sapiens
tgaatacaggaaaatatactga

SEQ ID NO: 8027547 - DNA, 22 bp, Homo sapiens
tgaatacaggaaaatatactga

SEQ ID NO: 8027548 - DNA, 22 bp, Homo sapiens
tgaatacaggaaaatatactga

SEQ ID NO: 8027549 - DNA, 19 bp, Homo sapiens
tgaatacagagatacagaa

SEQ ID NO: 8027550 - DNA, 22 bp, Homo sapiens
tgaatacaggaaaatatactga

SEQ ID NO: 8027551 - DNA, 22 bp, Homo sapiens
tgaatacaggaaaatatactga

SEQ ID NO: 8027552 - DNA, 19 bp, Homo sapiens
tgaatacagagatacagaa

SEQ ID NO: 8027553 - DNA, 19 bp, Homo sapiens
tgaatacagagatacagaa

SEQ ID NO: 8027554 - DNA, 22 bp, Homo sapiens
tgaatactatttcataatgtgg

SEQ ID NO: 8027555 - DNA, 22 bp, Homo sapiens
tgaatagactggggctgtgaag

SEQ ID NO: 8027556 - DNA, 22 bp, Homo sapiens
tgaatactatttcataatgtgg

SEQ ID NO: 8027557 - DNA, 22 bp, Homo sapiens
tgaatacaggaaaatatactga

SEQ ID NO: 8027558 - DNA, 21 bp, Homo sapiens
tgaatagggccagaaccaaag

SEQ ID NO: 8027559 - DNA, 18 bp, Homo sapiens
tgaataggggtttgcaga

SEQ ID NO: 8027560 - DNA, 22 bp, Homo sapiens
tgaatagtccttggaataactg

SEQ ID NO: 8027561 - DNA, 22 bp, Homo sapiens
tgaatagatggtgacagtatga

SEQ ID NO: 8027562 - DNA, 22 bp, Homo sapiens
tgaattcttaatgaaatctact

SEQ ID NO: 8027563 - DNA, 20 bp, Homo sapiens
tgaattctgggtttatctgc

SEQ ID NO: 8027564 - DNA, 22 bp, Homo sapiens
tgaattctggccctctcactta

SEQ ID NO: 8027565 - DNA, 22 bp, Homo sapiens
tgaattctggccctctcactta

SEQ ID NO: 8027566 - DNA, 22 bp, Homo sapiens
tgaattctggccctctcactta

SEQ ID NO: 8027567 - DNA, 22 bp, Homo sapiens
tgaattctcatctcctgacact

SEQ ID NO: 8027568 - DNA, 22 bp, Homo sapiens
tgaattctctttcctggagcat

SEQ ID NO: 8027569 - DNA, 22 bp, Homo sapiens
tgaattccctgcaggcatcctc

SEQ ID NO: 8027570 - DNA, 22 bp, Homo sapiens
tgaattcaggttgacgttgcca

SEQ ID NO: 8027571 - DNA, 22 bp, Homo sapiens
tgaattccattgccaaagtttt

SEQ ID NO: 8027572 - DNA, 20 bp, Homo sapiens
tgaattctagatgactggag

SEQ ID NO: 8027573 - DNA, 20 bp, Homo sapiens
tgaattctagatgactggag

SEQ ID NO: 8027574 - DNA, 22 bp, Homo sapiens
tgaattctcacaagcctggaag

SEQ ID NO: 8027575 - DNA, 20 bp, Homo sapiens
tgaattctagatgactggag

SEQ ID NO: 8027576 - DNA, 17 bp, Homo sapiens
tgaattcaatctgcact

SEQ ID NO: 8027577 - DNA, 22 bp, Homo sapiens
tgaattcaagttgttgagccat

SEQ ID NO: 8027578 - DNA, 22 bp, Homo sapiens
tgaattcacacttccaaagaga

SEQ ID NO: 8027579 - DNA, 17 bp, Homo sapiens
tgaattcaatctgcact

SEQ ID NO: 8027580 - DNA, 22 bp, Homo sapiens
tgaattcaggggctattatatt

SEQ ID NO: 8027581 - DNA, 22 bp, Homo sapiens
tgaattcaggggctattatatt

SEQ ID NO: 8027582 - DNA, 22 bp, Homo sapiens
tgaattcaaattgtgcctatta

SEQ ID NO: 8027583 - DNA, 22 bp, Homo sapiens
tgaattcacctgaaagtctgga

SEQ ID NO: 8027584 - DNA, 22 bp, Homo sapiens
tgaattcataggacacagggtg

SEQ ID NO: 8027585 - DNA, 22 bp, Homo sapiens
tgaattcatacagtggatacca

SEQ ID NO: 8027586 - DNA, 22 bp, Homo sapiens
tgaattcatccatttatgcaag

SEQ ID NO: 8027587 - DNA, 22 bp, Homo sapiens
tgaattcatccatttatgcaag

SEQ ID NO: 8027588 - DNA, 22 bp, Homo sapiens
tgaattcataggacacagggtg

SEQ ID NO: 8027589 - DNA, 22 bp, Homo sapiens
tgaattcatacagtggatacca

SEQ ID NO: 8027590 - DNA, 22 bp, Homo sapiens
tgaattcaggttgacgttgcca

SEQ ID NO: 8027591 - DNA, 22 bp, Homo sapiens
tgaattcaggggctattatatt

SEQ ID NO: 8027592 - DNA, 22 bp, Homo sapiens
tgaattcaggtagcacctcccc

SEQ ID NO: 8027593 - DNA, 21 bp, Homo sapiens
tgaatttccctctatcattct

SEQ ID NO: 8027594 - DNA, 22 bp, Homo sapiens
tgaatttatcaaagattcttaa

SEQ ID NO: 8027595 - DNA, 22 bp, Homo sapiens
tgaatttatattgctgagagtt

SEQ ID NO: 8027596 - DNA, 22 bp, Homo sapiens
tgaatttaccttgcctatattt

SEQ ID NO: 8027597 - DNA, 22 bp, Homo sapiens
tgaatttaccttgcctatattt

SEQ ID NO: 8027598 - DNA, 21 bp, Homo sapiens
tgaatttcggtatggctataa

SEQ ID NO: 8027599 - DNA, 23 bp, Homo sapiens
tgaatttggaactcagagaatta

SEQ ID NO: 8027600 - DNA, 23 bp, Homo sapiens
tgaatttggaactcagagaatta

SEQ ID NO: 8027601 - DNA, 22 bp, Homo sapiens
tgaatttggcttgaggcagata

SEQ ID NO: 8027602 - DNA, 21 bp, Homo sapiens
tgaatttcggtatggctataa

SEQ ID NO: 8027603 - DNA, 23 bp, Homo sapiens
tgaattttggcatattctgaaat

SEQ ID NO: 8027604 - DNA, 23 bp, Homo sapiens
tgaattttggcatattctgaaat

SEQ ID NO: 8027605 - DNA, 22 bp, Homo sapiens
tgaatttggcttgaggcagata

SEQ ID NO: 8027606 - DNA, 23 bp, Homo sapiens
tgaattttggcatattctgaaat

SEQ ID NO: 8027607 - DNA, 22 bp, Homo sapiens
tgaatttaaaataaatgtagtt

SEQ ID NO: 8027608 - DNA, 22 bp, Homo sapiens
tgaatttaaaataaatgtagtt

SEQ ID NO: 8027609 - DNA, 22 bp, Homo sapiens
tgaatttaagcactgatgttaa

SEQ ID NO: 8027610 - DNA, 22 bp, Homo sapiens
tgaatttaagcactgatgttaa

SEQ ID NO: 8027611 - DNA, 22 bp, Homo sapiens
tgaattcttttagaattcagtg

SEQ ID NO: 8027612 - DNA, 22 bp, Homo sapiens
tgaattcttatctgggctgtgc

SEQ ID NO: 8027613 - DNA, 22 bp, Homo sapiens
tgaattcttatctgggctgtgc

SEQ ID NO: 8027614 - DNA, 22 bp, Homo sapiens
tgacaattgtgggcagtttgtg

SEQ ID NO: 8027615 - DNA, 22 bp, Homo sapiens
tgacaaattcatatttcagagg

SEQ ID NO: 8027616 - DNA, 22 bp, Homo sapiens
tgacaatttggcagagtctggc

SEQ ID NO: 8027617 - DNA, 22 bp, Homo sapiens
tgacacaaacaagatatttgcc

SEQ ID NO: 8027618 - DNA, 22 bp, Homo sapiens
tgacacaagagccctgtttgct

SEQ ID NO: 8027619 - DNA, 20 bp, Homo sapiens
tgacacaaattgctttctca

SEQ ID NO: 8027620 - DNA, 20 bp, Homo sapiens
tgacacaaattgctttctca

SEQ ID NO: 8027621 - DNA, 22 bp, Homo sapiens
tgacacaattgagtggtactat

SEQ ID NO: 8027622 - DNA, 22 bp, Homo sapiens
tgacacaattgagtggtactat

SEQ ID NO: 8027623 - DNA, 20 bp, Homo sapiens
tgacacaaattgctttctca

SEQ ID NO: 8027624 - DNA, 20 bp, Homo sapiens
tgacacaaattgctttctca

SEQ ID NO: 8027625 - DNA, 20 bp, Homo sapiens
tgacaaatgatctgattttc

SEQ ID NO: 8027626 - DNA, 22 bp, Homo sapiens
tgacaaatatttgaagaggctg

SEQ ID NO: 8027627 - DNA, 22 bp, Homo sapiens
tgacaaatatttgaagaggctg

SEQ ID NO: 8027628 - DNA, 22 bp, Homo sapiens
tgacaaatacaataagatctgt

SEQ ID NO: 8027629 - DNA, 22 bp, Homo sapiens
tgacaaatacaataagatctgt

SEQ ID NO: 8027630 - DNA, 22 bp, Homo sapiens
tgacaaatacaataagatctgt

SEQ ID NO: 8027631 - DNA, 23 bp, Homo sapiens
tgacaaagtcatctctccttctt

SEQ ID NO: 8027632 - DNA, 22 bp, Homo sapiens
tgacaaagtgaggtcttcagta

SEQ ID NO: 8027633 - DNA, 22 bp, Homo sapiens
tgacaaagtgaggtcttcagta

SEQ ID NO: 8027634 - DNA, 23 bp, Homo sapiens
tgacaaagcgagactccagctca

SEQ ID NO: 8027635 - DNA, 22 bp, Homo sapiens
tgacaaagcctcatccttcaga

SEQ ID NO: 8027636 - DNA, 22 bp, Homo sapiens
tgacaaagcatgatggtgacag

SEQ ID NO: 8027637 - DNA, 22 bp, Homo sapiens
tgacaaagcatgatggtgacag

SEQ ID NO: 8027638 - DNA, 22 bp, Homo sapiens
tgacaaagaggaacagcagggg

SEQ ID NO: 8027639 - DNA, 22 bp, Homo sapiens
tgacaaagaccttcaacaagat

SEQ ID NO: 8027640 - DNA, 22 bp, Homo sapiens
tgacaaaccctgcaaatagctc

SEQ ID NO: 8027641 - DNA, 22 bp, Homo sapiens
tgacaaactctttgagaacaag

SEQ ID NO: 8027642 - DNA, 22 bp, Homo sapiens
tgacaaacagggagtttgctca

SEQ ID NO: 8027643 - DNA, 22 bp, Homo sapiens
tgacaaaccagtagcaataaag

SEQ ID NO: 8027644 - DNA, 22 bp, Homo sapiens
tgacaaaccctgcaaatagctc

SEQ ID NO: 8027645 - DNA, 22 bp, Homo sapiens
tgacaaaactgcaattactttt

SEQ ID NO: 8027646 - DNA, 22 bp, Homo sapiens
tgacaaaactgcaattactttt

SEQ ID NO: 8027647 - DNA, 22 bp, Homo sapiens
tgacaaaactgcaattactttt

SEQ ID NO: 8027648 - DNA, 22 bp, Homo sapiens
tgacaaaactgcaattactttt

SEQ ID NO: 8027649 - DNA, 22 bp, Homo sapiens
tgacaaaactgcaattactttt

SEQ ID NO: 8027650 - DNA, 22 bp, Homo sapiens
tgacaaaactgcaattactttt

SEQ ID NO: 8027651 - DNA, 21 bp, Homo sapiens
tgaagggcagcctcaggctcc

SEQ ID NO: 8027652 - DNA, 21 bp, Homo sapiens
tgaagggcagcctcaggctcc

SEQ ID NO: 8027653 - DNA, 22 bp, Homo sapiens
tgaagggtggcatggcaggcag

SEQ ID NO: 8027654 - DNA, 22 bp, Homo sapiens
tgaagggtggcatggcaggcag

SEQ ID NO: 8027655 - DNA, 22 bp, Homo sapiens
tgaaggtaatggaatctcctga

SEQ ID NO: 8027656 - DNA, 22 bp, Homo sapiens
tgaaggggttcagcatgggggt

SEQ ID NO: 8027657 - DNA, 22 bp, Homo sapiens
tgaaggggttcagcatgggggt

SEQ ID NO: 8027658 - DNA, 22 bp, Homo sapiens
tgaaggcctccccgagcattag

SEQ ID NO: 8027659 - DNA, 22 bp, Homo sapiens
tgaaggctgggctcagccagct

SEQ ID NO: 8027660 - DNA, 22 bp, Homo sapiens
tgaaggctgggctcagccagct

SEQ ID NO: 8027661 - DNA, 22 bp, Homo sapiens
tgaaggctgggctcagccagct

SEQ ID NO: 8027662 - DNA, 22 bp, Homo sapiens
tgaaggcttgactgaggcagga

SEQ ID NO: 8027663 - DNA, 22 bp, Homo sapiens
tgaaggctttttaaagcatttg

SEQ ID NO: 8027664 - DNA, 22 bp, Homo sapiens
tgaaggcttttagctctgaaaa

SEQ ID NO: 8027665 - DNA, 22 bp, Homo sapiens
tgaagggcaaccccaggcccag

SEQ ID NO: 8027666 - DNA, 22 bp, Homo sapiens
tgaaggctttttaaagcatttg

SEQ ID NO: 8027667 - DNA, 22 bp, Homo sapiens
tgaaggcttggtggcagcctct

SEQ ID NO: 8027668 - DNA, 22 bp, Homo sapiens
tgaaggctttctcccctctggt

SEQ ID NO: 8027669 - DNA, 22 bp, Homo sapiens
tgaaggcttggattggtcattt

SEQ ID NO: 8027670 - DNA, 22 bp, Homo sapiens
tgaaggcttggattggtcattt

SEQ ID NO: 8027671 - DNA, 22 bp, Homo sapiens
tgaaggccagggatttgcagcc

SEQ ID NO: 8027672 - DNA, 22 bp, Homo sapiens
tgaaggccagggatttgcagcc

SEQ ID NO: 8027673 - DNA, 22 bp, Homo sapiens
tgaaggccagggatttgcagcc

SEQ ID NO: 8027674 - DNA, 22 bp, Homo sapiens
tgaaggccagcagagtgaaggc

SEQ ID NO: 8027675 - DNA, 20 bp, Homo sapiens
tgaaggccagcagcataggg

SEQ ID NO: 8027676 - DNA, 22 bp, Homo sapiens
tgaaggccagcagagtgaaggc

SEQ ID NO: 8027677 - DNA, 22 bp, Homo sapiens
tgaaggccacttcctgtgagct

SEQ ID NO: 8027678 - DNA, 22 bp, Homo sapiens
tgaaggcccagccacagaatgg

SEQ ID NO: 8027679 - DNA, 20 bp, Homo sapiens
tgaaggccctataattcaat

SEQ ID NO: 8027680 - DNA, 22 bp, Homo sapiens
tgaaggcccagccacagaatgg

SEQ ID NO: 8027681 - DNA, 22 bp, Homo sapiens
tgaaggcctaacttccagtgct

SEQ ID NO: 8027682 - DNA, 22 bp, Homo sapiens
tgaaggcctaacttccagtgct

SEQ ID NO: 8027683 - DNA, 23 bp, Homo sapiens
tgaaggccctggagccacgaggc

SEQ ID NO: 8027684 - DNA, 22 bp, Homo sapiens
tgaaggcagcatgcacactagt

SEQ ID NO: 8027685 - DNA, 22 bp, Homo sapiens
tgaaggcacttgcctaggggca

SEQ ID NO: 8027686 - DNA, 22 bp, Homo sapiens
tgaaggcacttgcctaggggca

SEQ ID NO: 8027687 - DNA, 22 bp, Homo sapiens
tgaaggcagcatgcacactagt

SEQ ID NO: 8027688 - DNA, 22 bp, Homo sapiens
tgaaggcagcatgcacactagt

SEQ ID NO: 8027689 - DNA, 20 bp, Homo sapiens
tgaaggcaggtaagaaagat

SEQ ID NO: 8027690 - DNA, 22 bp, Homo sapiens
tgaaggcagcatgcacactagt

SEQ ID NO: 8027691 - DNA, 22 bp, Homo sapiens
tgaaggcagtgagtttgtgttt

SEQ ID NO: 8027692 - DNA, 22 bp, Homo sapiens
tgaaggcagtgagtttgtgttt

SEQ ID NO: 8027693 - DNA, 22 bp, Homo sapiens
tgaaggcagtgattttgtttgg

SEQ ID NO: 8027694 - DNA, 22 bp, Homo sapiens
tgaaggcatttgagttggtgag

SEQ ID NO: 8027695 - DNA, 22 bp, Homo sapiens
tgaaggcatttgagttggtgag

SEQ ID NO: 8027696 - DNA, 22 bp, Homo sapiens
tgaaggcatttgagttggtgag

SEQ ID NO: 8027697 - DNA, 22 bp, Homo sapiens
tgaaggcattgatgaaggaatc

SEQ ID NO: 8027698 - DNA, 22 bp, Homo sapiens
tgaaggcattgatgaaggaatc

SEQ ID NO: 8027699 - DNA, 22 bp, Homo sapiens
tgaaggcattgatgaaggaatc

SEQ ID NO: 8027700 - DNA, 22 bp, Homo sapiens
tgaaggcataaatcttgggaac

SEQ ID NO: 8027701 - DNA, 22 bp, Homo sapiens
tgaaggcattgatgaaggaatc

SEQ ID NO: 8027702 - DNA, 22 bp, Homo sapiens
tgaaggcataaatcttgggaac

SEQ ID NO: 8027703 - DNA, 22 bp, Homo sapiens
tgaaggcataaatcttgggaac

SEQ ID NO: 8027704 - DNA, 22 bp, Homo sapiens
tgaaggcattgatgaaggaatc

SEQ ID NO: 8027705 - DNA, 22 bp, Homo sapiens
tgaaggcataaatcttgggaac

SEQ ID NO: 8027706 - DNA, 22 bp, Homo sapiens
tgaaggcataaatcttgggaac

SEQ ID NO: 8027707 - DNA, 22 bp, Homo sapiens
tgaaggcataaatcttgggaac

SEQ ID NO: 8027708 - DNA, 22 bp, Homo sapiens
tgaataatcttgggtattaata

SEQ ID NO: 8027709 - DNA, 22 bp, Homo sapiens
tgaataatccacagtcattcat

SEQ ID NO: 8027710 - DNA, 22 bp, Homo sapiens
tgaataatccacagtcattcat

SEQ ID NO: 8027711 - DNA, 19 bp, Homo sapiens
tgaataacaataatggcta

SEQ ID NO: 8027712 - DNA, 22 bp, Homo sapiens
tgaataagaattattataatga

SEQ ID NO: 8027713 - DNA, 22 bp, Homo sapiens
tgaataatcatgtccatagtgt

SEQ ID NO: 8027714 - DNA, 22 bp, Homo sapiens
tgaataaattgagagcgaatgt

SEQ ID NO: 8027715 - DNA, 22 bp, Homo sapiens
tgaataagaattattataatga

SEQ ID NO: 8027716 - DNA, 21 bp, Homo sapiens
tgaataaagctgctgtcgata

SEQ ID NO: 8027717 - DNA, 21 bp, Homo sapiens
tgaataaagctgctgtcgata

SEQ ID NO: 8027718 - DNA, 22 bp, Homo sapiens
tgaagttttctggttgattaag

SEQ ID NO: 8027719 - DNA, 22 bp, Homo sapiens
tgaataaactatgaggaggaat

SEQ ID NO: 8027720 - DNA, 22 bp, Homo sapiens
tgaataaactatgaggaggaat

SEQ ID NO: 8027721 - DNA, 22 bp, Homo sapiens
tgaataaactatgaggaggaat

SEQ ID NO: 8027722 - DNA, 22 bp, Homo sapiens
tgaagttttactaggtgaattt

SEQ ID NO: 8027723 - DNA, 22 bp, Homo sapiens
tgaagttgttaaggttgccatt

SEQ ID NO: 8027724 - DNA, 22 bp, Homo sapiens
tgaaggtggggcttaggaatct

SEQ ID NO: 8027725 - DNA, 22 bp, Homo sapiens
tgaagtttaaggttagataagt

SEQ ID NO: 8027726 - DNA, 22 bp, Homo sapiens
tgaaggtgagcatttgctgatt

SEQ ID NO: 8027727 - DNA, 22 bp, Homo sapiens
tgaaggtgattatgaatgtata

SEQ ID NO: 8027728 - DNA, 22 bp, Homo sapiens
tgaaggtggcataggagagatg

SEQ ID NO: 8027729 - DNA, 22 bp, Homo sapiens
tgaaggtggcataggagagatg

SEQ ID NO: 8027730 - DNA, 22 bp, Homo sapiens
tgaaggtgggaattcaccaggt

SEQ ID NO: 8027731 - DNA, 22 bp, Homo sapiens
tgaaggtgaaagattgaagcca

SEQ ID NO: 8027732 - DNA, 22 bp, Homo sapiens
tgaaggtgaatgtctatgggga

SEQ ID NO: 8027733 - DNA, 23 bp, Homo sapiens
tgaaggtattacctgagatgctc

SEQ ID NO: 8027734 - DNA, 22 bp, Homo sapiens
tgaaggtacagatattttgtaa

SEQ ID NO: 8027735 - DNA, 22 bp, Homo sapiens
tgaaggtgaatgtctatgggga

SEQ ID NO: 8027736 - DNA, 22 bp, Homo sapiens
tgaaggtgacctgacagtggct

SEQ ID NO: 8027737 - DNA, 22 bp, Homo sapiens
tgaagccattactgtgttaggg

SEQ ID NO: 8027738 - DNA, 22 bp, Homo sapiens
tgaagccatcaggaagccagca

SEQ ID NO: 8027739 - DNA, 22 bp, Homo sapiens
tgaagccatcaggaagccagca

SEQ ID NO: 8027740 - DNA, 22 bp, Homo sapiens
tgaagccatcaggaagccagca

SEQ ID NO: 8027741 - DNA, 22 bp, Homo sapiens
tgaagccatccctcagatggcc

SEQ ID NO: 8027742 - DNA, 22 bp, Homo sapiens
tgaagcccttcatgcacagtca

SEQ ID NO: 8027743 - DNA, 22 bp, Homo sapiens
tgaagccctgtgtcagcttcca

SEQ ID NO: 8027744 - DNA, 22 bp, Homo sapiens
tgaagccctgtgtcagcttcca

SEQ ID NO: 8027745 - DNA, 22 bp, Homo sapiens
tgaagctatataagttacagca

SEQ ID NO: 8027746 - DNA, 22 bp, Homo sapiens
tgaagctatataagttacagca

SEQ ID NO: 8027747 - DNA, 22 bp, Homo sapiens
tgaagcagttctcagaagtggg

SEQ ID NO: 8027748 - DNA, 22 bp, Homo sapiens
tgaagcagttctcagaagtggg

SEQ ID NO: 8027749 - DNA, 22 bp, Homo sapiens
tgaagcagttctcagaagtggg

SEQ ID NO: 8027750 - DNA, 22 bp, Homo sapiens
tgaagcatctggtctgagaatt

SEQ ID NO: 8027751 - DNA, 22 bp, Homo sapiens
tgaagccaatctgccaggcaga

SEQ ID NO: 8027752 - DNA, 22 bp, Homo sapiens
tgaagccaaggatgcctttctc

SEQ ID NO: 8027753 - DNA, 22 bp, Homo sapiens
tgaagccacagagcatctgcct

SEQ ID NO: 8027754 - DNA, 22 bp, Homo sapiens
tgaagccacagagcatctgcct

SEQ ID NO: 8027755 - DNA, 22 bp, Homo sapiens
tgaagccacagagcatctgcct

SEQ ID NO: 8027756 - DNA, 22 bp, Homo sapiens
tgaagccacactagcttgtcct

SEQ ID NO: 8027757 - DNA, 22 bp, Homo sapiens
tgaagccaatctgccaggcaga

SEQ ID NO: 8027758 - DNA, 22 bp, Homo sapiens
tgaagccactttccagaatcac

SEQ ID NO: 8027759 - DNA, 22 bp, Homo sapiens
tgaagccactttccagaatcac

SEQ ID NO: 8027760 - DNA, 22 bp, Homo sapiens
tgaagccaccgaaccagaagag

SEQ ID NO: 8027761 - DNA, 22 bp, Homo sapiens
tgaagccactttccagaatcac

SEQ ID NO: 8027762 - DNA, 22 bp, Homo sapiens
tgaagccataggacagaggata

SEQ ID NO: 8027763 - DNA, 22 bp, Homo sapiens
tgaagccagggactgacacttc

SEQ ID NO: 8027764 - DNA, 22 bp, Homo sapiens
tgaagccagtcaatgttaagtt

SEQ ID NO: 8027765 - DNA, 22 bp, Homo sapiens
tgaagccagctttggaagacac

SEQ ID NO: 8027766 - DNA, 22 bp, Homo sapiens
tgaaggagggaagaaggctctg

SEQ ID NO: 8027767 - DNA, 22 bp, Homo sapiens
tgaaggagggaagaaggctctg

SEQ ID NO: 8027768 - DNA, 22 bp, Homo sapiens
tgaaggagggaagaaggctctg

SEQ ID NO: 8027769 - DNA, 19 bp, Homo sapiens
tgaaggagggggatggcca

SEQ ID NO: 8027770 - DNA, 19 bp, Homo sapiens
tgaaggagggggatggcca

SEQ ID NO: 8027771 - DNA, 19 bp, Homo sapiens
tgaaggagggggatggcca

SEQ ID NO: 8027772 - DNA, 19 bp, Homo sapiens
tgaaggagggggatggcca

SEQ ID NO: 8027773 - DNA, 22 bp, Homo sapiens
tgaaggaggaatgtggcctcca

SEQ ID NO: 8027774 - DNA, 22 bp, Homo sapiens
tgaaggagggaagaaggctctg

SEQ ID NO: 8027775 - DNA, 22 bp, Homo sapiens
tgaaggaggaatgtggcctcca

SEQ ID NO: 8027776 - DNA, 22 bp, Homo sapiens
tgaaggaggaatgtggcctcca

SEQ ID NO: 8027777 - DNA, 22 bp, Homo sapiens
tgaaggagctgatgtaaggggt

SEQ ID NO: 8027778 - DNA, 22 bp, Homo sapiens
tgaaggaggaatgtggcctcca

SEQ ID NO: 8027779 - DNA, 22 bp, Homo sapiens
tgaaggagctgatgtaaggggt

SEQ ID NO: 8027780 - DNA, 22 bp, Homo sapiens
tgaaggcacgtgggtggatact

SEQ ID NO: 8027781 - DNA, 22 bp, Homo sapiens
tgaaggcacgtgggtggatact

SEQ ID NO: 8027782 - DNA, 22 bp, Homo sapiens
tgaaggcacagtttaaccagta

SEQ ID NO: 8027783 - DNA, 22 bp, Homo sapiens
tgaaggcacagtttaaccagta

SEQ ID NO: 8027784 - DNA, 22 bp, Homo sapiens
tgaaggcacgtgggtggatact

SEQ ID NO: 8027785 - DNA, 22 bp, Homo sapiens
tgaaggcacagtttaaccagta

SEQ ID NO: 8027786 - DNA, 22 bp, Homo sapiens
tgaaggcacttgcctaggggca

SEQ ID NO: 8027787 - DNA, 22 bp, Homo sapiens
tgaaggcacgtgggtggatact

SEQ ID NO: 8027788 - DNA, 22 bp, Homo sapiens
tgaaggcacgtgggtggatact

SEQ ID NO: 8027789 - DNA, 22 bp, Homo sapiens
tgaaggcacttgcctaggggca

SEQ ID NO: 8027790 - DNA, 22 bp, Homo sapiens
tgaaggcacttgcctaggggca

SEQ ID NO: 8027791 - DNA, 19 bp, Homo sapiens
tgaaggagggggatggcca

SEQ ID NO: 8027792 - DNA, 22 bp, Homo sapiens
tgaaggcaaaacatgttacacc

SEQ ID NO: 8027793 - DNA, 22 bp, Homo sapiens
tgaaggcaacctctgtggtcct

SEQ ID NO: 8027794 - DNA, 22 bp, Homo sapiens
tgaaggcaaaacatgttacacc

SEQ ID NO: 8027795 - DNA, 22 bp, Homo sapiens
tgaaggcaactgagaaaaagca

SEQ ID NO: 8027796 - DNA, 22 bp, Homo sapiens
tgaaggcaacctctgtggtcct

SEQ ID NO: 8027797 - DNA, 22 bp, Homo sapiens
tgaaggagatttttagggaggc

SEQ ID NO: 8027798 - DNA, 22 bp, Homo sapiens
tgaaggagctcaatgatgatgc

SEQ ID NO: 8027799 - DNA, 22 bp, Homo sapiens
tgaaggagatttttagggaggc

SEQ ID NO: 8027800 - DNA, 22 bp, Homo sapiens
tgaagcttgtatttaaataagt

SEQ ID NO: 8027801 - DNA, 22 bp, Homo sapiens
tgaaggagatttttagggaggc

SEQ ID NO: 8027802 - DNA, 21 bp, Homo sapiens
tgaaggagaggaccgagtgct

SEQ ID NO: 8027803 - DNA, 22 bp, Homo sapiens
tgaagcttgtatttaaataagt

SEQ ID NO: 8027804 - DNA, 22 bp, Homo sapiens
tgaaggagctcaatgatgatgc

SEQ ID NO: 8027805 - DNA, 22 bp, Homo sapiens
tgaaggagctcaggagatagtc

SEQ ID NO: 8027806 - DNA, 22 bp, Homo sapiens
tgaaggagctcaggagatagtc

SEQ ID NO: 8027807 - DNA, 22 bp, Homo sapiens
tgaaggagctcaggagatagtc

SEQ ID NO: 8027808 - DNA, 22 bp, Homo sapiens
tgaaggagctcaggagatagtc

SEQ ID NO: 8027809 - DNA, 22 bp, Homo sapiens
tgaaggagctcaggagatagtc

SEQ ID NO: 8027810 - DNA, 22 bp, Homo sapiens
tgaaggagctgatgtaaggggt

SEQ ID NO: 8027811 - DNA, 22 bp, Homo sapiens
tgaaggagctgatgtaaggggt

SEQ ID NO: 8027812 - DNA, 22 bp, Homo sapiens
tgaagctggcttgacatggcct

SEQ ID NO: 8027813 - DNA, 22 bp, Homo sapiens
tgaagctggcttgacatggcct

SEQ ID NO: 8027814 - DNA, 22 bp, Homo sapiens
tgaagctggttgtatgactgga

SEQ ID NO: 8027815 - DNA, 22 bp, Homo sapiens
tgaagctggaagcatgcagact

SEQ ID NO: 8027816 - DNA, 22 bp, Homo sapiens
tgaagctgcctgctcacagcca

SEQ ID NO: 8027817 - DNA, 22 bp, Homo sapiens
tgaagctgcctgctcacagcca

SEQ ID NO: 8027818 - DNA, 22 bp, Homo sapiens
tgaagctggaagcatgcagact

SEQ ID NO: 8027819 - DNA, 22 bp, Homo sapiens
tgaagctggaagttaggtagac

SEQ ID NO: 8027820 - DNA, 22 bp, Homo sapiens
tgaagctgtccttgataggggc

SEQ ID NO: 8027821 - DNA, 22 bp, Homo sapiens
tgaagctgtgggcagtggagcc

SEQ ID NO: 8027822 - DNA, 22 bp, Homo sapiens
tgaagctgtgggcagtggagcc

SEQ ID NO: 8027823 - DNA, 22 bp, Homo sapiens
tgaagctgtccttgataggggc

SEQ ID NO: 8027824 - DNA, 22 bp, Homo sapiens
tgaagctgtaggcatgggcagc

SEQ ID NO: 8027825 - DNA, 22 bp, Homo sapiens
tgaagctggttgtatgactgga

SEQ ID NO: 8027826 - DNA, 22 bp, Homo sapiens
tgaagctggttgtatgactgga

SEQ ID NO: 8027827 - DNA, 22 bp, Homo sapiens
tcttttctccagacctgggatc

SEQ ID NO: 8027828 - DNA, 22 bp, Homo sapiens
tcttttctccagacctgggatc

SEQ ID NO: 8027829 - DNA, 21 bp, Homo sapiens
tcttttctctgcaggattcct

SEQ ID NO: 8027830 - DNA, 22 bp, Homo sapiens
tcttttctgccacagcctgagc

SEQ ID NO: 8027831 - DNA, 22 bp, Homo sapiens
tcttttgtggatgaagaaatgg

SEQ ID NO: 8027832 - DNA, 21 bp, Homo sapiens
tcttttctctgcaggattcct

SEQ ID NO: 8027833 - DNA, 22 bp, Homo sapiens
tcttttcattgagaacacactg

SEQ ID NO: 8027834 - DNA, 21 bp, Homo sapiens
tcttttcctttctgtgtgcaa

SEQ ID NO: 8027835 - DNA, 21 bp, Homo sapiens
tcttttcctttctgtgtgcaa

SEQ ID NO: 8027836 - DNA, 22 bp, Homo sapiens
tcttttctagcaaatccaggag

SEQ ID NO: 8027837 - DNA, 21 bp, Homo sapiens
tcttttctcagctttgtggtt

SEQ ID NO: 8027838 - DNA, 21 bp, Homo sapiens
tcttttctcagctttgtggtt

SEQ ID NO: 8027839 - DNA, 21 bp, Homo sapiens
tcttttctcagctttgtggtt

SEQ ID NO: 8027840 - DNA, 21 bp, Homo sapiens
tcttttctcagctttgtggtt

SEQ ID NO: 8027841 - DNA, 22 bp, Homo sapiens
tcttttctagcaaatccaggag

SEQ ID NO: 8027842 - DNA, 21 bp, Homo sapiens
tcttttctcagctttgtggtt

SEQ ID NO: 8027843 - DNA, 22 bp, Homo sapiens
tcttttccttccctacagatct

SEQ ID NO: 8027844 - DNA, 22 bp, Homo sapiens
tcttttccttccctacagatct

SEQ ID NO: 8027845 - DNA, 18 bp, Homo sapiens
tcttttccttccacttcc

SEQ ID NO: 8027846 - DNA, 18 bp, Homo sapiens
tcttttccttccacttcc

SEQ ID NO: 8027847 - DNA, 21 bp, Homo sapiens
tcttttcctttctgtgtgcaa

SEQ ID NO: 8027848 - DNA, 22 bp, Homo sapiens
tcttttccttgatggttaaata

SEQ ID NO: 8027849 - DNA, 22 bp, Homo sapiens
tcttttccttgatggttaaata

SEQ ID NO: 8027850 - DNA, 22 bp, Homo sapiens
tcttttccttgatggttaaata

SEQ ID NO: 8027851 - DNA, 22 bp, Homo sapiens
tcttttcattgagaacacactg

SEQ ID NO: 8027852 - DNA, 22 bp, Homo sapiens
tcttttcctcctcttgttggcc

SEQ ID NO: 8027853 - DNA, 22 bp, Homo sapiens
tcttttcctcctcttgttggcc

SEQ ID NO: 8027854 - DNA, 18 bp, Homo sapiens
tcttttccttccacttcc

SEQ ID NO: 8027855 - DNA, 18 bp, Homo sapiens
tcttttccttccacttcc

SEQ ID NO: 8027856 - DNA, 22 bp, Homo sapiens
tcttttcctcctcttgttggcc

SEQ ID NO: 8027857 - DNA, 18 bp, Homo sapiens
tcttttccttccacttcc

SEQ ID NO: 8027858 - DNA, 18 bp, Homo sapiens
tcttttccttccacttcc

SEQ ID NO: 8027859 - DNA, 20 bp, Homo sapiens
tcttttattggcagatcctg

SEQ ID NO: 8027860 - DNA, 20 bp, Homo sapiens
tcttttattggcagatcctg

SEQ ID NO: 8027861 - DNA, 20 bp, Homo sapiens
tcttttattggcagatcctg

SEQ ID NO: 8027862 - DNA, 22 bp, Homo sapiens
tcttttattaggctgaaatggg

SEQ ID NO: 8027863 - DNA, 22 bp, Homo sapiens
tcttttattaggctgaaatggg

SEQ ID NO: 8027864 - DNA, 22 bp, Homo sapiens
tcttttattaggctgaaatggg

SEQ ID NO: 8027865 - DNA, 22 bp, Homo sapiens
tcttttattaggctgaaatggg

SEQ ID NO: 8027866 - DNA, 22 bp, Homo sapiens
tcttttattaggctgaaatggg

SEQ ID NO: 8027867 - DNA, 22 bp, Homo sapiens
tcttttatctgttgtgtaacaa

SEQ ID NO: 8027868 - DNA, 22 bp, Homo sapiens
tcttttatctgttgtgtaacaa

SEQ ID NO: 8027869 - DNA, 22 bp, Homo sapiens
tcttttatctgttgtgtaacaa

SEQ ID NO: 8027870 - DNA, 22 bp, Homo sapiens
tcttttatcctacatttagctc

SEQ ID NO: 8027871 - DNA, 23 bp, Homo sapiens
tcttttcaatggttctttatgtg

SEQ ID NO: 8027872 - DNA, 22 bp, Homo sapiens
tcttttattaggctgaaatggg

SEQ ID NO: 8027873 - DNA, 20 bp, Homo sapiens
tcttttattggcagatcctg

SEQ ID NO: 8027874 - DNA, 23 bp, Homo sapiens
tcttttcaatggttctttatgtg

SEQ ID NO: 8027875 - DNA, 23 bp, Homo sapiens
tcttttcaatggttctttatgtg

SEQ ID NO: 8027876 - DNA, 23 bp, Homo sapiens
tcttttcaatggttctttatgtg

SEQ ID NO: 8027877 - DNA, 22 bp, Homo sapiens
tcttttcacagacaaatggaga

SEQ ID NO: 8027878 - DNA, 22 bp, Homo sapiens
tcttttcacagacaaatggaga

SEQ ID NO: 8027879 - DNA, 22 bp, Homo sapiens
tcttttcacaaaggagctggag

SEQ ID NO: 8027880 - DNA, 22 bp, Homo sapiens
tcttttcacaaaggagctggag

SEQ ID NO: 8027881 - DNA, 19 bp, Homo sapiens
tcttttcacgcattttgaa

SEQ ID NO: 8027882 - DNA, 22 bp, Homo sapiens
tcttttcacagacaaatggaga

SEQ ID NO: 8027883 - DNA, 22 bp, Homo sapiens
tcttttcaggaatggctctagt

SEQ ID NO: 8027884 - DNA, 22 bp, Homo sapiens
tcttttcaggaatggctctagt

SEQ ID NO: 8027885 - DNA, 22 bp, Homo sapiens
tcttttcatcatttaataggta

SEQ ID NO: 8027886 - DNA, 22 bp, Homo sapiens
tcttttcatcatttaataggta

SEQ ID NO: 8027887 - DNA, 22 bp, Homo sapiens
tcttttcatcatttaataggta

SEQ ID NO: 8027888 - DNA, 22 bp, Homo sapiens
tcttttcatcatttaataggta

SEQ ID NO: 8027889 - DNA, 22 bp, Homo sapiens
tcttttcattgagaacacactg

SEQ ID NO: 8027890 - DNA, 22 bp, Homo sapiens
tcttttcatcatttaataggta

SEQ ID NO: 8027891 - DNA, 22 bp, Homo sapiens
tcttttagaaaagttgaatgta

SEQ ID NO: 8027892 - DNA, 22 bp, Homo sapiens
tcttttaagcctctggcatagg

SEQ ID NO: 8027893 - DNA, 22 bp, Homo sapiens
tcttttaagcctctggcatagg

SEQ ID NO: 8027894 - DNA, 22 bp, Homo sapiens
tcttttaagcctctggcatagg

SEQ ID NO: 8027895 - DNA, 22 bp, Homo sapiens
tcttttaagcctctggcatagg

SEQ ID NO: 8027896 - DNA, 21 bp, Homo sapiens
tcttttaacaccaggaattcc

SEQ ID NO: 8027897 - DNA, 21 bp, Homo sapiens
tcttttaacaccaggaattcc

SEQ ID NO: 8027898 - DNA, 21 bp, Homo sapiens
tcttttaacaccaggaattcc

SEQ ID NO: 8027899 - DNA, 21 bp, Homo sapiens
tcttttaacaccaggaattcc

SEQ ID NO: 8027900 - DNA, 21 bp, Homo sapiens
tcttttaacaccaggaattcc

SEQ ID NO: 8027901 - DNA, 22 bp, Homo sapiens
tcttttaacctaactagcttgg

SEQ ID NO: 8027902 - DNA, 21 bp, Homo sapiens
tcttttaacaccaggaattcc

SEQ ID NO: 8027903 - DNA, 22 bp, Homo sapiens
tcttttaacctaactagcttgg

SEQ ID NO: 8027904 - DNA, 22 bp, Homo sapiens
tcttttagtaataaatatttgt

SEQ ID NO: 8027905 - DNA, 22 bp, Homo sapiens
tcttttatagtgaattttcttg

SEQ ID NO: 8027906 - DNA, 22 bp, Homo sapiens
tcttttagtaataaatatttgt

SEQ ID NO: 8027907 - DNA, 22 bp, Homo sapiens
tcttttagagcatttctgattc

SEQ ID NO: 8027908 - DNA, 22 bp, Homo sapiens
tcttttatagtgaattttcttg

SEQ ID NO: 8027909 - DNA, 22 bp, Homo sapiens
tcttttatagtgaattttcttg

SEQ ID NO: 8027910 - DNA, 22 bp, Homo sapiens
tcttttatagtgaattttcttg

SEQ ID NO: 8027911 - DNA, 22 bp, Homo sapiens
tcttttatcctacatttagctc

SEQ ID NO: 8027912 - DNA, 22 bp, Homo sapiens
tcttttatcctacatttagctc

SEQ ID NO: 8027913 - DNA, 22 bp, Homo sapiens
tcttttatcctacatttagctc

SEQ ID NO: 8027914 - DNA, 22 bp, Homo sapiens
tcttttatcctacatttagctc

SEQ ID NO: 8027915 - DNA, 22 bp, Homo sapiens
tcttttatagtgaattttcttg

SEQ ID NO: 8027916 - DNA, 22 bp, Homo sapiens
tctttgtttgtactgttagaat

SEQ ID NO: 8027917 - DNA, 22 bp, Homo sapiens
tctttgtttgtactgttagaat

SEQ ID NO: 8027918 - DNA, 22 bp, Homo sapiens
tctttgtttgtactgttagaat

SEQ ID NO: 8027919 - DNA, 21 bp, Homo sapiens
tcttttaacaccaggaattcc

SEQ ID NO: 8027920 - DNA, 22 bp, Homo sapiens
tctttgtttgcctttatcaaga

SEQ ID NO: 8027921 - DNA, 22 bp, Homo sapiens
tctttgtttgcctttatcaaga

SEQ ID NO: 8027922 - DNA, 22 bp, Homo sapiens
tctttgtttgtactgttagaat

SEQ ID NO: 8027923 - DNA, 22 bp, Homo sapiens
tctttgtttgcctttatcaaga

SEQ ID NO: 8027924 - DNA, 22 bp, Homo sapiens
tctttgtgttcaggagccacgt

SEQ ID NO: 8027925 - DNA, 20 bp, Homo sapiens
tctttgttaattttatctcc

SEQ ID NO: 8027926 - DNA, 20 bp, Homo sapiens
tctttgtgtcagatggacag

SEQ ID NO: 8027927 - DNA, 20 bp, Homo sapiens
tctttgttaattttatctcc

SEQ ID NO: 8027928 - DNA, 20 bp, Homo sapiens
tctttgttaattttatctcc

SEQ ID NO: 8027929 - DNA, 22 bp, Homo sapiens
tctttgttattgctttatctat

SEQ ID NO: 8027930 - DNA, 22 bp, Homo sapiens
tctttgttattgctttatctat

SEQ ID NO: 8027931 - DNA, 22 bp, Homo sapiens
tctttgttattgctttatctat

SEQ ID NO: 8027932 - DNA, 22 bp, Homo sapiens
tctttggattaaaatatttgta

SEQ ID NO: 8027933 - DNA, 22 bp, Homo sapiens
tctttggcacttctgttttaag

SEQ ID NO: 8027934 - DNA, 22 bp, Homo sapiens
tctttggatggaaattggagtc

SEQ ID NO: 8027935 - DNA, 22 bp, Homo sapiens
tctttggatggaaattggagtc

SEQ ID NO: 8027936 - DNA, 22 bp, Homo sapiens
tctttggattaaaatatttgta

SEQ ID NO: 8027937 - DNA, 22 bp, Homo sapiens
tctttggattaaaatatttgta

SEQ ID NO: 8027938 - DNA, 22 bp, Homo sapiens
tctttggcatcagggccagcta

SEQ ID NO: 8027939 - DNA, 22 bp, Homo sapiens
tctttggcatcagggccagcta

SEQ ID NO: 8027940 - DNA, 22 bp, Homo sapiens
tctttggcatttaggagcagga

SEQ ID NO: 8027941 - DNA, 22 bp, Homo sapiens
tctttggcatcagggccagcta

SEQ ID NO: 8027942 - DNA, 22 bp, Homo sapiens
tctttggcatcagggccagcta

SEQ ID NO: 8027943 - DNA, 22 bp, Homo sapiens
tctttggcatttaggagcagga

SEQ ID NO: 8027944 - DNA, 22 bp, Homo sapiens
tctttgtaaatgcctagcataa

SEQ ID NO: 8027945 - DNA, 22 bp, Homo sapiens
tctttgtaactgtctattgaga

SEQ ID NO: 8027946 - DNA, 22 bp, Homo sapiens
tctttgtaagaaattcttccgt

SEQ ID NO: 8027947 - DNA, 22 bp, Homo sapiens
tctttgtaactgtctattgaga

SEQ ID NO: 8027948 - DNA, 22 bp, Homo sapiens
tctttgtacaggaaggcactgt

SEQ ID NO: 8027949 - DNA, 16 bp, Homo sapiens
tctttgtaatcagcag

SEQ ID NO: 8027950 - DNA, 22 bp, Homo sapiens
tctttgtaagttatatgtagta

SEQ ID NO: 8027951 - DNA, 22 bp, Homo sapiens
tctttgtaagttatatgtagta

SEQ ID NO: 8027952 - DNA, 22 bp, Homo sapiens
tctttgtggcgggcttaaatac

SEQ ID NO: 8027953 - DNA, 22 bp, Homo sapiens
tctttggatatgtatggataga

SEQ ID NO: 8027954 - DNA, 22 bp, Homo sapiens
tctttggatatgtatggataga

SEQ ID NO: 8027955 - DNA, 22 bp, Homo sapiens
tctttggatatcgctagaccgt

SEQ ID NO: 8027956 - DNA, 22 bp, Homo sapiens
tctttggatcccaactggctgg

SEQ ID NO: 8027957 - DNA, 22 bp, Homo sapiens
tctttggatatgtatggataga

SEQ ID NO: 8027958 - DNA, 22 bp, Homo sapiens
tctttggagtgttatcagtaat

SEQ ID NO: 8027959 - DNA, 22 bp, Homo sapiens
tctttggagtgttatcagtaat

SEQ ID NO: 8027960 - DNA, 22 bp, Homo sapiens
tctttggatatcgctagaccgt

SEQ ID NO: 8027961 - DNA, 22 bp, Homo sapiens
tctttggagtgttatcagtaat

SEQ ID NO: 8027962 - DNA, 22 bp, Homo sapiens
tctttggagtgttatcagtaat

SEQ ID NO: 8027963 - DNA, 22 bp, Homo sapiens
tctttggagtgttatcagtaat

SEQ ID NO: 8027964 - DNA, 22 bp, Homo sapiens
tctttggagtgttatcagtaat

SEQ ID NO: 8027965 - DNA, 22 bp, Homo sapiens
tctttggatctcaaggtggcag

SEQ ID NO: 8027966 - DNA, 22 bp, Homo sapiens
tctttggatctcaaggtggcag

SEQ ID NO: 8027967 - DNA, 22 bp, Homo sapiens
tctttggatctcaaggtggcag

SEQ ID NO: 8027968 - DNA, 22 bp, Homo sapiens
tctttggatcccaactggctgg

SEQ ID NO: 8027969 - DNA, 22 bp, Homo sapiens
tctttggatcccaactggctgg

SEQ ID NO: 8027970 - DNA, 22 bp, Homo sapiens
tctttggatcccaactggctgg

SEQ ID NO: 8027971 - DNA, 22 bp, Homo sapiens
tctttggatggaaaatgtattc

SEQ ID NO: 8027972 - DNA, 22 bp, Homo sapiens
tctttggatggaaaatgtattc

SEQ ID NO: 8027973 - DNA, 22 bp, Homo sapiens
tctttggatggaaaatgtattc

SEQ ID NO: 8027974 - DNA, 22 bp, Homo sapiens
tctttggatgcgttacttttac

SEQ ID NO: 8027975 - DNA, 22 bp, Homo sapiens
tctttggatgcgttacttttac

SEQ ID NO: 8027976 - DNA, 22 bp, Homo sapiens
tctttggatgcgttacttttac

SEQ ID NO: 8027977 - DNA, 23 bp, Homo sapiens
tctttggagtgctaggggttggg

SEQ ID NO: 8027978 - DNA, 22 bp, Homo sapiens
tctttggactttccaatttgtt

SEQ ID NO: 8027979 - DNA, 23 bp, Homo sapiens
tctttggagtgctaggggttggg

SEQ ID NO: 8027980 - DNA, 22 bp, Homo sapiens
tctttggactttccaatttgtt

SEQ ID NO: 8027981 - DNA, 22 bp, Homo sapiens
tctttggactttccaatttgtt

SEQ ID NO: 8027982 - DNA, 22 bp, Homo sapiens
tctttggactttccaatttgtt

SEQ ID NO: 8027983 - DNA, 22 bp, Homo sapiens
tctttggacatgttgaggttgc

SEQ ID NO: 8027984 - DNA, 22 bp, Homo sapiens
tctttggacatgttgaggttgc

SEQ ID NO: 8027985 - DNA, 18 bp, Homo sapiens
tctttggacaactactgg

SEQ ID NO: 8027986 - DNA, 18 bp, Homo sapiens
tctttggacaactactgg

SEQ ID NO: 8027987 - DNA, 18 bp, Homo sapiens
tctttggacaactactgg

SEQ ID NO: 8027988 - DNA, 22 bp, Homo sapiens
tctttggaatgctagcattcta

SEQ ID NO: 8027989 - DNA, 22 bp, Homo sapiens
tctttggaattctctgcagccc

SEQ ID NO: 8027990 - DNA, 22 bp, Homo sapiens
tctttggaattctctgcagccc

SEQ ID NO: 8027991 - DNA, 22 bp, Homo sapiens
tctttggaatgctagcattcta

SEQ ID NO: 8027992 - DNA, 22 bp, Homo sapiens
tctttggaatgctagcattcta

SEQ ID NO: 8027993 - DNA, 22 bp, Homo sapiens
tctttggaatgctagcattcta

SEQ ID NO: 8027994 - DNA, 22 bp, Homo sapiens
tctttggaatttgctggaaata

SEQ ID NO: 8027995 - DNA, 22 bp, Homo sapiens
tctttggaattctctgcagccc

SEQ ID NO: 8027996 - DNA, 22 bp, Homo sapiens
tctttggaatttgctggaaata

SEQ ID NO: 8027997 - DNA, 22 bp, Homo sapiens
tctttggaatttgctggaaata

SEQ ID NO: 8027998 - DNA, 18 bp, Homo sapiens
tctttggacaactactgg

SEQ ID NO: 8027999 - DNA, 18 bp, Homo sapiens
tctttggacaactactgg

SEQ ID NO: 8028000 - DNA, 18 bp, Homo sapiens
tctttggacaactactgg

SEQ ID NO: 8028001 - DNA, 22 bp, Homo sapiens
tctttggaagtcaggggcatgg

SEQ ID NO: 8028002 - DNA, 22 bp, Homo sapiens
tctttggaagtcaggggcatgg

SEQ ID NO: 8028003 - DNA, 22 bp, Homo sapiens
tctttggaaggagcagtttttg

SEQ ID NO: 8028004 - DNA, 22 bp, Homo sapiens
tctttggaatgctagcattcta

SEQ ID NO: 8028005 - DNA, 22 bp, Homo sapiens
tctttggaagtcaggggcatgg

SEQ ID NO: 8028006 - DNA, 22 bp, Homo sapiens
tctttggaatgctagcattcta

SEQ ID NO: 8028007 - DNA, 22 bp, Homo sapiens
tctttggaagctttcagagaag

SEQ ID NO: 8028008 - DNA, 22 bp, Homo sapiens
tctttggaagctttcagagaag

SEQ ID NO: 8028009 - DNA, 22 bp, Homo sapiens
tctttggaagctttcagagaag

SEQ ID NO: 8028010 - DNA, 22 bp, Homo sapiens
tctttggaagctttcagagaag

SEQ ID NO: 8028011 - DNA, 22 bp, Homo sapiens
tctttggaagctttcagagaag

SEQ ID NO: 8028012 - DNA, 22 bp, Homo sapiens
tctttggaaggagcagtttttg

SEQ ID NO: 8028013 - DNA, 22 bp, Homo sapiens
tctttggaaaaaatggacaatc

SEQ ID NO: 8028014 - DNA, 22 bp, Homo sapiens
tctttgctgagtacatctccaa

SEQ ID NO: 8028015 - DNA, 22 bp, Homo sapiens
tctttgctgagtacatctccaa

SEQ ID NO: 8028016 - DNA, 22 bp, Homo sapiens
tctttgctcttacacagttagt

SEQ ID NO: 8028017 - DNA, 22 bp, Homo sapiens
tctttgctgagtacatctccaa

SEQ ID NO: 8028018 - DNA, 22 bp, Homo sapiens
tctttggaaatgctttgagaat

SEQ ID NO: 8028019 - DNA, 22 bp, Homo sapiens
tctttggaaatgctttgagaat

SEQ ID NO: 8028020 - DNA, 22 bp, Homo sapiens
tctttggaaatgctttgagaat

SEQ ID NO: 8028021 - DNA, 22 bp, Homo sapiens
tctttggaaatgctttgagaat

SEQ ID NO: 8028022 - DNA, 22 bp, Homo sapiens
tctttggaaaaaatggacaatc

SEQ ID NO: 8028023 - DNA, 22 bp, Homo sapiens
tctttggaaaaaatggacaatc

SEQ ID NO: 8028024 - DNA, 22 bp, Homo sapiens
tctttgcattcctgtgtgcttt

SEQ ID NO: 8028025 - DNA, 22 bp, Homo sapiens
tctttgctattgtgagtagtgc

SEQ ID NO: 8028026 - DNA, 22 bp, Homo sapiens
tctttgctattgtgaatagtgc

SEQ ID NO: 8028027 - DNA, 22 bp, Homo sapiens
tctttgcatgcattttccctta

SEQ ID NO: 8028028 - DNA, 22 bp, Homo sapiens
tctttgcatcccttccatagtt

SEQ ID NO: 8028029 - DNA, 22 bp, Homo sapiens
tctttgcatcccttccatagtt

SEQ ID NO: 8028030 - DNA, 22 bp, Homo sapiens
tctttgcactgtgcaagcagaa

SEQ ID NO: 8028031 - DNA, 22 bp, Homo sapiens
tctttgcactgtgcaagcagaa

SEQ ID NO: 8028032 - DNA, 22 bp, Homo sapiens
tctttgcagccccaggaagtgg

SEQ ID NO: 8028033 - DNA, 22 bp, Homo sapiens
tctttgcagaatttaactttgc

SEQ ID NO: 8028034 - DNA, 22 bp, Homo sapiens
tctttgcagtggtgaataaaga

SEQ ID NO: 8028035 - DNA, 22 bp, Homo sapiens
tctttgcaggccaaattgttaa

SEQ ID NO: 8028036 - DNA, 22 bp, Homo sapiens
tctttgcagttctgattaaata

SEQ ID NO: 8028037 - DNA, 22 bp, Homo sapiens
tctttgcagtggtgaataaaga

SEQ ID NO: 8028038 - DNA, 22 bp, Homo sapiens
tctttgcagttctgattaaata

SEQ ID NO: 8028039 - DNA, 22 bp, Homo sapiens
tctttgattttgttactaagac

SEQ ID NO: 8028040 - DNA, 22 bp, Homo sapiens
tctttgatttgacaatatcttg

SEQ ID NO: 8028041 - DNA, 22 bp, Homo sapiens
tctttgatttgacaatatcttg

SEQ ID NO: 8028042 - DNA, 22 bp, Homo sapiens
tctttgcaaaatacaacaatgg

SEQ ID NO: 8028043 - DNA, 22 bp, Homo sapiens
tctttgcaaactatggagtgtg

SEQ ID NO: 8028044 - DNA, 22 bp, Homo sapiens
tctttgcaaatgttattatctt

SEQ ID NO: 8028045 - DNA, 22 bp, Homo sapiens
tctttgcactgtgcaagcagaa

SEQ ID NO: 8028046 - DNA, 17 bp, Homo sapiens
tctttgcaatgagactg

SEQ ID NO: 8028047 - DNA, 22 bp, Homo sapiens
tctttgcacacagcgattcttc

SEQ ID NO: 8028048 - DNA, 22 bp, Homo sapiens
tctttttttcctgtgcagagct

SEQ ID NO: 8028049 - DNA, 22 bp, Homo sapiens
tctttttttcctgtgcagagct

SEQ ID NO: 8028050 - DNA, 22 bp, Homo sapiens
tctttttttcctgtgcagagct

SEQ ID NO: 8028051 - DNA, 22 bp, Homo sapiens
tctttttttcctgtgcagagct

SEQ ID NO: 8028052 - DNA, 22 bp, Homo sapiens
tgaaaaaacaagttggcccatt

SEQ ID NO: 8028053 - DNA, 22 bp, Homo sapiens
tgaaaaaacaagttggcccatt

SEQ ID NO: 8028054 - DNA, 22 bp, Homo sapiens
tctttttctgcacacgtgtccc

SEQ ID NO: 8028055 - DNA, 22 bp, Homo sapiens
tctttttcttattcccacactg

SEQ ID NO: 8028056 - DNA, 22 bp, Homo sapiens
tctttttcttattcccacactg

SEQ ID NO: 8028057 - DNA, 22 bp, Homo sapiens
tctttttatattgacaaaaggt

SEQ ID NO: 8028058 - DNA, 22 bp, Homo sapiens
tctttttatattgacaaaaggt

SEQ ID NO: 8028059 - DNA, 22 bp, Homo sapiens
tcttttgttgcctacttattaa

SEQ ID NO: 8028060 - DNA, 22 bp, Homo sapiens
tcttttgttgcctacttattaa

SEQ ID NO: 8028061 - DNA, 22 bp, Homo sapiens
tcttttgttgcctacttattaa

SEQ ID NO: 8028062 - DNA, 22 bp, Homo sapiens
tcttttgttgcctacttattaa

SEQ ID NO: 8028063 - DNA, 22 bp, Homo sapiens
tcttttgttgcctacttattaa

SEQ ID NO: 8028064 - DNA, 23 bp, Homo sapiens
tctttttaagagatctagtgacg

SEQ ID NO: 8028065 - DNA, 23 bp, Homo sapiens
tctttttaagagatctagtgacg

SEQ ID NO: 8028066 - DNA, 23 bp, Homo sapiens
tctttttaagagatctagtgacg

SEQ ID NO: 8028067 - DNA, 22 bp, Homo sapiens
tctttttatattgacaaaaggt

SEQ ID NO: 8028068 - DNA, 22 bp, Homo sapiens
tctttttatattgacaaaaggt

SEQ ID NO: 8028069 - DNA, 22 bp, Homo sapiens
tctttttatattgacaaaaggt

SEQ ID NO: 8028070 - DNA, 22 bp, Homo sapiens
tctttttatattgacaaaaggt

SEQ ID NO: 8028071 - DNA, 22 bp, Homo sapiens
tctttttatattgacaaaaggt

SEQ ID NO: 8028072 - DNA, 22 bp, Homo sapiens
tctttttatattgacaaaaggt

SEQ ID NO: 8028073 - DNA, 23 bp, Homo sapiens
tctttttaagagatctagtgacg

SEQ ID NO: 8028074 - DNA, 22 bp, Homo sapiens
tctttttatattgacaaaaggt

SEQ ID NO: 8028075 - DNA, 22 bp, Homo sapiens
tgaaaaaacaagttggcccatt

SEQ ID NO: 8028076 - DNA, 22 bp, Homo sapiens
tgaaaaaacaagttggcccatt

SEQ ID NO: 8028077 - DNA, 22 bp, Homo sapiens
tgaaaaaacaagttggcccatt

SEQ ID NO: 8028078 - DNA, 22 bp, Homo sapiens
tgaaaaaacaagttggcccatt

SEQ ID NO: 8028079 - DNA, 22 bp, Homo sapiens
tgaaaaaacaagttggcccatt

SEQ ID NO: 8028080 - DNA, 22 bp, Homo sapiens
tgaaaaaacaagttggcccatt

SEQ ID NO: 8028081 - DNA, 22 bp, Homo sapiens
tgaaaaaacaagttggcccatt

SEQ ID NO: 8028082 - DNA, 22 bp, Homo sapiens
tgaaaaacactaattggaaagc

SEQ ID NO: 8028083 - DNA, 22 bp, Homo sapiens
tgaaaaacactaattggaaagc

SEQ ID NO: 8028084 - DNA, 22 bp, Homo sapiens
tgaaaaacctcagtccgcttta

SEQ ID NO: 8028085 - DNA, 22 bp, Homo sapiens
tgaaaaacctcagtccgcttta

SEQ ID NO: 8028086 - DNA, 22 bp, Homo sapiens
tgaaaactccaagtttcatcag

SEQ ID NO: 8028087 - DNA, 22 bp, Homo sapiens
tgaaaacagaatccttgttttc

SEQ ID NO: 8028088 - DNA, 22 bp, Homo sapiens
tgaaaacagaatccttgttttc

SEQ ID NO: 8028089 - DNA, 22 bp, Homo sapiens
tgaaaacactttagtttaggtc

SEQ ID NO: 8028090 - DNA, 22 bp, Homo sapiens
tgaaaacactttagtttaggtc

SEQ ID NO: 8028091 - DNA, 22 bp, Homo sapiens
tgaaaaactttaatccataaag

SEQ ID NO: 8028092 - DNA, 22 bp, Homo sapiens
tgaaaaactttaatccataaag

SEQ ID NO: 8028093 - DNA, 22 bp, Homo sapiens
tgaaaaactttaatccataaag

SEQ ID NO: 8028094 - DNA, 22 bp, Homo sapiens
tgaaaaactgaatagttgagta

SEQ ID NO: 8028095 - DNA, 22 bp, Homo sapiens
tgaaaatttccatcagttatat

SEQ ID NO: 8028096 - DNA, 22 bp, Homo sapiens
tgaaacaaaagtatgtagcttg

SEQ ID NO: 8028097 - DNA, 22 bp, Homo sapiens
tgaaacaaaagtatgtagcttg

SEQ ID NO: 8028098 - DNA, 22 bp, Homo sapiens
tgaaaatttccatcagttatat

SEQ ID NO: 8028099 - DNA, 22 bp, Homo sapiens
tgaaaatttccatcagttatat

SEQ ID NO: 8028100 - DNA, 22 bp, Homo sapiens
tgaaaatttccatcagttatat

SEQ ID NO: 8028101 - DNA, 22 bp, Homo sapiens
tgaaaatttccatcagttatat

SEQ ID NO: 8028102 - DNA, 22 bp, Homo sapiens
tgaaaattgttgtacttgataa

SEQ ID NO: 8028103 - DNA, 22 bp, Homo sapiens
tgaaaattgttgtacttgataa

SEQ ID NO: 8028104 - DNA, 22 bp, Homo sapiens
tgaaaattgttgtacttgataa

SEQ ID NO: 8028105 - DNA, 22 bp, Homo sapiens
tgaaaattgttgtacttgataa

SEQ ID NO: 8028106 - DNA, 22 bp, Homo sapiens
tgaaaattgttgtacttgataa

SEQ ID NO: 8028107 - DNA, 22 bp, Homo sapiens
tgaaaatggcctgaagaagcaa

SEQ ID NO: 8028108 - DNA, 22 bp, Homo sapiens
tgaaaattaagcagatgaatga

SEQ ID NO: 8028109 - DNA, 22 bp, Homo sapiens
tgaaaattaagcagatgaatga

SEQ ID NO: 8028110 - DNA, 22 bp, Homo sapiens
tgaaaattcatctcatagcaga

SEQ ID NO: 8028111 - DNA, 22 bp, Homo sapiens
tgaaaattcatctcatagcaga

SEQ ID NO: 8028112 - DNA, 22 bp, Homo sapiens
tgaaaattcatctcatagcaga

SEQ ID NO: 8028113 - DNA, 22 bp, Homo sapiens
tgaaaaggagccttaggtaggt

SEQ ID NO: 8028114 - DNA, 22 bp, Homo sapiens
tgaaaagactgcaagagagcat

SEQ ID NO: 8028115 - DNA, 22 bp, Homo sapiens
tgaaaagtcttatattgtctga

SEQ ID NO: 8028116 - DNA, 20 bp, Homo sapiens
tgaaaaggtcaggagacatg

SEQ ID NO: 8028117 - DNA, 20 bp, Homo sapiens
tgaaaaggtcaggagacatg

SEQ ID NO: 8028118 - DNA, 22 bp, Homo sapiens
tgaaaatgcacgctggaaagca

SEQ ID NO: 8028119 - DNA, 22 bp, Homo sapiens
tgaaaatgccctctatgtctca

SEQ ID NO: 8028120 - DNA, 22 bp, Homo sapiens
tgaaaatatagttttccagact

SEQ ID NO: 8028121 - DNA, 22 bp, Homo sapiens
tgaaaatatagttttccagact

SEQ ID NO: 8028122 - DNA, 22 bp, Homo sapiens
tgaaaatatagttttccagact

SEQ ID NO: 8028123 - DNA, 22 bp, Homo sapiens
tgaaaatatagttttccagact

SEQ ID NO: 8028124 - DNA, 22 bp, Homo sapiens
tgaaaatatagttttccagact

SEQ ID NO: 8028125 - DNA, 22 bp, Homo sapiens
tgaaaagtgatcatggattagg

SEQ ID NO: 8028126 - DNA, 22 bp, Homo sapiens
tgaaaagtgatcatggattagg

SEQ ID NO: 8028127 - DNA, 22 bp, Homo sapiens
tgaaaagtgatcatggattagg

SEQ ID NO: 8028128 - DNA, 22 bp, Homo sapiens
tgaaacataaagttatcttcag

SEQ ID NO: 8028129 - DNA, 22 bp, Homo sapiens
tgaaacataaagttatcttcag

SEQ ID NO: 8028130 - DNA, 22 bp, Homo sapiens
tgaaacataaagttatcttcag

SEQ ID NO: 8028131 - DNA, 22 bp, Homo sapiens
tgaaacagtctccagacttgga

SEQ ID NO: 8028132 - DNA, 22 bp, Homo sapiens
tgaaacattaggaaatcattat

SEQ ID NO: 8028133 - DNA, 22 bp, Homo sapiens
tgaaacattatagaatatttat

SEQ ID NO: 8028134 - DNA, 22 bp, Homo sapiens
tgaaacattatagaatatttat

SEQ ID NO: 8028135 - DNA, 22 bp, Homo sapiens
tgaaacattatagaatatttat

SEQ ID NO: 8028136 - DNA, 22 bp, Homo sapiens
tgaaacattatagaatatttat

SEQ ID NO: 8028137 - DNA, 22 bp, Homo sapiens
tgaaacattatagaatatttat

SEQ ID NO: 8028138 - DNA, 22 bp, Homo sapiens
tgaaacattaggaaatcattat

SEQ ID NO: 8028139 - DNA, 22 bp, Homo sapiens
tgaaacattgcactgtatgaat

SEQ ID NO: 8028140 - DNA, 23 bp, Homo sapiens
tgaaacatttagggtagaatttc

SEQ ID NO: 8028141 - DNA, 23 bp, Homo sapiens
tgaaacatttagggtagaatttc

SEQ ID NO: 8028142 - DNA, 22 bp, Homo sapiens
tgaaacattgcactgtatgaat

SEQ ID NO: 8028143 - DNA, 22 bp, Homo sapiens
tgaaacattgcactgtatgaat

SEQ ID NO: 8028144 - DNA, 22 bp, Homo sapiens
tgaaacattgcactgtatgaat

SEQ ID NO: 8028145 - DNA, 22 bp, Homo sapiens
tgaaacattgcactgtatgaat

SEQ ID NO: 8028146 - DNA, 22 bp, Homo sapiens
tgaaacattgcactgtatgaat

SEQ ID NO: 8028147 - DNA, 22 bp, Homo sapiens
tgaaacatttgatgatctttgg

SEQ ID NO: 8028148 - DNA, 22 bp, Homo sapiens
tgaaacatttgatgatctttgg

SEQ ID NO: 8028149 - DNA, 22 bp, Homo sapiens
tgaaacatttgatgatctttgg

SEQ ID NO: 8028150 - DNA, 21 bp, Homo sapiens
tgaaacatttgatcaaagcac

SEQ ID NO: 8028151 - DNA, 21 bp, Homo sapiens
tgaaacatttgatcaaagcac

SEQ ID NO: 8028152 - DNA, 21 bp, Homo sapiens
tgaaacatttgatcaaagcac

SEQ ID NO: 8028153 - DNA, 22 bp, Homo sapiens
tgaaacaaaccagtaattttgt

SEQ ID NO: 8028154 - DNA, 22 bp, Homo sapiens
tgaaacaaaccagtaattttgt

SEQ ID NO: 8028155 - DNA, 22 bp, Homo sapiens
tgaaacaaaattaagattctcg

SEQ ID NO: 8028156 - DNA, 22 bp, Homo sapiens
tgaaacaaaccagtaattttgt

SEQ ID NO: 8028157 - DNA, 22 bp, Homo sapiens
tgaaacaaaccagtaattttgt

SEQ ID NO: 8028158 - DNA, 19 bp, Homo sapiens
tgaaacaaacttaaaagga

SEQ ID NO: 8028159 - DNA, 19 bp, Homo sapiens
tgaaacaaacttaaaagga

SEQ ID NO: 8028160 - DNA, 19 bp, Homo sapiens
tgaaacaaacttaaaagga

SEQ ID NO: 8028161 - DNA, 22 bp, Homo sapiens
tgaaacaggcaaaactgcagat

SEQ ID NO: 8028162 - DNA, 22 bp, Homo sapiens
tgaaacagtattctcaaccttt

SEQ ID NO: 8028163 - DNA, 22 bp, Homo sapiens
tgaaacagtctccagacttgga

SEQ ID NO: 8028164 - DNA, 22 bp, Homo sapiens
tgaaacagtgcttcactcagcc

SEQ ID NO: 8028165 - DNA, 19 bp, Homo sapiens
tgaaacaaacttaaaagga

SEQ ID NO: 8028166 - DNA, 19 bp, Homo sapiens
tgaaacaaacttaaaagga

SEQ ID NO: 8028167 - DNA, 22 bp, Homo sapiens
tgaaacaggaagtaaacagaca

SEQ ID NO: 8028168 - DNA, 22 bp, Homo sapiens
tgaaacaggatgcagaggagga

SEQ ID NO: 8028169 - DNA, 22 bp, Homo sapiens
tgaaacaggaagtaaacagaca

SEQ ID NO: 8028170 - DNA, 22 bp, Homo sapiens
tgaaacaggcaaaactgcagat

SEQ ID NO: 8028171 - DNA, 22 bp, Homo sapiens
tgaaagaagggtggaaaatgta

SEQ ID NO: 8028172 - DNA, 22 bp, Homo sapiens
tgaaagaagggtggaaaatgta

SEQ ID NO: 8028173 - DNA, 22 bp, Homo sapiens
tgaaagaagccttcgaggctcg

SEQ ID NO: 8028174 - DNA, 21 bp, Homo sapiens
tgaaagaaggtgcagtctgaa

SEQ ID NO: 8028175 - DNA, 22 bp, Homo sapiens
tgaaagaactagcatcttcaag

SEQ ID NO: 8028176 - DNA, 22 bp, Homo sapiens
tgaaagaactagcatcttcaag

SEQ ID NO: 8028177 - DNA, 17 bp, Homo sapiens
tgaaagaatcagggaga

SEQ ID NO: 8028178 - DNA, 17 bp, Homo sapiens
tgaaagaatcagggaga

SEQ ID NO: 8028179 - DNA, 17 bp, Homo sapiens
tgaaagaatcagggaga

SEQ ID NO: 8028180 - DNA, 22 bp, Homo sapiens
tgaaagagtgcaagtcaaggag

SEQ ID NO: 8028181 - DNA, 21 bp, Homo sapiens
tgaaagaggatgtggtcattc

SEQ ID NO: 8028182 - DNA, 22 bp, Homo sapiens
tgaaagaagtgtcacattgcca

SEQ ID NO: 8028183 - DNA, 22 bp, Homo sapiens
tgaaagaagtgtcacattgcca

SEQ ID NO: 8028184 - DNA, 21 bp, Homo sapiens
tgaaagaaggtgcagtctgaa

SEQ ID NO: 8028185 - DNA, 22 bp, Homo sapiens
tgaaagaagtgtcacattgcca

SEQ ID NO: 8028186 - DNA, 22 bp, Homo sapiens
tgaaaccattctcaggtacact

SEQ ID NO: 8028187 - DNA, 22 bp, Homo sapiens
tgaaaccactgatggtaccaag

SEQ ID NO: 8028188 - DNA, 21 bp, Homo sapiens
tgaaactacctacaagctacc

SEQ ID NO: 8028189 - DNA, 21 bp, Homo sapiens
tgaaactacctacaagctacc

SEQ ID NO: 8028190 - DNA, 22 bp, Homo sapiens
tgaaaccttggctagagattga

SEQ ID NO: 8028191 - DNA, 22 bp, Homo sapiens
tgaaactaggccaatcaaatta

SEQ ID NO: 8028192 - DNA, 22 bp, Homo sapiens
tgaaactaggccaatcaaatta

SEQ ID NO: 8028193 - DNA, 22 bp, Homo sapiens
tgaaactgaaaggtatttatag

SEQ ID NO: 8028194 - DNA, 22 bp, Homo sapiens
tgaaacttataagaatatgaat

SEQ ID NO: 8028195 - DNA, 22 bp, Homo sapiens
tgaaacttataagaatatgaat

SEQ ID NO: 8028196 - DNA, 22 bp, Homo sapiens
tgaaacttataagaatatgaat

SEQ ID NO: 8028197 - DNA, 22 bp, Homo sapiens
tgaaacttataagaatatgaat

SEQ ID NO: 8028198 - DNA, 22 bp, Homo sapiens
tgaaacttatatatcccaggtt

SEQ ID NO: 8028199 - DNA, 22 bp, Homo sapiens
tgaaagaaacaggtatattggg

SEQ ID NO: 8028200 - DNA, 22 bp, Homo sapiens
tgaaacttctaatatgaatagt

SEQ ID NO: 8028201 - DNA, 22 bp, Homo sapiens
tgaaacttctaatatgaatagt

SEQ ID NO: 8028202 - DNA, 22 bp, Homo sapiens
tgaaacttctaatatgaatagt

SEQ ID NO: 8028203 - DNA, 22 bp, Homo sapiens
tgaaagaactagcatcttcaag

SEQ ID NO: 8028204 - DNA, 22 bp, Homo sapiens
tgaaagaaacaggtatattggg

SEQ ID NO: 8028205 - DNA, 22 bp, Homo sapiens
tgaaagaaacaggtatattggg

SEQ ID NO: 8028206 - DNA, 22 bp, Homo sapiens
tgaaatgtctgaaagccaatct

SEQ ID NO: 8028207 - DNA, 22 bp, Homo sapiens
tgaaatgtctttgcaattgaaa

SEQ ID NO: 8028208 - DNA, 22 bp, Homo sapiens
tgaaatgtctttgcaattgaaa

SEQ ID NO: 8028209 - DNA, 22 bp, Homo sapiens
tgaaatgtctttgcaattgaaa

SEQ ID NO: 8028210 - DNA, 22 bp, Homo sapiens
tgaaatgtgatctgagcttggc

SEQ ID NO: 8028211 - DNA, 22 bp, Homo sapiens
tgaaatgtgatctgagcttggc

SEQ ID NO: 8028212 - DNA, 22 bp, Homo sapiens
tgaaatgtggagatggtaagta

SEQ ID NO: 8028213 - DNA, 22 bp, Homo sapiens
tgaaatgtgtccatgttatttc

SEQ ID NO: 8028214 - DNA, 22 bp, Homo sapiens
tgaaatgtgtccatgttatttc

SEQ ID NO: 8028215 - DNA, 22 bp, Homo sapiens
tgaaatgtgttatctgggcctg

SEQ ID NO: 8028216 - DNA, 22 bp, Homo sapiens
tgaaatgtgttatctgggcctg

SEQ ID NO: 8028217 - DNA, 22 bp, Homo sapiens
tgaaatgtagattaggcattct

SEQ ID NO: 8028218 - DNA, 23 bp, Homo sapiens
tgaaatgtagaggaattccacct

SEQ ID NO: 8028219 - DNA, 23 bp, Homo sapiens
tgaaatgtagaggaattccacct

SEQ ID NO: 8028220 - DNA, 22 bp, Homo sapiens
tgaaatgtatattgccagtgta

SEQ ID NO: 8028221 - DNA, 22 bp, Homo sapiens
tgaaatgtagtgaagcatggaa

SEQ ID NO: 8028222 - DNA, 22 bp, Homo sapiens
tgaaatgtagtgaagcatggaa

SEQ ID NO: 8028223 - DNA, 22 bp, Homo sapiens
tgaaatgtagattaggcattct

SEQ ID NO: 8028224 - DNA, 22 bp, Homo sapiens
tgaaatgtcagtgttttataag

SEQ ID NO: 8028225 - DNA, 22 bp, Homo sapiens
tgaaatgtcagtgttttataag

SEQ ID NO: 8028226 - DNA, 22 bp, Homo sapiens
tgaaatgtcatcctttagccat

SEQ ID NO: 8028227 - DNA, 22 bp, Homo sapiens
tgaaatgtctcacttagacttt

SEQ ID NO: 8028228 - DNA, 22 bp, Homo sapiens
tgaaatgttaatcacacaaagg

SEQ ID NO: 8028229 - DNA, 22 bp, Homo sapiens
tgaaatgttctggagtttctgt

SEQ ID NO: 8028230 - DNA, 22 bp, Homo sapiens
tgaaatgttctggagtttctgt

SEQ ID NO: 8028231 - DNA, 22 bp, Homo sapiens
tgaaatgttgccatgaggtctc

SEQ ID NO: 8028232 - DNA, 22 bp, Homo sapiens
tgaaatgttctggagtttctgt

SEQ ID NO: 8028233 - DNA, 22 bp, Homo sapiens
tgaaatgttaatcacacaaagg

SEQ ID NO: 8028234 - DNA, 22 bp, Homo sapiens
tgaaatgtgttctagtgttttg

SEQ ID NO: 8028235 - DNA, 22 bp, Homo sapiens
tgaaatgtgttctagtgttttg

SEQ ID NO: 8028236 - DNA, 22 bp, Homo sapiens
tgaaatgtttgggtccagaagt

SEQ ID NO: 8028237 - DNA, 22 bp, Homo sapiens
tgaaattagaaatatgtatggg

SEQ ID NO: 8028238 - DNA, 22 bp, Homo sapiens
tgaaatgtttatctctcctgct

SEQ ID NO: 8028239 - DNA, 22 bp, Homo sapiens
tgaaatgtttgaagaccactga

SEQ ID NO: 8028240 - DNA, 22 bp, Homo sapiens
tgaaatgtttgaagaccactga

SEQ ID NO: 8028241 - DNA, 22 bp, Homo sapiens
tgaaatgttggtaattttatat

SEQ ID NO: 8028242 - DNA, 22 bp, Homo sapiens
tgaaatgtttaggaccactaga

SEQ ID NO: 8028243 - DNA, 22 bp, Homo sapiens
tgaaatgtttaggaccactaga

SEQ ID NO: 8028244 - DNA, 22 bp, Homo sapiens
tgaaatgttggtaattttatat

SEQ ID NO: 8028245 - DNA, 22 bp, Homo sapiens
tgaaatcatgagatagtgtcac

SEQ ID NO: 8028246 - DNA, 22 bp, Homo sapiens
tgaaatcatgagatagtgtcac

SEQ ID NO: 8028247 - DNA, 22 bp, Homo sapiens
tgaaatcatgaacaaggtaggt

SEQ ID NO: 8028248 - DNA, 22 bp, Homo sapiens
tgaaatcattgccaagtattga

SEQ ID NO: 8028249 - DNA, 22 bp, Homo sapiens
tgaaatcatgtagttattgcaa

SEQ ID NO: 8028250 - DNA, 22 bp, Homo sapiens
tgaaatcatgtagttattgcaa

SEQ ID NO: 8028251 - DNA, 21 bp, Homo sapiens
tgaaatctgatgggacaaatg

SEQ ID NO: 8028252 - DNA, 22 bp, Homo sapiens
tgaaatcattggggttgaataa

SEQ ID NO: 8028253 - DNA, 22 bp, Homo sapiens
tgaaatcattggggttgaataa

SEQ ID NO: 8028254 - DNA, 22 bp, Homo sapiens
tgaaatctaccctattcagggt

SEQ ID NO: 8028255 - DNA, 22 bp, Homo sapiens
tgaaatctcctctttatatatc

SEQ ID NO: 8028256 - DNA, 22 bp, Homo sapiens
tgaaatgtaagcatagaggttg

SEQ ID NO: 8028257 - DNA, 22 bp, Homo sapiens
tgaaatgtacaagtgctttttt

SEQ ID NO: 8028258 - DNA, 22 bp, Homo sapiens
tgaaatgtacaagtgctttttt

SEQ ID NO: 8028259 - DNA, 22 bp, Homo sapiens
tgaaatgcttttacaggatatt

SEQ ID NO: 8028260 - DNA, 22 bp, Homo sapiens
tgaaatgcttttacaggatatt

SEQ ID NO: 8028261 - DNA, 22 bp, Homo sapiens
tgaaatggaattaatttgtatt

SEQ ID NO: 8028262 - DNA, 22 bp, Homo sapiens
tgaaatggatgagagcagaggt

SEQ ID NO: 8028263 - DNA, 22 bp, Homo sapiens
tgaaatggcaaggcagagcttt

SEQ ID NO: 8028264 - DNA, 19 bp, Homo sapiens
tgaaatggcagttgctaaa

SEQ ID NO: 8028265 - DNA, 22 bp, Homo sapiens
tgaaatggattgaagtggctta

SEQ ID NO: 8028266 - DNA, 22 bp, Homo sapiens
tgaaatggcaaggcagagcttt

SEQ ID NO: 8028267 - DNA, 22 bp, Homo sapiens
tgaaatgcttaggaccagaagg

SEQ ID NO: 8028268 - DNA, 22 bp, Homo sapiens
tgaaatgctgtagagactgtat

SEQ ID NO: 8028269 - DNA, 22 bp, Homo sapiens
tgaaatgctgtagagactgtat

SEQ ID NO: 8028270 - DNA, 22 bp, Homo sapiens
tgaaatgcttaggaccagaagg

SEQ ID NO: 8028271 - DNA, 22 bp, Homo sapiens
tgaaatgcttgggaccagaagt

SEQ ID NO: 8028272 - DNA, 22 bp, Homo sapiens
tgaaatgcttgggaccagaagt

SEQ ID NO: 8028273 - DNA, 22 bp, Homo sapiens
tgaaatgcttctctgaaaatac

SEQ ID NO: 8028274 - DNA, 22 bp, Homo sapiens
tgaaatgcttctctgaaaatac

SEQ ID NO: 8028275 - DNA, 22 bp, Homo sapiens
tgaaatgctgtagagactgtat

SEQ ID NO: 8028276 - DNA, 22 bp, Homo sapiens
tgaaatgctgtagagactgtat

SEQ ID NO: 8028277 - DNA, 22 bp, Homo sapiens
tgaaatgcctatgaagtcagga

SEQ ID NO: 8028278 - DNA, 22 bp, Homo sapiens
tgaaatgctgtagagactgtat

SEQ ID NO: 8028279 - DNA, 22 bp, Homo sapiens
tgaaatgcctatgaagtcagga

SEQ ID NO: 8028280 - DNA, 22 bp, Homo sapiens
tgaaatgcacatattccataaa

SEQ ID NO: 8028281 - DNA, 22 bp, Homo sapiens
tgaaatgcaatggggatccatt

SEQ ID NO: 8028282 - DNA, 23 bp, Homo sapiens
tgaaatattcttttgcatgagct

SEQ ID NO: 8028283 - DNA, 23 bp, Homo sapiens
tgaaatattcttttgcatgagct

SEQ ID NO: 8028284 - DNA, 22 bp, Homo sapiens
tgaaatatttagagagtaagtt

SEQ ID NO: 8028285 - DNA, 22 bp, Homo sapiens
tgaaatatttagagagtaagtt

SEQ ID NO: 8028286 - DNA, 22 bp, Homo sapiens
tgaaatatgctcccattcactt

SEQ ID NO: 8028287 - DNA, 22 bp, Homo sapiens
tgaaatatttagagagtaagtt

SEQ ID NO: 8028288 - DNA, 22 bp, Homo sapiens
tgaaatatttagagagtaagtt

SEQ ID NO: 8028289 - DNA, 22 bp, Homo sapiens
tgaaatcaactaggagacacca

SEQ ID NO: 8028290 - DNA, 22 bp, Homo sapiens
tgaaatcaataattggtgattg

SEQ ID NO: 8028291 - DNA, 22 bp, Homo sapiens
tgaaatcaatgtcttctgtctc

SEQ ID NO: 8028292 - DNA, 22 bp, Homo sapiens
tgaaatcaatgtcttctgtctc

SEQ ID NO: 8028293 - DNA, 22 bp, Homo sapiens
tgaaatcaattgcaatgtttat

SEQ ID NO: 8028294 - DNA, 22 bp, Homo sapiens
tgaaatcagtatgtctttctca

SEQ ID NO: 8028295 - DNA, 23 bp, Homo sapiens
tgaaatcagaacccttacctctc

SEQ ID NO: 8028296 - DNA, 22 bp, Homo sapiens
tgaaatcatctgccaataagtt

SEQ ID NO: 8028297 - DNA, 22 bp, Homo sapiens
tgaaatcatcaaaagagccatt

SEQ ID NO: 8028298 - DNA, 17 bp, Homo sapiens
tgaaatcagcacccagg

SEQ ID NO: 8028299 - DNA, 22 bp, Homo sapiens
tgaaatcagtatgtctttctca

SEQ ID NO: 8028300 - DNA, 22 bp, Homo sapiens
tgaaatcaattgcaatgtttat

SEQ ID NO: 8028301 - DNA, 17 bp, Homo sapiens
tgaaatcagcacccagg

SEQ ID NO: 8028302 - DNA, 22 bp, Homo sapiens
tgaaatatcattttcatctccc

SEQ ID NO: 8028303 - DNA, 22 bp, Homo sapiens
tgaaatatccagcccagcagga

SEQ ID NO: 8028304 - DNA, 22 bp, Homo sapiens
tgaaatatccagcccagcagga

SEQ ID NO: 8028305 - DNA, 22 bp, Homo sapiens
tgaaatatcattttcatctccc

SEQ ID NO: 8028306 - DNA, 22 bp, Homo sapiens
tgaaatagtctaaaaaaccaga

SEQ ID NO: 8028307 - DNA, 22 bp, Homo sapiens
tgaaatagtctaaaaaaccaga

SEQ ID NO: 8028308 - DNA, 22 bp, Homo sapiens
tgaaatagtctaaaaaaccaga

SEQ ID NO: 8028309 - DNA, 22 bp, Homo sapiens
tgaaataggaaacagatgtttc

SEQ ID NO: 8028310 - DNA, 22 bp, Homo sapiens
tgaaataggaaacagatgtttc

SEQ ID NO: 8028311 - DNA, 22 bp, Homo sapiens
tgaaatagtcaagtatttgaac

SEQ ID NO: 8028312 - DNA, 20 bp, Homo sapiens
tgaaatagatactcagagat

SEQ ID NO: 8028313 - DNA, 22 bp, Homo sapiens
tgaaatagacacagtgctatac

SEQ ID NO: 8028314 - DNA, 22 bp, Homo sapiens
tgaaatagacttgcactatatg

SEQ ID NO: 8028315 - DNA, 22 bp, Homo sapiens
tgaaatagacttgcactatatg

SEQ ID NO: 8028316 - DNA, 22 bp, Homo sapiens
tgaaataatatctggatcaatc

SEQ ID NO: 8028317 - DNA, 22 bp, Homo sapiens
tgaaataacttttgggtgagtt

SEQ ID NO: 8028318 - DNA, 22 bp, Homo sapiens
tgaaataacttttgggtgagtt

SEQ ID NO: 8028319 - DNA, 20 bp, Homo sapiens
tgaaataaggagttgtcctt

SEQ ID NO: 8028320 - DNA, 20 bp, Homo sapiens
tgaaataaggagttgtcctt

SEQ ID NO: 8028321 - DNA, 22 bp, Homo sapiens
tgaaatactgagtgaaagaatt

SEQ ID NO: 8028322 - DNA, 22 bp, Homo sapiens
tgaaatactgagtgaaagaatt

SEQ ID NO: 8028323 - DNA, 22 bp, Homo sapiens
tgaaatagaaaaacaggcttct

SEQ ID NO: 8028324 - DNA, 22 bp, Homo sapiens
tgaaatacacaaatttagtaag

SEQ ID NO: 8028325 - DNA, 22 bp, Homo sapiens
tgaaagattgtgattcaatatg

SEQ ID NO: 8028326 - DNA, 22 bp, Homo sapiens
tgaaagcaacctgtaacagtga

SEQ ID NO: 8028327 - DNA, 22 bp, Homo sapiens
tgaaagattgtgattcaatatg

SEQ ID NO: 8028328 - DNA, 22 bp, Homo sapiens
tgaaagatgctcaatgaatggt

SEQ ID NO: 8028329 - DNA, 22 bp, Homo sapiens
tgaaagatgctcaatgaatggt

SEQ ID NO: 8028330 - DNA, 22 bp, Homo sapiens
tgaaagatgctcaatgaatggt

SEQ ID NO: 8028331 - DNA, 22 bp, Homo sapiens
tgaaagagtttgacatgattct

SEQ ID NO: 8028332 - DNA, 22 bp, Homo sapiens
tgaaagagtgcaagtcaaggag

SEQ ID NO: 8028333 - DNA, 22 bp, Homo sapiens
tgaaagatgaaagcaggctggt

SEQ ID NO: 8028334 - DNA, 22 bp, Homo sapiens
tgaaagataagttattatgtac

SEQ ID NO: 8028335 - DNA, 22 bp, Homo sapiens
tgaaagataagttattatgtac

SEQ ID NO: 8028336 - DNA, 22 bp, Homo sapiens
tgaaagcacaagttctaacagg

SEQ ID NO: 8028337 - DNA, 22 bp, Homo sapiens
tgaaagcactcacttctgctct

SEQ ID NO: 8028338 - DNA, 23 bp, Homo sapiens
tgaaagcaatgggtctatagtat

SEQ ID NO: 8028339 - DNA, 23 bp, Homo sapiens
tgaaagcaatgggtctatagtat

SEQ ID NO: 8028340 - DNA, 22 bp, Homo sapiens
tgaaagcacaagttctaacagg

SEQ ID NO: 8028341 - DNA, 22 bp, Homo sapiens
tgaaagtctctgttatagagaa

SEQ ID NO: 8028342 - DNA, 22 bp, Homo sapiens
tgaaagtatttgatttctatta

SEQ ID NO: 8028343 - DNA, 22 bp, Homo sapiens
tgaaagtagcgcatttcactca

SEQ ID NO: 8028344 - DNA, 22 bp, Homo sapiens
tgaaagtatttgatttctatta

SEQ ID NO: 8028345 - DNA, 22 bp, Homo sapiens
tgaaagtagcgcatttcactca

SEQ ID NO: 8028346 - DNA, 22 bp, Homo sapiens
tgaaagtaaccaagggaaggtc

SEQ ID NO: 8028347 - DNA, 22 bp, Homo sapiens
tgaaagttgcacataagagaat

SEQ ID NO: 8028348 - DNA, 22 bp, Homo sapiens
tgaaagttgcacataagagaat

SEQ ID NO: 8028349 - DNA, 22 bp, Homo sapiens
tgaaagttgcacataagagaat

SEQ ID NO: 8028350 - DNA, 23 bp, Homo sapiens
tgaaagttctgaagagatcatgc

SEQ ID NO: 8028351 - DNA, 22 bp, Homo sapiens
tgaaagttattactgatgatgt

SEQ ID NO: 8028352 - DNA, 22 bp, Homo sapiens
tgaaagttattactgatgatgt

SEQ ID NO: 8028353 - DNA, 22 bp, Homo sapiens
tgaaagttaggatgtagtaatt

SEQ ID NO: 8028354 - DNA, 22 bp, Homo sapiens
tgaaagttattactgatgatgt

SEQ ID NO: 8028355 - DNA, 22 bp, Homo sapiens
tgaaagttaggatgtagtaatt

SEQ ID NO: 8028356 - DNA, 22 bp, Homo sapiens
tgaagaaacgcagagaggtagg

SEQ ID NO: 8028357 - DNA, 22 bp, Homo sapiens
tgaagaaacgcagagaggtagg

SEQ ID NO: 8028358 - DNA, 22 bp, Homo sapiens
tgaagaaaggtgtgggatactc

SEQ ID NO: 8028359 - DNA, 22 bp, Homo sapiens
tgaagaaaggtgtgggatactc

SEQ ID NO: 8028360 - DNA, 22 bp, Homo sapiens
tgaagaaaggtgtgggatactc

SEQ ID NO: 8028361 - DNA, 22 bp, Homo sapiens
tgaagaacgtgagatccagaaa

SEQ ID NO: 8028362 - DNA, 22 bp, Homo sapiens
tgaagaagccaattggtaggct

SEQ ID NO: 8028363 - DNA, 22 bp, Homo sapiens
tgaagaagccaattggtaggct

SEQ ID NO: 8028364 - DNA, 22 bp, Homo sapiens
tgaagaataagatagatggagc

SEQ ID NO: 8028365 - DNA, 22 bp, Homo sapiens
tgaagaataaatggttgagact

SEQ ID NO: 8028366 - DNA, 22 bp, Homo sapiens
tgaagaaacgcagagaggtagg

SEQ ID NO: 8028367 - DNA, 22 bp, Homo sapiens
tgaagaaacgcagagaggtagg

SEQ ID NO: 8028368 - DNA, 22 bp, Homo sapiens
tgaagaaacgcagagaggtagg

SEQ ID NO: 8028369 - DNA, 22 bp, Homo sapiens
tgaagaaacagaccaagaggat

SEQ ID NO: 8028370 - DNA, 22 bp, Homo sapiens
tgaagaaacagaccaagaggat

SEQ ID NO: 8028371 - DNA, 22 bp, Homo sapiens
tgaagaaacagaccaagaggat

SEQ ID NO: 8028372 - DNA, 22 bp, Homo sapiens
tgaagaaacagaccaagaggat

SEQ ID NO: 8028373 - DNA, 18 bp, Homo sapiens
tgaacttttcctgctgct

SEQ ID NO: 8028374 - DNA, 22 bp, Homo sapiens
tgaacttttatttgatgacagg

SEQ ID NO: 8028375 - DNA, 22 bp, Homo sapiens
tgaacttttgcacagaggattt

SEQ ID NO: 8028376 - DNA, 22 bp, Homo sapiens
tgaagaaaatatgattacccca

SEQ ID NO: 8028377 - DNA, 22 bp, Homo sapiens
tgaagaaaatatgattacccca

SEQ ID NO: 8028378 - DNA, 22 bp, Homo sapiens
tgaagaaaatatgattacccca

SEQ ID NO: 8028379 - DNA, 22 bp, Homo sapiens
tgaagacagggtctttaacgag

SEQ ID NO: 8028380 - DNA, 22 bp, Homo sapiens
tgaagacagaccaaggagaatg

SEQ ID NO: 8028381 - DNA, 22 bp, Homo sapiens
tgaagacagaccaaggagaatg

SEQ ID NO: 8028382 - DNA, 22 bp, Homo sapiens
tgaagacagggtctttaacgag

SEQ ID NO: 8028383 - DNA, 22 bp, Homo sapiens
tgaagacagttttactcatgag

SEQ ID NO: 8028384 - DNA, 22 bp, Homo sapiens
tgaagacagttttactcatgag

SEQ ID NO: 8028385 - DNA, 15 bp, Homo sapiens
tgaagacataaggtg

SEQ ID NO: 8028386 - DNA, 22 bp, Homo sapiens
tgaagactcagaagctaagata

SEQ ID NO: 8028387 - DNA, 22 bp, Homo sapiens
tgaagactcagaagctaagata

SEQ ID NO: 8028388 - DNA, 22 bp, Homo sapiens
tgaagactcagaagctaagata

SEQ ID NO: 8028389 - DNA, 22 bp, Homo sapiens
tgaagactcagaagctaagata

SEQ ID NO: 8028390 - DNA, 18 bp, Homo sapiens
tgaagacatgaggttagt

SEQ ID NO: 8028391 - DNA, 22 bp, Homo sapiens
tgaagacccctgctagtgtcat

SEQ ID NO: 8028392 - DNA, 22 bp, Homo sapiens
tgaagactcagaagctaagata

SEQ ID NO: 8028393 - DNA, 22 bp, Homo sapiens
tgaagactcagaagctaagata

SEQ ID NO: 8028394 - DNA, 22 bp, Homo sapiens
tgaagactttgctcttaaccac

SEQ ID NO: 8028395 - DNA, 22 bp, Homo sapiens
tgaagactcagaagctaagata

SEQ ID NO: 8028396 - DNA, 22 bp, Homo sapiens
tgaagacacatacaagggaatg

SEQ ID NO: 8028397 - DNA, 22 bp, Homo sapiens
tgaagacaagtgtgctggtgtt

SEQ ID NO: 8028398 - DNA, 22 bp, Homo sapiens
tgaagacaagtgtgctggtgtt

SEQ ID NO: 8028399 - DNA, 22 bp, Homo sapiens
tgaagacacatacaagggaatg

SEQ ID NO: 8028400 - DNA, 22 bp, Homo sapiens
tgaagacagaccaaggagaatg

SEQ ID NO: 8028401 - DNA, 22 bp, Homo sapiens
tgaagacagaccaaggagaatg

SEQ ID NO: 8028402 - DNA, 22 bp, Homo sapiens
tgaagaatcccagggaatttgg

SEQ ID NO: 8028403 - DNA, 22 bp, Homo sapiens
tgaagaatgttgcagtgagcat

SEQ ID NO: 8028404 - DNA, 22 bp, Homo sapiens
tgaagacaaagtcaggcccaga

SEQ ID NO: 8028405 - DNA, 22 bp, Homo sapiens
tgaagacaagaaaacactgggg

SEQ ID NO: 8028406 - DNA, 22 bp, Homo sapiens
tgaagacaaagtcaggcccaga

SEQ ID NO: 8028407 - DNA, 22 bp, Homo sapiens
tgaagcaggaaccagcagcatt

SEQ ID NO: 8028408 - DNA, 22 bp, Homo sapiens
tgaagcagcttctttctgtcaa

SEQ ID NO: 8028409 - DNA, 19 bp, Homo sapiens
tgaagcagcaaactctcag

SEQ ID NO: 8028410 - DNA, 20 bp, Homo sapiens
tgaagcagccttgattctgt

SEQ ID NO: 8028411 - DNA, 22 bp, Homo sapiens
tgaagcagcaaatgatgggaga

SEQ ID NO: 8028412 - DNA, 19 bp, Homo sapiens
tgaagcaggcagagaagat

SEQ ID NO: 8028413 - DNA, 22 bp, Homo sapiens
tgaagcaggaaccagcagcatt

SEQ ID NO: 8028414 - DNA, 22 bp, Homo sapiens
tgaagcaggtgaatggatgtcg

SEQ ID NO: 8028415 - DNA, 22 bp, Homo sapiens
tgaagcagttctcagaagtggg

SEQ ID NO: 8028416 - DNA, 22 bp, Homo sapiens
tgaagcaggtgaatggatgtcg

SEQ ID NO: 8028417 - DNA, 22 bp, Homo sapiens
tgaagcagagaatttgacagtc

SEQ ID NO: 8028418 - DNA, 22 bp, Homo sapiens
tgaagcagaggggtcttgagct

SEQ ID NO: 8028419 - DNA, 22 bp, Homo sapiens
tgaagcagagtgaaggtgaatt

SEQ ID NO: 8028420 - DNA, 22 bp, Homo sapiens
tgaagcaatagagacaagacca

SEQ ID NO: 8028421 - DNA, 22 bp, Homo sapiens
tgaagcaatagagacaagacca

SEQ ID NO: 8028422 - DNA, 22 bp, Homo sapiens
tgaagcaatagagacaagacca

SEQ ID NO: 8028423 - DNA, 22 bp, Homo sapiens
tgaagcaatgatagcagaatga

SEQ ID NO: 8028424 - DNA, 22 bp, Homo sapiens
tgaagcaatgatcttttggtgg

SEQ ID NO: 8028425 - DNA, 22 bp, Homo sapiens
tgaagcaatgatagcagaatga

SEQ ID NO: 8028426 - DNA, 22 bp, Homo sapiens
tgaagcaatgatagcagaatga

SEQ ID NO: 8028427 - DNA, 22 bp, Homo sapiens
tgaagcaatgatcttttggtgg

SEQ ID NO: 8028428 - DNA, 22 bp, Homo sapiens
tgaagcaacaagtctggcccca

SEQ ID NO: 8028429 - DNA, 22 bp, Homo sapiens
tgaagcaactggacaagttggc

SEQ ID NO: 8028430 - DNA, 22 bp, Homo sapiens
tgaagcaactggacaagttggc

SEQ ID NO: 8028431 - DNA, 22 bp, Homo sapiens
tgaagcaactggacaagttggc

SEQ ID NO: 8028432 - DNA, 22 bp, Homo sapiens
tgaagcaagatagaaagctgct

SEQ ID NO: 8028433 - DNA, 22 bp, Homo sapiens
tgaagcaagatagaaagctgct

SEQ ID NO: 8028434 - DNA, 22 bp, Homo sapiens
tgaagcaagatagaaagctgct

SEQ ID NO: 8028435 - DNA, 22 bp, Homo sapiens
tgaagcaagatagaaagctgct

SEQ ID NO: 8028436 - DNA, 22 bp, Homo sapiens
tgaagcaagtctattgccctgg

SEQ ID NO: 8028437 - DNA, 19 bp, Homo sapiens
tgaagcaataccatttttg

SEQ ID NO: 8028438 - DNA, 22 bp, Homo sapiens
tgaagcaaatttttctcagagt

SEQ ID NO: 8028439 - DNA, 22 bp, Homo sapiens
tgaagcaaattgtttagcctga

SEQ ID NO: 8028440 - DNA, 22 bp, Homo sapiens
tgaagcaaattgtttagcctga

SEQ ID NO: 8028441 - DNA, 22 bp, Homo sapiens
tgaagcaaacgcttctgttcct

SEQ ID NO: 8028442 - DNA, 22 bp, Homo sapiens
tgaagagaagaaaattatcttt

SEQ ID NO: 8028443 - DNA, 20 bp, Homo sapiens
tgaagattttgtgtttagaa

SEQ ID NO: 8028444 - DNA, 22 bp, Homo sapiens
tgaaattagtgaagttacagtt

SEQ ID NO: 8028445 - DNA, 22 bp, Homo sapiens
tgaaattatgcattgttgtacc

SEQ ID NO: 8028446 - DNA, 22 bp, Homo sapiens
tgaaattagtgaagttacagtt

SEQ ID NO: 8028447 - DNA, 22 bp, Homo sapiens
tgaaattagtgaagttacagtt

SEQ ID NO: 8028448 - DNA, 22 bp, Homo sapiens
tgaaattcaaaacacatttgtc

SEQ ID NO: 8028449 - DNA, 22 bp, Homo sapiens
tgaaattatgcattgttgtacc

SEQ ID NO: 8028450 - DNA, 22 bp, Homo sapiens
tgaaattatgcattgttgtacc

SEQ ID NO: 8028451 - DNA, 22 bp, Homo sapiens
tgaaattatgcattgttgtacc

SEQ ID NO: 8028452 - DNA, 22 bp, Homo sapiens
tgaaattatgcattgttgtacc

SEQ ID NO: 8028453 - DNA, 22 bp, Homo sapiens
tgaaattcaaaacacatttgtc

SEQ ID NO: 8028454 - DNA, 22 bp, Homo sapiens
tgaacaaactgcattcttcact

SEQ ID NO: 8028455 - DNA, 22 bp, Homo sapiens
tgaacaaactgcattcttcact

SEQ ID NO: 8028456 - DNA, 22 bp, Homo sapiens
tgaacaaactgcattcttcact

SEQ ID NO: 8028457 - DNA, 23 bp, Homo sapiens
tgaacaaaggcaggagaaggcgg

SEQ ID NO: 8028458 - DNA, 22 bp, Homo sapiens
tgaacaaactgcattcttcact

SEQ ID NO: 8028459 - DNA, 22 bp, Homo sapiens
tgaacacacacctatgtacaaa

SEQ ID NO: 8028460 - DNA, 22 bp, Homo sapiens
tgaacacacacctatgtacaaa

SEQ ID NO: 8028461 - DNA, 22 bp, Homo sapiens
tgaacacacacctatgtacaaa

SEQ ID NO: 8028462 - DNA, 22 bp, Homo sapiens
tgaacacacacctatgtacaaa

SEQ ID NO: 8028463 - DNA, 22 bp, Homo sapiens
tgaacagtgatctacatgtggc

SEQ ID NO: 8028464 - DNA, 22 bp, Homo sapiens
tgaacagtgggcatgtgaagac

SEQ ID NO: 8028465 - DNA, 22 bp, Homo sapiens
tgaacagtgggcatgtgaagac

SEQ ID NO: 8028466 - DNA, 22 bp, Homo sapiens
tgaacagtggttcatgtcacgg

SEQ ID NO: 8028467 - DNA, 22 bp, Homo sapiens
tgaacagtgtatctagatcatg

SEQ ID NO: 8028468 - DNA, 22 bp, Homo sapiens
tgaacagtgtgagggtgtgacc

SEQ ID NO: 8028469 - DNA, 22 bp, Homo sapiens
tgaacagttactttgtagaaga

SEQ ID NO: 8028470 - DNA, 22 bp, Homo sapiens
tgaacagttactttgtagaaga

SEQ ID NO: 8028471 - DNA, 22 bp, Homo sapiens
tgaacagtttcaagaaaacttt

SEQ ID NO: 8028472 - DNA, 22 bp, Homo sapiens
tgaacatacaattattaagaac

SEQ ID NO: 8028473 - DNA, 22 bp, Homo sapiens
tgaacagtttcaagaaaacttt

SEQ ID NO: 8028474 - DNA, 22 bp, Homo sapiens
tgaacaaatgaatcagtgtagc

SEQ ID NO: 8028475 - DNA, 21 bp, Homo sapiens
tgaacaaagttcttatcgtga

SEQ ID NO: 8028476 - DNA, 21 bp, Homo sapiens
tgaacaaagttcttatcgtga

SEQ ID NO: 8028477 - DNA, 22 bp, Homo sapiens
tgaacaaatggaaataaccagt

SEQ ID NO: 8028478 - DNA, 22 bp, Homo sapiens
tgaacaaatgaatcagtgtagc

SEQ ID NO: 8028479 - DNA, 22 bp, Homo sapiens
tgaacaaatgaatcagtgtagc

SEQ ID NO: 8028480 - DNA, 22 bp, Homo sapiens
tgaacaaatggaaataaccagt

SEQ ID NO: 8028481 - DNA, 22 bp, Homo sapiens
tgaacaaatggaaataaccagt

SEQ ID NO: 8028482 - DNA, 22 bp, Homo sapiens
tgaacaactgcaaaaatctcca

SEQ ID NO: 8028483 - DNA, 22 bp, Homo sapiens
tgaacaacagatgtccattgtt

SEQ ID NO: 8028484 - DNA, 22 bp, Homo sapiens
tgaacaaatggaaataaccagt

SEQ ID NO: 8028485 - DNA, 22 bp, Homo sapiens
tgaacaaatggaaataaccagt

SEQ ID NO: 8028486 - DNA, 22 bp, Homo sapiens
tgaacacacacatcttaataat

SEQ ID NO: 8028487 - DNA, 22 bp, Homo sapiens
tgaacacacacatcttaataat

SEQ ID NO: 8028488 - DNA, 22 bp, Homo sapiens
tgaacacacacatcttaataat

SEQ ID NO: 8028489 - DNA, 22 bp, Homo sapiens
tgaacacaaatattttggggtt

SEQ ID NO: 8028490 - DNA, 18 bp, Homo sapiens
tgaactttggtgtctctc

SEQ ID NO: 8028491 - DNA, 18 bp, Homo sapiens
tgaactttggtgtctctc

SEQ ID NO: 8028492 - DNA, 22 bp, Homo sapiens
tgaactttgtagtaatggagat

SEQ ID NO: 8028493 - DNA, 22 bp, Homo sapiens
tgaactttcacaagaatatgct

SEQ ID NO: 8028494 - DNA, 22 bp, Homo sapiens
tgaactttcacaagaatatgct

SEQ ID NO: 8028495 - DNA, 17 bp, Homo sapiens
tgaactttaggtggagc

SEQ ID NO: 8028496 - DNA, 22 bp, Homo sapiens
tgaacttgaattttggaaatac

SEQ ID NO: 8028497 - DNA, 22 bp, Homo sapiens
tgaacttagtgggaatatctct

SEQ ID NO: 8028498 - DNA, 22 bp, Homo sapiens
tgaacttacaaattaaaagact

SEQ ID NO: 8028499 - DNA, 18 bp, Homo sapiens
tgaactggcatcagaatc

SEQ ID NO: 8028500 - DNA, 22 bp, Homo sapiens
tgaactgtggccagtaattaat

SEQ ID NO: 8028501 - DNA, 21 bp, Homo sapiens
tgaactctggtcatcttcatt

SEQ ID NO: 8028502 - DNA, 22 bp, Homo sapiens
tgaactgagcagtttcctggga

SEQ ID NO: 8028503 - DNA, 22 bp, Homo sapiens
tgaactcctgacctcatgatcc

SEQ ID NO: 8028504 - DNA, 22 bp, Homo sapiens
tgaactcctgacctcatgatcc

SEQ ID NO: 8028505 - DNA, 22 bp, Homo sapiens
tgaactatacgataacatgatt

SEQ ID NO: 8028506 - DNA, 22 bp, Homo sapiens
tgaactacaaaaatcaacattt

SEQ ID NO: 8028507 - DNA, 22 bp, Homo sapiens
tgaactcctgacctcatgatcc

SEQ ID NO: 8028508 - DNA, 22 bp, Homo sapiens
tgaactcctgacctcatgatcc

SEQ ID NO: 8028509 - DNA, 22 bp, Homo sapiens
tgaacgcaggtccacatggctc

SEQ ID NO: 8028510 - DNA, 22 bp, Homo sapiens
tgaacgcaggtccacatggctc

SEQ ID NO: 8028511 - DNA, 22 bp, Homo sapiens
tgaacgcaggtccacatggctc

SEQ ID NO: 8028512 - DNA, 22 bp, Homo sapiens
tgaaccatctggctccagaaga

SEQ ID NO: 8028513 - DNA, 22 bp, Homo sapiens
tgaaccatctggctccagaaga

SEQ ID NO: 8028514 - DNA, 22 bp, Homo sapiens
tgaaccttttgctaagaagtta

SEQ ID NO: 8028515 - DNA, 22 bp, Homo sapiens
tgaaccttttgaataaggacca

SEQ ID NO: 8028516 - DNA, 22 bp, Homo sapiens
tgaaccttcataaaattaagtg

SEQ ID NO: 8028517 - DNA, 22 bp, Homo sapiens
tgaacctttgtgttggacctgg

SEQ ID NO: 8028518 - DNA, 22 bp, Homo sapiens
tgaacattgtcacattcctagc

SEQ ID NO: 8028519 - DNA, 22 bp, Homo sapiens
tgaacattcctgaatgaagcat

SEQ ID NO: 8028520 - DNA, 22 bp, Homo sapiens
tgaaccacaggagggttcatgt

SEQ ID NO: 8028521 - DNA, 22 bp, Homo sapiens
tgaaccagagtctccagtggtt

SEQ ID NO: 8028522 - DNA, 22 bp, Homo sapiens
tgaaccaggaggcagccagcac

SEQ ID NO: 8028523 - DNA, 22 bp, Homo sapiens
tgaacatacaattattaagaac

SEQ ID NO: 8028524 - DNA, 22 bp, Homo sapiens
tgaacatacaattattaagaac

SEQ ID NO: 8028525 - DNA, 22 bp, Homo sapiens
tgaacatattcacctctaaata

SEQ ID NO: 8028526 - DNA, 22 bp, Homo sapiens
tgaacatattcacctctaaata

SEQ ID NO: 8028527 - DNA, 22 bp, Homo sapiens
tgaacatgctgttgatggcctg

SEQ ID NO: 8028528 - DNA, 22 bp, Homo sapiens
tgaacatgctgttgatggcctg

SEQ ID NO: 8028529 - DNA, 22 bp, Homo sapiens
tgaacatgctgttgatggcctg

SEQ ID NO: 8028530 - DNA, 22 bp, Homo sapiens
tgaacatgctgttgatggcctg

SEQ ID NO: 8028531 - DNA, 22 bp, Homo sapiens
tgaacatgctgttgatggcctg

SEQ ID NO: 8028532 - DNA, 22 bp, Homo sapiens
tgaacattggcacaaggcagca

SEQ ID NO: 8028533 - DNA, 23 bp, Homo sapiens
tgagggacatggtggcttctgag

SEQ ID NO: 8028534 - DNA, 22 bp, Homo sapiens
tgagggacaccagggctggagc

SEQ ID NO: 8028535 - DNA, 22 bp, Homo sapiens
tgagggaatcctcacatcaatc

SEQ ID NO: 8028536 - DNA, 22 bp, Homo sapiens
tgagggaatattgatagatccg

SEQ ID NO: 8028537 - DNA, 22 bp, Homo sapiens
tgaggctttatgtaagggtgca

SEQ ID NO: 8028538 - DNA, 22 bp, Homo sapiens
tgaggcttgtctcagatggggg

SEQ ID NO: 8028539 - DNA, 22 bp, Homo sapiens
tgaggctttatgtaagggtgca

SEQ ID NO: 8028540 - DNA, 22 bp, Homo sapiens
tgaggcttgtctcagatggggg

SEQ ID NO: 8028541 - DNA, 22 bp, Homo sapiens
tgaggcttgtctcagatggggg

SEQ ID NO: 8028542 - DNA, 22 bp, Homo sapiens
tgaggcttggcaaaagagtggt

SEQ ID NO: 8028543 - DNA, 22 bp, Homo sapiens
tgaggcttgtctcagatggggg

SEQ ID NO: 8028544 - DNA, 22 bp, Homo sapiens
tgaggcttggcaaaagagtggt

SEQ ID NO: 8028545 - DNA, 22 bp, Homo sapiens
tgaggcttggaggctccagtgg

SEQ ID NO: 8028546 - DNA, 22 bp, Homo sapiens
tgaggcttggagaggtcaggga

SEQ ID NO: 8028547 - DNA, 22 bp, Homo sapiens
tgagggactcagaattcagcct

SEQ ID NO: 8028548 - DNA, 22 bp, Homo sapiens
tgagggactgcatacccagctt

SEQ ID NO: 8028549 - DNA, 22 bp, Homo sapiens
tgagggactcagaattcagcct

SEQ ID NO: 8028550 - DNA, 22 bp, Homo sapiens
tgagggactgcatacccagctt

SEQ ID NO: 8028551 - DNA, 22 bp, Homo sapiens
tgagggagagggcgaaaatgaa

SEQ ID NO: 8028552 - DNA, 22 bp, Homo sapiens
tgagggagagggcgaaaatgaa

SEQ ID NO: 8028553 - DNA, 22 bp, Homo sapiens
tgagggacttgctagttctctg

SEQ ID NO: 8028554 - DNA, 22 bp, Homo sapiens
tgagggagcacacactgaagtg

SEQ ID NO: 8028555 - DNA, 22 bp, Homo sapiens
tgagggagcacacactgaagtg

SEQ ID NO: 8028556 - DNA, 22 bp, Homo sapiens
tgagggagctgacctttctgtg

SEQ ID NO: 8028557 - DNA, 22 bp, Homo sapiens
tgagggaggccctttgagcaga

SEQ ID NO: 8028558 - DNA, 22 bp, Homo sapiens
tgagggaggccctttgagcaga

SEQ ID NO: 8028559 - DNA, 22 bp, Homo sapiens
tgagggagctgacctttctgtg

SEQ ID NO: 8028560 - DNA, 22 bp, Homo sapiens
tgagggaggccctttgagcaga

SEQ ID NO: 8028561 - DNA, 20 bp, Homo sapiens
tgagggagtattgatttccc

SEQ ID NO: 8028562 - DNA, 22 bp, Homo sapiens
tgagggagtcatgattaaggaa

SEQ ID NO: 8028563 - DNA, 22 bp, Homo sapiens
tgagggaggcctccatctgcca

SEQ ID NO: 8028564 - DNA, 22 bp, Homo sapiens
tgagggaggcctccatctgcca

SEQ ID NO: 8028565 - DNA, 22 bp, Homo sapiens
tgagggaggcctccatctgcca

SEQ ID NO: 8028566 - DNA, 22 bp, Homo sapiens
tgagggaggcctccatctgcca

SEQ ID NO: 8028567 - DNA, 22 bp, Homo sapiens
tgagggaggccctttgagcaga

SEQ ID NO: 8028568 - DNA, 22 bp, Homo sapiens
tgagggaggcctccatctgcca

SEQ ID NO: 8028569 - DNA, 22 bp, Homo sapiens
tgaggggaggttggggcacatc

SEQ ID NO: 8028570 - DNA, 22 bp, Homo sapiens
tgaggggaggttggggcacatc

SEQ ID NO: 8028571 - DNA, 22 bp, Homo sapiens
tgaggggaggttggggcacatc

SEQ ID NO: 8028572 - DNA, 22 bp, Homo sapiens
tgaggggaggttggggcacatc

SEQ ID NO: 8028573 - DNA, 22 bp, Homo sapiens
tgaggggaggttggggcacatc

SEQ ID NO: 8028574 - DNA, 22 bp, Homo sapiens
tgaggggaggttggggcacatc

SEQ ID NO: 8028575 - DNA, 22 bp, Homo sapiens
tgaggggatacggtacacattg

SEQ ID NO: 8028576 - DNA, 22 bp, Homo sapiens
tgaggggatacggtacacattg

SEQ ID NO: 8028577 - DNA, 22 bp, Homo sapiens
tgaggggatacggtacacattg

SEQ ID NO: 8028578 - DNA, 22 bp, Homo sapiens
tgaggggcagagaggtgtccag

SEQ ID NO: 8028579 - DNA, 19 bp, Homo sapiens
tgaggggaggagaggcctg

SEQ ID NO: 8028580 - DNA, 19 bp, Homo sapiens
tgaggggaggagaggcctg

SEQ ID NO: 8028581 - DNA, 19 bp, Homo sapiens
tgaggggaggagaggcctg

SEQ ID NO: 8028582 - DNA, 19 bp, Homo sapiens
tgaggggaggagaggcctg

SEQ ID NO: 8028583 - DNA, 19 bp, Homo sapiens
tgaggggaggagaggcctg

SEQ ID NO: 8028584 - DNA, 19 bp, Homo sapiens
tgaggggaggagaggcctg

SEQ ID NO: 8028585 - DNA, 19 bp, Homo sapiens
tgaggggaggagaggcctg

SEQ ID NO: 8028586 - DNA, 19 bp, Homo sapiens
tgaggggaggagaggcctg

SEQ ID NO: 8028587 - DNA, 22 bp, Homo sapiens
tgaggggagcccgccctggacg

SEQ ID NO: 8028588 - DNA, 22 bp, Homo sapiens
tgaggggagcccgccctggacg

SEQ ID NO: 8028589 - DNA, 22 bp, Homo sapiens
tgaggggagcccgccctggacg

SEQ ID NO: 8028590 - DNA, 22 bp, Homo sapiens
tgaggggagcccgccctggacg

SEQ ID NO: 8028591 - DNA, 22 bp, Homo sapiens
tgaggggagcccgccctggacg

SEQ ID NO: 8028592 - DNA, 22 bp, Homo sapiens
tgaggggagctagcatgccttg

SEQ ID NO: 8028593 - DNA, 22 bp, Homo sapiens
tgaggggagctagcatgccttg

SEQ ID NO: 8028594 - DNA, 22 bp, Homo sapiens
tgagggagtgtggatacagtag

SEQ ID NO: 8028595 - DNA, 22 bp, Homo sapiens
tgagggagttgggtgtatagga

SEQ ID NO: 8028596 - DNA, 22 bp, Homo sapiens
tgagggagttgggtgtatagga

SEQ ID NO: 8028597 - DNA, 22 bp, Homo sapiens
tgagggagttgggtgtatagga

SEQ ID NO: 8028598 - DNA, 22 bp, Homo sapiens
tgagggagttgggtgtatagga

SEQ ID NO: 8028599 - DNA, 22 bp, Homo sapiens
tgagggagtcatgattaaggaa

SEQ ID NO: 8028600 - DNA, 22 bp, Homo sapiens
tgagggagtgtggatacagtag

SEQ ID NO: 8028601 - DNA, 22 bp, Homo sapiens
tgagggagtgtggatacagtag

SEQ ID NO: 8028602 - DNA, 22 bp, Homo sapiens
tgagggagtgtggatacagtag

SEQ ID NO: 8028603 - DNA, 22 bp, Homo sapiens
tgagggagtgtggatacagtag

SEQ ID NO: 8028604 - DNA, 22 bp, Homo sapiens
tgaggggagacagagtggactc

SEQ ID NO: 8028605 - DNA, 22 bp, Homo sapiens
tgaggggagacagagtggactc

SEQ ID NO: 8028606 - DNA, 22 bp, Homo sapiens
tgaggggagacagagtggactc

SEQ ID NO: 8028607 - DNA, 22 bp, Homo sapiens
tgaggggagacagagtggactc

SEQ ID NO: 8028608 - DNA, 22 bp, Homo sapiens
tgaggggagacagagtggactc

SEQ ID NO: 8028609 - DNA, 22 bp, Homo sapiens
tgaggggagacagagtggactc

SEQ ID NO: 8028610 - DNA, 22 bp, Homo sapiens
tgaggggaaggcatgataaata

SEQ ID NO: 8028611 - DNA, 22 bp, Homo sapiens
tgaggggaactgatgcccattg

SEQ ID NO: 8028612 - DNA, 22 bp, Homo sapiens
tgaggggagaagcagcagcctg

SEQ ID NO: 8028613 - DNA, 22 bp, Homo sapiens
tgaggggagaagcagcagcctg

SEQ ID NO: 8028614 - DNA, 22 bp, Homo sapiens
tgaggggagaagcagcagcctg

SEQ ID NO: 8028615 - DNA, 22 bp, Homo sapiens
tgaggggagaagcagcagcctg

SEQ ID NO: 8028616 - DNA, 22 bp, Homo sapiens
tgaggctcagagaagtgctgtt

SEQ ID NO: 8028617 - DNA, 18 bp, Homo sapiens
tgaggctcagagacggtg

SEQ ID NO: 8028618 - DNA, 20 bp, Homo sapiens
tgaggctcagagaggttgag

SEQ ID NO: 8028619 - DNA, 22 bp, Homo sapiens
tgaggctcagagaagtgctgtt

SEQ ID NO: 8028620 - DNA, 22 bp, Homo sapiens
tgaggctcagagaagtgctgtt

SEQ ID NO: 8028621 - DNA, 22 bp, Homo sapiens
tgaggctcagagaagtgctgtt

SEQ ID NO: 8028622 - DNA, 22 bp, Homo sapiens
tgaggctcagagaagtgctgtt

SEQ ID NO: 8028623 - DNA, 22 bp, Homo sapiens
tgaggctcacgaacagaagact

SEQ ID NO: 8028624 - DNA, 22 bp, Homo sapiens
tgaggctcagaaatgtaagttt

SEQ ID NO: 8028625 - DNA, 22 bp, Homo sapiens
tgaggctcacgaacagaagact

SEQ ID NO: 8028626 - DNA, 22 bp, Homo sapiens
tgaggctcagaagtgccaagtg

SEQ ID NO: 8028627 - DNA, 22 bp, Homo sapiens
tgaggctcagaagtgccaagtg

SEQ ID NO: 8028628 - DNA, 22 bp, Homo sapiens
tgaggctcagagaacagtgact

SEQ ID NO: 8028629 - DNA, 22 bp, Homo sapiens
tgaggctcagagaacagtgact

SEQ ID NO: 8028630 - DNA, 22 bp, Homo sapiens
tgaggctcagtgagccctgcag

SEQ ID NO: 8028631 - DNA, 18 bp, Homo sapiens
tgaggctcagctcctggt

SEQ ID NO: 8028632 - DNA, 18 bp, Homo sapiens
tgaggctcagctcctggt

SEQ ID NO: 8028633 - DNA, 18 bp, Homo sapiens
tgaggctcagctcctggt

SEQ ID NO: 8028634 - DNA, 22 bp, Homo sapiens
tgaggctcagagcacctgctcc

SEQ ID NO: 8028635 - DNA, 20 bp, Homo sapiens
tgaggctcagagaggttgag

SEQ ID NO: 8028636 - DNA, 20 bp, Homo sapiens
tgaggctcagagaggttgag

SEQ ID NO: 8028637 - DNA, 22 bp, Homo sapiens
tgaggctccagccaggccagca

SEQ ID NO: 8028638 - DNA, 22 bp, Homo sapiens
tgaggctccttgtagagagtgg

SEQ ID NO: 8028639 - DNA, 22 bp, Homo sapiens
tgaggctccttgtagagagtgg

SEQ ID NO: 8028640 - DNA, 21 bp, Homo sapiens
tgaggctcatcttatgtggct

SEQ ID NO: 8028641 - DNA, 21 bp, Homo sapiens
tgaggctcatcttatgtggct

SEQ ID NO: 8028642 - DNA, 22 bp, Homo sapiens
tgaggctcattctgcatgccaa

SEQ ID NO: 8028643 - DNA, 22 bp, Homo sapiens
tgaggcctggactctgcatgga

SEQ ID NO: 8028644 - DNA, 22 bp, Homo sapiens
tgaggcctggactctgcatgga

SEQ ID NO: 8028645 - DNA, 22 bp, Homo sapiens
tgaggcctggactctgcatgga

SEQ ID NO: 8028646 - DNA, 22 bp, Homo sapiens
tgaggcctgcttggaattgaat

SEQ ID NO: 8028647 - DNA, 22 bp, Homo sapiens
tgaggcctgcttggaattgaat

SEQ ID NO: 8028648 - DNA, 21 bp, Homo sapiens
tgaggcctgccagtctcagaa

SEQ ID NO: 8028649 - DNA, 21 bp, Homo sapiens
tgaggcctgccagtctcagaa

SEQ ID NO: 8028650 - DNA, 22 bp, Homo sapiens
tgaggcctgccctggggaagtt

SEQ ID NO: 8028651 - DNA, 22 bp, Homo sapiens
tgaggcctgccctggggaagtt

SEQ ID NO: 8028652 - DNA, 22 bp, Homo sapiens
tgaggcctgccctggggaagtt

SEQ ID NO: 8028653 - DNA, 22 bp, Homo sapiens
tgaggcctggagggaggagttt

SEQ ID NO: 8028654 - DNA, 22 bp, Homo sapiens
tgaggcctggagggaggagttt

SEQ ID NO: 8028655 - DNA, 22 bp, Homo sapiens
tgaggcctggagggaggagttt

SEQ ID NO: 8028656 - DNA, 22 bp, Homo sapiens
tgaggcctggagggaggagttt

SEQ ID NO: 8028657 - DNA, 22 bp, Homo sapiens
tgaggcctggactctgcatgga

SEQ ID NO: 8028658 - DNA, 22 bp, Homo sapiens
tgaggcctgggcacataacctc

SEQ ID NO: 8028659 - DNA, 22 bp, Homo sapiens
tgaggcctgggcacataacctc

SEQ ID NO: 8028660 - DNA, 22 bp, Homo sapiens
tgaggcctggagggaggagttt

SEQ ID NO: 8028661 - DNA, 22 bp, Homo sapiens
tgaggctcaagaatagacagta

SEQ ID NO: 8028662 - DNA, 20 bp, Homo sapiens
tgaggcgacgaagaggcggc

SEQ ID NO: 8028663 - DNA, 22 bp, Homo sapiens
tgaggctaaaggtgaccagatt

SEQ ID NO: 8028664 - DNA, 22 bp, Homo sapiens
tgaggctcaagaaagatttgtt

SEQ ID NO: 8028665 - DNA, 22 bp, Homo sapiens
tgaggctcaagaaagatttgtt

SEQ ID NO: 8028666 - DNA, 22 bp, Homo sapiens
tgaggccttagtaaccctgcac

SEQ ID NO: 8028667 - DNA, 22 bp, Homo sapiens
tgaggccttagtaaccctgcac

SEQ ID NO: 8028668 - DNA, 22 bp, Homo sapiens
tgaggccttagtaaccctgcac

SEQ ID NO: 8028669 - DNA, 22 bp, Homo sapiens
tgaggcctgtcattgtcttgtt

SEQ ID NO: 8028670 - DNA, 22 bp, Homo sapiens
tgaggccttttctgtctggcta

SEQ ID NO: 8028671 - DNA, 19 bp, Homo sapiens
tgaggccttggatgaaagg

SEQ ID NO: 8028672 - DNA, 19 bp, Homo sapiens
tgaggccttggatgaaagg

SEQ ID NO: 8028673 - DNA, 22 bp, Homo sapiens
tgaggccttttctgtctggcta

SEQ ID NO: 8028674 - DNA, 22 bp, Homo sapiens
tgaggccttttctgtctggcta

SEQ ID NO: 8028675 - DNA, 22 bp, Homo sapiens
tgaggctcttctgtaaatgatc

SEQ ID NO: 8028676 - DNA, 22 bp, Homo sapiens
tgaggctgccttgggaagaggg

SEQ ID NO: 8028677 - DNA, 21 bp, Homo sapiens
tgaggctctgttgtgcctgca

SEQ ID NO: 8028678 - DNA, 21 bp, Homo sapiens
tgaggctctgttgtgcctgca

SEQ ID NO: 8028679 - DNA, 22 bp, Homo sapiens
tgaggctctgcttctgtggctc

SEQ ID NO: 8028680 - DNA, 22 bp, Homo sapiens
tgaggctctgcttctgtggctc

SEQ ID NO: 8028681 - DNA, 22 bp, Homo sapiens
tgaggctctgcttctgtggctc

SEQ ID NO: 8028682 - DNA, 17 bp, Homo sapiens
tgaggctcggtgaggag

SEQ ID NO: 8028683 - DNA, 17 bp, Homo sapiens
tgaggctcggtgaggag

SEQ ID NO: 8028684 - DNA, 17 bp, Homo sapiens
tgaggctcggtgaggag

SEQ ID NO: 8028685 - DNA, 17 bp, Homo sapiens
tgaggctcggtgaggag

SEQ ID NO: 8028686 - DNA, 22 bp, Homo sapiens
tgaggctctatgtggtagatta

SEQ ID NO: 8028687 - DNA, 22 bp, Homo sapiens
tgaggctctatgtggtagatta

SEQ ID NO: 8028688 - DNA, 22 bp, Homo sapiens
tgaggctctatgtggtagatta

SEQ ID NO: 8028689 - DNA, 22 bp, Homo sapiens
tgaggctctccaagcagatgag

SEQ ID NO: 8028690 - DNA, 22 bp, Homo sapiens
tgaggctctccaagcagatgag

SEQ ID NO: 8028691 - DNA, 22 bp, Homo sapiens
tgaggctgccttgggaagaggg

SEQ ID NO: 8028692 - DNA, 22 bp, Homo sapiens
tgaggctgccttgggaagaggg

SEQ ID NO: 8028693 - DNA, 22 bp, Homo sapiens
tgaggctggatgggatgcctcc

SEQ ID NO: 8028694 - DNA, 22 bp, Homo sapiens
tgaggctggatgggatgcctcc

SEQ ID NO: 8028695 - DNA, 22 bp, Homo sapiens
tgaggctggcaaggctggtatt

SEQ ID NO: 8028696 - DNA, 22 bp, Homo sapiens
tgaggctggcaaggctggtatt

SEQ ID NO: 8028697 - DNA, 22 bp, Homo sapiens
tgaggctggcaaggctggtatt

SEQ ID NO: 8028698 - DNA, 22 bp, Homo sapiens
tgaggctggatgggatgcctcc

SEQ ID NO: 8028699 - DNA, 22 bp, Homo sapiens
tgaggctggcaaggctggtatt

SEQ ID NO: 8028700 - DNA, 22 bp, Homo sapiens
tgaggctggatgggatgcctcc

SEQ ID NO: 8028701 - DNA, 22 bp, Homo sapiens
tgaggctggatgggatgcctcc

SEQ ID NO: 8028702 - DNA, 22 bp, Homo sapiens
tgaggctggatgggatgcctcc

SEQ ID NO: 8028703 - DNA, 22 bp, Homo sapiens
tgaggctggcaaggctggtatt

SEQ ID NO: 8028704 - DNA, 22 bp, Homo sapiens
tgaggctgttctaccagggcca

SEQ ID NO: 8028705 - DNA, 22 bp, Homo sapiens
tgaggctgttctaccagggcca

SEQ ID NO: 8028706 - DNA, 22 bp, Homo sapiens
tgaggctgttctaccagggcca

SEQ ID NO: 8028707 - DNA, 22 bp, Homo sapiens
tgaggctgttctaccagggcca

SEQ ID NO: 8028708 - DNA, 22 bp, Homo sapiens
tgaggctgttctaccagggcca

SEQ ID NO: 8028709 - DNA, 22 bp, Homo sapiens
tgaggctgttctaccagggcca

SEQ ID NO: 8028710 - DNA, 22 bp, Homo sapiens
tgaggctgttctaccagggcca

SEQ ID NO: 8028711 - DNA, 21 bp, Homo sapiens
tgaggctgttgtaccagggag

SEQ ID NO: 8028712 - DNA, 21 bp, Homo sapiens
tgaggctgttgtaccagggag

SEQ ID NO: 8028713 - DNA, 21 bp, Homo sapiens
tgaggctgttgtaccagggag

SEQ ID NO: 8028714 - DNA, 21 bp, Homo sapiens
tgaggctgttgtaccagggag

SEQ ID NO: 8028715 - DNA, 22 bp, Homo sapiens
tgaggcttagagaagatgggat

SEQ ID NO: 8028716 - DNA, 22 bp, Homo sapiens
tgaggcttagagaagatgggat

SEQ ID NO: 8028717 - DNA, 21 bp, Homo sapiens
tgaggctgttgtaccagggag

SEQ ID NO: 8028718 - DNA, 21 bp, Homo sapiens
tgaggctgttgtaccagggag

SEQ ID NO: 8028719 - DNA, 21 bp, Homo sapiens
tgaggctgttgtaccagggag

SEQ ID NO: 8028720 - DNA, 21 bp, Homo sapiens
tgaggctgttgtaccagggag

SEQ ID NO: 8028721 - DNA, 21 bp, Homo sapiens
tgaggctgttgtaccagggag

SEQ ID NO: 8028722 - DNA, 21 bp, Homo sapiens
tgaggctgttgtaccagggag

SEQ ID NO: 8028723 - DNA, 22 bp, Homo sapiens
tgaggcttccaacatgtgagaa

SEQ ID NO: 8028724 - DNA, 22 bp, Homo sapiens
tgaggcttccaacatgtgagaa

SEQ ID NO: 8028725 - DNA, 22 bp, Homo sapiens
tgaggcttagagaagatgggat

SEQ ID NO: 8028726 - DNA, 22 bp, Homo sapiens
tgaggcttagagaagatgggat

SEQ ID NO: 8028727 - DNA, 22 bp, Homo sapiens
tgaggcttggagaggtcaggga

SEQ ID NO: 8028728 - DNA, 22 bp, Homo sapiens
tgaggcttccaacatgtgagaa

SEQ ID NO: 8028729 - DNA, 22 bp, Homo sapiens
tgaggcttccaacatgtgagaa

SEQ ID NO: 8028730 - DNA, 23 bp, Homo sapiens
tgagtcttgagctttggattctg

SEQ ID NO: 8028731 - DNA, 21 bp, Homo sapiens
tgagtcttttaataggtgcac

SEQ ID NO: 8028732 - DNA, 22 bp, Homo sapiens
tgagtctttagaattctaactt

SEQ ID NO: 8028733 - DNA, 22 bp, Homo sapiens
tgagtctgggcatgttcacttt

SEQ ID NO: 8028734 - DNA, 22 bp, Homo sapiens
tgagtctgtatgtccagattta

SEQ ID NO: 8028735 - DNA, 22 bp, Homo sapiens
tgagtctgggcatgttcacttt

SEQ ID NO: 8028736 - DNA, 23 bp, Homo sapiens
tgagtcaccacagttacagtcac

SEQ ID NO: 8028737 - DNA, 22 bp, Homo sapiens
tgagtcacccacattaaaatgt

SEQ ID NO: 8028738 - DNA, 22 bp, Homo sapiens
tgagtcacatccatttttgtgt

SEQ ID NO: 8028739 - DNA, 22 bp, Homo sapiens
tgagtcactgggtaatctggat

SEQ ID NO: 8028740 - DNA, 19 bp, Homo sapiens
tgagtcactcttacagtca

SEQ ID NO: 8028741 - DNA, 22 bp, Homo sapiens
tgagtattttaagttctcaatc

SEQ ID NO: 8028742 - DNA, 22 bp, Homo sapiens
tgagtatttctaatattccagt

SEQ ID NO: 8028743 - DNA, 21 bp, Homo sapiens
tgagtatttgaatttctgtca

SEQ ID NO: 8028744 - DNA, 22 bp, Homo sapiens
tgagtattttaagttctcaatc

SEQ ID NO: 8028745 - DNA, 22 bp, Homo sapiens
tgagtcacacatttcttcatac

SEQ ID NO: 8028746 - DNA, 18 bp, Homo sapiens
tgagtatccagagtcttc

SEQ ID NO: 8028747 - DNA, 22 bp, Homo sapiens
tgagtatcctatatggtgtaag

SEQ ID NO: 8028748 - DNA, 22 bp, Homo sapiens
tgagtatcaattacatagttgt

SEQ ID NO: 8028749 - DNA, 22 bp, Homo sapiens
tgagtatattttccctgggtgg

SEQ ID NO: 8028750 - DNA, 22 bp, Homo sapiens
tgagtatattgagtttagggca

SEQ ID NO: 8028751 - DNA, 22 bp, Homo sapiens
tgagtattgaagcgatttcaat

SEQ ID NO: 8028752 - DNA, 22 bp, Homo sapiens
tgagtaggtggttaagcatgga

SEQ ID NO: 8028753 - DNA, 22 bp, Homo sapiens
tgagtatacactcctaagggta

SEQ ID NO: 8028754 - DNA, 22 bp, Homo sapiens
tgagtatacaatggcactgcca

SEQ ID NO: 8028755 - DNA, 22 bp, Homo sapiens
tgagtataaaacatatacatca

SEQ ID NO: 8028756 - DNA, 22 bp, Homo sapiens
tgagtataaaacatatacatca

SEQ ID NO: 8028757 - DNA, 22 bp, Homo sapiens
tgagtatatacccagaagtgga

SEQ ID NO: 8028758 - DNA, 22 bp, Homo sapiens
tgagtatatacccagaagtgga

SEQ ID NO: 8028759 - DNA, 22 bp, Homo sapiens
tgagtatagcatgatgggccat

SEQ ID NO: 8028760 - DNA, 22 bp, Homo sapiens
tgagtatagaaagtcacccttt

SEQ ID NO: 8028761 - DNA, 22 bp, Homo sapiens
tgagtatattaatttgccagca

SEQ ID NO: 8028762 - DNA, 22 bp, Homo sapiens
tgagtatatgatttgtgtttgc

SEQ ID NO: 8028763 - DNA, 22 bp, Homo sapiens
tgagtagagaattcagctaagg

SEQ ID NO: 8028764 - DNA, 22 bp, Homo sapiens
tgagtactttatgttagttatt

SEQ ID NO: 8028765 - DNA, 22 bp, Homo sapiens
tgagtaggatagggtggggctt

SEQ ID NO: 8028766 - DNA, 22 bp, Homo sapiens
tgagtagcggctatgtgtaact

SEQ ID NO: 8028767 - DNA, 22 bp, Homo sapiens
tgagtagcggctatgtgtaact

SEQ ID NO: 8028768 - DNA, 22 bp, Homo sapiens
tgagtagagaattcagctaagg

SEQ ID NO: 8028769 - DNA, 22 bp, Homo sapiens
tgagtactcggagtgctttgga

SEQ ID NO: 8028770 - DNA, 22 bp, Homo sapiens
tgagtactcttctcactacacc

SEQ ID NO: 8028771 - DNA, 22 bp, Homo sapiens
tgagtaacacagtatgcttaca

SEQ ID NO: 8028772 - DNA, 22 bp, Homo sapiens
tgagtaactctacatatgtaca

SEQ ID NO: 8028773 - DNA, 22 bp, Homo sapiens
tgagtaatctcacatattatgt

SEQ ID NO: 8028774 - DNA, 22 bp, Homo sapiens
tgagtaccgctacgttgtccat

SEQ ID NO: 8028775 - DNA, 22 bp, Homo sapiens
tgagtacaagcagtgctttctc

SEQ ID NO: 8028776 - DNA, 22 bp, Homo sapiens
tgagtaccttctatgtgcttgg

SEQ ID NO: 8028777 - DNA, 22 bp, Homo sapiens
tgagtactccctaggtgctgta

SEQ ID NO: 8028778 - DNA, 22 bp, Homo sapiens
tgaggttcagttcttggccaca

SEQ ID NO: 8028779 - DNA, 22 bp, Homo sapiens
tgagtaaaaattctacatttcc

SEQ ID NO: 8028780 - DNA, 22 bp, Homo sapiens
tgagtaaaagtgaatcttatgt

SEQ ID NO: 8028781 - DNA, 22 bp, Homo sapiens
tgagtaaatatttatgactaga

SEQ ID NO: 8028782 - DNA, 22 bp, Homo sapiens
tgagtaaatatttatgactaga

SEQ ID NO: 8028783 - DNA, 22 bp, Homo sapiens
tgagtaaatatcagtattgtgc

SEQ ID NO: 8028784 - DNA, 22 bp, Homo sapiens
tgagtaaagggccagatagtaa

SEQ ID NO: 8028785 - DNA, 17 bp, Homo sapiens
tgagtaaagcacatggt

SEQ ID NO: 8028786 - DNA, 22 bp, Homo sapiens
tgagtaaaagtgaatcttatgt

SEQ ID NO: 8028787 - DNA, 22 bp, Homo sapiens
tgaggtgggcttgtggatttgc

SEQ ID NO: 8028788 - DNA, 22 bp, Homo sapiens
tgaggtgggcttgtggatttgc

SEQ ID NO: 8028789 - DNA, 22 bp, Homo sapiens
tgaggtgggtgtcaggtcagag

SEQ ID NO: 8028790 - DNA, 22 bp, Homo sapiens
tgaggtggctagggaggcactc

SEQ ID NO: 8028791 - DNA, 22 bp, Homo sapiens
tgaggtggctggatctcagcct

SEQ ID NO: 8028792 - DNA, 22 bp, Homo sapiens
tgaggtggctagggaggcactc

SEQ ID NO: 8028793 - DNA, 22 bp, Homo sapiens
tgaggtggctagggaggcactc

SEQ ID NO: 8028794 - DNA, 22 bp, Homo sapiens
tgaggtggctagggaggcactc

SEQ ID NO: 8028795 - DNA, 22 bp, Homo sapiens
tgaggtggctagggaggcactc

SEQ ID NO: 8028796 - DNA, 22 bp, Homo sapiens
tgaggtgccacccaagagcctt

SEQ ID NO: 8028797 - DNA, 22 bp, Homo sapiens
tgaggtgatacagaccctactt

SEQ ID NO: 8028798 - DNA, 22 bp, Homo sapiens
tgaggtgataataactccctgc

SEQ ID NO: 8028799 - DNA, 22 bp, Homo sapiens
tgaggtgatacagaccctactt

SEQ ID NO: 8028800 - DNA, 22 bp, Homo sapiens
tgaggtgataataactccctgc

SEQ ID NO: 8028801 - DNA, 22 bp, Homo sapiens
tgaggtggccgaggagcaggac

SEQ ID NO: 8028802 - DNA, 22 bp, Homo sapiens
tgaggtggccgaggagcaggac

SEQ ID NO: 8028803 - DNA, 22 bp, Homo sapiens
tgaggtggccgaggagcaggac

SEQ ID NO: 8028804 - DNA, 22 bp, Homo sapiens
tgaggtggctagggaggcactc

SEQ ID NO: 8028805 - DNA, 22 bp, Homo sapiens
tgaggtggtgctaatctctgct

SEQ ID NO: 8028806 - DNA, 22 bp, Homo sapiens
tgaggtggtgctaatctctgct

SEQ ID NO: 8028807 - DNA, 22 bp, Homo sapiens
tgaggtggttactgtggtgctc

SEQ ID NO: 8028808 - DNA, 22 bp, Homo sapiens
tgaggtggttactgtggtgctc

SEQ ID NO: 8028809 - DNA, 22 bp, Homo sapiens
tgaggtggttactgtggtgctc

SEQ ID NO: 8028810 - DNA, 22 bp, Homo sapiens
tgaggtggtccaaagactgttt

SEQ ID NO: 8028811 - DNA, 22 bp, Homo sapiens
tgaggtggtccaaagactgttt

SEQ ID NO: 8028812 - DNA, 22 bp, Homo sapiens
tgaggtgggtgtcaggtcagag

SEQ ID NO: 8028813 - DNA, 22 bp, Homo sapiens
tgaggtgggtgtcaggtcagag

SEQ ID NO: 8028814 - DNA, 22 bp, Homo sapiens
tgaggtgggtgtcaggtcagag

SEQ ID NO: 8028815 - DNA, 22 bp, Homo sapiens
tgaggtggtttgtatcactggg

SEQ ID NO: 8028816 - DNA, 22 bp, Homo sapiens
tgaggtggttcaagagccttgt

SEQ ID NO: 8028817 - DNA, 22 bp, Homo sapiens
tgaggtggtttgtatcactggg

SEQ ID NO: 8028818 - DNA, 22 bp, Homo sapiens
tgaggtggttactgtggtgctc

SEQ ID NO: 8028819 - DNA, 22 bp, Homo sapiens
tgaggtggttactgtggtgctc

SEQ ID NO: 8028820 - DNA, 22 bp, Homo sapiens
tgaggtggttactgtggtgctc

SEQ ID NO: 8028821 - DNA, 22 bp, Homo sapiens
tgaggtggttcaagagccttgt

SEQ ID NO: 8028822 - DNA, 22 bp, Homo sapiens
tgaggggccgcccaagcacttc

SEQ ID NO: 8028823 - DNA, 22 bp, Homo sapiens
tgaggggccgcccaagcacttc

SEQ ID NO: 8028824 - DNA, 22 bp, Homo sapiens
tgaggggccgcccaagcacttc

SEQ ID NO: 8028825 - DNA, 22 bp, Homo sapiens
tgaggggccgcccaagcacttc

SEQ ID NO: 8028826 - DNA, 22 bp, Homo sapiens
tgaggggcgctggcaggttcct

SEQ ID NO: 8028827 - DNA, 22 bp, Homo sapiens
tgaggggcgctggcaggttcct

SEQ ID NO: 8028828 - DNA, 22 bp, Homo sapiens
tgaggggcgctggcaggttcct

SEQ ID NO: 8028829 - DNA, 22 bp, Homo sapiens
tgaggggcagagaggtgtccag

SEQ ID NO: 8028830 - DNA, 22 bp, Homo sapiens
tgaggggcatgtgtttacacat

SEQ ID NO: 8028831 - DNA, 22 bp, Homo sapiens
tgaggggcagagaggtgtccag

SEQ ID NO: 8028832 - DNA, 22 bp, Homo sapiens
tgaggggccagaccccacctag

SEQ ID NO: 8028833 - DNA, 22 bp, Homo sapiens
tgaggggccagaccccacctag

SEQ ID NO: 8028834 - DNA, 22 bp, Homo sapiens
tgaggggcggcctgcagaggcc

SEQ ID NO: 8028835 - DNA, 22 bp, Homo sapiens
tgaggggcggcctgcagaggcc

SEQ ID NO: 8028836 - DNA, 22 bp, Homo sapiens
tgaggggcggcctgcagaggcc

SEQ ID NO: 8028837 - DNA, 22 bp, Homo sapiens
tgaggggcggcctgcagaggcc

SEQ ID NO: 8028838 - DNA, 22 bp, Homo sapiens
tgaggggcgctggcaggttcct

SEQ ID NO: 8028839 - DNA, 22 bp, Homo sapiens
tgaggggcgctggcaggttcct

SEQ ID NO: 8028840 - DNA, 22 bp, Homo sapiens
tgaggggcggcctgcagaggcc

SEQ ID NO: 8028841 - DNA, 19 bp, Homo sapiens
tgaggggctcacagtctca

SEQ ID NO: 8028842 - DNA, 19 bp, Homo sapiens
tgaggggctcacagtctca

SEQ ID NO: 8028843 - DNA, 19 bp, Homo sapiens
tgaggggctcacagtctca

SEQ ID NO: 8028844 - DNA, 19 bp, Homo sapiens
tgaggggctcacagtctca

SEQ ID NO: 8028845 - DNA, 22 bp, Homo sapiens
tgagggtgcatttagcatgtag

SEQ ID NO: 8028846 - DNA, 22 bp, Homo sapiens
tgagggtgcatttagcatgtag

SEQ ID NO: 8028847 - DNA, 22 bp, Homo sapiens
tgagggtggcacaggcacaaag

SEQ ID NO: 8028848 - DNA, 22 bp, Homo sapiens
tgagggtggcacaggcacaaag

SEQ ID NO: 8028849 - DNA, 22 bp, Homo sapiens
tgagggtctggaatctgggctt

SEQ ID NO: 8028850 - DNA, 19 bp, Homo sapiens
tgagggtgagctttggaga

SEQ ID NO: 8028851 - DNA, 19 bp, Homo sapiens
tgagggtgagctttggaga

SEQ ID NO: 8028852 - DNA, 22 bp, Homo sapiens
tgagggtctggaatctgggctt

SEQ ID NO: 8028853 - DNA, 22 bp, Homo sapiens
tgagggtagctggatcacggag

SEQ ID NO: 8028854 - DNA, 22 bp, Homo sapiens
tgagggtatatattgtgtggag

SEQ ID NO: 8028855 - DNA, 21 bp, Homo sapiens
tgaggggttataacagggtgg

SEQ ID NO: 8028856 - DNA, 22 bp, Homo sapiens
tgaggggttgtgagaaatgtag

SEQ ID NO: 8028857 - DNA, 22 bp, Homo sapiens
tgagggtaacctggagctgctg

SEQ ID NO: 8028858 - DNA, 22 bp, Homo sapiens
tgaggggggtaatcactgggtt

SEQ ID NO: 8028859 - DNA, 22 bp, Homo sapiens
tgaggggggtaatcactgggtt

SEQ ID NO: 8028860 - DNA, 22 bp, Homo sapiens
tgagggggttaattaggagagt

SEQ ID NO: 8028861 - DNA, 22 bp, Homo sapiens
tgaggggggtaatcactgggtt

SEQ ID NO: 8028862 - DNA, 22 bp, Homo sapiens
tgaggggggtaatcactgggtt

SEQ ID NO: 8028863 - DNA, 22 bp, Homo sapiens
tgaggggggtaatcactgggtt

SEQ ID NO: 8028864 - DNA, 22 bp, Homo sapiens
tgaggggggtaatcactgggtt

SEQ ID NO: 8028865 - DNA, 22 bp, Homo sapiens
tgaggggttaccttggagttga

SEQ ID NO: 8028866 - DNA, 22 bp, Homo sapiens
tgaggggttaccttggagttga

SEQ ID NO: 8028867 - DNA, 22 bp, Homo sapiens
tgaggggtctaggctgcgcacc

SEQ ID NO: 8028868 - DNA, 22 bp, Homo sapiens
tgagggggttaattaggagagt

SEQ ID NO: 8028869 - DNA, 22 bp, Homo sapiens
tgagggggttaattaggagagt

SEQ ID NO: 8028870 - DNA, 22 bp, Homo sapiens
tgagggggttaattaggagagt

SEQ ID NO: 8028871 - DNA, 22 bp, Homo sapiens
tgaggtctgctcaagtccctgg

SEQ ID NO: 8028872 - DNA, 22 bp, Homo sapiens
tgaggtctgcagggctgtgcat

SEQ ID NO: 8028873 - DNA, 22 bp, Homo sapiens
tgaggtctcagctgggaagact

SEQ ID NO: 8028874 - DNA, 18 bp, Homo sapiens
tgaggtagctttcctcct

SEQ ID NO: 8028875 - DNA, 22 bp, Homo sapiens
tgaggtaggagggtgatcagca

SEQ ID NO: 8028876 - DNA, 22 bp, Homo sapiens
tgaggtgaatggtgtccctgga

SEQ ID NO: 8028877 - DNA, 22 bp, Homo sapiens
tgaggtgaatggtgtccctgga

SEQ ID NO: 8028878 - DNA, 22 bp, Homo sapiens
tgaggtgaaggagttttaaagt

SEQ ID NO: 8028879 - DNA, 22 bp, Homo sapiens
tgaggtcttttatagtgtgtca

SEQ ID NO: 8028880 - DNA, 22 bp, Homo sapiens
tgaggtctgtcctgtctttgga

SEQ ID NO: 8028881 - DNA, 22 bp, Homo sapiens
tgaggtgaagagtggagctcag

SEQ ID NO: 8028882 - DNA, 22 bp, Homo sapiens
tgaggtcttttatagtgtgtca

SEQ ID NO: 8028883 - DNA, 22 bp, Homo sapiens
tgaggtgaagagtggagctcag

SEQ ID NO: 8028884 - DNA, 22 bp, Homo sapiens
tgaggtgaatggtgtccctgga

SEQ ID NO: 8028885 - DNA, 20 bp, Homo sapiens
tgaggtgaatgtcttttaga

SEQ ID NO: 8028886 - DNA, 22 bp, Homo sapiens
tgaggtgacaattcattctcca

SEQ ID NO: 8028887 - DNA, 22 bp, Homo sapiens
tgaggtgaccgcagatgggaag

SEQ ID NO: 8028888 - DNA, 22 bp, Homo sapiens
tgaggtgacacaatttactcca

SEQ ID NO: 8028889 - DNA, 22 bp, Homo sapiens
tgaggtgagatggctaccccaa

SEQ ID NO: 8028890 - DNA, 22 bp, Homo sapiens
tgaggtgacacaatttactcca

SEQ ID NO: 8028891 - DNA, 22 bp, Homo sapiens
tgaggtgagatggctaccccaa

SEQ ID NO: 8028892 - DNA, 22 bp, Homo sapiens
tgaggtgaggttgaggaaagaa

SEQ ID NO: 8028893 - DNA, 22 bp, Homo sapiens
tgaggtgagcatctttatcttc

SEQ ID NO: 8028894 - DNA, 22 bp, Homo sapiens
tgaggtgagcatctttatcttc

SEQ ID NO: 8028895 - DNA, 22 bp, Homo sapiens
tgaggtgagtcagtttctgatg

SEQ ID NO: 8028896 - DNA, 22 bp, Homo sapiens
tgaggtgagtcatgcattggag

SEQ ID NO: 8028897 - DNA, 22 bp, Homo sapiens
tgaggtgagtcatgcattggag

SEQ ID NO: 8028898 - DNA, 22 bp, Homo sapiens
tgagggtgggcctgcaggaaga

SEQ ID NO: 8028899 - DNA, 22 bp, Homo sapiens
tgagggtttccgggcagtggac

SEQ ID NO: 8028900 - DNA, 22 bp, Homo sapiens
tgagggtgtgcggcccagacag

SEQ ID NO: 8028901 - DNA, 22 bp, Homo sapiens
tgagggtggccttgtgtggact

SEQ ID NO: 8028902 - DNA, 22 bp, Homo sapiens
tgagggtggccttgtgtggact

SEQ ID NO: 8028903 - DNA, 22 bp, Homo sapiens
tgagggtggccttgtgtggact

SEQ ID NO: 8028904 - DNA, 22 bp, Homo sapiens
tgagggtgggccctgggcatct

SEQ ID NO: 8028905 - DNA, 22 bp, Homo sapiens
tgagggtgggccctgggcatct

SEQ ID NO: 8028906 - DNA, 22 bp, Homo sapiens
tgagggtgggccctgggcatct

SEQ ID NO: 8028907 - DNA, 22 bp, Homo sapiens
tgaggtaggaatttgtattggg

SEQ ID NO: 8028908 - DNA, 21 bp, Homo sapiens
tgaggtagccagtgagatgga

SEQ ID NO: 8028909 - DNA, 22 bp, Homo sapiens
tgaggtagctgctatttgtagt

SEQ ID NO: 8028910 - DNA, 22 bp, Homo sapiens
tgaggtacactaaatttgtctt

SEQ ID NO: 8028911 - DNA, 22 bp, Homo sapiens
tgaggtagaagttgggctgctt

SEQ ID NO: 8028912 - DNA, 22 bp, Homo sapiens
tgaggtagagattgtgactgta

SEQ ID NO: 8028913 - DNA, 22 bp, Homo sapiens
tgagggtttttgagcagtgatt

SEQ ID NO: 8028914 - DNA, 22 bp, Homo sapiens
tgaggtagaaaaagcttgtagt

SEQ ID NO: 8028915 - DNA, 19 bp, Homo sapiens
tgaggccaaggtcacagat

SEQ ID NO: 8028916 - DNA, 19 bp, Homo sapiens
tgaggccaaggtcacagat

SEQ ID NO: 8028917 - DNA, 19 bp, Homo sapiens
tgaggccaaggtcacagat

SEQ ID NO: 8028918 - DNA, 22 bp, Homo sapiens
tgaggccaagaaaagctgggtg

SEQ ID NO: 8028919 - DNA, 22 bp, Homo sapiens
tgaggccaagaaaagctgggtg

SEQ ID NO: 8028920 - DNA, 22 bp, Homo sapiens
tgaggccaactagggagatgga

SEQ ID NO: 8028921 - DNA, 22 bp, Homo sapiens
tgaggccaactagggagatgga

SEQ ID NO: 8028922 - DNA, 22 bp, Homo sapiens
tgaggccaagcctcctctgcca

SEQ ID NO: 8028923 - DNA, 22 bp, Homo sapiens
tgaggccaagaaaagctgggtg

SEQ ID NO: 8028924 - DNA, 22 bp, Homo sapiens
tgaggccaagcctcctctgcca

SEQ ID NO: 8028925 - DNA, 22 bp, Homo sapiens
tgaggccaagcctcctctgcca

SEQ ID NO: 8028926 - DNA, 22 bp, Homo sapiens
tgaggcattaaagggaggtcaa

SEQ ID NO: 8028927 - DNA, 22 bp, Homo sapiens
tgaggccaaaatgactcaaatg

SEQ ID NO: 8028928 - DNA, 22 bp, Homo sapiens
tgaggccaaaatgactcaaatg

SEQ ID NO: 8028929 - DNA, 22 bp, Homo sapiens
tgaggccaactagggagatgga

SEQ ID NO: 8028930 - DNA, 22 bp, Homo sapiens
tgaggccaactagggagatgga

SEQ ID NO: 8028931 - DNA, 22 bp, Homo sapiens
tgaggccaactagggagatgga

SEQ ID NO: 8028932 - DNA, 22 bp, Homo sapiens
tgaggcagttgagcttcctgag

SEQ ID NO: 8028933 - DNA, 22 bp, Homo sapiens
tgaggcagttgagcttcctgag

SEQ ID NO: 8028934 - DNA, 23 bp, Homo sapiens
tgaggcaggcggatcacgaggtc

SEQ ID NO: 8028935 - DNA, 23 bp, Homo sapiens
tgaggcaggcggatcacgaggtc

SEQ ID NO: 8028936 - DNA, 23 bp, Homo sapiens
tgaggcaggcggatcacgaggtc

SEQ ID NO: 8028937 - DNA, 23 bp, Homo sapiens
tgaggcaggcggatcacgaggtc

SEQ ID NO: 8028938 - DNA, 22 bp, Homo sapiens
tgaggcagggagagtggatatg

SEQ ID NO: 8028939 - DNA, 22 bp, Homo sapiens
tgaggcagggagagtggatatg

SEQ ID NO: 8028940 - DNA, 22 bp, Homo sapiens
tgaggcagggagagtggatatg

SEQ ID NO: 8028941 - DNA, 21 bp, Homo sapiens
tgaggcaggggtgcttttgtc

SEQ ID NO: 8028942 - DNA, 21 bp, Homo sapiens
tgaggcaggggtgcttttgtc

SEQ ID NO: 8028943 - DNA, 21 bp, Homo sapiens
tgaggcaggggtgcttttgtc

SEQ ID NO: 8028944 - DNA, 22 bp, Homo sapiens
tgaggcagggagtttaattgtc

SEQ ID NO: 8028945 - DNA, 22 bp, Homo sapiens
tgaggcagttgagcttcctgag

SEQ ID NO: 8028946 - DNA, 22 bp, Homo sapiens
tgaggcagttcttacttgtatt

SEQ ID NO: 8028947 - DNA, 23 bp, Homo sapiens
tgaggcaggcggatcacgaggtc

SEQ ID NO: 8028948 - DNA, 23 bp, Homo sapiens
tgaggcaggcggatcacgaggtc

SEQ ID NO: 8028949 - DNA, 23 bp, Homo sapiens
tgaggcaggcggatcacgaggtc

SEQ ID NO: 8028950 - DNA, 23 bp, Homo sapiens
tgaggcaggcggatcacgaggtc

SEQ ID NO: 8028951 - DNA, 23 bp, Homo sapiens
tgaggcaggcggatcacgaggtc

SEQ ID NO: 8028952 - DNA, 22 bp, Homo sapiens
tgaggcaggatgcttgcacagg

SEQ ID NO: 8028953 - DNA, 22 bp, Homo sapiens
tgaggcaggagttcaggctgcg

SEQ ID NO: 8028954 - DNA, 22 bp, Homo sapiens
tgaggcaggagttcaggctgcg

SEQ ID NO: 8028955 - DNA, 22 bp, Homo sapiens
tgaggcaggagttcaggctgcg

SEQ ID NO: 8028956 - DNA, 22 bp, Homo sapiens
tgaggcaggagttcaggctgcg

SEQ ID NO: 8028957 - DNA, 22 bp, Homo sapiens
tgaggcaggagttcaggctgcg

SEQ ID NO: 8028958 - DNA, 22 bp, Homo sapiens
tgaggcaggagttcaggctgcg

SEQ ID NO: 8028959 - DNA, 22 bp, Homo sapiens
tgaggcaggagttaatgtgctc

SEQ ID NO: 8028960 - DNA, 22 bp, Homo sapiens
tgaggcaggagttaatgtgctc

SEQ ID NO: 8028961 - DNA, 22 bp, Homo sapiens
tgaggcaggagttcaggctgcg

SEQ ID NO: 8028962 - DNA, 22 bp, Homo sapiens
tgaggcaggagttcaggctgcg

SEQ ID NO: 8028963 - DNA, 22 bp, Homo sapiens
tgaggcaggagttcaggctgcg

SEQ ID NO: 8028964 - DNA, 22 bp, Homo sapiens
tgaggcaggaggttgagaactg

SEQ ID NO: 8028965 - DNA, 22 bp, Homo sapiens
tgaggcaggaggttgagaactg

SEQ ID NO: 8028966 - DNA, 22 bp, Homo sapiens
tgaggcaggaggttgagaactg

SEQ ID NO: 8028967 - DNA, 22 bp, Homo sapiens
tgaggcaggaggattgcaggat

SEQ ID NO: 8028968 - DNA, 22 bp, Homo sapiens
tgaggcaggaggattgcaggat

SEQ ID NO: 8028969 - DNA, 22 bp, Homo sapiens
tgaggcaggaggattgcaggat

SEQ ID NO: 8028970 - DNA, 22 bp, Homo sapiens
tgaggcaggagaatggcgggaa

SEQ ID NO: 8028971 - DNA, 22 bp, Homo sapiens
tgaggcaggagaatggcgggaa

SEQ ID NO: 8028972 - DNA, 22 bp, Homo sapiens
tgaggcaggagaatggcgggaa

SEQ ID NO: 8028973 - DNA, 20 bp, Homo sapiens
tgaggcaggagaatggcatg

SEQ ID NO: 8028974 - DNA, 20 bp, Homo sapiens
tgaggcaggagaatggcatg

SEQ ID NO: 8028975 - DNA, 22 bp, Homo sapiens
tgaggcaggagaatggcgggaa

SEQ ID NO: 8028976 - DNA, 22 bp, Homo sapiens
tgaggccaggacccccagcagg

SEQ ID NO: 8028977 - DNA, 22 bp, Homo sapiens
tgaggccaggacccccagcagg

SEQ ID NO: 8028978 - DNA, 22 bp, Homo sapiens
tgaggccaggacccccagcagg

SEQ ID NO: 8028979 - DNA, 22 bp, Homo sapiens
tgaggccagcttcagcagtgga

SEQ ID NO: 8028980 - DNA, 22 bp, Homo sapiens
tgaggccagcttcagcagtgga

SEQ ID NO: 8028981 - DNA, 22 bp, Homo sapiens
tgaggccagcttcagcagtgga

SEQ ID NO: 8028982 - DNA, 19 bp, Homo sapiens
tgaggccagctggcatttt

SEQ ID NO: 8028983 - DNA, 19 bp, Homo sapiens
tgaggccagctggcatttt

SEQ ID NO: 8028984 - DNA, 19 bp, Homo sapiens
tgaggccagctggcatttt

SEQ ID NO: 8028985 - DNA, 19 bp, Homo sapiens
tgaggccagctggcatttt

SEQ ID NO: 8028986 - DNA, 22 bp, Homo sapiens
tgaggccagagagtttgcattt

SEQ ID NO: 8028987 - DNA, 18 bp, Homo sapiens
tgaggccagagtgggcat

SEQ ID NO: 8028988 - DNA, 18 bp, Homo sapiens
tgaggccagagtgggcat

SEQ ID NO: 8028989 - DNA, 18 bp, Homo sapiens
tgaggccagagtgggcat

SEQ ID NO: 8028990 - DNA, 22 bp, Homo sapiens
tgaggccagccacagccaccct

SEQ ID NO: 8028991 - DNA, 22 bp, Homo sapiens
tgaggccagccacagccaccct

SEQ ID NO: 8028992 - DNA, 22 bp, Homo sapiens
tgaggccagccacagccaccct

SEQ ID NO: 8028993 - DNA, 22 bp, Homo sapiens
tgaggccagagtttttaattcc

SEQ ID NO: 8028994 - DNA, 22 bp, Homo sapiens
tgaggccagagtttttaattcc

SEQ ID NO: 8028995 - DNA, 18 bp, Homo sapiens
tgaggccagagtgggcat

SEQ ID NO: 8028996 - DNA, 22 bp, Homo sapiens
tgaggccagccacagccaccct

SEQ ID NO: 8028997 - DNA, 22 bp, Homo sapiens
tgaggccagccacagccaccct

SEQ ID NO: 8028998 - DNA, 22 bp, Homo sapiens
tgaggccagccacagccaccct

SEQ ID NO: 8028999 - DNA, 16 bp, Homo sapiens
tgaggccagccatttc

SEQ ID NO: 8029000 - DNA, 22 bp, Homo sapiens
tgaggccacttccccacagccc

SEQ ID NO: 8029001 - DNA, 22 bp, Homo sapiens
tgaggccacttccccacagccc

SEQ ID NO: 8029002 - DNA, 22 bp, Homo sapiens
tgaggccacttccccacagccc

SEQ ID NO: 8029003 - DNA, 22 bp, Homo sapiens
tgaggccacaggaaagggcccg

SEQ ID NO: 8029004 - DNA, 22 bp, Homo sapiens
tgaggccacagtatcagaacag

SEQ ID NO: 8029005 - DNA, 22 bp, Homo sapiens
tgaggccacagtatcagaacag

SEQ ID NO: 8029006 - DNA, 22 bp, Homo sapiens
tgaggccacttccccacagccc

SEQ ID NO: 8029007 - DNA, 22 bp, Homo sapiens
tgaggccacttccccacagccc

SEQ ID NO: 8029008 - DNA, 22 bp, Homo sapiens
tgaggccagactgaaaccaaca

SEQ ID NO: 8029009 - DNA, 22 bp, Homo sapiens
tgaggccagactgaaaccaaca

SEQ ID NO: 8029010 - DNA, 22 bp, Homo sapiens
tgaggccagagagtttgcattt

SEQ ID NO: 8029011 - DNA, 22 bp, Homo sapiens
tgaggccagagagtttgcattt

SEQ ID NO: 8029012 - DNA, 22 bp, Homo sapiens
tgaggccaatgaccctgggcag

SEQ ID NO: 8029013 - DNA, 22 bp, Homo sapiens
tgaggccaatgaccctgggcag

SEQ ID NO: 8029014 - DNA, 21 bp, Homo sapiens
tgaggccaatagcccctggac

SEQ ID NO: 8029015 - DNA, 21 bp, Homo sapiens
tgaggccaatagcccctggac

SEQ ID NO: 8029016 - DNA, 21 bp, Homo sapiens
tgaggccaatagcccctggac

SEQ ID NO: 8029017 - DNA, 19 bp, Homo sapiens
tgaggccaaggtcacagat

SEQ ID NO: 8029018 - DNA, 22 bp, Homo sapiens
tgaggccacaggaaagggcccg

SEQ ID NO: 8029019 - DNA, 22 bp, Homo sapiens
tgaggccacaggaaagggcccg

SEQ ID NO: 8029020 - DNA, 22 bp, Homo sapiens
tgaggccaatgaccctgggcag

SEQ ID NO: 8029021 - DNA, 22 bp, Homo sapiens
tgaggccaatgaccctgggcag

SEQ ID NO: 8029022 - DNA, 22 bp, Homo sapiens
tgaggccaatgaccctgggcag

SEQ ID NO: 8029023 - DNA, 22 bp, Homo sapiens
tgaggccaggatcccaggctct

SEQ ID NO: 8029024 - DNA, 22 bp, Homo sapiens
tgaggccaggacccccagcagg

SEQ ID NO: 8029025 - DNA, 22 bp, Homo sapiens
tgaggccaggatcccaggctct

SEQ ID NO: 8029026 - DNA, 22 bp, Homo sapiens
tgaggccaggatcccaggctct

SEQ ID NO: 8029027 - DNA, 22 bp, Homo sapiens
tgaggccaggatcccaggctct

SEQ ID NO: 8029028 - DNA, 18 bp, Homo sapiens
tgaggcccgcagaggtgg

SEQ ID NO: 8029029 - DNA, 18 bp, Homo sapiens
tgaggcccgcagaggtgg

SEQ ID NO: 8029030 - DNA, 22 bp, Homo sapiens
tgaggccaggatcccaggctct

SEQ ID NO: 8029031 - DNA, 22 bp, Homo sapiens
tgaggccccgaagctgaggttt

SEQ ID NO: 8029032 - DNA, 22 bp, Homo sapiens
tgaggcccgggtggaggaatgc

SEQ ID NO: 8029033 - DNA, 22 bp, Homo sapiens
tgaggcctcataatgagatttc

SEQ ID NO: 8029034 - DNA, 22 bp, Homo sapiens
tgaggcctcatttagggagagg

SEQ ID NO: 8029035 - DNA, 22 bp, Homo sapiens
tgaggcctcatttagggagagg

SEQ ID NO: 8029036 - DNA, 22 bp, Homo sapiens
tgaggcctacccccctgtgttt

SEQ ID NO: 8029037 - DNA, 22 bp, Homo sapiens
tgaggcctcataatgagatttc

SEQ ID NO: 8029038 - DNA, 21 bp, Homo sapiens
tgaggcctctcctgggctggc

SEQ ID NO: 8029039 - DNA, 22 bp, Homo sapiens
tgaggcctcatttagggagagg

SEQ ID NO: 8029040 - DNA, 22 bp, Homo sapiens
tgaggccctagggcatgggaga

SEQ ID NO: 8029041 - DNA, 22 bp, Homo sapiens
tgaggccctagggcatgggaga

SEQ ID NO: 8029042 - DNA, 22 bp, Homo sapiens
tgaggccctctgggctggtcct

SEQ ID NO: 8029043 - DNA, 22 bp, Homo sapiens
tgaggccctctgggctggtcct

SEQ ID NO: 8029044 - DNA, 22 bp, Homo sapiens
tgaggcctacccccctgtgttt

SEQ ID NO: 8029045 - DNA, 17 bp, Homo sapiens
tgaggcctgcatcagtg

SEQ ID NO: 8029046 - DNA, 17 bp, Homo sapiens
tgaggcctgcatcagtg

SEQ ID NO: 8029047 - DNA, 22 bp, Homo sapiens
tgaggcctgacagaccaagcct

SEQ ID NO: 8029048 - DNA, 22 bp, Homo sapiens
tgaggcctgaagcctggagcct

SEQ ID NO: 8029049 - DNA, 22 bp, Homo sapiens
tgaggcctgaagcctggagcct

SEQ ID NO: 8029050 - DNA, 17 bp, Homo sapiens
tgaggcctgcatcagtg

SEQ ID NO: 8029051 - DNA, 17 bp, Homo sapiens
tgaggcctgcatcagtg

SEQ ID NO: 8029052 - DNA, 21 bp, Homo sapiens
tgaggcctgccagtctcagaa

SEQ ID NO: 8029053 - DNA, 21 bp, Homo sapiens
tgaggcctgccagtctcagaa

SEQ ID NO: 8029054 - DNA, 22 bp, Homo sapiens
tgaggcctgcattgaactagaa

SEQ ID NO: 8029055 - DNA, 22 bp, Homo sapiens
tgaggcctgcattgaactagaa

SEQ ID NO: 8029056 - DNA, 22 bp, Homo sapiens
tgaggcctgcattgaactagaa

SEQ ID NO: 8029057 - DNA, 22 bp, Homo sapiens
tgaggcctcttggtatggtgtg

SEQ ID NO: 8029058 - DNA, 22 bp, Homo sapiens
tgaggcctgaagcctgaagtga

SEQ ID NO: 8029059 - DNA, 22 bp, Homo sapiens
tgaggcctgaagcctggagcct

SEQ ID NO: 8029060 - DNA, 22 bp, Homo sapiens
tgaggcctgaagcctgaagtga

SEQ ID NO: 8029061 - DNA, 22 bp, Homo sapiens
tgaggcctctgtgccatccagg

SEQ ID NO: 8029062 - DNA, 22 bp, Homo sapiens
tgaggcctctgtgccatccagg

SEQ ID NO: 8029063 - DNA, 18 bp, Homo sapiens
tgaggcctctgctgggcc

SEQ ID NO: 8029064 - DNA, 18 bp, Homo sapiens
tgaggcctctgctgggcc

SEQ ID NO: 8029065 - DNA, 18 bp, Homo sapiens
tgaggcctctgctgggcc

SEQ ID NO: 8029066 - DNA, 18 bp, Homo sapiens
tgaggcctctgctgggcc

SEQ ID NO: 8029067 - DNA, 18 bp, Homo sapiens
tgaggcctctgctgggcc

SEQ ID NO: 8029068 - DNA, 22 bp, Homo sapiens
tgaggcctctgaggcctaggct

SEQ ID NO: 8029069 - DNA, 21 bp, Homo sapiens
tgaggcctctcctgggctggc

SEQ ID NO: 8029070 - DNA, 21 bp, Homo sapiens
tgaggcctctcctgggctggc

SEQ ID NO: 8029071 - DNA, 22 bp, Homo sapiens
tgaggcctctgaggcctaggct

SEQ ID NO: 8029072 - DNA, 22 bp, Homo sapiens
tgaggcctctgaggcctaggct

SEQ ID NO: 8029073 - DNA, 22 bp, Homo sapiens
tgaggaagttgatctcatcagt

SEQ ID NO: 8029074 - DNA, 22 bp, Homo sapiens
tgaggaagttgatctcatcagt

SEQ ID NO: 8029075 - DNA, 22 bp, Homo sapiens
tgaggaagttgtttctcttcta

SEQ ID NO: 8029076 - DNA, 22 bp, Homo sapiens
tgaggagaaatgctcagagcca

SEQ ID NO: 8029077 - DNA, 22 bp, Homo sapiens
tgaggaagttgtttctcttcta

SEQ ID NO: 8029078 - DNA, 22 bp, Homo sapiens
tgaggagaaatgctcagagcca

SEQ ID NO: 8029079 - DNA, 22 bp, Homo sapiens
tgaggagaaatgctcagagcca

SEQ ID NO: 8029080 - DNA, 22 bp, Homo sapiens
tgaggaagttgatctcatcagt

SEQ ID NO: 8029081 - DNA, 22 bp, Homo sapiens
tgaggaagttgatctcatcagt

SEQ ID NO: 8029082 - DNA, 22 bp, Homo sapiens
tgaggaagtggttgtatggttt

SEQ ID NO: 8029083 - DNA, 22 bp, Homo sapiens
tgaggaagtggttgtatggttt

SEQ ID NO: 8029084 - DNA, 22 bp, Homo sapiens
tgaggaagtggttgtatggttt

SEQ ID NO: 8029085 - DNA, 22 bp, Homo sapiens
tgaggaagtggttgtatggttt

SEQ ID NO: 8029086 - DNA, 22 bp, Homo sapiens
tgaggaagtggttgtatggttt

SEQ ID NO: 8029087 - DNA, 23 bp, Homo sapiens
tgaggaagtaattgtaaaggtct

SEQ ID NO: 8029088 - DNA, 22 bp, Homo sapiens
tgaggaagtggttgtatggttt

SEQ ID NO: 8029089 - DNA, 18 bp, Homo sapiens
tgaggaaggggaagtatt

SEQ ID NO: 8029090 - DNA, 22 bp, Homo sapiens
tgaggaagggtgtgacggcacc

SEQ ID NO: 8029091 - DNA, 18 bp, Homo sapiens
tgaggaaggggaagtatt

SEQ ID NO: 8029092 - DNA, 18 bp, Homo sapiens
tgaggaaggggaagtatt

SEQ ID NO: 8029093 - DNA, 22 bp, Homo sapiens
tgaggaagggcacacggaccct

SEQ ID NO: 8029094 - DNA, 22 bp, Homo sapiens
tgaggaagggtgtgacggcacc

SEQ ID NO: 8029095 - DNA, 22 bp, Homo sapiens
tgaggaagggtgtgacggcacc

SEQ ID NO: 8029096 - DNA, 22 bp, Homo sapiens
tgaggaagggtgtgacggcacc

SEQ ID NO: 8029097 - DNA, 23 bp, Homo sapiens
tgaggaagtaattgtaaaggtct

SEQ ID NO: 8029098 - DNA, 23 bp, Homo sapiens
tgaggaagtaattgtaaaggtct

SEQ ID NO: 8029099 - DNA, 23 bp, Homo sapiens
tgaggaagtaattgtaaaggtct

SEQ ID NO: 8029100 - DNA, 22 bp, Homo sapiens
tgaggaagccaaacagctacac

SEQ ID NO: 8029101 - DNA, 22 bp, Homo sapiens
tgaggaaggaattgaggtttta

SEQ ID NO: 8029102 - DNA, 22 bp, Homo sapiens
tgaggaagccaaacagctacac

SEQ ID NO: 8029103 - DNA, 22 bp, Homo sapiens
tgaggaagccaaacagctacac

SEQ ID NO: 8029104 - DNA, 22 bp, Homo sapiens
tgaggaagccaaacagctacac

SEQ ID NO: 8029105 - DNA, 22 bp, Homo sapiens
tgaggaagcaaaggcttgtgtg

SEQ ID NO: 8029106 - DNA, 22 bp, Homo sapiens
tgaggaagcaaaggcttgtgtg

SEQ ID NO: 8029107 - DNA, 22 bp, Homo sapiens
tgaggaagccaaacagctacac

SEQ ID NO: 8029108 - DNA, 22 bp, Homo sapiens
tgaggaagcaaaggcttgtgtg

SEQ ID NO: 8029109 - DNA, 22 bp, Homo sapiens
tgaggaagcaaaggcttgtgtg

SEQ ID NO: 8029110 - DNA, 22 bp, Homo sapiens
tgaggaagcaaaggcttgtgtg

SEQ ID NO: 8029111 - DNA, 22 bp, Homo sapiens
tgaggaagaacaagaatttaga

SEQ ID NO: 8029112 - DNA, 22 bp, Homo sapiens
tgaggaagcaaaggcttgtgtg

SEQ ID NO: 8029113 - DNA, 22 bp, Homo sapiens
tgaggaagcaaaggcttgtgtg

SEQ ID NO: 8029114 - DNA, 22 bp, Homo sapiens
tgaggaaacttacaaggcagaa

SEQ ID NO: 8029115 - DNA, 22 bp, Homo sapiens
tgaggaaagaaaggcatgcatg

SEQ ID NO: 8029116 - DNA, 22 bp, Homo sapiens
tgaggaaattgaggctcacaga

SEQ ID NO: 8029117 - DNA, 22 bp, Homo sapiens
tgaggaactcaccaggcagaga

SEQ ID NO: 8029118 - DNA, 22 bp, Homo sapiens
tgaggaactcaccaggcagaga

SEQ ID NO: 8029119 - DNA, 22 bp, Homo sapiens
tgaggaactcaccaggcagaga

SEQ ID NO: 8029120 - DNA, 22 bp, Homo sapiens
tgaggaactcaccaggcagaga

SEQ ID NO: 8029121 - DNA, 22 bp, Homo sapiens
tgaggaactgccagactgtttt

SEQ ID NO: 8029122 - DNA, 22 bp, Homo sapiens
tgaggaagaacaagaatttaga

SEQ ID NO: 8029123 - DNA, 22 bp, Homo sapiens
tgaggaacaactcctgtgacta

SEQ ID NO: 8029124 - DNA, 22 bp, Homo sapiens
tgaggaacagagaggtaaaata

SEQ ID NO: 8029125 - DNA, 22 bp, Homo sapiens
tgaggaggtgggcacacagagt

SEQ ID NO: 8029126 - DNA, 22 bp, Homo sapiens
tgaggaggtgggcacacagagt

SEQ ID NO: 8029127 - DNA, 22 bp, Homo sapiens
tgaggaggtcagagtctggctg

SEQ ID NO: 8029128 - DNA, 22 bp, Homo sapiens
tgaggaggcccaggttggggct

SEQ ID NO: 8029129 - DNA, 22 bp, Homo sapiens
tgaggaggtcagagtctggctg

SEQ ID NO: 8029130 - DNA, 22 bp, Homo sapiens
tgaggaggtcagagtctggctg

SEQ ID NO: 8029131 - DNA, 22 bp, Homo sapiens
tgaggaggtcagagtctggctg

SEQ ID NO: 8029132 - DNA, 22 bp, Homo sapiens
tgaggaggtcagagtctggctg

SEQ ID NO: 8029133 - DNA, 23 bp, Homo sapiens
tgaggagcatagctgactgacag

SEQ ID NO: 8029134 - DNA, 22 bp, Homo sapiens
tgaggagccactctagcagtca

SEQ ID NO: 8029135 - DNA, 19 bp, Homo sapiens
tgaggagcagctggttgat

SEQ ID NO: 8029136 - DNA, 22 bp, Homo sapiens
tgaggagcagggtggcttactc

SEQ ID NO: 8029137 - DNA, 22 bp, Homo sapiens
tgaggagcttctggaaagtgca

SEQ ID NO: 8029138 - DNA, 22 bp, Homo sapiens
tgaggaggcccaggttggggct

SEQ ID NO: 8029139 - DNA, 22 bp, Homo sapiens
tgaggagccactctagcagtca

SEQ ID NO: 8029140 - DNA, 22 bp, Homo sapiens
tgaggagccactctagcagtca

SEQ ID NO: 8029141 - DNA, 22 bp, Homo sapiens
tgaggagcgggcagggatgcag

SEQ ID NO: 8029142 - DNA, 22 bp, Homo sapiens
tgaggatggcagtgtgctcagc

SEQ ID NO: 8029143 - DNA, 22 bp, Homo sapiens
tgaggatggcagtgtgctcagc

SEQ ID NO: 8029144 - DNA, 22 bp, Homo sapiens
tgaggatggaatgctgtgcaag

SEQ ID NO: 8029145 - DNA, 22 bp, Homo sapiens
tgaggatggaatgctgtgcaag

SEQ ID NO: 8029146 - DNA, 22 bp, Homo sapiens
tgaggatggaatgctgtgcaag

SEQ ID NO: 8029147 - DNA, 22 bp, Homo sapiens
tgaggatggcagtgtgctcagc

SEQ ID NO: 8029148 - DNA, 22 bp, Homo sapiens
tgaggatggcagtgtgctcagc

SEQ ID NO: 8029149 - DNA, 22 bp, Homo sapiens
tgaggatggtgttggagagggc

SEQ ID NO: 8029150 - DNA, 22 bp, Homo sapiens
tgaggatggtcccgaggacact

SEQ ID NO: 8029151 - DNA, 22 bp, Homo sapiens
tgaggatggtcccgaggacact

SEQ ID NO: 8029152 - DNA, 22 bp, Homo sapiens
tgaggagtatggtggggtcatt

SEQ ID NO: 8029153 - DNA, 22 bp, Homo sapiens
tgaggagtttttctagagctaa

SEQ ID NO: 8029154 - DNA, 22 bp, Homo sapiens
tgaggatgacgatggcaatggc

SEQ ID NO: 8029155 - DNA, 21 bp, Homo sapiens
tgaggataagtaaagctgaag

SEQ ID NO: 8029156 - DNA, 22 bp, Homo sapiens
tgaggatgacgatggcaatggc

SEQ ID NO: 8029157 - DNA, 22 bp, Homo sapiens
tgaggatgagatgagataacac

SEQ ID NO: 8029158 - DNA, 22 bp, Homo sapiens
tgaggatggaatgctgtgcaag

SEQ ID NO: 8029159 - DNA, 21 bp, Homo sapiens
tgaggatgtgcagcagcagga

SEQ ID NO: 8029160 - DNA, 22 bp, Homo sapiens
tgaggatgtctgtattttgcct

SEQ ID NO: 8029161 - DNA, 22 bp, Homo sapiens
tgaggattgagtcaagcagtat

SEQ ID NO: 8029162 - DNA, 19 bp, Homo sapiens
tgaggattgaggtccagta

SEQ ID NO: 8029163 - DNA, 22 bp, Homo sapiens
tgaggattaaatgagctaataa

SEQ ID NO: 8029164 - DNA, 22 bp, Homo sapiens
tgaggattcaagagggaacaag

SEQ ID NO: 8029165 - DNA, 22 bp, Homo sapiens
tgaggattggcaaaactcaggg

SEQ ID NO: 8029166 - DNA, 22 bp, Homo sapiens
tgaggattggcaaaactcaggg

SEQ ID NO: 8029167 - DNA, 22 bp, Homo sapiens
tgaggatttaatgggactcatt

SEQ ID NO: 8029168 - DNA, 22 bp, Homo sapiens
tgaggatttaatgggactcatt

SEQ ID NO: 8029169 - DNA, 21 bp, Homo sapiens
tgaggatttcagtagatgcct

SEQ ID NO: 8029170 - DNA, 21 bp, Homo sapiens
tgaggatttcagtagatgcct

SEQ ID NO: 8029171 - DNA, 22 bp, Homo sapiens
tgaggatttctatggttctttc

SEQ ID NO: 8029172 - DNA, 22 bp, Homo sapiens
tgaggcaaaaacactgattagg

SEQ ID NO: 8029173 - DNA, 22 bp, Homo sapiens
tgaggcaaaaacactgattagg

SEQ ID NO: 8029174 - DNA, 22 bp, Homo sapiens
tgaggcaaagttcaagctgaaa

SEQ ID NO: 8029175 - DNA, 17 bp, Homo sapiens
tgaggcaaccatcacta

SEQ ID NO: 8029176 - DNA, 22 bp, Homo sapiens
tgaggcaacagaaagggccaat

SEQ ID NO: 8029177 - DNA, 17 bp, Homo sapiens
tgaggcaaccatcacta

SEQ ID NO: 8029178 - DNA, 19 bp, Homo sapiens
tgaggcaagatggctctgg

SEQ ID NO: 8029179 - DNA, 19 bp, Homo sapiens
tgaggcaagatggctctgg

SEQ ID NO: 8029180 - DNA, 22 bp, Homo sapiens
tgaggcaagagtttgattagag

SEQ ID NO: 8029181 - DNA, 22 bp, Homo sapiens
tgaggcaaagacaaagcagcat

SEQ ID NO: 8029182 - DNA, 22 bp, Homo sapiens
tgaggcaaaagttatgtggtag

SEQ ID NO: 8029183 - DNA, 22 bp, Homo sapiens
tgaggcaagtctcaatctttga

SEQ ID NO: 8029184 - DNA, 22 bp, Homo sapiens
tgaggcaagtctcaatctttga

SEQ ID NO: 8029185 - DNA, 22 bp, Homo sapiens
tgaggcaagtactttccctttt

SEQ ID NO: 8029186 - DNA, 22 bp, Homo sapiens
tgaggcaagtactttccctttt

SEQ ID NO: 8029187 - DNA, 21 bp, Homo sapiens
tgaggcaagtccttttatagc

SEQ ID NO: 8029188 - DNA, 22 bp, Homo sapiens
tgaggcaagtactttccctttt

SEQ ID NO: 8029189 - DNA, 19 bp, Homo sapiens
tgaggcaagatggctctgg

SEQ ID NO: 8029190 - DNA, 22 bp, Homo sapiens
tgaggcaagctgggcccatgga

SEQ ID NO: 8029191 - DNA, 22 bp, Homo sapiens
tgaggcaagctgggcccatgga

SEQ ID NO: 8029192 - DNA, 19 bp, Homo sapiens
tgaggcaagctttttcttg

SEQ ID NO: 8029193 - DNA, 22 bp, Homo sapiens
tgaggcaaggctgaatgaaggc

SEQ ID NO: 8029194 - DNA, 22 bp, Homo sapiens
tgaggcaagggatggccccgtg

SEQ ID NO: 8029195 - DNA, 19 bp, Homo sapiens
tgaggcactagtctggtcc

SEQ ID NO: 8029196 - DNA, 22 bp, Homo sapiens
tgaggcactccaggatgctgtt

SEQ ID NO: 8029197 - DNA, 22 bp, Homo sapiens
tgaggcactccaggatgctgtt

SEQ ID NO: 8029198 - DNA, 22 bp, Homo sapiens
tgaggcactccaggatgctgtt

SEQ ID NO: 8029199 - DNA, 22 bp, Homo sapiens
tgaggcacatccaggccagctc

SEQ ID NO: 8029200 - DNA, 19 bp, Homo sapiens
tgaggcactagtctggtcc

SEQ ID NO: 8029201 - DNA, 19 bp, Homo sapiens
tgaggcacatgataagaac

SEQ ID NO: 8029202 - DNA, 19 bp, Homo sapiens
tgaggcacagtggtgaaat

SEQ ID NO: 8029203 - DNA, 19 bp, Homo sapiens
tgaggcacagtggtgaaat

SEQ ID NO: 8029204 - DNA, 22 bp, Homo sapiens
tgaggcacatccaggccagctc

SEQ ID NO: 8029205 - DNA, 22 bp, Homo sapiens
tgaggcacagaaaatggtaggg

SEQ ID NO: 8029206 - DNA, 22 bp, Homo sapiens
tgaggcaattggaaattttaac

SEQ ID NO: 8029207 - DNA, 22 bp, Homo sapiens
tgaggcaatccctagggtaagg

SEQ ID NO: 8029208 - DNA, 22 bp, Homo sapiens
tgaggcaatgtccttcatcctt

SEQ ID NO: 8029209 - DNA, 22 bp, Homo sapiens
tgaggcaggacatggacaactg

SEQ ID NO: 8029210 - DNA, 22 bp, Homo sapiens
tgaggcaggacatggacaactg

SEQ ID NO: 8029211 - DNA, 22 bp, Homo sapiens
tgaggcaggactgagcgggatg

SEQ ID NO: 8029212 - DNA, 22 bp, Homo sapiens
tgaggcaggacatggacaactg

SEQ ID NO: 8029213 - DNA, 22 bp, Homo sapiens
tgaggcaggacatggacaactg

SEQ ID NO: 8029214 - DNA, 22 bp, Homo sapiens
tgaggcaggaatggggaaaagt

SEQ ID NO: 8029215 - DNA, 22 bp, Homo sapiens
tgaggcaggaagttatataatg

SEQ ID NO: 8029216 - DNA, 22 bp, Homo sapiens
tgaggcaggacatggacaactg

SEQ ID NO: 8029217 - DNA, 22 bp, Homo sapiens
tgaggcaggaatggggaaaagt

SEQ ID NO: 8029218 - DNA, 22 bp, Homo sapiens
tgaggcaggaatggggaaaagt

SEQ ID NO: 8029219 - DNA, 22 bp, Homo sapiens
tgaggcaggaatggggaaaagt

SEQ ID NO: 8029220 - DNA, 22 bp, Homo sapiens
tgaggcactgggagagcacact

SEQ ID NO: 8029221 - DNA, 22 bp, Homo sapiens
tgaggcactgggagagcacact

SEQ ID NO: 8029222 - DNA, 22 bp, Homo sapiens
tgaggcagaaaatagcagttca

SEQ ID NO: 8029223 - DNA, 22 bp, Homo sapiens
tgaggcagcctgcattaaagag

SEQ ID NO: 8029224 - DNA, 22 bp, Homo sapiens
tgaggcagctttttctgtgtgt

SEQ ID NO: 8029225 - DNA, 20 bp, Homo sapiens
tgaggcaggagaatggcatg

SEQ ID NO: 8029226 - DNA, 20 bp, Homo sapiens
tgaggcaggagaatggcatg

SEQ ID NO: 8029227 - DNA, 22 bp, Homo sapiens
tgaggcaggagaatcaccggaa

SEQ ID NO: 8029228 - DNA, 22 bp, Homo sapiens
tgaggcaggagaatcacatgaa

SEQ ID NO: 8029229 - DNA, 22 bp, Homo sapiens
tgaggcaggagaatcacatgaa

SEQ ID NO: 8029230 - DNA, 22 bp, Homo sapiens
tgaggcaggactgagcgggatg

SEQ ID NO: 8029231 - DNA, 22 bp, Homo sapiens
tgaggcaggactgagcgggatg

SEQ ID NO: 8029232 - DNA, 22 bp, Homo sapiens
tgaggcaggactgagcgggatg

SEQ ID NO: 8029233 - DNA, 22 bp, Homo sapiens
tgaggcaggactgagcgggatg

SEQ ID NO: 8029234 - DNA, 22 bp, Homo sapiens
tgaggcaggactgagcgggatg

SEQ ID NO: 8029235 - DNA, 22 bp, Homo sapiens
tgaggcaggagaatcacatgaa

SEQ ID NO: 8029236 - DNA, 22 bp, Homo sapiens
tgaggcaggagaatcacatgaa

SEQ ID NO: 8029237 - DNA, 22 bp, Homo sapiens
tgaggcaggagaatcacatgaa

SEQ ID NO: 8029238 - DNA, 22 bp, Homo sapiens
tgaggcaggacttgcataaagt

SEQ ID NO: 8029239 - DNA, 22 bp, Homo sapiens
tgaggcaggacttgcataaagt

SEQ ID NO: 8029240 - DNA, 22 bp, Homo sapiens
tgagcagaggccagcacctggg

SEQ ID NO: 8029241 - DNA, 22 bp, Homo sapiens
tgagcagaggccagcacctggg

SEQ ID NO: 8029242 - DNA, 22 bp, Homo sapiens
tgagcagaggccagcacctggg

SEQ ID NO: 8029243 - DNA, 22 bp, Homo sapiens
tgagcagaggccagcacctggg

SEQ ID NO: 8029244 - DNA, 22 bp, Homo sapiens
tgagcagaggccagcacctggg

SEQ ID NO: 8029245 - DNA, 22 bp, Homo sapiens
tgagcagaggccagcacctggg

SEQ ID NO: 8029246 - DNA, 22 bp, Homo sapiens
tgagcagaggagtgacgtaggt

SEQ ID NO: 8029247 - DNA, 22 bp, Homo sapiens
tgagcagaggagtgacgtaggt

SEQ ID NO: 8029248 - DNA, 22 bp, Homo sapiens
tgagcagaggagtgacgtaggt

SEQ ID NO: 8029249 - DNA, 22 bp, Homo sapiens
tgagcagagcagtaacaggagc

SEQ ID NO: 8029250 - DNA, 22 bp, Homo sapiens
tgagcagagcagtaacaggagc

SEQ ID NO: 8029251 - DNA, 22 bp, Homo sapiens
tgagcagagcagtaacaggagc

SEQ ID NO: 8029252 - DNA, 22 bp, Homo sapiens
tgagcagaggaggctgccaact

SEQ ID NO: 8029253 - DNA, 22 bp, Homo sapiens
tgagcagaggaggctgccaact

SEQ ID NO: 8029254 - DNA, 22 bp, Homo sapiens
tgagcagaggaggctgccaact

SEQ ID NO: 8029255 - DNA, 22 bp, Homo sapiens
tgagcagatgtctaacttttac

SEQ ID NO: 8029256 - DNA, 22 bp, Homo sapiens
tgagcagatggaggcttctgca

SEQ ID NO: 8029257 - DNA, 22 bp, Homo sapiens
tgagcagatggaggcttctgca

SEQ ID NO: 8029258 - DNA, 22 bp, Homo sapiens
tgagcagatggaggcttctgca

SEQ ID NO: 8029259 - DNA, 22 bp, Homo sapiens
tgagcagatggaggcttctgca

SEQ ID NO: 8029260 - DNA, 22 bp, Homo sapiens
tgagcagatggaggcttctgca

SEQ ID NO: 8029261 - DNA, 22 bp, Homo sapiens
tgagcagagttgtttctcctga

SEQ ID NO: 8029262 - DNA, 22 bp, Homo sapiens
tgagcagatggaggcttctgca

SEQ ID NO: 8029263 - DNA, 22 bp, Homo sapiens
tgagcagagtcgctccagagtg

SEQ ID NO: 8029264 - DNA, 22 bp, Homo sapiens
tgagcagagttgtttctcctga

SEQ ID NO: 8029265 - DNA, 22 bp, Homo sapiens
tgagcagagttgtttctcctga

SEQ ID NO: 8029266 - DNA, 22 bp, Homo sapiens
tgagcagagttgtttctcctga

SEQ ID NO: 8029267 - DNA, 18 bp, Homo sapiens
tgagcagagtaaggcttt

SEQ ID NO: 8029268 - DNA, 18 bp, Homo sapiens
tgagcagagtaaggcttt

SEQ ID NO: 8029269 - DNA, 22 bp, Homo sapiens
tgagcagagtcgctccagagtg

SEQ ID NO: 8029270 - DNA, 22 bp, Homo sapiens
tgagcagagtcgctccagagtg

SEQ ID NO: 8029271 - DNA, 22 bp, Homo sapiens
tgagcagagacttcaagggcag

SEQ ID NO: 8029272 - DNA, 22 bp, Homo sapiens
tgagcagagatgactgggcatt

SEQ ID NO: 8029273 - DNA, 22 bp, Homo sapiens
tgagcagagatgactgggcatt

SEQ ID NO: 8029274 - DNA, 22 bp, Homo sapiens
tgagcacatgccagcccttctc

SEQ ID NO: 8029275 - DNA, 22 bp, Homo sapiens
tgagcacatttcacatgacagg

SEQ ID NO: 8029276 - DNA, 22 bp, Homo sapiens
tgagcagagcaggctgcgccct

SEQ ID NO: 8029277 - DNA, 22 bp, Homo sapiens
tgagcagagcaggctgcgccct

SEQ ID NO: 8029278 - DNA, 22 bp, Homo sapiens
tgagcagagcaggctgcgccct

SEQ ID NO: 8029279 - DNA, 22 bp, Homo sapiens
tgagcagagcaataggactctc

SEQ ID NO: 8029280 - DNA, 22 bp, Homo sapiens
tgagcagagcaataggactctc

SEQ ID NO: 8029281 - DNA, 22 bp, Homo sapiens
tgagcagagatgactgggcatt

SEQ ID NO: 8029282 - DNA, 22 bp, Homo sapiens
tgagcagagatgactgggcatt

SEQ ID NO: 8029283 - DNA, 22 bp, Homo sapiens
tgagcagagcaataggactctc

SEQ ID NO: 8029284 - DNA, 22 bp, Homo sapiens
tgagcagagcaataggactctc

SEQ ID NO: 8029285 - DNA, 22 bp, Homo sapiens
tgagcacagctcgcaccagctt

SEQ ID NO: 8029286 - DNA, 22 bp, Homo sapiens
tgagcacaagtttgcatgtgtg

SEQ ID NO: 8029287 - DNA, 22 bp, Homo sapiens
tgagcacaagtttgcatgtgtg

SEQ ID NO: 8029288 - DNA, 22 bp, Homo sapiens
tgagcacaagtttgcatgtgtg

SEQ ID NO: 8029289 - DNA, 19 bp, Homo sapiens
tgagcacacctgtacaccc

SEQ ID NO: 8029290 - DNA, 22 bp, Homo sapiens
tgagcacagctttcactagaaa

SEQ ID NO: 8029291 - DNA, 22 bp, Homo sapiens
tgagcacagctcgcaccagctt

SEQ ID NO: 8029292 - DNA, 23 bp, Homo sapiens
tgagcaagtgaccaactgtctgt

SEQ ID NO: 8029293 - DNA, 22 bp, Homo sapiens
tgagcaagagaaactgactgta

SEQ ID NO: 8029294 - DNA, 22 bp, Homo sapiens
tgagcaagacccggcctctgcc

SEQ ID NO: 8029295 - DNA, 22 bp, Homo sapiens
tgagcaggcgcagcaggaggtc

SEQ ID NO: 8029296 - DNA, 22 bp, Homo sapiens
tgagcaggcgcagcaggaggtc

SEQ ID NO: 8029297 - DNA, 22 bp, Homo sapiens
tgagcaggcgcagcaggaggtc

SEQ ID NO: 8029298 - DNA, 22 bp, Homo sapiens
tgagcaggcgcagcaggaggtc

SEQ ID NO: 8029299 - DNA, 22 bp, Homo sapiens
tgagcaggctcccacttcagtg

SEQ ID NO: 8029300 - DNA, 22 bp, Homo sapiens
tgagcagggactttgagtgtag

SEQ ID NO: 8029301 - DNA, 22 bp, Homo sapiens
tgagcaggctcccacttcagtg

SEQ ID NO: 8029302 - DNA, 22 bp, Homo sapiens
tgagcagggactttgagtgtag

SEQ ID NO: 8029303 - DNA, 22 bp, Homo sapiens
tgagcagggactttgagtgtag

SEQ ID NO: 8029304 - DNA, 22 bp, Homo sapiens
tgagcagggactttgagtgtag

SEQ ID NO: 8029305 - DNA, 22 bp, Homo sapiens
tgagcaggcaaacaatggttat

SEQ ID NO: 8029306 - DNA, 22 bp, Homo sapiens
tgagcaggcaaacaatggttat

SEQ ID NO: 8029307 - DNA, 22 bp, Homo sapiens
tgagcaggattcgcctcttgca

SEQ ID NO: 8029308 - DNA, 22 bp, Homo sapiens
tgagcaggcaaacaatggttat

SEQ ID NO: 8029309 - DNA, 22 bp, Homo sapiens
tgagcaggcgcagcaggaggtc

SEQ ID NO: 8029310 - DNA, 22 bp, Homo sapiens
tgagcaggcgcagcaggaggtc

SEQ ID NO: 8029311 - DNA, 22 bp, Homo sapiens
tgagcaggcgcagcaggaggtc

SEQ ID NO: 8029312 - DNA, 22 bp, Homo sapiens
tgagcaggcgcagcaggaggtc

SEQ ID NO: 8029313 - DNA, 22 bp, Homo sapiens
tgagcaggagataaacaggtag

SEQ ID NO: 8029314 - DNA, 22 bp, Homo sapiens
tgagcaggagataaacaggtag

SEQ ID NO: 8029315 - DNA, 21 bp, Homo sapiens
tgagcaggagtcatgggaatg

SEQ ID NO: 8029316 - DNA, 21 bp, Homo sapiens
tgagcaggagtcatgggaatg

SEQ ID NO: 8029317 - DNA, 21 bp, Homo sapiens
tgagcaggagtcatgggaatg

SEQ ID NO: 8029318 - DNA, 21 bp, Homo sapiens
tgagcaggagtcatgggaatg

SEQ ID NO: 8029319 - DNA, 21 bp, Homo sapiens
tgagcaggagtcatgggaatg

SEQ ID NO: 8029320 - DNA, 22 bp, Homo sapiens
tgagcaggattcgcctcttgca

SEQ ID NO: 8029321 - DNA, 22 bp, Homo sapiens
tgagcaggactcactgcagcct

SEQ ID NO: 8029322 - DNA, 22 bp, Homo sapiens
tgagcaggactcactgcagcct

SEQ ID NO: 8029323 - DNA, 22 bp, Homo sapiens
tgagcaggactcactgcagcct

SEQ ID NO: 8029324 - DNA, 22 bp, Homo sapiens
tgagcaggactcactgcagcct

SEQ ID NO: 8029325 - DNA, 22 bp, Homo sapiens
tgagcagcttgttccgagtgtt

SEQ ID NO: 8029326 - DNA, 22 bp, Homo sapiens
tgagcagcttgttccgagtgtt

SEQ ID NO: 8029327 - DNA, 22 bp, Homo sapiens
tgagcagcttctgtctgaaggc

SEQ ID NO: 8029328 - DNA, 22 bp, Homo sapiens
tgagcagcttctgtctgaaggc

SEQ ID NO: 8029329 - DNA, 22 bp, Homo sapiens
tgagcaggactcactgcagcct

SEQ ID NO: 8029330 - DNA, 22 bp, Homo sapiens
tgagcaggactcactgcagcct

SEQ ID NO: 8029331 - DNA, 22 bp, Homo sapiens
tgagcaggactgaccggcctta

SEQ ID NO: 8029332 - DNA, 22 bp, Homo sapiens
tgagcaggactgaccggcctta

SEQ ID NO: 8029333 - DNA, 22 bp, Homo sapiens
tgagcaggactgaccggcctta

SEQ ID NO: 8029334 - DNA, 22 bp, Homo sapiens
tgagcaggactgaccggcctta

SEQ ID NO: 8029335 - DNA, 22 bp, Homo sapiens
tgagcaggagataaacaggtag

SEQ ID NO: 8029336 - DNA, 22 bp, Homo sapiens
tgagcaggagataaacaggtag

SEQ ID NO: 8029337 - DNA, 23 bp, Homo sapiens
tgagcagctaaaggtgatgcggg

SEQ ID NO: 8029338 - DNA, 22 bp, Homo sapiens
tgagcagcccttcctccggcca

SEQ ID NO: 8029339 - DNA, 23 bp, Homo sapiens
tgagcagctaaaggtgatgcggg

SEQ ID NO: 8029340 - DNA, 22 bp, Homo sapiens
tgagcagctactgtgttcaggg

SEQ ID NO: 8029341 - DNA, 23 bp, Homo sapiens
tgagcagctaaaggtgatgcggg

SEQ ID NO: 8029342 - DNA, 22 bp, Homo sapiens
tgagcagcaggatcttctggta

SEQ ID NO: 8029343 - DNA, 22 bp, Homo sapiens
tgagcagcaactgtccatggca

SEQ ID NO: 8029344 - DNA, 22 bp, Homo sapiens
tgagcagcaggatcttctggta

SEQ ID NO: 8029345 - DNA, 22 bp, Homo sapiens
tgagcagatttgttctaggggt

SEQ ID NO: 8029346 - DNA, 22 bp, Homo sapiens
tgagcagatttgttctaggggt

SEQ ID NO: 8029347 - DNA, 22 bp, Homo sapiens
tgagcagatttgttctaggggt

SEQ ID NO: 8029348 - DNA, 22 bp, Homo sapiens
tgagcagatgtgccaaactgta

SEQ ID NO: 8029349 - DNA, 22 bp, Homo sapiens
tgagcagatgtctaacttttac

SEQ ID NO: 8029350 - DNA, 22 bp, Homo sapiens
tgagcagatttgttctaggggt

SEQ ID NO: 8029351 - DNA, 22 bp, Homo sapiens
tgagcagatgtgccaaactgta

SEQ ID NO: 8029352 - DNA, 22 bp, Homo sapiens
tgagccagataagggctcacgc

SEQ ID NO: 8029353 - DNA, 22 bp, Homo sapiens
tgagccagataagggctcacgc

SEQ ID NO: 8029354 - DNA, 22 bp, Homo sapiens
tgagccagagtggagtgtgcct

SEQ ID NO: 8029355 - DNA, 22 bp, Homo sapiens
tgagccagagaggttgaggcta

SEQ ID NO: 8029356 - DNA, 22 bp, Homo sapiens
tgagccagaggaggctgtgtgg

SEQ ID NO: 8029357 - DNA, 22 bp, Homo sapiens
tgagccagaggaggctgtgtgg

SEQ ID NO: 8029358 - DNA, 22 bp, Homo sapiens
tgagccagagtggagtgtgcct

SEQ ID NO: 8029359 - DNA, 22 bp, Homo sapiens
tgagccagagtggagtgtgcct

SEQ ID NO: 8029360 - DNA, 20 bp, Homo sapiens
tgagccaaacgatgaagagc

SEQ ID NO: 8029361 - DNA, 22 bp, Homo sapiens
tgagccaaacttctccttggtc

SEQ ID NO: 8029362 - DNA, 22 bp, Homo sapiens
tgagccaaggcctcaagaattt

SEQ ID NO: 8029363 - DNA, 22 bp, Homo sapiens
tgagccaaggagcaaagcctca

SEQ ID NO: 8029364 - DNA, 22 bp, Homo sapiens
tgagccaagatcatgccgttgt

SEQ ID NO: 8029365 - DNA, 22 bp, Homo sapiens
tgagccaagatcatgccgttgt

SEQ ID NO: 8029366 - DNA, 22 bp, Homo sapiens
tgagccaagttcacaccattgc

SEQ ID NO: 8029367 - DNA, 22 bp, Homo sapiens
tgagccaagttcacaccattgc

SEQ ID NO: 8029368 - DNA, 22 bp, Homo sapiens
tgagccagagaggttgaggcta

SEQ ID NO: 8029369 - DNA, 22 bp, Homo sapiens
tgagccagagaggttgaggcta

SEQ ID NO: 8029370 - DNA, 22 bp, Homo sapiens
tgagccagagaggttgaggcta

SEQ ID NO: 8029371 - DNA, 19 bp, Homo sapiens
tgagcatgcgagctgagaa

SEQ ID NO: 8029372 - DNA, 19 bp, Homo sapiens
tgagcatgcgagctgagaa

SEQ ID NO: 8029373 - DNA, 22 bp, Homo sapiens
tgagcatcttcgtgaaagcttc

SEQ ID NO: 8029374 - DNA, 22 bp, Homo sapiens
tgagcatggtgggtgcagagca

SEQ ID NO: 8029375 - DNA, 22 bp, Homo sapiens
tgagcatggtgggtgcagagca

SEQ ID NO: 8029376 - DNA, 22 bp, Homo sapiens
tgagcagtggcaccaggtcacc

SEQ ID NO: 8029377 - DNA, 22 bp, Homo sapiens
tgagcagtggcaccaggtcacc

SEQ ID NO: 8029378 - DNA, 22 bp, Homo sapiens
tgagcagtgatgcgttttgttt

SEQ ID NO: 8029379 - DNA, 22 bp, Homo sapiens
tgagcagtggcaccaggtcacc

SEQ ID NO: 8029380 - DNA, 22 bp, Homo sapiens
tgagcagggagctgggctgagc

SEQ ID NO: 8029381 - DNA, 22 bp, Homo sapiens
tgagcagtggtgtttttctatc

SEQ ID NO: 8029382 - DNA, 22 bp, Homo sapiens
tgagcagttcgacttcttcccc

SEQ ID NO: 8029383 - DNA, 22 bp, Homo sapiens
tgagcagtggctcctgctggac

SEQ ID NO: 8029384 - DNA, 22 bp, Homo sapiens
tgagcagtggctcctgctggac

SEQ ID NO: 8029385 - DNA, 22 bp, Homo sapiens
tgagcagtggggcctgcattct

SEQ ID NO: 8029386 - DNA, 22 bp, Homo sapiens
tgagcagggactttgagtgtag

SEQ ID NO: 8029387 - DNA, 22 bp, Homo sapiens
tgagcagggactttgagtgtag

SEQ ID NO: 8029388 - DNA, 22 bp, Homo sapiens
tgagcagggactttggagtctg

SEQ ID NO: 8029389 - DNA, 22 bp, Homo sapiens
tgagcagggactttggagtctg

SEQ ID NO: 8029390 - DNA, 22 bp, Homo sapiens
tgagcagggactttggagtctg

SEQ ID NO: 8029391 - DNA, 22 bp, Homo sapiens
tgagcagggactttggagtctg

SEQ ID NO: 8029392 - DNA, 22 bp, Homo sapiens
tgagcagggactttggagtctg

SEQ ID NO: 8029393 - DNA, 22 bp, Homo sapiens
tgagcagggagctgggctgagc

SEQ ID NO: 8029394 - DNA, 22 bp, Homo sapiens
tgagcagggagctgggctgagc

SEQ ID NO: 8029395 - DNA, 22 bp, Homo sapiens
tgagcagggagctgggctgagc

SEQ ID NO: 8029396 - DNA, 22 bp, Homo sapiens
tgagcagggactttggagtctg

SEQ ID NO: 8029397 - DNA, 22 bp, Homo sapiens
tgagcagggactttggagtctg

SEQ ID NO: 8029398 - DNA, 22 bp, Homo sapiens
tgagcagggagctgggctgagc

SEQ ID NO: 8029399 - DNA, 19 bp, Homo sapiens
tgagccagggaggccatgc

SEQ ID NO: 8029400 - DNA, 19 bp, Homo sapiens
tgagccagggaggccatgc

SEQ ID NO: 8029401 - DNA, 22 bp, Homo sapiens
tgagccagggtttccggctgct

SEQ ID NO: 8029402 - DNA, 22 bp, Homo sapiens
tgagccagggtttccggctgct

SEQ ID NO: 8029403 - DNA, 19 bp, Homo sapiens
tgagccagggaggccatgc

SEQ ID NO: 8029404 - DNA, 22 bp, Homo sapiens
tgagccaggctcaagtgatcct

SEQ ID NO: 8029405 - DNA, 22 bp, Homo sapiens
tgagccaggctccatgccacct

SEQ ID NO: 8029406 - DNA, 22 bp, Homo sapiens
tgagccaggctccatgccacct

SEQ ID NO: 8029407 - DNA, 21 bp, Homo sapiens
tgagccaggctgacggctgtg

SEQ ID NO: 8029408 - DNA, 21 bp, Homo sapiens
tgagccaggctgacggctgtg

SEQ ID NO: 8029409 - DNA, 21 bp, Homo sapiens
tgagccaggctgacggctgtg

SEQ ID NO: 8029410 - DNA, 21 bp, Homo sapiens
tgagccaggctgacggctgtg

SEQ ID NO: 8029411 - DNA, 22 bp, Homo sapiens
tgagccaggcccagtggggtca

SEQ ID NO: 8029412 - DNA, 20 bp, Homo sapiens
tgagccaggctaggaagggc

SEQ ID NO: 8029413 - DNA, 22 bp, Homo sapiens
tgagccaggcactgctcctgga

SEQ ID NO: 8029414 - DNA, 22 bp, Homo sapiens
tgagccaggcactgctcctgga

SEQ ID NO: 8029415 - DNA, 22 bp, Homo sapiens
tgagccaggcccagtggggtca

SEQ ID NO: 8029416 - DNA, 22 bp, Homo sapiens
tgagccaggcccagtggggtca

SEQ ID NO: 8029417 - DNA, 22 bp, Homo sapiens
tgagccaggctcaagtgatcct

SEQ ID NO: 8029418 - DNA, 20 bp, Homo sapiens
tgagccaggctaggaagggc

SEQ ID NO: 8029419 - DNA, 22 bp, Homo sapiens
tgagccaggctccatgccacct

SEQ ID NO: 8029420 - DNA, 22 bp, Homo sapiens
tgagccaggctcaagtgatcct

SEQ ID NO: 8029421 - DNA, 22 bp, Homo sapiens
tgagccagataagggctcacgc

SEQ ID NO: 8029422 - DNA, 22 bp, Homo sapiens
tgagccagcaggcctccagtgg

SEQ ID NO: 8029423 - DNA, 22 bp, Homo sapiens
tgagccagcctcagaagtcacg

SEQ ID NO: 8029424 - DNA, 22 bp, Homo sapiens
tgagccagcaggcctccagtgg

SEQ ID NO: 8029425 - DNA, 22 bp, Homo sapiens
tgagccagataagggctcacgc

SEQ ID NO: 8029426 - DNA, 22 bp, Homo sapiens
tgagccagccttgcagctgtgc

SEQ ID NO: 8029427 - DNA, 22 bp, Homo sapiens
tgagccagccttgcagctgtgc

SEQ ID NO: 8029428 - DNA, 22 bp, Homo sapiens
tgagccagccttgcagctgtgc

SEQ ID NO: 8029429 - DNA, 22 bp, Homo sapiens
tgagccagccttgcagctgtgc

SEQ ID NO: 8029430 - DNA, 22 bp, Homo sapiens
tgagccagcctcagaagtcacg

SEQ ID NO: 8029431 - DNA, 22 bp, Homo sapiens
tgagccagcctcagaagtcacg

SEQ ID NO: 8029432 - DNA, 22 bp, Homo sapiens
tgagccagctccttgcctgtca

SEQ ID NO: 8029433 - DNA, 22 bp, Homo sapiens
tgagccagctccttgcctgtca

SEQ ID NO: 8029434 - DNA, 22 bp, Homo sapiens
tgagccagctccttgcctgtca

SEQ ID NO: 8029435 - DNA, 22 bp, Homo sapiens
tgagccagctccttgcctgtca

SEQ ID NO: 8029436 - DNA, 22 bp, Homo sapiens
tgagccaggagtttgaggctgt

SEQ ID NO: 8029437 - DNA, 22 bp, Homo sapiens
tgagccaggagtttgaggctgt

SEQ ID NO: 8029438 - DNA, 22 bp, Homo sapiens
tgagccaggagtttgaggctgt

SEQ ID NO: 8029439 - DNA, 22 bp, Homo sapiens
tgagccaggagtttgaggctgt

SEQ ID NO: 8029440 - DNA, 22 bp, Homo sapiens
tgagccaggcactgctcctgga

SEQ ID NO: 8029441 - DNA, 22 bp, Homo sapiens
tgagccaggcactgctcctgga

SEQ ID NO: 8029442 - DNA, 22 bp, Homo sapiens
tgagccaggcactgctcctgga

SEQ ID NO: 8029443 - DNA, 22 bp, Homo sapiens
tgagccaggcactgctcctgga

SEQ ID NO: 8029444 - DNA, 22 bp, Homo sapiens
tgagccaggcactgctcctgga

SEQ ID NO: 8029445 - DNA, 22 bp, Homo sapiens
tgagccaggcactgctcctgga

SEQ ID NO: 8029446 - DNA, 22 bp, Homo sapiens
tgagccaggagtttgaggctgt

SEQ ID NO: 8029447 - DNA, 22 bp, Homo sapiens
tgagccttccttgtcatatcat

SEQ ID NO: 8029448 - DNA, 20 bp, Homo sapiens
tgagccttgaggagtgactg

SEQ ID NO: 8029449 - DNA, 22 bp, Homo sapiens
tgagcgtgcagtagtgttggta

SEQ ID NO: 8029450 - DNA, 22 bp, Homo sapiens
tgagccttcctcagaagctcct

SEQ ID NO: 8029451 - DNA, 23 bp, Homo sapiens
tgagcctgttaatactggctctg

SEQ ID NO: 8029452 - DNA, 22 bp, Homo sapiens
tgagcctgtcctgtgcatgtga

SEQ ID NO: 8029453 - DNA, 22 bp, Homo sapiens
tgagcctgtcctgtgcatgtga

SEQ ID NO: 8029454 - DNA, 22 bp, Homo sapiens
tgagcctgtcattattcagaga

SEQ ID NO: 8029455 - DNA, 22 bp, Homo sapiens
tgagcctgtcctgtgcatgtga

SEQ ID NO: 8029456 - DNA, 22 bp, Homo sapiens
tgagctaggtcctgtgtcagct

SEQ ID NO: 8029457 - DNA, 22 bp, Homo sapiens
tgagctacttctgatattggca

SEQ ID NO: 8029458 - DNA, 22 bp, Homo sapiens
tgagctcatagctcttattatg

SEQ ID NO: 8029459 - DNA, 22 bp, Homo sapiens
tgagctaggtgtgcagatatga

SEQ ID NO: 8029460 - DNA, 22 bp, Homo sapiens
tgagctcatagctcttattatg

SEQ ID NO: 8029461 - DNA, 22 bp, Homo sapiens
tgagctagggctggtgaggagc

SEQ ID NO: 8029462 - DNA, 22 bp, Homo sapiens
tgagctagggctggtgaggagc

SEQ ID NO: 8029463 - DNA, 22 bp, Homo sapiens
tgagctacacactaggcatggg

SEQ ID NO: 8029464 - DNA, 20 bp, Homo sapiens
tgagccttgaggagtgactg

SEQ ID NO: 8029465 - DNA, 22 bp, Homo sapiens
tgagcctggggcctgggcagcg

SEQ ID NO: 8029466 - DNA, 22 bp, Homo sapiens
tgagcctggttgcagtgtctgg

SEQ ID NO: 8029467 - DNA, 22 bp, Homo sapiens
tgagcctggttgcagtgtctgg

SEQ ID NO: 8029468 - DNA, 22 bp, Homo sapiens
tgagcctggttgcagtgtctgg

SEQ ID NO: 8029469 - DNA, 22 bp, Homo sapiens
tgagcctgggagatggaggctg

SEQ ID NO: 8029470 - DNA, 22 bp, Homo sapiens
tgagcctgggagatggaggctg

SEQ ID NO: 8029471 - DNA, 22 bp, Homo sapiens
tgagcctgggagatggaggctg

SEQ ID NO: 8029472 - DNA, 22 bp, Homo sapiens
tgagcctgggagatggaggctg

SEQ ID NO: 8029473 - DNA, 22 bp, Homo sapiens
tgagcctgggagatggaggctg

SEQ ID NO: 8029474 - DNA, 22 bp, Homo sapiens
tgagcctggggcctgggcagcg

SEQ ID NO: 8029475 - DNA, 22 bp, Homo sapiens
tgagcctggggcctgggcagcg

SEQ ID NO: 8029476 - DNA, 22 bp, Homo sapiens
tgagcctgggctttctctggag

SEQ ID NO: 8029477 - DNA, 22 bp, Homo sapiens
tgagcctgcaataagcacagcc

SEQ ID NO: 8029478 - DNA, 22 bp, Homo sapiens
tgagcctgagttcaaggctgca

SEQ ID NO: 8029479 - DNA, 22 bp, Homo sapiens
tgagcctgcaataagcacagcc

SEQ ID NO: 8029480 - DNA, 22 bp, Homo sapiens
tgagcctgcaataagcacagcc

SEQ ID NO: 8029481 - DNA, 22 bp, Homo sapiens
tgagcctgagttcaaggctgca

SEQ ID NO: 8029482 - DNA, 22 bp, Homo sapiens
tgagcctgagttcaaggctgca

SEQ ID NO: 8029483 - DNA, 22 bp, Homo sapiens
tgagcctctaccacaggtggaa

SEQ ID NO: 8029484 - DNA, 22 bp, Homo sapiens
tgagcctgagttcaaggctgca

SEQ ID NO: 8029485 - DNA, 20 bp, Homo sapiens
tgagcctgctgtaggaggcc

SEQ ID NO: 8029486 - DNA, 20 bp, Homo sapiens
tgagcctgctgtaggaggcc

SEQ ID NO: 8029487 - DNA, 23 bp, Homo sapiens
tgagcctgctgatagacacaatt

SEQ ID NO: 8029488 - DNA, 20 bp, Homo sapiens
tgagcctgctgtaggaggcc

SEQ ID NO: 8029489 - DNA, 22 bp, Homo sapiens
tgagcctgcctgcaggtgtgct

SEQ ID NO: 8029490 - DNA, 22 bp, Homo sapiens
tgagcctgcctgcaggtgtgct

SEQ ID NO: 8029491 - DNA, 22 bp, Homo sapiens
tgagcctgcctgcaggtgtgct

SEQ ID NO: 8029492 - DNA, 22 bp, Homo sapiens
tgagcctgcctgcaggtgtgct

SEQ ID NO: 8029493 - DNA, 22 bp, Homo sapiens
tgagcctgcctgcaggtgtgct

SEQ ID NO: 8029494 - DNA, 22 bp, Homo sapiens
tgagcctgcctgcaggtgtgct

SEQ ID NO: 8029495 - DNA, 22 bp, Homo sapiens
tgagcctggcggaagcagcgtg

SEQ ID NO: 8029496 - DNA, 22 bp, Homo sapiens
tgagcctggcctgcagagacca

SEQ ID NO: 8029497 - DNA, 22 bp, Homo sapiens
tgagcctggcggaagcagcgtg

SEQ ID NO: 8029498 - DNA, 22 bp, Homo sapiens
tgagcctggagtcgtggagggg

SEQ ID NO: 8029499 - DNA, 22 bp, Homo sapiens
tgagcctggagtcgtggagggg

SEQ ID NO: 8029500 - DNA, 22 bp, Homo sapiens
tgagcctggcctgcagagacca

SEQ ID NO: 8029501 - DNA, 22 bp, Homo sapiens
tgagcctggagtcgtggagggg

SEQ ID NO: 8029502 - DNA, 22 bp, Homo sapiens
tgagcctgctgtcgctggaccc

SEQ ID NO: 8029503 - DNA, 22 bp, Homo sapiens
tgagcctggagcccagatgttt

SEQ ID NO: 8029504 - DNA, 22 bp, Homo sapiens
tgagcctgctgtcgctggaccc

SEQ ID NO: 8029505 - DNA, 20 bp, Homo sapiens
tgagcctgctgtaggaggcc

SEQ ID NO: 8029506 - DNA, 22 bp, Homo sapiens
tgagcctgctgtcgctggaccc

SEQ ID NO: 8029507 - DNA, 22 bp, Homo sapiens
tgagcctggagcccagatgttt

SEQ ID NO: 8029508 - DNA, 21 bp, Homo sapiens
tgagcccttgcctcagagccc

SEQ ID NO: 8029509 - DNA, 22 bp, Homo sapiens
tgagccgtggtctctgagggtg

SEQ ID NO: 8029510 - DNA, 22 bp, Homo sapiens
tgagccctcggctggggcagag

SEQ ID NO: 8029511 - DNA, 22 bp, Homo sapiens
tgagcccgtaggggccaaggct

SEQ ID NO: 8029512 - DNA, 22 bp, Homo sapiens
tgagcccatgtagcacttccat

SEQ ID NO: 8029513 - DNA, 23 bp, Homo sapiens
tgagcccagttttccctcttgcc

SEQ ID NO: 8029514 - DNA, 22 bp, Homo sapiens
tgagccccggagtttcaggctg

SEQ ID NO: 8029515 - DNA, 22 bp, Homo sapiens
tgagccagtctctcagaaccct

SEQ ID NO: 8029516 - DNA, 22 bp, Homo sapiens
tgagccagtctctcagaaccct

SEQ ID NO: 8029517 - DNA, 22 bp, Homo sapiens
tgagccagtctctcagaaccct

SEQ ID NO: 8029518 - DNA, 22 bp, Homo sapiens
tgagccagtctgtctgggtgaa

SEQ ID NO: 8029519 - DNA, 22 bp, Homo sapiens
tgagccagtctgtctgggtgaa

SEQ ID NO: 8029520 - DNA, 22 bp, Homo sapiens
tgagccagtctgtctgggtgaa

SEQ ID NO: 8029521 - DNA, 22 bp, Homo sapiens
tgagccagtggaagatggcagt

SEQ ID NO: 8029522 - DNA, 22 bp, Homo sapiens
tgagccagtctgtctgggtgaa

SEQ ID NO: 8029523 - DNA, 22 bp, Homo sapiens
tgagccagtctgtctgggtgaa

SEQ ID NO: 8029524 - DNA, 22 bp, Homo sapiens
tgagccagtggaagatggcagt

SEQ ID NO: 8029525 - DNA, 20 bp, Homo sapiens
tgagccagtcaagctacatt

SEQ ID NO: 8029526 - DNA, 22 bp, Homo sapiens
tgagccaggttttccatcattc

SEQ ID NO: 8029527 - DNA, 20 bp, Homo sapiens
tgagccagtcaagctacatt

SEQ ID NO: 8029528 - DNA, 22 bp, Homo sapiens
tgagccaggttttccatcattc

SEQ ID NO: 8029529 - DNA, 22 bp, Homo sapiens
tgagccaggttttccatcattc

SEQ ID NO: 8029530 - DNA, 22 bp, Homo sapiens
tgagccaggttttccatcattc

SEQ ID NO: 8029531 - DNA, 22 bp, Homo sapiens
tgagccaggttaagacaggagc

SEQ ID NO: 8029532 - DNA, 22 bp, Homo sapiens
tgagccaggttaagacaggagc

SEQ ID NO: 8029533 - DNA, 22 bp, Homo sapiens
tgagccaggtctcactcacctt

SEQ ID NO: 8029534 - DNA, 22 bp, Homo sapiens
tgagccaggttaagacaggagc

SEQ ID NO: 8029535 - DNA, 22 bp, Homo sapiens
tgagccaggttaagacaggagc

SEQ ID NO: 8029536 - DNA, 22 bp, Homo sapiens
tgagcttacgtgggaacagact

SEQ ID NO: 8029537 - DNA, 22 bp, Homo sapiens
tgagcttacgtgggaacagact

SEQ ID NO: 8029538 - DNA, 22 bp, Homo sapiens
tgagcttacttctgtacacaga

SEQ ID NO: 8029539 - DNA, 22 bp, Homo sapiens
tgagctgtttctctggtggctt

SEQ ID NO: 8029540 - DNA, 22 bp, Homo sapiens
tgagctgtgtcctgggggcagt

SEQ ID NO: 8029541 - DNA, 22 bp, Homo sapiens
tgagctgtgtcctgggggcagt

SEQ ID NO: 8029542 - DNA, 22 bp, Homo sapiens
tgagctgtgtgacattgagcca

SEQ ID NO: 8029543 - DNA, 22 bp, Homo sapiens
tgagctgtgtcttggtgagagt

SEQ ID NO: 8029544 - DNA, 22 bp, Homo sapiens
tgagctgtgtgacattgagcca

SEQ ID NO: 8029545 - DNA, 17 bp, Homo sapiens
tgagcttcaatcaggtg

SEQ ID NO: 8029546 - DNA, 22 bp, Homo sapiens
tgagcttcaaagttggatctga

SEQ ID NO: 8029547 - DNA, 20 bp, Homo sapiens
tgagcttcagatatcgtgca

SEQ ID NO: 8029548 - DNA, 20 bp, Homo sapiens
tgagcttcagatatcgtgca

SEQ ID NO: 8029549 - DNA, 17 bp, Homo sapiens
tgagcttcaatcaggtg

SEQ ID NO: 8029550 - DNA, 22 bp, Homo sapiens
tgagcttcaaagttggatctga

SEQ ID NO: 8029551 - DNA, 22 bp, Homo sapiens
tgagcttcaaaatatgtgaatc

SEQ ID NO: 8029552 - DNA, 22 bp, Homo sapiens
tgagcttcaaagttggatctga

SEQ ID NO: 8029553 - DNA, 22 bp, Homo sapiens
tgagcttcaaagttggatctga

SEQ ID NO: 8029554 - DNA, 22 bp, Homo sapiens
tgagcttcaaaatatgtgaatc

SEQ ID NO: 8029555 - DNA, 22 bp, Homo sapiens
tgagctgtgctacgccctggga

SEQ ID NO: 8029556 - DNA, 22 bp, Homo sapiens
tgagctgtggtggggtagagga

SEQ ID NO: 8029557 - DNA, 22 bp, Homo sapiens
tgagctgtgattaactctgaga

SEQ ID NO: 8029558 - DNA, 22 bp, Homo sapiens
tgagctgtgattaactctgaga

SEQ ID NO: 8029559 - DNA, 22 bp, Homo sapiens
tgagctgtctatggtcctgtct

SEQ ID NO: 8029560 - DNA, 22 bp, Homo sapiens
tgagctgtctgaatggtgagga

SEQ ID NO: 8029561 - DNA, 22 bp, Homo sapiens
tgagctgtgagggtacagatat

SEQ ID NO: 8029562 - DNA, 22 bp, Homo sapiens
tgagctgtgatctatgataaat

SEQ ID NO: 8029563 - DNA, 22 bp, Homo sapiens
tgagctgtactcctccccaggg

SEQ ID NO: 8029564 - DNA, 22 bp, Homo sapiens
tgagctgtagcagatgctgttg

SEQ ID NO: 8029565 - DNA, 22 bp, Homo sapiens
tgagctgtaaggctgtcactga

SEQ ID NO: 8029566 - DNA, 22 bp, Homo sapiens
tgagctgtagcagatgctgttg

SEQ ID NO: 8029567 - DNA, 22 bp, Homo sapiens
tgagctgtatattgttttaata

SEQ ID NO: 8029568 - DNA, 22 bp, Homo sapiens
tgagctgtcaaggtacagtgaa

SEQ ID NO: 8029569 - DNA, 22 bp, Homo sapiens
tgagcttggaaggagaaacaga

SEQ ID NO: 8029570 - DNA, 22 bp, Homo sapiens
tgagcttggaaggagaaacaga

SEQ ID NO: 8029571 - DNA, 22 bp, Homo sapiens
tgagctttgtgggtaaagagag

SEQ ID NO: 8029572 - DNA, 22 bp, Homo sapiens
tgagctttcatgtatgaaaaga

SEQ ID NO: 8029573 - DNA, 22 bp, Homo sapiens
tgagcttccctcctgcactaca

SEQ ID NO: 8029574 - DNA, 22 bp, Homo sapiens
tgagcttccctcctgcactaca

SEQ ID NO: 8029575 - DNA, 22 bp, Homo sapiens
tgagcttcctccctgcatccat

SEQ ID NO: 8029576 - DNA, 22 bp, Homo sapiens
tgagcttctttatttggccaga

SEQ ID NO: 8029577 - DNA, 22 bp, Homo sapiens
tgagcttcctccctgcatccat

SEQ ID NO: 8029578 - DNA, 22 bp, Homo sapiens
tgagcttctttatttggccaga

SEQ ID NO: 8029579 - DNA, 22 bp, Homo sapiens
tgagcttcctccctgcatccat

SEQ ID NO: 8029580 - DNA, 22 bp, Homo sapiens
tgagcttttaatatacaggtgt

SEQ ID NO: 8029581 - DNA, 22 bp, Homo sapiens
tgaggaaaacgtattgaaagga

SEQ ID NO: 8029582 - DNA, 22 bp, Homo sapiens
tgaggaaaacgtattgaaagga

SEQ ID NO: 8029583 - DNA, 22 bp, Homo sapiens
tgaggaaaatgtcttatagatt

SEQ ID NO: 8029584 - DNA, 22 bp, Homo sapiens
tgaggaaaatgtcttatagatt

SEQ ID NO: 8029585 - DNA, 22 bp, Homo sapiens
tgaggaaactgaggcacagatg

SEQ ID NO: 8029586 - DNA, 22 bp, Homo sapiens
tgaggaaactgaggcacagatg

SEQ ID NO: 8029587 - DNA, 22 bp, Homo sapiens
tgaggaaactgaggcacagatg

SEQ ID NO: 8029588 - DNA, 22 bp, Homo sapiens
tgaggaaactgaggcacagatg

SEQ ID NO: 8029589 - DNA, 22 bp, Homo sapiens
tgaggaaacttacaaggcagaa

SEQ ID NO: 8029590 - DNA, 22 bp, Homo sapiens
tgaggaaacttacaaggcagaa

SEQ ID NO: 8029591 - DNA, 22 bp, Homo sapiens
tgagctcttgatatccttgttt

SEQ ID NO: 8029592 - DNA, 23 bp, Homo sapiens
tgagctgagtgagttggcctggg

SEQ ID NO: 8029593 - DNA, 22 bp, Homo sapiens
tgagctgagtggcaggtctcag

SEQ ID NO: 8029594 - DNA, 22 bp, Homo sapiens
tgagctgagtggcaggtctcag

SEQ ID NO: 8029595 - DNA, 22 bp, Homo sapiens
tgagctcctggtcacaattatc

SEQ ID NO: 8029596 - DNA, 19 bp, Homo sapiens
tgagctctccacaatttcc

SEQ ID NO: 8029597 - DNA, 22 bp, Homo sapiens
tgagctctgttagggctggaac

SEQ ID NO: 8029598 - DNA, 22 bp, Homo sapiens
tgagctgagtttaaaagctgct

SEQ ID NO: 8029599 - DNA, 22 bp, Homo sapiens
tgagctgcagagatctttgata

SEQ ID NO: 8029600 - DNA, 22 bp, Homo sapiens
tgagctgcagtgagctgagatg

SEQ ID NO: 8029601 - DNA, 22 bp, Homo sapiens
tgagctgcattacagcctctgt

SEQ ID NO: 8029602 - DNA, 22 bp, Homo sapiens
tgagctgcagtgagctgagatg

SEQ ID NO: 8029603 - DNA, 22 bp, Homo sapiens
tgagctgcagtgagctgagatg

SEQ ID NO: 8029604 - DNA, 19 bp, Homo sapiens
tgagctgctgctgcccatc

SEQ ID NO: 8029605 - DNA, 18 bp, Homo sapiens
tgagctgctctgtgaaga

SEQ ID NO: 8029606 - DNA, 22 bp, Homo sapiens
tgagctgctagatgatttatga

SEQ ID NO: 8029607 - DNA, 22 bp, Homo sapiens
tgagctgcattctctttatcat

SEQ ID NO: 8029608 - DNA, 22 bp, Homo sapiens
tgagctggtcttgagtgtagct

SEQ ID NO: 8029609 - DNA, 22 bp, Homo sapiens
tgagctggtcactccttctgaa

SEQ ID NO: 8029610 - DNA, 22 bp, Homo sapiens
tgagctggtcactccttctgaa

SEQ ID NO: 8029611 - DNA, 22 bp, Homo sapiens
tgagctggtcttgagtgtagct

SEQ ID NO: 8029612 - DNA, 22 bp, Homo sapiens
tgagctggtcttgagtgtagct

SEQ ID NO: 8029613 - DNA, 22 bp, Homo sapiens
tgagctggtcttgagtgtagct

SEQ ID NO: 8029614 - DNA, 22 bp, Homo sapiens
tgagctggttcttgaggcatga

SEQ ID NO: 8029615 - DNA, 22 bp, Homo sapiens
tgagctggtcttgagtgtagct

SEQ ID NO: 8029616 - DNA, 22 bp, Homo sapiens
tgagctggttcttgaggcatga

SEQ ID NO: 8029617 - DNA, 22 bp, Homo sapiens
tgagctggttcttgaggcatga

SEQ ID NO: 8029618 - DNA, 22 bp, Homo sapiens
tgagctggttcttgaggcatga

SEQ ID NO: 8029619 - DNA, 22 bp, Homo sapiens
tgagctggttcttgaggcatga

SEQ ID NO: 8029620 - DNA, 22 bp, Homo sapiens
tgagctggttcttgaggcatga

SEQ ID NO: 8029621 - DNA, 22 bp, Homo sapiens
tgagctggttcttgaggcatga

SEQ ID NO: 8029622 - DNA, 22 bp, Homo sapiens
tgagctggaggacaggagggta

SEQ ID NO: 8029623 - DNA, 22 bp, Homo sapiens
tgagctggagtcgtgagcaaag

SEQ ID NO: 8029624 - DNA, 22 bp, Homo sapiens
tgagctggagtcgtgagcaaag

SEQ ID NO: 8029625 - DNA, 22 bp, Homo sapiens
tgagctggaggacaggagggta

SEQ ID NO: 8029626 - DNA, 22 bp, Homo sapiens
tgagctggaggacaggagggta

SEQ ID NO: 8029627 - DNA, 22 bp, Homo sapiens
tgagctggaatcttcttgactg

SEQ ID NO: 8029628 - DNA, 22 bp, Homo sapiens
tgagctggaatcttcttgactg

SEQ ID NO: 8029629 - DNA, 22 bp, Homo sapiens
tgagctggaatcttcttgactg

SEQ ID NO: 8029630 - DNA, 22 bp, Homo sapiens
tgagctggaggacaggagggta

SEQ ID NO: 8029631 - DNA, 22 bp, Homo sapiens
tgagctggaggacaggagggta

SEQ ID NO: 8029632 - DNA, 19 bp, Homo sapiens
tgagctgctgctgcccatc

SEQ ID NO: 8029633 - DNA, 22 bp, Homo sapiens
tgagctgcttcttataatgtgt

SEQ ID NO: 8029634 - DNA, 22 bp, Homo sapiens
tgagctggatccaactccgttt

SEQ ID NO: 8029635 - DNA, 22 bp, Homo sapiens
tgagctggatccaactccgttt

SEQ ID NO: 8029636 - DNA, 22 bp, Homo sapiens
tgagctggcacttttcctggga

SEQ ID NO: 8029637 - DNA, 22 bp, Homo sapiens
tgagctggatccaactccgttt

SEQ ID NO: 8029638 - DNA, 22 bp, Homo sapiens
tgagctggagtctgtggctcct

SEQ ID NO: 8029639 - DNA, 22 bp, Homo sapiens
tgagctggagtctgtggctcct

SEQ ID NO: 8029640 - DNA, 22 bp, Homo sapiens
tgagctggagtctgtggctcct

SEQ ID NO: 8029641 - DNA, 22 bp, Homo sapiens
tgagctggagtctgtggctcct

SEQ ID NO: 8029642 - DNA, 22 bp, Homo sapiens
tgagctggagtcgtgagcaaag

SEQ ID NO: 8029643 - DNA, 22 bp, Homo sapiens
tgagaaagtgggtgcctagcaa

SEQ ID NO: 8029644 - DNA, 22 bp, Homo sapiens
tgagaaatattgcacagtgagg

SEQ ID NO: 8029645 - DNA, 22 bp, Homo sapiens
tgagaaatattgcacagtgagg

SEQ ID NO: 8029646 - DNA, 20 bp, Homo sapiens
tgagaaagtagagactcagg

SEQ ID NO: 8029647 - DNA, 22 bp, Homo sapiens
tgagaaaggtatttcatgcact

SEQ ID NO: 8029648 - DNA, 22 bp, Homo sapiens
tgagaaaggtatttcatgcact

SEQ ID NO: 8029649 - DNA, 22 bp, Homo sapiens
tgagaaaggtatttcatgcact

SEQ ID NO: 8029650 - DNA, 20 bp, Homo sapiens
tgagaaagtagagactcagg

SEQ ID NO: 8029651 - DNA, 20 bp, Homo sapiens
tgagaaagtagagactcagg

SEQ ID NO: 8029652 - DNA, 20 bp, Homo sapiens
tgagaaagtagagactcagg

SEQ ID NO: 8029653 - DNA, 20 bp, Homo sapiens
tgagaaagtagagactcagg

SEQ ID NO: 8029654 - DNA, 20 bp, Homo sapiens
tgagaaagtagagactcagg

SEQ ID NO: 8029655 - DNA, 19 bp, Homo sapiens
tgagaaattccacaggatg

SEQ ID NO: 8029656 - DNA, 19 bp, Homo sapiens
tgagaaattccacaggatg

SEQ ID NO: 8029657 - DNA, 22 bp, Homo sapiens
tgagaaattcgacatatattta

SEQ ID NO: 8029658 - DNA, 22 bp, Homo sapiens
tgagaaattcgacatatattta

SEQ ID NO: 8029659 - DNA, 23 bp, Homo sapiens
tgagaaattttgattcagtagga

SEQ ID NO: 8029660 - DNA, 22 bp, Homo sapiens
tgagaaatggcagcattactgg

SEQ ID NO: 8029661 - DNA, 22 bp, Homo sapiens
tgagaaatgggtctgctgaaga

SEQ ID NO: 8029662 - DNA, 22 bp, Homo sapiens
tgagaaatgggtctgctgaaga

SEQ ID NO: 8029663 - DNA, 22 bp, Homo sapiens
tgagaaatggcagcattactgg

SEQ ID NO: 8029664 - DNA, 22 bp, Homo sapiens
tgagaaatggcagcattactgg

SEQ ID NO: 8029665 - DNA, 22 bp, Homo sapiens
tgagaaaattactataattgtc

SEQ ID NO: 8029666 - DNA, 22 bp, Homo sapiens
tgagaaaattactataattgtc

SEQ ID NO: 8029667 - DNA, 22 bp, Homo sapiens
tgagaaaatccagaggctagtt

SEQ ID NO: 8029668 - DNA, 22 bp, Homo sapiens
tgagaaaatccagaggctagtt

SEQ ID NO: 8029669 - DNA, 22 bp, Homo sapiens
tgagaaaagtgtggaggtcaat

SEQ ID NO: 8029670 - DNA, 22 bp, Homo sapiens
tgagaaaatccagaggctagtt

SEQ ID NO: 8029671 - DNA, 22 bp, Homo sapiens
tgagaaaatccagaggctagtt

SEQ ID NO: 8029672 - DNA, 22 bp, Homo sapiens
tgactttaaaataacaagttta

SEQ ID NO: 8029673 - DNA, 22 bp, Homo sapiens
tgactttaaaataacaagttta

SEQ ID NO: 8029674 - DNA, 22 bp, Homo sapiens
tgagaaaagtgtggaggtcaat

SEQ ID NO: 8029675 - DNA, 22 bp, Homo sapiens
tgagaaaagtgtggaggtcaat

SEQ ID NO: 8029676 - DNA, 22 bp, Homo sapiens
tgagaaaagtgtggaggtcaat

SEQ ID NO: 8029677 - DNA, 22 bp, Homo sapiens
tgagaaacacaggcatgaatag

SEQ ID NO: 8029678 - DNA, 22 bp, Homo sapiens
tgagaaacatatgagagatttg

SEQ ID NO: 8029679 - DNA, 22 bp, Homo sapiens
tgagaaacttgccaagcatctc

SEQ ID NO: 8029680 - DNA, 22 bp, Homo sapiens
tgagaaagacagacattcctaa

SEQ ID NO: 8029681 - DNA, 22 bp, Homo sapiens
tgagaaagacagacattcctaa

SEQ ID NO: 8029682 - DNA, 22 bp, Homo sapiens
tgagaaagcctttagtcccagg

SEQ ID NO: 8029683 - DNA, 22 bp, Homo sapiens
tgagaaagcctttagtcccagg

SEQ ID NO: 8029684 - DNA, 22 bp, Homo sapiens
tgagaaaggtatttcatgcact

SEQ ID NO: 8029685 - DNA, 22 bp, Homo sapiens
tgagaaaggtatttcatgcact

SEQ ID NO: 8029686 - DNA, 22 bp, Homo sapiens
tgagaacattgggaaagctatg

SEQ ID NO: 8029687 - DNA, 22 bp, Homo sapiens
tgagaacattcctcttcctggc

SEQ ID NO: 8029688 - DNA, 23 bp, Homo sapiens
tgagaaattttgattcagtagga

SEQ ID NO: 8029689 - DNA, 22 bp, Homo sapiens
tgagaacaaagttgaaagtttg

SEQ ID NO: 8029690 - DNA, 23 bp, Homo sapiens
tgagaaattttgattcagtagga

SEQ ID NO: 8029691 - DNA, 22 bp, Homo sapiens
tgagaaccacctggaggtgact

SEQ ID NO: 8029692 - DNA, 22 bp, Homo sapiens
tgagaaccatgaaaagctgtca

SEQ ID NO: 8029693 - DNA, 18 bp, Homo sapiens
tgagaactaggcattgca

SEQ ID NO: 8029694 - DNA, 22 bp, Homo sapiens
tgagaaccatgaaaagctgtca

SEQ ID NO: 8029695 - DNA, 22 bp, Homo sapiens
tgagaacggatactaagggctg

SEQ ID NO: 8029696 - DNA, 22 bp, Homo sapiens
tgagaacttgtgctattgcaca

SEQ ID NO: 8029697 - DNA, 22 bp, Homo sapiens
tgagaacttgtgctattgcaca

SEQ ID NO: 8029698 - DNA, 22 bp, Homo sapiens
tgagaactgaggatttgaattc

SEQ ID NO: 8029699 - DNA, 22 bp, Homo sapiens
tgagaactgaggatttgaattc

SEQ ID NO: 8029700 - DNA, 22 bp, Homo sapiens
tgagaactgaggatttgaattc

SEQ ID NO: 8029701 - DNA, 22 bp, Homo sapiens
tgagaactggtagcacttgtga

SEQ ID NO: 8029702 - DNA, 22 bp, Homo sapiens
tgagaactggtagcacttgtga

SEQ ID NO: 8029703 - DNA, 22 bp, Homo sapiens
tgagaactggtttctattcatg

SEQ ID NO: 8029704 - DNA, 22 bp, Homo sapiens
tgagaaccatgaaaagctgtca

SEQ ID NO: 8029705 - DNA, 22 bp, Homo sapiens
tgagaactgaggatttgaattc

SEQ ID NO: 8029706 - DNA, 22 bp, Homo sapiens
tgagaagatttgctcttctgag

SEQ ID NO: 8029707 - DNA, 22 bp, Homo sapiens
tgagaagattgggcagagtgga

SEQ ID NO: 8029708 - DNA, 22 bp, Homo sapiens
tgagaagagcaaggaactggtt

SEQ ID NO: 8029709 - DNA, 22 bp, Homo sapiens
tgagaagattgggcagagtgga

SEQ ID NO: 8029710 - DNA, 22 bp, Homo sapiens
tgagaagatttgctcttctgag

SEQ ID NO: 8029711 - DNA, 22 bp, Homo sapiens
tgagaagcacagctcactcacg

SEQ ID NO: 8029712 - DNA, 22 bp, Homo sapiens
tgagaagatttgctcttctgag

SEQ ID NO: 8029713 - DNA, 22 bp, Homo sapiens
tgagaagcagcttacaggtgtc

SEQ ID NO: 8029714 - DNA, 22 bp, Homo sapiens
tgagaagcacagctcactcacg

SEQ ID NO: 8029715 - DNA, 22 bp, Homo sapiens
tgagaagcagtttcagtaagaa

SEQ ID NO: 8029716 - DNA, 22 bp, Homo sapiens
tgagaagcccacactctttcct

SEQ ID NO: 8029717 - DNA, 23 bp, Homo sapiens
tgagaagccgccgggcagcctgg

SEQ ID NO: 8029718 - DNA, 22 bp, Homo sapiens
tgagaagcccacactctttcct

SEQ ID NO: 8029719 - DNA, 22 bp, Homo sapiens
tgagaagcagtttcagtaagaa

SEQ ID NO: 8029720 - DNA, 22 bp, Homo sapiens
tgagaagcagtttcagtaagaa

SEQ ID NO: 8029721 - DNA, 22 bp, Homo sapiens
tgagaagcagtttcagtaagaa

SEQ ID NO: 8029722 - DNA, 22 bp, Homo sapiens
tgagaagcattaggaagaacat

SEQ ID NO: 8029723 - DNA, 23 bp, Homo sapiens
tgagaagccattagagcaggtgg

SEQ ID NO: 8029724 - DNA, 23 bp, Homo sapiens
tgagaagccattagagcaggtgg

SEQ ID NO: 8029725 - DNA, 23 bp, Homo sapiens
tgagaagccaggggagcgtgagg

SEQ ID NO: 8029726 - DNA, 22 bp, Homo sapiens
tgagaattttttgtcatgcatt

SEQ ID NO: 8029727 - DNA, 22 bp, Homo sapiens
tgagaatttttggcagaaacaa

SEQ ID NO: 8029728 - DNA, 22 bp, Homo sapiens
tgagaatttttggcagaaacaa

SEQ ID NO: 8029729 - DNA, 22 bp, Homo sapiens
tgagaattttcagtttcacttt

SEQ ID NO: 8029730 - DNA, 22 bp, Homo sapiens
tgagaatttgcatttctaacaa

SEQ ID NO: 8029731 - DNA, 22 bp, Homo sapiens
tgagacaaaattgacagacaaa

SEQ ID NO: 8029732 - DNA, 22 bp, Homo sapiens
tgagaattttttgtcatgcatt

SEQ ID NO: 8029733 - DNA, 22 bp, Homo sapiens
tgagaattttttgtcatgcatt

SEQ ID NO: 8029734 - DNA, 22 bp, Homo sapiens
tgagacaaaattgacagacaaa

SEQ ID NO: 8029735 - DNA, 22 bp, Homo sapiens
tgagacaaaattgacagacaaa

SEQ ID NO: 8029736 - DNA, 22 bp, Homo sapiens
tgagaatttgcatttctaacaa

SEQ ID NO: 8029737 - DNA, 22 bp, Homo sapiens
tgagaatttgtgaacttttctc

SEQ ID NO: 8029738 - DNA, 22 bp, Homo sapiens
tgagaattttcagtttcacttt

SEQ ID NO: 8029739 - DNA, 22 bp, Homo sapiens
tgagaattctacaatagatcaa

SEQ ID NO: 8029740 - DNA, 20 bp, Homo sapiens
tgagaagctcctgtctcctc

SEQ ID NO: 8029741 - DNA, 20 bp, Homo sapiens
tgagaagctcctgtctcctc

SEQ ID NO: 8029742 - DNA, 22 bp, Homo sapiens
tgagaagctgctgacttagcct

SEQ ID NO: 8029743 - DNA, 22 bp, Homo sapiens
tgagaagctgctgacttagcct

SEQ ID NO: 8029744 - DNA, 22 bp, Homo sapiens
tgagaagctctgaaacagtatc

SEQ ID NO: 8029745 - DNA, 22 bp, Homo sapiens
tgagaagctctgaaacagtatc

SEQ ID NO: 8029746 - DNA, 18 bp, Homo sapiens
tgagaatgtaagaaatgg

SEQ ID NO: 8029747 - DNA, 22 bp, Homo sapiens
tgagaattacaaatgagtcaca

SEQ ID NO: 8029748 - DNA, 22 bp, Homo sapiens
tgagaatgtgcaatatccttcc

SEQ ID NO: 8029749 - DNA, 22 bp, Homo sapiens
tgagaagctgcttgtgctgtat

SEQ ID NO: 8029750 - DNA, 19 bp, Homo sapiens
tgagacagaagatgagcct

SEQ ID NO: 8029751 - DNA, 19 bp, Homo sapiens
tgagacagaagatgagcct

SEQ ID NO: 8029752 - DNA, 19 bp, Homo sapiens
tgagacagaagatgagcct

SEQ ID NO: 8029753 - DNA, 22 bp, Homo sapiens
tgagacagcagtcagggaaata

SEQ ID NO: 8029754 - DNA, 22 bp, Homo sapiens
tgagacagcagtcagggaaata

SEQ ID NO: 8029755 - DNA, 22 bp, Homo sapiens
tgagacagcagtcagggaaata

SEQ ID NO: 8029756 - DNA, 22 bp, Homo sapiens
tgagacagcagattagcaatga

SEQ ID NO: 8029757 - DNA, 22 bp, Homo sapiens
tgagacagcagattagcaatga

SEQ ID NO: 8029758 - DNA, 22 bp, Homo sapiens
tgagacagcagattagcaatga

SEQ ID NO: 8029759 - DNA, 23 bp, Homo sapiens
tgagacactcattcatggagtat

SEQ ID NO: 8029760 - DNA, 22 bp, Homo sapiens
tgagacaataaggctgagaagc

SEQ ID NO: 8029761 - DNA, 22 bp, Homo sapiens
tgagacaataaggctgagaagc

SEQ ID NO: 8029762 - DNA, 22 bp, Homo sapiens
tgagacaatatcctttgtaacc

SEQ ID NO: 8029763 - DNA, 22 bp, Homo sapiens
tgagacaataaggctgagaagc

SEQ ID NO: 8029764 - DNA, 22 bp, Homo sapiens
tgagacaacattgggcaagtcc

SEQ ID NO: 8029765 - DNA, 20 bp, Homo sapiens
tgagacaaggctggagagac

SEQ ID NO: 8029766 - DNA, 22 bp, Homo sapiens
tgagacaaggaaaggaagctga

SEQ ID NO: 8029767 - DNA, 22 bp, Homo sapiens
tgagacaacagcttgtgctgct

SEQ ID NO: 8029768 - DNA, 22 bp, Homo sapiens
tgagacaacagcttgtgctgct

SEQ ID NO: 8029769 - DNA, 22 bp, Homo sapiens
tgagacaaaattgacagacaaa

SEQ ID NO: 8029770 - DNA, 22 bp, Homo sapiens
tgagacaaagcagctgacagaa

SEQ ID NO: 8029771 - DNA, 22 bp, Homo sapiens
tgagacagcccttctgcacagg

SEQ ID NO: 8029772 - DNA, 22 bp, Homo sapiens
tgagacagcccttctgcacagg

SEQ ID NO: 8029773 - DNA, 22 bp, Homo sapiens
tgagacagcccttctgcacagg

SEQ ID NO: 8029774 - DNA, 22 bp, Homo sapiens
tgagacagcccttctgcacagg

SEQ ID NO: 8029775 - DNA, 22 bp, Homo sapiens
tgagacagcctctgcactcatg

SEQ ID NO: 8029776 - DNA, 22 bp, Homo sapiens
tgagacagcctctgcactcatg

SEQ ID NO: 8029777 - DNA, 22 bp, Homo sapiens
tgagacagcctctgcactcatg

SEQ ID NO: 8029778 - DNA, 22 bp, Homo sapiens
tgagacagcctctgcactcatg

SEQ ID NO: 8029779 - DNA, 22 bp, Homo sapiens
tgagacagcctctgcactcatg

SEQ ID NO: 8029780 - DNA, 22 bp, Homo sapiens
tgagacagcctctgcactcatg

SEQ ID NO: 8029781 - DNA, 22 bp, Homo sapiens
tgagacagcctctgcactcatg

SEQ ID NO: 8029782 - DNA, 22 bp, Homo sapiens
tgagacagcctctgcactcatg

SEQ ID NO: 8029783 - DNA, 22 bp, Homo sapiens
tgagacagcctctgcactcatg

SEQ ID NO: 8029784 - DNA, 22 bp, Homo sapiens
tgagacaggcttccttcttggg

SEQ ID NO: 8029785 - DNA, 19 bp, Homo sapiens
tgagacagggattcaggtg

SEQ ID NO: 8029786 - DNA, 22 bp, Homo sapiens
tgagacaggcttccttcttggg

SEQ ID NO: 8029787 - DNA, 22 bp, Homo sapiens
tgagacaggcttccttcttggg

SEQ ID NO: 8029788 - DNA, 22 bp, Homo sapiens
tgagacaggagaggcccctcct

SEQ ID NO: 8029789 - DNA, 22 bp, Homo sapiens
tgagacaggagaggcccctcct

SEQ ID NO: 8029790 - DNA, 22 bp, Homo sapiens
tgagacaggagaggcccctcct

SEQ ID NO: 8029791 - DNA, 18 bp, Homo sapiens
tgagacagctaccacttg

SEQ ID NO: 8029792 - DNA, 18 bp, Homo sapiens
tgagacagctaccacttg

SEQ ID NO: 8029793 - DNA, 22 bp, Homo sapiens
tgagacagtcaccaggcaggcc

SEQ ID NO: 8029794 - DNA, 22 bp, Homo sapiens
tgagacagtcaccaggcaggcc

SEQ ID NO: 8029795 - DNA, 22 bp, Homo sapiens
tgagacagtatcgccccaaggc

SEQ ID NO: 8029796 - DNA, 22 bp, Homo sapiens
tgagacagtatcgccccaaggc

SEQ ID NO: 8029797 - DNA, 22 bp, Homo sapiens
tgagacagtcccatgatctgca

SEQ ID NO: 8029798 - DNA, 22 bp, Homo sapiens
tgagacagtcccatgatctgca

SEQ ID NO: 8029799 - DNA, 22 bp, Homo sapiens
tgagacagttctgcagctgggt

SEQ ID NO: 8029800 - DNA, 22 bp, Homo sapiens
tgagacagtcccatgatctgca

SEQ ID NO: 8029801 - DNA, 22 bp, Homo sapiens
tgagacagtcccatgatctgca

SEQ ID NO: 8029802 - DNA, 17 bp, Homo sapiens
tgagacagggcaggccc

SEQ ID NO: 8029803 - DNA, 17 bp, Homo sapiens
tgagacagggcaggccc

SEQ ID NO: 8029804 - DNA, 17 bp, Homo sapiens
tgagacagggcaggccc

SEQ ID NO: 8029805 - DNA, 17 bp, Homo sapiens
tgagacagggcaggccc

SEQ ID NO: 8029806 - DNA, 17 bp, Homo sapiens
tgagacagggcaggccc

SEQ ID NO: 8029807 - DNA, 22 bp, Homo sapiens
tgagacagggtcttgctctgtt

SEQ ID NO: 8029808 - DNA, 22 bp, Homo sapiens
tgagacagggtcttgctctgtt

SEQ ID NO: 8029809 - DNA, 22 bp, Homo sapiens
tgagacagggtcttgctctgtt

SEQ ID NO: 8029810 - DNA, 22 bp, Homo sapiens
tgagacagtaattgtatagttt

SEQ ID NO: 8029811 - DNA, 22 bp, Homo sapiens
tgagacagggtcttgctctgtt

SEQ ID NO: 8029812 - DNA, 22 bp, Homo sapiens
tgagacagggtcttgctctgtt

SEQ ID NO: 8029813 - DNA, 22 bp, Homo sapiens
tgagacagggtcttgctctgtt

SEQ ID NO: 8029814 - DNA, 22 bp, Homo sapiens
tgagacagggtcttgctctgtt

SEQ ID NO: 8029815 - DNA, 22 bp, Homo sapiens
tgagacagggtcttgctctgtt

SEQ ID NO: 8029816 - DNA, 22 bp, Homo sapiens
tgagatgtaaggtatgcttact

SEQ ID NO: 8029817 - DNA, 22 bp, Homo sapiens
tgagatggttgaccagagagca

SEQ ID NO: 8029818 - DNA, 22 bp, Homo sapiens
tgagatggttcacagagaaggc

SEQ ID NO: 8029819 - DNA, 22 bp, Homo sapiens
tgagatggttcacagagaaggc

SEQ ID NO: 8029820 - DNA, 22 bp, Homo sapiens
tgagatggttgaccagagagca

SEQ ID NO: 8029821 - DNA, 22 bp, Homo sapiens
tgagatggttcacagagaaggc

SEQ ID NO: 8029822 - DNA, 22 bp, Homo sapiens
tgagatggttcacagagaaggc

SEQ ID NO: 8029823 - DNA, 22 bp, Homo sapiens
tgagatggtgaagaagacagca

SEQ ID NO: 8029824 - DNA, 22 bp, Homo sapiens
tgagatggttcacagagaaggc

SEQ ID NO: 8029825 - DNA, 22 bp, Homo sapiens
tgagatggttcacagagaaggc

SEQ ID NO: 8029826 - DNA, 22 bp, Homo sapiens
tgagatggttcacagagaaggc

SEQ ID NO: 8029827 - DNA, 22 bp, Homo sapiens
tgagatgggtgtccagggagga

SEQ ID NO: 8029828 - DNA, 22 bp, Homo sapiens
tgagatgggtgtccagggagga

SEQ ID NO: 8029829 - DNA, 22 bp, Homo sapiens
tgagatggtgaagaagacagca

SEQ ID NO: 8029830 - DNA, 22 bp, Homo sapiens
tgagatgggtgggtagccaagg

SEQ ID NO: 8029831 - DNA, 22 bp, Homo sapiens
tgagatgggtgtccagggagga

SEQ ID NO: 8029832 - DNA, 22 bp, Homo sapiens
tgagatgggtggggagctcagg

SEQ ID NO: 8029833 - DNA, 22 bp, Homo sapiens
tgagatgggtcatcaggtttgg

SEQ ID NO: 8029834 - DNA, 22 bp, Homo sapiens
tgagatgggtggggagctcagg

SEQ ID NO: 8029835 - DNA, 22 bp, Homo sapiens
tgagatgggtcatcaggtttgg

SEQ ID NO: 8029836 - DNA, 22 bp, Homo sapiens
tgagatggggtcatgctttgtc

SEQ ID NO: 8029837 - DNA, 22 bp, Homo sapiens
tgagatggggtcatgctttgtc

SEQ ID NO: 8029838 - DNA, 22 bp, Homo sapiens
tgagatggggagggctgcagaa

SEQ ID NO: 8029839 - DNA, 22 bp, Homo sapiens
tgagatggctgggccccaggag

SEQ ID NO: 8029840 - DNA, 22 bp, Homo sapiens
tgagatggcaacaccagctttg

SEQ ID NO: 8029841 - DNA, 22 bp, Homo sapiens
tgagatggcaacaccagctttg

SEQ ID NO: 8029842 - DNA, 22 bp, Homo sapiens
tgagatggctgggccccaggag

SEQ ID NO: 8029843 - DNA, 22 bp, Homo sapiens
tgagatgggatgtgcacttggc

SEQ ID NO: 8029844 - DNA, 22 bp, Homo sapiens
tgagatgggatgtgcacttggc

SEQ ID NO: 8029845 - DNA, 22 bp, Homo sapiens
tgagatggggagggctgcagaa

SEQ ID NO: 8029846 - DNA, 22 bp, Homo sapiens
tgagatggggagggctgcagaa

SEQ ID NO: 8029847 - DNA, 22 bp, Homo sapiens
tgagatggggagggctgcagaa

SEQ ID NO: 8029848 - DNA, 22 bp, Homo sapiens
tgagatggcaacaccagctttg

SEQ ID NO: 8029849 - DNA, 22 bp, Homo sapiens
tgagatggagttttggggatat

SEQ ID NO: 8029850 - DNA, 22 bp, Homo sapiens
tgagatggattgggttggttcc

SEQ ID NO: 8029851 - DNA, 22 bp, Homo sapiens
tgagatgtaaggtatgcttact

SEQ ID NO: 8029852 - DNA, 22 bp, Homo sapiens
tgagattcagttgattagtgat

SEQ ID NO: 8029853 - DNA, 22 bp, Homo sapiens
tgagattcagggatgcagagca

SEQ ID NO: 8029854 - DNA, 22 bp, Homo sapiens
tgagattcagttgattagtgat

SEQ ID NO: 8029855 - DNA, 22 bp, Homo sapiens
tgagattcccattaattttata

SEQ ID NO: 8029856 - DNA, 22 bp, Homo sapiens
tgagattctgcatttctaataa

SEQ ID NO: 8029857 - DNA, 22 bp, Homo sapiens
tgagattccctgaatgatatat

SEQ ID NO: 8029858 - DNA, 22 bp, Homo sapiens
tgagatttcaggccaaggagtg

SEQ ID NO: 8029859 - DNA, 22 bp, Homo sapiens
tgagattctgttcagaaaaatg

SEQ ID NO: 8029860 - DNA, 19 bp, Homo sapiens
tgagatttcttaggtgatt

SEQ ID NO: 8029861 - DNA, 22 bp, Homo sapiens
tgagatttgagggttaatctga

SEQ ID NO: 8029862 - DNA, 20 bp, Homo sapiens
tgagatttgtattataagtc

SEQ ID NO: 8029863 - DNA, 22 bp, Homo sapiens
tgagatttgttttataaaatag

SEQ ID NO: 8029864 - DNA, 21 bp, Homo sapiens
tgagcaaaatttagagtgatg

SEQ ID NO: 8029865 - DNA, 22 bp, Homo sapiens
tgagattttcctaaatataatg

SEQ ID NO: 8029866 - DNA, 22 bp, Homo sapiens
tgagcaaagggatgaatcactg

SEQ ID NO: 8029867 - DNA, 22 bp, Homo sapiens
tgagattttcctaaatataatg

SEQ ID NO: 8029868 - DNA, 19 bp, Homo sapiens
tgagatgccttccagccct

SEQ ID NO: 8029869 - DNA, 22 bp, Homo sapiens
tgagatgctaaagggctgctca

SEQ ID NO: 8029870 - DNA, 22 bp, Homo sapiens
tgagatgatgggataagagggc

SEQ ID NO: 8029871 - DNA, 22 bp, Homo sapiens
tgagatgctgctgtaacaaata

SEQ ID NO: 8029872 - DNA, 22 bp, Homo sapiens
tgagatgctgctgtaacaaata

SEQ ID NO: 8029873 - DNA, 22 bp, Homo sapiens
tgagatgctgctgtaacaaata

SEQ ID NO: 8029874 - DNA, 21 bp, Homo sapiens
tgagatgctagaaggcaggga

SEQ ID NO: 8029875 - DNA, 22 bp, Homo sapiens
tgagatgaataactcctgctaa

SEQ ID NO: 8029876 - DNA, 22 bp, Homo sapiens
tgagatgaataactcctgctaa

SEQ ID NO: 8029877 - DNA, 22 bp, Homo sapiens
tgagatgaataactcctgctaa

SEQ ID NO: 8029878 - DNA, 22 bp, Homo sapiens
tgagatgaataactcctgctaa

SEQ ID NO: 8029879 - DNA, 22 bp, Homo sapiens
tgagatgaataactcctgctaa

SEQ ID NO: 8029880 - DNA, 22 bp, Homo sapiens
tgagatggagtcttgctctgtt

SEQ ID NO: 8029881 - DNA, 22 bp, Homo sapiens
tgagatggagtctcgctctgtt

SEQ ID NO: 8029882 - DNA, 22 bp, Homo sapiens
tgagatggagtctcgctctgtt

SEQ ID NO: 8029883 - DNA, 22 bp, Homo sapiens
tgagatggagtctcactctgtt

SEQ ID NO: 8029884 - DNA, 22 bp, Homo sapiens
tgagatggagtctcactctgtt

SEQ ID NO: 8029885 - DNA, 22 bp, Homo sapiens
tgagatggagttctgctcttgt

SEQ ID NO: 8029886 - DNA, 22 bp, Homo sapiens
tgagatggagttctgctcttgt

SEQ ID NO: 8029887 - DNA, 22 bp, Homo sapiens
tgagatggagttctgctcttgt

SEQ ID NO: 8029888 - DNA, 22 bp, Homo sapiens
tgagatggagttctgctcttgt

SEQ ID NO: 8029889 - DNA, 22 bp, Homo sapiens
tgagatggagtcttgctctgtt

SEQ ID NO: 8029890 - DNA, 22 bp, Homo sapiens
tgagatggagccactgcactct

SEQ ID NO: 8029891 - DNA, 22 bp, Homo sapiens
tgagatggagccactgcactct

SEQ ID NO: 8029892 - DNA, 22 bp, Homo sapiens
tgagatggagccactgcactct

SEQ ID NO: 8029893 - DNA, 22 bp, Homo sapiens
tgagatggaaggtgaggcagta

SEQ ID NO: 8029894 - DNA, 22 bp, Homo sapiens
tgagatggaaggtgaggcagta

SEQ ID NO: 8029895 - DNA, 22 bp, Homo sapiens
tgagatggaaggtgaggcagta

SEQ ID NO: 8029896 - DNA, 22 bp, Homo sapiens
tgagatgctgggaacaaggaag

SEQ ID NO: 8029897 - DNA, 22 bp, Homo sapiens
tgagatgctgctgtaacaaata

SEQ ID NO: 8029898 - DNA, 17 bp, Homo sapiens
tgagatggaagaagact

SEQ ID NO: 8029899 - DNA, 22 bp, Homo sapiens
tgagatgctgggaacaaggaag

SEQ ID NO: 8029900 - DNA, 17 bp, Homo sapiens
tgagatggaagaagact

SEQ ID NO: 8029901 - DNA, 22 bp, Homo sapiens
tgagatgctgggaacaaggaag

SEQ ID NO: 8029902 - DNA, 22 bp, Homo sapiens
tgagatggaaggtgaggcagta

SEQ ID NO: 8029903 - DNA, 22 bp, Homo sapiens
tgagatcattgacttgttcctg

SEQ ID NO: 8029904 - DNA, 22 bp, Homo sapiens
tgagatcattgacttgttcctg

SEQ ID NO: 8029905 - DNA, 22 bp, Homo sapiens
tgagatcattgacttgttcctg

SEQ ID NO: 8029906 - DNA, 22 bp, Homo sapiens
tgagatcaaaattggtattaga

SEQ ID NO: 8029907 - DNA, 22 bp, Homo sapiens
tgagatcacttacgtggctgca

SEQ ID NO: 8029908 - DNA, 22 bp, Homo sapiens
tgagatagtatatggaaagagt

SEQ ID NO: 8029909 - DNA, 23 bp, Homo sapiens
tgagataggtattattatcatgc

SEQ ID NO: 8029910 - DNA, 23 bp, Homo sapiens
tgagataggtattattatcatgc

SEQ ID NO: 8029911 - DNA, 22 bp, Homo sapiens
tgagaggtcaaagggcatggag

SEQ ID NO: 8029912 - DNA, 22 bp, Homo sapiens
tgagataatacttcttagctgg

SEQ ID NO: 8029913 - DNA, 22 bp, Homo sapiens
tgagataatacttcttagctgg

SEQ ID NO: 8029914 - DNA, 22 bp, Homo sapiens
tgagataatcatgtgatttcat

SEQ ID NO: 8029915 - DNA, 22 bp, Homo sapiens
tgagatactgaaaatagctaac

SEQ ID NO: 8029916 - DNA, 22 bp, Homo sapiens
tgagatccccaggaaggacaac

SEQ ID NO: 8029917 - DNA, 23 bp, Homo sapiens
tgagatcgcccagctggtaggca

SEQ ID NO: 8029918 - DNA, 23 bp, Homo sapiens
tgagatctacagatctcagatct

SEQ ID NO: 8029919 - DNA, 22 bp, Homo sapiens
tgagatcattgacttgttcctg

SEQ ID NO: 8029920 - DNA, 22 bp, Homo sapiens
tgagatcattgacttgttcctg

SEQ ID NO: 8029921 - DNA, 22 bp, Homo sapiens
tgagatcatttatttacctttc

SEQ ID NO: 8029922 - DNA, 22 bp, Homo sapiens
tgagatcatttatttacctttc

SEQ ID NO: 8029923 - DNA, 22 bp, Homo sapiens
tgagatctgctaattgactgac

SEQ ID NO: 8029924 - DNA, 22 bp, Homo sapiens
tgagaggctagatcagctctgt

SEQ ID NO: 8029925 - DNA, 18 bp, Homo sapiens
tgagaggctattttttgc

SEQ ID NO: 8029926 - DNA, 18 bp, Homo sapiens
tgagaggctattttttgc

SEQ ID NO: 8029927 - DNA, 18 bp, Homo sapiens
tgagaggctattttttgc

SEQ ID NO: 8029928 - DNA, 22 bp, Homo sapiens
tgagaggctagatcagctctgt

SEQ ID NO: 8029929 - DNA, 22 bp, Homo sapiens
tgagaggctagatcagctctgt

SEQ ID NO: 8029930 - DNA, 22 bp, Homo sapiens
tgagaggctagatcagctctgt

SEQ ID NO: 8029931 - DNA, 22 bp, Homo sapiens
tgagaggctagatcagctctgt

SEQ ID NO: 8029932 - DNA, 18 bp, Homo sapiens
tgagaggctattttttgc

SEQ ID NO: 8029933 - DNA, 22 bp, Homo sapiens
tgagaggcgctcactctcaggt

SEQ ID NO: 8029934 - DNA, 22 bp, Homo sapiens
tgagaggctagatcagctctgt

SEQ ID NO: 8029935 - DNA, 22 bp, Homo sapiens
tgagaggcgctcactctcaggt

SEQ ID NO: 8029936 - DNA, 22 bp, Homo sapiens
tgagaggcgctcactctcaggt

SEQ ID NO: 8029937 - DNA, 18 bp, Homo sapiens
tgagaggcaggtagagga

SEQ ID NO: 8029938 - DNA, 22 bp, Homo sapiens
tgagaggccccagctcttggcc

SEQ ID NO: 8029939 - DNA, 18 bp, Homo sapiens
tgagaggctattttttgc

SEQ ID NO: 8029940 - DNA, 19 bp, Homo sapiens
tgagaggcttaaggcagct

SEQ ID NO: 8029941 - DNA, 19 bp, Homo sapiens
tgagaggcttaaggcagct

SEQ ID NO: 8029942 - DNA, 19 bp, Homo sapiens
tgagaggcttaaggcagct

SEQ ID NO: 8029943 - DNA, 22 bp, Homo sapiens
tgagagggcccagagcacacca

SEQ ID NO: 8029944 - DNA, 22 bp, Homo sapiens
tgagaggtaggaaatgaacaag

SEQ ID NO: 8029945 - DNA, 22 bp, Homo sapiens
tgagagggcccagagcacacca

SEQ ID NO: 8029946 - DNA, 22 bp, Homo sapiens
tgagagggttcccaggggtttc

SEQ ID NO: 8029947 - DNA, 22 bp, Homo sapiens
tgagaggaacaggcagtaggtt

SEQ ID NO: 8029948 - DNA, 22 bp, Homo sapiens
tgagaggaacaggcagtaggtt

SEQ ID NO: 8029949 - DNA, 22 bp, Homo sapiens
tgagaggaacaggcagtaggtt

SEQ ID NO: 8029950 - DNA, 22 bp, Homo sapiens
tgagaggaacaggcagtaggtt

SEQ ID NO: 8029951 - DNA, 22 bp, Homo sapiens
tgagagcttgagtatcactggc

SEQ ID NO: 8029952 - DNA, 22 bp, Homo sapiens
tgagagctgtccacctgtggga

SEQ ID NO: 8029953 - DNA, 22 bp, Homo sapiens
tgagagcttgagtatcactggc

SEQ ID NO: 8029954 - DNA, 22 bp, Homo sapiens
tgagagctgtccacctgtggga

SEQ ID NO: 8029955 - DNA, 20 bp, Homo sapiens
tgagagctgggcagggatac

SEQ ID NO: 8029956 - DNA, 20 bp, Homo sapiens
tgagagctgggcagggatac

SEQ ID NO: 8029957 - DNA, 22 bp, Homo sapiens
tgagagctgaagatatgttaac

SEQ ID NO: 8029958 - DNA, 22 bp, Homo sapiens
tgagagctgacagtaagctgca

SEQ ID NO: 8029959 - DNA, 22 bp, Homo sapiens
tgagagctgccacgtgaccatg

SEQ ID NO: 8029960 - DNA, 22 bp, Homo sapiens
tgagagctgctgagactgtcct

SEQ ID NO: 8029961 - DNA, 22 bp, Homo sapiens
tgagagctgctgagactgtcct

SEQ ID NO: 8029962 - DNA, 22 bp, Homo sapiens
tgagagctgccacgtgaccatg

SEQ ID NO: 8029963 - DNA, 22 bp, Homo sapiens
tgagagctgccacgtgaccatg

SEQ ID NO: 8029964 - DNA, 22 bp, Homo sapiens
tgagagctgctgagactgtcct

SEQ ID NO: 8029965 - DNA, 22 bp, Homo sapiens
tgagaggagtgattgtaaaatt

SEQ ID NO: 8029966 - DNA, 20 bp, Homo sapiens
tgagaggacatttttcatgt

SEQ ID NO: 8029967 - DNA, 20 bp, Homo sapiens
tgagaggacatttttcatgt

SEQ ID NO: 8029968 - DNA, 22 bp, Homo sapiens
tgagaggatattttgggaggat

SEQ ID NO: 8029969 - DNA, 22 bp, Homo sapiens
tgagaggatattttgggaggat

SEQ ID NO: 8029970 - DNA, 22 bp, Homo sapiens
tgagaggcagaatggtgcctgc

SEQ ID NO: 8029971 - DNA, 22 bp, Homo sapiens
tgagaggcagaatggtgcctgc

SEQ ID NO: 8029972 - DNA, 22 bp, Homo sapiens
tgagaggcagaatggtgcctgc

SEQ ID NO: 8029973 - DNA, 22 bp, Homo sapiens
tgagagagcgcctgggatcatt

SEQ ID NO: 8029974 - DNA, 22 bp, Homo sapiens
tgagagaggatgccctcatatt

SEQ ID NO: 8029975 - DNA, 22 bp, Homo sapiens
tgagagaggatgccctcatatt

SEQ ID NO: 8029976 - DNA, 22 bp, Homo sapiens
tgagagagggatgcaccctcct

SEQ ID NO: 8029977 - DNA, 22 bp, Homo sapiens
tgagagaggggactgcctgctt

SEQ ID NO: 8029978 - DNA, 21 bp, Homo sapiens
tgagagagtagcaggacatat

SEQ ID NO: 8029979 - DNA, 22 bp, Homo sapiens
tgagagagtaattgagtggtaa

SEQ ID NO: 8029980 - DNA, 22 bp, Homo sapiens
tgagagagtaattgagtggtaa

SEQ ID NO: 8029981 - DNA, 22 bp, Homo sapiens
tgagagagtaattgagtggtaa

SEQ ID NO: 8029982 - DNA, 22 bp, Homo sapiens
tgagagagtaattgagtggtaa

SEQ ID NO: 8029983 - DNA, 22 bp, Homo sapiens
tgagagagtaattgagtggtaa

SEQ ID NO: 8029984 - DNA, 21 bp, Homo sapiens
tgagagactggtggatacagg

SEQ ID NO: 8029985 - DNA, 22 bp, Homo sapiens
tgagagagcctgaatctcttac

SEQ ID NO: 8029986 - DNA, 22 bp, Homo sapiens
tgagagagcctgaatctcttac

SEQ ID NO: 8029987 - DNA, 22 bp, Homo sapiens
tgagagagcgcctgggatcatt

SEQ ID NO: 8029988 - DNA, 22 bp, Homo sapiens
tgagagaaacgttccttacatc

SEQ ID NO: 8029989 - DNA, 22 bp, Homo sapiens
tgagacttgtgagtccttctag

SEQ ID NO: 8029990 - DNA, 22 bp, Homo sapiens
tgagacagttctgcagctgggt

SEQ ID NO: 8029991 - DNA, 22 bp, Homo sapiens
tgagacagttctgcagctgggt

SEQ ID NO: 8029992 - DNA, 22 bp, Homo sapiens
tgagagacacactgtgcatgta

SEQ ID NO: 8029993 - DNA, 22 bp, Homo sapiens
tgagagacacactgtgcatgta

SEQ ID NO: 8029994 - DNA, 18 bp, Homo sapiens
tgagagaatgttcatgct

SEQ ID NO: 8029995 - DNA, 18 bp, Homo sapiens
tgagagcattcgaggcaa

SEQ ID NO: 8029996 - DNA, 17 bp, Homo sapiens
tgagagcagggctgggc

SEQ ID NO: 8029997 - DNA, 22 bp, Homo sapiens
tgagagcagaggtgggcagcct

SEQ ID NO: 8029998 - DNA, 17 bp, Homo sapiens
tgagagcagggctgggc

SEQ ID NO: 8029999 - DNA, 22 bp, Homo sapiens
tgagagcacagtgtggtctgga

SEQ ID NO: 8030000 - DNA, 22 bp, Homo sapiens
tgagagcagaggtgggcagcct

SEQ ID NO: 8030001 - DNA, 18 bp, Homo sapiens
tgagagcctgcttgtccc

SEQ ID NO: 8030002 - DNA, 23 bp, Homo sapiens
tgagagcctggcagcctgggttc

SEQ ID NO: 8030003 - DNA, 22 bp, Homo sapiens
tgagagccaggatctgctctat

SEQ ID NO: 8030004 - DNA, 22 bp, Homo sapiens
tgagagcctagtaggtggaaaa

SEQ ID NO: 8030005 - DNA, 21 bp, Homo sapiens
tgagagcctccaaccggctac

SEQ ID NO: 8030006 - DNA, 22 bp, Homo sapiens
tgagagatgaagttagttgttc

SEQ ID NO: 8030007 - DNA, 22 bp, Homo sapiens
tgagagattgctgtatgttttg

SEQ ID NO: 8030008 - DNA, 22 bp, Homo sapiens
tgagagatgaagttagttgttc

SEQ ID NO: 8030009 - DNA, 22 bp, Homo sapiens
tgagagattttcatgagtgctt

SEQ ID NO: 8030010 - DNA, 21 bp, Homo sapiens
tgagagagtagcaggacatat

SEQ ID NO: 8030011 - DNA, 21 bp, Homo sapiens
tgagagagtagcaggacatat

SEQ ID NO: 8030012 - DNA, 21 bp, Homo sapiens
tgagagagtagcaggacatat

SEQ ID NO: 8030013 - DNA, 21 bp, Homo sapiens
tgagagagtagcaggacatat

SEQ ID NO: 8030014 - DNA, 21 bp, Homo sapiens
tgagagagtagcaggacatat

SEQ ID NO: 8030015 - DNA, 21 bp, Homo sapiens
tgagagagtagcaggacatat

SEQ ID NO: 8030016 - DNA, 21 bp, Homo sapiens
tgagagagtagcaggacatat

SEQ ID NO: 8030017 - DNA, 22 bp, Homo sapiens
tgccacaggcaatccctgcacg

SEQ ID NO: 8030018 - DNA, 22 bp, Homo sapiens
tgccacaggcaatccctgcacg

SEQ ID NO: 8030019 - DNA, 22 bp, Homo sapiens
tgccaagagggcagagggcagt

SEQ ID NO: 8030020 - DNA, 17 bp, Homo sapiens
tgccaagaagagcagag

SEQ ID NO: 8030021 - DNA, 17 bp, Homo sapiens
tgccaagaagagcagag

SEQ ID NO: 8030022 - DNA, 22 bp, Homo sapiens
tgccacagggtcctcaggccag

SEQ ID NO: 8030023 - DNA, 22 bp, Homo sapiens
tgccacaggcaatccctgcacg

SEQ ID NO: 8030024 - DNA, 22 bp, Homo sapiens
tgccacagttgtttgtgctcta

SEQ ID NO: 8030025 - DNA, 22 bp, Homo sapiens
tgccacagttgtttgtgctcta

SEQ ID NO: 8030026 - DNA, 22 bp, Homo sapiens
tgccacagttgtttgtgctcta

SEQ ID NO: 8030027 - DNA, 22 bp, Homo sapiens
tgccacagttgtttgtgctcta

SEQ ID NO: 8030028 - DNA, 22 bp, Homo sapiens
tgccacagtttcatggattctg

SEQ ID NO: 8030029 - DNA, 22 bp, Homo sapiens
tgccacagtttcatggattctg

SEQ ID NO: 8030030 - DNA, 22 bp, Homo sapiens
tgccacatggtgcatttcctag

SEQ ID NO: 8030031 - DNA, 22 bp, Homo sapiens
tgccaccaggagaaccagtgca

SEQ ID NO: 8030032 - DNA, 22 bp, Homo sapiens
tgccaccatctggctgtgttga

SEQ ID NO: 8030033 - DNA, 22 bp, Homo sapiens
tgccaccaggagaaccagtgca

SEQ ID NO: 8030034 - DNA, 22 bp, Homo sapiens
tgccaccaggagaaccagtgca

SEQ ID NO: 8030035 - DNA, 22 bp, Homo sapiens
tgccaccatctggctgtgttga

SEQ ID NO: 8030036 - DNA, 22 bp, Homo sapiens
tgccagaaccattcaatgtgaa

SEQ ID NO: 8030037 - DNA, 22 bp, Homo sapiens
tgccagaagtgctttataagtg

SEQ ID NO: 8030038 - DNA, 22 bp, Homo sapiens
tgccagagaagacccagtcact

SEQ ID NO: 8030039 - DNA, 22 bp, Homo sapiens
tgccactggggctaggactgtt

SEQ ID NO: 8030040 - DNA, 22 bp, Homo sapiens
tgccagaacagctcatctggcc

SEQ ID NO: 8030041 - DNA, 22 bp, Homo sapiens
tgccactggggctaggactgtt

SEQ ID NO: 8030042 - DNA, 22 bp, Homo sapiens
tgccactggacccagaactctt

SEQ ID NO: 8030043 - DNA, 22 bp, Homo sapiens
tgccactggctcaatggtgcag

SEQ ID NO: 8030044 - DNA, 23 bp, Homo sapiens
tgccacccttctcttcccagctt

SEQ ID NO: 8030045 - DNA, 23 bp, Homo sapiens
tgccacccttctcttcccagctt

SEQ ID NO: 8030046 - DNA, 22 bp, Homo sapiens
tgccacctgtacatgctatctg

SEQ ID NO: 8030047 - DNA, 22 bp, Homo sapiens
tgccacctagtggtctttagtc

SEQ ID NO: 8030048 - DNA, 22 bp, Homo sapiens
tgccaccccggcccagagagca

SEQ ID NO: 8030049 - DNA, 22 bp, Homo sapiens
tgccaccccggcccagagagca

SEQ ID NO: 8030050 - DNA, 22 bp, Homo sapiens
tgccaccctctctgctacccgc

SEQ ID NO: 8030051 - DNA, 22 bp, Homo sapiens
tgccaccctgagctaaatgacc

SEQ ID NO: 8030052 - DNA, 22 bp, Homo sapiens
tgccaccctggcggcagcctgc

SEQ ID NO: 8030053 - DNA, 22 bp, Homo sapiens
tgccaccctggcggcagcctgc

SEQ ID NO: 8030054 - DNA, 22 bp, Homo sapiens
tgccaccctggcggcagcctgc

SEQ ID NO: 8030055 - DNA, 22 bp, Homo sapiens
tgccagccagggaagctcaccc

SEQ ID NO: 8030056 - DNA, 22 bp, Homo sapiens
tgccagccagggaagctcaccc

SEQ ID NO: 8030057 - DNA, 22 bp, Homo sapiens
tgccagccagggaagctcaccc

SEQ ID NO: 8030058 - DNA, 22 bp, Homo sapiens
tgccagccaggttctgaggcta

SEQ ID NO: 8030059 - DNA, 22 bp, Homo sapiens
tgccagccaggttctgaggcta

SEQ ID NO: 8030060 - DNA, 19 bp, Homo sapiens
tgccagcattaggctgaag

SEQ ID NO: 8030061 - DNA, 22 bp, Homo sapiens
tgccagccagggaagctcaccc

SEQ ID NO: 8030062 - DNA, 22 bp, Homo sapiens
tgccagccagggaagctcaccc

SEQ ID NO: 8030063 - DNA, 22 bp, Homo sapiens
tgccagcccaccttggggcctc

SEQ ID NO: 8030064 - DNA, 22 bp, Homo sapiens
tgccagcccaccttggggcctc

SEQ ID NO: 8030065 - DNA, 22 bp, Homo sapiens
tgccagcccaccttggggcctc

SEQ ID NO: 8030066 - DNA, 22 bp, Homo sapiens
tgccagccaggttctgaggcta

SEQ ID NO: 8030067 - DNA, 22 bp, Homo sapiens
tgccagccaggttctgaggcta

SEQ ID NO: 8030068 - DNA, 23 bp, Homo sapiens
tgccagcagggaatgggaaggac

SEQ ID NO: 8030069 - DNA, 23 bp, Homo sapiens
tgccagcagggaatgggaaggac

SEQ ID NO: 8030070 - DNA, 22 bp, Homo sapiens
tgccagcagaaataaatacttg

SEQ ID NO: 8030071 - DNA, 22 bp, Homo sapiens
tgccagcagtagcagtaggcca

SEQ ID NO: 8030072 - DNA, 22 bp, Homo sapiens
tgccagcagtagcagtaggcca

SEQ ID NO: 8030073 - DNA, 22 bp, Homo sapiens
tgccagcagtagcagtaggcca

SEQ ID NO: 8030074 - DNA, 22 bp, Homo sapiens
tgccagcagtagcagtaggcca

SEQ ID NO: 8030075 - DNA, 19 bp, Homo sapiens
tgccagcattaggctgaag

SEQ ID NO: 8030076 - DNA, 19 bp, Homo sapiens
tgccagcattaggctgaag

SEQ ID NO: 8030077 - DNA, 19 bp, Homo sapiens
tgccagcattaggctgaag

SEQ ID NO: 8030078 - DNA, 21 bp, Homo sapiens
tgccagcatgtaggctagttg

SEQ ID NO: 8030079 - DNA, 21 bp, Homo sapiens
tgccagcatgtaggctagttg

SEQ ID NO: 8030080 - DNA, 22 bp, Homo sapiens
tgccagcacttctggctgtctg

SEQ ID NO: 8030081 - DNA, 22 bp, Homo sapiens
tgccagcacttctggctgtctg

SEQ ID NO: 8030082 - DNA, 22 bp, Homo sapiens
tgccagcacaagttaagagatc

SEQ ID NO: 8030083 - DNA, 22 bp, Homo sapiens
tgccagcaccttcctgctccct

SEQ ID NO: 8030084 - DNA, 22 bp, Homo sapiens
tgccagcaccttcctgctccct

SEQ ID NO: 8030085 - DNA, 22 bp, Homo sapiens
tgccagcacaagttaagagatc

SEQ ID NO: 8030086 - DNA, 22 bp, Homo sapiens
tgccagcaagaatagacagtaa

SEQ ID NO: 8030087 - DNA, 22 bp, Homo sapiens
tgccagcaagaatagacagtaa

SEQ ID NO: 8030088 - DNA, 22 bp, Homo sapiens
tgccagatgcaggaggtaaggc

SEQ ID NO: 8030089 - DNA, 22 bp, Homo sapiens
tgccagagttacatgagggtca

SEQ ID NO: 8030090 - DNA, 22 bp, Homo sapiens
tgccagagttacatgagggtca

SEQ ID NO: 8030091 - DNA, 23 bp, Homo sapiens
tgccagaggcagtcacagtggtg

SEQ ID NO: 8030092 - DNA, 23 bp, Homo sapiens
tgccagaggcagtcacagtggtg

SEQ ID NO: 8030093 - DNA, 23 bp, Homo sapiens
tgccagaggcagtcacagtggtg

SEQ ID NO: 8030094 - DNA, 23 bp, Homo sapiens
tgccagaggcagtcacagtggtg

SEQ ID NO: 8030095 - DNA, 22 bp, Homo sapiens
tgccagagatttcacactgcta

SEQ ID NO: 8030096 - DNA, 19 bp, Homo sapiens
tgccagagatactcccaga

SEQ ID NO: 8030097 - DNA, 22 bp, Homo sapiens
tgccagagcaaaatgcccttaa

SEQ ID NO: 8030098 - DNA, 22 bp, Homo sapiens
tgccagagcaaaatgcccttaa

SEQ ID NO: 8030099 - DNA, 22 bp, Homo sapiens
tgccagagatttcacactgcta

SEQ ID NO: 8030100 - DNA, 22 bp, Homo sapiens
tgccagagatttcacactgcta

SEQ ID NO: 8030101 - DNA, 22 bp, Homo sapiens
tgccagagagtggctgggtgtc

SEQ ID NO: 8030102 - DNA, 22 bp, Homo sapiens
tgccagagagtggctgggtgtc

SEQ ID NO: 8030103 - DNA, 22 bp, Homo sapiens
tgccagagagtggctgggtgtc

SEQ ID NO: 8030104 - DNA, 22 bp, Homo sapiens
tgccagagaggagaaagcattt

SEQ ID NO: 8030105 - DNA, 22 bp, Homo sapiens
tgccagagaatcacctctcctt

SEQ ID NO: 8030106 - DNA, 22 bp, Homo sapiens
tgccagagaagacccagtcact

SEQ ID NO: 8030107 - DNA, 22 bp, Homo sapiens
tgccagagaagacccagtcact

SEQ ID NO: 8030108 - DNA, 22 bp, Homo sapiens
tgccagagaatcacctctcctt

SEQ ID NO: 8030109 - DNA, 22 bp, Homo sapiens
tgcattctgaacgtaaatgtga

SEQ ID NO: 8030110 - DNA, 22 bp, Homo sapiens
tgcattctgacttagttaatat

SEQ ID NO: 8030111 - DNA, 22 bp, Homo sapiens
tgcattctgaacgtaaatgtga

SEQ ID NO: 8030112 - DNA, 22 bp, Homo sapiens
tgcattcttggaagaagctctc

SEQ ID NO: 8030113 - DNA, 22 bp, Homo sapiens
tgcattcttggaagaagctctc

SEQ ID NO: 8030114 - DNA, 22 bp, Homo sapiens
tgcattgagattttaaaattca

SEQ ID NO: 8030115 - DNA, 19 bp, Homo sapiens
tgcattgagggctgtctca

SEQ ID NO: 8030116 - DNA, 21 bp, Homo sapiens
tgcattcctccatccaacagg

SEQ ID NO: 8030117 - DNA, 22 bp, Homo sapiens
tgcattcctccacctcctgcac

SEQ ID NO: 8030118 - DNA, 22 bp, Homo sapiens
tgcattgatagaaaaacatgga

SEQ ID NO: 8030119 - DNA, 22 bp, Homo sapiens
tgcattgatcatatccttcctg

SEQ ID NO: 8030120 - DNA, 22 bp, Homo sapiens
tgcattgaggggctctcttcct

SEQ ID NO: 8030121 - DNA, 22 bp, Homo sapiens
tgcattgagtcatttcagtatg

SEQ ID NO: 8030122 - DNA, 22 bp, Homo sapiens
tgcattgcatttgtcatgaaga

SEQ ID NO: 8030123 - DNA, 22 bp, Homo sapiens
tgcattggaaaactatggctca

SEQ ID NO: 8030124 - DNA, 22 bp, Homo sapiens
tgcattggtcatttagaaaata

SEQ ID NO: 8030125 - DNA, 22 bp, Homo sapiens
tgcattggaaactcagcagcac

SEQ ID NO: 8030126 - DNA, 22 bp, Homo sapiens
tgcattgggttgacatactaaa

SEQ ID NO: 8030127 - DNA, 22 bp, Homo sapiens
tgcatttaagaaaacatgagtc

SEQ ID NO: 8030128 - DNA, 22 bp, Homo sapiens
tgcatttaagaaaacatgagtc

SEQ ID NO: 8030129 - DNA, 22 bp, Homo sapiens
tgcatttaagaaaacatgagtc

SEQ ID NO: 8030130 - DNA, 22 bp, Homo sapiens
tgcatttaactagaatattaat

SEQ ID NO: 8030131 - DNA, 22 bp, Homo sapiens
tgcatttaactagaatattaat

SEQ ID NO: 8030132 - DNA, 21 bp, Homo sapiens
tgcatttaacagaaacaggaa

SEQ ID NO: 8030133 - DNA, 22 bp, Homo sapiens
tgcattgttgaccagttgtgca

SEQ ID NO: 8030134 - DNA, 22 bp, Homo sapiens
tgcattgttgatgagttgaata

SEQ ID NO: 8030135 - DNA, 22 bp, Homo sapiens
tgcatttacctggaggtcattt

SEQ ID NO: 8030136 - DNA, 22 bp, Homo sapiens
tgcatttacctggaggtcattt

SEQ ID NO: 8030137 - DNA, 20 bp, Homo sapiens
tgcatttacagtgtggatac

SEQ ID NO: 8030138 - DNA, 22 bp, Homo sapiens
tgcatttacctggaggtcattt

SEQ ID NO: 8030139 - DNA, 18 bp, Homo sapiens
tgcatttagtacatctag

SEQ ID NO: 8030140 - DNA, 18 bp, Homo sapiens
tgcatttagtacatctag

SEQ ID NO: 8030141 - DNA, 22 bp, Homo sapiens
tgcatttacggtacaacagcag

SEQ ID NO: 8030142 - DNA, 18 bp, Homo sapiens
tgcatttagtacatctag

SEQ ID NO: 8030143 - DNA, 18 bp, Homo sapiens
tgcatttagtacatctag

SEQ ID NO: 8030144 - DNA, 18 bp, Homo sapiens
tgcatttagtacatctag

SEQ ID NO: 8030145 - DNA, 22 bp, Homo sapiens
tgcatttagttttaataaagga

SEQ ID NO: 8030146 - DNA, 22 bp, Homo sapiens
tgcatttagttatgagaaaaac

SEQ ID NO: 8030147 - DNA, 22 bp, Homo sapiens
tgcatttagttatgagaaaaac

SEQ ID NO: 8030148 - DNA, 22 bp, Homo sapiens
tgcatttagttatgagaaaaac

SEQ ID NO: 8030149 - DNA, 22 bp, Homo sapiens
tgcatttagttttaataaagga

SEQ ID NO: 8030150 - DNA, 22 bp, Homo sapiens
tgcatttagttttaataaagga

SEQ ID NO: 8030151 - DNA, 22 bp, Homo sapiens
tgcatttagttttaataaagga

SEQ ID NO: 8030152 - DNA, 22 bp, Homo sapiens
tgcatttatggagcaaggcagt

SEQ ID NO: 8030153 - DNA, 22 bp, Homo sapiens
tgcatttatggagttacctcat

SEQ ID NO: 8030154 - DNA, 22 bp, Homo sapiens
tgcatttatggagttacctcat

SEQ ID NO: 8030155 - DNA, 22 bp, Homo sapiens
tgcatttatttgaattgatcta

SEQ ID NO: 8030156 - DNA, 22 bp, Homo sapiens
tgcatttcacagactgagaaat

SEQ ID NO: 8030157 - DNA, 22 bp, Homo sapiens
tgcatttcagaagaaaattcgg

SEQ ID NO: 8030158 - DNA, 22 bp, Homo sapiens
tgcatttcagaagaaaattcgg

SEQ ID NO: 8030159 - DNA, 22 bp, Homo sapiens
tgcatttatttgaattgatcta

SEQ ID NO: 8030160 - DNA, 22 bp, Homo sapiens
tgcatttcacagactgagaaat

SEQ ID NO: 8030161 - DNA, 22 bp, Homo sapiens
tgcatttccagatttctggagt

SEQ ID NO: 8030162 - DNA, 22 bp, Homo sapiens
tgcatttccagatttctggagt

SEQ ID NO: 8030163 - DNA, 22 bp, Homo sapiens
tgcatttcagaagaaaattcgg

SEQ ID NO: 8030164 - DNA, 21 bp, Homo sapiens
tgcatttctaactagttgacc

SEQ ID NO: 8030165 - DNA, 22 bp, Homo sapiens
tgcatttcttttgagtatatgc

SEQ ID NO: 8030166 - DNA, 22 bp, Homo sapiens
tgcatttcttttgagtatatgc

SEQ ID NO: 8030167 - DNA, 22 bp, Homo sapiens
tgcatttccagatttctggagt

SEQ ID NO: 8030168 - DNA, 22 bp, Homo sapiens
tgcatttccagatttctggagt

SEQ ID NO: 8030169 - DNA, 21 bp, Homo sapiens
tgcatttctaactagttgacc

SEQ ID NO: 8030170 - DNA, 22 bp, Homo sapiens
tgcatttgagttgggagcaggc

SEQ ID NO: 8030171 - DNA, 22 bp, Homo sapiens
tgcatttgagttgggagcaggc

SEQ ID NO: 8030172 - DNA, 22 bp, Homo sapiens
tgcatttgagttgggagcaggc

SEQ ID NO: 8030173 - DNA, 22 bp, Homo sapiens
tgcatttgaagtcagacaggct

SEQ ID NO: 8030174 - DNA, 22 bp, Homo sapiens
tgcatttgaagtcagacaggct

SEQ ID NO: 8030175 - DNA, 22 bp, Homo sapiens
tgcatttgaagtcagacaggct

SEQ ID NO: 8030176 - DNA, 22 bp, Homo sapiens
tgcatttgagttgggagcaggc

SEQ ID NO: 8030177 - DNA, 23 bp, Homo sapiens
tgcatttgcaattgcagtaaggt

SEQ ID NO: 8030178 - DNA, 22 bp, Homo sapiens
tgcatttgctggggatgtgatt

SEQ ID NO: 8030179 - DNA, 22 bp, Homo sapiens
tgcatttgctggggatgtgatt

SEQ ID NO: 8030180 - DNA, 22 bp, Homo sapiens
tgcatttggggcagactagcag

SEQ ID NO: 8030181 - DNA, 22 bp, Homo sapiens
tgcatttttaacaaggctaatt

SEQ ID NO: 8030182 - DNA, 22 bp, Homo sapiens
tgcattttcttccaccaatatc

SEQ ID NO: 8030183 - DNA, 22 bp, Homo sapiens
tgcatttgttcagtgaaatgtt

SEQ ID NO: 8030184 - DNA, 22 bp, Homo sapiens
tgcatttgttcagtgaaatgtt

SEQ ID NO: 8030185 - DNA, 22 bp, Homo sapiens
tgcattttacttacctgttagt

SEQ ID NO: 8030186 - DNA, 20 bp, Homo sapiens
tgcatttgttatttgtactc

SEQ ID NO: 8030187 - DNA, 22 bp, Homo sapiens
tgcatttgtaacattcaagaat

SEQ ID NO: 8030188 - DNA, 22 bp, Homo sapiens
tgcatttgtcttgtctcatgaa

SEQ ID NO: 8030189 - DNA, 22 bp, Homo sapiens
tgccaaaatggccaaaagctag

SEQ ID NO: 8030190 - DNA, 22 bp, Homo sapiens
tgcatttttgataactgtgtac

SEQ ID NO: 8030191 - DNA, 22 bp, Homo sapiens
tgccaaaatgggctttataccg

SEQ ID NO: 8030192 - DNA, 22 bp, Homo sapiens
tgccaaaatggccaaaagctag

SEQ ID NO: 8030193 - DNA, 22 bp, Homo sapiens
tgcatttttgaggttaactcaa

SEQ ID NO: 8030194 - DNA, 22 bp, Homo sapiens
tgccaaatgccaccacagctgc

SEQ ID NO: 8030195 - DNA, 22 bp, Homo sapiens
tgccaaatgccaccacagctgc

SEQ ID NO: 8030196 - DNA, 22 bp, Homo sapiens
tgccaaagaagtatcaaagatg

SEQ ID NO: 8030197 - DNA, 23 bp, Homo sapiens
tgccaaagtttacctaacactgg

SEQ ID NO: 8030198 - DNA, 22 bp, Homo sapiens
tgccaaaatgggctttataccg

SEQ ID NO: 8030199 - DNA, 23 bp, Homo sapiens
tgccaaagtttacctaacactgg

SEQ ID NO: 8030200 - DNA, 22 bp, Homo sapiens
tgcataatgctggacttttcaa

SEQ ID NO: 8030201 - DNA, 19 bp, Homo sapiens
tgcataaattatatacttt

SEQ ID NO: 8030202 - DNA, 19 bp, Homo sapiens
tgcataaattatatacttt

SEQ ID NO: 8030203 - DNA, 22 bp, Homo sapiens
tgcataattggtcctccacatt

SEQ ID NO: 8030204 - DNA, 22 bp, Homo sapiens
tgcatacacaagcatacatgta

SEQ ID NO: 8030205 - DNA, 22 bp, Homo sapiens
tgcatacataatcgagaccagt

SEQ ID NO: 8030206 - DNA, 22 bp, Homo sapiens
tgcatacataaagtgctatcat

SEQ ID NO: 8030207 - DNA, 22 bp, Homo sapiens
tgcatacataatcgagaccagt

SEQ ID NO: 8030208 - DNA, 22 bp, Homo sapiens
tgcatacacatgtgcacatacg

SEQ ID NO: 8030209 - DNA, 22 bp, Homo sapiens
tgcatacacttcaaatgagcat

SEQ ID NO: 8030210 - DNA, 22 bp, Homo sapiens
tgcatacacttcaaatgagcat

SEQ ID NO: 8030211 - DNA, 22 bp, Homo sapiens
tgcatatacccgcatttacata

SEQ ID NO: 8030212 - DNA, 20 bp, Homo sapiens
tgcatagttgctgcagttga

SEQ ID NO: 8030213 - DNA, 22 bp, Homo sapiens
tgcatatacccgcatttacata

SEQ ID NO: 8030214 - DNA, 22 bp, Homo sapiens
tgcatagtcgctctgtgcttca

SEQ ID NO: 8030215 - DNA, 22 bp, Homo sapiens
tgcatagttctccttcctcctc

SEQ ID NO: 8030216 - DNA, 22 bp, Homo sapiens
tgcatacatgtttgtgtatttt

SEQ ID NO: 8030217 - DNA, 20 bp, Homo sapiens
tgcatacgtatgtatttgga

SEQ ID NO: 8030218 - DNA, 22 bp, Homo sapiens
tgcatacatgtttgtgtatttt

SEQ ID NO: 8030219 - DNA, 22 bp, Homo sapiens
tgcatagaggatccagtgtggt

SEQ ID NO: 8030220 - DNA, 22 bp, Homo sapiens
tgcatagaggatccagtgtggt

SEQ ID NO: 8030221 - DNA, 18 bp, Homo sapiens
tgcatcatttatgggtca

SEQ ID NO: 8030222 - DNA, 22 bp, Homo sapiens
tgcatcatttataatgtctttg

SEQ ID NO: 8030223 - DNA, 18 bp, Homo sapiens
tgcatatactgcctatct

SEQ ID NO: 8030224 - DNA, 22 bp, Homo sapiens
tgcatcagagtttgctgctgct

SEQ ID NO: 8030225 - DNA, 18 bp, Homo sapiens
tgcatatactgcctatct

SEQ ID NO: 8030226 - DNA, 22 bp, Homo sapiens
tgcatcagctgtgcttcttgac

SEQ ID NO: 8030227 - DNA, 22 bp, Homo sapiens
tgcatcagagtttgctgctgct

SEQ ID NO: 8030228 - DNA, 22 bp, Homo sapiens
tgcatcatataatgtctatgga

SEQ ID NO: 8030229 - DNA, 22 bp, Homo sapiens
tgcatcatataatgtctatgga

SEQ ID NO: 8030230 - DNA, 22 bp, Homo sapiens
tgcatctgtagtggaaacctta

SEQ ID NO: 8030231 - DNA, 22 bp, Homo sapiens
tgcatctgtagtggaaacctta

SEQ ID NO: 8030232 - DNA, 22 bp, Homo sapiens
tgcatctgattctcaggcagaa

SEQ ID NO: 8030233 - DNA, 22 bp, Homo sapiens
tgcatccttcccatttaaacca

SEQ ID NO: 8030234 - DNA, 22 bp, Homo sapiens
tgcatctgattctcaggcagaa

SEQ ID NO: 8030235 - DNA, 22 bp, Homo sapiens
tgcatctgattctcaggcagaa

SEQ ID NO: 8030236 - DNA, 22 bp, Homo sapiens
tgcatccttaaccagcatcact

SEQ ID NO: 8030237 - DNA, 22 bp, Homo sapiens
tgcataaagtgccatagtatta

SEQ ID NO: 8030238 - DNA, 17 bp, Homo sapiens
tgcataaagggtgagca

SEQ ID NO: 8030239 - DNA, 17 bp, Homo sapiens
tgcataaagggtgagca

SEQ ID NO: 8030240 - DNA, 22 bp, Homo sapiens
tgcataaagtgccatagtatta

SEQ ID NO: 8030241 - DNA, 22 bp, Homo sapiens
tgcataaagtgccatagtatta

SEQ ID NO: 8030242 - DNA, 22 bp, Homo sapiens
tgcataaatagtacctgctttt

SEQ ID NO: 8030243 - DNA, 22 bp, Homo sapiens
tgcataaagtgccatagtatta

SEQ ID NO: 8030244 - DNA, 22 bp, Homo sapiens
tgcataaagtgccatagtatta

SEQ ID NO: 8030245 - DNA, 19 bp, Homo sapiens
tgcataaattatatacttt

SEQ ID NO: 8030246 - DNA, 22 bp, Homo sapiens
tgcataaatcttggaagttgtt

SEQ ID NO: 8030247 - DNA, 19 bp, Homo sapiens
tgcataaattatatacttt

SEQ ID NO: 8030248 - DNA, 19 bp, Homo sapiens
tgcataaattatatacttt

SEQ ID NO: 8030249 - DNA, 19 bp, Homo sapiens
tgcataaattatatacttt

SEQ ID NO: 8030250 - DNA, 22 bp, Homo sapiens
tgcataaatcttggaagttgtt

SEQ ID NO: 8030251 - DNA, 22 bp, Homo sapiens
tgcataaatattgttgggagta

SEQ ID NO: 8030252 - DNA, 22 bp, Homo sapiens
tgcataaatattgttgggagta

SEQ ID NO: 8030253 - DNA, 22 bp, Homo sapiens
tgcataaatattgttgggagta

SEQ ID NO: 8030254 - DNA, 22 bp, Homo sapiens
tgcataaatagtacctgctttt

SEQ ID NO: 8030255 - DNA, 22 bp, Homo sapiens
tgcataaatcttggaagttgtt

SEQ ID NO: 8030256 - DNA, 19 bp, Homo sapiens
tgcataaattatatacttt

SEQ ID NO: 8030257 - DNA, 21 bp, Homo sapiens
tgcataaagaaatacaaatac

SEQ ID NO: 8030258 - DNA, 21 bp, Homo sapiens
tgcataaagaaatacaaatac

SEQ ID NO: 8030259 - DNA, 22 bp, Homo sapiens
tgcataaagaaagcctggagag

SEQ ID NO: 8030260 - DNA, 22 bp, Homo sapiens
tgcataaagaaagcctggagag

SEQ ID NO: 8030261 - DNA, 22 bp, Homo sapiens
tgcataaacttctctggtgtga

SEQ ID NO: 8030262 - DNA, 22 bp, Homo sapiens
tgcataaacttctctggtgtga

SEQ ID NO: 8030263 - DNA, 21 bp, Homo sapiens
tgcataaagaaatacaaatac

SEQ ID NO: 8030264 - DNA, 21 bp, Homo sapiens
tgcataaagaaatacaaatac

SEQ ID NO: 8030265 - DNA, 22 bp, Homo sapiens
tgcataaacagatacttcatgt

SEQ ID NO: 8030266 - DNA, 22 bp, Homo sapiens
tgcataaacagatacttcatgt

SEQ ID NO: 8030267 - DNA, 22 bp, Homo sapiens
tgcataaacagatacttcatgt

SEQ ID NO: 8030268 - DNA, 22 bp, Homo sapiens
tgcataaaatatgagaaatgta

SEQ ID NO: 8030269 - DNA, 22 bp, Homo sapiens
tgcataaaatatgagaaatgta

SEQ ID NO: 8030270 - DNA, 22 bp, Homo sapiens
tgcataaaatatgagaaatgta

SEQ ID NO: 8030271 - DNA, 22 bp, Homo sapiens
tgcataaaatatgagaaatgta

SEQ ID NO: 8030272 - DNA, 22 bp, Homo sapiens
tgcataaaatatgagaaatgta

SEQ ID NO: 8030273 - DNA, 22 bp, Homo sapiens
tgcagttttatcacatatatag

SEQ ID NO: 8030274 - DNA, 20 bp, Homo sapiens
tgcagtttgtcaaggttcct

SEQ ID NO: 8030275 - DNA, 22 bp, Homo sapiens
tgcagtttgccctttgctcact

SEQ ID NO: 8030276 - DNA, 22 bp, Homo sapiens
tgcagtttgccctttgctcact

SEQ ID NO: 8030277 - DNA, 22 bp, Homo sapiens
tgcagtttcctttctagtcttt

SEQ ID NO: 8030278 - DNA, 22 bp, Homo sapiens
tgcagtttaaacttggcaactt

SEQ ID NO: 8030279 - DNA, 22 bp, Homo sapiens
tgcagttcaaggttgtacagct

SEQ ID NO: 8030280 - DNA, 22 bp, Homo sapiens
tgcagttcaaggttgtacagct

SEQ ID NO: 8030281 - DNA, 22 bp, Homo sapiens
tgcagtgtttttcagggcatat

SEQ ID NO: 8030282 - DNA, 22 bp, Homo sapiens
tgcagtgtttggatgctgagtc

SEQ ID NO: 8030283 - DNA, 22 bp, Homo sapiens
tgcagtgtttttcagggcatat

SEQ ID NO: 8030284 - DNA, 22 bp, Homo sapiens
tgcagttctaagtagacaagtc

SEQ ID NO: 8030285 - DNA, 21 bp, Homo sapiens
tgcagttcaagtcaatctact

SEQ ID NO: 8030286 - DNA, 22 bp, Homo sapiens
tgcagttctaagtagacaagtc

SEQ ID NO: 8030287 - DNA, 22 bp, Homo sapiens
tgcagttctatcacccaccccg

SEQ ID NO: 8030288 - DNA, 22 bp, Homo sapiens
tgcataaaaaccacatacaagg

SEQ ID NO: 8030289 - DNA, 22 bp, Homo sapiens
tgcagttttggccattgaaggc

SEQ ID NO: 8030290 - DNA, 22 bp, Homo sapiens
tgcataaaaaccacatacaagg

SEQ ID NO: 8030291 - DNA, 22 bp, Homo sapiens
tgcataaaaaccacatacaagg

SEQ ID NO: 8030292 - DNA, 22 bp, Homo sapiens
tgcataaaacatgatttctgct

SEQ ID NO: 8030293 - DNA, 22 bp, Homo sapiens
tgcataaaatatgagaaatgta

SEQ ID NO: 8030294 - DNA, 22 bp, Homo sapiens
tgcataaaacaccagcagggtg

SEQ ID NO: 8030295 - DNA, 22 bp, Homo sapiens
tgcataaaacatgatttctgct

SEQ ID NO: 8030296 - DNA, 22 bp, Homo sapiens
tgcataaaacatgatttctgct

SEQ ID NO: 8030297 - DNA, 22 bp, Homo sapiens
tgcataaaacatgatttctgct

SEQ ID NO: 8030298 - DNA, 22 bp, Homo sapiens
tgcataaaacaccagcagggtg

SEQ ID NO: 8030299 - DNA, 22 bp, Homo sapiens
tgcagttttgccaggcaatgga

SEQ ID NO: 8030300 - DNA, 22 bp, Homo sapiens
tgcagttttgccaggcaatgga

SEQ ID NO: 8030301 - DNA, 21 bp, Homo sapiens
tgcagttttgcttgatctctg

SEQ ID NO: 8030302 - DNA, 22 bp, Homo sapiens
tgcagttttatcacatatatag

SEQ ID NO: 8030303 - DNA, 22 bp, Homo sapiens
tgcagttttcaaaagtttacag

SEQ ID NO: 8030304 - DNA, 22 bp, Homo sapiens
tgcagttttccttcaacattgt

SEQ ID NO: 8030305 - DNA, 22 bp, Homo sapiens
tgcagttttctcacccccacaa

SEQ ID NO: 8030306 - DNA, 22 bp, Homo sapiens
tgcagttttccttcaacattgt

SEQ ID NO: 8030307 - DNA, 22 bp, Homo sapiens
tgcatgtggacccctggtgcct

SEQ ID NO: 8030308 - DNA, 22 bp, Homo sapiens
tgcatgtggacccctggtgcct

SEQ ID NO: 8030309 - DNA, 17 bp, Homo sapiens
tgcatgtcctttgttcc

SEQ ID NO: 8030310 - DNA, 22 bp, Homo sapiens
tgcatgtctttagcatttgtta

SEQ ID NO: 8030311 - DNA, 23 bp, Homo sapiens
tgcatgtgaattcatacttgttt

SEQ ID NO: 8030312 - DNA, 22 bp, Homo sapiens
tgcatgtgcccactctggctta

SEQ ID NO: 8030313 - DNA, 17 bp, Homo sapiens
tgcatgtcctttgttcc

SEQ ID NO: 8030314 - DNA, 23 bp, Homo sapiens
tgcatgtgaattcatacttgttt

SEQ ID NO: 8030315 - DNA, 22 bp, Homo sapiens
tgcatgtatgtaaatgtgagcg

SEQ ID NO: 8030316 - DNA, 22 bp, Homo sapiens
tgcatggaggaagatgaatgca

SEQ ID NO: 8030317 - DNA, 23 bp, Homo sapiens
tgcatggggctatactgctgttc

SEQ ID NO: 8030318 - DNA, 22 bp, Homo sapiens
tgcatggcttgtgagggtttga

SEQ ID NO: 8030319 - DNA, 20 bp, Homo sapiens
tgcatggcgcacatctgtgg

SEQ ID NO: 8030320 - DNA, 22 bp, Homo sapiens
tgcatggttatatactactagt

SEQ ID NO: 8030321 - DNA, 22 bp, Homo sapiens
tgcattccatgtgtttcctgag

SEQ ID NO: 8030322 - DNA, 22 bp, Homo sapiens
tgcattcatcatttgaaagccc

SEQ ID NO: 8030323 - DNA, 22 bp, Homo sapiens
tgcattccacagaagggaaaac

SEQ ID NO: 8030324 - DNA, 22 bp, Homo sapiens
tgcatgtttataacagatgagg

SEQ ID NO: 8030325 - DNA, 22 bp, Homo sapiens
tgcatgtgtgacaaggacagtt

SEQ ID NO: 8030326 - DNA, 22 bp, Homo sapiens
tgcatgtgtcgggcctgtgcta

SEQ ID NO: 8030327 - DNA, 22 bp, Homo sapiens
tgcatgtgtgacaaggacagtt

SEQ ID NO: 8030328 - DNA, 22 bp, Homo sapiens
tgcatgtggatcatatgtccta

SEQ ID NO: 8030329 - DNA, 22 bp, Homo sapiens
tgcatgtgtcgggcctgtgcta

SEQ ID NO: 8030330 - DNA, 22 bp, Homo sapiens
tgcatgtgtttcccagcaagct

SEQ ID NO: 8030331 - DNA, 19 bp, Homo sapiens
tgcatgtgttctcccattg

SEQ ID NO: 8030332 - DNA, 22 bp, Homo sapiens
tgcatgtgtgtgtatttataaa

SEQ ID NO: 8030333 - DNA, 22 bp, Homo sapiens
tgcatgtgtgtgtatttataaa

SEQ ID NO: 8030334 - DNA, 23 bp, Homo sapiens
tgcatgctaacacagtgcacagg

SEQ ID NO: 8030335 - DNA, 22 bp, Homo sapiens
tgcatgctaagaaatagcagct

SEQ ID NO: 8030336 - DNA, 21 bp, Homo sapiens
tgcatgctatgtttttatttc

SEQ ID NO: 8030337 - DNA, 22 bp, Homo sapiens
tgcatgctaagaaatagcagct

SEQ ID NO: 8030338 - DNA, 17 bp, Homo sapiens
tgcatgcgtctgtgata

SEQ ID NO: 8030339 - DNA, 17 bp, Homo sapiens
tgcatgcgtctgtgata

SEQ ID NO: 8030340 - DNA, 22 bp, Homo sapiens
tgcatgcgttagttggcgtgtt

SEQ ID NO: 8030341 - DNA, 22 bp, Homo sapiens
tgcatgcgttagttggcgtgtt

SEQ ID NO: 8030342 - DNA, 22 bp, Homo sapiens
tgcatgcatgctactgggaggt

SEQ ID NO: 8030343 - DNA, 22 bp, Homo sapiens
tgcatgctctgtagaaagcagg

SEQ ID NO: 8030344 - DNA, 22 bp, Homo sapiens
tgcatgctctgtagaaagcagg

SEQ ID NO: 8030345 - DNA, 22 bp, Homo sapiens
tgcatgcttcaggctggctctg

SEQ ID NO: 8030346 - DNA, 22 bp, Homo sapiens
tgcatgcttcccttctcccagc

SEQ ID NO: 8030347 - DNA, 22 bp, Homo sapiens
tgcatgctttattttcatgtgt

SEQ ID NO: 8030348 - DNA, 22 bp, Homo sapiens
tgcatgcttcaggctggctctg

SEQ ID NO: 8030349 - DNA, 22 bp, Homo sapiens
tgcatggaacggtctcctggtc

SEQ ID NO: 8030350 - DNA, 22 bp, Homo sapiens
tgcatctttttccaagtttatt

SEQ ID NO: 8030351 - DNA, 22 bp, Homo sapiens
tgcatctttttccaagtttatt

SEQ ID NO: 8030352 - DNA, 22 bp, Homo sapiens
tgcatctttgcttggctccttc

SEQ ID NO: 8030353 - DNA, 22 bp, Homo sapiens
tgcatctttagtcttatgtctg

SEQ ID NO: 8030354 - DNA, 22 bp, Homo sapiens
tgcatctttctgcatatgtaaa

SEQ ID NO: 8030355 - DNA, 22 bp, Homo sapiens
tgcatgaacggagggtaagctg

SEQ ID NO: 8030356 - DNA, 22 bp, Homo sapiens
tgcatctttgcttggctccttc

SEQ ID NO: 8030357 - DNA, 22 bp, Homo sapiens
tgcatgagcgaatgtgtcctgt

SEQ ID NO: 8030358 - DNA, 22 bp, Homo sapiens
tgcatgaggactcagagcttct

SEQ ID NO: 8030359 - DNA, 22 bp, Homo sapiens
tgcatctttctgcatatgtaaa

SEQ ID NO: 8030360 - DNA, 22 bp, Homo sapiens
tgcatctttctgcatatgtaaa

SEQ ID NO: 8030361 - DNA, 22 bp, Homo sapiens
tgcatcttggaagattgcacaa

SEQ ID NO: 8030362 - DNA, 22 bp, Homo sapiens
tgcatcttcagtaggaactctc

SEQ ID NO: 8030363 - DNA, 19 bp, Homo sapiens
tgcatcttgcatgggtgag

SEQ ID NO: 8030364 - DNA, 22 bp, Homo sapiens
tgcatcttcagccctcagccag

SEQ ID NO: 8030365 - DNA, 22 bp, Homo sapiens
tgcatcttcagccctcagccag

SEQ ID NO: 8030366 - DNA, 22 bp, Homo sapiens
tgcatcttcagtaggaactctc

SEQ ID NO: 8030367 - DNA, 22 bp, Homo sapiens
tgcatcttacgttttgaaaggg

SEQ ID NO: 8030368 - DNA, 22 bp, Homo sapiens
tgcatcttacgttttgaaaggg

SEQ ID NO: 8030369 - DNA, 21 bp, Homo sapiens
tgcatcttcaaggttggcagg

SEQ ID NO: 8030370 - DNA, 22 bp, Homo sapiens
tgcatcttagcaatgaccgagt

SEQ ID NO: 8030371 - DNA, 21 bp, Homo sapiens
tgcatcttcaaggttggcagg

SEQ ID NO: 8030372 - DNA, 22 bp, Homo sapiens
tgcatctgttcagagctgtcga

SEQ ID NO: 8030373 - DNA, 22 bp, Homo sapiens
tgcatctgtgctccctcttcta

SEQ ID NO: 8030374 - DNA, 22 bp, Homo sapiens
tgcatctgttcattcgttccca

SEQ ID NO: 8030375 - DNA, 22 bp, Homo sapiens
tgcatgcacttggctggcacgt

SEQ ID NO: 8030376 - DNA, 22 bp, Homo sapiens
tgcatgatagagatggtattag

SEQ ID NO: 8030377 - DNA, 22 bp, Homo sapiens
tgcatgcaaaaaaatctgcatt

SEQ ID NO: 8030378 - DNA, 22 bp, Homo sapiens
tgcatgatgactaaggtggtga

SEQ ID NO: 8030379 - DNA, 22 bp, Homo sapiens
tgcatgatggtttagatggggt

SEQ ID NO: 8030380 - DNA, 20 bp, Homo sapiens
tgcagggctgcctcccagct

SEQ ID NO: 8030381 - DNA, 20 bp, Homo sapiens
tgcagggctgcctcccagct

SEQ ID NO: 8030382 - DNA, 20 bp, Homo sapiens
tgcagggctgcctcccagct

SEQ ID NO: 8030383 - DNA, 20 bp, Homo sapiens
tgcagggctgcctcccagct

SEQ ID NO: 8030384 - DNA, 20 bp, Homo sapiens
tgcagggctgcctcccagct

SEQ ID NO: 8030385 - DNA, 19 bp, Homo sapiens
tgcagggctgcgcctgggg

SEQ ID NO: 8030386 - DNA, 20 bp, Homo sapiens
tgcagggctctgcttctctc

SEQ ID NO: 8030387 - DNA, 22 bp, Homo sapiens
tgcagggctcctggctccaatc

SEQ ID NO: 8030388 - DNA, 22 bp, Homo sapiens
tgcagggctcctggctccaatc

SEQ ID NO: 8030389 - DNA, 20 bp, Homo sapiens
tgcagggctgcctcccagct

SEQ ID NO: 8030390 - DNA, 20 bp, Homo sapiens
tgcagggctctgcttctctc

SEQ ID NO: 8030391 - DNA, 20 bp, Homo sapiens
tgcagggctctgcttctctc

SEQ ID NO: 8030392 - DNA, 19 bp, Homo sapiens
tgcagggctgcgcctgggg

SEQ ID NO: 8030393 - DNA, 19 bp, Homo sapiens
tgcagggctgcgcctgggg

SEQ ID NO: 8030394 - DNA, 22 bp, Homo sapiens
tgcagggcttcctcttggagtt

SEQ ID NO: 8030395 - DNA, 22 bp, Homo sapiens
tgcagggcttcctcttggagtt

SEQ ID NO: 8030396 - DNA, 22 bp, Homo sapiens
tgcagggcttcctcttggagtt

SEQ ID NO: 8030397 - DNA, 22 bp, Homo sapiens
tgcagggcttcctcttggagtt

SEQ ID NO: 8030398 - DNA, 22 bp, Homo sapiens
tgcagggcttcctcttggagtt

SEQ ID NO: 8030399 - DNA, 23 bp, Homo sapiens
tgcaggggaggcttaaagcaggt

SEQ ID NO: 8030400 - DNA, 23 bp, Homo sapiens
tgcaggggaggcttaaagcaggt

SEQ ID NO: 8030401 - DNA, 23 bp, Homo sapiens
tgcaggggaggcttaaagcaggt

SEQ ID NO: 8030402 - DNA, 23 bp, Homo sapiens
tgcaggggaggcttaaagcaggt

SEQ ID NO: 8030403 - DNA, 22 bp, Homo sapiens
tgcaggggcttgtctgggcctg

SEQ ID NO: 8030404 - DNA, 22 bp, Homo sapiens
tgcaggggcttgtctgggcctg

SEQ ID NO: 8030405 - DNA, 22 bp, Homo sapiens
tgcaggggcttgtctgggcctg

SEQ ID NO: 8030406 - DNA, 22 bp, Homo sapiens
tgcaggggcttgtctgggcctg

SEQ ID NO: 8030407 - DNA, 22 bp, Homo sapiens
tgcaggggcttgtctgggcctg

SEQ ID NO: 8030408 - DNA, 22 bp, Homo sapiens
tgcaggggcttgtctgggcctg

SEQ ID NO: 8030409 - DNA, 22 bp, Homo sapiens
tgcagggtagacaggtgaggtc

SEQ ID NO: 8030410 - DNA, 22 bp, Homo sapiens
tgcagggtagacaggtgaggtc

SEQ ID NO: 8030411 - DNA, 22 bp, Homo sapiens
tgcaggggcttgtctgggcctg

SEQ ID NO: 8030412 - DNA, 22 bp, Homo sapiens
tgcaggggcttgtctgggcctg

SEQ ID NO: 8030413 - DNA, 22 bp, Homo sapiens
tgcaggggcttgtctgggcctg

SEQ ID NO: 8030414 - DNA, 22 bp, Homo sapiens
tgcaggggcttgtctgggcctg

SEQ ID NO: 8030415 - DNA, 22 bp, Homo sapiens
tgcagggtcccgaagggaagac

SEQ ID NO: 8030416 - DNA, 22 bp, Homo sapiens
tgcagggtcccgaagggaagac

SEQ ID NO: 8030417 - DNA, 22 bp, Homo sapiens
tgcagggtcccgaagggaagac

SEQ ID NO: 8030418 - DNA, 22 bp, Homo sapiens
tgcagggtatccttgtctctgc

SEQ ID NO: 8030419 - DNA, 22 bp, Homo sapiens
tgcagggtagatgcaggctgtg

SEQ ID NO: 8030420 - DNA, 22 bp, Homo sapiens
tgcagggtagatgcaggctgtg

SEQ ID NO: 8030421 - DNA, 22 bp, Homo sapiens
tgcagggtagatgcaggctgtg

SEQ ID NO: 8030422 - DNA, 22 bp, Homo sapiens
tgcagggtggagcggaagcgga

SEQ ID NO: 8030423 - DNA, 22 bp, Homo sapiens
tgcagggtggagcggaagcgga

SEQ ID NO: 8030424 - DNA, 22 bp, Homo sapiens
tgcagggtggtttgaagggtct

SEQ ID NO: 8030425 - DNA, 22 bp, Homo sapiens
tgcagggtggtttgaagggtct

SEQ ID NO: 8030426 - DNA, 22 bp, Homo sapiens
tgcagggtgcacagtggggtgc

SEQ ID NO: 8030427 - DNA, 22 bp, Homo sapiens
tgcagggtgcacagtggggtgc

SEQ ID NO: 8030428 - DNA, 22 bp, Homo sapiens
tgcagggtgcacagtggggtgc

SEQ ID NO: 8030429 - DNA, 22 bp, Homo sapiens
tgcaggtgattctgatgcagtt

SEQ ID NO: 8030430 - DNA, 23 bp, Homo sapiens
tgcaggtgattaatccagtttca

SEQ ID NO: 8030431 - DNA, 22 bp, Homo sapiens
tgcaggtgattctgatgcagtt

SEQ ID NO: 8030432 - DNA, 22 bp, Homo sapiens
tgcaggtgagtgcaggggctca

SEQ ID NO: 8030433 - DNA, 22 bp, Homo sapiens
tgcaggtgagtgcaggggctca

SEQ ID NO: 8030434 - DNA, 22 bp, Homo sapiens
tgcaggtgattctgatgcagtt

SEQ ID NO: 8030435 - DNA, 22 bp, Homo sapiens
tgcaggtggacacgggagacgg

SEQ ID NO: 8030436 - DNA, 22 bp, Homo sapiens
tgcaggtgcagcgatactgtga

SEQ ID NO: 8030437 - DNA, 22 bp, Homo sapiens
tgcaggtggacacgggagacgg

SEQ ID NO: 8030438 - DNA, 22 bp, Homo sapiens
tgcaggtggacacgggagacgg

SEQ ID NO: 8030439 - DNA, 22 bp, Homo sapiens
tgcaggtggatatctcatcaga

SEQ ID NO: 8030440 - DNA, 22 bp, Homo sapiens
tgcaggtggctccagggactgc

SEQ ID NO: 8030441 - DNA, 22 bp, Homo sapiens
tgcaggtggctccagggactgc

SEQ ID NO: 8030442 - DNA, 22 bp, Homo sapiens
tgcaggtggctccagggactgc

SEQ ID NO: 8030443 - DNA, 22 bp, Homo sapiens
tgcaggtggccatcttcgttct

SEQ ID NO: 8030444 - DNA, 22 bp, Homo sapiens
tgcaggtggctccagggactgc

SEQ ID NO: 8030445 - DNA, 22 bp, Homo sapiens
tgcaggtggcagcggggcacca

SEQ ID NO: 8030446 - DNA, 22 bp, Homo sapiens
tgcaggtggcagcggggcacca

SEQ ID NO: 8030447 - DNA, 22 bp, Homo sapiens
tgcaggtggcagcggggcacca

SEQ ID NO: 8030448 - DNA, 22 bp, Homo sapiens
tgcaggtggattcaatgtggga

SEQ ID NO: 8030449 - DNA, 22 bp, Homo sapiens
tgcaggtggatatctcatcaga

SEQ ID NO: 8030450 - DNA, 22 bp, Homo sapiens
tgcaggtggatatctcatcaga

SEQ ID NO: 8030451 - DNA, 22 bp, Homo sapiens
tgcaggtaaatttgtggaggat

SEQ ID NO: 8030452 - DNA, 22 bp, Homo sapiens
tgcaggtaaatttgtggaggat

SEQ ID NO: 8030453 - DNA, 22 bp, Homo sapiens
tgcaggtacttgacaacttggg

SEQ ID NO: 8030454 - DNA, 22 bp, Homo sapiens
tgcagggtgtccggaggatcac

SEQ ID NO: 8030455 - DNA, 22 bp, Homo sapiens
tgcagggtgtccggaggatcac

SEQ ID NO: 8030456 - DNA, 22 bp, Homo sapiens
tgcagggtgtccggaggatcac

SEQ ID NO: 8030457 - DNA, 22 bp, Homo sapiens
tgcaggtctccattggcagact

SEQ ID NO: 8030458 - DNA, 22 bp, Homo sapiens
tgcaggtgaaaattatgaggat

SEQ ID NO: 8030459 - DNA, 22 bp, Homo sapiens
tgcaggtctctgcaaggcctat

SEQ ID NO: 8030460 - DNA, 22 bp, Homo sapiens
tgcaggtctctgcaaggcctat

SEQ ID NO: 8030461 - DNA, 22 bp, Homo sapiens
tgcaggtctccattggcagact

SEQ ID NO: 8030462 - DNA, 22 bp, Homo sapiens
tgcaggtctccattggcagact

SEQ ID NO: 8030463 - DNA, 22 bp, Homo sapiens
tgcaggtgagtgcaggggctca

SEQ ID NO: 8030464 - DNA, 22 bp, Homo sapiens
tgcaggtgagtgcaggggctca

SEQ ID NO: 8030465 - DNA, 22 bp, Homo sapiens
tgcaggtgacaccactcttcct

SEQ ID NO: 8030466 - DNA, 22 bp, Homo sapiens
tgcaggtgagtgcaggggctca

SEQ ID NO: 8030467 - DNA, 22 bp, Homo sapiens
tgcaggtgacaccactcttcct

SEQ ID NO: 8030468 - DNA, 22 bp, Homo sapiens
tgcaggtgaaaattatgaggat

SEQ ID NO: 8030469 - DNA, 22 bp, Homo sapiens
tgcagtggttgagagcccagac

SEQ ID NO: 8030470 - DNA, 22 bp, Homo sapiens
tgcagtggttgagagcccagac

SEQ ID NO: 8030471 - DNA, 21 bp, Homo sapiens
tgcagtgtccctaacagtggt

SEQ ID NO: 8030472 - DNA, 23 bp, Homo sapiens
tgcagtgtagcatctacgaagct

SEQ ID NO: 8030473 - DNA, 21 bp, Homo sapiens
tgcagtgtccctaacagtggt

SEQ ID NO: 8030474 - DNA, 22 bp, Homo sapiens
tgcagtgtagaaaaagagtgag

SEQ ID NO: 8030475 - DNA, 20 bp, Homo sapiens
tgcagtgtcctcacttgtca

SEQ ID NO: 8030476 - DNA, 20 bp, Homo sapiens
tgcagtgtcctcacttgtca

SEQ ID NO: 8030477 - DNA, 23 bp, Homo sapiens
tgcagtgtcgctgcgagcccggc

SEQ ID NO: 8030478 - DNA, 22 bp, Homo sapiens
tgcagtgtcttgtggacttgag

SEQ ID NO: 8030479 - DNA, 22 bp, Homo sapiens
tgcagtgtgctagatttggact

SEQ ID NO: 8030480 - DNA, 22 bp, Homo sapiens
tgcagtgtgattttctggctga

SEQ ID NO: 8030481 - DNA, 22 bp, Homo sapiens
tgcagtgtgacctgtagcgagc

SEQ ID NO: 8030482 - DNA, 22 bp, Homo sapiens
tgcagtgtgacctgtagcgagc

SEQ ID NO: 8030483 - DNA, 22 bp, Homo sapiens
tgcagtgtgacctgtagcgagc

SEQ ID NO: 8030484 - DNA, 22 bp, Homo sapiens
tgcagtgtgaggtccacatctg

SEQ ID NO: 8030485 - DNA, 23 bp, Homo sapiens
tgcagtgtttaacaatgacttga

SEQ ID NO: 8030486 - DNA, 23 bp, Homo sapiens
tgcagtgtttaacaatgacttga

SEQ ID NO: 8030487 - DNA, 22 bp, Homo sapiens
tgcagtgtttccagatattgtc

SEQ ID NO: 8030488 - DNA, 22 bp, Homo sapiens
tgcagtgttcctgtgggtttat

SEQ ID NO: 8030489 - DNA, 22 bp, Homo sapiens
tgcagtgtttttcagggcatat

SEQ ID NO: 8030490 - DNA, 22 bp, Homo sapiens
tgcagtgtttggatgctgagtc

SEQ ID NO: 8030491 - DNA, 22 bp, Homo sapiens
tgcagtgtttggatgctgagtc

SEQ ID NO: 8030492 - DNA, 22 bp, Homo sapiens
tgcagtgttcctgtagcctgcc

SEQ ID NO: 8030493 - DNA, 22 bp, Homo sapiens
tgcagtgttcctgtagcctgcc

SEQ ID NO: 8030494 - DNA, 22 bp, Homo sapiens
tgcagtgttcctgtgggtttat

SEQ ID NO: 8030495 - DNA, 22 bp, Homo sapiens
tgcagtgtggccatgtcagcta

SEQ ID NO: 8030496 - DNA, 22 bp, Homo sapiens
tgcagtgtggccatgtcagcta

SEQ ID NO: 8030497 - DNA, 22 bp, Homo sapiens
tgcagtgttcagtgatctctcc

SEQ ID NO: 8030498 - DNA, 22 bp, Homo sapiens
tgcagtgtggccatgtcagcta

SEQ ID NO: 8030499 - DNA, 22 bp, Homo sapiens
tgcagtgtggccatgtcagcta

SEQ ID NO: 8030500 - DNA, 20 bp, Homo sapiens
tgcagtgtggaagactgaga

SEQ ID NO: 8030501 - DNA, 22 bp, Homo sapiens
tgcagtgtgctagatttggact

SEQ ID NO: 8030502 - DNA, 22 bp, Homo sapiens
tgcagtcctaaatatatagctg

SEQ ID NO: 8030503 - DNA, 22 bp, Homo sapiens
tgcagtccctggcccactttaa

SEQ ID NO: 8030504 - DNA, 21 bp, Homo sapiens
tgcagtatgtatttgtatcca

SEQ ID NO: 8030505 - DNA, 22 bp, Homo sapiens
tgcagtaggcacgtggctgtga

SEQ ID NO: 8030506 - DNA, 23 bp, Homo sapiens
tgcagtaggatggggctgggcct

SEQ ID NO: 8030507 - DNA, 22 bp, Homo sapiens
tgcagtacagtataatcttgct

SEQ ID NO: 8030508 - DNA, 22 bp, Homo sapiens
tgcaggttctgaccagccaact

SEQ ID NO: 8030509 - DNA, 20 bp, Homo sapiens
tgcaggtgttggagaaggta

SEQ ID NO: 8030510 - DNA, 22 bp, Homo sapiens
tgcagtggcgccatctcagctc

SEQ ID NO: 8030511 - DNA, 22 bp, Homo sapiens
tgcagtgggccggaggccaggg

SEQ ID NO: 8030512 - DNA, 22 bp, Homo sapiens
tgcagtctctagtttctgaatg

SEQ ID NO: 8030513 - DNA, 22 bp, Homo sapiens
tgcagtgggccggaggccaggg

SEQ ID NO: 8030514 - DNA, 22 bp, Homo sapiens
tgcagtggtggtaaagatgctc

SEQ ID NO: 8030515 - DNA, 22 bp, Homo sapiens
tgcagtggtgtccaggtgtact

SEQ ID NO: 8030516 - DNA, 22 bp, Homo sapiens
tgcaggtggtttggacactgct

SEQ ID NO: 8030517 - DNA, 22 bp, Homo sapiens
tgcaggtggtccttcctctgct

SEQ ID NO: 8030518 - DNA, 22 bp, Homo sapiens
tgcaggtggtccttcctctgct

SEQ ID NO: 8030519 - DNA, 22 bp, Homo sapiens
tgcaggtggtccttcctctgct

SEQ ID NO: 8030520 - DNA, 22 bp, Homo sapiens
tgcaggtggtccttcctctgct

SEQ ID NO: 8030521 - DNA, 22 bp, Homo sapiens
tgcaggtggtccatttgggaac

SEQ ID NO: 8030522 - DNA, 22 bp, Homo sapiens
tgcaggtggtacttctttttct

SEQ ID NO: 8030523 - DNA, 20 bp, Homo sapiens
tgcaggtgggcccttctggg

SEQ ID NO: 8030524 - DNA, 20 bp, Homo sapiens
tgcaggtgggcccttctggg

SEQ ID NO: 8030525 - DNA, 20 bp, Homo sapiens
tgcaggtgggcccttctggg

SEQ ID NO: 8030526 - DNA, 22 bp, Homo sapiens
tgcaggtggctccagggactgc

SEQ ID NO: 8030527 - DNA, 20 bp, Homo sapiens
tgcaggtgggcccttctggg

SEQ ID NO: 8030528 - DNA, 22 bp, Homo sapiens
tgcaggtgtctccagggcaggt

SEQ ID NO: 8030529 - DNA, 22 bp, Homo sapiens
tgcaggtgtctccagggcaggt

SEQ ID NO: 8030530 - DNA, 22 bp, Homo sapiens
tgcaggtgtagagttgggctcc

SEQ ID NO: 8030531 - DNA, 22 bp, Homo sapiens
tgcaggtgtctccagggcaggt

SEQ ID NO: 8030532 - DNA, 22 bp, Homo sapiens
tgcaggtgtctccagggcaggt

SEQ ID NO: 8030533 - DNA, 22 bp, Homo sapiens
tgcaggtgtctccagggcaggt

SEQ ID NO: 8030534 - DNA, 22 bp, Homo sapiens
tgcaggtgtagagttgggctcc

SEQ ID NO: 8030535 - DNA, 22 bp, Homo sapiens
tgcaggtgtagagttgggctcc

SEQ ID NO: 8030536 - DNA, 22 bp, Homo sapiens
tgcaggtgtaaattttcaagag

SEQ ID NO: 8030537 - DNA, 22 bp, Homo sapiens
tgcaggtggtttggacactgct

SEQ ID NO: 8030538 - DNA, 22 bp, Homo sapiens
tgcaggtggtttggacactgct

SEQ ID NO: 8030539 - DNA, 22 bp, Homo sapiens
tgcaggtgtgtgcaagggaggg

SEQ ID NO: 8030540 - DNA, 20 bp, Homo sapiens
tgcaggtgtgtccaagcact

SEQ ID NO: 8030541 - DNA, 20 bp, Homo sapiens
tgcaggtgttggagaaggta

SEQ ID NO: 8030542 - DNA, 22 bp, Homo sapiens
tgcaggtgtgtgcaagggaggg

SEQ ID NO: 8030543 - DNA, 22 bp, Homo sapiens
tgcaggtgtggttcctcagcca

SEQ ID NO: 8030544 - DNA, 22 bp, Homo sapiens
tgcaggtgtgggcaggggagca

SEQ ID NO: 8030545 - DNA, 22 bp, Homo sapiens
tgcaggtgtggttcctcagcca

SEQ ID NO: 8030546 - DNA, 22 bp, Homo sapiens
tgcaggtgtgggcaggggagca

SEQ ID NO: 8030547 - DNA, 22 bp, Homo sapiens
tgcaggtgtggttcctcagcca

SEQ ID NO: 8030548 - DNA, 22 bp, Homo sapiens
tgcaggtgtggttcctcagcca

SEQ ID NO: 8030549 - DNA, 22 bp, Homo sapiens
tgcaggtgtgggcaggggagca

SEQ ID NO: 8030550 - DNA, 23 bp, Homo sapiens
tgcaggtgtgcagagggctcttg

SEQ ID NO: 8030551 - DNA, 22 bp, Homo sapiens
tgcaggtgtctgggggcaacag

SEQ ID NO: 8030552 - DNA, 22 bp, Homo sapiens
tgcaggtgtgggcaggggagca

SEQ ID NO: 8030553 - DNA, 22 bp, Homo sapiens
tgcaggtgtgggcaggggagca

SEQ ID NO: 8030554 - DNA, 22 bp, Homo sapiens
tgcaggtgtgggcaggggagca

SEQ ID NO: 8030555 - DNA, 23 bp, Homo sapiens
tgcaggtgtgcagagggctcttg

SEQ ID NO: 8030556 - DNA, 22 bp, Homo sapiens
tgcaggtgtctctgtctagcgt

SEQ ID NO: 8030557 - DNA, 22 bp, Homo sapiens
tgcaggtgtctctgtctagcgt

SEQ ID NO: 8030558 - DNA, 22 bp, Homo sapiens
tgcagggattgttggcatccat

SEQ ID NO: 8030559 - DNA, 22 bp, Homo sapiens
tgcagggattgttggcatccat

SEQ ID NO: 8030560 - DNA, 22 bp, Homo sapiens
tgcagggattgttggcatccat

SEQ ID NO: 8030561 - DNA, 22 bp, Homo sapiens
tgcagggattgttggcatccat

SEQ ID NO: 8030562 - DNA, 22 bp, Homo sapiens
tgcagggattatgtaggggttg

SEQ ID NO: 8030563 - DNA, 22 bp, Homo sapiens
tgcagggattatgtaggggttg

SEQ ID NO: 8030564 - DNA, 22 bp, Homo sapiens
tgcagggattatgtaggggttg

SEQ ID NO: 8030565 - DNA, 22 bp, Homo sapiens
tgcagggattgttggcatccat

SEQ ID NO: 8030566 - DNA, 23 bp, Homo sapiens
tgcagggcaagttagagacccca

SEQ ID NO: 8030567 - DNA, 22 bp, Homo sapiens
tgcagggcacacgcacgggtgt

SEQ ID NO: 8030568 - DNA, 23 bp, Homo sapiens
tgcagggcaagttagagacccca

SEQ ID NO: 8030569 - DNA, 23 bp, Homo sapiens
tgcagggcaagttagagacccca

SEQ ID NO: 8030570 - DNA, 22 bp, Homo sapiens
tgcagggattagaggccgggga

SEQ ID NO: 8030571 - DNA, 22 bp, Homo sapiens
tgcagggattagaggccgggga

SEQ ID NO: 8030572 - DNA, 22 bp, Homo sapiens
tgcagggattatgtaggggttg

SEQ ID NO: 8030573 - DNA, 22 bp, Homo sapiens
tgcagggattatgtaggggttg

SEQ ID NO: 8030574 - DNA, 22 bp, Homo sapiens
tgcagggattagaggccgggga

SEQ ID NO: 8030575 - DNA, 22 bp, Homo sapiens
tgcagggattagaggccgggga

SEQ ID NO: 8030576 - DNA, 22 bp, Homo sapiens
tgcagggatgctagaggtaaga

SEQ ID NO: 8030577 - DNA, 22 bp, Homo sapiens
tgcagggatgctagaggtaaga

SEQ ID NO: 8030578 - DNA, 22 bp, Homo sapiens
tgcagggatgctagaggtaaga

SEQ ID NO: 8030579 - DNA, 22 bp, Homo sapiens
tgcagggatgctagaggtaaga

SEQ ID NO: 8030580 - DNA, 22 bp, Homo sapiens
tgcagggatgctagaggtaaga

SEQ ID NO: 8030581 - DNA, 21 bp, Homo sapiens
tgcagggatctttctgcctga

SEQ ID NO: 8030582 - DNA, 21 bp, Homo sapiens
tgcagggatctttctgcctga

SEQ ID NO: 8030583 - DNA, 21 bp, Homo sapiens
tgcagggatctttctgcctga

SEQ ID NO: 8030584 - DNA, 22 bp, Homo sapiens
tgcagggcacggtgcgcgtggg

SEQ ID NO: 8030585 - DNA, 22 bp, Homo sapiens
tgcagggcacggtgcgcgtggg

SEQ ID NO: 8030586 - DNA, 22 bp, Homo sapiens
tgcagggcagatatgactgtag

SEQ ID NO: 8030587 - DNA, 22 bp, Homo sapiens
tgcagggcagatatgactgtag

SEQ ID NO: 8030588 - DNA, 22 bp, Homo sapiens
tgcagggcacacgcacgggtgt

SEQ ID NO: 8030589 - DNA, 22 bp, Homo sapiens
tgcagggcacggtgcgcgtggg

SEQ ID NO: 8030590 - DNA, 22 bp, Homo sapiens
tgcagggcacacgcacgggtgt

SEQ ID NO: 8030591 - DNA, 22 bp, Homo sapiens
tgcagggcacacgcacgggtgt

SEQ ID NO: 8030592 - DNA, 22 bp, Homo sapiens
tgcagggcacacgcacgggtgt

SEQ ID NO: 8030593 - DNA, 22 bp, Homo sapiens
tgcagggcagctagggagcttt

SEQ ID NO: 8030594 - DNA, 22 bp, Homo sapiens
tgcagggcagctagggagcttt

SEQ ID NO: 8030595 - DNA, 22 bp, Homo sapiens
tgcagggcacggtgcgcgtggg

SEQ ID NO: 8030596 - DNA, 22 bp, Homo sapiens
tgcagggcagctagggagcttt

SEQ ID NO: 8030597 - DNA, 22 bp, Homo sapiens
tgcagggcagatatgactgtag

SEQ ID NO: 8030598 - DNA, 22 bp, Homo sapiens
tgcagggcagtggaggttgagt

SEQ ID NO: 8030599 - DNA, 22 bp, Homo sapiens
tgcagggcagtggaggttgagt

SEQ ID NO: 8030600 - DNA, 22 bp, Homo sapiens
tgcagggcagtggaggttgagt

SEQ ID NO: 8030601 - DNA, 22 bp, Homo sapiens
tgcagggcagtggaggttgagt

SEQ ID NO: 8030602 - DNA, 22 bp, Homo sapiens
tgcagggcagtggaggttgagt

SEQ ID NO: 8030603 - DNA, 22 bp, Homo sapiens
tgcagggcagctagggagcttt

SEQ ID NO: 8030604 - DNA, 22 bp, Homo sapiens
tgcagggcccctctgcatgagt

SEQ ID NO: 8030605 - DNA, 22 bp, Homo sapiens
tgcagggcccctctgcatgagt

SEQ ID NO: 8030606 - DNA, 22 bp, Homo sapiens
tgcagggcccctctgcatgagt

SEQ ID NO: 8030607 - DNA, 22 bp, Homo sapiens
tgcagggcccctctgcatgagt

SEQ ID NO: 8030608 - DNA, 22 bp, Homo sapiens
tgcagggccctcattcctgtcc

SEQ ID NO: 8030609 - DNA, 22 bp, Homo sapiens
tgcagggcccttggggttgaac

SEQ ID NO: 8030610 - DNA, 22 bp, Homo sapiens
tgcagggcccttggggttgaac

SEQ ID NO: 8030611 - DNA, 22 bp, Homo sapiens
tgcagggccgctggaggtcatg

SEQ ID NO: 8030612 - DNA, 22 bp, Homo sapiens
tgcagggcccctctgcatgagt

SEQ ID NO: 8030613 - DNA, 22 bp, Homo sapiens
tgcagggctataactccattct

SEQ ID NO: 8030614 - DNA, 22 bp, Homo sapiens
tgcagggctacaggactacaac

SEQ ID NO: 8030615 - DNA, 22 bp, Homo sapiens
tgcagggctcctggctccaatc

SEQ ID NO: 8030616 - DNA, 22 bp, Homo sapiens
tgcagggctcctggctccaatc

SEQ ID NO: 8030617 - DNA, 22 bp, Homo sapiens
tgcagggctcctggctccaatc

SEQ ID NO: 8030618 - DNA, 22 bp, Homo sapiens
tgcagggctataactccattct

SEQ ID NO: 8030619 - DNA, 22 bp, Homo sapiens
tgcagggccgctggaggtcatg

SEQ ID NO: 8030620 - DNA, 22 bp, Homo sapiens
tgcagggccgctggaggtcatg

SEQ ID NO: 8030621 - DNA, 22 bp, Homo sapiens
tgcagggccgctggaggtcatg

SEQ ID NO: 8030622 - DNA, 22 bp, Homo sapiens
tgcagggctacaggactacaac

SEQ ID NO: 8030623 - DNA, 22 bp, Homo sapiens
tgcagggccgctggaggtcatg

SEQ ID NO: 8030624 - DNA, 22 bp, Homo sapiens
tgcagggctacaggactacaac

SEQ ID NO: 8030625 - DNA, 22 bp, Homo sapiens
tgcagggccatggtggcggctg

SEQ ID NO: 8030626 - DNA, 22 bp, Homo sapiens
tgcagggcccctctgcatgagt

SEQ ID NO: 8030627 - DNA, 22 bp, Homo sapiens
tgcagggccatggtggcggctg

SEQ ID NO: 8030628 - DNA, 22 bp, Homo sapiens
tgcagggccatggtggcggctg

SEQ ID NO: 8030629 - DNA, 22 bp, Homo sapiens
tgcagggccatggtggcggctg

SEQ ID NO: 8030630 - DNA, 22 bp, Homo sapiens
tgcagggccagactgggttgga

SEQ ID NO: 8030631 - DNA, 22 bp, Homo sapiens
tgcagggccagactgggttgga

SEQ ID NO: 8030632 - DNA, 22 bp, Homo sapiens
tgcagggccagactgggttgga

SEQ ID NO: 8030633 - DNA, 22 bp, Homo sapiens
tgcagggccatggtggcggctg

SEQ ID NO: 8030634 - DNA, 22 bp, Homo sapiens
tgcagggccagactgggttgga

SEQ ID NO: 8030635 - DNA, 22 bp, Homo sapiens
tgcagggcatagggtccagttt

SEQ ID NO: 8030636 - DNA, 22 bp, Homo sapiens
tgcagggcatagggtccagttt

SEQ ID NO: 8030637 - DNA, 22 bp, Homo sapiens
tgcagggcagtttgtttcggca

SEQ ID NO: 8030638 - DNA, 22 bp, Homo sapiens
tgcagggcagtggaggttgagt

SEQ ID NO: 8030639 - DNA, 22 bp, Homo sapiens
tgcagggcatctttgaagtgtg

SEQ ID NO: 8030640 - DNA, 22 bp, Homo sapiens
tgcagggcatctttgaagtgtg

SEQ ID NO: 8030641 - DNA, 22 bp, Homo sapiens
tgcagggcatctttgaagtgtg

SEQ ID NO: 8030642 - DNA, 22 bp, Homo sapiens
tgcagggaagtcccagctcctg

SEQ ID NO: 8030643 - DNA, 22 bp, Homo sapiens
tgcagggaagtcccagctcctg

SEQ ID NO: 8030644 - DNA, 22 bp, Homo sapiens
tgcagggaatccagtctagggt

SEQ ID NO: 8030645 - DNA, 22 bp, Homo sapiens
tgcagggaatccagtctagggt

SEQ ID NO: 8030646 - DNA, 22 bp, Homo sapiens
tgcagggaatccagtctagggt

SEQ ID NO: 8030647 - DNA, 22 bp, Homo sapiens
tgcagggaatccagtctagggt

SEQ ID NO: 8030648 - DNA, 22 bp, Homo sapiens
tgcagggatcctagctgaagag

SEQ ID NO: 8030649 - DNA, 22 bp, Homo sapiens
tgcagggaatccagtctagggt

SEQ ID NO: 8030650 - DNA, 22 bp, Homo sapiens
tgcagggaagcaagggtggctc

SEQ ID NO: 8030651 - DNA, 22 bp, Homo sapiens
tgcagggaagcaagggtggctc

SEQ ID NO: 8030652 - DNA, 22 bp, Homo sapiens
tgcagggaagtcccagctcctg

SEQ ID NO: 8030653 - DNA, 22 bp, Homo sapiens
tgcagggaagtcccagctcctg

SEQ ID NO: 8030654 - DNA, 22 bp, Homo sapiens
tgcagggaagtcccagctcctg

SEQ ID NO: 8030655 - DNA, 22 bp, Homo sapiens
tgcagggaaagtgttggcagca

SEQ ID NO: 8030656 - DNA, 22 bp, Homo sapiens
tgcagggaaagtgttggcagca

SEQ ID NO: 8030657 - DNA, 22 bp, Homo sapiens
tgcagggaaagtgttggcagca

SEQ ID NO: 8030658 - DNA, 22 bp, Homo sapiens
tgcagggaaagggcactgggct

SEQ ID NO: 8030659 - DNA, 22 bp, Homo sapiens
tgcagggaaagggcactgggct

SEQ ID NO: 8030660 - DNA, 22 bp, Homo sapiens
tgcagggaaagggcactgggct

SEQ ID NO: 8030661 - DNA, 22 bp, Homo sapiens
tgcagggaacttggacagctag

SEQ ID NO: 8030662 - DNA, 22 bp, Homo sapiens
tgcagggaacttggacagctag

SEQ ID NO: 8030663 - DNA, 22 bp, Homo sapiens
tgcagggaacttggacagctag

SEQ ID NO: 8030664 - DNA, 22 bp, Homo sapiens
tgcagggaaagtgttggcagca

SEQ ID NO: 8030665 - DNA, 22 bp, Homo sapiens
tgcagggaacttggacagctag

SEQ ID NO: 8030666 - DNA, 22 bp, Homo sapiens
tgcagggaacttggacagctag

SEQ ID NO: 8030667 - DNA, 22 bp, Homo sapiens
tgcagggaacttggacagctag

SEQ ID NO: 8030668 - DNA, 22 bp, Homo sapiens
tgcagggaacttggacagctag

SEQ ID NO: 8030669 - DNA, 22 bp, Homo sapiens
tgcagggaaaacccaggatgct

SEQ ID NO: 8030670 - DNA, 22 bp, Homo sapiens
tgcagggaaaacccaggatgct

SEQ ID NO: 8030671 - DNA, 22 bp, Homo sapiens
tgcagggaaaacccaggatgct

SEQ ID NO: 8030672 - DNA, 22 bp, Homo sapiens
tgcagggaaaacccaggatgct

SEQ ID NO: 8030673 - DNA, 22 bp, Homo sapiens
tgcaggctttagccccatggct

SEQ ID NO: 8030674 - DNA, 22 bp, Homo sapiens
tgcaggctttagccccatggct

SEQ ID NO: 8030675 - DNA, 20 bp, Homo sapiens
tgcaggcttcgctctaggag

SEQ ID NO: 8030676 - DNA, 17 bp, Homo sapiens
tgcaggctgttatagcc

SEQ ID NO: 8030677 - DNA, 21 bp, Homo sapiens
tgcaggctgtttaagaggcaa

SEQ ID NO: 8030678 - DNA, 21 bp, Homo sapiens
tgcaggctgtttaagaggcaa

SEQ ID NO: 8030679 - DNA, 21 bp, Homo sapiens
tgcaggctgtttaagaggcaa

SEQ ID NO: 8030680 - DNA, 21 bp, Homo sapiens
tgcaggctgtgcgctcctgcc

SEQ ID NO: 8030681 - DNA, 21 bp, Homo sapiens
tgcaggctgtgcgctcctgcc

SEQ ID NO: 8030682 - DNA, 21 bp, Homo sapiens
tgcaggctgtgcgctcctgcc

SEQ ID NO: 8030683 - DNA, 22 bp, Homo sapiens
tgcaggctgtaatctgaggcta

SEQ ID NO: 8030684 - DNA, 22 bp, Homo sapiens
tgcaggctgtaatctgaggcta

SEQ ID NO: 8030685 - DNA, 21 bp, Homo sapiens
tgcaggctgtgcgctcctgcc

SEQ ID NO: 8030686 - DNA, 21 bp, Homo sapiens
tgcaggctgtgcgctcctgcc

SEQ ID NO: 8030687 - DNA, 21 bp, Homo sapiens
tgcaggctgtgcgctcctgcc

SEQ ID NO: 8030688 - DNA, 21 bp, Homo sapiens
tgcaggctgtgcgctcctgcc

SEQ ID NO: 8030689 - DNA, 21 bp, Homo sapiens
tgcaggctgtgcgctcctgcc

SEQ ID NO: 8030690 - DNA, 22 bp, Homo sapiens
tgcaggctctctgctgccagat

SEQ ID NO: 8030691 - DNA, 22 bp, Homo sapiens
tgcaggctctctgctgccagat

SEQ ID NO: 8030692 - DNA, 17 bp, Homo sapiens
tgcaggctcctgtccct

SEQ ID NO: 8030693 - DNA, 22 bp, Homo sapiens
tgcaggctctctgctgccagat

SEQ ID NO: 8030694 - DNA, 22 bp, Homo sapiens
tgcaggctctctgctgccagat

SEQ ID NO: 8030695 - DNA, 22 bp, Homo sapiens
tgcaggctctctgctgccagat

SEQ ID NO: 8030696 - DNA, 22 bp, Homo sapiens
tgcaggctccatgaggacaggc

SEQ ID NO: 8030697 - DNA, 17 bp, Homo sapiens
tgcaggctcctgtccct

SEQ ID NO: 8030698 - DNA, 22 bp, Homo sapiens
tgcaggctccatgaggacaggc

SEQ ID NO: 8030699 - DNA, 22 bp, Homo sapiens
tgcaggctccatgaggacaggc

SEQ ID NO: 8030700 - DNA, 22 bp, Homo sapiens
tgcaggctccatgaggacaggc

SEQ ID NO: 8030701 - DNA, 22 bp, Homo sapiens
tgcaggctctgtgtgtgcctgg

SEQ ID NO: 8030702 - DNA, 22 bp, Homo sapiens
tgcaggctgaggctggctcaac

SEQ ID NO: 8030703 - DNA, 22 bp, Homo sapiens
tgcaggctcttggtgacgtggg

SEQ ID NO: 8030704 - DNA, 22 bp, Homo sapiens
tgcaggctctgtgtgtgcctgg

SEQ ID NO: 8030705 - DNA, 22 bp, Homo sapiens
tgcaggctctgtgtgtgcctgg

SEQ ID NO: 8030706 - DNA, 22 bp, Homo sapiens
tgcaggctctgtgtgtgcctgg

SEQ ID NO: 8030707 - DNA, 22 bp, Homo sapiens
tgcaggctgaggctggctcaac

SEQ ID NO: 8030708 - DNA, 22 bp, Homo sapiens
tgcaggctgcagtctcaggtgg

SEQ ID NO: 8030709 - DNA, 22 bp, Homo sapiens
tgcaggctgcagtctcaggtgg

SEQ ID NO: 8030710 - DNA, 22 bp, Homo sapiens
tgcaggctgccttcacagagcc

SEQ ID NO: 8030711 - DNA, 22 bp, Homo sapiens
tgcaggctgctggcagtagctt

SEQ ID NO: 8030712 - DNA, 22 bp, Homo sapiens
tgcaggctgctggcagtagctt

SEQ ID NO: 8030713 - DNA, 22 bp, Homo sapiens
tgcaggctgccttcacagagcc

SEQ ID NO: 8030714 - DNA, 22 bp, Homo sapiens
tgcaggctgccttcacagagcc

SEQ ID NO: 8030715 - DNA, 22 bp, Homo sapiens
tgcaggctgccttcacagagcc

SEQ ID NO: 8030716 - DNA, 22 bp, Homo sapiens
tgcaggctggcagtgctgaaat

SEQ ID NO: 8030717 - DNA, 22 bp, Homo sapiens
tgcaggctggaggagggactaa

SEQ ID NO: 8030718 - DNA, 22 bp, Homo sapiens
tgcaggctgctggcagtagctt

SEQ ID NO: 8030719 - DNA, 22 bp, Homo sapiens
tgcaggctgctggcagtagctt

SEQ ID NO: 8030720 - DNA, 22 bp, Homo sapiens
tgcaggctggcagtgctgaaat

SEQ ID NO: 8030721 - DNA, 22 bp, Homo sapiens
tgcaggctggggaggcagactt

SEQ ID NO: 8030722 - DNA, 22 bp, Homo sapiens
tgcaggctggggaggcagactt

SEQ ID NO: 8030723 - DNA, 22 bp, Homo sapiens
tgcaggctggggaggcagactt

SEQ ID NO: 8030724 - DNA, 22 bp, Homo sapiens
tgcaggctgggaagagggacaa

SEQ ID NO: 8030725 - DNA, 22 bp, Homo sapiens
tgcaggctgtaatctgaggcta

SEQ ID NO: 8030726 - DNA, 22 bp, Homo sapiens
tgcaggctggggaggcagactt

SEQ ID NO: 8030727 - DNA, 22 bp, Homo sapiens
tgcaggctggggaggcagactt

SEQ ID NO: 8030728 - DNA, 22 bp, Homo sapiens
tgcaggctggggaggcagactt

SEQ ID NO: 8030729 - DNA, 22 bp, Homo sapiens
tgcaggctggggaggcagactt

SEQ ID NO: 8030730 - DNA, 22 bp, Homo sapiens
tgcctaggctggagtgtagtgg

SEQ ID NO: 8030731 - DNA, 22 bp, Homo sapiens
tgcctaggctggagtgtagtgg

SEQ ID NO: 8030732 - DNA, 22 bp, Homo sapiens
tgcctaggctggagtgtagtgg

SEQ ID NO: 8030733 - DNA, 22 bp, Homo sapiens
tgcctagggcctaaccagagcc

SEQ ID NO: 8030734 - DNA, 22 bp, Homo sapiens
tgcctagggcctaaccagagcc

SEQ ID NO: 8030735 - DNA, 22 bp, Homo sapiens
tgcctagtagggttgttgtagg

SEQ ID NO: 8030736 - DNA, 22 bp, Homo sapiens
tgcctaggaaacctcatgcttc

SEQ ID NO: 8030737 - DNA, 22 bp, Homo sapiens
tgcctagaactttattctttat

SEQ ID NO: 8030738 - DNA, 22 bp, Homo sapiens
tgcctactagtactattttgtg

SEQ ID NO: 8030739 - DNA, 22 bp, Homo sapiens
tgcctaggaaacctcatgcttc

SEQ ID NO: 8030740 - DNA, 22 bp, Homo sapiens
tgcctaggctggagtgcaatgg

SEQ ID NO: 8030741 - DNA, 22 bp, Homo sapiens
tgcctaggctggagtgcagtga

SEQ ID NO: 8030742 - DNA, 22 bp, Homo sapiens
tgcctcagagtgggcttgctat

SEQ ID NO: 8030743 - DNA, 22 bp, Homo sapiens
tgcctcagagacctgacagtac

SEQ ID NO: 8030744 - DNA, 22 bp, Homo sapiens
tgcctcagagacctgacagtac

SEQ ID NO: 8030745 - DNA, 22 bp, Homo sapiens
tgcctcagagacctgacagtac

SEQ ID NO: 8030746 - DNA, 22 bp, Homo sapiens
tgcctcagagacctgacagtac

SEQ ID NO: 8030747 - DNA, 22 bp, Homo sapiens
tgcctcagagacctgacagtac

SEQ ID NO: 8030748 - DNA, 22 bp, Homo sapiens
tgcctcagagacctgacagtac

SEQ ID NO: 8030749 - DNA, 22 bp, Homo sapiens
tgcctcaagccctccactgcac

SEQ ID NO: 8030750 - DNA, 22 bp, Homo sapiens
tgcctatttacttcacagttga

SEQ ID NO: 8030751 - DNA, 22 bp, Homo sapiens
tgcctagttctgtatttacagt

SEQ ID NO: 8030752 - DNA, 22 bp, Homo sapiens
tgcctagttctgtatttacagt

SEQ ID NO: 8030753 - DNA, 22 bp, Homo sapiens
tgcctagtggccttatgagtat

SEQ ID NO: 8030754 - DNA, 20 bp, Homo sapiens
tgcctataaagggccaggta

SEQ ID NO: 8030755 - DNA, 22 bp, Homo sapiens
tgcctattcaatatatgcattt

SEQ ID NO: 8030756 - DNA, 21 bp, Homo sapiens
tgcctatatgaaaggggtgtt

SEQ ID NO: 8030757 - DNA, 22 bp, Homo sapiens
tgcctaccctgcccgcagacac

SEQ ID NO: 8030758 - DNA, 22 bp, Homo sapiens
tgcctactagtactattttgtg

SEQ ID NO: 8030759 - DNA, 22 bp, Homo sapiens
tgcctaactccaccaggcaggt

SEQ ID NO: 8030760 - DNA, 22 bp, Homo sapiens
tgcctaaaccattccccttcct

SEQ ID NO: 8030761 - DNA, 22 bp, Homo sapiens
tgcctaaacagtccccaaatta

SEQ ID NO: 8030762 - DNA, 23 bp, Homo sapiens
tgccgtgttagaaatgttttaca

SEQ ID NO: 8030763 - DNA, 22 bp, Homo sapiens
tgccgtgtcccattgtgctctg

SEQ ID NO: 8030764 - DNA, 22 bp, Homo sapiens
tgccgtggggctgaggctggag

SEQ ID NO: 8030765 - DNA, 22 bp, Homo sapiens
tgccgtggggctgaggctggag

SEQ ID NO: 8030766 - DNA, 22 bp, Homo sapiens
tgccgtggggctgaggctggag

SEQ ID NO: 8030767 - DNA, 22 bp, Homo sapiens
tgccgtggggctgaggctggag

SEQ ID NO: 8030768 - DNA, 20 bp, Homo sapiens
tgccgggcagcctgaggagt

SEQ ID NO: 8030769 - DNA, 22 bp, Homo sapiens
tgccgtggggctgaggctggag

SEQ ID NO: 8030770 - DNA, 22 bp, Homo sapiens
tgccgcagtgcggggagggccc

SEQ ID NO: 8030771 - DNA, 22 bp, Homo sapiens
tgccgcagtgcggggagggccc

SEQ ID NO: 8030772 - DNA, 22 bp, Homo sapiens
tgccgcagtgcggggagggccc

SEQ ID NO: 8030773 - DNA, 22 bp, Homo sapiens
tgccgcagtgcggggagggccc

SEQ ID NO: 8030774 - DNA, 22 bp, Homo sapiens
tgccgcagtgcggggagggccc

SEQ ID NO: 8030775 - DNA, 22 bp, Homo sapiens
tgccgcctggtttctccgcccc

SEQ ID NO: 8030776 - DNA, 22 bp, Homo sapiens
tgccgctccaggtctcgcggtg

SEQ ID NO: 8030777 - DNA, 22 bp, Homo sapiens
tgccgctccaggtctcgcggtg

SEQ ID NO: 8030778 - DNA, 22 bp, Homo sapiens
tgccgctccaggtctcgcggtg

SEQ ID NO: 8030779 - DNA, 22 bp, Homo sapiens
tgccgtgcccatattgtgggtg

SEQ ID NO: 8030780 - DNA, 22 bp, Homo sapiens
tgccctttatttctggggcaga

SEQ ID NO: 8030781 - DNA, 22 bp, Homo sapiens
tgcccttgggtaacttgctgat

SEQ ID NO: 8030782 - DNA, 22 bp, Homo sapiens
tgcccttgggtaacttgctgat

SEQ ID NO: 8030783 - DNA, 22 bp, Homo sapiens
tgcccttgggtaacttgctgat

SEQ ID NO: 8030784 - DNA, 22 bp, Homo sapiens
tgcccttgggatttaggtaagg

SEQ ID NO: 8030785 - DNA, 22 bp, Homo sapiens
tgcccttgaggacagctcccag

SEQ ID NO: 8030786 - DNA, 22 bp, Homo sapiens
tgcccttataaaggaggcctga

SEQ ID NO: 8030787 - DNA, 22 bp, Homo sapiens
tgcccttaggaaggctcaccaa

SEQ ID NO: 8030788 - DNA, 22 bp, Homo sapiens
tgcccttatgaaagaggcccaa

SEQ ID NO: 8030789 - DNA, 22 bp, Homo sapiens
tgcccttgaaatacgcttgggg

SEQ ID NO: 8030790 - DNA, 22 bp, Homo sapiens
tgcccttcctctggattgcctt

SEQ ID NO: 8030791 - DNA, 22 bp, Homo sapiens
tgccctgttcctgcctccagct

SEQ ID NO: 8030792 - DNA, 22 bp, Homo sapiens
tgccctgttcctgcctccagct

SEQ ID NO: 8030793 - DNA, 22 bp, Homo sapiens
tgccctgttcctgcctccagct

SEQ ID NO: 8030794 - DNA, 22 bp, Homo sapiens
tgccctgtgtgtgcaagcactg

SEQ ID NO: 8030795 - DNA, 22 bp, Homo sapiens
tgccctgtgggtatctgatggc

SEQ ID NO: 8030796 - DNA, 22 bp, Homo sapiens
tgccctgtgttgggaatccaca

SEQ ID NO: 8030797 - DNA, 22 bp, Homo sapiens
tgccctgttatcttggaagagt

SEQ ID NO: 8030798 - DNA, 22 bp, Homo sapiens
tgccctgttcacttcatggttc

SEQ ID NO: 8030799 - DNA, 20 bp, Homo sapiens
tgccctgtggaggggaaagg

SEQ ID NO: 8030800 - DNA, 20 bp, Homo sapiens
tgccctgtggaggggaaagg

SEQ ID NO: 8030801 - DNA, 22 bp, Homo sapiens
tgccctgtggggatttccagcc

SEQ ID NO: 8030802 - DNA, 22 bp, Homo sapiens
tgccctgtgccagacttcctgg

SEQ ID NO: 8030803 - DNA, 22 bp, Homo sapiens
tgccctgtctaagctgtcagta

SEQ ID NO: 8030804 - DNA, 22 bp, Homo sapiens
tgccctgtgccagacttcctgg

SEQ ID NO: 8030805 - DNA, 17 bp, Homo sapiens
tgccctgtgcctggtgt

SEQ ID NO: 8030806 - DNA, 17 bp, Homo sapiens
tgccctgtgcctggtgt

SEQ ID NO: 8030807 - DNA, 22 bp, Homo sapiens
tgccctgggaacacagatgcca

SEQ ID NO: 8030808 - DNA, 22 bp, Homo sapiens
tgccctgggacatgcagcggag

SEQ ID NO: 8030809 - DNA, 22 bp, Homo sapiens
tgccctgggacatgcagcggag

SEQ ID NO: 8030810 - DNA, 22 bp, Homo sapiens
tgccctgggaggctttcctgtt

SEQ ID NO: 8030811 - DNA, 22 bp, Homo sapiens
tgccctgggaggctttcctgtt

SEQ ID NO: 8030812 - DNA, 22 bp, Homo sapiens
tgccctgggacatgcagcggag

SEQ ID NO: 8030813 - DNA, 22 bp, Homo sapiens
tgccctgggacatgcagcggag

SEQ ID NO: 8030814 - DNA, 22 bp, Homo sapiens
tgccctgggaggctttcctgtt

SEQ ID NO: 8030815 - DNA, 22 bp, Homo sapiens
tgccctgtcgctcactcccacc

SEQ ID NO: 8030816 - DNA, 22 bp, Homo sapiens
tgccctgtcgctcactcccacc

SEQ ID NO: 8030817 - DNA, 22 bp, Homo sapiens
tgccctgtctaagctgtcagta

SEQ ID NO: 8030818 - DNA, 22 bp, Homo sapiens
tgccctgtctaagctgtcagta

SEQ ID NO: 8030819 - DNA, 22 bp, Homo sapiens
tgccctggctcttcttgttcca

SEQ ID NO: 8030820 - DNA, 22 bp, Homo sapiens
tgccctggctggagtgcagtgg

SEQ ID NO: 8030821 - DNA, 22 bp, Homo sapiens
tgccctggctggagtgcagtgg

SEQ ID NO: 8030822 - DNA, 22 bp, Homo sapiens
tgccctggctggagtgcagtgg

SEQ ID NO: 8030823 - DNA, 22 bp, Homo sapiens
tgccctggctggagtgcagtgg

SEQ ID NO: 8030824 - DNA, 22 bp, Homo sapiens
tgccctggctggagtgcagtgg

SEQ ID NO: 8030825 - DNA, 22 bp, Homo sapiens
tgccctggcttcagctttggct

SEQ ID NO: 8030826 - DNA, 22 bp, Homo sapiens
tgccctgggaacacagatgcca

SEQ ID NO: 8030827 - DNA, 22 bp, Homo sapiens
tgccctgggaacacagatgcca

SEQ ID NO: 8030828 - DNA, 22 bp, Homo sapiens
tgccctgggaacacagatgcca

SEQ ID NO: 8030829 - DNA, 22 bp, Homo sapiens
tgccctgggaacacagatgcca

SEQ ID NO: 8030830 - DNA, 22 bp, Homo sapiens
tgccctgggaacacagatgcca

SEQ ID NO: 8030831 - DNA, 22 bp, Homo sapiens
tgccctgggaacacagatgcca

SEQ ID NO: 8030832 - DNA, 22 bp, Homo sapiens
tgccctgggaacacagatgcca

SEQ ID NO: 8030833 - DNA, 22 bp, Homo sapiens
tgccctgggaacacagatgcca

SEQ ID NO: 8030834 - DNA, 22 bp, Homo sapiens
tgccctggaggggcttacagtc

SEQ ID NO: 8030835 - DNA, 22 bp, Homo sapiens
tgccctggaggggcttacagtc

SEQ ID NO: 8030836 - DNA, 22 bp, Homo sapiens
tgccctggaggggcttacagtc

SEQ ID NO: 8030837 - DNA, 22 bp, Homo sapiens
tgccctggaggggcttacagtc

SEQ ID NO: 8030838 - DNA, 22 bp, Homo sapiens
tgccctggagtcagtggctatt

SEQ ID NO: 8030839 - DNA, 22 bp, Homo sapiens
tgccctggaggggcttacagtc

SEQ ID NO: 8030840 - DNA, 22 bp, Homo sapiens
tgccctggagtcagtggctatt

SEQ ID NO: 8030841 - DNA, 22 bp, Homo sapiens
tgccctggaaccatctacagtc

SEQ ID NO: 8030842 - DNA, 22 bp, Homo sapiens
tgccctggaaccatctacagtc

SEQ ID NO: 8030843 - DNA, 22 bp, Homo sapiens
tgccctggaaccatctacagtc

SEQ ID NO: 8030844 - DNA, 22 bp, Homo sapiens
tgccctggaaccatctacagtc

SEQ ID NO: 8030845 - DNA, 22 bp, Homo sapiens
tgccctggaaccatctacagtc

SEQ ID NO: 8030846 - DNA, 22 bp, Homo sapiens
tgccctggaaatgagaggtgtg

SEQ ID NO: 8030847 - DNA, 22 bp, Homo sapiens
tgccctggaaatgagaggtgtg

SEQ ID NO: 8030848 - DNA, 22 bp, Homo sapiens
tgccctggaaccatctacagtc

SEQ ID NO: 8030849 - DNA, 22 bp, Homo sapiens
tgccctggaaatgagaggtgtg

SEQ ID NO: 8030850 - DNA, 22 bp, Homo sapiens
tgccctggaaatgagaggtgtg

SEQ ID NO: 8030851 - DNA, 22 bp, Homo sapiens
tgccctggaaatgagaggtgtg

SEQ ID NO: 8030852 - DNA, 22 bp, Homo sapiens
tgccctggaaatgagaggtgtg

SEQ ID NO: 8030853 - DNA, 22 bp, Homo sapiens
tgccctggaaatgagaggtgtg

SEQ ID NO: 8030854 - DNA, 22 bp, Homo sapiens
tgccctggaaatgagaggtgtg

SEQ ID NO: 8030855 - DNA, 22 bp, Homo sapiens
tgccctgcttctcttgggacag

SEQ ID NO: 8030856 - DNA, 22 bp, Homo sapiens
tgccctgctgtggctctgccca

SEQ ID NO: 8030857 - DNA, 22 bp, Homo sapiens
tgccctgctgtggctctgccca

SEQ ID NO: 8030858 - DNA, 22 bp, Homo sapiens
tgccctgctgtggctctgccca

SEQ ID NO: 8030859 - DNA, 22 bp, Homo sapiens
tgccctgctgtggctctgccca

SEQ ID NO: 8030860 - DNA, 22 bp, Homo sapiens
tgccctgctgtggctctgccca

SEQ ID NO: 8030861 - DNA, 22 bp, Homo sapiens
tgccctggctcttcttgttcca

SEQ ID NO: 8030862 - DNA, 22 bp, Homo sapiens
tgccctggctctccactagttt

SEQ ID NO: 8030863 - DNA, 22 bp, Homo sapiens
tgccctggctctccactagttt

SEQ ID NO: 8030864 - DNA, 22 bp, Homo sapiens
tgccctggctctccactagttt

SEQ ID NO: 8030865 - DNA, 22 bp, Homo sapiens
tgccctggctcctcccacgctg

SEQ ID NO: 8030866 - DNA, 22 bp, Homo sapiens
tgccctggctcctcccacgctg

SEQ ID NO: 8030867 - DNA, 22 bp, Homo sapiens
tgccctggctcctcccacgctg

SEQ ID NO: 8030868 - DNA, 22 bp, Homo sapiens
tgccctggcgctgtctctatgg

SEQ ID NO: 8030869 - DNA, 22 bp, Homo sapiens
tgccctggctcctcccacgctg

SEQ ID NO: 8030870 - DNA, 22 bp, Homo sapiens
tgccctggcacacacacagctg

SEQ ID NO: 8030871 - DNA, 22 bp, Homo sapiens
tgccctggcattgggttggata

SEQ ID NO: 8030872 - DNA, 22 bp, Homo sapiens
tgccctggcattgggttggata

SEQ ID NO: 8030873 - DNA, 22 bp, Homo sapiens
tgccctggatgctgcaggtgtg

SEQ ID NO: 8030874 - DNA, 22 bp, Homo sapiens
tgccctggatgctgcaggtgtg

SEQ ID NO: 8030875 - DNA, 22 bp, Homo sapiens
tgccctggatgctgcaggtgtg

SEQ ID NO: 8030876 - DNA, 22 bp, Homo sapiens
tgccctggatgctgcaggtgtg

SEQ ID NO: 8030877 - DNA, 22 bp, Homo sapiens
tgccctggatgctgcaggtgtg

SEQ ID NO: 8030878 - DNA, 22 bp, Homo sapiens
tgccctggatgctgcaggtgtg

SEQ ID NO: 8030879 - DNA, 22 bp, Homo sapiens
tgccctggcacacacacagctg

SEQ ID NO: 8030880 - DNA, 22 bp, Homo sapiens
tgccctggatgctgcaggtgtg

SEQ ID NO: 8030881 - DNA, 22 bp, Homo sapiens
tgccctggcacacacacagctg

SEQ ID NO: 8030882 - DNA, 22 bp, Homo sapiens
tgccctggcacacacacagctg

SEQ ID NO: 8030883 - DNA, 22 bp, Homo sapiens
tgccctggcacacacacagctg

SEQ ID NO: 8030884 - DNA, 22 bp, Homo sapiens
tgcccctgacctcaggcgaagg

SEQ ID NO: 8030885 - DNA, 22 bp, Homo sapiens
tgccccttctacccgtctctgt

SEQ ID NO: 8030886 - DNA, 22 bp, Homo sapiens
tgccccttcaccttcagtcttg

SEQ ID NO: 8030887 - DNA, 22 bp, Homo sapiens
tgccccttctacccgtctctgt

SEQ ID NO: 8030888 - DNA, 21 bp, Homo sapiens
tgcccctttatgggctcccta

SEQ ID NO: 8030889 - DNA, 22 bp, Homo sapiens
tgcccctctcctgtgatccaag

SEQ ID NO: 8030890 - DNA, 22 bp, Homo sapiens
tgcccctcttgagaagctcagc

SEQ ID NO: 8030891 - DNA, 22 bp, Homo sapiens
tgcccctcttgagaagctcagc

SEQ ID NO: 8030892 - DNA, 22 bp, Homo sapiens
tgcccctcttgctggccctgtc

SEQ ID NO: 8030893 - DNA, 22 bp, Homo sapiens
tgcccctcttgctggccctgtc

SEQ ID NO: 8030894 - DNA, 22 bp, Homo sapiens
tgcccctcttgctggccctgtc

SEQ ID NO: 8030895 - DNA, 22 bp, Homo sapiens
tgcccctcttgctggccctgtc

SEQ ID NO: 8030896 - DNA, 22 bp, Homo sapiens
tgcccctgacctcaggcgaagg

SEQ ID NO: 8030897 - DNA, 22 bp, Homo sapiens
tgccctcaagcaacagagagga

SEQ ID NO: 8030898 - DNA, 22 bp, Homo sapiens
tgcccgttcattcatacttaac

SEQ ID NO: 8030899 - DNA, 22 bp, Homo sapiens
tgcccgtggcctggggcagctt

SEQ ID NO: 8030900 - DNA, 22 bp, Homo sapiens
tgcccgtggcctggggcagctt

SEQ ID NO: 8030901 - DNA, 22 bp, Homo sapiens
tgcccgctgctgctcagtctgt

SEQ ID NO: 8030902 - DNA, 22 bp, Homo sapiens
tgccctgcagaccctgcagtgt

SEQ ID NO: 8030903 - DNA, 22 bp, Homo sapiens
tgccctcagaattgctccctgc

SEQ ID NO: 8030904 - DNA, 22 bp, Homo sapiens
tgccctcagaattgctccctgc

SEQ ID NO: 8030905 - DNA, 22 bp, Homo sapiens
tgccctcagaattgctccctgc

SEQ ID NO: 8030906 - DNA, 22 bp, Homo sapiens
tgccctgcatgcagggagctgt

SEQ ID NO: 8030907 - DNA, 22 bp, Homo sapiens
tgccctgcagtgagtgcgtctg

SEQ ID NO: 8030908 - DNA, 22 bp, Homo sapiens
tgccctgcagaccctgcagtgt

SEQ ID NO: 8030909 - DNA, 22 bp, Homo sapiens
tgccctgcagaccctgcagtgt

SEQ ID NO: 8030910 - DNA, 19 bp, Homo sapiens
tgccctgcccgcagccttg

SEQ ID NO: 8030911 - DNA, 22 bp, Homo sapiens
tgccctgcccatctaccctgtc

SEQ ID NO: 8030912 - DNA, 22 bp, Homo sapiens
tgccctgccaagactgagtggt

SEQ ID NO: 8030913 - DNA, 22 bp, Homo sapiens
tgccctgccaagactgagtggt

SEQ ID NO: 8030914 - DNA, 22 bp, Homo sapiens
tgccctgccaagaccaagtggt

SEQ ID NO: 8030915 - DNA, 22 bp, Homo sapiens
tgccctgcatgcagggagctgt

SEQ ID NO: 8030916 - DNA, 22 bp, Homo sapiens
tgccctgccaagactcagtggt

SEQ ID NO: 8030917 - DNA, 22 bp, Homo sapiens
tgccctgctgtgcctggagcca

SEQ ID NO: 8030918 - DNA, 22 bp, Homo sapiens
tgccctgctgtgcctggagcca

SEQ ID NO: 8030919 - DNA, 22 bp, Homo sapiens
tgccctgctaaccttggttcca

SEQ ID NO: 8030920 - DNA, 22 bp, Homo sapiens
tgccctgctaaccttggttcca

SEQ ID NO: 8030921 - DNA, 22 bp, Homo sapiens
tgccctgctgtgcctggagcca

SEQ ID NO: 8030922 - DNA, 22 bp, Homo sapiens
tgccctgcggctatctagatga

SEQ ID NO: 8030923 - DNA, 22 bp, Homo sapiens
tgccctgcctgagagacagtaa

SEQ ID NO: 8030924 - DNA, 22 bp, Homo sapiens
tgcctcaggcacctggcaggtt

SEQ ID NO: 8030925 - DNA, 22 bp, Homo sapiens
tgcctcaggcacctggcaggtt

SEQ ID NO: 8030926 - DNA, 22 bp, Homo sapiens
tgcctcaggcacctggcaggtt

SEQ ID NO: 8030927 - DNA, 22 bp, Homo sapiens
tgcctcaggcacctggcaggtt

SEQ ID NO: 8030928 - DNA, 22 bp, Homo sapiens
tgcctcaggcacctggcaggtt

SEQ ID NO: 8030929 - DNA, 22 bp, Homo sapiens
tgcctcagctgaggccgctcca

SEQ ID NO: 8030930 - DNA, 22 bp, Homo sapiens
tgcctcagctgaggccgctcca

SEQ ID NO: 8030931 - DNA, 22 bp, Homo sapiens
tgcctcagctgaggccgctcca

SEQ ID NO: 8030932 - DNA, 22 bp, Homo sapiens
tgcctcagctgaggccgctcca

SEQ ID NO: 8030933 - DNA, 22 bp, Homo sapiens
tgcctcagagttgtccctacca
